United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 5

SEQ ID NO: 9594 - DNA, 996 bp, Pseudomonas aeruginosa
ttcggcgtagtcgagggtggcctgcttggtgcggacgaaggcgatcagcgcgtcgaactgctcgacttccagcaggcgctggatcgaaccggccttctggtcggcatggaccatcaggtggacctgctcgatgcgcgccacggtctgggtcttggcggcgatcttgacgtgcttgggctgcttcaggtggcgctcggcgatgccacggatggacgccggcagggtcgccgagaagagcacggtctggcgcgattcgggaagcgcctcgaagatcacttccaggtcgtccatgaagccgagcttgagcatctcgtcggcttcgtcgagcaccaggcgctggacggtggccagcagcttctcgtcgcggcgcaggtggtcgcacaggcggccgggggtagcgacgaggatctgtgcgccctggcgcagggccttcagctgcggccccatgggcgcgccgccgtagacggcgaccacgccgacgcccggcaattgcttggaataggtttcgcaggcggtggcgacctgcagggccagctcgcgggtcggcaccagcaccagcatctgcggctcgcggcggctcgggtcgatgcgcgacagcagcggcagggcgaacgcggcggtcttgccggtaccggtctgcgcctggccgatcatgtcgtggccttcgaggatcagcggaatcgattgagcctggataggcgaaggctcttcgtagcctacggcgacgattgccgcgagcacattggggtgaataccgagcgcggcgaagccgacggtttcctgagtcatgggtttgcctcgtatacatccgcaaagacccatgacccatggctgctcatgccctgtacggccgaaacggccacccaggcagctggggcggggatttgcgagattgcttttgaattagaagattacgtaaaggaaatccgcagagcggatacacagccagagcacagcgctccgaaaaatgcaggtcctgaacggggtcagttttga

SEQ ID NO: 9595 - DNA, 1740 bp, Pseudomonas aeruginosa
cgtttgtgtgcgttttttccgacatgcgtcatcggagagactgacaatggacatcccgattccagacgtctataccgacgttgcccgccccccgccaggaaaccgccgcatgaacgacaccctcccaggacgcatcagccgcgaacggcgcggccacctgctgctgctcggcctcgaccgcgtggccaagcgcaacgccttcgacctgccgatgctcgacgacctggtcgccgcgctcggcgaatacgaggccgacgaccagttgcgctgtgccctgctcttcgcccacggcgagcatttcaccgccgggctggacctggccaatgtcggcgagaccttccgccagggctggaaactccccgaaggcgccgtcgatccctggggcaccttcggcggccggcgtccaagcaagccgctggtggtggccgtgcaaggctactgctacaccatcggcatcgaactgatgctggcggccgacatcaacctctgcgccagcaacgcgcgcttcgcccagctcgaagtgcagcgcggaatcctcccgttcggtggcgcgacactgcgcatgcaccaggtcgccggctggggcaacgccatgcgctggctgctcaccggcgacgaattcgacgcccacgaagcctatcgtctcggcctggtgcaggaagtcaccgccccggaggacctcctcgaccacgccatcgccctcgccgaacgggtcgcggcccaggcgccgctgggcgtgcgcgccaccctcggctcggcgcgccaggccctgctggaaggcgaagcggtcgccgccgctgcgttgccggaagccgccaggcgcctgctcgacagcgaggacgccaaggaaggcctgcgcgctctccaggaacgccgcccgggacgcttcgaaggacgctaggccgggcccttgtccgcgcgccctggctactgggccgggcgcaggctgtcgatatagccctgcaacgaatagccgagttgcggctccagcgccgcggcacgcgtccgcagggcttcctggtcgagttcgagggccaggttcgccggcaccagcatcaccacgttgccctcggccaccggacactcccagtaatgatggtgatagcgcccgcgcagcagcggcgcgcccagcggcttgccatcggtgccgctccactggttgatcaccagccagccatcctcggcgaggcgctcctggcaggcaccgaggaaattccaggccaggtgcgcggccgacgggccggtatcggtatagaggtcgaggaagatcaggtcggcctccgcgcattcgcccaggctctccagtgcgtcgccgatgcgcaatcgcaggcgcgggtcgtcgcgcagccccagatgctcgcgggccaggcgcggaatcgccgggcgcagctcgatggcctcggcctcctccagcggcaggtggcgcaggcaggcctgggtcaggctgccggcgccgaaaccgaggaacaacgcgcgacgcggttgcgaatggcagagcccgccgagcagcatggcgcgggtgtagtcgtattccagccaggctggatcgggcatgaacacgcagctctgctcgacaccgtcgccgaactcaaggaagcgatagtcgccggactcgatgacccggatgaccccgtattcgtcgcgctcctcgaccagcagacgttcttcgctcaccactcacctccccccgccgcttcgccggctatcgccaggcgctccggcaaaagcaccgcagcatag

SEQ ID NO: 9596 - DNA, 1503 bp, Pseudomonas aeruginosa
caaagccggcccgacgatggatttccgctattgcaacgatcgctggcggcgctgcggcgagctgctctaccatgccgcaatccgctttcccgagcattgccaagagtcgtagatgagccagtcctggagccccgagagctggagggccaagccgatccagcaacaacccgagtaccccgatgccgcgcacctggccagggtcgagcagaccctcgccggatacccgccgctggtcttcgccggcgaggctcgcgagctgcgccggcagttcgccgaagtcaccgccggacgcgccttcttgctccagggcggggattgcgcggaaagcttcgccgaattttccgcggcgaagatccgcgataccttcaaggtactgttgcagatggcggtggtaatgaccttcgccgccggctgcccggtagtgaaggtcgggcgcatggccggccagttcgccaagccgcgctcctccggcgacgaaacgcagaacggcgtgaccctgcccgcctatcgcggcgacatcgtcaacggcatcggcttcgacgagaagagccgcgtgccggacccggagcgcctgttgcaggcctaccaccagtccaccgccagcctcaacctgttgcgcgccttcgcccagggcggcttcgccgacctgcaccaggtgcaccgctggaacctcgatttcatcgccaactcggcgctggccgagcgctaccagcaactcgccgaccgcatcgacgagaccctcgccttcatgcgcgcctgcggcctggacagcgcgccgcagctccgcgaaacaagcttcttcaccgcccacgaagcgctcctgctgaactacgaggaagccctgacccgccgcgacagcctgaccggcgagtggtacgactgctcggcgcacatgctctggatcggcgaccgcacccgccagatcgacggcgctcatgtcgagatgctgcgcggcgtgggcaatccgatcggggtcaaggtcgggccgagcatggacagcgaggagctgatccgcctgatcgatattctcaacccggacaacgatccgggccgcctcaacctgatcgtgcggatgggtgccgacaaggtcggcgaccacctgccgcgcctgatccaggccatccagcgcgagggccgccaggtgctgtggagttccgatcctatgcacggcaataccatcaaggcctccagcggctacaagacccgcgacttcgcccgcgtgctcgccgaagtccgccagttcttcgaggtgcaccaggccgaaggcagctacgccggcggcatccacatcgagatgaccgggcagaacgtcaccgagtgcatcggcggttcgcgaccgatcaccgaagacggcctcagcgaccgctaccacacccactgcgacccgcggctgaacgccgaccagtcgctggagctggccttcctgatcgccgaaaccctgaagcaggtgcgccgctgagcgcgccgcggccgctcccgccgcccggcgggagcgctcgctag

SEQ ID NO: 9597 - DNA, 855 bp, Pseudomonas aeruginosa
atgagctaccagcccggcatcgatacggaattgctccgcaccttcgtcgccatcgccgagcacggtggtttcacccgcgccgcggaggcggtgaatcgcacccagtcggcggtcagcatgcagatgaagcggctcgaagaggacgtcctgcagcgctcgctgttcgagcgcgacggaaggcagacccgcctcaccgccgaaggccaggtgctgctcggctatgcccggcggatcctcaagctgcacggcgaggtgttcaacaccctgcgccgcccgcacatggtcggctcggtgcgcatcggcaccccggacgactacgtgatgcgcttcctcccggcgatcctgtcgcgcttcgccgaagcctatccgctggtgcaggtcgaggtgcattgcgacacctcgctcaacctgctggcgcgcaacgacctcgacctgtccatcgtcacccgcgagccgggcaccgagatcggccagttgctgcgccaggagcccttcgtctggatggccgccgagggcttctgcccccacgaccagcggccgatcccgctggccatgttcaacaccacctgcttttgccgggcctgggcctgcaacgccctggaggcggcggaactggactaccgcatcgcctacagcagccccagcctgtcggcgctgttcgcggtggtcagcgccggcctcgccgtgaccgtgcaactgcgcagcctgctcaccggcaacctgcgcatcctcgacgagagcgagggcctgcccgccctgccctcggccagcatcatgctgatgcgcaacccgcacagccagtcaccggtcaccgagaagctcgccgaatacatcggcgagggcttccgtctctga

SEQ ID NO: 9598 - DNA, 849 bp, Pseudomonas aeruginosa
ctcaaccgcgcaccagcaggagcaccgcgcacaatgcgaggaaggcgcagaaggccatgcgcaggctgcgctcgggcaaggcgtgggccagcctcacgccccaggaaatgctcagcaggccgcccagcgccagggggatccccatccgccagtcgacatggccgtgcatggcgtaggtccccagcgccaccgccgtgctcggcgcggccagggccagcgcgaggccctgggcgacgacctgggcgaggccgaacaccgaagtcagcaccggtgtcgccagcaccccgccaccgaccccgaaaagcccgccgagcgagcccgcgccaaggcccagcacgcccatccagggcaaaccgtagcgcggcgtcgcgccgccctgcggcgggcgccggaacaggcgccagaacatgtagccggccagcgccaggaggaagatcacgaacgcttcgcgcatccgcgccgcatcgatccgcgcggccacgctggacgccaggaacgcgcaaagcaggccggtcagggcaaggactccggcctggcgcggatcgatgcggttgcgctggtggtagcgccacaacgccagcaccacgttcggtaccaccatcaccagcgcggtaccctgcgccagttgctggtcgagaccgaagatcacccccagcgccgggatcgccagcaagccgccgcctatcccgaacagaccgcccaggcaaccgagcaccatccccagcaggaaatcgagaaatacatccagcatgtcagcccctctttcgacgcctccatgctaggcaagcgtggctggatgggaaacgcacaagaaagcacaatggctatgccaattacgcaaaggcatga

SEQ ID NO: 9599 - DNA, 1107 bp, Pseudomonas aeruginosa
tcggcagcttcatcgacctgcagggcgaacatctcggcgaggtcgatctggtgttgcgcgccggcccgctacccgacagccgcctggtggccacctcgctggcgccgatggtgcgggtggtctgcgccagcccggaatacctgcgcgaacacggcgttcccgcatccccaggcgaactgccggagcatgccggcatcgattgggacaacctgtcgccaccctatgcctggcgcttccagcacgacggcaagctccagcacctgcggccgaaacgggcgcggctggccaccaataacgccgaagcgatggtcgacgcggcgctggccggcctcggcatcgcccacctgccgacctggttgtgcagcgagtacctgctgcgcggcgaactgcaggcgctgttctgcgacgacggcttgcccgccgccgagcccacctgcatttatgccctgcgcctggaacgcgaagccagttcgcgaacccgtctgctgctggctttcctccgcgagcgcttcggctttccgccgccctgggaccaggccctgcagcagcgtctcggcgagcgctgaggacaccacccggcgggaaacctggaaagccaatagccactacgctaaattcatgcacagtgccctacttacttggaagacagccatgtcccgactgcccaccaccccttgcgagcagctcaagctggacaaccagctgtgcttcgccctgtattccacctcgctgcagatgaccaaggtctacaagcccctgctgcaagcgctcggcctcacctatccgcagtacatcgccatgctggtgctgtgggaacgcgacggcctgaccgtgggcgaaatcagcgcacgcatgcttaccgacccgggatcgctcacgcctctgctcaagcgcctggagggcgaaggtctgattacccgcactcgcagcagcgaagacgagcgggtagtcctgctgcgcctgaccgacaagggccgcgccctgcagcgacaggccgagagcattcccgcctgcatcctggagagtaccggcctcgacttgccacaactggtcgccctaaaggatgagctgctggccctgcgcggcaacctgcaagcaccggattga

SEQ ID NO: 9600 - DNA, 504 bp, Pseudomonas aeruginosa
catgacgataaatttcactttacgcacttacttagcgcgcaagaacttaacgtacaaatcagacaggtgaccctcatgcaaaccatcaaggctctctacaccgcaaccgcaaccgccaccggaggccgtgacggccgtgcggtatcgtcggacggcgtgctcgacgtgaaactcagcactccgcgcgaactgggcggccagggcggcgcggccaccaacccggaacaactgttcgccgccggctactccgcctgcttcatcggagccctgaagttcgttgccggccagcgcaagcagacccttcccgccgacgcctcgataaccggcaaggtcggcatcggccagattcccggcggcttcggcctggaggtcgaactgcacatcaacctgccgggcctggagcgcgaagccgccgaagcgctggtagccgccgcccaccaggtctgcccctactccaacgctacccgcggcaatatcgacgtacgcctgaacgtgtcggtctga

SEQ ID NO: 9601 - DNA, 315 bp, Pseudomonas aeruginosa
ccggctaatttccccggctggggagattgctgttatggaaatgtccaccttaaggggaacacgatgaacaacgttctgaaattctctgctctggctctggctgctgttctggccaccggttgcagcagccactccaaagaaaccgaagctcgtctgaccgctaccgaagacgcagctgctcgtgctcaggctcgcgctgacgaagcctatcgcaaggctgacgaagctctgggcgctgctcagaaagctcagcagactgctgacgaggctaacgagcgtgccctgcgcatgctggaaaaagccagccgcaagtaa

SEQ ID NO: 9602 - DNA, 999 bp, Pseudomonas aeruginosa
aaaaacccgcgtcccttgcgggtacgcgggcctctgcctcgacgctctccgtcagggcgtaagctgggtaggatcgctatccaccgtcgcggtcatcgccggcgccgattcctgggcgatttccaccggcacgccatcctccgaggccaccacttcgcggaccacgtcccagttcaactggatacgcttggccaggtcgtcgcgcttgagcatggtgttgatcaccgcagtgtgcttgtccaccaccgacgggtcgccatggtcgttcagcggcgtatgcgcctccaggtagaccttgccgttgctcacgccgaacttgtagggctcgttgatgatacgcacgctggtgccgacgctgatcatagagaacaggtgggtcacgtcggcgttgtacatgcggaagcagccatggctggtgcgggtgccgatgccgaacttcttgttcgaaccatggatcaggtagcccggcacacccagggtcagcttgtacggtcccagcggattgtccgggcccggcggcaccacggtcggcagcggatcgccatcggcggcgtgctcggcgcggatcgaggccggcggataccaggccgggtccttggtcttggcggtgatgcgggtgttcgcgatcggcgaaccccagccctcgcggccgatgcccagcggataggtgtgcaccacgttctgccctttcgggtagtagtacaggcggtactcggccaggttgatcaccacgccttcgcgcgggccaggcggcagcacgaagcgggtcgggatgatcacctcggtgccgacgcccggcaaccagggatcgacgccggggttggcggcgaccatttcgctgtagcccaggttgtactgctcgccgaggtcggcgaaagtgtcctcgtacttggccttgatcacctggacctggccgacgacgtcctcgcccggaggcgggagctgcagttccagggccgatgcggagccggccgaaagcagcgcggcgaaagacagtga

SEQ ID NO: 9603 - DNA, 693 bp, Pseudomonas aeruginosa
gggtgcgcaaccttagccgaaagcggtatcccggggaagtctcaaagcagcggtttcagcgtcggccagacattttccaggagccttcgggtgggcggcgagcgccggatggatgccatccgcctgcatcatcccctggaccccgccgaccccttcgaggaaaaacggcaccagggcggtcttttcctgcgccgcgaccgcgccgtagaccttggaaaaggcctcgatgtagcgcgggccgtagttcggcggcaactggatacccagcagcagcaccttcgccccttccgcccgggccttttgcgccatgctggcaagattctgttgcaattgcgccggcgccattccgcgcagcccgtcgttgcctcccagctcgatcaccaccagcgccggcttctcctcggcaagcagcgccggcaggcgcgccaggccacccgcggaggtgtcgccgctgatcgaggcgttcaccacccggtagtcgtaaccttcgtcggcgaggcgcttctgcaacagggcgacccagccctggctggtatccagtcccaaagcggcgctgatactatcgcccacgaccaacagcgtctgcgccgcggcctgctgggtcagcaggaccagggccaggcagccgctcaacagcaatgcacgcatcggaacctccatgagcgccagcattctcaacgcgcagaaccttag

SEQ ID NO: 9604 - DNA, 2799 bp, Pseudomonas aeruginosa
gcgagtcggcctcggccaacgcctgggccactatccgcgccagctctccggcggcgagcagcaacgggtcgccattgcccgtgccttcgcggcgcagccggacgtgctgttcgccgacgaacccaccggcaacctcgacagcgccaccggcgagcggatcagcgacctgctcttcgaactcaaccgcgaacgcggtaccaccctggtcctggttacccacgacgagcgtctggcgcatcgctgccggcgcctgatccgtctggaaagcggtcgcctgatcgaccgggtcgaaccctgatgaagccggtgcccctctcccgcctgctgagcctcgccggtcgccaattgttccgcgagtcgcgcagcggcgagctgcgcgtgctgttcttcgccctgctgatcgcggtcgcctcgagcaccgccatcggctatttcagcgcccgcctgaacggcgccatgctcgcccgcgccgccgagttcctcggcgccgacctggtgctcaacggtacccagccggcaagcgccgaacagatcgaacgcggcacccgtctgggcctgcgccacgccgacagcgtcgagttttccagcgtgatcgccaccgaccagggcatccagctcagcagcatcaaggcggtcggcgaccgctaccccctgcgcggccagctcaagagcgctgccgcgccgttcgccgccgagcaggccggcggtcgtccgcaggcgggcgaggtatgggtcgaatcgcgcttgctggtcagcctcgacctgaaggtcggcgacagcatcgagatcggccgcaagccgctgcgcatcgcgcgcatccttacctacgagccggaccgcgccggcgacttgtacagcctgacgccccgcgccatgatgagcctggccgacctcgatgccaccggggtggtccagccgggcagccgggtgcgctaccgcgatctgtgggaaggcccgccggaagccctccaggcctatcgccagcaggtcaagggcagcctcgccgccaaccagcgcctgcaggatgcccgcgacggcaaccgccaggtgggcgatgccctcggccgtgccgagcgctacctgaacctggccagcctggccgcggtgctgctcgccggcgtcgccgtggccctgtccgccgcccgtttcgctgcacggcgctacgacgccagcgcgctgctgcgctgcctcggtctgtcgcgcagcgaaaccctgctcctctacgcgctgcaactgttgctgctgggcctgctcgccagcgccatcggcgccctgctcggctggttggcacagctcggcctgttccgcctgctcgccacgctgctgccgccggacgtaccagccggcggcctgttccccgccttcgccggggtcgccaccggcctggtatcgctggccggcttcgccctcccgccgctggcagccctgggccgggtaccgccgttgcgggtcctgcgcagcgacctgctgccggtgccgatgcgcacctggatggcctacgcctgcgccctgctcgccctgggcctgatcatgtggcggttgagtctcgacctgaagctgaccctcgccctgctcggcggcggcctggtcgccacgctggtgctcggcgccctcctgctgctcggcctgaacggcctgcgccgggcactggcgcgtgccagcctgccatggcggctgggactcggccagttgttgcggcacccgctggccgccgccggacagagcctggccttcggcctgatcctgctggctatggccctgatcgccctgcttcgcggcgaactgctggatacctggcaggcccagttgccgccggacgcccccaaccatttcgccctgaacatcctgccgacggaaaaggacgccttcgaacgtcgcgtgcaaaagctctcccccggcgccgagccgctgttccccatggttcccgggcgcctggtagcggtgaacggcaagccggtccaggcgctcgacgaagacgtgcgcagcgagcgtgccctgcagcgcgacctcggcctgacctggtcagagcgactgccctccggcaaccagctcaccgccggacgctggtggagcgcgccgcagccgggggccctgccgggcgtgtcggtggaagagaagctggccgccaacctgcgtatccaggtcggcgaccggctcaccttcagcgtcgccgggcagaatcgcgaggtccaggtccagagcctgcgcaaggtgaagtgggacaatttccagccgaacttcttcatggtcttccagcccggcaccctgaccgacctgccggtgacctacctgaccagcttctacctgccggccagccaggaacgcgacctgatcgaactggcccgcgccttccccaccgtcaccctgctgccggtagacgccctgctgagccagctgcggagcatcctcgaccaggtcaccctggccgtggagtacgtgctggtgttcgttctcgcggcgggcttcgtggtgctcttcgccggtctccaggcgaccctcgacgagcgcgtgcgccagggtgccctgctgcgcgcgctgggtgccgagcgcgagttgctgcaacgtacccggcgggtcgagttcgccctgctcggcgcagtcagcggcctgctcgcggcgctcggctgcgaggcggtcagcctgctgctctaccgactggtcttcgacctgccgtggcaagcgcatccctggttgctcgcgctgcctctggtgggcgccgtgctggtaggcggcgccggcctgctgggcacccgtcgcgccctcaacagcagcccgctgcgggtcctgcgcgagggctga

SEQ ID NO: 9605 - DNA, 558 bp, Pseudomonas aeruginosa
tcggatacactggcaggctttcatccgttcatttgtggaaccacccgaaccatgagtcgctatcgtccaccgcgcaccgccggcaccccgctgatcactccggagggcgccgcgcggttacgcgcagagctgcatgaactctggcacgtgcgccgtccccaggtgacccaggcggtcagcgaagccgccgccctcggcgatcgctcggaaaacgccgaatacatctacggcaagaagatgctgcgcgagatcgacagtcgcgtgcgcttcctgcgcaagcgcctggagaacctgaaagtggtcggcgagcggccggcggatccgaaccgggtgtacttcggcgcctgggtgaccctggaagacgaagacggcgagcaggcccgctatcgcatcgtcggccccgacgaactggacctgcgcaacaaccagatcagcatcgactcgccgctcgcccgcgcactggtcggcaaggagctggacgccgaggtgctggtgcgcaccccggccggggaaaagctctggttcgtcgtcgagatcgagtatccgccggcgccctga

SEQ ID NO: 9606 - DNA, 1089 bp, Pseudomonas aeruginosa
agaacgccagcctgtaggaccccggccggggcctcggccccggccctttcccggaagccccctcgcgtgaagaaaatcctcctgctgattccactggcgttcgccgccagcctggcctggttcgtctggctggaaccttcccccgcccccgagacggcgcccccggccagcccgcaggcgggcgcagaccgcgccccgccagcagcctccgcgggagaagcggtgccggccccccaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggacggcaagctcagcgccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaataccgggctgagcgaagccgaccgccgcgcggcggtcgaacgcctggccgaggagcgcttcagcgaacaggaacgcttgcgcctgggcgcgctggaacagatgcgccaggccgagcagcgctga

SEQ ID NO: 9607 - DNA, 1614 bp, Pseudomonas aeruginosa
aaaacgcgttatcaatatcgaatttatagattatttttgagccgtcgccgtcttcgcacgcaccccgggctccaggcgaacccgttcgcgttcatatgcaaggtagtacttgttgacgctgctgacataactcaccacacccatgcctatctcttccgcagccacccgctcgacctggaagaaccagcgattcggatcgagcccccggcgacgcgcctgggtgcgcaggttctgtacccgctccggccccatgttgtaggccgccagggtgaacgccaggcgctcgcgttcgtcgaggtgcttgctggagaagaactgcttgcggatcttggtcaggtagcgactggcggccagcacgttgctgtccttgtcgtgcacattgccgaccccgacgctgcgcgccgccgccggggtgatctgcatcagcccgctggcgccgccggaaccgcgcgccttcgggttcagatgcgactccttgtaggccaccgccgccagcgccagccagtccatgctgctctgccgcgcgtagcgctgcagcagtggacggaccgcttccaggcgcttgcggtccgccgcgccgagggggttgcggaccttgtaggcgcgccggtagacgcgctggaaagccacgtcctggtcggccggcgcgcgggtatcggcgaggaagcggtcgatggtcgcgcgcagggtgctggcatcgcggcgcacgtaccaggccatgtcggcgcgattgtccagcaccaggtggcggtcgacgcgcagcttcggcagcaccttggcccagcgttcggcgatgggctgctcgaccacggtgaagccgaggatgcctgcctggaccatttccatcacatcctcgacggccagggaagcgtccagcttttcgatccggatcggtgccatgcggcgttgcgccaggcgctggttgaccagttcgatggcgccctcggcggcgctgccggccggcagcgggatggtccgcccggacaactgctccaggcgcgtgtagcgccggttgcccttgcgcgccaccagcaccagcggcacatcggcgcgcaccggcgcgctcgggctgacctgcaggccgtcgtgcgccggcagcagttcgccgggggcgaccaggtcgccttcgccacgctgcagggcggcaagcaactggtccttgggcttgggtatgagcttgagggtgaggttccgcgcggacggcgaacggctgttgaggtattgctcgaaggcgcgcaggcgacggtactcgacgccgatcggctcgcccttcacctcgcccgagctgttgcggctctggttgaccagcaccttgagcacgccagcgcggcggatgctcgccaggtcgcgggtctccggctgttccctgtgccagttgtccggctggccggtgatgcgcgcagccgccggcaagggtgcgagcaccagcaggcaaagcgaaagcagcaacagacgcgtcatccaggtctccagaggccaggctcgatgtccctctccgggggaccggatcaatcagagcatggcagtcttggcaagttcctctccgacagcggctgcaaacggaggcattgggtagataatccgggcgccgaagaacccgatctgcgattataa

SEQ ID NO: 9608 - DNA, 897 bp, Pseudomonas aeruginosa
cggattgttctacaagcggtttgccacccatctcccggcgggtccggcgcgatcgagggggcgccgcctcgctgcgaattccaggaaggcaccatgcaactcatcgatatcggcgtcaatctgacccacgccagcttcgccccggaacgtgaagcactgctcgcccgcgcgcgcgccgccggggtggtacaaatggtcatcaccggcaccagcctggccgacagcgaacaggcgctgcagctctgcggcgaactcgacgagggcggccggctgtttaccaccgccggcgtccacccccacgaggccagccactggaacgccgacaccgctcgcggcctgcgcgccctgttcgacgacccgcgggtacgcgcggtgggcgaatgcggcctcgacttcaatcgcgacttctctccccgtccggcccaggaaaaggccctcgaggaacaactggcactggccgtcgagctacagcgtccggtgttcctccacgaacgcgacgccagcgagcgcctgctggcgatcctgcgcgacttccgcgatcgcctgccggccgccgtcgtacattgtttcaccggcgagcgccgggcgctgtatggctacctcgacctcgacctgcacatcggcatcaccggctggatcaacgacgagcgccgcggcacccacctgcatgatctggtaggcgagatcccggtcggccgtctcatgctggaaagcgacgcgccctacctgctgccgcgcagcctgcgaccgaagccgaagaacgggcgcaacgagccggcctacctggtcgaggtgctcgactgcgtggcccgccatcgcggcgagagcgcagagcgcctggccgctcacaccagcgccgcggcgcgggcgttcttcggcctgccgacgatcgactga

SEQ ID NO: 9609 - DNA, 1515 bp, Pseudomonas aeruginosa
tggcgccttgccattagcttgccgataagaagaaatccccctatgggcacctggatcagcgacattccactgaaatacaagttctgggccgtcaacgcggtggccttcttcaccaccctgctgctggtgttgttcgccatgcagcaggaagccgccgggcgcaacgcttccgcccagcgcgccgccgccgccgagggcgagctggttcagagctggccagccggcagcgccctgcccgcccgcagcaacctgctgccgctggaacaggccgcgagcctgggcggcacagctgcccaggcgctgggcaaggggcagggttggatcgagttgtccggcgcgcgccagggcgataccccgctgctcggcgcctgggtcggccagaccggctccggccagcgcttcgccgtgctcgccccggccagcgacctgtggcaggtcttcgccgaccgtgccggcgcctacgccgtcgccgtgctggtgctgatgctggcgctgctggcggcctcgcaactgctgatccgcttcatcctcacccacctgcataccctcaaggacgtgatgctgcacgtcgagaagagcggcgacctgtccgctcgcgtaccgctgcagggacgcgacgaagtcggccagatggccagcgccttcaacgccatgcaggccggctaccagcgcatcgtcggcaccgtcgccgcggccgctaccaagctcgacgaaggcgcccaggcgctggcccgcagcatgggccaggtacgccagggcatgctcggccagcagagcgagaccgaccagaccgccaccgcgatcaacgagatgtccaccacggtcttccatatcgcccagcacgccgccgacacccgtgaccagtcgcaggaagccgaccgcctggccggcgccggccagcaggcggtgagccgggtcagcgcgtcgattgccgggttgtcccagggcgtccaggacaccgccgagatgatccagaagctggccgaggacagccagaagatcagcggcgtggtcaacgtgatccacggcatcgccgaacagaccaacctgcttgccctcaacgccgccatcgaggccgcgcgggccggggaaatgggccgcggcttcgcggtggtggccgatgaggtgcgcaacctcgcccgtcgcgtgcaggactccaccgacgagatcacccagatgatcctcgccctgcagtcgggtacccgcgacgccgtggagttcatgcaggaaagctcgctcaaggccgacggttgcgtcagccaggccggcgacgccggcgaggcgctggcggcgatcgccaacgcggtggcgcagatgcgtgaaagcaacacgcagatcgccgtcgccgcggaacagcagagccaggtcgcggaagagatgacccgttcggtggtgggcatccgcgacgtcaccgaactcaccgtgcagcagaccgtcgagtcggcggccaccagtcagcaactggtcgacctggcgggcgatctgacccgcgccatcggccagctacgcctctga

SEQ ID NO: 9610 - DNA, 684 bp, Pseudomonas aeruginosa
gtaagtaacggacatgactgtgccgctgctcgatccgacaaagctgcgccggcaacgccagatcatggggctgttgctcggcctggtgctgctgatggcgctgatcgccggggctgcgctgtggctggcggtgcgccaggcccagcaactggcccagccgaacctgcacaacgagctgtggcagacctactcgctgcgcgccgaactggatcgcacgctggacgccgcgcggcacaccgagagcggcgaaggccaagccgacgacctggcgatccgtctcgaagtcctcgccagcctgatcgcgccgctgcgccgccagtcgttgttcaggcatctcgccgaaccgcgtccggaggtacaggccaccctgcaacgcctgatcgagctcagcgatcgctggtcgaaccaggccccctggggcgatcccgtcgccgcgcgccgcctggccgcggagatcgtccagcaggttccgcccttgctcgaaccgacccaccagatcgtcgtcgccagcaacatcgccctgaccaaccagttggacgtcgaccgcaagcgcctgcaccgggcgttctacgcgttgttctgggcgctgctcgggatcggtgccggcggtgccctgctggtgctgcgcctggtcaccgacttcaaacgcgcacagcaactggccgggcatctgatcgagcttaa

SEQ ID NO: 9611 - DNA, 1749 bp, Pseudomonas aeruginosa
cgccaccctggagaaacgcgtcggcgagcgcacccgccagctcagcgaaggcaaggcgctgctgcatttcatcctcgaggccagcccgagcgacgtggtcctgctcagcgcctgcggcgccagcatccattacgtcagcccacgcctgctcaagcgcctgggttgccaggcccaggacgacttcaacctgccccggctgttcgccagcaccagcgaatacagccgcctgcagaacgccctggaggcgcgcggccaggtggatggctgggaagcccagctatgcggggaaacgccttgctgggcggtgatctgcgcgcgccacctggaaatcgacggcgagccggcgaccctgatctggtgctacgacatcagccggcgcaaggccatggagcaggaactgcgcctgctggccagcaccgataccctgaccggcctgcacaaccgccactcgttcctgcaccaggcggaactcatgctcaaggccgccgaacgcttccgccacccctgcgtggcgctgatgctggacatcgaccacttcaagaacatcaacgacagccacggccacctgaccggcgaccgcgccctgcaacgtgtcgccgagaccctgcgccagggcctgcgcgaggtggacctgctcggtcgcctgggcggcgaggaattcgccgcgctgcttccagaggtcagcctggaccaggcgctggacgtcgccgaacggctgcgcgccggcgtcgaggcgctacgggtgaacaatcccgacggcgaaccgctgcggatgaccgtgagcatcggcgtcgccctgcgcagggacgccggggacgacctggaaagcctgctggtgcgcgccgacagcgcgctctaccaggccaagagcggcgggcgcaaccgcaccgagtacgcgcccgcctgacatgcgcctcagccgaacaccgtgaccatctgccggctgatcgccagcaactggccgtcggcgctccacatccgcgccgccacgtgaccgtagccgtcgcgcgcctcctcgatctccgccaggtaacggcaccagtcgccgctgccctgctgcggcagcggctggaggaactcggcggtccaggtcagcgagctggccatcgccggggtgcccaggtgcggcaacagcgccggcggccaggagtcgagcagcgccagcaggtgggaaacctccatgggctctccctcgggttcgtcgcggaaacgcatccagccgcccatctggcgcgacttgttcgaagagaacggcaggccgcccactgcccagcgcatggcgatgtagcgagtgaactccggggtcacgttacggatatagggcagctcctggctctcttcggggcccttcatcccggccgccggcaacgcttccaccgccaccgccgacgcgcgggcgacgccgaaactggcctggaccagcgtcaccacctgctcgccctgacggacctcgacctgtacctggctcaccgccttgccctcgcgcaacaaccgggcgctgaagctcgccggctgctcgggggccagcggtccgacgaagctgacgccgatggagcgcaacggacgccccgcctcgaccaccgcaagcatggcctcgtaggccaacgccaccaccaggccaccgaaggtggcgcggccctggccccaactggccggtactaccaccgaggaagggtcgcggcggaccgcctggatcaattcggaaaaattcatgtgtgcctcgcgaggggattcgagggcccatcttag

SEQ ID NO: 9612 - DNA, 615 bp, Pseudomonas aeruginosa
ccggactccagcaccggccggcgcaccgccagcgcatcccgcagcccttcggcggcgagcgccggcagcagcacctccaggtcgcggatcggcccgctgagccacccgacctcggcggcggcatgctccagctcctcgacgccggggactccgcggatcggccgcagcaggctgcgcagacggcgcagggcgatgcgcaggtcgtgcagtgcctcgccatccgtgcgcgcctccaggcgggcgaccgccgacatcaacgccacctgctggccgatcacctcggccagcagttcatcgatgaaccccgtcatgcctgctcctctccccggccatcccgcgtgggcgcgcgcaccaggcgccagggcagcgcccggcgcaatgcgcgcagacgcaaccctggatcatcggcaccgccatgtccatagcgttgcgcttcgaacgcgccgacgaaggccgcgatggctggcgcctgcgccggcaggacgcgggcggcgcgctcgccgtaggagcgtagcccttcgccgggggaacggcgcaggccatgcatctccagcaggcgttcgaagcggcgcagttggcggctgcgcagatcgccacggccttgccagggcttga

SEQ ID NO: 9613 - DNA, 1254 bp, Pseudomonas aeruginosa
cccaggcgcgcggatagccggcacgcatgcggaagacctgcacccgccaggccgcgcaaccgagccacatggccgcgatccacagcggcaggtaggccaggtgcggcaggatcaccagtacctgcgccaccagcagccagaccagcgcgacccgcggaatcgcgttcatcgcgccgctccgaacaacgccagcgcacgcaggcaggcctcgcgctgggcctcgccgctggccggttgcaggcgtgtgccgggcagcgccaggccatagggctgctgccgcgcggagagttccaggactgcatggcacaagcggcccaggcgactttcgagatccccgccgaggcgctcgaattccagccacaggtcttccccaccgagcgcggcgaagtccttcaccagcagcccctggccacgggaaaacgccttccaatgcaggcgccgccgcgagtcgcccggctggtaggcgcgcagtccctggtagtcgtcgacgcccgtgcttgccagcgcgcgcccctggtcctcggcatcctccgcgcccggcgcgaggaatggctcgccggccagcggccgagggtagaccagcgcctgctggcgcaggtcgacccagctccaggccaccagcaggccgaggggaaagcgactctccacccgcaggcgccccggccgcagccagccgcgtcgctcggtcgggtggaacagcagcacctcggcagccgcgtcgcctgccaggtcggcgtattccagcggccgctccggccagccgacggcgatggcctggcgcgcccgccgcgggctttccaggcgcacccggaaaccggcgcgctcgccggcgaacaccgggtccgctcccaacgcggtgaggcgcaggccggcaaggttgcgataggtatggaggatggtcaccacgcccagggacagcagcaggaaggtcaacccgtaggccaggctgttctggtagttgatcgccgccagcagcatcaccagcagcgccaggccgaaagcgccgccctggcgggtcggcaggatgaatacgcgacgctggttcagctcgacgctgctcgccggcggtatccgccggttcagccagcgctgccagcgcggccagttgcgcaggcgcatcagagcgccgggacttcgcgcaacagccattgcaccagcgcgccgccaccgtgcccggtggggtccgcctggtcgcgcaggcgatgcccggcgaccgccggcaacaccgcctggacgtcttccggaatcacatag

SEQ ID NO: 9614 - DNA, 867 bp, Pseudomonas aeruginosa
gtgtcggatagcgccagggtcacccgtggctccgagccgccggcgagcagcgcggcgacccggcgcaggcggtcggatgcgccgaggacctcctcgacccgtcccagcagggtgcgtccggcctcggtcagttgcggctggcggccactgcgatcgaagagttccaggccgaggtcgatctccagccgggcaatggcctcgctgacggtcgactggctcttgcccagcttgcgcgcggcggcgctgaaggagccgagggaaacggcctggacgaaggcctcgagggattcgggcgacaaatgcatatcggtttttccgattgtatccaacttaaccctatcccaaagaccgatgacaatacagcccgacttcaacgacgaaccgggagcgttcgccatgacccacacccacaccgccctcgacaagactctcaaggagcggatcttccacgccctggccttcgagggcctggccgtcctcctcaccgcgccggtgctgtcgctggtgatgaacaagcccctggcgcacatgggtgcgctgacgctgatgttctccaccgtggcgatgctctggaacatgcttttcaacagcctcttcgaccgcgcccagcggcgcatgggcttccagcgcaccctgcaggtccgggtgctgcatgcgatgctcttcgagctggggctgatcgtggtgctggtaccgctggccgcctggtggctgtcgatcggactggtcgaggcgttcctcctcgacatgggcctgatcctgttcttcctgccctacaccatggccttcaactggagctacgacgtcctccgcgcacgcctggtggaaagccgccaggccaaggccgccggttgcgacgccggctag

SEQ ID NO: 9615 - DNA, 1443 bp, Pseudomonas aeruginosa
tggcggcggaactgcatggccaggctgcgcaggatgcgctcctcgtcatcgacgaagagaatgcggacgggagatgggctcatgtcaggcgctccgtttcagttcgcgggcctgctctcgcggcaggctgatgaggaagcgggttccgcggcccggttcggaggccacgcggatggtcccgccatgttgctggatgatcttgtagctgatcgacaggccgagcccggtgccctgccccaccggcttggtggtgaagaacgggtcgaagatccggccgaggacctcggcgggcatgcccttgccgttgtcctgcacggagaggaacacctggcgctcgtcggcccagctcttcagcaggatgcggccgaaacgctccatggcctgcgcggcgttggtcagcaggttcagcagcacctggttgatctgcgacggcgcgcaggcgataagcggcagctcgccgagctggctgctgatctcggccttgtccttgatggcggtgcgggcgatcagcacggcgttgcgcacgcagtcgttgaggtcgacctcctcgctgaaggcgcggtccaggcgggcgaagtccttgagcccggaaaccagctcgccgatctggccgaggccgtagcgggtatcgacgaacaattgccgcaggtcctcgcgcaactgttcgacggcggcttcgcggcgcaccgcgtcggccgcctgcagcgcctgcgccaggcgcgcttcgtcgcactgcgggtcgcccaggcagtcgaccagcgccgcctgggcatcggccaggcgcaacaagggatcgctcagctcctccagcagcgccaggttgttgccgacgtagccgagcggcgtgttcagctcgtgtgcgaccccggccaccatctgcccgagcgaagccatcttttccgactgcaccagttgcgcctgggactccttgaggtccaccagcgccttgcgcagcacccggttgcgctgggcgatgcgcgcctccatggccttcagcaggtcgagcacggtgcccaggccacggtagcggccctcttcgtcgaccagggcgaagtcctcggtgatcggatactgcaggcgaccggtgacctgctgcgccgcctcttccaggctggcgccgagggagacgctgaggggcgcccggttcatgacgtcgcgcaccggatggcggccccagaggtcgcggccgaaacgctgcatgaagatgtcctggagggtgtagcggctgaccaggccgaggacccggcgctcgtcgtcgaccaccggcagcgagaggaaggcacggtgctccggcatcagcaggcggtcggcgacgtcgctgatgctcatcgccggagtcaggggttccaccgggcgcaacagacgggacaacgcgctcggagacatcggcaacctctcgctggcaggcccggacggggcaatgaagggatacccgccagttaa

SEQ ID NO: 9616 - DNA, 2064 bp, Pseudomonas aeruginosa
tcgtccaacgctgagtaccccttttccggatcgtcggcggctcggtgccgctcatccgcgcgcccggccgctccgtatttgccgaccggcctcgggattgccccgcaagtgcttgtcggcattcatgaaatgtatgcctgcgaagacgaccgagcaagcgcttgggtaacagccgagaacggatttgtttctgcccccttctcaaccaagcgcttgcttggtaatgtcgccccacacttccgccgtcacgggtcaagaacaatgcaaaagaccgtacgcatcggctgcgcctcggccttctggggcgacacctgcaccgcggccgcccagttggtgcgcggcgcgccgctggactacctggtgttcgactacctggccgagatcaccatgtcgatcatggccggcgcccgcctgaaacagccggacgccggctacgccaccgacttcgtcgaggtcctcgcaccactgctgggcgagatcgccgagaagaagatccgcgtcatcagcaacgctggcgggatcaatccgcaggcctgtgccgccgccctcgccgcggcctgcgagaaggccggggtgcagctgaagatcgccgtgctccatggcgacaacctgcaagcgcgccaggccgaactggccaaggccggcatccgcgagatgttcagcgacgcgcctttcccgccgatgtgcgtctcgctcaacgcctacctcggcgcgccgggcatcgtcgaggccctgcgcctgggcgcggatatcgtgatcaccggccgggtggtcgacagcgcggtggtcagcgccgccctggtgcacgagttcggctgggcctgggacgactacgaccgactggcccaggccgccctcgccgggcacatcgtcgaatgcggcgcgcaatgcaccggcggcaatttcaccgactgggagcaggtgccggactacgagcacatcggtttccccatcgtcgaggtcgaggccgacgggcgcttcgtggtgaccaaggcgcccggcaccggtggcctggtcagcgaactgagcgtcggcgaacagatgctctacgagatcggcgacccacgcgcctacctgctgcccgacgtggtctgcgacttcaccgaggtgcgcctgcgccaggtcggacccgaccgggtcgcggtggaaggcgcgcgcggcctgccgcccaccgaccggtacaaggtcagcgccacctatccggacggtttccgctgcaccgccagttgcctgatcgccggcatcgatgcgctgaagaaggccgagcgggtcagccaggcgatcatcgccaggaccgaggaaatcttcgccgagcgcggctgggagccctaccgcgaggtcaatgtcgaactgctcggcagcgaagccacctatggtccccatgggcgacggcaggacagccgcgaagtggtggtcaagctggccgtccggcatccgcgcaaggaagccctggtgctgttctcccgcgagatcgcccaggccgccaccgggatggcgcccggcctgaccggcatcgtcggcggccggccgacggtgtatccggtgatccgcctgttctctttcctgatcgacaaggcgcaatgcgcgttgagcgtagagatcgacggccagcgccatccgctggaactgccggtcctcgaagccttcgacccggcacgattggccgaggcgcgccagccgccacgcccggtgcagcccgccagcgccagcgtgccgctggtgaagctagcggtggcgcgctccggcgacaaaggcaaccacagcaacatcggggtcatggcgcggcgcccggagtacctgccgtggatcgccgaggcgctggaggaaggcgcggtggtggactggatgcagcatgtgctcgacccgcagaccggccgggtcggccgctggtacctgccaggcagccacagcctgaacttcctgctggagaacgccctcggcggcggcggcgtcgccagcctgcgcatcgacccgcagggcaaggcctttgcccagcagttgctggagttcccggtggcggtgccgcaggcgctcgccgacgcgctggaaacgcaaggcagataa

SEQ ID NO: 9617 - DNA, 948 bp, Pseudomonas aeruginosa
ccacaaccaggaacggcgaatgcggcgttccgctgcccctctacgggattcatcggagtcaccagaacaatgagctacgactcgatcttccgacctggcctgttcgacggccagaccatcatcgtcaccggcggcggcagcggcatcggccgctgcaccgcccacgagctggcggccctcggcgcccacgtggtgctggtcggacgcaaggcggaaaagctggagaagaccgccggcgagatcgtcgaggacggcggcagcgtcagctggcacgcctgcgacatccgcgaggaggaagcggtgaagacgctggtggcgaatatcctggccgaacgcgggaccatccatcacctcgtcaacaacgccggcggccagtatccctcgcccctcgcctcgatcagccagaagggcttcgagaccgtgctccgcaccaacctggtcggcggcttcctggtcgcccgcgaagtgttcaaccagtcgatgagcaagaccggcggcagcatcgtcaacatgctcgccgacatgtggggcggcatgcccggcatgggtcactccggcgccgcacgctcgggcatggagaatttcaccaggaccgccgccgtcgagtggggccatgccggcgtgcgggtcaacgcggtggcgccgggctggatcgcgtccagcggcatggatacctacgaaggcgcgttcaaggcggtgatcccgaccctgcgcgagcacgtgccgctcaagcgcatcggcagcgagtcggaagtcgccgccgccatcgtcttcctgctctcccccggcgccgccttcgtcagcggcaacacgatccgcatcgacggcgccgccagccagggcagccgcgccttcccgctattcaagggcaagccgggacagagccgcgcgtacaacggcttccaccgcgcctacctgcccgacgtactgaaggaccaggaggactga

SEQ ID NO: 9618 - DNA, 2052 bp, Pseudomonas aeruginosa
accgctgtacccggtggaggagctgctcggggtggttccggccgacccgaagaagccctacgacgtccgcgagatcgtcgcgcgcatcgccgacggctccgagttcctcgacttcaagaacgagttcgacggccagaccgtctgcggccacctgcgcatcgagggccacgcctgcggcctgatcggcaacaacggaccgatcaccccgcagggcgcggccaaggcggcgcagttcatccagctctgcgaacagagcaacacgccgctgctgttcctgcacaacaccaccggcttcatggtcggcaccgagtcggagcgccagggcgtgatcaagcacggctcgaagatgatccaggcggtggccaacgcccgcgtgcccaagctgaccctggtggtcggcggctcctacggcgccggcaactacgcgatgtgcggacgcggcctcgacccgcgcttcatcttcgcctggccgaacagtcgcaccgcggtgatgggcggtgcccaggccggcaaggtgctgcgcatcgtcaccgaggagaaacacgccaaggaaggcaaggaagccgatccgaagatgctcgagatgctggaaaccgtcaccgcgcagaagctcgacagccagtccaccgcgctctacggcaccgccagcctgtgggacgacggcctggtcgacccgcgcgacagccgcaggctgctcggctacctgctggatatctgcgcggaagccgaggcgcggccgctgaagggcaacagcttcggggtcgcgaggttctgactgcaacaggcgagccggcgacagcccctctccccgctctccctgaaggaagagggttgggagagagcaagcggatcctgccggaaaacaatgatgcccaggaggaaagacaacccatgatcttcacccaggaacacgaggaactccgccgcaccgttcgcagcttcgtcgagcgggaaatcaaccccaacgtcgaccagtgggaaaaggacggccgcttcccgatccacgagatcttccgcaaggccggcgaactcggcctgctgggcatctccaagccggagaagttcggcggcatgggcctggactacagctactcgatcgtcgccgccgaggaattcggcagcatcacctgcggcggcatcccgatggccatcggcgtgcagaccgacatgtgcaccccggccctggcccgcttcggttccgacgagttgcgcgaggagttcctccgcccggccatcgccggcgagatggtcggctgcatcggcgtctccgaggtcggcgccggctccgacgtcgccggcctgaagaccaccgcgcgcaaggacggcgacgactatgtgatcaacggcagcaagatgtggatcaccaactcgccgtcggccgacttcatgtgcctgctcgccaatacctccgacgacaagccgcacgtcaacaagtcgctgatcgtggtcccgatgaagaccccgggcattaccctcagtccgcacctggacaagctcggcatgcgcagttcggagaccgcccaggtgttcttcgataacgtccgcgtaccgcagcgcaaccgcatcggcgcggaaggcgccggcttcatgatgcagatgctgcagttccaggaagaacggctgttcggcgcggccaacatgatcaagggcctggagcactgcatcgacgtcaccatcgagtattgcaaggagcgcaggaccttcggccagccgctgatcgacaaccaggtcatccactttcgcatggccgagatgatgaccgaggtcgaggcgctgcgcgccctggtctaccaggccaccgagctgtacgtgaaaggcagggacgtgacgcgcctggcttccatggccaagctcaaggccggccgcctcggccgcgaggtcagcgacgcctgcctgcagtactggggcggcatgggcttcatgtgggacaacccggtctcccgcgcctaccgcgacacccgcctggtatccatcggcggcggtgccgacgagatcatgctcggcatcatctgcaagctgatgggcatcctgccgggcaagaagaaaggctga

SEQ ID NO: 9619 - DNA, 552 bp, Pseudomonas aeruginosa
cccaggcccgccgcctggccctcaccgccgcccgcttcgacggccgcgaggcgctgcgcctgggcctggtgcatttctgcgaggccgacgccgatgccctcgaacagcgcctggaggaaaccctcgagcaactgcgccgctgcgcgccgaacgccaacgccgccaccaaggccctgctgctggccagcgaaagcggcgaactcggcgccctgctggacgatgcggcgcgacagttcgccgaagcggtgggcggcgccgaaggcagtgaaggcaccctggccttcgtacagaaacgcaagccggtctgggcccagtgagccacgaccgcgaaacagggcaacagcctccaggagccgaacgacatgcccagcttcaacaagatcctcgtcgccaaccgcggtgaaatcgcctgccgggtgctgcgcaccgcccatgaactgggctaccgcagcgttgccgtgtacagcgaggcggacgccgacgcccgccatgtgcaactggccgacgaggccgtgtgcatcggcccggcagcggtggcgcagtcctacctga

SEQ ID NO: 9620 - DNA, 870 bp, Pseudomonas aeruginosa
ccgcgagaagagcctgtccctgggctgggcgctggagcgcgcggcacgcctgtacccggacaacccggcggtgctcgacggccatcggcggatcagctacgccctgttcaacggctgggccaatcgcctggcgcgcgccttcaaggccgagggcgtaggccacggcagcgtggtcgcggtgatgctggaaaaccgcgtcgagctgctggcgatcctcgccgccctggccaagctcggcgccatcggcgcactggtcaacaccacccagcgcggcaaggtcctggtgcacagcctgaacctggtgaagcccggccacttcgtggtcggcgaagagttgcgcgaggtgttcgaggaagtccgccaggaggtgctcggcaacgccggccattgctactgggtcgacgacggcgacaccctcggcgatcccggctcgccgccgatgggctggcgcaacctgatgcgcctggcccagggacagacctcggagaacctcgaggacaccggcagggtgcggctcaaggactcctgcttctacatctacacctccggcaccaccggcctgccgaaagcctcgatcatgagccacggcaagtggatcaaggcctacggcggcttcggccattccggcctgggcctgggccgcgacgacgtgctctacctgaccctgccctgttaccacaacaacgccgtgaccgtctgctggagcgcggcgctcgccggcggcgcggccatggccctgcgccgcaagttctccgccagcggtttctggaaggacgtgcaacactaccgggcgacctgcttcggctacatcggcgagctctgccgctacctgctgaaccagccaccgtgcgccgaggaacgcggcaatag

SEQ ID NO: 9621 - DNA, 627 bp, Pseudomonas aeruginosa
agcaactggccgttgaggcggaagtcgctgtcgtccttttcctcgaacatcggcggcaacagcggcttgggcttatgggtctcttccgtgccgggcggcgccatcttctgcaccagttccttcggcaggcgcaggtccagcttggcgctcggcagcggcttgcgtacctcggggtcgagacgagcggtggaagcgcgcttcgccggcgccggcttgtccttggcgaccggcctgctggccggcttcggcggcgcagccgcaggcttcggcttggccggcggcttgggttcggcaacctgctccgcggctggcgcgaccttcttcgaagctgttttcggcgcggcaggcacggcaggcgctggctccgctcgtgcaggcttcactggcttggcaggggcgcgctgctcctgcggcggtgcttccggggctttcttttccggtgccttggagccgtcatcgcaggccgccaggaagcaaccgaaaagaacaacgacgcaaattcggcaaagacgtttcatagtcacgcaggtatggccaattgcggcaatgctgacggcagactgcaaccaaggcaaggggtcactatcgtcatcctggcactctctctgttgttcgccccatgtctaa

SEQ ID NO: 9622 - DNA, 510 bp, Pseudomonas aeruginosa
ctggccagcaaggccgggggctccgacatctcgccggacagcggagccggcgccgccggcgcgcgcatggcccgcttcgccgcagcggccccggcgactccgtcgcgcaggggcacatcgctgaacgccacttcggggcgggcctggcgctcggcgtcgtccagcacgttttggctgaccagccccagcaccagcgccacgcccagcaggctggcgaaagccgcctgccaacgcggcctgcgggaggcttccagccagcgccgccaccaggaccgggcgggttcgacatgcgccgcctggcgtcgcgcggcggcgaggatcgcctggtccagcgccggcgccggctgctgcggcgcgtgggcgcggaaatgcgccagcatctgctcttcggcgacgctcgcggaatgcttctgtgggttcataccgccacctcctcggccagcagccggcgcagcttctgcaccgcgtagcggaaacggctcttcaccgtctccagcggcgactgggtga

SEQ ID NO: 9623 - DNA, 1047 bp, Pseudomonas aeruginosa
cagagaaatccggcgccacccggttcgccaggcgaaaaaagccccggaccctttggggtaccggggctccctgcggcagcgcgggactcagcgcggcgcgctgagctggcccttgtcgttggagaagacgatctccacccggcggttctgcgcccgcccccggttggaggcgttgtcggtgaccgggaaggcttcgccgtagccgaccacctgcatgcgcgcgggatccacgccgagatcggcgagcacgtcggccaccgcctgggcgcgctcgcgcgacaggtcgaggttggcctgcctgtcgccgacgctgtcggtatagccttcgatgcggatcacccgccgcggattgagctggaggaactgcaccagcttcagcgcggtgcggttggccgccggcttgagttcggcgcggttgaagtcgaacagcacgtcgccaagggtgagcaccaggccacgctcggtttcctcggtgctgagactggcgatctcctcgctcaggcgctggccctgctcctgcacgctgagcagcttggcttcgcgcagggccagttgcaggcgctcgcgctccagttgcaggcgggtcaggcgctcctggttgaggttgagcaaggcgtgctggcgagcgatctcgctgtagcgctggctcaggtaggcatactggatcacgtcgctgctgctgccccagtagctggacaggcgttcggcgcgggccagcgattcgccggcgcggatcacatccttgggcgccgcgcggagcacgtcggaatcttccttgacctggtcgaactcgctctgcgccttggccagcgactgttcgctgagcttgtggtcggcgcagccagccagcgcggcgcaggccagcagggtggcgaagagagtcgctttgcccggcatcagtcggtctcccccagttgcttgcgcagacgtttcaggctcttgtccagctcgccgagctggtccttgctcttctgcgtcagcaccttggactcggcgaggcgtgcgtccagctcggcctgctcggccaacaggcgcgccttcttgtag

SEQ ID NO: 9624 - DNA, 540 bp, Pseudomonas aeruginosa
acgggaacgcggcgtccttgttcacccagaccaccccgctggtcatcaggaacggcggatgcacatagtccatgctgccgagccgtgccagggtcaggtaagccccggcgagcaggtcggcgcgaccgctggtcacctcttcctgggccttctcccaggagccgctgtagagcacgtcgatgcgcacgccgagctccttgcccaggcgctgcaacaggtcggcattggctccgatcaggcgcttcggatcctgcgggtcgcgccacaggtagggggggtactccgggttgccggtggccaccaggcgctcgcaggagccggccgccgcggccagccccggaacgaacagcgccgccagcaggatgccggccaggcggcacggggaacagcgaaaggacatggattcaggctccgcggtacagggatgcgcgcagcagtctgccacatttccgcgcgcgctcccgccccgctattccgatgggtaccagcgcggcgtgtagacccaggcttcgccgtcggcgcgcgggaagctgcgggtag

SEQ ID NO: 9625 - DNA, 414 bp, Pseudomonas aeruginosa
ggttgtcggacagcgacagcacgcagaaatcgtggcccagaggcgcccccgccctggccgcggtggccagggccgccgagacgccagggaagatccgcagctcgaccgcgtcccaggccggctcgccagcgccatgcagggcttccagcaccgcggcggccatggcgaacacgccggggtcgccggacgataccagcaccaccgccctgcccgtcgccgccagttcgaaggcatgccgggcgcgctgcaattcctcgcggttgtcgctgccatgcagcacctgtccggcgcggaagggtccggccatgtcgacgtaggtctggtaaccgaggatgtcctcggcctcgtccagtgcccgccgcgccgcaggcaccatcagctcggcgcagccgggccccaggccgatcactgtga

SEQ ID NO: 9626 - DNA, 513 bp, Pseudomonas aeruginosa
gtcggccgcgacgctggccgatgcggtccatcgccaagggcgcggcggccaccgccagccggtcgccgacctgctcggcggcgggcaaggcctggcgcaggcgcgcagcgggatcggcctgcggcaggaagcgcagcggtacgccgagcgcatcggcggcggcctgcaggcgcggatcggccatccgcgcgctgtcggccagcaagccgccgagcgccgccgcggccaggccggcatcgaccagcgcctggcgcaccgcgtccgccgccgcgtcggcaggttcgagcgccgccagcacgcagcgcggatggatcagcagttcctcggcccgcggcgcacgcgccgagggcgtcacgtgaatcgccagcgctgcctccgggtcgcgcggcaaacgggccgcgtcgagccagtcggcggcaccctcgacgcgcaccggctggccaccgagcaaatcggcaacgaagcgcttgccctgctccaggtcggccaggacataaccggcgggcgggttga

SEQ ID NO: 9627 - DNA, 600 bp, Pseudomonas aeruginosa
cggctgtccgcctggagccgcagcaacagccgagcggccagcgggcgcacgtccagcgacaggtgcggatcgagcccggcggccgggctgagcataaggttgcgcacgtcgtcggcgccggccagggacccatgccggggaccgaggccggcgtccagcaggcggcggacaagccgctcttcctcgccgcgacggacgccgcgcaattgcaggttggaacggttggtcgcctcgatcacgccgctggcgcaatcccgcgccgcggccgccacggcgcgtgcctgggcggcgtccaggcggccggcgtcgagcttgatgcggcagatgccgccgtccagcgcctggacgatacgcagcaggccgggacagggcgacggacgtggtacgggcaggggcgccggggtctggtcgtcgttcaaaaacgctactcgaatcggcgtcgcggcgaccgcaccgctgtcccccagggacagaccacggcatcggtacaccccgcccgatgttggcactcgcgactggtttcggcggcaggtctcctggctcgcagcccggcgttccacccgggggaggaacctccgcttcgcgccgccttcccggtaa

SEQ ID NO: 9628 - DNA, 462 bp, Pseudomonas aeruginosa
ccctggtgggcatcggcgaggacggttatcccggcctcggcaagcaggcccggcgtgccctgctgcaagccagccggatcgtcggcgcggcgcgccagctggaactgctgccgccgtgcatcggcgccgcccgcgaaacctggccgacgccgttctccctggaaccattgctggcccggcgcggccagccgacctgcgtgctggccagcggcgacccgatgctgttcggcgtcggcgccagtctcgcccggcaactgccggcgaccgaactgcgggtcctgccggcgccctcctccctctcgctggccgccgcccgcctcggctgggccctgcaggaggtcgcctgcctgtcgctggtggcgcgcccgctggcggcgctgcaggcacaggtccacgacggccggcgcctgctggtcctcagcaacgacggcgacagcccggccgccatcgcccgcctgttga

SEQ ID NO: 9629 - DNA, 462 bp, Pseudomonas aeruginosa
gattcccgtttggtgaagagcgggtggaggtcgccacccaggcgttgctgccagtcgagcagcacccgttcgctctgcagggtgaccgcgttggcgaacaggcggccgccgggccgcaggcgctcccagcaggtttccagcacgccctcggcggtgactccgccgccgatgaaaatggcgtccggctcgggcagttccagcagcgcctccggggcgctgccggcgaccaggtgcagggtcggtacgccgagggcgtcgcggttgtggcggatatgttcctggcgctcgtcgttggcttcgatggcgatcgcccggcaactggggtgcgcgcgcatccattcgatgccgatggagccgcaaccggcgccgacgtcccagagcagctcgccggggcagggcgccaggcgcgccagggtcacggcgcggacgtcgcgcttggtcaactggccgtcgtggcgatag

SEQ ID NO: 9630 - DNA, 630 bp, Pseudomonas aeruginosa
gcttcgtcggccaggcccggggtcagcggcaggcgcacggcgccggcgccggcgcggcattccaccgccaccaggttgagatcggcggcgcgcggcagcgaccagtcgccggcgaggccgtcgagacggcgctcgagcggcccgccgaggtgttccagcacgctcaggcgactggcgccgaagccacgggcgttcaacaggcgggcgatggcggccgggctgtcgccgtcgttgctgaggaccagcaggcgccggccgtcgtggacctgtgcctgcagcgccgccagcgggcgcgccaccagcgacaggcaggcgacctcctgcagggcccagccgaggcgggcggcggccagcgagagggaggagggcgccggcaggacccgcagttcggtcgccggcagttgccgggcgagactggcgccgacgccgaacagcatcgggtcgccgctggccagcacgcaggtcggctggccgcgccgggccagcaatggttccagggagaacggcgtcggccaggtttcgcgggcggcgccgatgcacggcggcagcagttccagctggcgcgccgcgccgacgatccggctggcttgcagcagggcacgccgggcctgcttgccgaggccgggataa

SEQ ID NO: 9631 - DNA, 621 bp, Pseudomonas aeruginosa
ctacatccgcgatggccaggcgatctatcgccagtcgttcgccaccatccgcgccgaagcgaacctcgccggcatcccggccgacctggaaaagctcgcggtcagggtgatccacgcctgcggcatggtcgacgtggtcgacgacctgcgcttctcgcccggcgccggcgccgccggccgcgccgcgctggccgccggcgcggcgatcctctgcgacgcgcggatggtcgccgaaggcgtgacccgctcgcggctgcccgccgccaaccgggtgatctgcaccctcaacgaagcggacgtgccggcgctcgccacggaactcggcaatacccgctcggcggtgggcccctggagcactggcgcgagcacctggagggcagcgtggtggtgatcggcaacgcgccgaccgcgctgttctacctgctggaaatgctcgacgccggcgcgccgaaaccggcgctgatcctgggcttcccggtcggcttcgtcggcgccgcggaatccaaggagatgctcgccgccgatagccgcggggtgccttacgtgatcgtccgcggtcgccgtggcggcagcgccatggccgccgcggcggtgaacgccctggccacggagcgcgaatga

SEQ ID NO: 9632 - DNA, 1719 bp, Pseudomonas aeruginosa
tcgtcgtccccggcgacaagtggcagggaggggccggcggtgagtgacgcccagcaggttccggccatcgtcatcctcggccagggcgcgctggataccgcgcggcgggtccaggcgcgctatcccggggcgctggtccacgggctcgccgggcgggtggaggccgaccgttcctatacggacttcggcgacaccctgcgcgaactgtattgcgccgaccgcccaatcgtcgccctgtgcgccgccggcatcgtcattcgcagcctggcgccgttgttgcaacgcaagggagcggagccgccggtgctggccctggccgaggacggtagcgcggtggtgccgctgctcggcgggctggccggggtcaaccggctggcgcgggaaatcggcgaggtgctggccgtggcgccggcgatcaccaccagcggcgagctgcgcttcggcacctgcgtgctcaacccgcccgccggttatgtcctggccgacctggagcagggcaagcgcttcgttgccgatttgctcggtggccagccggtgcgcgtcgagggtgccgccgactggctcgacgcggcccgtttgccgcgcgacccggaggcagcgctggcgattcacgtgacgccctcggcgcgtgcgccgcgggccgaggaactgctgatccatccgcgctgcgtgctggcggcgctcgaacctgccgacgcggcggcggacgcggtgcgccaggcgctggtcgatgccggcctggccgcggcggcgctcggcggcttgctggccgacagcgcgcggatggccgatccgcgcctgcaggccgccgccgatgcgctcggcgtaccgctgcgcttcctgccgcaggccgatcccgctgcgcgcctgcgccaggccttgcccgccgccgagcaggtcggcgaccggctggcggtggccgccgcgcccttggcgatggaccgcatcggccagcgtcgcggccgactcacagtgatcggcctggggcccggctgcgccgagctgatggtgcctgcggcgcggcgggcactggacgaggccgaggacatcctcggttaccagacctacgtcgacatggccggacccttccgcgccggacaggtgctgcatggcagcgacaaccgcgaggaattgcagcgcgcccggcatgccttcgaactggcggcgacgggcagggcggtggtgctggtatcgtccggcgaccccggcgtgttcgccatggccgccgcggtgctggaagccctgcatggcgctggcgagccggcctgggacgcggtcgagctgcggatcttccctggcgtctcggcggccctggccaccgcggccagggcgggggcgcctctgggccacgatttctgcgtgctgtcgctgtccgacaacctcaagccctgggaggtgatcgagcggcgcctggacctggccggcgccgccgacctggcgatggctttctacaatccgatctcgcgggcgcggccctggcaactgggacgggcgctggagatcgtcgcccgccatcgttcgccgcagaccctggtggtgctcggtcgcgacatcgggcggcccggtgagcgcctgctgcgcaccaccctgggcgagctgcgtgcggagcaggtggacatgcgcaccctggtgatcatcggctcgtccactacccgcagcttcccgcgcgccgacggcgaagcctgggtctacacgccgcgctggtacccatcggaatag

SEQ ID NO: 9633 - DNA, 918 bp, Pseudomonas aeruginosa
cggggcgggagcgcgcgcggaaatgtggcagactgctgcgcgcatccctgtaccgcggagcctgaatccatgtcctttcgctgttccccgtgccgcctggccggcatcctgctggcggcgctgttcgttccggggctggccgcggcggccggctcctgcgagcgcctggtggccaccggcaacccggagtaccccccctacctgtggcgcgacccgcaggatccgaagcgcctgatcggagccaatgccgacctgttgcagcgcctgggcaaggagctcggcgtgcgcatcgacgtgctctacagcggctcctgggagaaggcccaggaagaggtgaccagcggtcgcgccgacctgctcgccggggcttacctgaccctggcacggctcggcagcatggactatgtgcatccgccgttcctgatgaccagcggggtggtctgggtgaacaaggacgccgcgttcccgttcatcggccgcgacgacctgatcgggcacaagggcagcgtgctggccggcagcagcctgggcgaggagttcgaccgcttcgccaaggccagtctcgacctgaagccggtgccgagcctgacccagggcttgcaggacctgatgctcaagcgcagcgagttcctcctctaccaggcgttgcccgggcaggcccaggtcgaggcgctgggcatggccgacgacctggaggcgctggaaccggtgctgagcagcgaggggctgtacctgacgctgtcgcacaactccgcctgcaacgatccgtggctgcgcggacaactggcgaaaaagatgacagaattgtcggctgccggcgttcccgtaacgctcttgcaggacaatctcgaacgctggaaagcccagcaattgccggcttccggcgccagttcgactacgcaggaaagtgacttgtga

SEQ ID NO: 9634 - DNA, 477 bp, Pseudomonas aeruginosa
actggctccacgaactcgcctgaccgggttcgaaacatctcgaccgccagttgcggaacaatcctcgccagcccccgggagccatcccgccgcagccgaggaatccgcatgatccgccagccccgctttgcccgtttcgtcctgccgttgttgctgagcctgtgccagccgtccttcgccgccgaactccgcgcggttgccgaagcacgccgccaggaactcctgctggaggactcgccggtggcgtgcggcgaggcgggctgcacggcgcgggaaagcctcagcctggtggcgttgcaggtgcaggcccgggttctggtcacccgcctcggccgcgatgatttttccccggccgcccgccagcccgccgccgtcccggactaccgcctgttcggcgatctcggcctggcgccaagccccttcgcctggcaagcgttgaccggcgagagcgcggcggcggacgcgttgcgtttctga

SEQ ID NO: 9635 - DNA, 846 bp, Pseudomonas aeruginosa
cccgaatccaccgacagcttcgtctcagcgggtatctccgctgcacgacgaggtcgtctcgatgtttttcccggcttccatccggaccggcactttcgccgaactgtccgacgctggaaaatgtctaccgatagccgctccggccgcgcttctggcgacggcccgggcgtttcgtggcgacgccgatgcgtgccgcgaaggatgtggccgatgagcctgctctcggtcgcctttgacacaggacaggagtcgaccagcggcatgcatgcctccaccagcgccacgacggccgccggcagcgacgaaacgctgctggcgcgttaccgcaagggcgacagcgcggccttcgaggtgctctaccagcgccatcggcaaggtctctaccgttttctctgcggcctggccggacagaccgaactggccgacgagatctaccaggaaacctggctcagcctgatccgcagcgagagccagccgcagggccgggcgagcttccgcacctggctctaccagatcgcccgcaaccgcttgatcgatcattggcgcaagcatggccagcgccagccgttgcaggacagctacgacgaacagttgcacgcgcaacccgaccagggcgccggccccgagcagcagctcagcctgagccgcgacggcgagcgcttgcagagcgcgctggagaccctgcccgaggaacagcgcgaggtattcctgatgcgcgcccacggcgaactggaactggccgagatcgccacgctcacccagtcgccgctggagacggtgaagagccgtttccgctacgcggtgcagaagctgcgccggctgctggccgaggaggtggcggtatga

SEQ ID NO: 9636 - DNA, 2346 bp, Pseudomonas aeruginosa
agcctgcacgagcggagccagcgcctgccgtgcctgccgcgccgaaaacagcttcgaagaaggtcgcgccagccgcggagcaggttgccgaacccaagccgccggccaagccgaagcctgcggctgcgccgccgaagccggccagcaggccggtcgccaaggacaagccggcgccggcgaagcgcgcttccaccgctcgtctcgaccccgaggtacgcaagccgctgccgagcgccaagctggacctgcgcctgccgaaggaactggtgcagaagatggcgccgcccggcacggaagagacccataagcccaagccgctgttgccgccgatgttcgaggaaaaggacgacagcgacttccgcctcaacggccagttgctctatcgcgaccgcgaactgggcgtgtcgcggcccctggaaggggccgagttgcagttcgagttccgccagtaggccgccacggtgctcagaagcggtagcgctgctcctgcaacgcctggtacagctccgcgtccagcggctggtagccggcgctgccgggcaacctgacgaagagtttgtcgctgacccgcgcgggatcgtaggcgtcgcgcttgaggtcggtcttcttgtacttgaaggtgccggtggtctcgacttcgcgcagcaggcgcaggaacaccggtgtggcataggccggcaactcgcggtcgaggtgcgcggcgagagcgtcgcggtccagttcgacgccatcggccaggcgcagcgcggccatcccgcagcggccgttggtgccgggaatctccacgccgtagaccaccgcatcctcgaccccgtcgaaggcgccgagggcgttttccacctcggtggtggaaacgttctcgcccttccagcggaaggtgtcgccgagacggtcgacgaactgggtgtgcttgaaaccgatgtcgcgcatcaggtcgccggtgttgaaccaggcgtcgcccttcttgaacacgtcgcggaggatcaccgcttcgctcttggccggatcggtgtagccgtcgaacggccacttcgcactgatctcgctgatcagcaggccgacctcgcccttgccgaccttctccatgaagcccttggcgtcgcgcaccggatggtcgttctccaggtcgtagcggacgatggcgtaggtggctggggagaagcccaccgtattgtcgaaattgaatacattggtgaagccgatgttgccttcgctggaagcgtagaactcggtgatccgctggatctcgaagcgttgcttgaactcggcccagatcgacgggcgcaggccgttgccgatcatgcaggtcaggctattgccgcgttcctcggcgcacggtggctggttcagcaggtagcggcagagctcgccgatgtagccgaagcaggtcgcccggtagtgttgcacgtccttccagaaaccgctggcggagaacttgcggcgcagggccatggccgcgccgccggcgagcgccgcgctccagcagacggtcacggcgttgttgtggtaacagggcagggtcaggtagagcacgtcgtcgcggcccaggcccaggccggaatggccgaagccgccgtaggccttgatccacttgccgtggctcatgatcgaggctttcggcaggccggtggtgccggaggtgtagatgtagaagcaggagtccttgagccgcaccctgccggtgtcctcgaggttctccgaggtctgtccctgggccaggcgcatcaggttgcgccagcccatcggcggcgagccgggatcgccgagggtgtcgccgtcgtcgacccagtagcaatggccggcgttgccgagcacctcctggcggacttcctcgaacacctcgcgcaactcttcgccgaccacgaagtggccgggcttcaccaggttcaggctgtgcaccaggaccttgccgcgctgggtggtgttgaccagtgcgccgatggcgccgagcttggccagggcggcgaggatcgccagcagctcgacgcggttttccagcatcaccgcgaccacgctgccgtggcctacgccctcggccttgaaggcgcgcgccaggcgattggcccagccgttgaacagggcgtagctgatccgccgatggccgtcgagcaccgccgggttgtccgggtacaggcgtgccgcgcgctccagcgcccagcccagggacaggctcttctcgcggttacggatcgcggtgtagtacaggccgcgcagcatgcgcggcacgcggccgaaggtggcaggcaggcgggcaacgaaacggttgaaagtgatcaggtcggcgtgggtcatggctctcgcgctagtcgttgttgtgcggggcgtaggacgctcccgcgactctag

SEQ ID NO: 9637 - DNA, 1026 bp, Pseudomonas aeruginosa
ggcagggcggcctggctgcagaccagcaccgcgcgggtgttgatctggtacatcaggtcgaagcgcttgggctccagcttctccaccccgaccaggcggatcgccccggcgttgttgaccagcgcgtcgatcccgccgaagcgttcggcggcgcgggccatggccgccgccacggcctgctcgtcgcgcacgtcgagttgcagcggcagggcctggccgccggcggcctcgacctcggcggcgacgctgaagatggtgccttccagcttcggatgcggctcggcgctcttcgccgcgatcaccaggttggcgccatcgcgcgcggcgcgcagggctatctcccggccgatgccgcggctggcgccggtgatgaacagggtcttgccgtgcagtgacatgggcgtctccgttttcttgtcgttgtcgttgcggatgagcggcggggtgtctcaggcgtcggcttccacctcgaccagcacctgccggttgcgcacctgctcgccacggccgacctggacgcggcggaccacgccgtcgactccggccttcagcgggtgttccatcttcattgcctccagcaccagcagcagttggcccttgccgacccgttcgccctcgccgaccagcacctcgacgatggcgccgtccatcggcgccttgagcgtgccggaactggcgccgacctgggcgctggcgccggcgtgggtgacctctaccagttcgaggttgccgccgtggccgtatacccagaggcgcccgccgtccacgtggtacgcgtggcggcggcgaatgccgtcgagttcggcgctggcccagcgtccgtcgcagtcgagcaggcgcacggcgatctcgcgtcgctccaggcgcgccagcagtcgcggccggcgaccgctttcgaggacgtccaggccgatctccacgcgctgttcggcgtgcttcaggacgatcttccacggtgccccggcggcgctgcgccagccggccaggccgggctggtgcgcactggcctcggcgccggcctggtag

SEQ ID NO: 9638 - DNA, 672 bp, Pseudomonas aeruginosa
cccagttcatgggcggtgcgcagcacccggcaggcgatttcaccgcggttggcgacgaggatcttgttgaagctgggcatgtcgttcggctcctggaggctgttgccctgtttcgcggtcgtggctcactgggcccagaccggcttgcgtttctgtacgaaggccagggtgccttcactgccttcggcgccgcccaccgcttcggcgaactgtcgcgccgcatcgtccagcagggcgccgagttcgccgctttcgctggccagcagcagggccttggtggcggcgttggcgttcggcgcgcagcggcgcagttgctcgagggtttcctccaggcgctgttcgagggcatcggcgtcggcctcgcagaaatgcaccaggcccaggcgcagcgcctcgcggccgtcgaagcgggcggcggtgagggccaggcggcgggcctgggtcaggccgatgcggcggaccacgaaaggcgcgatctgcgccgggagaatgccgaggctggtttccggcaggccgaactgcgcatcggcggcggcgatcgctacgtccgacacgcaggccaggccgaaaccgccgccgagcaccgcgccttccaccagcgccaccagcagttgcggggcggcctgggcttcctccagcaggctgccgaaggcgcggttcagcgtgcggtag

SEQ ID NO: 9639 - DNA, 1827 bp, Pseudomonas aeruginosa
agatcatgggttgtctttcctcctgggcatcattgttttccggcaggatccgcttgctctctcccaaccctcttccttcagggagagcggggagaggggctgtcgccggctcgcctgttgcagtcagaacctcgcgaccccgaagctgttgcccttcagcggccgcgcctcggcttccgcgcagatatccagcaggtagccgagcagcctgcggctgtcgcgcgggtcgaccaggccgtcgtcccacaggctggcggtgccgtagagcgcggtggactggctgtcgagcttctgcgcggtgacggtttccagcatctcgagcatcttcggatcggcttccttgccttccttggcgtgtttctcctcggtgacgatgcgcagcaccttgccggcctgggcaccgcccatcaccgcggtgcgactgttcggccaggcgaagatgaagcgcgggtcgaggccgcgtccgcacatcgcgtagttgccggcgccgtaggagccgccgaccaccagggtcagcttgggcacgcgggcgttggccaccgcctggatcatcttcgagccgtgcttgatcacgccctggcgctccgactcggtgccgaccatgaagccggtggtgttgtgcaggaacagcagcggcgtgttgctctgttcgcagagctggatgaactgcgccgccttggccgcgccctgcggggtgatcggtccgttgttgccgatcaggccgcaggcgtggccctcgatgcgcaggtggccgcagacggtctggccgtcgaactcgttcttgaagtcgaggaactcggagccgtcggcgatgcgcgcgacgatctcgcggacgtcgtagggcttcttcgggtcggccggaaccaccccgagcagctcctccaccgggtacagcggttcacgccaggaacgcgccgggcgcgccggcagttgtgcgttccacggcaacatgccgacgatctcgcgggccaggcgcacgccgtcggcgtcgttttccgccaggtattccgcggtgccggcgacctgcgcgtgcagttcggctccgccgagctcctcgtcgctggcgatctcgccggtggcggccttgagcaacggcggcccggcgaggaacatcttggccttgccgcgcaccaccaccacgtagtccgacagccccggctggtaggcaccgccggcggtgctggaaccatgcaccacggtgacctggggaatgcccatggcggagatccgcgcctggttggcgaagccgcgcgcaccttcgacgaagatctccgccgcgtagttgaggttggcgccaccgctttcggtgagggtcaccaccggcagcttgttctccatggcgatctgctgcaggcgcagggtcttcttcagcccggtcggggagatggtgccgcccttgatcgcgctgttgctggcactgaccaggcagcgcaccccggcgatgtagccgatcccggcgatgatcccgccgccggcctgggtgccgtccttgtcgtcgtgcagcttgtagccggccagcgaggacagttcgaggaacggcgcgcccgggtcgagcagcagcgccaggcgttcgcgcggcagcagctggccgcgtttctcgaacttcggcctggcctcggcggccttgtccaggaccttctgctccaactcgcggaagccggccacggcggcgagcatggcctcgcggttgcgggcgaagtcctcgccgttgacgtcgagttccgactggatcgcgggcatgtcagtcctcctggtccttcagtacgtcgggcaggtaggcgcggtggaagccgttgtacgcgcggctctgtcccggcttgcccttga

SEQ ID NO: 9640 - DNA, 402 bp, Pseudomonas aeruginosa
tctcggccaggtagtcgaacaccaggtagtccagcggcgcgccgcgcaccaactgggcggccgcggtgcaggtgtcgccccagaaggccgaggcgcagccgatgcgtacggtcttttgcattgttcttgacccgtgacggcggaagtgtggggcgacattaccaagcaagcgcttggttgagaagggggcagaaacaaatccgttctcggctgttacccaagcgcttgctcggtcgtcttcgcaggcatacatttcatgaatgccgacaagcacttgcggggcaatcccgaggccggtcggcaaatacggagcggccgggcgcgcggatgagcggcaccgagccgccgacgatccggaaaaggggtactcagcgttggacgatcagaaagcccgggaagtga

SEQ ID NO: 9641 - DNA, 1395 bp, Pseudomonas aeruginosa
tgcctgtcacatgttggcaatctgacattgcttaactggcgggtatcccttcattgccccgtccgggcctgccagcgagaggttgccgatgtctccgagcgcgttgtcccgtctgttgcgcccggtggaacccctgactccggcgatgagcatcagcgacgtcgccgaccgcctgctgatgccggagcaccgtgccttcctctcgctgccggtggtcgacgacgagcgccgggtcctcggcctggtcagccgctacaccctccaggacatcttcatgcagcgtttcggccgcgacctctggggccgccatccggtgcgcgacgtcatgaaccgggcgcccctcagcgtctccctcggcgccagcctggaagaggcggcgcagcaggtcaccggtcgcctgcagtatccgatcaccgaggacttcgccctggtcgacgaagagggccgctaccgtggcctgggcaccgtgctcgacctgctgaaggccatggaggcgcgcatcgcccagcgcaaccgggtgctgcgcaaggcgctggtggacctcaaggagtcccaggcgcaactggtgcagtcggaaaagatggcttcgctcgggcagatggtggccggggtcgcacacgagctgaacacgccgctcggctacgtcggcaacaacctggcgctgctggaggagctgagcgatcccttgttgcgcctggccgatgcccaggcggcgctggtcgactgcctgggcgacccgcagtgcgacgaagcgcgcctggcgcaggcgctgcaggcggccgacgcggtgcgccgcgaagccgccgtcgaacagttgcgcgaggacctgcggcaattgttcgtcgatacccgctacggcctcggccagatcggcgagctggtttccgggctcaaggacttcgcccgcctggaccgcgccttcagcgaggaggtcgacctcaacgactgcgtgcgcaacgccgtgctgatcgcccgcaccgccatcaaggacaaggccgagatcagcagccagctcggcgagctgccgcttatcgcctgcgcgccgtcgcagatcaaccaggtgctgctgaacctgctgaccaacgccgcgcaggccatggagcgtttcggccgcatcctgctgaagagctgggccgacgagcgccaggtgttcctctccgtgcaggacaacggcaagggcatgcccgccgaggtcctcggccggatcttcgacccgttcttcaccaccaagccggtggggcagggcaccgggctcggcctgtcgatcagctacaagatcatccagcaacatggcgggaccatccgcgtggcctccgaaccgggccgcggaacccgcttcctcatcagcctgccgcgagagcaggcccgcgaactgaaacggagcgcctgacatga

SEQ ID NO: 9642 - DNA, 933 bp, Pseudomonas aeruginosa
  unsure (717): Identity of nucleotide at the above locations are unknown.
actgtccagccatcccgaatagagagaaggggcctgcccatggatcgtctggacagcatgcgcgtgttcctgcgcgttgccgaaaccggcagcttcaccaaggccgcggacctgctggacatgccgcgggcgacggtctcggcggcggtccagcagctcgaagcgcaactcggcagccggctgctgcatcgcaccacccggcaggtccagctgacccacgacggcagcgtggtgctggagcgttgccgccacctgctggaagacatggaggagctggagagcctgttccacgacggcagccgcgccagcggccggctcaaggtcgacgtgccgagccgggtggcgcgactgctgatcgccccggcgctgccggaattcttccgccagcatccggacatcgaactggaactgggttccagcgaccgttcggtggacctggtgcaggagggcgtcgactgcgtcctgcgggtcggccagttgggcaacagcagcctggtggcgcgacgcctcggcgagatgcaactgatcaattgcgccagtcccgcctacctggaagagcatggcgagccacggacgccagccgacctcgaccggcactgggcggtcaagtatgcctcgcccagcagcggccgggtgttgccctgggagtatcgcgaggatgggcgcaccctgacccgcgcgttgcgcagccgggtcacggtgaacaatgcggaaagntacatcgcctgctgcctgtccggactgggcctgatccagatccctgcctacgacgtgcgcgagcacctccaacgcggcgagctgcgcgaggtgctgccgcagtggcgggccgaagcgatgccggcgtacgccctgtatccgcaccggcggcatctgtcgcggcgggtcagggcattcgtcgactggctggagcaactgctccgcgcccgcctttag

SEQ ID NO: 9643 - DNA, 795 bp, Pseudomonas aeruginosa
tccacgacgttcatctccccggcgcgttccgggctacggcaaacggccggattctgcgacaatgcgcgccgttttcgattcgccgcgagagagcccatgtccgcctgccagtcccccatcatcgtcgccctggatttccccacccgtgaggccgccctggcgctggccgatcagctggacccgaaactgtgccgggtgaaggtcggcaaggaactcttcaccagttgtgccgcgggtatagtcgagaccttgcgtggcaagggcttcgaggtgttcctcgacctgaaattccacgacatcccgaacaccacggcgatggcggtgaaggccgccgccgagatgggcgtgtggatggtcaacgtgcactgctccggcggcctgcgcatgatggccgcctgccgcgagacgctggaggccttcagcgggcccaggccgttgctcatcggcgtgaccgtgctgaccagcatggagcgcgaggacctggcgggcatcggcctcgacatcgagccccaggagcaggtgttgcgcctcgccgccctggcgcagaaggccggcatggacggcctggtctgctcggcccaggaagcgccggcgctgaaggccgcccatccgggcctgcaactggtcacgccgggcatccgcccggccggcagcgcccaggacgaccagcggcgcatcctcaccccgcgccaggccctggacgccggctccgattacctggtgatcggccggccgatcagccaggccgccgacccggccaaggcgctggcggcgatcgtcgccgaactgggctga

SEQ ID NO: 9644 - DNA, 297 bp, Pseudomonas aeruginosa
tgcgcctgtcgctgggttaccccgggcgcgcggcggaacgctcgctgttgctcggcgaagcccggcgcgatctgctgccgcgcctggaacccttgctcgaccacgcggcgctggccgctttccaggccgaagtgccgaaggtccgcgccagcgatgcgctggtggactacgtgctgcgcctggtcgaagcgacccgcacgcagccggccttcgccctcggcctgtcgccgcgcggtagcctggcgttgctcgccgcggcgcgtgcctgggcgctgctggcgggacgcgactatgtga

SEQ ID NO: 9645 - DNA, 3084 bp, Pseudomonas aeruginosa
ttccggaagacgtccaggcggtgttgccggcggtcgccgggcatcgcctgcgcgaccaggcggaccccaccgggcacggtggcggcgcgctggtgcaatggctgttgcgcgaagtcccggcgctctgatgcgcctgcgcaactggccgcgctggcagcgctggctgaaccggcggataccgccggcgagcagcgtcgagctgaaccagcgtcgcgtattcatcctgccgacccgccagggcggcgctttcggcctggcgctgctggtgatgctgctggcggcgatcaactaccagaacagcctggcctacgggttgaccttcctgctgctgtccctgggcgtggtgaccatcctccatacctatcgcaaccttgccggcctgcgcctcaccgcgttgggagcggacccggtgttcgccggcgagcgcgccggtttccgggtgcgcctggaaagcccgcggcgggcgcgccaggccatcgccgtcggctggccggagcggccgctggaatacgccgacctggcaggcgacgcggctgccgaggtgctgctgttccacccgaccgagcgacgcggctggctgcggccggggcgcctgcgggtggagagtcgctttcccctcggcctgctggtggcctggagctgggtcgacctgcgccagcaggcgctggtctaccctcggccgctggccggcgagccattcctcgcgccgggcgcggaggatgccgaggaccaggggcgcgcgctggcaagcacgggcgtcgacgactaccagggactgcgcgcctaccagccgggcgactcgcggcggcgcctgcattggaaggcgttttcccgtggccaggggctgctggtgaaggacttcgccgcgctcggtggggaagacctgtggctggaattcgagcgcctcggcggggatctcgaaagtcgcctgggccgcttgtgccatgcagtcctggaactctccgcgcggcagcagccctatggcctggcgctgcccggcacacgcctgcaaccggccagcggcgaggcccagcgcgaggcctgcctgcgtgcgctggcgttgttcggagcggcgcgatgaacgcgattccgcgggtcgcgctggtctggctgctggtggcgcaggtactggtgatcctgccgcacctggcctacctgccgctgtggatcgcggccatgtggctcggttgcgcggcctggcgggtgcaggtcttccgcatgcgtgccggctatccgcgcgcctgggtcaagctggccctggcgctgctcgccggggccggggtctggttgtcgcgcggcagcctggtgggcctggacgcgggggcggtgctgctgatcgccgcgttcatcctcaagctggtggaaatgaagacccgccgcgatgcgctggtactggtgttcctcggtttcttcgcagtggtggtgggctacctgttcgacgacggtttcctcgccgcgctgtacagcctgctgccggtgaccgcgttgctggcggcgctgatcggattgcagcagagcgctttcgccagccggccctggccgaccctgcggctggccggcgggctgttgctgcaggcgctgccgctgatgctcctgctgttcctgttcttcccccgcctggggccgctgtggtcgttgccgatgcccggcaacaagggggtcaccggactctcggagagcatggcgccaggggatatcgccgagcttgggcgctccgccgaactggcgttccgggtccgcttcgagggcgcaccgccgccgcgcgagcagctctactggcgcgccttgaccatggagcgtttcgacggacgacgttgggctcaggcgccgcaatggtcgggcgaggatgctatgcactggcagaagcgtggccccgagctgcgctacgacgtgatcatgcagcccagttcgcagccctggctgttcgccctcgacgtggcgcagaccgaccagaccgacacgcgcctgatgagcgatttccacctgcagcggcggcagccggtcgagcaacgtctgttctaccgagccagttcctggccacaggcgctgcgcgagtccagcatcgatccgcgcatgcgctggcgcaacctgcagttgccgatgcacggcaatccgcgcgcgcgcgccctggccgagcaactgcgccaggcccatgcgcaaccgcaggcactggtcgcggccctgttgcagcgcttcaaccgcgagcccttcgcctacaccctgaaaccgccagcgaccggtgccgacggggtggacgatttcctgttcgacacgcgcagcggcttctgcgcgcattacgccggggcgatggctttcgtcctgcgcgccgcgggcattcctgcgcgagtggtggccggctaccagggcggcgagctgaatccggcgggcaactacctgctggtgcatcagttcgacgcccacgcctgggtcgaatactggcagccggagcagggctggctgagcgtcgacccgacctaccaggtggcgcccgaacggatcgaacaggggctggagcaggccctggccggggacagcgagtacctcgccgacgcaccgctgtcgccgttgcgctaccgtggcctgccctggctcaacgacatgcgtctggcctgggacagcctgaactatggctggcaacgctgggtcctggcctaccagggtgagcagcagggcgccttcctgcagcgctggttcggcgggctcgatccgacccgactgggcctgttgctcggtgccgcggcgatattgtcggtcggtctgctcgcgctgttcctgctcaagccctggcaaggccgtggcgatctgcgcagccgccaactgcgccgcttcgaacgcctgctggagatgcatggcctgcgccgttcccccggcgaagggctacgctcctacggcgagcgcgccgcccgcgtcctgccggcgcaggcgccagccatcgcggccttcgtcggcgcgttcgaagcgcaacgctatggacatggcggtgccgatgatccagggttgcgtctgcgcgcattgcgccgggcgctgccctggcgcctggtgcgcgcgcccacgcgggatggccggggagaggagcaggcatga

SEQ ID NO: 9646 - DNA, 1197 bp, Pseudomonas aeruginosa
tgtcggcggtcgcccgcctggaggcgcgcacggatggcgaggcactgcacgacctgcgcatcgccctgcgccgtctgcgcagcctgctgcggccgatccgcggagtccccggcgtcgaggagctggagcatgccgccgccgaggtcgggtggctcagcgggccgatccgcgacctggaggtgctgctgccggcgctcgccgccgaagggctgcgggatgcgctggcggtgcgccggccggtgctggagtccggctacgtggcggttctcgccagccagccgctgcaccgcctgcagctttgcctggacgtctggccggccctgttgcgtacggcccagcggcatgccgtgttggatggcatgcacggccgggtgcgcaagcgcctgcgccggcaatggaagaccctgcgcgccgagctggcggacaccacctacgagcactggcacccgctacggctgcggatcaagcgcgtgcgctacgggctggaggcctatccgcacgattgcagcattcccggctcgctgctggcgccgctcaaggcggcccagtcggcgctgggcgattggcacgacctcgaacagtggctgttgcgatgccagcgcgagccggacctggcgcccgtgcgcgaggtctggacggcacgcttcgaactggcccgggagcgtgccggacgggccctgtcgacattgcagcaggcacttgccgggcactgaggccgccggtattccgatcggctttttcccaaggatcgcctcgcctaagatgggccctcgaatcccctcgcgaggcacacatgaatttttccgaattgatccaggcggtccgccgcgacccttcctcggtggtagtaccggccagttggggccagggccgcgccaccttcggtggcctggtggtggcgttggcctacgaggccatgcttgcggtggtcgaggcggggcgtccgttgcgctccatcggcgtcagcttcgtcggaccgctggcccccgagcagccggcgagcttcagcgcccggttgttgcgcgagggcaaggcggtgagccaggtacaggtcgaggtccgtcagggcgagcaggtggtgacgctggtccaggccagtttcggcgtcgcccgcgcgtcggcggtggcggtggaagcgttgccggcggccgggatgaagggccccgaagagagccaggagctgccctatatccgtaa

SEQ ID NO: 9647 - DNA, 459 bp, Pseudomonas aeruginosa
cgcctcgacgccggcgcgcagccgttcggcgacgtccagcgcctggtccaggctgacctctggaagcagcgcggcgaattcctcgccgcccaggcgaccgagcaggtccacctcgcgcaggccctggcgcagggtctcggcgacacgttgcagggcgcggtcgccggtcaggtggccgtggctgtcgttgatgttcttgaagtggtcgatgtccagcatcagcgccacgcaggggtggcggaagcgttcggcggccttgagcatgagttccgcctggtgcaggaacgagtggcggttgtgcaggccggtcagggtatcggtgctggccagcaggcgcagttcctgctccatggccttgcgccggctgatgtcgtagcaccagatcagggtcgccggctcgccgtcgatttccaggtggcgcgcgcagatcaccgcccagcaaggcgtttccccgcatag

SEQ ID NO: 9648 - DNA, 1428 bp, Pseudomonas aeruginosa
ctgggcttcccagccatccacctggccgcgcgcctccagggcgttctgcaggcggctgtattcgctggtgctggcgaacagccggggcaggttgaagtcgtcctgggcctggcaacccaggcgcttgagcaggcgtgggctgacgtaatggatgctggcgccgcaggcgctgagcaggaccacgtcgctcgggctggcctcgaggatgaaatgcagcagcgccttgccttcgctgagctggcgggtgcgctcgccgacgcgtttctccagggtggcgttaagctcgatcagatgcccggccagttgctgtgcgcgtttgaagtcggtgaccaggcgcagcaccagcagggcaccgccggcaccgatcccgagcagcgcccagaacaacgcgtagaacgcccggtgcaggcgcttgcggtcgacgtccaactggttggtcagggcgatgttgctggcgacgacgatctggtgggtcggttcgagcaagggcggaacctgctggacgatctccgcggccaggcggcgcgcggcgacgggatcgccccagggggcctggttcgaccagcgatcgctgagctcgatcaggcgttgcagggtggcctgtacctccggacgcggttcggcgagatgcctgaacaacgactggcggcgcagcggcgcgatcaggctggcgaggacttcgagacggatcgccaggtcgtcggcttggccttcgccgctctcggtgtgccgcgcggcgtccagcgtgcgatccagttcggcgcgcagcgagtaggtctgccacagctcgttgtgcaggttcggctgggccagttgctgggcctggcgcaccgccagccacagcgcagccccggcgatcagcgccatcagcagcaccaggccgagcaacagccccatgatctggcgttgccggcgcagctttgtcggatcgagcagcggcacagtcatgtccgttacttactcaagagtgatggagctgacctgccagacggtacggttgtagtagacctggtttctcaactcaggatagcgggccatcgggtagatgatgaaaagcggtccgcgttcgcggatcgccatgtaggcgccgttgcggcgataggcgaggatgggctggtagctgtcgaggtcgctgtacgggatgatcgccgagtagtcgttcagcgccagcacgcgcaggcgcgtgggcggcgccaggtccaggtggcgcagcaacaggctgaggcgcacgccttgccagcgggcgttggcctcgccggggagctgggcttccagggtctcgctgggcagggcttcgaggtcggacagggtcagccgtacgggagcgtcgccggaccgctgcagggtgacgatcggacgtccgcccagcggcacgggctccgcggcctgggcaagaggcagccccaggcaacagagaaagacgattaa

SEQ ID NO: 9649 - DNA, 414 bp, Pseudomonas aeruginosa
agcggatcagcagttgcgaggccgccagcagcgccagcatcagcaccagcacggcgacggcgtaggcgccggcacggtcggcgaagacctgccacaggtcgctggccggggcgagcacggcgaagcgctggccggagccggtctggccgacccaggcgccgagcagcggggtatcgccctggcgcgcgccggacaactcgatccaaccctgccccttgcccagcgcctgggcagctgtgccgcccaggctcgcggcctgttccagcggcagcaggttgctgcgggcgggcagggcgctgccggctggccagctctgaaccagctcgccctcggcggcggcggcgcgctgggcggaagcgttgcgcccggcggcttcctgctgcatggcgaacaacaccagcagcagggtggtga

SEQ ID NO: 9650 - DNA, 1623 bp, Pseudomonas aeruginosa
gttgcatggtgccttcctggaattcgcagcgaggcggcgccccctcgatcgcgccggacccgccgggagatgggtggcaaaccgcttgtagaacaatccgttataatcgcagatcgggttcttcggcgcccggattatctacccaatgcctccgtttgcagccgctgtcggagaggaacttgccaagactgccatgctctgattgatccggtcccccggagagggacatcgagcctggcctctggagacctggatgacgcgtctgttgctgctttcgctttgcctgctggtgctcgcacccttgccggcggctgcgcgcatcaccggccagccggacaactggcacagggaacagccggagacccgcgacctggcgagcatccgccgcgctggcgtgctcaaggtgctggtcaaccagagccgcaacagctcgggcgaggtgaagggcgagccgatcggcgtcgagtaccgtcgcctgcgcgccttcgagcaatacctcaacagccgttcgccgtccgcgcggaacctcaccctcaagctcatacccaagcccaaggaccagttgcttgccgccctgcagcgtggcgaaggcgacctggtcgcccccggcgaactgctgccggcgcacgacggcctgcaggtcagcccgagcgcgccggtgcgcgccgatgtgccgctggtgctggtggcgcgcaagggcaaccggcgctacacgcgcctggagcagttgtccgggcggaccatcccgctgccggccggcagcgccgccgagggcgccatcgaactggtcaaccagcgcctggcgcaacgccgcatggcaccgatccggatcgaaaagctggacgcttccctggccgtcgaggatgtgatggaaatggtccaggcaggcatcctcggcttcaccgtggtcgagcagcccatcgccgaacgctgggccaaggtgctgccgaagctgcgcgtcgaccgccacctggtgctggacaatcgcgccgacatggcctggtacgtgcgccgcgatgccagcaccctgcgcgcgaccatcgaccgcttcctcgccgatacccgcgcgccggccgaccaggacgtggctttccagcgcgtctaccggcgcgcctacaaggtccgcaaccccctcggcgcggcggaccgcaagcgcctggaagcggtccgtccactgctgcagcgctacgcgcggcagagcagcatggactggctggcgctggcggcggtggcctacaaggagtcgcatctgaacccgaaggcgcgcggttccggcggcgccagcgggctgatgcagatcaccccggcggcggcgcgcagcgtcggggtcggcaatgtgcacgacaaggacagcaacgtgctggccgccagtcgctacctgaccaagatccgcaagcagttcttctccagcaagcacctcgacgaacgcgagcgcctggcgttcaccctggcggcctacaacatggggccggagcgggtacagaacctgcgcacccaggcgcgtcgccgggggctcgatccgaatcgctggttcttccaggtcgagcgggtggctgcggaagagataggcatgggtgtggtgagttatgtcagcagcgtcaacaagtactaccttgcatatga

SEQ ID NO: 9651 - DNA, 444 bp, Pseudomonas aeruginosa
ggacgcaccatgaatccactgatcaagaccatcctgtcgaccaacgccggtgccggcctggccatcctgcgtatcgtcaccggtcttaccctgatgtcccacggttcgcaaaagctcttcggcatgttcggcggcgccggcctgaacggcatggcgcagtggttcgaatccatcggcctgacccctggctacctgctggcgaccctggccggcagcgccgagttcttcggcggcctggcgctggtgatcggcctgctggtgcgtccggcgtcggtggtggtgggcttcaccatgatcgtggcgatcttcagcgtgcacatcggcaatggcttcttcatcaccgacaacggctatgaatatgccctgacccttctgatgatcagcgtggcgctgctgatcgatggcgccggcaagttctcgctggacggcaagctgtcccgctga

SEQ ID NO: 9652 - DNA, 540 bp, Pseudomonas aeruginosa
tcaggcccagggcgagcagggcgcaggcgtaggccatccaggtgcgcatcggcaccggcagcaggtcgctgcgcaggacccgcaacggcggtacccggcccagggctgccagcggcgggagggcgaagccggccagcgataccaggccggtggcgaccccggcgaaggcggggaacaggccgccggctggtacgtccggcggcagcagcgtggcgagcaggcggaacaggccgagctgtgccaaccagccgagcagggcgccgatggcgctggcgagcaggcccagcagcaacagttgcagcgcgtagaggagcagggtttcgctgcgcgacagaccgaggcagcgcagcagcgcgctggcgtcgtagcgccgtgcagcgaaacgggcggcggacagggccacggcgacgccggcgagcagcaccgcggccaggctggccaggttcaggtagcgctcggcacggccgagggcatcgcccacctggcggttgccgtcgcgggcatcctgcaggcgctggttggcggcgaggctgcccttga

SEQ ID NO: 9653 - DNA, 918 bp, Pseudomonas aeruginosa
aatagccgatggcggtgctcgaggcgaccgcgatcagcagggcgaagaacagcacgcgcagctcgccgctgcgcgactcgcggaacaattggcgaccggcgaggctcagcaggcgggagaggggcaccggcttcatcagggttcgacccggtcgatcaggcgaccgctttccagacggatcaggcgccggcagcgatgcgccagacgctcgtcgtgggtaaccaggaccagggtggtaccgcgttcgcggttgagttcgaagagcaggtcgctgatccgctcgccggtggcgctgtcgaggttgccggtgggttcgtcggcgaacagcacgtccggctgcgccgcgaaggcacgggcaatggcgacccgttgctgctcgccgccggagagctggcgcggatagtggcccaggcgttggccgaggccgactcgctcaagcagttctctggcgcgctggcgagcgtcggcgcggccttccagttccaggggcagcatcacgttctccagcgcatcgaggctgtcgagcaactggaacgactggaacacgaagcctacatgggccgcgcggacgcgcgcccgctggtcctcgtcgaggtcgccgagggcgtgcccggcgagacggacctcgccgccgctgggctggtcgagcccggcgagcaggccgagcagggtcgacttgccggagccggagctgccgacgatcgccaggctgtcgccgcgggcgaggtcgagggagaggtcgtggaggatggtcaacttgccttccgcgctaccgacaaccttgctaaggttctgcgcgttgagaatgctggcgctcatggaggttccgatgcgtgcattgctgttgagcggctgcctggccctggtcctgctgacccagcaggccgcggcgcagacgctgttggtcgtgggcgatag

SEQ ID NO: 9654 - DNA, 504 bp, Pseudomonas aeruginosa
tatcagcgccgctttgggactggataccagccagggctgggtcgccctgttgcagaagcgcctcgccgacgaaggttacgactaccgggtggtgaacgcctcgatcagcggcgacacctccgcgggtggcctggcgcgcctgccggcgctgcttgccgaggagaagccggcgctggtggtgatcgagctgggaggcaacgacgggctgcgcggaatggcgccggcgcaattgcaacagaatcttgccagcatggcgcaaaaggcccgggcggaaggggcgaaggtgctgctgctgggtatccagttgccgccgaactacggcccgcgctacatcgaggccttttccaaggtctacggcgcggtcgcggcgcaggaaaagaccgccctggtgccgtttttcctcgaaggggtcggcggggtccaggggatgatgcaggcggatggcatccatccggcgctcgccgcccacccgaaggctcctggaaaatgtctggccgacgctga

SEQ ID NO: 9655 - DNA, 1011 bp, Pseudomonas aeruginosa
aacctggcggggtgttacactgtctttcctactccttcatcgcactcgccaaggattctccggaatgttgtcgcgcgtacccgttgtctcactgtctttcgccgcgctgctttcggccggctccgcatcggccctggaactgcagctcccgcctccgggcgaggacgtcgtcggccaggtccaggtgatcaaggccaagtacgaggacactttcgccgacctcggcgagcagtacaacctgggctacagcgaaatggtcgccgccaaccccggcgtcgatccctggttgccgggcgtcggcaccgaggtgatcatcccgacccgcttcgtgctgccgcctggcccgcgcgaaggcgtggtgatcaacctggccgagtaccgcctgtactactacccgaaagggcagaacgtggtgcacacctatccgctgggcatcggccgcgagggctggggttcgccgatcgcgaacacccgcatcaccgccaagaccaaggacccggcctggtatccgccggcctcgatccgcgccgagcacgccgccgatggcgatccgctgccgaccgtggtgccgccgggcccggacaatccgctgggaccgtacaagctgaccctgggtgtgccgggctacctgatccatggttcgaacaagaagttcggcatcggcacccgcaccagccatggctgcttccgcatgtacaacgccgacgtgacccacctgttctctatgatcagcgtcggcaccagcgtgcgtatcatcaacgagccctacaagttcggcgtgagcaacggcaaggtctacctggaggcgcatacgccgctgaacgaccatggcgacccgtcggtggtggacaagcacactgcggtgatcaacaccatgctcaagcgcgacgacctggccaagcgtatccagttgaactgggacgtggtccgcgaagtggtggcctcggaggatggcgtgccggtggaaatcgcccaggaatcggcgccggcgatgaccgcgacggtggatag

SEQ ID NO: 9656 - DNA, 600 bp, Pseudomonas aeruginosa
cgctgccgtcgtcaagatgaagctgaagaacctgctgaccggcgccggtaccgagaccgtgttcaaggccgacgacaagctggagccgatcatcctcgatcgcaaggaagtgacctactcctacttcgccgacccgctgtacgtcttcatggacagcgagttcaaccagtacgagatcgagaaagacgatctggaaggcgtgctgaccttcatcgaagacggcatgaccgacatctgcgaagccgtgttctacaacgacaaggtgatctcggtagagctgccgaccaccatcgttcgccagatcgcctacaccgagccggccgtccgcggcgacacctcgggcaaggtgatgaagaccgcgcgcctgaacaacggcgccgagctgcaggtttccgcgttctgcgaaatcggcgactcgatcgagatcgatacccgcaccggcgagtacaagtcccgcgtcaaggcctgatcctttcgtgcgacgagaaaaagcccggcattcgccgggctttttcgtttccgctgtccgccgccgcggcgcggagagtcggaagcttcagaccgacacgttcaggcgtacgtcgatattgccgcgggtag

SEQ ID NO: 9657 - DNA, 777 bp, Pseudomonas aeruginosa
catggaggcgtcgaaagaggggctgacatgctggatgtatttctcgatttcctgctggggatggtgctcggttgcctgggcggtctgttcgggataggcggcggcttgctggcgatcccggcgctgggggtgatcttcggtctcgaccagcaactggcgcagggtaccgcgctggtgatggtggtaccgaacgtggtgctggcgttgtggcgctaccaccagcgcaaccgcatcgatccgcgccaggccggagtccttgccctgaccggcctgctttgcgcgttcctggcgtccagcgtggccgcgcggatcgatgcggcgcggatgcgcgaagcgttcgtgatcttcctcctggcgctggccggctacatgttctggcgcctgttccggcgcccgccgcagggcggcgcgacgccgcgctacggtttgccctggatgggcgtgctgggccttggcgcgggctcgctcggcgggcttttcggggtcggtggcggggtgctggcgacaccggtgctgacttcggtgttcggcctcgcccaggtcgtcgcccagggcctcgcgctggccctggccgcgccgagcacggcggtggcgctggggacctacgccatgcacggccatgtcgactggcggatggggatccccctggcgctgggcggcctgctgagcatttcctggggcgtgaggctggcccacgccttgcccgagcgcagcctgcgcatggccttctgcgccttcctcgcattgtgcgcggtgctcctgctggtgcgcggttga

SEQ ID NO: 9658 - DNA, 1902 bp, Pseudomonas aeruginosa
gcgccagtgccttgctctcgcccttcgactcgttggtctgggagcgggcgcgggccgagcgcctgttcgatttccgctatcgcctggagatctacacgccgaaggaaaaacgcgtgtacggctactacgtgctgccattcctgtacaacggccgtctggtcggccgcgtcgacctccgcgccgagcgggcgcgcgagcgcctggcggtacatgcgttgcatgccgaggcgaacggcatggacgatgccgccctgcacgagctggccgagcaactgcgcagcatggccgcctggctgggcctggcgacggtggcgatcgaggggcgcggggagttggcggtacgcttgcgcggggtgctgctctagcgagcgctcccgccgggcggcgggagcggccgcggcgcgctcagcggcgcacctgcttcagggtttcggcgatcaggaaggccagctccagcgactggtcggcgttcagccgcgggtcgcagtgggtgtggtagcggtcgctgaggccgtcttcggtgatcggtcgcgaaccgccgatgcactcggtgacgttctgcccggtcatctcgatgtggatgccgccggcgtagctgccttcggcctggtgcacctcgaagaactggcggacttcggcgagcacgcgggcgaagtcgcgggtcttgtagccgctggaggccttgatggtattgccgtgcataggatcggaactccacagcacctggcggccctcgcgctggatggcctggatcaggcgcggcaggtggtcgccgaccttgtcggcacccatccgcacgatcaggttgaggcggcccggatcgttgtccgggttgagaatatcgatcaggcggatcagctcctcgctgtccatgctcggcccgaccttgaccccgatcggattgcccacgccgcgcagcatctcgacatgagcgccgtcgatctggcgggtgcggtcgccgatccagagcatgtgcgccgagcagtcgtaccactcgccggtcaggctgtcgcggcgggtcagggcttcctcgtagttcagcaggagcgcttcgtgggcggtgaagaagcttgtttcgcggagctgcggcgcgctgtccaggccgcaggcgcgcatgaaggcgagggtctcgtcgatgcggtcggcgagttgctggtagcgctcggccagcgccgagttggcgatgaaatcgaggttccagcggtgcacctggtgcaggtcggcgaagccgccctgggcgaaggcgcgcaacaggttgaggctggcggtggactggtggtaggcctgcaacaggcgctccgggtccggcacgcggctcttctcgtcgaagccgatgccgttgacgatgtcgccgcgataggcgggcagggtcacgccgttctgcgtttcgtcgccggaggagcgcggcttggcgaactggccggccatgcgcccgaccttcactaccgggcagccggcggcgaaggtcattaccaccgccatctgcaacagtaccttgaaggtatcgcggatcttcgccgcggaaaattcggcgaagctttccgcgcaatccccgccctggagcaagaaggcgcgtccggcggtgacttcggcgaactgccggcgcagctcgcgagcctcgccggcgaagaccagcggcgggtatccggcgagggtctgctcgaccctggccaggtgcgcggcatcggggtactcgggttgttgctggatcggcttggccctccagctctcggggctccaggactggctcatctacgactcttggcaatgctcgggaaagcggattgcggcatggtagagcagctcgccgcagcgccgccagcgatcgttgcaatagcggaaatccatcgtcgggccggctttgctatgctgcggtgcttttgccggagcgcctggcgatag

SEQ ID NO: 9659 - DNA, 1560 bp, Pseudomonas aeruginosa
gttcggcgacggtgtcgagcagagctgcgtgttcatgcccgatccagcctggctggaatacgactacacccgcgccatgctgctcggcgggctctgccattcgcaaccgcgtcgcgcgttgttcctcggtttcggcgccggcagcctgacccaggcctgcctgcgccacctgccgctggaggaggccgaggccatcgagctgcgcccggcgattccgcgcctggcccgcgagcatctggggctgcgcgacgacccgcgcctgcgattgcgcatcggcgacgcactggagagcctgggcgaatgcgcggaggccgacctgatcttcctcgacctctataccgataccggcccgtcggccgcgcacctggcctggaatttcctcggtgcctgccaggagcgcctcgccgaggatggctggctggtgatcaaccagtggagcggcaccgatggcaagccgctgggcgcgccgctgctgcgcgggcgctatcaccatcattactgggagtgtccggtggccgagggcaacgtggtgatgctggtgccggcgaacctggccctcgaactcgaccaggaagccctgcggacgcgtgccgcggcgctggagccgcaactcggctattcgttgcagggctatatcgacagcctgcgcccggcccagtagccagggcgcgcggacaagggcccggcctagcgtccttcgaagcgtcccgggcggcgttcctggagagcgcgcaggccttccttggcgtcctcgctgtcgagcaggcgcctggcggcttccggcaacgcagcggcggcgaccgcttcgccttccagcagggcctggcgcgccgagccgagggtggcgcgcacgcccagcggcgcctgggccgcgacccgttcggcgagggcgatggcgtggtcgaggaggtcctccggggcggtgacttcctgcaccaggccgagacgataggcttcgtgggcgtcgaattcgtcgccggtgagcagccagcgcatggcgttgccccagccggcgacctggtgcatgcgcagtgtcgcgccaccgaacgggaggattccgcgctgcacttcgagctgggcgaagcgcgcgttgctggcgcagaggttgatgtcggccgccagcatcagttcgatgccgatggtgtagcagtagccttgcacggccaccaccagcggcttgcttggacgccggccgccgaaggtgccccagggatcgacggcgccttcggggagtttccagccctggcggaaggtctcgccgacattggccaggtccagcccggcggtgaaatgctcgccgtgggcgaagagcagggcacagcgcaactggtcgtcggcctcgtattcgccgagcgcggcgaccaggtcgtcgagcatcggcaggtcgaaggcgttgcgcttggccacgcggtcgaggccgagcagcagcaggtggccgcgccgttcgcggctgatgcgtcctgggagggtgtcgttcatgcggcggtttcctggcggggggcgggcaacgtcggtatagacgtctggaatcgggatgtccattgtcagtctctccgatga

SEQ ID NO: 9660 - DNA, 2100 bp, Pseudomonas aeruginosa
gcagccatgggtcatgggtctttgcggatgtatacgaggcaaacccatgactcaggaaaccgtcggcttcgccgcgctcggtattcaccccaatgtgctcgcggcaatcgtcgccgtaggctacgaagagccttcgcctatccaggctcaatcgattccgctgatcctcgaaggccacgacatgatcggccaggcgcagaccggtaccggcaagaccgccgcgttcgccctgccgctgctgtcgcgcatcgacccgagccgccgcgagccgcagatgctggtgctggtgccgacccgcgagctggccctgcaggtcgccaccgcctgcgaaacctattccaagcaattgccgggcgtcggcgtggtcgccgtctacggcggcgcgcccatggggccgcagctgaaggccctgcgccagggcgcacagatcctcgtcgctacccccggccgcctgtgcgaccacctgcgccgcgacgagaagctgctggccaccgtccagcgcctggtgctcgacgaagccgacgagatgctcaagctcggcttcatggacgacctggaagtgatcttcgaggcgcttcccgaatcgcgccagaccgtgctcttctcggcgaccctgccggcgtccatccgtggcatcgccgagcgccacctgaagcagcccaagcacgtcaagatcgccgccaagacccagaccgtggcgcgcatcgagcaggtccacctgatggtccatgccgaccagaaggccggttcgatccagcgcctgctggaagtcgagcagttcgacgcgctgatcgccttcgtccgcaccaagcaggccaccctcgactacgccgaattactcgagcgccagggctaccgcgccgccgcgctcaacggcgacatgccgcaggcccagcgcgagcgggtcatcgagtcgctgaaggacggttcgctggacatcgtcatcgccaccgacgttgccgcccggggcctggacgtaccgcgcatcacccacgtgctgaacatcgacatgccctacgaccccgagtcctacgtgcaccgcatcggccgtaccggccgtgccggccgggaagggcgcgcgctgttgctggtgactccgcgcgagcggcgcatgctgcaggtgatcgagcgggtcaccgggcagaaggtcggcgaagtccgcctgccggatgccgagaccgtactggaggcccgcctggcgcgcctggccgcgagcctgacgcccttgctcgacagcgccgtcgagcagcgcggcgcggtgcgcgacgagctgtgccgtcgcctcggctgcgatgccgagaccctggccgccgcattgctggcacgcctgaccgccggcaaggcgctggacctggagtcggtgcgccgcgaacagccgctgaccccatcggcaccgcgcgagcgtgccgaccgtggcgaacgcggcgagcgtccggagcgcagcggcgagcgtcgtccgatggcgccgccgagcgaaggccgtgcccgctgccgcactgccctcggcgcgcgcgacggggttgcggcgaagaacctgctgggcgcgatcctcaacgagggcggcctgtcccgcgaggacatcggtcgcatccagattcgcgataccttcagcctgatcgagctgcccgaggccaatctcgagcgcctgctgaccaagctcaaggacacccgcgtcgccggcaaggccctgcgcctgcgccgctatcgcgaggactgaggtccagcgcgatgaacaaaagccccgcttcggcggggctttttcatgggcttgatgtttgctggccagactgtttttcgcgcctgccccggcttctcgtttcgtcaccccgggcgagtccctttggcaagcgtcctgaaggaaacaaaggactcgcccagccgccagggcaggcaccacgtcgtgcatgtcagacctgcacataccgaggccctgatccgccgcctatccatgacatcgcggataacgcctatggcgttattcgcgctacaggactatgtcgctcgcgatttcctggctgccagccgagtccacccagcttgcggcgggaagccgatgctctccgccagtcccccgagaaaccctgtcaatcgaagcgatag

SEQ ID NO: 9661 - DNA, 489 bp, Pseudomonas aeruginosa
cgccgcgaggagtacagcacgaacacctcgcggacatgcagtcgatggcccggcagtagccgcaacaggctgccttcctgcagcgcgcgggcggcgacgaagccgggcagcaggcagacgccgagcccggccgcggcggcggcgcaggcggcctcgggaaggttgaccttgagcgcctcgtcgagatcgagcagcgtttcgccgcgttcgccgacgaaggcccagccctgcgggcaggacggcgcggccacgttcaggcagcgatgccgcagcaggtcctccggcgtgcgtggcacgccatgccgtgccaggtattccggcgcggcacagaccacgctgaacacctggccgagatcgcgggcgaccagggtcgagtccggcaaggttcggctgagggtgatcagcacgtccaggccttcctcgagcagggccggggtgccctgggccagcgtgaggtcgacggagacgtccggatggccgtccaggtag

SEQ ID NO: 9662 - DNA, 732 bp, Pseudomonas aeruginosa
cagcatcggcaggtagaagtcctcgcgcacccagtccgccgtcagttggctgaagctcaggcaggcaccggcgcacaggcacaggccgcaggccagcacccagcggcagtcgacccgcgggatgttgcagagggccgccaccagcggcagcgcgacgagctgcggaagggccaccagcaacaccatgggtacgctctgcagggggcggtagccgcggatctcggcgaggaattcggtcggcacgcccatgctcgcgccgagcaccaccagcacgccggccagggtgatcagggcgaaggtcaggttgcggcgcttcagcaactgcaggcggaagaacggcagcgggtggctccattcgttgaccaggaacagccccagcaggaggctgccgctgcccagcagcaggcagatcagcggcgactcgaaccagtccaggcgttcgccttgcagcagaccgatcaccagggcgcagatcgccgggaagccggtgagcaggccgatgccgtcgaactggcggaagcgttccaggcgcaccgggtcctgggggatgccatgggacaccgcggccatcgccaccaggcacagtggaatgacctgccagaacacccactgccagccgacgtattcgaaccagaacgccgccagtggcaggcccaggttaggcccgaaggtcgcggtgagggcataggcgcccaggccatagagctttatcccgggtggcaggaagcgtag

SEQ ID NO: 9663 - DNA, 510 bp, Pseudomonas aeruginosa
cgccacggtcatcagcattggcggcaggcagccggccatcagcccttgcagggtgcgcaggaccagcaggctctcgaggttcggcgcgaacggacagagcagggccagcagggcgaagccgccgatggcgaagagcgtgaagcggcgcagggaaaaggtcaccgaacaccagggcgcgaatgccatggcggcgacctgggtggcttcgtagagcacggtcagccaggtgccttcgtcatggccaatggcgagtgcgccgcgcacatcggtcatggcgatctcggtgacatgaccattgagaccggcggtgagcgaggcgagcagcacgccgagcaggccgaccacgatgcgcgcgccgaaaggctgggcggcgggggctgcggttggcgtcggctggccgagcggggtggcgagcgaagtcatcgcgacctcgctacggcgagggtggggaaacaaggcatgggcggaaactcttctgatttccgccgcagtctaggagcgtcccggtag

SEQ ID NO: 9664 - DNA, 816 bp, Pseudomonas aeruginosa
aggtcgatgcggttctgccgcagtgcctcgtcgtcgatgtccgactcctgcacgaagcgcagggtgcagcgcggcgcctcctcggcgaagatctccagcaggcgtatcgacagaccgccgaccagggtgttgttggaacgcagggtgaagcagcgctccagcttgtccagttggatggtctcgcgagtgttgaacaggtcgcgggcctggtccaccagttgccggacctgctcctgcagttccagggcacggggcgtgggcaccagcttgcggccggcgcggaccatgatcgggtcgcctaccgcctcgcggatccgtgacagggtacggctcatcgccggtgggctgaggtgcatgcggcgcgcggctccgaccacgctgccctcttcgagaagaacgttgagggcgaccaggagattcagatcgggaagatgcatggagtggaagtataagcacgctggcatgcgcagggtgcagtctttcgttctcccaggcgtgcgttcgctgcattgctggattgcgttcgcggtgcctttacgcgcaccggtggctgccgaagaatgccggtgcacgctctatccgaggatttgccgatgttccatacgctcctggtcgccatcgacggcggcccgcagacccgtcgcattgccgagctggcgcggcaggccgccgcgccgggcgcgcgggtccacctgctgtgcgcggtggacgccggctatgcgttgccgggccggccgacgctgctcgactatccgcccgccgcgcacgagtgcgaagaggcccggcaggtgctcgacgaggcttgtgcgctgctag

SEQ ID NO: 9665 - DNA, 774 bp, Pseudomonas aeruginosa
tccgcgaggcgccgtgtccggtgctggtggaagtgcgcgagggagatgcgcaggggagttgacctgccggccgattgtcgccaccttgcggtttttcccacgaatgcggaggacaggatgcaggcggatttttggcacgcccgctgggcgaacaaccagatcggcttccacctggacgagatcaatccctacctgatgcgccacctgtcgcggctgcgactgcaagcgggcgaacagatcctggtgccgttgtgcggcaagaccctggacctggcctggctggccgcccagggactggaggtgctgggggtggagctttcggaaaaggccgtgagcgacttcttcgaggagcacgacctgcgccccgagatcgatcaactggatggtttccgccgctaccgggtcgccggcatcaccctgctgcagggtgatttcttcgccttgcaggcagagcacctggcgcagtgcagggcgttctacgaccgcgccgcgctgatcgccctgccgccggagatgcgcgagcgctatgccgggcatctccaggcggtcctgccgacgcgcagcctcggcttgctggtcaccatcgactacccgcaggcggagatggccggtccgccgttcgccgtgcccgacgaggaggtgcgtggctactacgctggcggttggcggatcgaggaactggagcgcggcgacgtgctcggcgtcaactggaaattcctcgagcgcggggtgtcctggctggacgaggccgtctacctgctggagagaggctga

SEQ ID NO: 9666 - DNA, 1239 bp, Pseudomonas aeruginosa
aaaaagggcgaccgatggtcgccctgtcccaagtgtgaaagcggatcagcgtgcgctggcgcgcagcgcttcgatacgatcttccagcggcgggtggctcatcagcaggccggccaggccgtgcttgaggccgccattgatgccgaaggcgttcagggtgtcgggcatctgcaccggcacgccctgttccgaacgcaggcgttgcagcgcggcgatcatcgcgccggtgccggccaggtgggcgccggcggcgtcggcgcggaactcgcggcggcgcgagaaccacatgacgatgatgctggcgaggatgccgagcaccagttcggcgaagatggtcgcgacgaagtagccgatgcccgggccgtcctcgttcttcaggatggccttgtcgacgaagttgccgaagatccgcgcgaagaacatcacgaaggtgttcaccacgccctggatcaatgccagggtgaccatgtcgccgttggcgacgtgaccgatctcgtgggcgaggacggctttcacctcatcgggcgagaaacgttcgagcaggccctggctgaccgcgaccagcgcgtcgttcttgttccagccggtggcgaaggcgttggcctcgtaggcggggaagatgccgacctccggcatcttgatgccggcttcgcgggacagctcttcgacggtttgcagcagccactgtttgtgacgggtgcgcggctggctgatgacttcggtaccggtgctcatcttcgccatccacttggagatgaacagcgagaccagcgaaccggcgaaaccgaacacggcgcagaagaccagcaggctgccgtaattctggccggtgaagcggtccaccccgagcagtttcagggtgatgctggcaatcaccaggactgccaggttggtggccaggaacaacaggatgcgcatcatggtgtaaagcttctcctcacggctgaaggcacggagcgcggttcgcaggccgccggggcgggcgaacgggctcctgataatcatgcggggttatataaggggcggtccatggcgattcaatcgagggactatttcaaactgtgtcgccttgcgcgcccaggttgccctcgaacagcaggcgggtcagcccggccaggcgttcgccgtcgccctgcgccagcgcctggcgcaactggttggccaggctggcctgttcgcggcgcacgctggccggcgcctcggccagcgccgccgcggcccgggggacgatacgggtaa

SEQ ID NO: 9667 - DNA, 330 bp, Pseudomonas aeruginosa
ccgaagagcagttccacatctgtcgcctgggcggtaccgaacgcgccttcagtggcgaataccacgccaccaagacccccgggatctatcattgcacctgctgcggcacggcgttgttcgactccgacgccaagtacgactccggcagcggttggccgagctatttccagccggtggacgccgaggcggtccgcgaactggacgacttcagccacggcatgcatcgcatcgaagtccgctgcggccgctgcgatgcccacctggggcacgtcttcccggatggcccccggcccaccgggttgcgttactgcatcaactcggcctcgctga

SEQ ID NO: 9668 - DNA, 1242 bp, Pseudomonas aeruginosa
gcggtgaccagcaggatcggcgtaccgatgctcggacgcagtcccatcagacagtccgggcaatccgatatcagtacgtcgagcgagtggccgagcaggctgtcgtcggtctccagacgcttgtactccaggccccagcgcggcagccaggtttgcagcagctgcgccagcccgctgttggccgagcattgcgcgatcacccggccgcgcagcggcagcgcttgcagcggagggctgaccggcgccagcggcaggccgacgctgaacaggctgcccaggccgaccgtcgactccaccgtcagctcgccctgcatggcctcgcacagcttgcgcgtgagggccaggccgaggcctgtgccgccgtattggcgggtgatacccgcgtcggcctgggtgaacggttggaagatgcgatccagcgcctcctgggcgatgccgatgccggtgtcgcgcacactgatgcgcacaccctcggcggtggcttccacgcgaacgtcgacccgccccaggcgggtgaacttcagcgcgttggacagcaggttgctgacgacctggcgaatccgcgtcgggtcgccggaaacctgggcgggcagggcggggtcgaccaggcaggtcagctccacgccggccgcggcgttctgcgagaggaggctggcggtgtcttccaccaggacgcccaggtcgaacgggatctgttccaggaccagttgcccggcctcgaacttggagaggtcgagcacgtcgttgagcaattccaccagcaccttgccggagtcgtgggcgatcgacagttgctggcgctgttccggggtgagcgggccgtcgaggctcagcgagagcatgccgagcaggccgttcagcggcgtgcggatctcgtggctcatgttggccaggaagctggcgcgggcctgggccatatcgagagcggtctggcgggcttcttcgagttcctggttggatagcgtcaggcgcgcgttggcggccttcagctcggcggtacgggcggcgacgatgctttccagctcctccaggtactgggtcaggcggttctccgcctcccggcgctgttcgatctctaccgagatgcgcccgagctggcggttgatgacttccaccagcacgccgatctcgtcgcgttcgtggcccttggggcagggcaggcgcatgcgtgccggcgagcgtggatcgtgtccgctgagggcctggatcaggctgaccaggggcttggtcagcagggtatag

SEQ ID NO: 9669 - DNA, 1032 bp, Pseudomonas aeruginosa
gtcagcgctatatccatgggggcggggatcagccttggcgaggttctgccgcctagcatagcccatcccgaccgtctgtcggggttcctgggcgcaaccgatgatcgatccgtgacgtcagtccgatccgaggagaacagagtggattcccgattgagcgattttcttgcccgcgccgaaagcgtgctcgcgcgcctggagccgctgctgccggccgtacgcgaagccgtcgactgggagcgcagcctggcggcgcgctggcaccgcgacggccgtagcggctacctgcagccgctggaggtcagcctcgacctgcgcctggccgacctgctgggcgtagagcggcagcgcgagcaactggaacgcaacacccgccagttcgtcgccggccagccggccaaccacgccttgctctggggggcccgcgggaccggcaagtcctccctggttcgtgcgctgctggccgagctggccggcgccgggctgcgcctgatcgagatcgagcgcgaccacctggccgacctgccgcgcgtggtcgagcaactgcaaggcctgccgcagcgcttcgtactgttctgcgacgacctctcgttcgatgccggggaaggcgactaccgggtactcaagagcgtgctcgacggctcgctggaacaggcgccggacaatgtgctgctctacgccacctccaaccgccggcacctggtttcggagaagcagagcgacaacgagaactggaagatggtggacggcgagctgcatcccaacgaagcggtggaggacaagatcgccttgtccgaccgtttcggcctgtggctgtcgttctatcccttcacccaggagcatttcctcagcgtggttcaccactgggtggacgtgctcgcggagaaggccgggctggcctggagctggagcgaggaactggagaaggaagcgatccgctgggcgcttggccgcggcaaccgcaacggccgttgcgcctatcagttctcccgctactgggtgggcaagcaactgctggagcgccaggcatga

SEQ ID NO: 9670 - DNA, 468 bp, Pseudomonas aeruginosa
ggaccagcaggcgccggccgtcgtggacctgtgcctgcagcgccgccagcgggcgcgccaccagcgacaggcaggcgacctcctgcagggcccagccgaggcgggcggcggccagcgagagggaggagggcgccggcaggacccgcagttcggtcgccggcagttgccgggcgagactggcgccgacgccgaacagcatcgggtcgccgctggccagcacgcaggtcggctggccgcgccgggccagcaatggttccagggagaacggcgtcggccaggtttcgcgggcggcgccgatgcacggcggcagcagttccagctggcgcgccgcgccgacgatccggctggcttgcagcagggcacgccgggcctgcttgccgaggccgggataaccgtcctcgccgatgcccaccagggtcagccagggcggcgtcgagtctgccgatgacacggttccgatactcctga

SEQ ID NO: 9671 - DNA, 906 bp, Pseudomonas aeruginosa
aatgcgtctgtgaagggcccgcgacggcttccggacggaatgggttttcccggccccgggctgggcggcataatagcgcgttcgtcggtgcccggccctttcgcgttagcgcggggccaacgagggccgaagagggaacacggagccgcggtcttttcgaagcccgggcctagccgtggctgcccccgcaactgtatgcagcctgtattcgcgccattcgccactggattaccgggaaggcggcgcgaagcggaggttcctcccccgggtggaacgccgggctgcgagccaggagacctgccgccgaaaccagtcgcgagtgccaacatcgggcggggtgtaccgatgccgtggtctgtccctgggggacagcggtgcggtcgccgcgacgccgattcgagtagcgtttttgaacgacgaccagaccccggcgcccctgcccgtaccacgtccgtcgccctgtcccggcctgctgcgtatcgtccaggcgctggacggcggcatctgccgcatcaagctcgacgccggccgcctggacgccgcccaggcacgcgccgtggcggccgcggcgcgggattgcgccagcggcgtgatcgaggcgaccaaccgttccaacctgcaattgcgcggcgtccgtcgcggcgaggaagagcggcttgtccgccgcctgctggacgccggcctcggtccccggcatgggtccctggccggcgccgacgacgtgcgcaaccttatgctcagcccggccgccgggctcgatccgcacctgtcgctggacgtgcgcccgctggccgctcggctgttgctgcggctccaggcggacagccgctaccacgcgctgtcggccaagttcgccatccagctggacggcggcgaagacctggcgatgctcgaacatccccatga

SEQ ID NO: 9672 - DNA, 1014 bp, Pseudomonas aeruginosa
cgagcgggtggcggcctggcggcgttcgccggggcgtccgtggagtcatctcggcgtccagccgcaacgccagccgggcctggtgatggtcggcgcggcggcgccgctcggccggctcgacagcgcttgcctggaaggcctggccgagctggtcgaacgccatggcgacggcagcctgcgcctgaccccctggcaaggcgtgctcctgccgaacctggcgcacgccgaggccgaccaggcgctgctcggcctgcgcggactcggcctgctgaccgagcccgatgcgccgttggcgcggctgatcgcctgcagcggttccagcgcctgcgccagaggcctggccgacaccaagggcgacgccttgcgcctggccgaacgcctcggcccgcgcagcgacctgccgcaactgcacctgtgcggctgcgaacggtcctgcgccgctgcccaccgcgcgccgctcaccctgctggcgcgcagcggcgggttctacgacctgtaccggcacgacccatgccaccccggattcggccagttgctggccagccgcctgactttcgccacggccgccgactacctggcggccctgccttcccagcccacttccggaaaacccgcatgattgactacatccgcgatggccaggcgatctatcgccagtcgttcgccaccatccgcgccgaagcgaacctcgccggcatcccggccgacctggaaaagctcgcggtcagggtgatccacgcctgcggcatggtcgacgtggtcgacgacctgcgcttctcgcccggcgccggcgccgccggccgcgccgcgctggccgccggcgcggcgatcctctgcgacgcgcggatggtcgccgaaggcgtgacccgctcgcggctgcccgccgccaaccgggtgatctgcaccctcaacgaagcggacgtgccggcgctcgccacggaactcggcaatacccgctcggcggtgggcccctggagcactggcgcgagcacctggagggcagcgtggtggtga

SEQ ID NO: 9673 - DNA, 771 bp, Pseudomonas aeruginosa
acgccctggccacggagcgcgaatgatgagtgtcgtgaagggccgcctgctgggcctgggcgtcgggcccggcgatcccgaactgatcaccctcaaggccctgcgcctgctgcgcgcggcgccggtggtcggctatttcgtggccaagggcaagaagggcaacgccttcggcatcatcgaggcgcacctggaccaggcccaggtgcgcctgccgctggtctatccggtgaccaccgagaagctggaaccgccgctgtgctacgagaccatcatcagcgatttctacgacaccgccgccgaacagctggccgcgcacctggacgccggccgcgacgtggcggtgatctgcgagggcgacccgttcttctacggttcctacatgtacctgcacgaccgcctggcgacgcgctacgaaagcgaagtggtgcctggcgtctgctcgatgctcggcggcgcggcggtgctcggtgcgccgctggtgtaccgcaaccagagcctctcggtgctctccggagtgctgcccgaggaggagttgcgccggcgcctggcggatgccgacgcggcggtggtgatgaagctcggccgcaatttcgacaaggtccgccgcgtgctggtcgagcttggcctcgagcgccgcgcgctgtacgtcgagcgggcgaccatggccaaccagcggatcgtgccgttggaacgggtggagccgatggcctcgccgtacttctcgctgatcgtcgtccccggcgacaagtggcagggaggggccggcggtga

SEQ ID NO: 9674 - DNA, 1254 bp, Pseudomonas aeruginosa
cgctcttgcaggacaatctcgaacgctggaaagcccagcaattgccggcttccggcgccagttcgactacgcaggaaagtgacttgtgagcattcgatggatgatggccgcaggcctcgccgcgctgaccctgagcggttgtgcgagcaacgacccggctccgctggagcagatgcgcctgaccgaacaggcgctggagcaggccaaggcggtgggtgccaccgacgacgtggccgagctgaaactggcccaggacaagtacgccgcggcgcagatcgcgatgaccgcggagtcctacaagaaggcgcgcctgttggccgagcaggccgagctggacgcacgcctcgccgagtccaaggtgctgacgcagaagagcaaggaccagctcggcgagctggacaagagcctgaaacgtctgcgcaagcaactgggggagaccgactgatgccgggcaaagcgactctcttcgccaccctgctggcctgcgccgcgctggctggctgcgccgaccacaagctcagcgaacagtcgctggccaaggcgcagagcgagttcgaccaggtcaaggaagattccgacgtgctccgcgcggcgcccaaggatgtgatccgcgccggcgaatcgctggcccgcgccgaacgcctgtccagctactggggcagcagcagcgacgtgatccagtatgcctacctgagccagcgctacagcgagatcgctcgccagcacgccttgctcaacctcaaccaggagcgcctgacccgcctgcaactggagcgcgagcgcctgcaactggccctgcgcgaagccaagctgctcagcgtgcaggagcagggccagcgcctgagcgaggagatcgccagtctcagcaccgaggaaaccgagcgtggcctggtgctcacccttggcgacgtgctgttcgacttcaaccgcgccgaactcaagccggcggccaaccgcaccgcgctgaagctggtgcagttcctccagctcaatccgcggcgggtgatccgcatcgaaggctataccgacagcgtcggcgacaggcaggccaacctcgacctgtcgcgcgagcgcgcccaggcggtggccgacgtgctcgccgatctcggcgtggatcccgcgcgcatgcaggtggtcggctacggcgaagccttcccggtcaccgacaacgcctccaaccgggggcgggcgcagaaccgccgggtggagatcgtcttctccaacgacaagggccagctcagcgcgccgcgctga

SEQ ID NO: 9675 - DNA, 735 bp, Pseudomonas aeruginosa
gctactgtttcggttcaatcgccgaggaaaacccgccatgaccaatctgctgctttaccaacgcatcgcccagcagttggccgaggacattcgccgtggcgtctaccagccgggcgagcgggtaccgtcggtgcgcaagctcagtacccagttgaacgtcagccacgccaccgtgctgcaggcgtacgccaccctcgaggaccagggactgatccgcgcccgtccgcaatccggcttctacgtccaccgcaccccggcgctgaccgcgccgaccccggatatcgcgcgggtcgagcgtcccggcctggtcacccgcagcagcatcatcaaccaggtgctcgccgagtcccgccgcgaaggggtattcccgctcggcgcggcggtgccgcacgtggactacctgccggtgcgcgccttgcaccagcaactggccaaggtcacccgcttccagagcccccgggcgttcagctacatgttcagccccggtttcgagccgctgcggcggcaggtggcgatccgcatgcgcgacgccggcgtggtggtcgacccgtcgcaggtgaccatcacccacggctgcgtggatgcgatccacatggccctgcgggtgctgacccgtcccggcgacctgatcgccaccgagtcgccgagctactacggcctgctgcaactcgccgacgtgctgggcctgaaggtcatcgagatccccagcgacccgcgcaccgggatcagccttga

SEQ ID NO: 9676 - DNA, 699 bp, Pseudomonas aeruginosa
agagccgtttccgctacgcggtgcagaagctgcgccggctgctggccgaggaggtggcggtatgaacccacagaagcattccgcgagcgtcgccgaagagcagatgctggcgcatttccgcgcccacgcgccgcagcagccggcgccggcgctggaccaggcgatcctcgccgccgcgcgacgccaggcggcgcatgtcgaacccgcccggtcctggtggcggcgctggctggaagcctcccgcaggccgcgttggcaggcggctttcgccagcctgctgggcgtggcgctggtgctggggctggtcagccaaaacgtgctggacgacgccgagcgccaggcccgccccgaagtggcgttcagcgatgtgcccctgcgcgacggagtcgccggggccgctgcggcgaagcgggccatgcgcgcgccggcggcgccggctccgctgtccggcgagatgtcggagcccccggccttgctggccagctacgcatcgtccggggaggcgccgcaactgatggccgaggccgcgccgccggctccggctgccctggccgaccgaccgccggcccaggccgcgcagcaggcgaaggtccaggcggcgctggccggcgacttcgtcgcccaggccaggggcaaggcggttgcggtgaagccggaggtgctcgacgaggcgctcggggcggtccttgccctgcgtga

SEQ ID NO: 9677 - DNA, 411 bp, Pseudomonas aeruginosa
aggcggtggtcgcctcgccggcggcgaagtccggatgcgccaggaggttggcgaggaaccgctggttgccgtcgacccccagcagcacgcagcgctccagcgcgcggatcagcttgcgccgggcttcgtcgcgggtcgccccgtaggcgatcagcttggccagcatcgggtcgtagaagggcgtcaccgcctgcccctcgaccaggccatggtcgatgcgtacgccgggcagcagttccgggtcccagcgcagcaccgtgccggtctgcggcaggaagccgcgaccggcgtcctcggcgtagaggcggacctcgatggcatgcccgcgcagttccacctgttcctgccgcagcggcagcggatggccctcggcgacgcggatctgccaggccaccaggtcctggccggtga

SEQ ID NO: 9678 - DNA, 1431 bp, Pseudomonas aeruginosa
tccgcaggacgccctcgacgggttccagcagcagggtctcgcaatgcggcaggctcatgccggtttcctcctggaacgtcagcctttcttcttgcccggcaggatgcccatcagcttgcagatgatgccgagcatgatctcgtcggcaccgccgccgatggataccaggcgggtgtcgcggtaggcgcgggagaccgggttgtcccacatgaagcccatgccgccccagtactgcaggcaggcgtcgctgacctcgcggccgaggcggccggccttgagcttggccatggaagccaggcgcgtcacgtccctgcctttcacgtacagctcggtggcctggtagaccagggcgcgcagcgcctcgacctcggtcatcatctcggccatgcgaaagtggatgacctggttgtcgatcagcggctggccgaaggtcctgcgctccttgcaatactcgatggtgacgtcgatgcagtgctccaggcccttgatcatgttggccgcgccgaacagccgttcttcctggaactgcagcatctgcatcatgaagccggcgccttccgcgccgatgcggttgcgctgcggtacgcggacgttatcgaagaacacctgggcggtctccgaactgcgcatgccgagcttgtccaggtgcggactgagggtaatgcccggggtcttcatcgggaccacgatcagcgacttgttgacgtgcggcttgtcgtcggaggtattggcgagcaggcacatgaagtcggccgacggcgagttggtgatccacatcttgctgccgttgatcacatagtcgtcgccgtccttgcgcgcggtggtcttcaggccggcgacgtcggagccggcgccgacctcggagacgccgatgcagccgaccatctcgccggcgatggccgggcggaggaactcctcgcgcaactcgtcggaaccgaagcgggccagggccggggtgcacatgtcggtctgcacgccgatggccatcgggatgccgccgcaggtgatgctgccgaattcctcggcggcgacgatcgagtagctgtagtccaggcccatgccgccgaacttctccggcttggagatgcccagcaggccgagttcgccggccttgcggaagatctcgtggatcgggaagcggccgtccttttcccactggtcgacgttggggttgatttcccgctcgacgaagctgcgaacggtgcggcggagttcctcgtgttcctgggtgaagatcatgggttgtctttcctcctgggcatcattgttttccggcaggatccgcttgctctctcccaaccctcttccttcagggagagcggggagaggggctgtcgccggctcgcctgttgcagtcagaacctcgcgaccccgaagctgttgcccttcagcggccgcgcctcggcttccgcgcagatatccagcaggtag

SEQ ID NO: 9679 - DNA, 1473 bp, Pseudomonas aeruginosa
cttcaccagcggcacgctggcgctggcgggctgcaccgggcgtggcggctggcgcgcctcggccaatcgtgccgggtcgaaggcttcgaggaccggcagttccagcggatggcgctggccgtcgatctctacgctcaacgcgcattgcgccttgtcgatcaggaaagagaacaggcggatcaccggatacaccgtcggccggccgccgacgatgccggtcaggccgggcgccatcccggtggcggcctgggcgatctcgcgggagaacagcaccagggcttccttgcgcggatgccggacggccagcttgaccaccacttcgcggctgtcctgccgtcgcccatggggaccataggtggcttcgctgccgagcagttcgacattgacctcgcggtagggctcccagccgcgctcggcgaagatttcctcggtcctggcgatgatcgcctggctgacccgctcggccttcttcagcgcatcgatgccggcgatcaggcaactggcggtgcagcggaaaccgtccggataggtggcgctgaccttgtaccggtcggtgggcggcaggccgcgcgcgccttccaccgcgacccggtcgggtccgacctggcgcaggcgcacctcggtgaagtcgcagaccacgtcgggcagcaggtaggcgcgtgggtcgccgatctcgtagagcatctgttcgccgacgctcagttcgctgaccaggccaccggtgccgggcgccttggtcaccacgaagcgcccgtcggcctcgacctcgacgatggggaaaccgatgtgctcgtagtccggcacctgctcccagtcggtgaaattgccgccggtgcattgcgcgccgcattcgacgatgtgcccggcgagggcggcctgggccagtcggtcgtagtcgtcccaggcccagccgaactcgtgcaccagggcggcgctgaccaccgcgctgtcgaccacccggccggtgatcacgatatccgcgcccaggcgcagggcctcgacgatgcccggcgcgccgaggtaggcgttgagcgagacgcacatcggcgggaaaggcgcgtcgctgaacatctcgcggatgccggccttggccagttcggcctggcgcgcttgcaggttgtcgccatggagcacggcgatcttcagctgcaccccggccttctcgcaggccgcggcgagggcggcggcacaggcctgcggattgatcccgccagcgttgctgatgacgcggatcttcttctcggcgatctcgcccagcagtggtgcgaggacctcgacgaagtcggtggcgtagccggcgtccggctgtttcaggcgggcgccggccatgatcgacatggtgatctcggccaggtagtcgaacaccaggtagtccagcggcgcgccgcgcaccaactgggcggccgcggtgcaggtgtcgccccagaaggccgaggcgcagccgatgcgtacggtcttttgcattgttcttga

SEQ ID NO: 9680 - DNA, 1365 bp, Pseudomonas aeruginosa
cattgcttaactggcgggtatcccttcattgccccgtccgggcctgccagcgagaggttgccgatgtctccgagcgcgttgtcccgtctgttgcgcccggtggaacccctgactccggcgatgagcatcagcgacgtcgccgaccgcctgctgatgccggagcaccgtgccttcctctcgctgccggtggtcgacgacgagcgccgggtcctcggcctggtcagccgctacaccctccaggacatcttcatgcagcgtttcggccgcgacctctggggccgccatccggtgcgcgacgtcatgaaccgggcgcccctcagcgtctccctcggcgccagcctggaagaggcggcgcagcaggtcaccggtcgcctgcagtatccgatcaccgaggacttcgccctggtcgacgaagagggccgctaccgtggcctgggcaccgtgctcgacctgctgaaggccatggaggcgcgcatcgcccagcgcaaccgggtgctgcgcaaggcgctggtggacctcaaggagtcccaggcgcaactggtgcagtcggaaaagatggcttcgctcgggcagatggtggccggggtcgcacacgagctgaacacgccgctcggctacgtcggcaacaacctggcgctgctggaggagctgagcgatcccttgttgcgcctggccgatgcccaggcggcgctggtcgactgcctgggcgacccgcagtgcgacgaagcgcgcctggcgcaggcgctgcaggcggccgacgcggtgcgccgcgaagccgccgtcgaacagttgcgcgaggacctgcggcaattgttcgtcgatacccgctacggcctcggccagatcggcgagctggtttccgggctcaaggacttcgcccgcctggaccgcgccttcagcgaggaggtcgacctcaacgactgcgtgcgcaacgccgtgctgatcgcccgcaccgccatcaaggacaaggccgagatcagcagccagctcggcgagctgccgcttatcgcctgcgcgccgtcgcagatcaaccaggtgctgctgaacctgctgaccaacgccgcgcaggccatggagcgtttcggccgcatcctgctgaagagctgggccgacgagcgccaggtgttcctctccgtgcaggacaacggcaagggcatgcccgccgaggtcctcggccggatcttcgacccgttcttcaccaccaagccggtggggcagggcaccgggctcggcctgtcgatcagctacaagatcatccagcaacatggcgggaccatccgcgtggcctccgaaccgggccgcggaacccgcttcctcatcagcctgccgcgagagcaggcccgcgaactgaaacggagcgcctga

SEQ ID NO: 9681 - DNA, 777 bp, Pseudomonas aeruginosa
cgaggagcgcatcctgcgcagcctggccatgcagttccgccgccattacgaggtgctcaccgagagcgacccgcggcgcgccctggagcgcctgaagacggaacggatacaggtgctggtcagcgaccagcgcatgccgcagatgagcggcgccgaactgctggcgcaggctcgcgagcgctatccggagaccctgcggattctcctcaccggctattccgacctcgatgccgccgtcgacgcgctcaacgacggtggcatcttccgctacctgaccaagccctggaatccccaggaaatggccttcaccctgcgccaggcggcggagatcgccagccgccagggcctgccggcgccgcccgcggccacgctggcggcgccgctgagcgtgctgctgctcgacgacgacccggaaaccctggactgcgtcggggccttctgccatgccggcgggcatcgcctgctgcgcgcgcgcaacctggccgaggcgctggtgtggctgaacaccgaaccggtggaggtgctggtcagcgacctgaagctggccggggagcataccgcgccgctgctgaaatccctggcccaggcccatccgcgcctgctcagcctggtggttacgccgttccgcgacacccaggccctgctcgaactgatcaaccaggcgcagatattccgctacctgcccaagccgatccgcaggggattgttcgagaaaggcctgaaggcggccgccgagcaggccttgctgtggcgcgggcgaagcctgccggaggttga

SEQ ID NO: 9682 - DNA, 636 bp, Pseudomonas aeruginosa
ccggctggccgaggtgccgcgcgacgagcgcgagaaggaacgggtcggcagcctgctcggcatgctcggccgcctgcgcgagcggctgacggcctgaacgccggcctagccggcgtcgcaaccggcggccttggcctggcggctttccaccaggcgtgcgcggaggacgtcgtagctccagttgaaggccatggtgtagggcaggaagaacaggatcaggcccatgtcgaggaggaacgcctcgaccagtccgatcgacagccaccaggcggccagcggtaccagcaccacgatcagccccagctcgaagagcatcgcatgcagcacccggacctgcagggtgcgctggaagcccatgcgccgctgggcgcggtcgaagaggctgttgaaaagcatgttccagagcatcgccacggtggagaacatcagcgtcagcgcacccatgtgcgccaggggcttgttcatcaccagcgacagcaccggcgcggtgaggaggacggccaggccctcgaaggccagggcgtggaagatccgctccttgagagtcttgtcgagggcggtgtgggtgtgggtcatggcgaacgctcccggttcgtcgttgaagtcgggctgtattgtcatcggtctttgggatag

SEQ ID NO: 9683 - DNA, 690 bp, Pseudomonas aeruginosa
gattctcctgggcaaggaccgccaggtgcgcctggccctggcctgcctgctggcccgtgggcacctgttgatcgaagacctgccggggatgggcaagaccaccctcagccatgccctggcgcgggtgctcgggctcagtttccagcgcatccagttcacctcggacctgctgccgggcgatatcctcggtacctcggtgttcgacaaggacagcgggcaattcgtcttccatcccgggccgatcttcgccgaactggtgcttgccgacgagatcaaccgcgccacgccgaaaagccagagcgccttgctcgaggcgatggaagaaggccaggtgaccatcgagggcgccacccggcccttgccggaaccgttcttcgtcatcgccacgcagaacccggccagccagggcggcaccttctccctgccggaatcgcagctggatcgcttcctgatgcgcctgtcgctgggttaccccgggcgcgcggcggaacgctcgctgttgctcggcgaagcccggcgcgatctgctgccgcgcctggaacccttgctcgaccacgcggcgctggccgctttccaggccgaagtgccgaaggtccgcgccagcgatgcgctggtggactacgtgctgcgcctggtcgaagcgacccgcacgcagccggccttcgccctcggcctgtcgccgcgcggtag

SEQ ID NO: 9684 - DNA, 1140 bp, Pseudomonas aeruginosa
cctggcgttgctcgccgcggcgcgtgcctgggcgctgctggcgggacgcgactatgtgattccggaagacgtccaggcggtgttgccggcggtcgccgggcatcgcctgcgcgaccaggcggaccccaccgggcacggtggcggcgcgctggtgcaatggctgttgcgcgaagtcccggcgctctgatgcgcctgcgcaactggccgcgctggcagcgctggctgaaccggcggataccgccggcgagcagcgtcgagctgaaccagcgtcgcgtattcatcctgccgacccgccagggcggcgctttcggcctggcgctgctggtgatgctgctggcggcgatcaactaccagaacagcctggcctacgggttgaccttcctgctgctgtccctgggcgtggtgaccatcctccatacctatcgcaaccttgccggcctgcgcctcaccgcgttgggagcggacccggtgttcgccggcgagcgcgccggtttccgggtgcgcctggaaagcccgcggcgggcgcgccaggccatcgccgtcggctggccggagcggccgctggaatacgccgacctggcaggcgacgcggctgccgaggtgctgctgttccacccgaccgagcgacgcggctggctgcggccggggcgcctgcgggtggagagtcgctttcccctcggcctgctggtggcctggagctgggtcgacctgcgccagcaggcgctggtctaccctcggccgctggccggcgagccattcctcgcgccgggcgcggaggatgccgaggaccaggggcgcgcgctggcaagcacgggcgtcgacgactaccagggactgcgcgcctaccagccgggcgactcgcggcggcgcctgcattggaaggcgttttcccgtggccaggggctgctggtgaaggacttcgccgcgctcggtggggaagacctgtggctggaattcgagcgcctcggcggggatctcgaaagtcgcctgggccgcttgtgccatgcagtcctggaactctccgcgcggcagcagccctatggcctggcgctgcccggcacacgcctgcaaccggccagcggcgaggcccagcgcgaggcctgcctgcgtgcgctggcgttgttcggagcggcgcgatga

SEQ ID NO: 9685 - DNA, 1629 bp, Pseudomonas aeruginosa
actgctggccgaggtgatcggccagcaggtggcgttgatgtcggcggtcgcccgcctggaggcgcgcacggatggcgaggcactgcacgacctgcgcatcgccctgcgccgtctgcgcagcctgctgcggccgatccgcggagtccccggcgtcgaggagctggagcatgccgccgccgaggtcgggtggctcagcgggccgatccgcgacctggaggtgctgctgccggcgctcgccgccgaagggctgcgggatgcgctggcggtgcgccggccggtgctggagtccggctacgtggcggttctcgccagccagccgctgcaccgcctgcagctttgcctggacgtctggccggccctgttgcgtacggcccagcggcatgccgtgttggatggcatgcacggccgggtgcgcaagcgcctgcgccggcaatggaagaccctgcgcgccgagctggcggacaccacctacgagcactggcacccgctacggctgcggatcaagcgcgtgcgctacgggctggaggcctatccgcacgattgcagcattcccggctcgctgctggcgccgctcaaggcggcccagtcggcgctgggcgattggcacgacctcgaacagtggctgttgcgatgccagcgcgagccggacctggcgcccgtgcgcgaggtctggacggcacgcttcgaactggcccgggagcgtgccggacgggccctgtcgacattgcagcaggcacttgccgggcactgaggccgccggtattccgatcggctttttcccaaggatcgcctcgcctaagatgggccctcgaatcccctcgcgaggcacacatgaatttttccgaattgatccaggcggtccgccgcgacccttcctcggtggtagtaccggccagttggggccagggccgcgccaccttcggtggcctggtggtggcgttggcctacgaggccatgcttgcggtggtcgaggcggggcgtccgttgcgctccatcggcgtcagcttcgtcggaccgctggcccccgagcagccggcgagcttcagcgcccggttgttgcgcgagggcaaggcggtgagccaggtacaggtcgaggtccgtcagggcgagcaggtggtgacgctggtccaggccagtttcggcgtcgcccgcgcgtcggcggtggcggtggaagcgttgccggcggccgggatgaagggccccgaagagagccaggagctgccctatatccgtaacgtgaccccggagttcactcgctacatcgccatgcgctgggcagtgggcggcctgccgttctcttcgaacaagtcgcgccagatgggcggctggatgcgtttccgcgacgaacccgagggagagcccatggaggtttcccacctgctggcgctgctcgactcctggccgccggcgctgttgccgcacctgggcaccccggcgatggccagctcgctgacctggaccgccgagttcctccagccgctgccgcagcagggcagcggcgactggtgccgttacctggcggagatcgaggaggcgcgcgacggctacggtcacgtggcggcgcggatgtggagcgccgacggccagttgctggcgatcagccggcagatggtcacggtgttcggctga

SEQ ID NO: 9686 - DNA, 495 bp, Pseudomonas aeruginosa
agcgcgctgtcggcgcgcaccagcaggctttccaggtcgtccccggcgtccctgcgcagggcgacgccgatgctcacggtcatccgcagcggttcgccgtcgggattgttcacccgtagcgcctcgacgccggcgcgcagccgttcggcgacgtccagcgcctggtccaggctgacctctggaagcagcgcggcgaattcctcgccgcccaggcgaccgagcaggtccacctcgcgcaggccctggcgcagggtctcggcgacacgttgcagggcgcggtcgccggtcaggtggccgtggctgtcgttgatgttcttgaagtggtcgatgtccagcatcagcgccacgcaggggtggcggaagcgttcggcggccttgagcatgagttccgcctggtgcaggaacgagtggcggttgtgcaggccggtcagggtatcggtgctggccagcaggcgcagttcctgctccatggccttgcgccggctgatgtcgtag

SEQ ID NO: 9687 - DNA, 1512 bp, Pseudomonas aeruginosa
ctggccgatggcgcgggtcagatcgcccgccaggtcgaccagttgctgactggtggccgccgactcgacggtctgctgcacggtgagttcggtgacgtcgcggatgcccaccaccgaacgggtcatctcttccgcgacctggctctgctgttccgcggcgacggcgatctgcgtgttgctttcacgcatctgcgccaccgcgttggcgatcgccgccagcgcctcgccggcgtcgccggcctggctgacgcaaccgtcggccttgagcgagctttcctgcatgaactccacggcgtcgcgggtacccgactgcagggcgaggatcatctgggtgatctcgtcggtggagtcctgcacgcgacgggcgaggttgcgcacctcatcggccaccaccgcgaagccgcggcccatttccccggcccgcgcggcctcgatggcggcgttgagggcaagcaggttggtctgttcggcgatgccgtggatcacgttgaccacgccgctgatcttctggctgtcctcggccagcttctggatcatctcggcggtgtcctggacgccctgggacaacccggcaatcgacgcgctgacccggctcaccgcctgctggccggcgccggccaggcggtcggcttcctgcgactggtcacgggtgtcggcggcgtgctgggcgatatggaagaccgtggtggacatctcgttgatcgcggtggcggtctggtcggtctcgctctgctggccgagcatgccctggcgtacctggcccatgctgcgggccagcgcctgggcgccttcgtcgagcttggtagcggccgcggcgacggtgccgacgatgcgctggtagccggcctgcatggcgttgaaggcgctggccatctggccgacttcgtcgcgtccctgcagcggtacgcgagcggacaggtcgccgctcttctcgacgtgcagcatcacgtccttgagggtatgcaggtgggtgaggatgaagcggatcagcagttgcgaggccgccagcagcgccagcatcagcaccagcacggcgacggcgtaggcgccggcacggtcggcgaagacctgccacaggtcgctggccggggcgagcacggcgaagcgctggccggagccggtctggccgacccaggcgccgagcagcggggtatcgccctggcgcgcgccggacaactcgatccaaccctgccccttgcccagcgcctgggcagctgtgccgcccaggctcgcggcctgttccagcggcagcaggttgctgcgggcgggcagggcgctgccggctggccagctctgaaccagctcgccctcggcggcggcggcgcgctgggcggaagcgttgcgcccggcggcttcctgctgcatggcgaacaacaccagcagcagggtggtgaagaaggccaccgcgttgacggcccagaacttgtatttcagtggaatgtcgctgatccaggtgcccatagggggatttcttcttatcggcaagctaatggcaaggcgccattatcttga

SEQ ID NO: 9688 - DNA, 519 bp, Pseudomonas aeruginosa
aagctgagtaaggggcaatcgttgatgcgggtcaacgagaccgttcgtcagcttagcggccgatccgccgggagcttgagggcgatctcagtcgatcgtcggcaggccgaagaacgcccgcgccgcggcgctggtgtgagcggccaggcgctctgcgctctcgccgcgatggcgggccacgcagtcgagcacctcgaccaggtaggccggctcgttgcgcccgttcttcggcttcggtcgcaggctgcgcggcagcaggtagggcgcgtcgctttccagcatgagacggccgaccgggatctcgcctaccagatcatgcaggtgggtgccgcggcgctcgtcgttgatccagccggtgatgccgatgtgcaggtcgaggtcgaggtagccatacagcgcccggcgctcgccggtgaaacaatgtacgacggcggccggcaggcgatcgcggaagtcgcgcaggatcgccagcaggcgctcgctggcgtcgcgttcgtggaggaacaccggacgctgtag

SEQ ID NO: 9689 - DNA, 1482 bp, Pseudomonas aeruginosa
ttgatccggtcccccggagagggacatcgagcctggcctctggagacctggatgacgcgtctgttgctgctttcgctttgcctgctggtgctcgcacccttgccggcggctgcgcgcatcaccggccagccggacaactggcacagggaacagccggagacccgcgacctggcgagcatccgccgcgctggcgtgctcaaggtgctggtcaaccagagccgcaacagctcgggcgaggtgaagggcgagccgatcggcgtcgagtaccgtcgcctgcgcgccttcgagcaatacctcaacagccgttcgccgtccgcgcggaacctcaccctcaagctcatacccaagcccaaggaccagttgcttgccgccctgcagcgtggcgaaggcgacctggtcgcccccggcgaactgctgccggcgcacgacggcctgcaggtcagcccgagcgcgccggtgcgcgccgatgtgccgctggtgctggtggcgcgcaagggcaaccggcgctacacgcgcctggagcagttgtccgggcggaccatcccgctgccggccggcagcgccgccgagggcgccatcgaactggtcaaccagcgcctggcgcaacgccgcatggcaccgatccggatcgaaaagctggacgcttccctggccgtcgaggatgtgatggaaatggtccaggcaggcatcctcggcttcaccgtggtcgagcagcccatcgccgaacgctgggccaaggtgctgccgaagctgcgcgtcgaccgccacctggtgctggacaatcgcgccgacatggcctggtacgtgcgccgcgatgccagcaccctgcgcgcgaccatcgaccgcttcctcgccgatacccgcgcgccggccgaccaggacgtggctttccagcgcgtctaccggcgcgcctacaaggtccgcaaccccctcggcgcggcggaccgcaagcgcctggaagcggtccgtccactgctgcagcgctacgcgcggcagagcagcatggactggctggcgctggcggcggtggcctacaaggagtcgcatctgaacccgaaggcgcgcggttccggcggcgccagcgggctgatgcagatcaccccggcggcggcgcgcagcgtcggggtcggcaatgtgcacgacaaggacagcaacgtgctggccgccagtcgctacctgaccaagatccgcaagcagttcttctccagcaagcacctcgacgaacgcgagcgcctggcgttcaccctggcggcctacaacatggggccggagcgggtacagaacctgcgcacccaggcgcgtcgccgggggctcgatccgaatcgctggttcttccaggtcgagcgggtggctgcggaagagataggcatgggtgtggtgagttatgtcagcagcgtcaacaagtactaccttgcatatgaacgcgaacgggttcgcctggagcccggggtgcgtgcgaagacggcgacggctcaaaaataa

SEQ ID NO: 9690 - DNA, 1335 bp, Pseudomonas aeruginosa
tcgatggcgccggcaagttctcgctggacggcaagctgtcccgctgaaccgggctggcgacgaaaaagggcggacaccttcgggtggccgccctttttcgttgcggcgcgcagcacaggtttccgcctcgccggccacgccagggctgcacccctgagggtagcgttatccgccgaagcgcccttcgccgcgttctcggcgtttccgtgccggtcagcgctgctcggcctggcgcatctgttccagcgcgcccaggcgcaagcgttcctgttcgctgaagcgctcctcggccaggcgttcgaccgccgcgcggcggtcggcttcgctcagcccggtattgccttcgatccggctcttctcggcgaaatagtcgtccagccggcccttccaggccgagcgttgccgatcgagttgctccaggcgggtggtggcttcggcgcccaccagttgctgacgcatctggcggatggcttccgggccggcgccagcggcctggagggcggcggtctgctgctgcagttcgctttgcagttgcggcagcacgctttcctgctggtcttccggcaggctggcgcgcaggcggtcgatggcggcggccttttcctcggcgctgagcttgccgtcctggcggatcgccaggcgctccagggtgaactggttgtaggtttcctcgtcggcgaagaacgccacgtgcgcttcgttgctgaagatccgcgcgcgcagggctttcaccgcggcttcccgctggcgcagggcgtcgaggtcggccaggcgcggcaggtcgcgttcgagcagcaccagttccttcttgtagtcgatgtattgctgcatcagcgccaacgcctggccgcgcgccggctcctggagttcggcggcgatgtaggcgcgcaggcggtccaggctttgctgcaggggctcttcgccgacggcgctgaggaagtagtcgaacaggttgcggatgtcgcgggtgatcagcaggttgccgctggcgtcgacactgaaactgccatcgacgctggtgcccctgaaggaggttggcagcggcgcgaccttggccggcatgacctggggggccggcaccgcttctcccgcggaggctgctggcggggcgcggtctgcgcccgcctgcgggctggccgggggcgccgtctcgggggcgggggaaggttccagccagacgaaccaggccaggctggcggcgaacgccagtggaatcagcaggaggattttcttcacgcgagggggcttccgggaaagggccggggccgaggccccggccggggtcctacaggctggcgttcttcaggcggttggcgtgctggcggtagacgctga

SEQ ID NO: 9691 - DNA, 471 bp, Pseudomonas aeruginosa
cagtctccatgcggcttttctaggatgcgcgtgcgccgatttaaacagcaacttgcggggcgcccggcagcagccgaaataccgctaaagcgctggctcggtgttgcctctcaccgctgtccagcgggaccgaagaggcggagacatgacgtcatgacctgtcccagcacgcaattgcgcctggcacccatcaccaccggcctggtccggcggaacccgaggattctcctcagcggcccgcaccagccgaccctcgtccgttacctcgaaggctggccgaagcgctggaacggttcgcgtaccttccttatccagttcgcccaggacggcaaggacctggcgcgcttccccagcgacgcgttcgacttcgccgtggtccaggcccccgaggcggaagacctggacctggtggtccggcaactgatccgggtcgcccgccagggcctgatcacccgccgtatcctgcgctga

SEQ ID NO: 9692 - DNA, 894 bp, Pseudomonas aeruginosa
ccgcgcggcgccctccggagtgatcagcggggtgccggcggtgcgcggtggacgatagcgactcatggttcgggtggttccacaaatgaacggatgaaagcctgccagtgtatccgatcagccctcgcgcaggacccgcagcgggctgctgttgagggcgcgacgggtgcccagcaggccggcgccgcctaccagcacggcgcccaccagaggcagcgcgagcaaccagggatgcgcttgccacggcaggtcgaagaccagtcggtagagcagcaggctgaccgcctcgcagccgagcgccgcgagcaggccgctgactgcgccgagcagggcgaactcgacccgccgggtacgttgcagcaactcgcgctcggcacccagcgcgcgcagcagggcaccctggcgcacgcgctcgtcgagggtcgcctggagaccggcgaagagcaccacgaagcccgccgcgagaacgaacaccagcacgtactccacggccagggtgacctggtcgaggatgctccgcagctggctcagcagggcgtctaccggcagcagggtgacggtggggaaggcgcgggccagttcgatcaggtcgcgttcctggctggccggcaggtagaagctggtcaggtaggtcaccggcaggtcggtcagggtgccgggctggaagaccatgaagaagttcggctggaaattgtcccacttcaccttgcgcaggctctggacctggacctcgcgattctgcccggcgacgctgaaggtgagccggtcgccgacctggatacgcaggttggcggccagcttctcttccaccgacacgcccggcagggcccccggctgcggcgcgctccaccagcgtccggcggtgagctggttgccggagggcagtcgctctga

SEQ ID NO: 9693 - DNA, 1992 bp, Pseudomonas aeruginosa
ccaggtcaggccgaggtcgcgctgcagggcacgctcgctgcgcacgtcttcgtcgagcgcctggaccggcttgccgttcaccgctaccaggcgcccgggaaccatggggaacagcggctcggcgccgggggagagcttttgcacgcgacgttcgaaggcgtccttttccgtcggcaggatgttcagggcgaaatggttgggggcgtccggcggcaactgggcctgccaggtatccagcagttcgccgcgaagcagggcgatcagggccatagccagcaggatcaggccgaaggccaggctctgtccggcggcggccagcgggtgccgcaacaactggccgagtcccagccgccatggcaggctggcacgcgccagtgcccggcgcaggccgttcaggccgagcagcaggagggcgccgagcaccagcgtggcgaccaggccgccgccgagcagggcgagggtcagcttcaggtcgagactcaaccgccacatgatcaggcccagggcgagcagggcgcaggcgtaggccatccaggtgcgcatcggcaccggcagcaggtcgctgcgcaggacccgcaacggcggtacccggcccagggctgccagcggcgggagggcgaagccggccagcgataccaggccggtggcgaccccggcgaaggcggggaacaggccgccggctggtacgtccggcggcagcagcgtggcgagcaggcggaacaggccgagctgtgccaaccagccgagcagggcgccgatggcgctggcgagcaggcccagcagcaacagttgcagcgcgtagaggagcagggtttcgctgcgcgacagaccgaggcagcgcagcagcgcgctggcgtcgtagcgccgtgcagcgaaacgggcggcggacagggccacggcgacgccggcgagcagcaccgcggccaggctggccaggttcaggtagcgctcggcacggccgagggcatcgcccacctggcggttgccgtcgcgggcatcctgcaggcgctggttggcggcgaggctgcccttgacctgctggcgataggcctggagggcttccggcgggccttcccacagatcgcggtagcgcacccggctgcccggctggaccaccccggtggcatcgaggtcggccaggctcatcatggcgcggggcgtcaggctgtacaagtcgccggcgcggtccggctcgtaggtaaggatgcgcgcgatgcgcagcggcttgcggccgatctcgatgctgtcgccgaccttcaggtcgaggctgaccagcaagcgcgattcgacccatacctcgcccgcctgcggacgaccgccggcctgctcggcggcgaacggcgcggcagcgctcttgagctggccgcgcagggggtagcggtcgccgaccgccttgatgctgctgagctggatgccctggtcggtggcgatcacgctggaaaactcgacgctgtcggcgtggcgcaggcccagacgggtgccgcgttcgatctgttcggcgcttgccggctgggtaccgttgagcaccaggtcggcgccgaggaactcggcggcgcgggcgagcatggcgccgttcaggcgggcgctgaaatagccgatggcggtgctcgaggcgaccgcgatcagcagggcgaagaacagcacgcgcagctcgccgctgcgcgactcgcggaacaattggcgaccggcgaggctcagcaggcgggagaggggcaccggcttcatcagggttcgacccggtcgatcaggcgaccgctttccagacggatcaggcgccggcagcgatgcgccagacgctcgtcgtgggtaaccaggaccagggtggtaccgcgttcgcggttgagttcgaagagcaggtcgctgatccgctcgccggtggcgctgtcgaggttgccggtgggttcgtcggcgaacagcacgtccggctgcgccgcgaaggcacgggcaatggcgacccgttgctgctcgccgccggagagctggcgcggatag

SEQ ID NO: 9694 - DNA, 1062 bp, Pseudomonas aeruginosa
tggcccaggcgttggccgaggccgactcgctcaagcagttctctggcgcgctggcgagcgtcggcgcggccttccagttccaggggcagcatcacgttctccagcgcatcgaggctgtcgagcaactggaacgactggaacacgaagcctacatgggccgcgcggacgcgcgcccgctggtcctcgtcgaggtcgccgagggcgtgcccggcgagacggacctcgccgccgctgggctggtcgagcccggcgagcaggccgagcagggtcgacttgccggagccggagctgccgacgatcgccaggctgtcgccgcgggcgaggtcgagggagaggtcgtggaggatggtcaacttgccttccgcgctaccgacaaccttgctaaggttctgcgcgttgagaatgctggcgctcatggaggttccgatgcgtgcattgctgttgagcggctgcctggccctggtcctgctgacccagcaggccgcggcgcagacgctgttggtcgtgggcgatagtatcagcgccgctttgggactggataccagccagggctgggtcgccctgttgcagaagcgcctcgccgacgaaggttacgactaccgggtggtgaacgcctcgatcagcggcgacacctccgcgggtggcctggcgcgcctgccggcgctgcttgccgaggagaagccggcgctggtggtgatcgagctgggaggcaacgacgggctgcgcggaatggcgccggcgcaattgcaacagaatcttgccagcatggcgcaaaaggcccgggcggaaggggcgaaggtgctgctgctgggtatccagttgccgccgaactacggcccgcgctacatcgaggccttttccaaggtctacggcgcggtcgcggcgcaggaaaagaccgccctggtgccgtttttcctcgaaggggtcggcggggtccaggggatgatgcaggcggatggcatccatccggcgctcgccgcccacccgaaggctcctggaaaatgtctggccgacgctgaaaccgctgctttgagacttccccgggataccgctttcggctaa

SEQ ID NO: 9695 - DNA, 1353 bp, Pseudomonas aeruginosa
ggttgcgcaccctcaggagccccccatgccgcgtcccgcctggaccctctacgcctatcaactgatcgagcccgacgatcagctggacctgttcgcctgtcgcgaggtccgggtgcatgtggtggcgcgtcagctggagctggataccccggcggaccgcacgctttgtggcaagctgctgccggcccagccgcgctggcagccgctggaacgggcgcgtctgcgcgaccggctgctgtgtcccgattgccggaaacaactggaggcggaaaagcgcggggagcgcctgtcctggttggtctgagccctcccggtgaaacctggcggggtgttacactgtctttcctactccttcatcgcactcgccaaggattctccggaatgttgtcgcgcgtacccgttgtctcactgtctttcgccgcgctgctttcggccggctccgcatcggccctggaactgcagctcccgcctccgggcgaggacgtcgtcggccaggtccaggtgatcaaggccaagtacgaggacactttcgccgacctcggcgagcagtacaacctgggctacagcgaaatggtcgccgccaaccccggcgtcgatccctggttgccgggcgtcggcaccgaggtgatcatcccgacccgcttcgtgctgccgcctggcccgcgcgaaggcgtggtgatcaacctggccgagtaccgcctgtactactacccgaaagggcagaacgtggtgcacacctatccgctgggcatcggccgcgagggctggggttcgccgatcgcgaacacccgcatcaccgccaagaccaaggacccggcctggtatccgccggcctcgatccgcgccgagcacgccgccgatggcgatccgctgccgaccgtggtgccgccgggcccggacaatccgctgggaccgtacaagctgaccctgggtgtgccgggctacctgatccatggttcgaacaagaagttcggcatcggcacccgcaccagccatggctgcttccgcatgtacaacgccgacgtgacccacctgttctctatgatcagcgtcggcaccagcgtgcgtatcatcaacgagccctacaagttcggcgtgagcaacggcaaggtctacctggaggcgcatacgccgctgaacgaccatggcgacccgtcggtggtggacaagcacactgcggtgatcaacaccatgctcaagcgcgacgacctggccaagcgtatccagttgaactgggacgtggtccgcgaagtggtggcctcggaggatggcgtgccggtggaaatcgcccaggaatcggcgccggcgatgaccgcgacggtggatagcgatcctacccagcttacgccctga

SEQ ID NO: 9696 - DNA, 882 bp, Pseudomonas aeruginosa
aggccttcgccctgcgaactgccggaggcgcaccggcaggccatgcgcgagcgcaagcggccgtccctgtggctgaacctggagtacctgagtgccgaggaatggatcggcagttgccacgcattgccgtcgctgcaggcgtgcgggctttccaagtacttcttctttcccgggttccgcgagcccagtggcggcctgttgcgcgaggccggcctgctggaacgtcggcgccgtttccaggcctccgtctcggcgcaggatgagtttctcgcctccctcggcgtgcggcggaaggttggcgagcgactgatttcgctgtttgcctacgaaaacccggcgctgcctggttggctggaacaactgcgcgacgcccgccagccgagcctgctgctggtgccggaggggcgggtgctggcggatgtcgccgattggctgcgggtggctaccctggccgtcggggacgtccacgtgcgcgacgcgttgcgggtccaggtgctgccgttcatggcgcaggacgactacgatcgcctgttgtggtgctgcgacctgaacgcggtgcgcggcgaggattccttcgttcgcgcgcagtgggcgggacggccgctgctctggcacatctatagacaggaagaggaggcgcacctggcgaagctcgaggcattcctcgaactctattgcgccggcctgcccgccgacctggcggaaaacctgcgcaccttctggctggcgtggaacgccggcggtggacttgccggggcctgggaggggctggagaggcaactgcccgagtggcgtcgggaagcgcagcgctgggccgacgaacagggcatgcgtccggatcttgcggcaaggctggtgcaattttacgcagattggctatga

SEQ ID NO: 9697 - DNA, 597 bp, Pseudomonas aeruginosa
ttttttgtctttcatccatcggatattcgtatgaaaaccgctcaagagttccgcgccggccaggttgccaacatcaatggcgctccctgggtcatccagaaggccgagttcaacaagtccggccgtaacgctgccgtcgtcaagatgaagctgaagaacctgctgaccggcgccggtaccgagaccgtgttcaaggccgacgacaagctggagccgatcatcctcgatcgcaaggaagtgacctactcctacttcgccgacccgctgtacgtcttcatggacagcgagttcaaccagtacgagatcgagaaagacgatctggaaggcgtgctgaccttcatcgaagacggcatgaccgacatctgcgaagccgtgttctacaacgacaaggtgatctcggtagagctgccgaccaccatcgttcgccagatcgcctacaccgagccggccgtccgcggcgacacctcgggcaaggtgatgaagaccgcgcgcctgaacaacggcgccgagctgcaggtttccgcgttctgcgaaatcggcgactcgatcgagatcgatacccgcaccggcgagtacaagtcccgcgtcaaggcctga

SEQ ID NO: 9698 - DNA, 564 bp, Pseudomonas aeruginosa
tcctttcgtgcgacgagaaaaagcccggcattcgccgggctttttcgtttccgctgtccgccgccgcggcgcggagagtcggaagcttcagaccgacacgttcaggcgtacgtcgatattgccgcgggtagcgttggagtaggggcagacctggtgggcggcggctaccagcgcttcggcggcttcgcgctccaggcccggcaggttgatgtgcagttcgacctccaggccgaagccgccgggaatctggccgatgccgaccttgccggttatcgaggcgtcggcgggaagggtctgcttgcgctggccggcaacgaacttcagggctccgatgaagcaggcggagtagccggcggcgaacagttgttccgggttggtggccgcgccgccctggccgcccagttcgcgcggagtgctgagtttcacgtcgagcacgccgtccgacgataccgcacggccgtcacggcctccggtggcggttgcggttgcggtgtagagagccttgatggtttgcatgagggtcacctgtctgatttgtacgttaagttcttgcgcgctaagtaa

SEQ ID NO: 9699 - DNA, 1131 bp, Pseudomonas aeruginosa
ctggctgtgcgggttgcgcatcagcatgatgctggccgagggcagggcgggcaggccctcgctctcgtcgaggatgcgcaggttgccggtgagcaggctgcgcagttgcacggtcacggcgaggccggcgctgaccaccgcgaacagcgccgacaggctggggctgctgtaggcgatgcggtagtccagttccgccgcctccagggcgttgcaggcccaggcccggcaaaagcaggtggtgttgaacatggccagcgggatcggccgctggtcgtgggggcagaagccctcggcggccatccagacgaagggctcctggcgcagcaactggccgatctcggtgcccggctcgcgggtgacgatggacaggtcgaggtcgttgcgcgccagcaggttgagcgaggtgtcgcaatgcacctcgacctgcaccagcggataggcttcggcgaagcgcgacaggatcgccgggaggaagcgcatcacgtagtcgtccggggtgccgatgcgcaccgagccgaccatgtgcgggcggcgcagggtgttgaacacctcgccgtgcagcttgaggatccgccgggcatagccgagcagcacctggccttcggcggtgaggcgggtctgccttccgtcgcgctcgaacagcgagcgctgcaggacgtcctcttcgagccgcttcatctgcatgctgaccgccgactgggtgcgattcaccgcctccgcggcgcgggtgaaaccaccgtgctcggcgatggcgacgaaggtgcggagcaattccgtatcgatgccgggctggtagctcattcatcaatctccaagatgcattgcataagaatgattcgttggattgatcctatgcctggcgggacactgtgcctatcccgaacggagggcaagacgatgaaaggtcaacaggattatttcggcagtcacttccacgctgcatcccatcccgcctcgaccgctgcgccgtcgttgtggcgtcgctggcggcgctggttgcagttggcccgcgagcgccgggaactgctgaggatgagcgacgaagcgctgaaggacctcggcctgagtcgggcggatatcttccaggagggcgagcggcatttctgggacgacccgctgcgtcggcattga

SEQ ID NO: 9700 - DNA, 750 bp, Pseudomonas aeruginosa
gtggtgagcgaagaacgtctgctggtcgaggagcgcgacgaatacggggtcatccgggtcatcgagtccggcgactatcgcttccttgagttcggcgacggtgtcgagcagagctgcgtgttcatgcccgatccagcctggctggaatacgactacacccgcgccatgctgctcggcgggctctgccattcgcaaccgcgtcgcgcgttgttcctcggtttcggcgccggcagcctgacccaggcctgcctgcgccacctgccgctggaggaggccgaggccatcgagctgcgcccggcgattccgcgcctggcccgcgagcatctggggctgcgcgacgacccgcgcctgcgattgcgcatcggcgacgcactggagagcctgggcgaatgcgcggaggccgacctgatcttcctcgacctctataccgataccggcccgtcggccgcgcacctggcctggaatttcctcggtgcctgccaggagcgcctcgccgaggatggctggctggtgatcaaccagtggagcggcaccgatggcaagccgctgggcgcgccgctgctgcgcgggcgctatcaccatcattactgggagtgtccggtggccgagggcaacgtggtgatgctggtgccggcgaacctggccctcgaactcgaccaggaagccctgcggacgcgtgccgcggcgctggagccgcaactcggctattcgttgcagggctatatcgacagcctgcgcccggcccagtag

SEQ ID NO: 9701 - DNA, 1785 bp, Pseudomonas aeruginosa
ttcaaaagcaatctcgcaaatccccgccccagctgcctgggtggccgtttcggccgtacagggcatgagcagccatgggtcatgggtctttgcggatgtatacgaggcaaacccatgactcaggaaaccgtcggcttcgccgcgctcggtattcaccccaatgtgctcgcggcaatcgtcgccgtaggctacgaagagccttcgcctatccaggctcaatcgattccgctgatcctcgaaggccacgacatgatcggccaggcgcagaccggtaccggcaagaccgccgcgttcgccctgccgctgctgtcgcgcatcgacccgagccgccgcgagccgcagatgctggtgctggtgccgacccgcgagctggccctgcaggtcgccaccgcctgcgaaacctattccaagcaattgccgggcgtcggcgtggtcgccgtctacggcggcgcgcccatggggccgcagctgaaggccctgcgccagggcgcacagatcctcgtcgctacccccggccgcctgtgcgaccacctgcgccgcgacgagaagctgctggccaccgtccagcgcctggtgctcgacgaagccgacgagatgctcaagctcggcttcatggacgacctggaagtgatcttcgaggcgcttcccgaatcgcgccagaccgtgctcttctcggcgaccctgccggcgtccatccgtggcatcgccgagcgccacctgaagcagcccaagcacgtcaagatcgccgccaagacccagaccgtggcgcgcatcgagcaggtccacctgatggtccatgccgaccagaaggccggttcgatccagcgcctgctggaagtcgagcagttcgacgcgctgatcgccttcgtccgcaccaagcaggccaccctcgactacgccgaattactcgagcgccagggctaccgcgccgccgcgctcaacggcgacatgccgcaggcccagcgcgagcgggtcatcgagtcgctgaaggacggttcgctggacatcgtcatcgccaccgacgttgccgcccggggcctggacgtaccgcgcatcacccacgtgctgaacatcgacatgccctacgaccccgagtcctacgtgcaccgcatcggccgtaccggccgtgccggccgggaagggcgcgcgctgttgctggtgactccgcgcgagcggcgcatgctgcaggtgatcgagcgggtcaccgggcagaaggtcggcgaagtccgcctgccggatgccgagaccgtactggaggcccgcctggcgcgcctggccgcgagcctgacgcccttgctcgacagcgccgtcgagcagcgcggcgcggtgcgcgacgagctgtgccgtcgcctcggctgcgatgccgagaccctggccgccgcattgctggcacgcctgaccgccggcaaggcgctggacctggagtcggtgcgccgcgaacagccgctgaccccatcggcaccgcgcgagcgtgccgaccgtggcgaacgcggcgagcgtccggagcgcagcggcgagcgtcgtccgatggcgccgccgagcgaaggccgtgcccgctgccgcactgccctcggcgcgcgcgacggggttgcggcgaagaacctgctgggcgcgatcctcaacgagggcggcctgtcccgcgaggacatcggtcgcatccagattcgcgataccttcagcctgatcgagctgcccgaggccaatctcgagcgcctgctgaccaagctcaaggacacccgcgtcgccggcaaggccctgcgcctgcgccgctatcgcgaggactga

SEQ ID NO: 9702 - DNA, 402 bp, Pseudomonas aeruginosa
tgctgccggaaccgatcagcagcacgccttccccgcgcagttggcgcagggcctggccgacgcggctctgcagggccggaccgaggcggctcggcagggacagctggagcaccgggatgtccgcctgcgggtacatcaggctcagcggcacccaggtgccgtggtcgaatggtcgctgtgggtcggcctgggccggcaggccggcggcctggagcagttcgatcgtccgctgcgccagcgccggctcgcctttggccgggtagcgcacggcgtagaggggcggcggaaagccgtagaagtcgtgccagatatccggcgccgcggcgccggttactcgcaggtcgtcgctttcccagtgcgcggaaaccaccaggatcgccttcggccgcggcagctctgtag

SEQ ID NO: 9703 - DNA, 1023 bp, Pseudomonas aeruginosa
gcaggagcggagtgcctttcattgctgggcaacctcggcggagcgggtgccggtcgcggtgtcgatccgtgcttccaccgacatgcccacacgcaacttgcccgccatggcctggcgcggctcgagaacgatcttcaccgggatccgctggaccaccttggtgaagttgccggtggcgttgtccggggcgatcggcgcgaagctcaggccggtggccggtgcgatgctgtcgacatggccgcgcagaacctcgccggggaaggtatcgacgcggatttccacggcctgtccgggagagacgtgggtcagttgggtttcctggaaattgccgaccacgtaggcctgctgcaggggcaccaccgccagcagcgcgctgcccggcgtgacataggcgccgacgcgcagttggcggcggccgacctggccgtcgaagggcgcgcggagttcgcagtaggagaggtccaggcgggcctggtcgcgtcgcgcctgcatgcgttgcaggtcgccacgggcctggccgacgcgggcttcgaggacgctcacctgcttgcgcgtggcatccactgcggcctggccctcggccagccgggcgctggcggtatcgatccgcgattgcgcctgctgggcgttctgcaggctgccggcgcccttgctggcgagggtctggtagcggctttgctcgtgacgggcgaagaccagctcggcctgctcggcgcggaccttggcccgcgcctgttcgatcagcgcctgctggcgttgcaggttggcctcggcattggccaggttggcctcggcaccgagcacgtcggcttcggcggcggccagggcggtgcggaagtcgcggtcgtcgaggcgggcgagcaactggccggccttgaccggctggttgtcctcgaccagaacgtcctggacgaagccggcgactttcggcgcgaccagggtgaaatcggcgtgcacataggcgtcgtcggtgctctgcacgacccgtggggcgagcaggtggaacagcaggtagaccagtag

SEQ ID NO: 9704 - DNA, 771 bp, Pseudomonas aeruginosa
gggcgaccaggagattcagatcgggaagatgcatggagtggaagtataagcacgctggcatgcgcagggtgcagtctttcgttctcccaggcgtgcgttcgctgcattgctggattgcgttcgcggtgcctttacgcgcaccggtggctgccgaagaatgccggtgcacgctctatccgaggatttgccgatgttccatacgctcctggtcgccatcgacggcggcccgcagacccgtcgcattgccgagctggcgcggcaggccgccgcgccgggcgcgcgggtccacctgctgtgcgcggtggacgccggctatgcgttgccgggccggccgacgctgctcgactatccgcccgccgcgcacgagtgcgaagaggcccggcaggtgctcgacgaggcttgtgcgctgctagccgggtgcgagctggaggtacgggccgagctgcgtgccggcgacccggtgcaggtgatcctgggcgaggcgcggcgcctgggctgcgagctgatcatcatcggccatcggcacctgggacggctggagcgcctgctcgatccttcggtcggcgaccgggtgatccgcgaggcgccgtgtccggtgctggtggaagtgcgcgagggagatgcgcaggggagttgacctgccggccgattgtcgccaccttgcggtttttcccacgaatgcggaggacaggatgcaggcggatttttggcacgcccgctgggcgaacaaccagatcggcttccacctggacgagatcaatccctacctga

SEQ ID NO: 9705 - DNA, 1881 bp, Pseudomonas aeruginosa
tcgccctgccgccggagatgcgcgagcgctatgccgggcatctccaggcggtcctgccgacgcgcagcctcggcttgctggtcaccatcgactacccgcaggcggagatggccggtccgccgttcgccgtgcccgacgaggaggtgcgtggctactacgctggcggttggcggatcgaggaactggagcgcggcgacgtgctcggcgtcaactggaaattcctcgagcgcggggtgtcctggctggacgaggccgtctacctgctggagagaggctgaaacggggcgccgcgcggcgccccgtccattttcagcggagttcgtcgaccagcaccgcaagggtgctcaggacgtcctggccgagccgcttggagcgggcgccggaccagccggtcccgggctccgggttgtcgtcgtggtccttgaacggcatctcgatggtgaacgccaggcagtcgtaggtctgcccgacgaagttgcaggccagcgccaggttggcctggcccggcgcagtgcgtgggtacccatggcggatctggaattcgccgcgcgccatcagttcctcgcggaagcgttgctcgagccgttccaggcggggcgtatagcccgggttgccctcgcagccggcggcgaatacgtgggggatttcctcgtcgccgtggatgtcgaggaacaggtcgacgccatggcgcttcatctcctgctggacgaaccagacttccgggctgcgctcggcgctcggctccagccaggcccggttgagatcctggccggcggcgttggtgcgcaggttgccgtggaacgcgccgtccgggttcatgttcggcaccaggtacaggtcggccttttccagcaggcgctgcatttccgtatcgtccggccgctgcaggcgctcgatcaggccttccatgaaccattcggccatgtgttcgccgggatgctgctgggcgatgacccacagcttcaggtggctgtcgggatggcgcctgacccgcagcaattcgatgtcgcggccttgcacgctggtgccgacggcgagccgttcgacgccctcgatgccgagcgcacgttcgaccaggcgggcatgccgttcgcggctgtagggctcgaagtaggcgaagcggacttcgctttcctccggttccagctggaaatgcaggccgtcggcgtcgtattgcgacggcacgcggaaccagcgttcgccatcgtacgaggcgactgcctggtagccgctccaggcatggctgtaggccgactggccggcgttgaccagggtgaagcggtgctcggtggcgggagccatgccctcgaccttgaagtggaaccactggaaatgctggctggccaggtcgggacggatcgccaggcggatccggcggggatcgctggcatcgatgacctggatgttgccgctgtcgaaatcggcgcggatctgcatgggaacctcatcgggcgaaatcacggacccgcatgttccggggctggctcgcggctgtcaaagcgaccatggataggtggctttcccgggcataaaaaaagggcgaccgatggtcgccctgtcccaagtgtgaaagcggatcagcgtgcgctggcgcgcagcgcttcgatacgatcttccagcggcgggtggctcatcagcaggccggccaggccgtgcttgaggccgccattgatgccgaaggcgttcagggtgtcgggcatctgcaccggcacgccctgttccgaacgcaggcgttgcagcgcggcgatcatcgcgccggtgccggccaggtgggcgccggcggcgtcggcgcggaactcgcggcggcgcgagaaccacatgacgatgatgctggcgaggatgccgagcaccagttcggcgaagatggtcgcgacgaagtag

SEQ ID NO: 9706 - DNA, 465 bp, Pseudomonas aeruginosa
gaaggccttttcgctgagcaccgcctggtcgagagcctcgtaatgaatggtgttggcgaagcgcaggtagccttcctcggcgagccagagcaacgcgcccagacaactttggtgacgtttgctcggcaggccgaactcgtccggcgcctcgcggccgatcaggtcttcgacgtagagcgcggtcttgcgcggaaacgcctggtagagaagcaggaggccgccagcggcgtccttgtggaagtcgtcgatctgcaggtccatggatgggtcgccgggcagggcggcgccagcggcgccgcgggagcgggggggttactgctggtagcccttgaggaagctgccgatgcgcaggatcgcctgctccaggtcgtcgacgcggggcagggtgaccacccggaagtggtcgggccacggccagttgaaggcggtgccctggacgatcagcagtttttccgagagcagtag

SEQ ID NO: 9707 - DNA, 981 bp, Pseudomonas aeruginosa
gtcgaggacgaacttttcgtcgttgtggatcgggcagaccttcgggtcgatccgcgggaaggcgtacagcgcgcccatcggcttcacgcagctgacgccggggatgtcgttgagcagttcccaggcgcggttgcgctgctccagcaggcgccccggcggcaggaccagatcgttgatgctctggtagccgcccagggcggtctggatcgcgtgctgcgccgggacgttggcgcacaggcgcatgttggcgaggatgtcgagaccttcgatatagctctgtgcccgctgcttgggcccggagatcgccacccagccggagcggaagccggccacccggtaggatttggacaggccgttgaaggtcaggcagagcacgtccggcgccagcgaggcggtggagacgtggacggcgccgtcgtagaggatcttgtcgtagatctcgtcggagaacagcaccaggttgtgctggcgggccagttcgaccatgccttccagcacttccctggaatacaccgcgccggtggggttgttcgggttgatgatcaccatcgccctggtgttcggcgtgatcttcgccttgatgtcttccaggtccggccaccagttggcctgctcgtcgcacaggtagtgcaccgccttgccgccggcgaggctgaccgcggcggtccacagcgggtagtcgggagcggggatcagcacctcgtcgccgttgttcagcagcgcctgcatggacatcacgatcagttccgacacgccgttgccgaggtagatgtcctcgatgccaacgccttccacctgcttctgctggtaatactgcatcactgccttgcgcgcgctgaacaggcccttggagtcgctgtagccctgggcggtcggcaggttgcggatgacgtcctggagaatttcctcgggagcttcgaaaccgaacggcgccgggttgccgatattcagcttgaggatgcggtgaccctcttcctctag

SEQ ID NO: 9708 - DNA, 336 bp, Pseudomonas aeruginosa
aaaatgaagttattcagacattacatcatcgcactagcaattatcgctcctgctcccgcctttgctgacggctcgacggatcgactttatggtgaaacgctgcaagcaaatgaagcttccacgcgtgcatatgccttgaatgcaggaaagaatccgcctcccgtcgtccattatcgctacggaatgacgcttgatatcgctaaggtcatcggccttacacccacatatggaaagtgcggaataatgccggcgcagatgtcttatgtggactcgaaaggagaaatcaacatactcgaatatcgcacttcggggagcagctgtcgaaacgagaactga

SEQ ID NO: 9709 - DNA, 711 bp, Pseudomonas aeruginosa
ctcgtttgccgcagtcaaccatgtctgcgcttcatcgtcgaaggcccgcatgtcgttcaggcggccgaacggcgaaatccggacgccgacccgttgcgcgccaatcgcctcggccaaggcgtccaccgtatcgagcaaaaagcgcaaccggttggcgatcgagccaccgtagcgatccaggcgcgtgttcagctcgccattgatgaactgctcgaacaggtagccgttggctgcgtgcagctcaatgccgtcgaagcccgccgtgatcgcgcccctggcggcagccacgatgtcgcgcgtgacccgcggcacctcatcctcggccaaggcgcgcggggcgcttgccggcacctggccggccaggccttgcacgatccaggcgtaagcctgcgaattctctgctcgccgggcgacggaagacacgggagacgcgcctgcctcctgcagcgagacgtgcgagatgcgtccaacatgccagagctgggcgaagatgcggccgccggcctcgtgcaccgcgttggtcaccagccgccagcccgcgacctgctgctccgtatacaagccaggcgtgaacaagtagcccatgccctcgcgcgagaccggaaccccttcgctgacgatcaggccggccgatgcgcgctggcggtaataggtcaccgtcgccgcatccggtacgtcgttgaccgcgcgcgcgcgtcatcggtgccatga

SEQ ID NO: 9710 - DNA, 1146 bp, Pseudomonas aeruginosa
ttcccgtttggtgaagagcgggtggaggtcgccacccaggcgttgctgccagtcgagcagcacccgttcgctctgcagggtgaccgcgttggcgaacaggcggccgccgggccgcaggcgctcccagcaggtttccagcacgccctcggcggtgactccgccgccgatgaaaatggcgtccggctcgggcagttccagcagcgcctccggggcgctgccggcgaccaggtgcagggtcggtacgccgagggcgtcgcggttgtggcggatatgttcctggcgctcgtcgttggcttcgatggcgatcgcccggcaactggggtgcgcgcgcatccattcgatgccgatggagccgcaaccggcgccgacgtcccagagcagctcgccggggcagggcgccaggcgcgccagggtcacggcgcggacgtcgcgcttggtcaactggccgtcgtggcgataggcttcgtcggccaggcccggggtcagcggcaggcgcacggcgccggcgccggcgcggcattccaccgccaccaggttgagatcggcggcgcgcggcagcgaccagtcgccggcgaggccgtcgagacggcgctcgagcggcccgccgaggtgttccagcacgctcaggcgactggcgccgaagccacgggcgttcaacaggcgggcgatggcggccgggctgtcgccgtcgttgctgaggaccagcaggcgccggccgtcgtggacctgtgcctgcagcgccgccagcgggcgcgccaccagcgacaggcaggcgacctcctgcagggcccagccgaggcgggcggcggccagcgagagggaggagggcgccggcaggacccgcagttcggtcgccggcagttgccgggcgagactggcgccgacgccgaacagcatcgggtcgccgctggccagcacgcaggtcggctggccgcgccgggccagcaatggttccagggagaacggcgtcggccaggtttcgcgggcggcgccgatgcacggcggcagcagttccagctggcgcgccgcgccgacgatccggctggcttgcagcagggcacgccgggcctgcttgccgaggccgggataaccgtcctcgccgatgcccaccagggtcagccagggcggcgtcgagtctgccgatga

SEQ ID NO: 9711 - DNA, 1671 bp, Pseudomonas aeruginosa
cgcggggccaacgagggccgaagagggaacacggagccgcggtcttttcgaagcccgggcctagccgtggctgcccccgcaactgtatgcagcctgtattcgcgccattcgccactggattaccgggaaggcggcgcgaagcggaggttcctcccccgggtggaacgccgggctgcgagccaggagacctgccgccgaaaccagtcgcgagtgccaacatcgggcggggtgtaccgatgccgtggtctgtccctgggggacagcggtgcggtcgccgcgacgccgattcgagtagcgtttttgaacgacgaccagaccccggcgcccctgcccgtaccacgtccgtcgccctgtcccggcctgctgcgtatcgtccaggcgctggacggcggcatctgccgcatcaagctcgacgccggccgcctggacgccgcccaggcacgcgccgtggcggccgcggcgcgggattgcgccagcggcgtgatcgaggcgaccaaccgttccaacctgcaattgcgcggcgtccgtcgcggcgaggaagagcggcttgtccgccgcctgctggacgccggcctcggtccccggcatgggtccctggccggcgccgacgacgtgcgcaaccttatgctcagcccggccgccgggctcgatccgcacctgtcgctggacgtgcgcccgctggccgctcggctgttgctgcggctccaggcggacagccgctaccacgcgctgtcggccaagttcgccatccagctggacggcggcgaagacctggcgatgctcgaacatccccatgacatctggctctcgccgatgcccgcggcgccgaccgcgacgctggtcttcggactcgccggctgcccggcccgcgaccgccccctggcggcgttgccggcggagcggggcgagtccctggtgctggcgctgctcgacctgttcctcgagcgcgcccagccgcaacagacggcgaatgcgccacctgttgcaggagctggccggagaaccttgctggaggccttgcaggcgcgcctggatttccctctgcggcgtgacgagcgggtggcggcctggcggcgttcgccggggcgtccgtggagtcatctcggcgtccagccgcaacgccagccgggcctggtgatggtcggcgcggcggcgccgctcggccggctcgacagcgcttgcctggaaggcctggccgagctggtcgaacgccatggcgacggcagcctgcgcctgaccccctggcaaggcgtgctcctgccgaacctggcgcacgccgaggccgaccaggcgctgctcggcctgcgcggactcggcctgctgaccgagcccgatgcgccgttggcgcggctgatcgcctgcagcggttccagcgcctgcgccagaggcctggccgacaccaagggcgacgccttgcgcctggccgaacgcctcggcccgcgcagcgacctgccgcaactgcacctgtgcggctgcgaacggtcctgcgccgctgcccaccgcgcgccgctcaccctgctggcgcgcagcggcgggttctacgacctgtaccggcacgacccatgccaccccggattcggccagttgctggccagccgcctgactttcgccacggccgccgactacctggcggccctgccttcccagcccacttccggaaaacccgcatga

SEQ ID NO: 9712 - DNA, 843 bp, Pseudomonas aeruginosa
ccgcggggtgccttacgtgatcgtccgcggtcgccgtggcggcagcgccatggccgccgcggcggtgaacgccctggccacggagcgcgaatgatgagtgtcgtgaagggccgcctgctgggcctgggcgtcgggcccggcgatcccgaactgatcaccctcaaggccctgcgcctgctgcgcgcggcgccggtggtcggctatttcgtggccaagggcaagaagggcaacgccttcggcatcatcgaggcgcacctggaccaggcccaggtgcgcctgccgctggtctatccggtgaccaccgagaagctggaaccgccgctgtgctacgagaccatcatcagcgatttctacgacaccgccgccgaacagctggccgcgcacctggacgccggccgcgacgtggcggtgatctgcgagggcgacccgttcttctacggttcctacatgtacctgcacgaccgcctggcgacgcgctacgaaagcgaagtggtgcctggcgtctgctcgatgctcggcggcgcggcggtgctcggtgcgccgctggtgtaccgcaaccagagcctctcggtgctctccggagtgctgcccgaggaggagttgcgccggcgcctggcggatgccgacgcggcggtggtgatgaagctcggccgcaatttcgacaaggtccgccgcgtgctggtcgagcttggcctcgagcgccgcgcgctgtacgtcgagcgggcgaccatggccaaccagcggatcgtgccgttggaacgggtggagccgatggcctcgccgtacttctcgctgatcgtcgtccccggcgacaagtggcagggaggggccggcggtgagtga

SEQ ID NO: 9713 - DNA, 1239 bp, Pseudomonas aeruginosa
cgcggtggtgccgctgctcggcgggctggccggggtcaaccggctggcgcgggaaatcggcgaggtgctggccgtggcgccggcgatcaccaccagcggcgagctgcgcttcggcacctgcgtgctcaacccgcccgccggttatgtcctggccgacctggagcagggcaagcgcttcgttgccgatttgctcggtggccagccggtgcgcgtcgagggtgccgccgactggctcgacgcggcccgtttgccgcgcgacccggaggcagcgctggcgattcacgtgacgccctcggcgcgtgcgccgcgggccgaggaactgctgatccatccgcgctgcgtgctggcggcgctcgaacctgccgacgcggcggcggacgcggtgcgccaggcgctggtcgatgccggcctggccgcggcggcgctcggcggcttgctggccgacagcgcgcggatggccgatccgcgcctgcaggccgccgccgatgcgctcggcgtaccgctgcgcttcctgccgcaggccgatcccgctgcgcgcctgcgccaggccttgcccgccgccgagcaggtcggcgaccggctggcggtggccgccgcgcccttggcgatggaccgcatcggccagcgtcgcggccgactcacagtgatcggcctggggcccggctgcgccgagctgatggtgcctgcggcgcggcgggcactggacgaggccgaggacatcctcggttaccagacctacgtcgacatggccggacccttccgcgccggacaggtgctgcatggcagcgacaaccgcgaggaattgcagcgcgcccggcatgccttcgaactggcggcgacgggcagggcggtggtgctggtatcgtccggcgaccccggcgtgttcgccatggccgccgcggtgctggaagccctgcatggcgctggcgagccggcctgggacgcggtcgagctgcggatcttccctggcgtctcggcggccctggccaccgcggccagggcgggggcgcctctgggccacgatttctgcgtgctgtcgctgtccgacaacctcaagccctgggaggtgatcgagcggcgcctggacctggccggcgccgccgacctggcgatggctttctacaatccgatctcgcgggcgcggccctggcaactgggacgggcgctggagatcgtcgcccgccatcgttcgccgcagaccctggtggtgctcggtcgcgacatcgggcggcccggtga

SEQ ID NO: 9714 - DNA, 363 bp, Pseudomonas aeruginosa
cttgtgagcattcgatggatgatggccgcaggcctcgccgcgctgaccctgagcggttgtgcgagcaacgacccggctccgctggagcagatgcgcctgaccgaacaggcgctggagcaggccaaggcggtgggtgccaccgacgacgtggccgagctgaaactggcccaggacaagtacgccgcggcgcagatcgcgatgaccgcggagtcctacaagaaggcgcgcctgttggccgagcaggccgagctggacgcacgcctcgccgagtccaaggtgctgacgcagaagagcaaggaccagctcggcgagctggacaagagcctgaaacgtctgcgcaagcaactgggggagaccgactga

SEQ ID NO: 9715 - DNA, 648 bp, Pseudomonas aeruginosa
agaggcgcaatgagttcgaacgaaaccctgccggggctggtgatcgccgattccttcccggtcatgcagtgggcgctgcagcgctacctcagcgaggagtgcggacgccaggtgctggcggtgatcggcgatagcgacagcctggtggagcgcctggccgacctgccgccggaaagcatcctgatcaccgagctgggcttgcctggccagcgcagccgcgacggtatccacctggtggaatggctgacccggcactgcccgcaaatgaaggtgatggtctactcggtgttcagcgcgccgttgctggccaaggcggtcctgcgcagcggcgcctcggcctacatcagcaagcgcagcccgctggagacgttgaaggcggcgctggagtgcatggcgctcggacagaccttcctcgaccccggcctgcacccgcagcggcataccggcaagccgctgagccccaccgaggtggacatcctccggcgcctggcgcgtggcgacacggtcagcgagatcgcccagcggaccatgcgcagcgtgtcgaccatcagcacccacaagaagaacgcgatggtcaagataggcctcaacagtgacgccgaactgatcgccctgggcgtgatgaactggctccacgaactcgcctga

SEQ ID NO: 9716 - DNA, 1797 bp, Pseudomonas aeruginosa
tttttccccggccgcccgccagcccgccgccgtcccggactaccgcctgttcggcgatctcggcctggcgccaagccccttcgcctggcaagcgttgaccggcgagagcgcggcggcggacgcgttgcgtttctgactttccctatggccgctccccaggcggctcttggcggactgtttcccgcccgcacccggccggtggcgaccgaccgggttttcttttcctcgcgaacgcgccgtctctgcgaccgacccgtacagttttgcgactgtatgcctggttgtcggccgaactgttctggagcagtttcacgaattgagctactgtttcggttcaatcgccgaggaaaacccgccatgaccaatctgctgctttaccaacgcatcgcccagcagttggccgaggacattcgccgtggcgtctaccagccgggcgagcgggtaccgtcggtgcgcaagctcagtacccagttgaacgtcagccacgccaccgtgctgcaggcgtacgccaccctcgaggaccagggactgatccgcgcccgtccgcaatccggcttctacgtccaccgcaccccggcgctgaccgcgccgaccccggatatcgcgcgggtcgagcgtcccggcctggtcacccgcagcagcatcatcaaccaggtgctcgccgagtcccgccgcgaaggggtattcccgctcggcgcggcggtgccgcacgtggactacctgccggtgcgcgccttgcaccagcaactggccaaggtcacccgcttccagagcccccgggcgttcagctacatgttcagccccggtttcgagccgctgcggcggcaggtggcgatccgcatgcgcgacgccggcgtggtggtcgacccgtcgcaggtgaccatcacccacggctgcgtggatgcgatccacatggccctgcgggtgctgacccgtcccggcgacctgatcgccaccgagtcgccgagctactacggcctgctgcaactcgccgacgtgctgggcctgaaggtcatcgagatccccagcgacccgcgcaccgggatcagccttgaagcgctgcaactggcggccaaccagtggtcgatcaaggccttggtgctgaccgcgcggctgagcaatcccttcggcgggacgattcccgaggatcgccagaagcaactgctgaaactgaccgccgaacacaacatcggggtggtcgaggacgacatctacggcgaactgatgttcgaccagggccaggcgcgctcgctcaagtcccacgaccgcgacggccgggtgatctactgctcgagtttctccaagaccatctcgcccggcgtacgcatcggctggatcatcgccgagcgctaccaggaggagatccgtcgcttgcagaccttcaccacccattcggcctgcaccgtgacccagatgggcgtcgccgcctacctggagaacggcggctacgaccgccacctgcgctacatccgccaggagtaccggaagaacatgaccgcctaccagttggcggtgcagcagtacttcccggaaggtacgcagatgacccggcccaagggcggcttcatcctctgggtcagcctgccggccaaggtcaacaccaaggaactccacgtgcgggccctggagcagggcatcagcatcgccccggggctgatcttcagcaacaccgagcagttcaacaactgcctgcggctgacctgcgggattccctggaaccgcgaggcggagcgggcgatcatgaccctcggcatgcttgccgggcagctttgccaggaaggccttatcgccgcctga

SEQ ID NO: 9717 - DNA, 1371 bp, Pseudomonas aeruginosa
cacaggacaggagtcgaccagcggcatgcatgcctccaccagcgccacgacggccgccggcagcgacgaaacgctgctggcgcgttaccgcaagggcgacagcgcggccttcgaggtgctctaccagcgccatcggcaaggtctctaccgttttctctgcggcctggccggacagaccgaactggccgacgagatctaccaggaaacctggctcagcctgatccgcagcgagagccagccgcagggccgggcgagcttccgcacctggctctaccagatcgcccgcaaccgcttgatcgatcattggcgcaagcatggccagcgccagccgttgcaggacagctacgacgaacagttgcacgcgcaacccgaccagggcgccggccccgagcagcagctcagcctgagccgcgacggcgagcgcttgcagagcgcgctggagaccctgcccgaggaacagcgcgaggtattcctgatgcgcgcccacggcgaactggaactggccgagatcgccacgctcacccagtcgccgctggagacggtgaagagccgtttccgctacgcggtgcagaagctgcgccggctgctggccgaggaggtggcggtatgaacccacagaagcattccgcgagcgtcgccgaagagcagatgctggcgcatttccgcgcccacgcgccgcagcagccggcgccggcgctggaccaggcgatcctcgccgccgcgcgacgccaggcggcgcatgtcgaacccgcccggtcctggtggcggcgctggctggaagcctcccgcaggccgcgttggcaggcggctttcgccagcctgctgggcgtggcgctggtgctggggctggtcagccaaaacgtgctggacgacgccgagcgccaggcccgccccgaagtggcgttcagcgatgtgcccctgcgcgacggagtcgccggggccgctgcggcgaagcgggccatgcgcgcgccggcggcgccggctccgctgtccggcgagatgtcggagcccccggccttgctggccagctacgcatcgtccggggaggcgccgcaactgatggccgaggccgcgccgccggctccggctgccctggccgaccgaccgccggcccaggccgcgcagcaggcgaaggtccaggcggcgctggccggcgacttcgtcgcccaggccaggggcaaggcggttgcggtgaagccggaggtgctcgacgaggcgctcggggcggtccttgccctgcgtgagcagggcaagacggagcaggccgcgacccagttggccgagctgcagaaacgtttccccggagagaacctggtggaacgactggaacgcctcgcgacgatagccgcgagcgccaagaaacggccgtga

SEQ ID NO: 9718 - DNA, 696 bp, Pseudomonas aeruginosa
acatggggcgaacaacagagagagtgccaggatgacgatagtgaccccttgccttggttgcagtctgccgtcagcattgccgcaattggccatacctgcgtgactatgaaacgtctttgccgaatttgcgtcgttgttcttttcggttgcttcctggcggcctgcgatgacggctccaaggcaccggaaaagaaagccccggaagcaccgccgcaggagcagcgcgcccctgccaagccagtgaagcctgcacgagcggagccagcgcctgccgtgcctgccgcgccgaaaacagcttcgaagaaggtcgcgccagccgcggagcaggttgccgaacccaagccgccggccaagccgaagcctgcggctgcgccgccgaagccggccagcaggccggtcgccaaggacaagccggcgccggcgaagcgcgcttccaccgctcgtctcgaccccgaggtacgcaagccgctgccgagcgccaagctggacctgcgcctgccgaaggaactggtgcagaagatggcgccgcccggcacggaagagacccataagcccaagccgctgttgccgccgatgttcgaggaaaaggacgacagcgacttccgcctcaacggccagttgctctatcgcgaccgcgaactgggcgtgtcgcggcccctggaaggggccgagttgcagttcgagttccgccagtag

SEQ ID NO: 9719 - DNA, 867 bp, Pseudomonas aeruginosa
cccggaagcccgccccagagcgccgcgcgcctttcgtcggagacctcagtcgaggaacaggtcgggcaccagcgcgccaccctccgggtcgtagcggtactgctcgaaatcgctctggccgcgctcgcgcagcaattcctcgtcgaccagcaggcgcccgctgaggctgcgcccctcgctggtgagaatggcgtgcgcggcgtcggccatgatcgccggggtgcgcgcgcggcggaaggcgtcacggctgcccagctcgaactcgatggcggcggtggcgatcatggtcttcggccacagcgcgttgacgctgatggcgtatttcccgaactcctcgtgcatccccagggtaagcatgctcatgccgtacttggtgaccgtgtaggggccgtgctgggcgaaccacctgccggccaggttgatcggcggcgacaggctgaggatgtggccgttggcgctcctgcgcaggtagggcagggcggcctggctgcagaccagcaccgcgcgggtgttgatctggtacatcaggtcgaagcgcttgggctccagcttctccaccccgaccaggcggatcgccccggcgttgttgaccagcgcgtcgatcccgccgaagcgttcggcggcgcgggccatggccgccgccacggcctgctcgtcgcgcacgtcgagttgcagcggcagggcctggccgccggcggcctcgacctcggcggcgacgctgaagatggtgccttccagcttcggatgcggctcggcgctcttcgccgcgatcaccaggttggcgccatcgcgcgcggcgcgcagggctatctcccggccgatgccgcggctggcgccggtgatgaacagggtcttgccgtgcagtga

SEQ ID NO: 9720 - DNA, 3006 bp, Pseudomonas aeruginosa
catgggcgtctccgttttcttgtcgttgtcgttgcggatgagcggcggggtgtctcaggcgtcggcttccacctcgaccagcacctgccggttgcgcacctgctcgccacggccgacctggacgcggcggaccacgccgtcgactccggccttcagcgggtgttccatcttcattgcctccagcaccagcagcagttggcccttgccgacccgttcgccctcgccgaccagcacctcgacgatggcgccgtccatcggcgccttgagcgtgccggaactggcgccgacctgggcgctggcgccggcgtgggtgacctctaccagttcgaggttgccgccgtggccgtatacccagaggcgcccgccgtccacgtggtacgcgtggcggcggcgaatgccgtcgagttcggcgctggcccagcgtccgtcgcagtcgagcaggcgcacggcgatctcgcgtcgctccaggcgcgccagcagtcgcggccggcgaccgctttcgaggacgtccaggccgatctccacgcgctgttcggcgtgcttcaggacgatcttccacggtgccccggcggcgctgcgccagccggccaggccgggctggtgcgcactggcctcggcgccggcctggtagagcagggcggcggccagggccagttcctcggcgcccggctggcgcggttgcaggctggggtcttcggcgaagcgttcgccgatgaaggcggtggtcgcctcgccggcggcgaagtccggatgcgccaggaggttggcgaggaaccgctggttgccgtcgacccccagcagcacgcagcgctccagcgcgcggatcagcttgcgccgggcttcgtcgcgggtcgccccgtaggcgatcagcttggccagcatcgggtcgtagaagggcgtcaccgcctgcccctcgaccaggccatggtcgatgcgtacgccgggcagcagttccgggtcccagcgcagcaccgtgccggtctgcggcaggaagccgcgaccggcgtcctcggcgtagaggcggacctcgatggcatgcccgcgcagttccacctgttcctgccgcagcggcagcggatggccctcggcgacgcggatctgccaggccaccaggtcctggccggtgaccagttcggtgaccgggtgttcgacctgcaggcgggtattcatctccaggaagtagaagcggccatcctcgccgagaagaaactcgacggtgccggcgcccacgtagttgaccgaagccgcggccttcaccgccgcctcgcccatggcgcgacgcaggtcggcatcgagcaccgggcagggagcttcctcgatgaccttctggtggcggcgctgcaccgagcagtcgcgttcgccgaggtagagcaggttgccgtggcggtcgccgaacacctggatctccacatggcgcgggcgcagcacggccttctccaggatcagttcggcgctgccgaaggcgcccagcgcttccgagcgtgcggtgcgcaactggtccagcagttggtcgggttcctccaccaggcgcatgccgcggccgccgccgccggcgctggccttgatcatcagtgggtagccgatgcgttcggcctcgcgccgcagggtcgcgtcgtcctgttcggcgccttcgtagccggggatgcacggcaccccggcggcgagcatggcgatcttcgacaggcgcttgctgcccatcaggtggatggcttccgcatccgggccgatgaaaacaatcccggcggcttcgcaggcacgggcgaattcggcgttctcggagaggaagccgtagccggggtggatcgcctcggcgccgctgcgacgggcggcgtcgaggatcgcctcgagattcaggtaggactgcgccaccgctgccgggccgatgcacacggcctcgtcggccagttgcacatggcgggcgtcggcgtccgcctcgctgtacacggcaacgctgcggtagcccagttcatgggcggtgcgcagcacccggcaggcgatttcaccgcggttggcgacgaggatcttgttgaagctgggcatgtcgttcggctcctggaggctgttgccctgtttcgcggtcgtggctcactgggcccagaccggcttgcgtttctgtacgaaggccagggtgccttcactgccttcggcgccgcccaccgcttcggcgaactgtcgcgccgcatcgtccagcagggcgccgagttcgccgctttcgctggccagcagcagggccttggtggcggcgttggcgttcggcgcgcagcggcgcagttgctcgagggtttcctccaggcgctgttcgagggcatcggcgtcggcctcgcagaaatgcaccaggcccaggcgcagcgcctcgcggccgtcgaagcgggcggcggtgagggccaggcggcgggcctgggtcaggccgatgcggcggaccacgaaaggcgcgatctgcgccgggagaatgccgaggctggtttccggcaggccgaactgcgcatcggcggcggcgatcgctacgtccgacacgcaggccaggccgaaaccgccgccgagcaccgcgccttccaccagcgccaccagcagttgcggggcggcctgggcttcctccagcaggctgccgaaggcgcggttcagcgtgcggtaggcttccgccccggcggcgcgggcaccggccatgtccttgatgtcgccgccggcgcagaagtgcccgccggcgccgcgcagcaccagcgcccgcacgctacggtcgtcgcgcacggcggcgagcaccgcgcgcagttcgccgaccatcgccaggctcatggcgttgcggctttgcgggcggttcagggtgatccgcaggacgccctcgacgggttccagcagcagggtctcgcaatgcggcaggctcatgccggtttcctcctggaacgtcagcctttcttcttgcccggcaggatgcccatcagcttgcagatgatgccgagcatgatctcgtcggcaccgccgccgatggataccaggcgggtgtcgcggtag

SEQ ID NO: 9721 - DNA, 738 bp, Pseudomonas aeruginosa
atgccgacaagcacttgcggggcaatcccgaggccggtcggcaaatacggagcggccgggcgcgcggatgagcggcaccgagccgccgacgatccggaaaaggggtactcagcgttggacgatcagaaagcccgggaagtgatgctggagctggtggctaccggacagctcaccgatccggaaagcgcccgcggcaagctgctgcagaccgccgcccacctgttccgcagcaaaggctacgaacgcaccacggtgcgcgacctggccagcgcggtgggcatccagtcgggcagcatcttccatcacttcaagagcaaggatgagatcctgcgctcggtgatggaagagaccatcctctacaacaccgccctgatgcgcgccgccctggccgacgccgaggacctgcgcgagcgggtgctgggactgatccgctgcgagctgcaatcgatcatgggcggtaccggcgaggcgatggcggtgctggtctacgagtggcgctcgctgtccgccgaaggccaggcgtacatcctcggcctgcgcgacatctacgagcagatgtggctcgacgtgctgggggaggcgcggctggccggctactgccagggcgatccgttcatcctgcggcgcttcctcaccggcgcgctgtcctggaccaccacctggttccgtccggaaggaccgatgagtctcgatcagctcgccgaggaggccctggcgctggtgatcaaggacgcctga

SEQ ID NO: 9722 - DNA, 927 bp, Pseudomonas aeruginosa
aacggagcgcctgacatgagcccatctcccgtccgcattctcttcgtcgatgacgaggagcgcatcctgcgcagcctggccatgcagttccgccgccattacgaggtgctcaccgagagcgacccgcggcgcgccctggagcgcctgaagacggaacggatacaggtgctggtcagcgaccagcgcatgccgcagatgagcggcgccgaactgctggcgcaggctcgcgagcgctatccggagaccctgcggattctcctcaccggctattccgacctcgatgccgccgtcgacgcgctcaacgacggtggcatcttccgctacctgaccaagccctggaatccccaggaaatggccttcaccctgcgccaggcggcggagatcgccagccgccagggcctgccggcgccgcccgcggccacgctggcggcgccgctgagcgtgctgctgctcgacgacgacccggaaaccctggactgcgtcggggccttctgccatgccggcgggcatcgcctgctgcgcgcgcgcaacctggccgaggcgctggtgtggctgaacaccgaaccggtggaggtgctggtcagcgacctgaagctggccggggagcataccgcgccgctgctgaaatccctggcccaggcccatccgcgcctgctcagcctggtggttacgccgttccgcgacacccaggccctgctcgaactgatcaaccaggcgcagatattccgctacctgcccaagccgatccgcaggggattgttcgagaaaggcctgaaggcggccgccgagcaggccttgctgtggcgcgggcgaagcctgccggaggttgaccggctggccgaggtgccgcgcgacgagcgcgagaaggaacgggtcggcagcctgctcggcatgctcggccgcctgcgcgagcggctgacggcctga

SEQ ID NO: 9723 - DNA, 1359 bp, Pseudomonas aeruginosa
ggcaggaagaacaggatcaggcccatgtcgaggaggaacgcctcgaccagtccgatcgacagccaccaggcggccagcggtaccagcaccacgatcagccccagctcgaagagcatcgcatgcagcacccggacctgcagggtgcgctggaagcccatgcgccgctgggcgcggtcgaagaggctgttgaaaagcatgttccagagcatcgccacggtggagaacatcagcgtcagcgcacccatgtgcgccaggggcttgttcatcaccagcgacagcaccggcgcggtgaggaggacggccaggccctcgaaggccagggcgtggaagatccgctccttgagagtcttgtcgagggcggtgtgggtgtgggtcatggcgaacgctcccggttcgtcgttgaagtcgggctgtattgtcatcggtctttgggatagggttaagttggatacaatcggaaaaaccgatatgcatttgtcgcccgaatccctcgaggccttcgtccaggccgtttccctcggctccttcagcgccgccgcgcgcaagctgggcaagagccagtcgaccgtcagcgaggccattgcccggctggagatcgacctcggcctggaactcttcgatcgcagtggccgccagccgcaactgaccgaggccggacgcaccctgctgggacgggtcgaggaggtcctcggcgcatccgaccgcctgcgccgggtcgccgcgctgctcgccggcggctcggagccacgggtgaccctggcgctatccgacacctaccattcggcgcgctacgaggcgcgcctggccgaactggacgagcgttaccctgagctggagttcgaatgcctgatcgccgaggaccaggacgtgatcgcccaggtcagccgcggccgcgccaccctcggcctgctcgccgcgcagccgcactacccgccggagctgggcgtggcggcggtcgccgagcgtgccgagttcggcctgttcgccgccgtcgaccatccgctggcgggtctggagcgggtcagcgagcgcgacctttccgaatggcgtctgctgcgcctgaacacctatagcgagaccggcgcggcgatcaacgacggcctgccgtccagcggcgggcgctgctggtcggcgcccaactacctgttgctgctggaaatggccacccacggcttcggttgggccgagctgccgcgctggctggtcagcggctacgccaacggacggctgaaggagttgccggtgtccggctggccgcgcagccaggcggtggacgtggtctggtcgcggcagcggccgttgggaccggcggccaactggttgctggaccgcttgctggatcgcgacctgcctatctag

SEQ ID NO: 9724 - DNA, 1095 bp, Pseudomonas aeruginosa
  unsure (730): Identity of nucleotide at the above locations are unknown.
gtggcatggatagactgtccagccatcccgaatagagagaaggggcctgcccatggatcgtctggacagcatgcgcgtgttcctgcgcgttgccgaaaccggcagcttcaccaaggccgcggacctgctggacatgccgcgggcgacggtctcggcggcggtccagcagctcgaagcgcaactcggcagccggctgctgcatcgcaccacccggcaggtccagctgacccacgacggcagcgtggtgctggagcgttgccgccacctgctggaagacatggaggagctggagagcctgttccacgacggcagccgcgccagcggccggctcaaggtcgacgtgccgagccgggtggcgcgactgctgatcgccccggcgctgccggaattcttccgccagcatccggacatcgaactggaactgggttccagcgaccgttcggtggacctggtgcaggagggcgtcgactgcgtcctgcgggtcggccagttgggcaacagcagcctggtggcgcgacgcctcggcgagatgcaactgatcaattgcgccagtcccgcctacctggaagagcatggcgagccacggacgccagccgacctcgaccggcactgggcggtcaagtatgcctcgcccagcagcggccgggtgttgccctgggagtatcgcgaggatgggcgcaccctgacccgcgcgttgcgcagccgggtcacggtgaacaatgcggaaagntacatcgcctgctgcctgtccggactgggcctgatccagatccctgcctacgacgtgcgcgagcacctccaacgcggcgagctgcgcgaggtgctgccgcagtggcgggccgaagcgatgccggcgtacgccctgtatccgcaccggcggcatctgtcgcggcgggtcagggcattcgtcgactggctggagcaactgctccgcgcccgcctttagtccacgacgttcatctccccggcgcgttccgggctacggcaaacggccggattctgcgacaatgcgcgccgttttcgattcgccgcgagagagcccatgtccgcctgccagtcccccatcatcgtcgccctggatttccccacccgtga

SEQ ID NO: 9725 - DNA, 771 bp, Pseudomonas aeruginosa
ggccgccctggcgctggccgatcagctggacccgaaactgtgccgggtgaaggtcggcaaggaactcttcaccagttgtgccgcgggtatagtcgagaccttgcgtggcaagggcttcgaggtgttcctcgacctgaaattccacgacatcccgaacaccacggcgatggcggtgaaggccgccgccgagatgggcgtgtggatggtcaacgtgcactgctccggcggcctgcgcatgatggccgcctgccgcgagacgctggaggccttcagcgggcccaggccgttgctcatcggcgtgaccgtgctgaccagcatggagcgcgaggacctggcgggcatcggcctcgacatcgagccccaggagcaggtgttgcgcctcgccgccctggcgcagaaggccggcatggacggcctggtctgctcggcccaggaagcgccggcgctgaaggccgcccatccgggcctgcaactggtcacgccgggcatccgcccggccggcagcgcccaggacgaccagcggcgcatcctcaccccgcgccaggccctggacgccggctccgattacctggtgatcggccggccgatcagccaggccgccgacccggccaaggcgctggcggcgatcgtcgccgaactgggctgaggcggcttcccccacgcctgccgtcggcgaccgtcgcgcgccgtgtcgagccggactggcgcaggcatcatccgcgccggcgcccaggggggcgcctgtccctcccccagcgtctaggcttgtag

SEQ ID NO: 9726 - DNA, 951 bp, Pseudomonas aeruginosa
gatcgctgttttccccggaaacgcgaggtcgggatgctgaacaccctggaagcctgcctgaaggcggtcgatgagattctcctgggcaaggaccgccaggtgcgcctggccctggcctgcctgctggcccgtgggcacctgttgatcgaagacctgccggggatgggcaagaccaccctcagccatgccctggcgcgggtgctcgggctcagtttccagcgcatccagttcacctcggacctgctgccgggcgatatcctcggtacctcggtgttcgacaaggacagcgggcaattcgtcttccatcccgggccgatcttcgccgaactggtgcttgccgacgagatcaaccgcgccacgccgaaaagccagagcgccttgctcgaggcgatggaagaaggccaggtgaccatcgagggcgccacccggcccttgccggaaccgttcttcgtcatcgccacgcagaacccggccagccagggcggcaccttctccctgccggaatcgcagctggatcgcttcctgatgcgcctgtcgctgggttaccccgggcgcgcggcggaacgctcgctgttgctcggcgaagcccggcgcgatctgctgccgcgcctggaacccttgctcgaccacgcggcgctggccgctttccaggccgaagtgccgaaggtccgcgccagcgatgcgctggtggactacgtgctgcgcctggtcgaagcgacccgcacgcagccggccttcgccctcggcctgtcgccgcgcggtagcctggcgttgctcgccgcggcgcgtgcctgggcgctgctggcgggacgcgactatgtgattccggaagacgtccaggcggtgttgccggcggtcgccgggcatcgcctgcgcgaccaggcggaccccaccgggcacggtggcggcgcgctggtgcaatggctgttgcgcgaagtcccggcgctctga

SEQ ID NO: 9727 - DNA, 1809 bp, Pseudomonas aeruginosa
aggacttcgccgcgctcggtggggaagacctgtggctggaattcgagcgcctcggcggggatctcgaaagtcgcctgggccgcttgtgccatgcagtcctggaactctccgcgcggcagcagccctatggcctggcgctgcccggcacacgcctgcaaccggccagcggcgaggcccagcgcgaggcctgcctgcgtgcgctggcgttgttcggagcggcgcgatgaacgcgattccgcgggtcgcgctggtctggctgctggtggcgcaggtactggtgatcctgccgcacctggcctacctgccgctgtggatcgcggccatgtggctcggttgcgcggcctggcgggtgcaggtcttccgcatgcgtgccggctatccgcgcgcctgggtcaagctggccctggcgctgctcgccggggccggggtctggttgtcgcgcggcagcctggtgggcctggacgcgggggcggtgctgctgatcgccgcgttcatcctcaagctggtggaaatgaagacccgccgcgatgcgctggtactggtgttcctcggtttcttcgcagtggtggtgggctacctgttcgacgacggtttcctcgccgcgctgtacagcctgctgccggtgaccgcgttgctggcggcgctgatcggattgcagcagagcgctttcgccagccggccctggccgaccctgcggctggccggcgggctgttgctgcaggcgctgccgctgatgctcctgctgttcctgttcttcccccgcctggggccgctgtggtcgttgccgatgcccggcaacaagggggtcaccggactctcggagagcatggcgccaggggatatcgccgagcttgggcgctccgccgaactggcgttccgggtccgcttcgagggcgcaccgccgccgcgcgagcagctctactggcgcgccttgaccatggagcgtttcgacggacgacgttgggctcaggcgccgcaatggtcgggcgaggatgctatgcactggcagaagcgtggccccgagctgcgctacgacgtgatcatgcagcccagttcgcagccctggctgttcgccctcgacgtggcgcagaccgaccagaccgacacgcgcctgatgagcgatttccacctgcagcggcggcagccggtcgagcaacgtctgttctaccgagccagttcctggccacaggcgctgcgcgagtccagcatcgatccgcgcatgcgctggcgcaacctgcagttgccgatgcacggcaatccgcgcgcgcgcgccctggccgagcaactgcgccaggcccatgcgcaaccgcaggcactggtcgcggccctgttgcagcgcttcaaccgcgagcccttcgcctacaccctgaaaccgccagcgaccggtgccgacggggtggacgatttcctgttcgacacgcgcagcggcttctgcgcgcattacgccggggcgatggctttcgtcctgcgcgccgcgggcattcctgcgcgagtggtggccggctaccagggcggcgagctgaatccggcgggcaactacctgctggtgcatcagttcgacgcccacgcctgggtcgaatactggcagccggagcagggctggctgagcgtcgacccgacctaccaggtggcgcccgaacggatcgaacaggggctggagcaggccctggccggggacagcgagtacctcgccgacgcaccgctgtcgccgttgcgctaccgtggcctgccctggctcaacgacatgcgtctggcctgggacagcctgaactatggctggcaacgctgggtcctggcctaccagggtga

SEQ ID NO: 9728 - DNA, 861 bp, Pseudomonas aeruginosa
tccagggttgcgtctgcgcgcattgcgccgggcgctgccctggcgcctggtgcgcgcgcccacgcgggatggccggggagaggagcaggcatgacggggttcatcgatgaactgctggccgaggtgatcggccagcaggtggcgttgatgtcggcggtcgcccgcctggaggcgcgcacggatggcgaggcactgcacgacctgcgcatcgccctgcgccgtctgcgcagcctgctgcggccgatccgcggagtccccggcgtcgaggagctggagcatgccgccgccgaggtcgggtggctcagcgggccgatccgcgacctggaggtgctgctgccggcgctcgccgccgaagggctgcgggatgcgctggcggtgcgccggccggtgctggagtccggctacgtggcggttctcgccagccagccgctgcaccgcctgcagctttgcctggacgtctggccggccctgttgcgtacggcccagcggcatgccgtgttggatggcatgcacggccgggtgcgcaagcgcctgcgccggcaatggaagaccctgcgcgccgagctggcggacaccacctacgagcactggcacccgctacggctgcggatcaagcgcgtgcgctacgggctggaggcctatccgcacgattgcagcattcccggctcgctgctggcgccgctcaaggcggcccagtcggcgctgggcgattggcacgacctcgaacagtggctgttgcgatgccagcgcgagccggacctggcgcccgtgcgcgaggtctggacggcacgcttcgaactggcccgggagcgtgccggacgggccctgtcgacattgcagcaggcacttgccgggcactga

SEQ ID NO: 9729 - DNA, 792 bp, Pseudomonas aeruginosa
ctggtggccgccgactcgacggtctgctgcacggtgagttcggtgacgtcgcggatgcccaccaccgaacgggtcatctcttccgcgacctggctctgctgttccgcggcgacggcgatctgcgtgttgctttcacgcatctgcgccaccgcgttggcgatcgccgccagcgcctcgccggcgtcgccggcctggctgacgcaaccgtcggccttgagcgagctttcctgcatgaactccacggcgtcgcgggtacccgactgcagggcgaggatcatctgggtgatctcgtcggtggagtcctgcacgcgacgggcgaggttgcgcacctcatcggccaccaccgcgaagccgcggcccatttccccggcccgcgcggcctcgatggcggcgttgagggcaagcaggttggtctgttcggcgatgccgtggatcacgttgaccacgccgctgatcttctggctgtcctcggccagcttctggatcatctcggcggtgtcctggacgccctgggacaacccggcaatcgacgcgctgacccggctcaccgcctgctggccggcgccggccaggcggtcggcttcctgcgactggtcacgggtgtcggcggcgtgctgggcgatatggaagaccgtggtggacatctcgttgatcgcggtggcggtctggtcggtctcgctctgctggccgagcatgccctggcgtacctggcccatgctgcgggccagcgcctgggcgccttcgtcgagcttggtagcggccgcggcgacggtgccgacgatgcgctggtag

SEQ ID NO: 9730 - DNA, 702 bp, Pseudomonas aeruginosa
ccatacagcgcccggcgctcgccggtgaaacaatgtacgacggcggccggcaggcgatcgcggaagtcgcgcaggatcgccagcaggcgctcgctggcgtcgcgttcgtggaggaacaccggacgctgtagctcgacggccagtgccagttgttcctcgagggccttttcctgggccggacggggagagaagtcgcgattgaagtcgaggccgcattcgcccaccgcgcgtacccgcgggtcgtcgaacagggcgcgcaggccgcgagcggtgtcggcgttccagtggctggcctcgtgggggtggacgccggcggtggtaaacagccggccgccctcgtcgagttcgccgcagagctgcagcgcctgttcgctgtcggccaggctggtgccggtgatgaccatttgtaccaccccggcggcgcgcgcgcgggcgagcagtgcttcacgttccggggcgaagctggcgtgggtcagattgacgccgatatcgatgagttgcatggtgccttcctggaattcgcagcgaggcggcgccccctcgatcgcgccggacccgccgggagatgggtggcaaaccgcttgtagaacaatccgttataatcgcagatcgggttcttcggcgcccggattatctacccaatgcctccgtttgcagccgctgtcggagaggaacttgccaagactgccatgctctgattga

SEQ ID NO: 9731 - DNA, 426 bp, Pseudomonas aeruginosa
agggcgagccgatcggcgtcgagtaccgtcgcctgcgcgccttcgagcaatacctcaacagccgttcgccgtccgcgcggaacctcaccctcaagctcatacccaagcccaaggaccagttgcttgccgccctgcagcgtggcgaaggcgacctggtcgcccccggcgaactgctgccggcgcacgacggcctgcaggtcagcccgagcgcgccggtgcgcgccgatgtgccgctggtgctggtggcgcgcaagggcaaccggcgctacacgcgcctggagcagttgtccgggcggaccatcccgctgccggccggcagcgccgccgagggcgccatcgaactggtcaaccagcgcctggcgcaacgccgcatggcaccgatccggatcgaaaagctggacgcttccctggccgtcgaggatgtga

SEQ ID NO: 9732 - DNA, 384 bp, Pseudomonas aeruginosa
tggaaatggtccaggcaggcatcctcggcttcaccgtggtcgagcagcccatcgccgaacgctgggccaaggtgctgccgaagctgcgcgtcgaccgccacctggtgctggacaatcgcgccgacatggcctggtacgtgcgccgcgatgccagcaccctgcgcgcgaccatcgaccgcttcctcgccgatacccgcgcgccggccgaccaggacgtggctttccagcgcgtctaccggcgcgcctacaaggtccgcaaccccctcggcgcggcggaccgcaagcgcctggaagcggtccgtccactgctgcagcgctacgcgcggcagagcagcatggactggctggcgctggcggcggtggcctacaaggagtcgcatctga

SEQ ID NO: 9733 - DNA, 738 bp, Pseudomonas aeruginosa
tcgaacaggttgcggatgtcgcgggtgatcagcaggttgccgctggcgtcgacactgaaactgccatcgacgctggtgcccctgaaggaggttggcagcggcgcgaccttggccggcatgacctggggggccggcaccgcttctcccgcggaggctgctggcggggcgcggtctgcgcccgcctgcgggctggccgggggcgccgtctcgggggcgggggaaggttccagccagacgaaccaggccaggctggcggcgaacgccagtggaatcagcaggaggattttcttcacgcgagggggcttccgggaaagggccggggccgaggccccggccggggtcctacaggctggcgttcttcaggcggttggcgtgctggcggtagacgctgaccgggctggtctcgaacaggctggtgaggccgaagacctggttcacctcgtccaggtggttcatccggtagttgtcgcggatcaccatgcccaggtgcgaactgcaggtgccgaccaggccgtcgttggcggtgccgttcttgaaggtcagcgacgaggcgccgaggaaggcgtcgctcggatcgaggaagttggtcagcggcgaggaaccgctccaggagtaatagctcacgccgttgaccttgtaggcgccctcgccgcaggccgaggtggggacgccctgcgggtacttggcgttgaagcgcgcggccccctcgctgttcagcgactccagcgagcccagtga

SEQ ID NO: 9734 - DNA, 789 bp, Pseudomonas aeruginosa
gtcaccggcaggtcggtcagggtgccgggctggaagaccatgaagaagttcggctggaaattgtcccacttcaccttgcgcaggctctggacctggacctcgcgattctgcccggcgacgctgaaggtgagccggtcgccgacctggatacgcaggttggcggccagcttctcttccaccgacacgcccggcagggcccccggctgcggcgcgctccaccagcgtccggcggtgagctggttgccggagggcagtcgctctgaccaggtcaggccgaggtcgcgctgcagggcacgctcgctgcgcacgtcttcgtcgagcgcctggaccggcttgccgttcaccgctaccaggcgcccgggaaccatggggaacagcggctcggcgccgggggagagcttttgcacgcgacgttcgaaggcgtccttttccgtcggcaggatgttcagggcgaaatggttgggggcgtccggcggcaactgggcctgccaggtatccagcagttcgccgcgaagcagggcgatcagggccatagccagcaggatcaggccgaaggccaggctctgtccggcggcggccagcgggtgccgcaacaactggccgagtcccagccgccatggcaggctggcacgcgccagtgcccggcgcaggccgttcaggccgagcagcaggagggcgccgagcaccagcgtggcgaccaggccgccgccgagcagggcgagggtcagcttcaggtcgagactcaaccgccacatgatcaggcccagggcgagcagggcgcaggcgtag

SEQ ID NO: 9735 - DNA, 513 bp, Pseudomonas aeruginosa
tccgctcgccggtggcgctgtcgaggttgccggtgggttcgtcggcgaacagcacgtccggctgcgccgcgaaggcacgggcaatggcgacccgttgctgctcgccgccggagagctggcgcggatagtggcccaggcgttggccgaggccgactcgctcaagcagttctctggcgcgctggcgagcgtcggcgcggccttccagttccaggggcagcatcacgttctccagcgcatcgaggctgtcgagcaactggaacgactggaacacgaagcctacatgggccgcgcggacgcgcgcccgctggtcctcgtcgaggtcgccgagggcgtgcccggcgagacggacctcgccgccgctgggctggtcgagcccggcgagcaggccgagcagggtcgacttgccggagccggagctgccgacgatcgccaggctgtcgccgcgggcgaggtcgagggagaggtcgtggaggatggtcaacttgccttccgcgctaccgacaaccttgctaa

SEQ ID NO: 9736 - DNA, 333 bp, Pseudomonas aeruginosa
gacttccccgggataccgctttcggctaaggttgcgcaccctcaggagccccccatgccgcgtcccgcctggaccctctacgcctatcaactgatcgagcccgacgatcagctggacctgttcgcctgtcgcgaggtccgggtgcatgtggtggcgcgtcagctggagctggataccccggcggaccgcacgctttgtggcaagctgctgccggcccagccgcgctggcagccgctggaacgggcgcgtctgcgcgaccggctgctgtgtcccgattgccggaaacaactggaggcggaaaagcgcggggagcgcctgtcctggttggtctga

SEQ ID NO: 9737 - DNA, 354 bp, Pseudomonas aeruginosa
actgccgggcacgaagaggagaggcggatggcgagctgggacattttctgtagcgtggtcgacaactatggcgacatcggcgtcacctggcgcctggctcgccaactggccgccgagcacggtcaggccgtgcgcctgtgggtggacgagccgcaggccttcgcccggatctgtccgcgggcggacccggtggcgcacgtgcagtgcctggatggggtcgaagtgcgtgcctggggcccggccgtgggcaccggtggcggccgccgatgtggtgatagaggccttcgccctgcgaactgccggaggcgcaccggcaggccatgcgcgagcgcaagcggccgtccctgtggctga

SEQ ID NO: 9738 - DNA, 1242 bp, Pseudomonas aeruginosa
actcgcagtctccttcatcgactggggcgctccatgagtctttcgctttccctcgccgaagcccgccgcctggccctggccgcgcagggcttcgacggccggcggacgcgccgcagcgtgcagcggcggcatctgcgcgaaatgctcgcgcgccttggcctgttgcagatcgattcggtgaatgcgctggtgcgctcgcactacctgccgctgttttcccgtctcggtccctactccatgacgctgctcgacgaggcggcctggagtgtcggccgtcaccgccagttgttcgaatactgggggcacgaggcctcgctgctgccgctggaacactacccgttgatgcgctggcggatgcgccaggccgccgacggccagggcatctaccagcaactggcacgtttcggccgggaacagcagccactgatccgccaggtgttgcaggcggtgcgcgagcaaggtgcgctaggtgccggcagcctgagcacgcggcaggagcgggccggtccctggtgggactggagcgcggaaaagcatgcgctggaatggctgttcgccgccggcgagctgacggtggccggacggcgcggcttcgagcggctctatgacctgccggagcgggtgtttcccgcggaattgctggcgcgccccgagctttcggaggcacaggcccagcgcgagctgttgcggatggcggcgagcgccctgggcgtggccaccgaaaaggacctgcgcgactactatcggctgagcccggcgcagagccgcgcgcgcctcgccgaactggtggaggctggcgagctgctgccggtccgggtcgagggctggagccagccggcctactgccccggcgaaccgcaggtgccgcggcggctaggcgccagtgccttgctctcgcccttcgactcgttggtctgggagcgggcgcgggccgagcgcctgttcgatttccgctatcgcctggagatctacacgccgaaggaaaaacgcgtgtacggctactacgtgctgccattcctgtacaacggccgtctggtcggccgcgtcgacctccgcgccgagcgggcgcgcgagcgcctggcggtacatgcgttgcatgccgaggcgaacggcatggacgatgccgccctgcacgagctggccgagcaactgcgcagcatggccgcctggctgggcctggcgacggtggcgatcgaggggcgcggggagttggcggtacgcttgcgcggggtgctgctctag

SEQ ID NO: 9739 - DNA, 861 bp, Pseudomonas aeruginosa
cgcctatggcgttattcgcgctacaggactatgtcgctcgcgatttcctggctgccagccgagtccacccagcttgcggcgggaagccgatgctctccgccagtcccccgagaaaccctgtcaatcgaagcgatagatatccatccccaacgagcccagggtaaagccgctgtgctcgacgcgcatcccgccgccgcccgcgccgcgggcgaagaacagtggcagcaggtgctcgtcgctggggtggttgcgcgccgcccagggcgcctgccggcggtagtcgtgaagcgcggcctcgtcgtcggcctggagcttttccaccatccagtcacggaactcccgcgcccagggcgcgatggcttccggcccggcgcgccagtccagttcgcccaggttgtgggtgatgctgccggaaccgatcagcagcacgccttccccgcgcagttggcgcagggcctggccgacgcggctctgcagggccggaccgaggcggctcggcagggacagctggagcaccgggatgtccgcctgcgggtacatcaggctcagcggcacccaggtgccgtggtcgaatggtcgctgtgggtcggcctgggccggcaggccggcggcctggagcagttcgatcgtccgctgcgccagcgccggctcgcctttggccgggtagcgcacggcgtagaggggcggcggaaagccgtagaagtcgtgccagatatccggcgccgcggcgccggttactcgcaggtcgtcgctttcccagtgcgcggaaaccaccaggatcgccttcggccgcggcagctctgtagccaggcggcgcagttgtacgccgctggcgcccggttcgagggcgagcatcggtga

SEQ ID NO: 9740 - DNA, 597 bp, Pseudomonas aeruginosa
gatctgcttgcaatgctcgtaatagcgcagaccgctttccgtcaccacgacgctgcgcgtattgcgttgcagcaggcgcgccgagagcgcctgttcgagcccggcgacctggcgcgaaacggtcgccggagaggtccccagcgcctgggcggcctgggtgaagctgccgtgctccaccacgcggacgaaggtccggataccttgcagcaggtccatttccaactccttcgccggtccgcgcccggcgccgtctcagcccgacgccgggtcggacgttgggctccagccgccgcccagcgccttgtagaggttgaccagggtcagcgacaccgcttcgtcgctggcgacctgctgttcctggttgtccagcagttgccgctggctgtcgagcacgctgaggaagtccaccgcgccggcgcggtattgctcgcgggcgctctgcagggcgcggcggttctgcgccacggcttcgccgaggcgctcctggcggcgctggttggcggcgtagtcgtgcatcgcgtcgtcgacttcctgccaggcacgcagcacggtgcgctggtagtcgatggcggcttcctgctgctgtgcctcgcgtag

SEQ ID NO: 9741 - DNA, 1413 bp, Pseudomonas aeruginosa
ctccaggcgtccgcgcaggcgtccgccttcgaagatcggcaggctgaacgccgggccgatggcgaactggcgatggtcccagtcgcccaggctggacagttgcagggattcgaaaccgaagttgccgttgagcgtgatgcgcggatagaagtccgccttggccacgccgatgctggcggtagcggcgtgcaggcgcgcttcggcacgacggatgtcggggcggcgctgggccagttcggacggcaggccgaccggcacgctgcccggcggacgcggaatcgcccgcgccgggccgagttcggcgagcaggctgccggggctggcgccgaccaggtagccgagggcgttgaccaggtgcgcctggttcttttccacctcgggcaggcgtgcctccatgctggccacctgggccagcgcctgggctacctcgaggtcggtggcgacgccgttggccaggcgcgtgcgggtgagttccaggctgcgccgtgcggtctcgaggttgtcgcggatgatcgccgcacggttctgttcgccgcgcaactggatatagtcgcgcgcggcttccgccagcaccgagacctgcacgtcgcgcagttcgttctcgctggcttccaccgtcgcgtcggcggcttccagctcgcgtcgcacgcggccccagaagtccagctcccaggaggcgtcgaagccggccagggcgtggttgtagttgcctttgccggccttgccggagggatcgaacaggccggcgctggtggtccgctggcgctggtaggtgccgctggcgtccaccgagggcagggcgtcaccgccgaggctgcgacggatcgcgcggctctgctgcaggcgcgccgcggcgctgcgcaggtcgaggttggcacgctggacccgttgcagcagggcgttcaattgcgcgtcgtcgaacagcgtccaccattgggctgcgagcggcgcggcggcgaggtggctggggttgccggcagcggcctggagcgaccattcgccgggcgcagggcggtccgggcgggtgaagtcggggccgaggctgcaggcgccgagcgcaaggctggcaataagcaggagcggagtgcctttcattgctgggcaacctcggcggagcgggtgccggtcgcggtgtcgatccgtgcttccaccgacatgcccacacgcaacttgcccgccatggcctggcgcggctcgagaacgatcttcaccgggatccgctggaccaccttggtgaagttgccggtggcgttgtccggggcgatcggcgcgaagctcaggccggtggccggtgcgatgctgtcgacatggccgcgcagaacctcgccggggaaggtatcgacgcggatttccacggcctgtccgggagagacgtgggtcagttgggtttcctggaaattgccgaccacgtag

SEQ ID NO: 9742 - DNA, 588 bp, Pseudomonas aeruginosa
gcacgctggcatgcgcagggtgcagtctttcgttctcccaggcgtgcgttcgctgcattgctggattgcgttcgcggtgcctttacgcgcaccggtggctgccgaagaatgccggtgcacgctctatccgaggatttgccgatgttccatacgctcctggtcgccatcgacggcggcccgcagacccgtcgcattgccgagctggcgcggcaggccgccgcgccgggcgcgcgggtccacctgctgtgcgcggtggacgccggctatgcgttgccgggccggccgacgctgctcgactatccgcccgccgcgcacgagtgcgaagaggcccggcaggtgctcgacgaggcttgtgcgctgctagccgggtgcgagctggaggtacgggccgagctgcgtgccggcgacccggtgcaggtgatcctgggcgaggcgcggcgcctgggctgcgagctgatcatcatcggccatcggcacctgggacggctggagcgcctgctcgatccttcggtcggcgaccgggtgatccgcgaggcgccgtgtccggtgctggtggaagtgcgcgagggagatgcgcaggggagttga

SEQ ID NO: 9743 - DNA, 561 bp, Pseudomonas aeruginosa
gcgaacaccgtggaacaggctgcgaaaagcccgctggatcgcggcttggcaggctgtaacgcggatgacagactggcgtctataaggagcacgcatgatacgtgcggcccgtcccccggaaaagggagcgccgggcatttttcagatcgcgaggtagagccgatgagcaagatcgacaaacccctggactcctggcgcgaggagttgaccgaagagcagttccacatctgtcgcctgggcggtaccgaacgcgccttcagtggcgaataccacgccaccaagacccccgggatctatcattgcacctgctgcggcacggcgttgttcgactccgacgccaagtacgactccggcagcggttggccgagctatttccagccggtggacgccgaggcggtccgcgaactggacgacttcagccacggcatgcatcgcatcgaagtccgctgcggccgctgcgatgcccacctggggcacgtcttcccggatggcccccggcccaccgggttgcgttactgcatcaactcggcctcgctgaagctggtgccgcgggagagctag

SEQ ID NO: 9744 - DNA, 594 bp, Pseudomonas aeruginosa
agagcgacgacccgtctttggttcgggtcgtttttcattcaatcaatttgtgtgcaattgaattgcgagctactttgtttcgagacccaccctcaacaaggaagacaagccatgagcgattcgctgctgagcattccctgcaccaccatcaagggcgaacagaagaccctggccgacttcggcggcaaggcgctgctggtggtgaacaccgccagcaagtgcggcttcaccccgcagtaccaggggctggaggccttgtgggaaaaataccgtgagcgcggactggtggtgctcgggttcccctgcaaccagttcggcaagcaggaaccgggcgacgagggcgagatttcgcagttctgcgaactgaactacggggtgagcttcccgctgttcaggaagatcgaggtcaacggcgccggcgcccacccgttgttcgtcagcctgaagaagcgcgcgccgggcctgctcggcagccagggcatcaagtgggaacttcaccaagttcctgatcgggcgcgatgggccagtggtgaagcgctatgcgccgaccaccaagccgggagagctgagctcggcgatccaggcgctgcttga

SEQ ID NO: 9745 - DNA, 492 bp, Pseudomonas aeruginosa
atgagcacccggggaaaagtcgccaggccggatggcgtcgaagaatcgctgctgctcgacaaccagctgtgtttcaagctgtacgccgcctcgcgcgcggtgatccgcggctatcggccgctgctcgaacagatcggcctgacctacccgcagtacctggtcatgctggtgctctgggagtggcatgcgagcccgccggagcagccgacggtgaaggccctgggcgaccgcctgctgctcgactccggaaccctgacgcccttgctcaagcgtctcgaacagctcggcctggtggatcgccgtcgcgccagtcacgatgagcgggaagtgcacctgacgctgacggtgccggggatcaccttgcgcgaacgggtcattccgctgcgccagcagctgatctgcagcaccggtttcgacctcaacgagatgttcgacctgcaccagcgcctgggcggattgctgtcgcgcttccgtctggtggtaggaggctag

SEQ ID NO: 9746 - DNA, 1521 bp, Pseudomonas aeruginosa
ccgtcgtcgcgaggccggctagtcgctcgcggtgagcgggcaccaacggtcgaggatggctttcagttcgtcgcggtggaaaggcttggccaggtagtcgtccatgccggcggcacgacaacgttcgcgctcgtccggcagggcgttggcggtcagcgcgatgatcggcaggccgccccagcgtccgctgtcgcggatctgccgggtcgcttcgtagccgtccatcaccggcatgttgcagtccatcaggaccaggtcgatgggatgctcctccagcatcttcagggcattcagcccgtgttcggcgatccatacctggcagccgagcttgtgcagcaggcccttggcgaccaactggttgaccgggttgtcctccaccagcaggacccgggtgttgcgctgttctcccgtggtgtccgaggcgctcgacggggctatggcagtgtgttcgagcacgtgtttcagggcctggtacaactggttgcgactcagcggcctggccagttggcgcagcggcgacaggcggcgggccagctccggttcgaggaaactgccgtaggcggtgaccagcaggatcggcgtaccgatgctcggacgcagtcccatcagacagtccgggcaatccgatatcagtacgtcgagcgagtggccgagcaggctgtcgtcggtctccagacgcttgtactccaggccccagcgcggcagccaggtttgcagcagctgcgccagcccgctgttggccgagcattgcgcgatcacccggccgcgcagcggcagcgcttgcagcggagggctgaccggcgccagcggcaggccgacgctgaacaggctgcccaggccgaccgtcgactccaccgtcagctcgccctgcatggcctcgcacagcttgcgcgtgagggccaggccgaggcctgtgccgccgtattggcgggtgatacccgcgtcggcctgggtgaacggttggaagatgcgatccagcgcctcctgggcgatgccgatgccggtgtcgcgcacactgatgcgcacaccctcggcggtggcttccacgcgaacgtcgacccgccccaggcgggtgaacttcagcgcgttggacagcaggttgctgacgacctggcgaatccgcgtcgggtcgccggaaacctgggcgggcagggcggggtcgaccaggcaggtcagctccacgccggccgcggcgttctgcgagaggaggctggcggtgtcttccaccaggacgcccaggtcgaacgggatctgttccaggaccagttgcccggcctcgaacttggagaggtcgagcacgtcgttgagcaattccaccagcaccttgccggagtcgtgggcgatcgacagttgctggcgctgttccggggtgagcgggccgtcgaggctcagcgagagcatgccgagcaggccgttcagcggcgtgcggatctcgtggctcatgttggccaggaagctggcgcgggcctgggccatatcgagagcggtctggcgggcttcttcgagttcctggttggatag

SEQ ID NO: 9747 - DNA, 1233 bp, Pseudomonas aeruginosa
cggctacctgcagccgctggaggtcagcctcgacctgcgcctggccgacctgctgggcgtagagcggcagcgcgagcaactggaacgcaacacccgccagttcgtcgccggccagccggccaaccacgccttgctctggggggcccgcgggaccggcaagtcctccctggttcgtgcgctgctggccgagctggccggcgccgggctgcgcctgatcgagatcgagcgcgaccacctggccgacctgccgcgcgtggtcgagcaactgcaaggcctgccgcagcgcttcgtactgttctgcgacgacctctcgttcgatgccggggaaggcgactaccgggtactcaagagcgtgctcgacggctcgctggaacaggcgccggacaatgtgctgctctacgccacctccaaccgccggcacctggtttcggagaagcagagcgacaacgagaactggaagatggtggacggcgagctgcatcccaacgaagcggtggaggacaagatcgccttgtccgaccgtttcggcctgtggctgtcgttctatcccttcacccaggagcatttcctcagcgtggttcaccactgggtggacgtgctcgcggagaaggccgggctggcctggagctggagcgaggaactggagaaggaagcgatccgctgggcgcttggccgcggcaaccgcaacggccgttgcgcctatcagttctcccgctactgggtgggcaagcaactgctggagcgccaggcatgatcgatctgcagcaatctggcgccgggctggccggctacgccctgctggcggcgcaggccgaggcgctgttcgccgacgagcgcgatttcatcgccaacgccgcgcagttctccgcctttctcttccatgagctgggcgacctgaactgggccggcttctatctgaaccgcaacgaggaactggtcctgggaccgttccagggcaaggtcgcctgcgtccgcatccccttctccaagggcgtctgcggcgccgcggcgcgtacccggctgacccagcgggtcgacgacgtccacgcgtttcccggccacatcgcctgcgacagcgcttccagcagcgaactggtggtgcccctgctcaaggacggccgcctggtcgctgtgctcgatctggacagcccgagcgtgggacgcttcagcgccgaggaccaggccgggatcgaaggcctggtggagatattcctgcgcctgacggactgctga

SEQ ID NO: 9748 - DNA, 1977 bp, Pseudomonas aeruginosa
caagcagcatcgggcctaagtccaagacttaggagcttgatgatgacactctctgatctgaccgtgcggcaagccaaggccgccgagaaaacctacagcatccccgacaccgatggcctcggcctggtggtcgcccgcaccggcggcaagtcgtggcatttgcgctattactggctcggcaagcaaaagcgcatctccctggggaactaccccgagatcggtttgcgcgaagcgcgcaccttgcgcgacgaagcccgggcgcttctggcaaagggcgtcaacccccataccgatcggaaacagaagcgacacgcggtcaagcttgcggccgactacaccttcaaggccgtcttcgatgcgtgggtcgagcatcgccgcaaggagatcaaggagggcaggaacagcacgctgtcgcagatcctgcggatcttcaacaaggacgtgctgcctagcctcaagcagatgtcgatctacgacattcgccggccccaactcctgggcgtcctggcgaggatcgaggagcgcaaggcgttcaccactgccgagaaggtccgcacctggctggggcagttgttccgctatgccctcgtcatcgtggaggggctggaagccaatccggcctccgacctggacgtggtggccgagcccaagcccccggtgaaccacaacccctacctgcatcttccggagcttcccgatttcctgcacaagctcaggctctacaaccctcgtggttggcagacccaactcggcatccggctgctgttcctgaccggcgtgcgtaccggcgagctgcggctggcgaccccggaccagttcgatctcgaccgtggcctgtggatcatcccgccgcagatcgtcaagcaactccaggacgagatgcgcaaggccggcaagcgcccgcaggacgttccgccctacatcgtgccgttgtccgtgcaggccatcgagatcgtgcgctacctgttgggtgtgatgaggccggctcaggtccatctgctcacgcaccgcagcgaactcaagaagcgcatcagcgagaacaccctcaacgcggccttgaaacgaatgggctacgaggatcaactgaccggtcacggcatccgcggaaccatctcgacggcgctcaacgagatcggctatcccaagatttgggtggacgcgcagctttcgcactcggacccgaacaaggtgagttcggcctacaaccacgccaagtatgttgagccgcgccgccggatgatgcaggactgggcggatcgtctcgatctgctcgaacagggccaagtggaagcggccagcgcgcacctcacgatccatatcgagggcgtgccggccatggcagaggaggacaagcccaacaccatcgtcgctgctgcttctgcggcatccgttccgcctgtggtggccgaacccatcgtcgtgacgccaaacgacgggggaatcacattccagcgactgtcgcaggtaccaccgcccccgacgcatgcgccagagccggaggtgtcagtcatccagcgcgagcgcgaggaaatgctggccatctacgaatcgccgagcagtctgccggtcccgctgttcggcaagttggccgggaagtccaaggaccagatcaaccgcgagctgaaggcgggcaagctgctgtctatcagcttgggcaaccgcgggcaacgcgtgcccgactggcagctggtacccctcaagcacaagctggcacaggtgctcatgaaccagtgcccgcatgcggatccgtgggacctgtaccggatgctgacccgcccacatccggacctgggtgatcgcgcagccatcgacatcgtgacaccaggaaatttgggcatggtcgtgcgggtcatcgcgggcacccagcagcagccaaacaggcccggacctgactcgtctgtgcaaggtattccagaggagactcgccagcgcattcaacggttgctaaatgatgcggcaatgctcgaaagtgcctga

SEQ ID NO: 9749 - DNA, 474 bp, Pseudomonas aeruginosa
cggggcgtaacgccagatgtgcaggcgactcctgacaacgcaatatcagaagtcatctgcaccaatctcgactatgctcaatactcgtgtgcaccaaagcgaggtgtgagcatggcgtcagacacatcattgattgccgagcaaggcgtggccaccctgcccgatgcggcttgggcgcaggcccggcaacgggcggaaatcatcgggccgctggcagcgcttgatgtggtcgggcatgaagccgccgatgccgctgctcacgcgcttggcctgtccaggcggcaggtgtatgtcctaatccgccgtgcccggcaaggtgctgggcttgtgacggacctggctcgcagccgatccggcggcggaaaaggcaagggacgcttgccggaatcagttgagcgcatcatccgcgagttgctgcaaaagcgcttcctgaccaagcagaagcgtagcctggcagcgttccaccgtgagtag

SEQ ID NO: 9750 - DNA, 648 bp, Pseudomonas aeruginosa
ggtgaagactcggctgatttcggcggtgtcggcgacgtagcgcaattccaggcgctcgggattgccggtgccgacggcgatggcgcgcaggccgttgcgattgacctgcaccgggatactgtgggtggtgtcggtgagcaccaggacccgcgcggtatagggcatcacctcgaccacctggcccatcaggccgctggcatcgagcaccggctggccgacgaaaacgccgtcgttctcgcccttgtcgatcatgatgcgttgggtgaaggggttcggatcgacgccgatcagctcgctgaccagtaccttgtcgtcgaccagcgcggcggaattgagcagctcgcgcaggcgcacgttctgctcggtgagcgcggcgagtttctgcacccggcgctgcatcagcagggactcggccttgaggcgttcgttctcggcgatcagctcgctacggctgctgaactggtcgcgcacgccttcccaggcgcgcaccggcatttccgccaggccgtaaaaaggcgtgagcaccatccccagcttgctacggacgggctccagatagtcgaaccgggcgtccaccaccatcaggctgaccgacagcacggccagcaccaacaggcgaacgcccagcgacgggcctttggagaatag

SEQ ID NO: 9751 - DNA, 378 bp, Pseudomonas aeruginosa
accgccgaccgcggcatccgttccctgccttatataacgcatggcgccccgccgcccttccaaggccgcttttgctggagactcccgatggcgcttgaacgctccgacgtggaaaaaatcgcccatctcgcccgcctgggcctgagcgaggccgatcttccgcgcaccaccgagaccctgaacaacatcctcggcctgatcgaccagatgcaggcggtcgacaccagcggcgtcgaaccgctcgcccatccgctggaagccacccagcgcctgcgcccggacgcggtcaccgagaccgatcaccgcgacgcctaccagaccatcgcccccgccgtggaagaaggtatgtacctggttccgaaagtcatcgagtcataa

SEQ ID NO: 9752 - DNA, 1467 bp, Pseudomonas aeruginosa
ggacgcggacacatgctgcatcaattgaccctcgccgagatcgcccgcgccctcgccgacaagcaattttccgccgaagagctgacccgcaccctgctcggtcgcatccggcagctggatccccagctcaacagtttcatcagcatcaccgacgacctggccatcgcccaggccaaggcagccgacgaacggcgcgccaacggcgagaacggcgccctgctcggcgcgccgatcgcccacaaggacctgttctgcacccagggcgtacgcaccagctgcggttcgaagatgctcgacaacttcgtctcgccctacgacgccaccgtggtcgagaagctcaccgccgccggcgccgttaccctcggcaagctgaacatggatgaattcgccatgggctcgtcgaaccagtccagccactacggcgcggtgaagaacccctggagcctcgaccgcgtgccgggcggctcctccggcggttccgccgcggcagtcgccgcgcgcctgctgccggccgccaccggcaccgataccggcggctcgatccgccaaccggcggcgctgaccaacctcaccgggatcaagccaacctacggccgggtttcccgctggggcatgatcgcctacgcttccagcctcgaccagggcggcccgctggcgcgcaccgccgaggactgcgcgctgatgctgggggtgatggccggattcgatccgaaggactcgaccagcgtcgaacagccggtggacgactacctggccgccctgcagaagccgctgagcggcctgcgcatcggcctgccgcgggaatacttcggcgccggcctcgacagccgcatcgccgacgcggtgctggccgtagtcgaggagctgaagacgctcggcgccacggtgaaggacatttccctgccgaacatgcagcacgccatcccagcctactacgtgatcgcgccggccgaggcgtcctccaacctgtcgcgcttcgacggcgtgcgctatggctatcgttgcgacgccccgcagaacctggaagacctgtacaagcgctcgcgcgcggaaggcttcggcagcgaagtgaagaaccgcatcatggtcggcacctacgcactctcggccggctactacgatgcctattacctgcaggctcagaagattcgccggctgatcaagaacgacttcgtcagcgcctttgccgaagtggacgtgatcctcggcccgaccacgccgaacccggcctggaagatcggcgagaagaacgacgacccggtttcccagtacctggaagacatctacaccatcaccgccaacctcgccggcctgccggggctgtccatgcccgccggcttcgtcgacggcctgccggtgggtgtccagttgctcgcgccctacttccaggaaggccgcctgctcaacgtcgcgcaccagtaccagcaggtcagcgactggcacacccgcaccccggccggcttctaa

SEQ ID NO: 9753 - DNA, 1893 bp, Pseudomonas aeruginosa
ggaacaccacatgcaatgggaaaccgtgatcgggctggaaatccacgcacagctcgccacccaatcgaagatcttctccggcagctcgaccgccttcggcgccgcgccgaatacccaagccagcctggtcgacctggccatgccgggcaccctgccggtgctcaacgaggaggccgtacgcatggcctgcctgttcggcctggcgatcgacgcacggatcgaccggcagaacgtgttcgcccgcaagaactacttctaccccgacctgccgaagggctaccagaccagccagatggaccatcccatcgtcggcaagggccatctcgacatcaccctggaagacggcaccaccaagcgcatcggcatcacccgcgcgcacctggaggaggacgccggcaagagcctgcacgaagacttccagggcatgagcggcatcgacctgaaccgcgccggcacgccgttgctggagatcgtttccgagccggacatccgcagcgccaaggaagccgtggcctacgtcaaggcgatccacgccctggtgcgctacctgggcatctgcgacggcaacatggccgagggctcgctgcgctgcgactgcaacgtctcggtacgaccgaagggccaggccgaattcggcacccgcgccgagatcaagaacgtcaactccttccgcttcatcgagaaggcgatcaaccacgagatccagcgccagatcgagctgatcgaggacggcggcaaggtagtccaggaaacccgcctgtacgacccgaacaaggacgagacccgctccatgcgcggcaaggaagaagccaacgactaccgttacttcccctgtcccgacctgctgccggtggtcatcgagcccgagtacctggcgaagctgcgcgagcaactgccggaactgccggtgcagaagcgcgaacgcttcgagagccagtacggcctgtccgcctacgatgccagcgtgctgtccgccagccgcgagatggccgactacttcgagaaggtccagggcatctgcggcgacgccaagctggcggccaactgggtgatggtcgagctgggcagcctgctcaacaaggacggcctggagatcgagcagtccccggtgtccgccgagcaactgggcggcatgatcctgcgcatcaaggacaacaccatctccggcaagatcgccaagatggtcttcgaagccatggccaacggcgagggttccgccgaccagatcatcgaggccaagggcctgaagcaggtcaccgacagtggcgccatcgagaagatgctcgacgaggtgctggcggccaacgccgagcaggtcgagcagtaccgcgctgccgacgaggccaagcgcggcaagatgttcggcttcttcgtcggccaggcgatgaaggcctcgaaaggcaaggccaacccgcagcaggtgaacgagttgctgaagaaaaagctcgaagcgtgagtcaaagccagacgccgggttcgcccggcgtcttcttgtccgccaggagcctgttgtccatgcccaccccatccgccgccgcgcgcctcgccctcgccgtcctgcccctgttcctcgccggctgctccagcctcgccggcagcggttccgcggataccggcgaagcctcctactatggcagccgccacgcaggcctgcgtaccgctagcggcgagcgctacaaccccaacgcaatgaccgctgcccaccgcacgttgccgttcggtacccgcgtgcgggtaaccaacctcgacaaccgccgcagcgtggtggtgcggatcaacgatcgcgggccgttccgccgcgggcggatcatcgatgtatcgcgcaaggccgccgaaggcctgggtatgatccgcagcggcgtggcgccggttcggatagagtcgctggattga

SEQ ID NO: 9754 - DNA, 915 bp, Pseudomonas aeruginosa
tacaaggagttgcccaatgtctgcgatttcccgcctggccgccgccgtcaccctctgcgccgccagcctctcggccgtcgccgaggaagcgccgcgctacaaccaggtctcgctgcacgccgaagtcagccagcaggtggcccacgacctgatgcaggtcaccctctacagcgaaaaccagggcagcgatccggccaagctcgccgccgagaccaccagcgtcctcaacgccgccgtcgccgacgcgcgcaaggtcaagggcgtgaccatcagcctgggcagtcgcaacagctatccggtctacgacgacaagggccagaagatcaccggctggcgcgagcgcgccgagctgcgcctggaaagctccgacttcgccgccctcggccagctttccgccgacctgctgggcaagctgaagatgggcggcatggacttcagcatcgccgatgcgacccgcaagaagaacgaggaccaattgatgaaaggcgccgtggacgcgttcaaggagcgcgcccagttgctcaccgaggcgctcggcggcaagggctacaagctggtcagcctgagcgtgaacagcgccggcgcaccgcgcccgtacccggtgatgcggatggcggcgatgaaggccgacgccagcttcggtggcgcccaggcaccggagatcgaggccgggaccagccaggtcacggtcaacgccgacggtgtgatcgaggtgcagatgccctgatccggtcggcgcgcaccacaagaggcagcctccgggctgcctcttgcgtttccactgtctctcgcgcagcaaacgcggcctgcgtcgcgtttgcgcaaattcgaaaatgcgacattccctttcaaacggataacaacatctacactgaaccgacctcgacgcttgcggccggcacatgccctgcatag

SEQ ID NO: 9755 - DNA, 1278 bp, Pseudomonas aeruginosa
aaacgccgtcatccgctccgcgatcattccctcgctgctcggcgcagcgctggtcgccgccgttccccaggccttcgccagcaacctgatcttctgctcggaaggcagcccggccggcttcgatcccgcccagtacaccaccggtaccgatttcgacgccgcggcggaaaccgtcttcaaccgcctgacccagttcgagcgcggcggcaccaaggtccttcccggcctcgcggaaagctgggacgtcagcgacgacggcaagacctataccttccacctgcgcaagggcgtgaagttccacagtaccgactacttcaagccgacccgcgaattcaatgccgacgacgtgctgttcaccttcgaacgcatgctcgacaaggatcatccgttccgcaaggcctaccccaccgagtttccctacttcaccgacatgggcctggacaagaacatcgccagggtcgagaagctcgacgagcatacggtgaagttcaccctcaacgaggtcgacgcggccttcatccagaacctggcgatgcccttcccatcgatccagtccgccgaatacgccgcgcaactgctcaagcagggcaaggccagcgacatcaaccagaagccgatcggcaccggcccgttcgtgttcagccgctaccaaaaggatgcgcagatccgcttcaagggcaacaaggactactggaagccggacgaggtgaaggtcgacaacctgatcttcgccatcaacaccgacgcctcggtgcgcgcgcagaagctcaaggccggcgagtgccagatcaccctcaacccgcgccccgccgacctcgacgcgctgaagaaggacccgaacctgaacctgccgtcgcaggccggcttcaacctcggctacatcgcctacaacgtcacccacaagccgttcgacaagctggaagtacgccaggcgctggacatggcggtgaacaagaaggccatcatcgacgccgtctaccagggcgccggccagttggcgagcaacggcatgccaccgacccagtggtcctacgacgagaccatcaaggacgcgccctacgatccggccaaggccagggagctgctgaagaaggccggcgtcgccgagggcaccgagatcaccctgtgggccatgccggtacaacgcccctacaaccccaacgccaagctgatggcggaaatgctgcagaacgattgggcgaagatcggtatcaaggcgaagatcgtcacctacgaatggggcgaatacatcaagcgcgccaagggcggcgagcatga

SEQ ID NO: 9756 - DNA, 1650 bp, Pseudomonas aeruginosa
ggccgatcctcagacgatgcccttagaaaaagaaaaaatgaggtttgcatgcgtaagatccttccccttcgggcctggctggcagccggtctgatcctcggctccccgttctcccacgccgccagcaacctggtgttctgctcggagggcagcccggccggcttcgatcccgcccagtacaccaccggcaccgactacgacgcgacctcggtcaccctgttcaaccgcctcgtccagttcgagcgcggcggcacccgggcgatcccggccctggcggaaagctgggacatcggcgacgacggcaagacctacaccttccacctgcgcaagggtgtgaagttccacagcaccgactacttcaagccgacccgcgaattcaacgccgacgatgtgctgttcaccttccagcgcatgctcgacaagaatcatccgttccgcaaggcctaccccaccgagtttccctacttcaccgacatgggcctggacaagaacatcgccagggtcgagaagctcgacgagcacagggtgaagttcaccctcaacgaggtcgacgccgccttcatccagaacctggcgatggacgtcgcctcgatccagtccgccgagtacgccgggcagttgctcgaggccggcaagccacagcagatcaaccagaagccgatcggcaccgggcctttcatcctgagccgctaccagaaggatgcgcagatccgcttcaagggcaacaaggactactggaaacccgaagacgtgaagatcgacaacctgatcttctcgatcaacaccgacgccgcggtgcgcgcacagaagctcaaggccggcgagtgccagatcaccctcaacccacgccccgccgatctcaaggccctgcaggaagcggcgaacctgaaggtgccctcgcagccaggcttcaacctcggctacatcgcctacaacgtcacccacaagccgttcgaccagctcgaagtacgccaggcgctggacatggcggtgaacaagcaggccatcatcgacgccgtctaccagggtgccgggcaactggcggtgaacggcatgccgccgacccagtggtcctatgacgaaaccatcaaggacgccccgttcgatccggccaaggcccgggaactgctgaagaaggccggcatcgccgagggcaccgagatcaccctgtgggcgatgccggtgcagcgtccctacaaccccaacgccaagctgatggcggagatgatccaggccgactgggcgaagatcggcatcaaggccaggatcgtcagctacgagtggggcgagtacatcaagcgcgcccatgccggcgagcatgacgccatgctgttcggctggaccggcgacaacggcgatccggacaactggctggcgaccctctacggctgcgactcgatcaacggcaacaacgtatcgaaatggtgcgacgcggcctacgacaagctggtcaaggctgccaagcgggtctccgaccaggacaagcgcagcgagctgtacaagcaggcccagcacatcctcaaggagcaggtgccgatcaccccgatcgcccactccaccgtgtaccagccgatgaacaagtcggtgcatgacttcaagatcagccccttctcgcggaacgccttctatggcgtagccaaccagccctga

SEQ ID NO: 9757 - DNA, 1728 bp, Pseudomonas aeruginosa
tgcacaaggccagccagaaccaggtcgacggcagcgtcaacgaactgcgcctggtcagcaccttccccttcaacctgctgtaaacctgcgacaaccggcggccccggcgacggggcccacgaggaggaccccatgctccatccgttgctccgacacctgcccctggccctggcgctatgcgccgccggcgcggcccaggcgaagaacctggtggtctgcaccgaggccagcccggaacgcttcgacatcgtccagtacaccggcgcggtgaccgccgacgcctccgcggaaaccgtgttcaaccgcctgctcgccttccgccccggcaccaccgaggtgatcccggggctggccgagcgctgggacgtcagcgccgacggactgagctataccttccacctgcgccccggcgtgaaattccataccaccgactacttcaagccgacccggagcctgaatgccgatgatgtgctgtggaccttccagcgcgccctcgatccgaagcatccctggcatgcctcggcgctgcgcggctacgcctacttcgacgcgatgggcatgggcgagctgatcaagtcggtggaaaaggtcgacgagctcaccgtgcgcttcgtcctcaaccgtcccgaagcgccgttcctgcgcgatatggcgatgcccttcgcgtccatctattccgccgagtacggcgaccagttgctcgccgccggcaagcagggccagctgaacaaccagccgatcggcaccgggccgttcgtcttcaagcgctacgccaaggacgcccaggtccgctatacggcgaacccggactactacgccggcaagccgccgatcgacaacctggtgttcgccattaccctcgatcccaacgtgcgcatgcagaaggtccgtgccggcgagtgccaggtctcgctgtacccgaaaccggaggacgtgccgcgcctgaagcaggacccgaacctggcggtggacgagatcgatgccctgctgaccacctacattgccatcaacacccagcacaagccgctcgacgacccgcgcgtgcgccaggcgatcaacctcgcgctggacaagaaggccatgctcgacgcggtgttcggccccggcgcggccagtccggcggtcggtccctatcccccgaccctgctcggctacaaccattcgatccaggactggccgcacgatcccgaacgcgccagggcgctgctcaaggaagccggcgcggaaaatctcaggatcaccctgttcattcgcaacggcacctcgcctaccatccccaaccccgccctggcggcacagatgctgcaggcagacctggccaaggccggcatccagctgaccattcgttccctggaatggggcgagctgctcaagcgttcgaaggccggcgagcacgacctgtcgctgcttggctgggccggcgacaacggcgacccggacaacttcctcagcccgaacctgagctgcgccgccgccgagtcgggtgaaaaccaggcgcgctggtgcgacaaggacttcgaggcgctgatgcgcaaggcccgcgaggtgagcgatccggccgagcgggcgaaactgtacgagcaggcccaggtggtattccacgaacaggccccatggataccgctggcctacccgaagctgttcaacgtccggcggaacacggtgcagggctacgtgatcaatccgttgagcaacaacaacttcgccaccacctcggtgaagccgtag

SEQ ID NO: 9758 - DNA, 1926 bp, Pseudomonas aeruginosa
tttcattgcacgacgattggggttgctgatccccaccttcttcggcgtgacgctgctcaccttcgcgctgatccgcctgattcccggcgacccggtggaggtgatgatgggcgaacgtcgcgtcgatccgcagatgcatgccgaggccctgcaccgcctgggcctggacaagccgttgtaccagcagtacctggactacgtgggcaacctggcacagggcaatctcggcgaatcgctgaccacccgcgaaggcgtctggcacgaattcctcaccctgttcccggcgaccctggaactgtccctggccgccatgctcttcgccggcaccttcggtctgctggccggggtgatcgccgccctgaaacgcggttcgctgttcgaccacggggtgatgacggtgtccctcgccggctattcgatgccgatcttctggtggggcctgatcctgatcatgctgttctccgtgtcgctgggctggacgccggtgtccggccgtctcgacctgctctacgacatcgagccgaagaccggcttcatgctgatcgacaccctgctttccgacgaacagggctcgttcctcgatgccgtgcgccacctgatcctgccggccatcgtgctgggcaccatcccgctggcggtgattgcccgcatgacccgctcggcgatgctcgaggtgttgcgcgaagactatgtgcgcaccgcccgcgccaagggcctgtcgccggcccgggtggtcttcgtgcacgccctgcgcaacgcgctgattccggtgctgacggtattcggcctgcaggtcggcacgctgctcgccggcgcggtgctgaccgaaaccatcttctcctggccgggcatcggcaagtggctgatcgacgccatcagccgtcgcgactacccggtggtgcagaacggcatcctgctggtcgccaccctggtcatcttggtcaatttcgtcgtggacatcctctacggcctggccaacccgcgcattcgccaccaacgctgatgagccagccgatgaacgccatgcacaacgctcccgccagcgacccgagcctggtctacccgtccccgctgaaggaattctggcaggccttcgcgcacaacaagggcgccctcggcggcctgctgttcatgctgctgatcgtgttctgcgcgctgttcgccccctgggtcgccccctacgatccgagcgagcagttccgggacttcctgctgaccccgccatcctggctggaaggcggccaggcgcgcttcctgctcggcaccgacgagctgggccgcgacctgctctcgcggctgatccacggcgcccgcctgtcgctgctgatcggcctgtcctcggtggtgatctcgctgatccccggcatcctcctcggcctgctcgccggcttctcgccgaaccgtgccgggccgctgatcatgcgcctgatggacatcatgctggcgctgccgtcgctgctgctggcggtggccatcgtggcgatcctcggcccgggcctgatcaacaccgtgatcgccatcgccatcgtctcgctgccggcctacgtacgcctgacccgcgccgcggtgatgaccgagctaaaccgcgactacgtcaccgcctcgcgcctggccggcgccggcaccctgcgactgatgttcgtctgcgtgctgccgaactgcatggcgccgctgatcgtccaggccaccctgagcttctcttcggcgatcctcgacgccgccgccctcggcttcctcggcctcggcgtgcaaccgccgacccccgagtggggcaccatgctcgcctccgcccgcgactacatcgagcgcgcctggtgggtggtcagcctgcccggcctgaccatcctgctcagcgtactggcgatcaacctgatgggcgacggcctgcgcgacgccctcgatccgaaactgaagaacgcggcatga

SEQ ID NO: 9759 - DNA, 1038 bp, Pseudomonas aeruginosa
acagcgcatccgtatccgcgccacaggagaccgccgcatgagcctcctcgatatcaagaacctcagcgtgcgcttcggcgacaccaccgccgtgcccgtggtcgacggcctcgacctgagcgtcgacaagggcgaggtgctggccatcgtcggcgagtccggctccggcaagtcggtgaccatgatggccctgatgggcctgatcgacgcccccggctgggtatccgccgatcacctgcgcttcgacggccacgacatgctcaccctcaagggccgccagcgccggcgcatcgtcggcaaggacatggcgatggtattccaggacccgatgaccgccctcaaccccagctacaccgtcggctaccagatcgaggaagtcctccgcctgcatctcggcctgcgcggcaaggccctgcgccagcgcgccctggaactgctcgaacgggtcgagatcccggccgccgccagccgtctcgacgcctacccgcaccagctctccggcggcatgagccagcgcgtggcgatcgccatggctatcgccgccgagcccaagctgctgatcgccgacgagccgaccaccgccctcgacgtgaccatccaggcgcagatcatggagctgctgctgaacctgcagcgcgaccaggacatggcgctgatcctgatcacccacgatctcgccgtggtcgccgagaccgcccagcgcgtctgcgtgatgtacgccggcgaagcggtggaaatcggcggcgtgccggcgctgttcgaccgcccgacccatccctacaccgaggcgctgatcaaggcgatccccgagcactgtgccggcgaagcccgcctggccaccctgcccggcatcgttccggggcgctacgaccgcccgcgcggttgcctgctgtcgccacgctgcccctatgcccaggagcattgccgccaggagcggccggccctggaggcacacgagcgcggcgcggtgcgctgcttctatccgttgaacctgctgaacgaggtggcctgatggaaaccggttctgaccgcccgtga

SEQ ID NO: 9760 - DNA, 1713 bp, Pseudomonas aeruginosa
tctgacccgtcactacgaagtctcccgcggcctgttcaagggccacgcccaggtgcgcgcgctgaacggcgtatcgttcgaactggaagccggcaagaccctcgccgtggtcggcgagtccggctgcggcaagtcgaccctggcgcgcgccctgaccctgatcgaggaacccacctccggctcgctgaaaatcgccgggcaggaggtcaagggcgccagcaaggaccagcgccggcagttgcgccgcgacgtgcagatggtcttccagaacccctacgcctcgctcaatccgcgacagaagatcggcgaccagttggccgagccgctgctgatcaacaccgcgctgtcgcgcgaggaacgccgcgaaaaggtccagcagatgatgcgccaggtcggcctgcggccggagcattaccagcgctacccgcacatgttctccggcggccagcgccagcgcatcgccctggcccgggcgatgatgctgcaacccaaggtgctggtggcggacgagccgacctcggccctcgacgtgtcgatccaggcccaggtactgaaccttttcatggacctgcagcagcagttccgcaccgcctacgtgttcatctcgcacaacctggcggtggtccgccacgtcgccgacgacgtcctggtgatgtacctcggccgaccggcggagatggggccggcggacaagctctacgagaacccgctgcatccctatacccgtgcgctgctctcggcgaccccggcgatccacccggacccgacgaagccgaagatccgcatccagggcgaactgccgaacccgctgaacccgccggagggttgcgccttccacaagcgctgcccctacgccaccgagcgctgccgcagcgaggtgcccgagctgcgcctgctcgaccagcgccaggtggcctgccaccacgccgagcaattcctcggctgagcgccacggggcgctcgccgccccgcagcccttcagagctggcgcagcagcgccagccttaccccgaaccctatcaacaacccaccgaagccccactgctgcaggcgctgtgcccgcggccgggacgccagccagcggcccaggcggccaccggccagcgcataggcgcagtcgaaggccaggccaaccagaaccaggaccgtaccgagcgcggcgaactggacggccagcgaaccggccccggggctgacgaactgcggcagcagcaccgaacagaacagcagggccttggggttcagcaggttggtcaggagtccgcgcagcaaggcccggcggtcggcgtgagggaccaccggcgcggagcccgcgtcgctggtcggcaaggccagtccgccaccgcgcagcatctgcaggccaagccaggcgaggtaggcggcgccgagcaggcgcaccaggtcgaaggtccagggagcggtacggaacagcagcgccagtccagtcgcggccatcagcacatggcaggcccgagccagcgccaggccgagggcggtgaccagcgccgcgcgacggccctggcgggcgccggtctggaacagcaggagcatgtctggtccgggcaccaggtaaaccaccgccagggcaatcaggaaagcgctcgtgtccatcgtatcggctccaggaaggtgacccggataacgattctatgcccgcaaggcagggcaggtgcttgcgttttccaccagcctatccattctatttggcagtaa

SEQ ID NO: 9761 - DNA, 513 bp, Pseudomonas aeruginosa
attccactctctggagactatccatccggatatgccaagatgaaactcgacgcctatgaccaccgcatcctcgccgccctccagcgcgacggccgcctgagcaacgtccagttggccgaggagatcggcctctccccgtccccctgcctgcgccgcgtgcgcctgctggaagaggccggggtgattcgcggctaccaggccagcatcgaccgcgacgaggtcggcctcggcctcacggtgttcgtcgggatcaaggtggaacgccaccgccaggagcaggccgaggccttccaccgtgcggtggtcgacctgccggaggtgatctcggtgcacctcgtctccggcgagtcggacttcctcctgcaagtggtggtccccgacctgcgcgcctacgaacgcctgctcagcgagaccctgctgcgcctgcccggggtcagcgacattcgcagcaacttcgcgatcaagacggtcaaggcgccctcgccgctgccgctcggccacctggccggctga

SEQ ID NO: 9762 - DNA, 609 bp, Pseudomonas aeruginosa
ttcgccaggcgctggcgaagaaggcttgccggctggctgcgtcgaaggccgccgcatcgccgccgagcagcacgcgcaagggccgctgctgccggtagtccggctggaaacgccagggcacgctggcatcccacggacacgccgctcccgcttcggcacacggcaggcaatcgccctccgccaggatccggccatcgccctgtaaaccgccgagcccgtcgcgaacctggcaggcgacgctgcccagtaccggcctcgcccggaaaccgccggcgcaggccaggtaggcacgctgcccggcctcggcgaagcccagttcgatgcgttgcccgcggcggacccggaagcgactccagggcaggcattcgcgaccgtccaccgtcagcgccagacgcgctccggtcaacgccagccaggtcgcctccaccctgcactccagcaccaagccgccgaaagcgatttccagcaatggcgtcccccagggattaccgagcagacgattggcccaggctgccgcctggcggtccagagggccgccagcggatacgccgaggtgctgccagccgcgccggccgtcgtcctgcagcaggctttgcggtcccgccttga

SEQ ID NO: 9763 - DNA, 801 bp, Pseudomonas aeruginosa
cgacccgcaaaccattcattcgcgcccgcccaggtcgaggaagtcctcgcgcccgatggcgacgaagcgcacccggtcgcccagcgccagtgggcacggaggagtggcggccggatcgaacggacgccacggactgcgtcccagcaggtgccagccgccgggcgaggcctgcggatagatcgccgtctgcgcctcggcaatggccaggctgccggccggtacacgcgcccgcggggtggcccgccgcggcaggaccaggcgcggatcgaggccgccgaggtaggcgaatcccggagcgaaaccgatcgcgccgacccggtattcggccgcgctgtgcagttcgatcactccttcgccagtcaatccgcaggcaaccgctaccgtcgcgaggtcctcgccggcgtaccagacgggaatctcgtgcaggcgcccggcatcctcggcggggcgccaggcgtgccactccgccagcagcggacccaggcgttcttccagtacctgcggggcgatgcggtaggggtcgtaatgcagcatcagggtggtccagcccggcaccagatccctgacgccttcgccgagcccctcgcgcagacgtctggccagctcggccaggcgcacagacaggtccacttcgggctcttcggcgagcgtcagcagcagggcttcggcaccagcgggttcgatgcggatcacaggctgtccagggccgcgcgcaggcgccggaggaccgccagcgactgcgggttgtcgccatgcacgcaaagactgtcggcggtcaggcgcagcgggttgccgtcgtag

SEQ ID NO: 9764 - DNA, 591 bp, Pseudomonas aeruginosa
aggtcgcggaatttattgcagatcagaattgttatcaattattacggattcgcattcgacaggaatttacattctttacaattttctcattacattttttcccatctcgctcgtctggaacatttggcggttttacatgaccaatgcaaatcaatatcattggcaatcatttcgccttcatggacagcgccatgttgctgcatattcccgccatcttcaccgccgaggaagtctcccggatccgcgcagccctggagcaggcggaatgggccgacggcaaggcgaccgccggctaccaatcggccaaggccaagcacaacctgcaactgccgcaggaccacccgctggcccgggagatcggcgaagccatgctgcagcgcctgtggaaccatcccctgttcatgtccgccgccctgccgctcaaggtcttcccgccgctattcaactgctataccggcgggggctcgttcgacttccacatcgacaacgccgtgcgcgacgtccatggcggccgcgagcgggtccgtaccgacctgtcctcgaccctcttcttcagcgacccggaggactatgacggcggcgaactggtga

SEQ ID NO: 9765 - DNA, 1878 bp, Pseudomonas aeruginosa
caagcctttccctaccctcgccgcttcatcgaggcgagcgacgatcgcgcctccggtccatcgtacgaggctatcgtgtcccccactccaccaagcgttacgcgcaatcgcatcgactgggccggcctgggctggctgttcctgttcttctggttcttctccggcatcacccaactgctcctgctgacctccggcaacagcggtttctccggtttccgcaacgccatggtgctaagcaccatctggcttgcgccggtgttgctgttcccgcgctggaccaagccgctggccgccgtcatcgggctggtgctgtgggccgcctcgctggtcggcctgagctatttcggcatctatcaccaggaattctcgcaaagcgtgatcttcgtgatgttcgagtcgaacaccgccgaggccagtgaatatttcagccagtacttcaacccctggatgactctcggcctggtgctctacagcctggtcgccatcctcctctggcgccgcctgcgcccggtctacctgccgcgcttcagcgccctgccggtggcggtgctgctgatcgtcgcgaccatcggttatccgttctacaagcaactggtcagccagggccgacccttcgacgaagccctggacaaggtccaggcgcgcatggaaccggcggtgccctggcaattgctgatcggctaccagcaataccgccagcaactgggcagcatgcaggcgctgttgcaaaagaacgcggccctaccaccgctgaagaacctcgtcgatgccaatggcgatacgccgcgcacgctggtcctggtgatcggcgaatccacgtcgcgcaagcacatgagcctctacggctatccacgcgaaacgaccccgcagttggacgcactgaaggccgcgaaccggaacctcacggtattcaacaacgtggtggcgtcgcggccatacaccatcgaggtgctgcagcaggtgctgacgttcgctgaccaggagcatcccgaccgcttcctcaccgatccgtcgctgatgaacctgatgaagcaggccggctacaaaaccttctggatcaccaaccagcagaccatgaccaagcgcaacaccatgctgacgaccttcgcccagcagaccgatgcgcagttctacctgaacaaccagcgcagccagaacgccagccagctggacggcgcggtgctggcgcccttcgccaaggtgctggacgacccggcgccgaagaaattcatcgtggtccatctgctcggcacccacatgaactacaagtaccgctatcccgccgactacgctcgcttcgtcgaccgccagggcgccccggcggccctcagcgatgaccaggtggaggtctacaacagctacgacaacgccgtgctgtacaacgactacgtggtctccagcctgatcaagggcttcgccaacagcgatccgaacggcttcctggtctacctctcggaccatggcgaggaagtcttcgacgaagccccgcacgaccgtctcggccgcaacgaaggcgacccgacccgcggcatgtacaccgtgcccttcctggtctggacttcgcccagctggcagcagacccatccgcgcgacctgcaggccctggtcgaccgacgctacagcagcgaagacctgatccatacctggtccgacctcgccggcctcaactatgacctcttcgatccgaccaagagcctggtgagcaacgacttccagcatgaagtccgctggatcggcaacccctatgcccacaatggcttgcgcgacttcgacaagctgccgctggacaaggccgacgccgggcagcaggtagcccaggccggacgacccgcgccaacgacaccgcgcgcaccgtcccgccagccgaacgaaggctga

SEQ ID NO: 9766 - DNA, 1086 bp, Pseudomonas aeruginosa
cagtgggatgtccccgtccgcccagcgttcaatcggatggacgaaaaacgtcccgcgcaggccttgcgcctacacccggaacgcgccgatcaggcgtttcagctgggtcacctgggcgcccagttcgcggctggcccgttcggtctggctggcgccttccgcggtgcgctcgccggcctggttgatctcgacgatgttctggtcgatatcgtgggccacggcggtctgttgctcggcggcggcggcgatctgctggttctggtcgacgatcatgcccaccgcgccgaggatattctccagtgcctgctgcacctgcgccgactcgttgaccgtgccatcggcggtatggtggctgctgcccatcgccttcaccgccgcatcgacgccgccctgcaggcgcaggatcatctgttcgatctcggcggtggattgctgggtgcgcttggccagcgtgcgcacctcgtcggccaccaccgcgaaaccgcgcccctgctccccggcacgagcggcctcgatcgccgcattgagcgccagcaggttggtctgttcggcgatgcccttgatcacatccagcacctggctgatcgaggcgctgtcactggccaggcgattgatcgccgccaccgactggtcgatctcgccggccaggcgctggatgctacccacctgcgactcgaccaggctgcgcccgctgagggtttcctggttcacgctgttcgcgctgctcaccgccatcgccgcgctgcgtgccacttcctgggcggtagcggccatctggttcatcgccgtggccacctgctcgatctggctgcgttgcccggctaccgcctggttgctttcggccgacaccgactcgacgcgcagggtctgccgctcgacctcgccgacggtctggctgacccgctcgatcaggtcgtggatcttcgccaccgattcgttgaacgattgtcccagctcgcccagttcgtcacggctgcgggcctggaagctgaccgtcatgtcgccgccggcgacgcgctccatcattcgcccgagatccttcagggtggcgcgggtggaaacgtagaaaccgccgtagaggtatag

SEQ ID NO: 9767 - DNA, 918 bp, Pseudomonas aeruginosa
cttaaggttaacggggaatcgcaggcggattccccgtcgctgcgctcagaggaacagcgcgcagaaggcgaacacggcgtaccagagcacggccgcgcgcaccagcaattgccagagcgcatccaggctggcgacgccggcggcacccagttcgaccgcttcgacatcgctggcgacccgtccggccttgcccagcagcgcggccgccgagatgtcccaggccagcagccagtgcagcagcacgcggataaccgcgaggaagttgccgaccagggcgaagctcagcaccagcgcacgcaccggcaaccagtcgaggatatgccggacgcgcgccgcctgttcgcgcaacgccggctggcgggcgtgctccagcgccagtgccagcaggcgataggccagggccgccaccgggccgagcaaggcataccagaagatcactgcgaagaagctctggtagccctgccagagcagatggccgtgcacccggccgatcagttcgctctcgctgccgcccaggatccccagatcgcgttcggcgacatggaaggcagcctgggcctcctcgcgccgccaggcgtcgcggaacggcccgaggtcggccatgacgtcgccgcggccgagactgtagaccaccaccagaagatgcagcggaaggctcagccagccataggccaacggctgcagcaatgtcagcaacagggccagcggcagcaacggcaggactaccgcgagcagcagccccagccaggagcggcgggacaccgagggcagatcctcgaccaggctcagccaggcgagccaggcgccatcgcgctggatacgccggcgccagccggagaacttctccagcgcaagggccagcagcaacaccaggaacgtcatgtttcctccttggaatcggtcaatccggcgcggtag

SEQ ID NO: 9768 - DNA, 1317 bp, Pseudomonas aeruginosa
  unsure (522): Identity of nucleotide at the above locations are unknown.
cgaccggtgggccggatcactgccgccagcttgcagcgcagcttgtgctcggcgtcctcctggatctccacccaactgccgacacgcagcgcatcgacccgcagcagtgcctcgtcgttgtccggcaggcgcacttcgctctcaacaggcgccggggcggcgtccggcgaggtcaggacgatttcttcgaccacccgcagcatgaccggcgcccggggcttttccgcggccgtgcccgggctcgcttcgtcgagcagggggctgtccgcgaccgccgcctcgccgcgcttgtcgcgctgcagaccctggacatgcagggtttccagctggctgaagaattctccggtggaaaacggatcgaagggtgcgctggccaatccctcacgcagcgccttgagcaggccaggcacacgctccagcaactgttggcgggacagcggatcgtcatgcgggccgacgctccagatcagctggtccatggtatccagggcctcccgccactcggcggaagccttgccatgnttgaggcagatcagcagcatcaccttgctccaggcatcccgcagcaggcgcaccaccacctccggcaggaccttgccgagcagtcgctggttcagcacctgctccacgtcctgccgagccagttcggccttggcgcggccttcctcggcgtcgcgggtgccgctgctcgaggagctcgctgcggcggcgctcgtcgccggtgaaggcaatgaagtcctccagcaactcggcgaagatcgccgggtcgtcgacgaagtcgttcaacagccgcatcacgacctgttcgatcttctggtacaggctgtcgcgccgggcatcattgtgttcggcccagcccagcgacgcggatgcgatctcgttgagcaggcgacgcgccggatggctaccgcggctgaagaaggtcttgtcgagcagggccaccttgagcatcgggatctgcatccgaccgatcagggccttcagcgaatcaggcagggtgcggtcatcgagaatgaattcgaacagcatcgacaccaggttgatgacgtcatcgtccacctggccgaccacccgagaacggccgctcttgtggctgacccgctggagcagttggtcgaccccgtcgcggacgtcgaactccgcggcgccggggcccggcaggtgctgctgcaggtgggaaagcaggcgcatcaggtcgttgctggaaatcggcgcggcattctcaggcgtttcgcgacggtagaaggaaggattgtcgcggacctgcgccagcagttcctgcagcgcgccgaagacttcctgctggccgccctctag

SEQ ID NO: 9769 - DNA, 876 bp, Pseudomonas aeruginosa
tcgcccgatctcgtacaggagcccgccatgcctaacctcacccttgccgacctccaaggcgaaatccaggccaacgtccgcaccgccctggcggaagacgtcggcggcggcgaccttaccgctcagttgatcgatccacagcgcgaggccgaggcccgggtgattacccgcgagcacgcgacgatcgcgggccgcgcctgggtcgacgaggtcttccgccaggtcgatccccgagtgctggtgacctggcaggtggaggacggccagcgagtcgagccgaaccagatgctgttccagctaaaaggtccggcccgcgccctgctcaccggcgagcgcagcgcgctgaacttcctccaactgctttccggtaccgccacccgcagccagcactacgccgacctggtcgccggcaccgcggtgaagctcctcgacacgcgcaagaccctgcccggcctgcgcctggcgcagaagtacgcggtcacctgcggcggttgccacaaccatcgcatcggcctctacgatgccttcctgatcaaggaaaaccacatcgccgcctgcggcggtatcgatcgggcaatcgccgaagcccggcgcatagcacccggcaagccggtggaagtggaagtggagaacctcgatgaactgcgccaggcgctggaggccggcgccgatatcgtcatgctcgacgaactcagcctggacgacatgcgcaccgccgtcgccctcaccgccggccgtgccaagctggaagcttccggcggaatcaacgagagcaccctgcgcaacatcgccgagaccggcgtcgactacatctccatcggcaccctgaccaaggacgtcagggccgtcgacctgtccatgcgcctcaccctctga

SEQ ID NO: 9770 - DNA, 1029 bp, Pseudomonas aeruginosa
cgcggaaaagtccacccaggaggataccagcgcagaagcggacgacgctcctgtagtacgtttcgtcaacaagatgctgctggatgccataaagggtggctcttccgacctgcacttcgagccctacgagaagatctaccgggtgcgcttccgtaccgacggcatgctccacgaagtggccaagccgccgatccagttggccagccgtatttccgcgcgactcaaggtgatggccggcctggacatttccgaacggcgcaaaccgcaggacggacggatcaagatgcgcgtgtcgaagagcaagtccatcgacttccgcgtcaacaccctgccgaccctgtggggcgagaagatcgtgatgcggatcctcgactcctccagcgcacaaatgggcatcgacgccctcggctacgaggaggaccagaaggaactctacctggccgcactcaagcagccacagggcatgatcctggtcaccggccccaccggctcgggcaagacggtatcgctatacaccggcctgaacatcctcaataccaccgacatcaacatttccaccgccgaagacccggtggagatcaacctggaaggcatcaaccaggtcaacgtcaacccgcgccagggcatggacttctcccaggcgctgcgcgccttcctgcgccaggacccggacgtgatcatggtcggcgagatccgcgacctggagaccgccgagatcgccatcaaggcggcgcagaccggacatatggtgatgtccaccctacacaccaacagcgccgccgagaccctgactcgcctgctgaacatgggcgtgccggcgttcaacctggcgacctcggtgaacctgatcatcgcccagcgccttgcgcgaaaactctgttcgcactgcaagaaagaacacgaggtgccgagggaaaccctgcttcacgagggctttccggaagacaagatcggtaccttcaagctttattcgccggtgggctgcgaccattgcaagaacggttacaagggccgtgtcggtatttatga

SEQ ID NO: 9771 - DNA, 1011 bp, Pseudomonas aeruginosa
ggaggaagtagacaatgccgtcgacaatctgacaactctcatggaacctatgatcatggccgtgctcggcgtactggtcggcggcctgatcatcgctatgtatctaccgatcttccaactgggttccgttgtgtaaagatggaactcctagactacctggccagccatccgctggcctttgtcttgtgcgctatcctccttggcctgctggtcggcagcttcctcaacgtcgtcgtgcatcgcctgccgaagatgatggagcgcaactggaaggccgaagcccgcgaagcgctcgggctggagccggaacccaagcaggcgacctacaacctggtgctgccgaattcggcgtgcccgcgctgcggccacgagatccgcccctgggaaaacatcccgctggtcagctacctggcgctgggcggcaagtgctcgtcctgcaaggccgccatcggcaaacgctaccccctggtggaactggccaccgcgctgctttccggctacgtcgcctggcatttcggcttcacctggcaggcgggcgcgatgctcctgctgacctggggtctgctggcgatgagcctgatcgatgccgatcaccaactgctgccggacgtgctggtgctgccgctgctctggctgggcctgatcgccaaccatttcggcctcttcgccagcctcgacgatgcgctgttcggcgcggtgttcggctacctgagcctgtggtcggtgttctggctgttcaagctggtgaccggcaaggagggcatgggctacggcgacttcaagctgctggccatgctcggtgcctggggtggctggcagatcctgccgctgaccatcctgctgtcgtcgctggtcggggcgatcctcggggtgatcatgctgcgcctgcgcaacgccgaaagcggcacgccgatccccttcggtccctatctggctattgccgggtggattgctttgctctggggtgatcaaataacccggacctatctgcaattcgccggattcaaatga

SEQ ID NO: 9772 - DNA, 495 bp, Pseudomonas aeruginosa
gcctgtgagcgaagggcgggtgaagtggatcggcgtgcgctccggcagccgcgcgccgatccaggaactggaggcggtggaggcacggcgcggcctgggactgacaggcgaccacccgcacccgccgcgccaggtcaccctggtgcagtgggaacacatcgaggccctcggtaccctgctgggcaggccgctgttgcccaacgagatgcgccgcaacatcgccgtcgccggcatcaacctgctcagcctgaaggaccgtcgcttccgcctcggcggcgcgctgctggaaaccactggctggtaccaaccctgcggacgcctggaaaagcacatcgaccaccgcacactgaagagcgtgcgcgaacagggcggcatcaccgcgcgggtgatcggcagcggagtgatccgcctcgacgatccgctggtgatcgagccccctgtctgtctagaatgaccgacatcgaaaacggaggcctgccatgtccagccgactga

SEQ ID NO: 9773 - DNA, 810 bp, Pseudomonas aeruginosa
gcgggtcagcttccaccagccgggccaggacgccgtcgccctgaaccgggtgatcggccgcaacggcagcgatatccaggggcggatagatgccaacggcaaggtcttcctggtcaatcccaacggcgtggtcttcggcaagtccgcccaggtcaatgtaggcggcctggtggcttccaccctggacctggccgacagggacttcctcgccggcaactaccagttctccggcgactccggcgcaaccgtaagcaatgccggcagcctgcaagccagcgaaggcggcagcatcgccctgctgggcgcccgggtcagcaacgacggcgtgatccaggcgcaactcggcgacgtggccctgggcgcaggccagggcatcaacctcaatttcgacggcgacggcctgctcaacctgcaggtggacaagggctcggtcgacgctctcgcacacaacggcggcctcatccgcgccgatggcggccaggtgctgatgagcgcccgcagcgccgacagcctgctcaagaccgtcgtcaacaaccagggcactctcgaggccaggacgctacgcagcgcggaaggacgcatcgtcctcgacggcggcgaacaggggaccgtgcgggtggccggcaagcaggacgccagcgccatcggcggaggcaatggcggcctggtgctgaaccagggcgcgaacgtcgagatacagcgaaccgcgcagctggacacccatgccgaccagggcgcaaccggcacctggaggattctctcgcacgaggtcagcgtagccgctgtcggccaggcaaacgctgccggtga

SEQ ID NO: 9774 - DNA, 987 bp, Pseudomonas aeruginosa
cctggccgccgtcaacctcggtcgcatcgacaatgtgaacgccagcgacatccgtatcgccgcggcctcgcagctgaacagcctcggcgggctggtcgcgctgaacctgggcagcatcgacaacgccagcgccagcggcacgctggtcggcaaccgccaaacctatgctctgggcggactcgcagccgaaaacatcagcacagccaggggcgtggccagcatctccaacagccgggccgattttgccatctccggccagttgaaggaccatgccagccactacggcgcggggggcctggtaggcaggaaccgcggcggcctcatccgcagcagcggcagtcagggaacgctgtcgctgagcggtcacgggatgaacctgggaggactggtcggatacagctccgccggcggactggcggacgtttccgcctccgtcgacgtctcaggcaacggacagcgcggcctgtacggtgggctcatcggcctcaacgtaaacagtggtatcgcccacgccacggccagcggcaaggtccggggcacagacgcggaagcactgggcgggctgatcggccggaacctgaacgcggccatcaacaacgccagcgcccatggcgatgtcagcctgcaagccggtcgctacctgggaggcctgatcggccacaaccaggcaggcaacctggccaacgtcagtgccagcggcaacctgagtggtgggtcgctgctccaggccggcggcctgatcggtctcaacgccaatgcctcgctggtcaatgcctccgccaagggcaatgtcgctacccgcggagcagaagcggttggcggtctgctcggagaaaacctgtacggctccgtcatcaacggttccgccagtggcgaagtcaccgacggcagcggcaaaaccctgggtggcctgatagggtccaacctcggcggcaatcattccaacctgaaggcctccgggtgggtaaacgcaggggcgaacagtga

SEQ ID NO: 9775 - DNA, 777 bp, Pseudomonas aeruginosa
cccggaaggccagcaactggccgcagaggcaagtgcagtgcttggcatgagcgagggggggctggcatgaagccaatggacaagcaaaaagtcctcgccaaggtcgagaagctgatggccctggcgaatgccaagggggccacgccgaacgaggcggaaaccgcattgcgccaggccgcgatcctgaagcgccagttcgacctcagcgaagcggagatctcggcccacacggtggaaaccgcgtgcgttcccactcgaaccaggcgctctcctgcccaatggctgcatgagctggccgggatctgcgccagttccttcggctgcgactacctggcggcatacgcgatgccagcgggctggacgttcaagttcatgggccgagggatcggccctgagctagccgctcacgcctactctacgctccaccaccaactggtggcggcgcgctcggctcatgtcgctcaacagaagcgctgcaagctgtcgaccaagcgccgtcgcagcaagctcttcgtcgaaggctggcttctcgcagtgcgttcgctggtacgtgactttgccggcaggccggacgagtcgactcaagcagccatcaaggcctacctcgaactacaccatccggagctgaaactcctggagccggcagcgccgacgaagcccctggcctatgaccaggcttcgctgcacgcaggctgggagcacggcaaaaacactcgcctgcaccgcggcgtcagccggcgagttcagggcgcgctcgagcagggaggttcccgatga

SEQ ID NO: 9776 - DNA, 279 bp, Pseudomonas aeruginosa
agagcgcaatccgcgtcatcagcaagctcaagcgcaccattcaggaggtcgagcatgaaaaacaagattgaggatctgcgtaatcacctctttgccaccatcgaagggctgctggacgaagacaagcccctggatatcgaacgcgcgaaagcggtggctcatgtgggttcggtgatcatcgagtccgccaaggtggaggtgaaagcgctggagatcatcggcgccccgggcagcagcggaagcacattcctgcagatcggccaggaggactcgaagtga

SEQ ID NO: 9777 - DNA, 270 bp, Pseudomonas aeruginosa
ggaggccgaatcatgaaggcgtcccagacctatcagtgcatcgtcaagttcgatggcgccggcttctggaccaataccattcagaagcagcgtgcgacctgcacctggagcgacaaggtggcagcctcccgccttgccgaacggctattcggcgaggacaacgcctacatcacccgtatgccggcacaggcaggcgaccacgaaaagcgcatcgagagtcgctgggaactgtcctgcaaagatcccaaggaggtagcgcgcgatgcctga

SEQ ID NO: 9778 - DNA, 1116 bp, Pseudomonas aeruginosa
caaggactacggcctgtcgccggaaatcccggcggacaagcgcaccctcaaccagttccgccgcttcaccggccgcgccgaaggcctgtcgatcagcttcgaggcgcacctgctgggctccaggatcgagtacgacgaggagcgcgacacactccggatcagcagcctccccactcagcttcgcgaccagctcaagcgccgcaaggcggagcaggagagcacgtcatgaaaggggttcgtcgcccaatcctgcgctaccacggaggcaagtggaaacttgctccctggatcatccagcacctggcgccacatcacacttacgtcgagcccttcggcggcgcagcctccgtcctgctccggaaagcccgcagctacgccgagatctataacgacctcgacggggacgtggtgaacctgttccgcgtcgcgcgggatcacggtgagcaactgcgccaggccctggcgcttaccccgtttgcccgggaagagttcgaagccagctacgcggaaacgtccgatccgctcgagcgcgcgcggcggatggttacccgaagcttgcaaggtttcggtaccgcagctgcgtccggcgaacgtacagggttccgctcaacctcgaccagatccggtaccggacctgcactggactggcgcaactaccccgacacgctgaccgcgataacagaacgcctgcagggcgtggtgatcgaaaaccgcgacgccctcgcgctgatggaatatcacgaccggccgaatacgctgcactacgtggatccgccctatgtccactcgacccgcagcacgaaggtgcgccacaacgccacaggcaagtcgtaccggtacgaactggacgacaaccagcacaaggagctggcggcattcctcaagcggctgcgcggcatggtggtgctctccggatatccctgcccactctacgacgagctctacagcacctggcacagagtcgaccgccacgcctatgcagacggctccagagagcgaatcgaatgcctctggctcaacagcgcagcgcttgaggggttggcacaactggatttcttccaggccagtaatgcgtctccatcgccctcattccagaccacggtcgctcagtactga

SEQ ID NO: 9779 - DNA, 321 bp, Pseudomonas aeruginosa
cgaacagaccgaacgccagatttggttccgctgggagcacctgatgcaggaaaaccaggtccgcctcgaggacagcatggagttgctggacatcgcgatgatcctcaccgaggaagtcaacgccggagtcgaacaagacagtccagagttcatcagcctcgccatcgtttggtctctcatccagagctggttgaaagacagcctctaccaaccaaacaggaaagagcaggccaagcccgccaccctttacctggccaacgtcagcgctcacctcccctcgcctacggctcacccgccacagagcccccgcttggagattga

SEQ ID NO: 9780 - DNA, 1386 bp, Pseudomonas aeruginosa
gtctgcgcagcagcaactcctcaacctggttcagtccgaaggcgatacgacaccatgacaatgaggctgtcgcgctttcccatttcgactctgctggactcggcctcgggacatctcgaggcccacttgtttaagaagcggcttgatgccgagagcggcgaaccgctggctcaacaatattccggcatcattttcagcggtaacccgcatgaaaccgttcctcggcgcctgctgctggataaacgcctcaccccgctggagcggaactgctggcaagtgttccgcttgctcatcaacgacgacggactgaccgcgttccctacatacgagcaactacgcccttatctcggcatgcagccgggtaagatcgcctcgcgcgaaaccatcgccaaggcactcaaggtccttcggttgacacgctggctcagtctcggccgtcgcctgcgcaacgacctcaacgggcaagtacagggcaacgtctacatcctccacgacgaaccggtatccccggcagaagccctggagctggaccccgactacatgcagttgctgagccagtccaccggcgacagcaaccgagccatacgcgaaatcggccaggtcacatggcgggagttcagggatgacccggacgtgggtcgccgcctcccaacccatctggagaagctcgagggacgcttgaaccaccagcaatgggctattgatagtcagctcgaagcggatccagcggcagagttcggcatccgaactctgcccgatctacctcattcaaccctgagttcggatgccgaactcagtgaaatcagcggcaagcaatgcgctttaccgctgagttcggatgccgaacccagacagaatccgccgagtacgcccttggttcggatgccgaactcatatagtacgtatacatacaaacaaggttctgtatgtaaaaagccagtacaaccgcgaacacgcgaggaagcacatccgaactggcagggcctcttgcacacactggaggccgagcaacggatccaagccgtaagcgcgctccgacgggtgtccgaggatcttcggcaacccatcatcgagcaatggcagcaccgatgtgccggcggaaccgtcggtaatccgttcggctacctcatgacgctcatccagcgtgcagtccagggcaagttcaacgcctcttgggctccagaggaaccggctgaacgaaccatcccagcagcggaacgccccagtcgtgctctggcaccaccaagccccacaacgcctacacagcctcagcttcagccgaagggggatacccggacagggaacgaggtcctcagccggctcaaggacctcattcggcccaggcacggatcgagcgtgccatccgagcggggtgatgagccatga

SEQ ID NO: 9781 - DNA, 1860 bp, Pseudomonas aeruginosa
gaaagtctcggtcgggcgtcgtgttttttggtgatgcggccccgcatcactctgccaggtcctgacctcggcaccggtggcgaactgggtgttgccactggcaacactctgccaaggatcgaactcggtgccgtcgacgagctgggtggtgccactggcaccacttcaccaggatccagcctcggcgccgtcgaggagttgggtgattccactggaatcaccccaccagggaccgaccccagcgccggcggcgagctgggtgttgccactggcaacactctgccaaggatcgacctcggcgccgtcgacgagttgggtgattccactggaatcaccccaccagggaccgaccccagcgccggcggcgagctgggtgttgccactggcaacactctgccaaggatcgacctcggcgccgtcgacgagttgggtggtgccactggcaccacttcaccaggaactgacttcggcgccggtggcgagttgggtggttccactggaaccactccactaggaactgacttcggcgccggcggcgagttgggtggttccactggaatcaccccaccagggaccgaccccagcgccggcggcgagctgggtgttgccactggcaacactctgccaaggatcgacctcggcgccgtcgacgagttgggtgattccactggaatcaccccaccagggaccgaccccagcgccggcggcgagctgggtgttgccactggcaacactctgccaaggatcgacctcggcgccgtcgacgagttgggtggtgccactggcaccacttcaccaggaactgacttcggcgccggtggcgagttgggtggttccactggaaccactccactaggaactgacttcggcgccggcggcgagttgggtggttccactggaaccactccaccaggaactgacttcggcgccggcggcgagttgggtgttgccactggcaacactctgccaaggatcgacctcggcgccgtcgacgagttgggtgttgccactggcaacactccgccaggaccaggcctcggcgccgtcgacgagctgggtggtgccactggcaccacttcaccaggaaccgacctccgcgccggtggcgagttgggtggttccactggaaccactccactaggaactgacttcggcgccggcggcgagttgggtggttccactggaaccactccaccaggaactgacttcggcgccggcggcgagttgggtggttccactggaatcaccccaccagggaccgaccccagcgccggcggcgagctgggtgttgccactggcaacactccgccaggaccaggcctcggcgccgtcgacgagctgggtggtgccactggcaccacttcaccaggaaccgacctccgcgccggtggcgagttgggtggttccactggaaccactccactaggaactgacttcggcgccggcggcgagttgggtggttccactggaaccactccaccaggaactgacttcggcgccggcggcgagttgggtggttccactggaatcaccccaccagggaccgaccccagcgccggcggcgagctgggtgttgccactggcaacactccgccaggaccaggcctcggcgccgtcgacgagctgggtggtgccactggcaccacttcaccaggaaccgacctccgcgccggtggcgagttgggtggttccactggaaccacttcaccaggaactgacttcggcgccggtggcggctatcaacttctcccacccaataggaaccgaaaagatgtgcgactcaatcgtgtatgcccctatggacgaactcgaattcgagcggctgctagggctggcaaccctattcaacgacaacgatga

SEQ ID NO: 9782 - DNA, 561 bp, Pseudomonas aeruginosa
ggactgatcggaatgcggcagctcgataaggaccagcaaggcgctctgcaacaaagtgccttccgcccactgcaacaaactgccttccaggcgctgcaacacagtgcctcactaaaaggccttttaaagccttttaaaggtaagggggagctggcccagttggcggagcaatgcgaagtcctggagcagggattgcttgagcttgcccagggactgctggcccaggttcgtcgcccgcccttcactcttctgcccacccgactcatcgagcagcgcacatccgcacgcaccacctttcttcgctggcagcacattgcaacccggcggatgggcgtcggggtgtgggcggaaatgctgcgccaggacaagaccccggaatacctgctgcaagacctctacgagatggagctgcagcgcatcaccctcaacatgcagatcagcctgatccactccatcggcaagcaggccgccgagtgtgcggaaaagatgggccaggccgaggccgagttcatgggccgactgcagcagagtcagacccgccctggttccgtgggcatgtag

SEQ ID NO: 9783 - DNA, 1959 bp, Pseudomonas aeruginosa
ccgcgacagttcgaccgactgttccgagagattccgccgatgcacctcgtaatcattgaagccccgggcaagctgaaaaagctgcggtcccttctcccctccattcgtcccgacgtgacctggcaggtcgaagcgactgccggtcatatcagagacctacccgttcacggccaggatccgcagatgctcaccgtcggcgtaggccaggatttcaaaccccactaccagatcctttcgggcaaggaaaagaccgtcgcacggctgaaggagctgcggcagaaagccgtggaagtctacgtcgcatccgacccggatcgggaaggcgaaagcatcggctggcacatcctccaggctgccgggatcaagaactacaagcgcgttgccttcaaggaaatcaccaagtcgtgcatcagcgccgagctcagctcaccacgccgtctggacctcccgaaggtcgcctcgcaggaatgccgtcgcgtcatcgatcgcctggtggggtatctggtcacgccagagctgcggcgtgtgatgggtaggccaaccaccgccgggcgcgtgcagtccgtcgccgtgtacctggtggtcctgcgagagcgggagattcgcgccttcacagcaatcaagcatttcggggtggaactggccttcgtttcgcccagcgacggccgtacctggaaggcggagtgggatccagtgcccacgtttgccagcaaggagttcccgtatgtccaggatcgtcaactcgcagaactggtgggggctatacgcaatgtgatcgtcgagacctgcattgatggcgaagaaaccgatacgcctccggcgccgttcatctcctcttcgctccagatggccgccgggaatgcgctgaagtggtcacccgacaagacgatgaagatcgcccagcggctgtatgaacaggggctcatcacctaccaccggacggacaaccccaatatttcgaaggactccatgtcggatatccgtgctgtcgccaaggcattggggctgaagtgtgttgagcaacagcggatgttcaaggctgaccaggacgcccaagagggccaccccgccatcacccccaccgattggacggccgctaccgctggtgaaactgctgatgagcaggccctgtaccagctcattcgagttcgtgcgcttgccagccagatcgaagctgccgtgtacgcagtgagaaccatcaccctcctgggcgtcggccccgacaagaagccgctgcgcttcggcgccaaagggaagctgttgaacgtgcctggctggagaaaactgctgcaaggcgatgacgccgaggagcagaagaacgaaacgccctcaaaccccatcccggagctggagccaggccagatcctcaaggtctacagcggcgaggtcctggagaagaaaacctcccctcccaagcgcttcaccgatgccagcctggtgggcgagatgaagcgccgcgggattggccggccatcctcctacgcctcgatcgtgaagaacatcatcgacaagggccaggtgcagatgaagggccgaagcctgatccccggcgagctgggcgaggccaccatcgcgctcctggagcacaacttcagcttcctcagcctcgactttacccgcaacctggaggtcgccctggaccggatcgctaacagcgaggacacctacatgaacgtggtccagcagttctaccagctcctgcagtcggagctgcagacgctgcgcgcgcaccccagcgcacagggcgacccgcgagcaagctctaccgccagcgctcccacggcgccggccagtgacttcctctgcggcaagtgcggtctgcccctggtccaccgcaagaaagctggcaagggcggcttcgacttctggggctgcagcggctatcgcaccaccggctgcaaagtcggctatcccaccaggaacggccaacctgacttcgacaacccgcgcgggctatag

SEQ ID NO: 9784 - DNA, 255 bp, Pseudomonas aeruginosa
ccaggctttgaacctgcgcactctcaaattttggagatatacatcatggcaactcgccaaactggtactgttaagtggtttaacgaagttaaaggtttcggtttcatcaccccggaaagcggcgcagatgtttttgttcacttccgacagatcgaagctagcggttacaagtcccttgacgaagggcagcgtgtaagcttcttcgttaccgcaggcgccaaaggcccgcaggccgaacaagtgcaagctctgtag

SEQ ID NO: 9785 - DNA, 1293 bp, Pseudomonas aeruginosa
caccgccagccaaaccctggcttgaaaattgtacaaaaaataaccagcccgctcgattgtcccgccttcatcgccgcccaccgccagaatcctcaagactttacccgccgacgccagctcaccttcaagaacctcgtcctgttcctgctcaatcagccgcgcacggccctgcaaaccgaactcgatcagttctatcgcgtactcaatcaggcgtcgactgagacgcaaatggtcactgcgcaggccttctgcaaagcgcgcaaaaagctcaaccccgaggtatttgaaagtctcaatcgcctcctgcagcaacaaattgactgcttcgggctgcgtcagaagtggcgtgggctgagggtgctcgcggtggatggctcgaccgtgcatttacccctggagtcgaccatggcgaccttctttggcagtcactctggctttcccatggctcgcttgtccacactctacgaagtcgctgacggtcaaaccttgcatagcctgatcgtgcccctgacagtcggtgagcgcgactgtgcccatctgcaccttgagcacctgccggctgacagcctgacgctgtttgaccgtggttaccctgggcactggttattcgcgctgttcgcgcagcaacagcggcactttctgatgcgcctgccctgtggctataacgcccaggtcaaagcgtttctacactctggccaagttgaagacacacagcttttcgtggccaaccatcctgaagcacgtctgttctgctccgaggctggcgttgatcctgccagccagatcgagctgagactgatccgggtcgagttggccaacggcgaaagcgaagtattgctgacctcgctgctggatcgagaagcctttcccgctgaggtgtttgccgagctttaccaccgccgctggggcatcgaaaccgacttccgtcgcctcaaacaaaccctgacgctggacaacttcagcggccgcagcgtgaccgctgtaaagcaggactttcatgccgctcaactgttgaagaacctggcgctgttgatgcagcacctgctacagccggtcatcgaacagcgccacaaaggtcgcaagctgcgatggaaagtcaacttcacccaaggcgtgtcacggctcaaaaataccctggtcgagctgctggtgcggcactgtgctcaggggctgagcaatgtgctggccttgatggctaaaagcctcagtgccgtacgctcaggccgtagctttgcgcgccaacgcaaacgcgcagccagccgaggttgtgagggctacaaaccgacgcgctga

SEQ ID NO: 9786 - DNA, 1140 bp, Pseudomonas aeruginosa
atggcggccggggccgctggcacgattccttcatccaatatacatgccagcgtgtatagaaacgggccgacgctggtgccgcctggcgcccttcgcgccactgtaggagtcacgcagatgattgaaataaaaagggaaaagaaattttttgcgctgggcgaaatgcgcctcgaaaacggcgaacgcctgcgcaatgcgcggctctgctatcaggtagtgggcacgccgaaccgcgcgcgggacaacctcgtgctgattccgagctactacggcggcacacattggggcagcctgcccctgcttggtgcggatggcccgctggcaggtggcgattactgcgtagtgctgaccaacctgttcggtgcaggctggtcgacttcgccgagcaacgctgcgcccggtcagggcgcagcggacttcccgcgggtcggcctgctggacaacgtgagggcgcagaaggcgttgctcgatcggttgtatggcgacgactggcagctcgccctggtcagcggctggtccatgggcggcatgcagacgctgttctgggcaatggcctatccggaacggatgcgtgccatcctgccgttctgctgtacggcacgctgctggccacataaccgggtgtttctcgaaggggtgaaggcggcgctgtgcgccgacgccgcctggctgggagggcgctacagcatgccgccggaacgcgggctgcgggctttcggccgtgcctatgccggctgggcctattcgcaggcgttctatcgtcatgagctgtggcgcgagatgggtttcgagagcctcgaggcgctgctcgactactgggaacaggatcatctggagcaggacgccaacgacctgctctgcgtgctgcatacctggcaatcggccgacccggcccgcagtttcgctgcgggctcgctggccgaagcgctgggtcgcatccgtgcgcggtccatcctgatgcccggcagcagcgatctgtatttcaccgtcgaggatgcccgccacgaggccgcgctgattccgggtgccgagctgcgggtgctcgaatcggactggggccattgtgccggtgggccgggccgcagcgcggcggccatgcgccaggtgttcgcggcaatggccgaactgcttggccgctag

SEQ ID NO: 9787 - DNA, 897 bp, Pseudomonas aeruginosa
ccttcagccggccacggcgctgagtttggccagttgctcgaggtcggtctgcatgccggaggtttcgcggatccgggcgaggatctcgcgcttgagctcggtgaattccggcgcgagcttcatgtcctggtggcgctgggccggcagcggcacctcgtagatggaatcgatgcgcccggggcgtggcgccatcagcacgatgcggctgcccagatagatggcttcttcgacatcgtgggtgacgaacaggatggtgctcttctccagccggtgcacgtgacggatcaggtcgtgcatgacttcgcgggtttgcgcatccagcgcgccgaacggctcgtccatcagcagtgtcgcgggtttgggcagcagggcgcgggcaatggcaacgcgttgctgcatgccgccggagagctggctggggtaggcatcggcgaagcgcgtcagacccatcaggttgagcagggcatcggcgcggccggcggcggactccacgtctccatcgtggcgcacggtatcgccgatcaccttgagctggcggcagaacttgatgttctgcatcaccgtcagccaggggtagaggctgtagtgctggaagaccatggcgcggtcgacgccggggccgtcgatgggcctgccgtcgagcaggatctcgccgcgactcagcgtctccaggccggcgatgatgcgcagcagggtggacttgccgcagcccgaggcgccgacgaaggtgacgaactcgttgggctggatgtccaggtcgatcgactgcagcgcctgcacctcacggcgctcgctgacgaaggtcttgccgacctggtgtacacgaatcttggcatcggacatggtcatttcctcatccagggaaaggcgcggcggtgcaaccagcggaaggcctga

SEQ ID NO: 9788 - DNA, 393 bp, Pseudomonas aeruginosa
tctgccagggcgtggcgccgttgcggtggcggccgaaggacagctcgcaggccagcagctgcggccacaacgcgggctcgacggcggccagctgttcacgcagatgccccgagctggccggcagcagaatcggccgctcggcggcgaacaggaagtagtcgcccgctaccagcaggcaggcctggcgggctggctgctccgacgcgcgcagccagatcccccagtttcgcccctgcgattccggcaggcgctgccagatttcgtgatagctgccgtccagtccgtcttccagcagccgttccggggtctcgaagcgcatcaggccgatatccgcaggcccgcccggcggctggaagtcgatcaggcgatgccactggcagatatcgccgttga

SEQ ID NO: 9789 - DNA, 993 bp, Pseudomonas aeruginosa
cccggcttgtcgatcaccggctcgccggcgcgcggttgcagctcgtcgatcaggtcatggccgaattcgccgcgcaccagcaggcggccgagggggccagggctgccgatggcagcgccggtggcctgggcgcggcggcgtttgggctcgggcaggtcggaaagatccggtcgatggccttcacgggtgtgcaccaccagcatgcccacgccgcgcgcgcaatccagcagcgcctggatcgccgcgatcggtgcgcgcaggcggctgacgtccattccggcctggtcggcgtatccacccagcgcgcagaagtcgcgctgcatgtcgatcaccagcagcgccgtgtgctcgaggagcagcggatgcgtcgtcaggctcacagcgcaaactccttgcacaccgcggcggcgatgccttcgacgatgtcgtgggccagccgctggcctttcgccgcgctggagcctctggccgaggacagcaccccggagggcggcacccattcggtacgggtggggtacatgtcgtagggcggaaagtcggccggggcgtcgtcgggaatcttctccagcgcgaccagttgcggatggaaatgcagcatcagcgaggtctcgatcaccgcggcatgctccagcgcgaaaccggggaagccttccgggaagatgtcggtcagggtctgctcgtggcagaaatcccaatgctccaggcgcattacctccagcccggcgtccggcccgaggtcgcgcagcgccagctggatgccctcggcgacgaaccactggttctcgtaatggccgagcaccagcaccaggcggcgcacaccgtggcgatggaactcacgcaccgcgtcgcgcaccagggcgctcaaggtcgcgccatccaggctggtggtgccgcagaagtgctggccgccgccgcatttcggttgcgacttgtagccgtatgacagcgccggtgccaccagtccgccgactcgtgccgccacgtccgcgctga

SEQ ID NO: 9790 - DNA, 768 bp, Pseudomonas aeruginosa
atcggccggtgtcagcagctccggaatggcctggttggcgagtatcgccgcgagctcggcgctgtcgctgcggccgttggcgtccgccatcaccttcagcgagcgcatggccgcatcggtgccgatccagccggggcacaccgcgttcacccgaatgcgtcgcgggcccagctcccaggccagcgagcgggtcaggccgaccaccgcgtgcttgctggcgacataggcggaaaagcccggcacgcctttcagtccccagatggaggcctggttgatcacgctggcgccggcgcgcaggcgtggcagcaatgcgcgggtcaggcgctgcatggaaccgacgttgttctccagcagggccgaccagcgctgatcggcctcgaagctgcactcgcccagcggcgtggcgtactcgacgccggcgttgttgatcagcacatcggcgttgaggccgcggcaggcgaggtcatcggcgtactgctgcaccgcctgccgatcacccaggtccagtgcggtgcagtgcagcagcgtctcgccagcgagttcgtcggcgagccgggcgagggcgtcggcgtcacggtccagcagctccagggtggcgccggcagcggcgaagctctgcgccaggccccggccgatgcccccggcggcgccagtgatgaccacgcaacggcctcggtaatccagtgccttgtgcatgtcacaccgccgtcaggaacgagacgcccacggcgccgtagaagttgtcggccttgttcggcccttcgctga

SEQ ID NO: 9791 - DNA, 2514 bp, Pseudomonas aeruginosa
cgacaccgttccggcccgaccgccaccacgggccaggcggcgcatgggggcggtcagcccgttacggcttggcaggggtcagatcggcaccggcgcatcctcgcgcagcaggccgtcttgcttgagggtctgccagaactcccggggcacctgggcgttgaagtcttccatgtactgccggggacgctcgggattggccgtgcccgggatgaccgaggcgaccaccgggttggccaggcagaaatgcagggcggcggcccgcagatcgacgccgcagtgctcggcagcggccttgagctgctccctgcgctgggcgacctgtggtgggatctggtcgtactcatagtgatcgccaccggccaggacgccggagttgaacggcccgccaacgacgacgccaacgtcgcgtgcctggcaggtcgggaacagggtgtccagcgcctcgtcgtgctccagcagcgagtagcggccggccagcaggaacacgttcgggtcgctctgctccagagccaggcggcatggctccaccaggttgacccccaggccccagccgcgaatcacgccttcatcgcgcagctgggtcagcgccttcgccgcgccgttcatggcctgctggaagtactcgcgccattgcgggccccattggtcttcggaaacgtcgtggatgaacaccacatcgaggcgatcgacgcccatgcgctccaggctgtcctcgatggagcggcgtgcgccgtcggccgaataatccggcacacgcttgttgggcagctcgtcgacgaagggcttggcgttttccggctggctggccggctgcagcaggcgcccgaccttggtgctcaggacgtactcgtcacgcggcttgccactcagcaggcgcccgaagcgctgctcggcgaggcccgcgccgtagtgcggcgacacgtcgtaatagcgaaagccggcgtcccaggcggcattgagggtggcgtcggcggtttcttcgctgagcggatggaacatgttgcccagcggtgcgccgccgagaccgatgcgtggcagggtgatacgcatggagtcctccttcggatgcagatggtgccgaccggagtcggcgtggctctgcatcggaggtcggcccggcgctggatgttccgacaatgcgacgggatggccgcagtgcaaccccgtcgctcctcgtctgcctcagctgcgacgcttcagataggtgcgccagccgccaagttcggtgatgtcctgggcgccgtccaggccgtagggctcgcagatgaagcctgtttcccagcggccgtcggcgagctgcaccttgcccaggccgagcggtgccggaatgccggtgagaaaggagccgagctcctggttcggcagctcccagacttcaacctcgacggccgctccgccttcggcgacgcgaaccatgcccgggcgcagcggtggcccgccggccagggcgtagagcttgtagtccggcgagctgcgggtggtttccagcagccgtccgccacgctgcctgagttgccagttcagcggcaggccgtccaggtgcgctccgcagaccaccaggcgggcgcggtcgttgcgggccggattccggggcggcggggtaatgagcgcgttaccgccgatcaacttcagccctgtctgatgctgcagcgcatcggccaggctcagcaggtactggtcggtgaacacccggccgaacagcgtcacgccccagggcaggccgttgtgcatggtggcggccggcaccgcgacagcggcgtagtcgagcatgttcatgaagttggtgtagtagcccaggtccgaattgcgcttgaccggctcggcgtgaagttcggcgagcgtcactgggcgcgggtaggcgggcgtcagcacacaatcgacctcggccatggtgcggtcgcagacggccttgagttgctgcaggcggtattgcgcctggaacagctgcacggcggttgtaccgggggctttctccagaacggcttttattaccggcagcacggcgtcgggctgctgctcgatcagcgcgcccgccacgctgtagcgttcggccacccaggggccttcgtaaagcaggcgtgcagcttcgaggaagggggcgaagtccacttccaccggctcgccgccgagggctttcagctgttcgatggtggcggcgaacaacgccgcgctttccgcgcagccgaaaaattccaggtgctggggtatgccgaagcggaaggtcttgatctggccgaaggccgagccgtcattacacagcgggttgctgcggctgtactcgtcgcgcggatcgagcctggtggtgagcgccagcagctgactggcttcggccgctgtggccgtgaagaaggtcacgcagtccagcgtacggcaggccgggacaacgccggcggtggagatcagccctttgctcgctttcaggcccaccaggttgttcagcgccgccggcacccggccggaaccggcggtatcggtgcccagcgcgaaggaacagagcccgagcgcaacggctag

SEQ ID NO: 9792 - DNA, 3717 bp, Pseudomonas aeruginosa
aaacggcgaaaccttttccaccgcgatgttcgttgccggcccgctgggccggtgggtggatcgataaagcgcgatccaccctacggttgcttcgggtgccgaggggcctcacgcctcctcgatcaccaccacccgctggccagcgcgcaccggcgaccctggctgggcgcggacttccttgaccacgccggcgaccggcgcggtgagcgggatttccatcttcatgctctcgaggatcaccagcacgtcgccggcatcgacccgcgtgccctcggccaccgacacctgccagaggttgccggcgatgtggctctcgatgccgagctggccggcgccgagcggggcgtcctcgccgaggtctgcggcgacttcctcgctctcgaagtgcgcctggcccgattcgatccagcgctggcgctcggcgtcgaaggcgccgcgctgctggcggcggaaggcgtcgatgctgtcggcctcggcggcaagaaagtcctggtagtcggacaggcgcagctcggtgttctcgatcttcagcgggtagcggccgagcggaaaatcgcggcggattctcgacagctcctcggccgagaccgggtagaagcggatctggtcgaagaagcgcaacagccacggctggccgccgaacgcctcgaccgcgcggtagcggttccacatctgcagggtgcggccgacgaactggtagccgcccgggccttccatgccgtagatgcacatgtaggcgccgccgatgcccaccgagttctccgcggtccaggtgcgcgccgggttgtacttggtggtgaccaggcggtggcgcgggtccagcggagtggccaccggcgcaccgagatacacgtcgccgaggcccatcaccaagtagctggcgtcgaacaccgtgcggtacaccgcgtcgaggttgggcaggtcgttgatgcggcggatgaactccaggttgctcgggcaccagggcgcgtccttgcgcaccgtggtcatgtacttctcgatggccaactggcaggccgggtcgtcccaggacagcggcaggtggacgatgcgcgagggcaccttcagatcctgcgcggcgcacacggcatcccacaggccggcgacgatctccaagagatcctccagcgccagggtctcgggctggtagtgcacctgcagggagcggatgccgggggtcaggtcgatcaccccatcgagctgcttggcttcgagggcctgcatcagtgcatgaccacggaagcgcagcaccaggtccagctccggcgcgccgatttccagcaacaggtgggtgtcgccggagaggggggcgaccaggcggctgtccgcttcaccgatatccagcacgatgggcgactgcagagctaccggcgtggcgaccactgccgccggcgcgaggctggcgcactcggcatcggcggccttggccaactggcgtgcggtcagcacatccaccgggacgaagcgcaccttgtcgccggccttgagctggccgagctgccacagatctgcctcgatgatggtcaccgggcagacgaagccgcccaggctcgggccgtccgggccgaggatcaccggcatatcgccggtgaaatcgaccgcgccgatggcgtaggggttgtcgtggatgttcgacgggtgcaggccggcctcgccgccgctctcgcgcacccactcgggtttcgggccgatcaggcgcaccccggtgcggctggagttgaagtgcacttcccagtcggtggcgaagaagcgcgcgatgtagccctcggtgaagtattccggcgcgccgtgcgggccgtagatcacccgcagctcgcgcaccgccggcagggcgctgcacagctcggcggcgagcctggcgccggccgacgagtcgctcagcggtgccaggtgcagcacgtcgccggcacgcagggcgcggccaccgtggccgccgaactggccgagggtaaaggtgctcttgctgcccagatactccggcacctgcacgccgccgcgcacggccaggtaggagcgggcaccggcgccggtgatggtgccgatggtcagggtgctgccggccgggacgaaaatggcggtgcacatcggctgcgcgacgtcatcgagcttcacggggatctcggcgccagtcagcgccaccaccgcatcggtattgaagcgcaggatcggtccgctcatggtgatttccagcccggcggcgtcctcggggttgtccaacagggcgttgcccaggcgcagcgcgcggctgtccatcgggccggacggcggcacgcccaccgcccagtagccgaggcgaccggggaagtcctgcacggtggtctgggtgccggcgctgatgacctcgaaggtgttggccttgtagctgaggcccttcagacaacgggtccaggggttgccgctggcgaatggggtgaaggcaagaatctggcgcagataatcgcggttggtttccacgccgtagatcagggtgtcgccgagggcggcgtccagcgcggcgcgggccgcttcgcggctcggcgcccagctgatgaccttggcgatcatcgggtcgaaatacggcgggatctcgcagccggcttcgacccaggtgtcgatgcgcaggctcttgccgtcggcggccgggaaggccacggcggtcaacaggcccgggctcggctggaagtcccggcccgggtcctcggcgtagacgcgcgcctggatcgagtggccgctgggcttgagacccttcaccagctcgaccaaaggcggcaggtcgccggcggccagctcgatcatccagcgcaccagatccacgccccagacctgctcggtgacgccgtgctccacctgcaggcgggtgttcacctcgaggaagtagaagcgctgggcttcggcgtcgtagacgaactcgacggtgccggcgctgcggtaactgaccgccttggccagggtgattgccgcctcgcacagggcctcggccatgccggtcggcaggttcggcgccggggtttcctccagcaccttctggttgcgccgctgcaccgagcagtcgcgcacgcccagggcgatgacgtcgccggcgccgtcgccgaacacctgtacctccaggtggcgggcacgctcgatgtacttctcgatgaacacgcccgaatcgctgaagttgttctgccccaggcgcttgaccgcgtcgaaggcatcagtgagctccgccgccgtgcggcacacgcgcatgccgataccaccaccaccggcggtgcttttcagcatcaccgggtagccgacctgctcggctgcgccgagggcatcggcgaggctgtcgagcagctcggtgccctccagcatcggtacgccgcgttgtttggccaaggcgcgggcggtgtgcttgaggccaaacacccgcagctgttccggcgtcgggccgacgaaggcgatcccggcggcctcgcaggcttcggcaaacgccgcgttctcggagaggaatccgtagccggggtggatggctttcgcgccggtttcacgggcgatgcggagaatcttctccacgtccagataggtctgcgtggccgggccttcgcccaggctgtgggcctcgtcggcctgctgcagatgcaggctggcggcgtcggcctcggagtagacggccacgccgttcacattcaggttgcgcagcgtacgcaggatgcggcaggcaatggcgccgcggttggcgatcagcagtttgtcgaacatggtcagtaa

SEQ ID NO: 9793 - DNA, 909 bp, Pseudomonas aeruginosa
cgctcgcgcgggtttttcgcgctgaagaacagcgtgtccaccgcctggttgccttcgagatcgagcaggcgcagggtctgtccggccttgacttcgaacaggtacggttcgccggccgggatcacatggcggaacgcggcggtttcggggtgcaggctgctttcggtaaggctcatcacggccacctcctcagatgtacaggcgttcggtgttgtgaaaggcacgaccgttttccgggcgcgaggtgcggcagagcacgctgatgccgtcgctggccacctgatgccaggacagcttgaccggcctgggcgcgtacaccgggttcgggtccagcggatgctgcagggcggtgaggatcaccagggtgtccatcggtgcgtacagttccaggtagtcgccggcctgggagttgccgctatggaaggcgaaggcaccgtcggcggtgacgtccacccgactgaacagattgagcaccatgagcaggtcctgcaggttcaggttccacttgcccatttccaccagcaggttgtcggtgccattgcggaagaagccattgcgcagttcctgatagcggccctggccgtacttctccatgacttcatcggcgttcagcacgccgccgaagctgtcgtgccagccgcaggtgtcggccgtgatggcggcgagtacgcgccccatgtccgagtacaggcaatgcccggcggtgagcttggcggtgtgctggcccttgagggtatccggcaggttcagccgctcgctcttctcctgggcgttgagcagcatcaggctgacgttggcgccgccttcgagatcggtcagacgcagcagttggccccgcttgaggatgaaggaggtgtggccgccgccaggaacggtttcctcgtacagcgtggggcggatcgcgagtga

SEQ ID NO: 9794 - DNA, 567 bp, Pseudomonas aeruginosa
acaccgtcagccgggtttcccgccacagctccagcagcagctcatgcatgtccttgcgaatgccggggtcgagggcgccgaagggctcgtccagcaacagcacgcggggcttcatcaccagcgcctgggcgatggccagtcgctgttgcatgccgccggagagctgtgccgggtacttgtccagcgcatggccgaggccgaccttgtgcagcatctgcgcagcctgctcacgggcatcgcgcttgcggcgtccgagcagacgacccagcagcggggcgcgcgggagttccaggccgagggcgacgttgtccagcaccgtcaggtgcggaaataccgagtagcgctgaaagaccacgccgcgactggcgtccggttcgtctgccaatggctggccatccagcaggatctcgccacggctgggcgcttcctggccgagcagcagccgcaggaaggtcgacttgccgcaaccggaggcaccgaccagggtgcagaactcaccttcggcaatcttcaggttcaggcgctccagcaccacctggtcgccatactgctgccagacattcctga

SEQ ID NO: 9795 - DNA, 921 bp, Pseudomonas aeruginosa
ctgcggcaacaccaggcgcaggatcagcgtccaggtgttggcgccgagggtctgcgccttgatcagcagttcgcggggtatctcgcgagcacgctgctcgaggtcgcgggcgaggatcggggtgatgccgatgacgatcagcatcaccttggacagctcgcccagcccgaacacgataaacaggatcggcaggatcgccagcggtggcaccatcgacagcacggtcagcagaggcgacagaggcgcaccgaacagcggcagggtgccagcggcgacgcccaggcagaggccggccacggcggcgatggccagcccgctaccgaggcgcttgagactcgaggcggtgtcctgccagaacaggtagtcgcccgagcgtttgtccggggtgaaggcgaggcgttcgacagccgcgctcatctggtcgaagctgggcaggagcttgtcgttgggattgatttccaggcgctgggtagagctggtcaggtacagcgccagcatcagggcgaagggcagtatggccagagcaagccagccgctgcggctcggcgttcgattgatcaggcgcatggacaggtgccccggtttgcgacagctgctagaacgggcagggtggtgaacggcagagccgatacgagcgggcacatggcaaaccctccagtgtttggggatggcgcaggagctgcgtgcggatcacgctgttctcccgggcttttatcccgccgtgtaacctcactggaggtcgccaactctcggaccagccactcgcgagcgagtcggaaccctagtcggctatttcgaattgtcgcagcagcttcgcctgcaggatcgacaaagcaagagcggtgccaaggcgcgattgacaggtgtcagcggcttttgcgctggaccaaggctggcgagacgccccttcatggggcatga

SEQ ID NO: 9796 - DNA, 1293 bp, Pseudomonas aeruginosa
caccgccagccaaaccctggcttgaaaattgtacaaaaaataaccagcccgctcgattgtcccgccttcatcgccgcccaccgccagaatcctcaagactttacccgccgacgccagctcaccttcaagaacctcgtcctgttcctgctcaatcagccgcgcacggccctgcaaaccgaactcgatcagttctatcgcgtactcaatcaggcgtcgactgagacgcaaatggtcactgcgcaggccttctgcaaagcgcgcaaaaagctcaaccccgaggtatttgaaagtctcaatcgcctcctgcagcaacaaattgactgctgcgggctgcgccagaagtggcgtgggctgagagtgctcgcggtggatggctcgaccgtgcatttacccctggagtcgaccatggcgaccttctttggcagtcactctggctttcccatggctcgcttgtccacactctacgaagtcgctgacggtcaaaccttgcatagcctgatcgtgcccctgaccgtcggcgagcgcgactgtgcccatctgcaccttgagcacctgccggctgacagcctgacgctgtttgaccgtggttaccctgggcactggttattcgcgctattcgcgcagcaacagcggcactttctgatgcgcctgccctgtggctataacgcccaggtcaaagcgtttctacactctggccaagttgaagacacacagcttttcgtggccaaccatcctgaagcacgtctgttctgctccgaggctggcgttgatcctgccagccagatcgagctgagactgatccgggtcgagttggccaacggcgaaagcgaggtattgctgacctcgctgctggatcgagaagcctttcccgctgaggtgtttgccgagctttaccaccgccgctggggcatcgaaaccgacttccgtcgcctcaaacaaaccctgacgctggacaacttcagcggccgcagcgtgaccgctgtaaagcaggactttcatgccgctcaactgttgaagaacctggcgctgttgatgcagcacctgctacagccggtcatcgaacagcgccacaaaggtcgcaagctgcgatggaaagtcaacttcacccaaggcgtgtcacggctcaaaaataccctggtcgagctgctggtgcggcactgtgctcaggggctgagcaatgtgctggccttgatggctaaaagcctcagtgccgtacgctcaggccgtagctttgcgcgccaacgcaaacgcgcagccagccgaggttgtgagggctacaaaccgacgcgctga

SEQ ID NO: 9797 - DNA, 591 bp, Pseudomonas aeruginosa
gccgctgcagccagccgacgacgcgctgcaggcgctcaccagccatctgtaccgtcagggtgtcgagcccaagctgtcgatcagccaggagacaactccgccccttcctggcgcggaagcagcgacggagcagcaagtggtgttgccttcctggaagaaattcaccttcagcgcccagaccaggctcccggcagacctgaccttccaggggctgcccgccgccggggtccgcatcaccaacctcgaaaccacgctcaaggacagccagttggactggactgtcacaggagaaatctatgcgaactgagccgatcggcatggccgtggccgtgctcttcctcctcgcgtccggccaggcctgcgccggcaccgttggcgaactggcggagatccaggcccaggccatcctcaccgaggccaaggtgcgtctggccacggcgcagcggcaactggagggcaaaggcgaaaccggccagatcgtcagcgcccaggggcagacgttcgccatgccggtgccggcggcgccgccgacgatcacgcagccggttccgccggtggtgcggaccatctacggcgccggcggcaagatga

SEQ ID NO: 9798 - DNA, 531 bp, Pseudomonas aeruginosa
ctgccacattcttgttcccgggcgggtacgagattgacgccgccagcggcgcggagctgccgggcaactaccgcgtcgagtcgatctccctggaccaggtcgtactcaccgacaaggacggcaaccgcgtgcccgtgggcttctccagcgttgcccccacccaagccgcctcctcggcccaaggcgcctccgttccgccggcgctgcccggggcggtaccgcagccgttcatccagtaggtaccgccatgacgaaccttcaaattgccgcgcttgcacagccctccatggtgacccaactgctcaccgccgacggtggcgagtgggaggtctcgaaacacctgcaagagatcatggccctggccgccgacggcacgctctatctatcggagagccaccagaacgacattcacgttctgtcgttcatcgaccgtctcgatcgccgtggcttccgataccagctcaacctcaccgacctgcagaccattcaccagctctaccgcgccgtcgccatggacggcctggtcgatag

SEQ ID NO: 9799 - DNA, 1122 bp, Pseudomonas aeruginosa
gcatctgctcgacgacagcttctactcgcaggaggcgtgctgatggggggcttctgggagcagttgcagttcgccttctacagcaagcagttcggccgcaaggaacgcctgcagttctacgaaagcatgtccaccctgctcgaaaacggggtcccgttgaaggacgctgtggcagaggtgcacaagatcttcgctcatgagggacagcatccgtttcatccggtggccatcgccagtcgcgaagcgctgatggggctgtccaacggcaagcgtctggccaccgccatggcgctctatctgcccgcccaggagcgagcgctgatcgaggccggcgagatgagcggcaacctggttcaggccatgggcgatgccgtctccctggtcgaggcccaggccaggatccgcgccaccatctggcaggcgctgctctatccctcggcgctgtccgccatgatggtgttcctgctgtgcatcgtggcctatcgcatggtccccagcctggccaggctctccgatccagtcacgtggaccggcccgctcgccacgctcaacgccattgccagcttcgtcacaggacctggtatctacgttctggtcgccgtcatcaccctcacggtggtggtcatcgtcacgttaccgacctaccgctggaaaggccgggtctggctggaccggatgctgccgccctggtccatctaccgcatgctccagggcaccaccttcctgctgaacatggccgtcatgctcaacgccggcatacgcccctacgacagcctggccagcatgatcaagatctccccgccctggctgaagcagcgcttggaagctgcccgctacggcgtgggcctgggccagaacctgggagtcgcccttcgcagcgccggtcacgatttccccgaccgacaggccatccagtacctgtgcatcctcgccaaccggggaggcttctccgaagctctggtcaagttcagccgccgctggcaggagaccagcctcaagcagatcgagctggccgccgggctggtgaagaacttcgccctgatcttcatcggcgcgctgatgatcctggtcctgctcggcgcctaccaggcacagcagctcatccaatccatgaaccactga

SEQ ID NO: 9800 - DNA, 552 bp, Pseudomonas aeruginosa
aacctcaccaaggagcgctccatgagcactacgcaacgcacctcccgtccgacgcagggcggtttcgtttccatcgagatgatcatcgtgctgatcatcatcgccatcggggtcggcctgggcctggccgcagcggctgggatgttcagttcgtccaacgccaacgaggaacagcgcaacatcagcgtcattgcggccaacgcacgtgccctgaagacctcttcgggctacggctccagcggtaccaacctgatcccgagcctgatcgcaatcaacggcgtgccgaagaacatgagtgtctcctccggcgtcgtctacaacgtctacggcggatcggtcactgtctcgtccaccggcatgggcttctcgatcaccaccagcaagctgcccaaggatgcctgtatcaccctgggcaccaaaatcgcgaagaacaccttcgagcagaccaagatcaacagcggcaccgctatcactggtgaggtcaccactgcggctgcgacccaggcctgcagcagcgatagcaacagcattacctggacctacagttcgtga

SEQ ID NO: 9801 - DNA, 1416 bp, Pseudomonas aeruginosa
atcgccaggctcgcaaaagcctgtgggagcctatctatgaataacctcaagctcagccgcggctttatctcaattgaattaatgatcgccttgatcgttatcgccatcgcgactaccggcgggatttcagtcttgatgagctatctagacggcctgaatgaacagcacgcggcccagcagcaacagcaggtggccaaggcagcggagaagtacctgaaggacaacttcagcacggttctggccagcgccggcgccacggccccggcggtgatcaccgtcccgatgttgcgcaacacccgttacctgcccgcaggcttccgcgacaccaacatctacggccagcaataccaggtactggcccgcaagccggcggccaaccagctcgaaacgctgatcgtgaccacgggtggacaggtagcttccgaactctcgatccgccggatcgcgcagctcatgggagccaccgggggctacatctcgaaaaccaacaccagtgtcgcccagggcgccgcctggcaggtggccttgagcaatttcggtagcgctcccggcgctggacacctggcgacggcgctgttcttccaggacggcgccattgccaacgagtacctctaccgcaatgccgtcccgggtcatcccgagctcaaccggatgaacacggcattgaatatgggcggcaacaatatcgccgcagccggagcggtcaccgccagcggaaacatcacgaccagcgcggacatcagcgcgcgcaacgtgacagccactggcacggtgaaagccggcactgctgacgtcgccggcgagacgtacaccggaggctggttcaggacccgcggtaactcaggttggtacaacgaacggtgggacggtggctggtatatgagtgacagcacatgggtcaggtcgtggatgaacaagaacgtttataccggcggagaattgagagggggaaagctcagctccgaaggtagaacgaccgtcggcgagtaccttcagatcaatggtttggcggcagaaaatgcaggatgcgcccccaatggcctggtaggcagagacaacagcggccccctattctgcaccgatgggctgtggaaacggcccagtggcgtgaatatcgccacccctgtggtgctggcacagtatcccgccgataaccgaccccgcacccactgccaagcggtatccagggacgcgctgatcaatggctccggccccggcgttctgcgcctggaagtcgatggcgtgatcgttggtcaagcgcgctccaccgctgggcgaaacgctgacgtagttgaagacgcctcgatctccgccatggtgaaagccggacaccggttctgcctttacagcaccgttgtgctcgcaggattcggcaactccgccggcatgcgtgtgacggccacctacctcaactag

SEQ ID NO: 9802 - DNA, 318 bp, Pseudomonas aeruginosa
gctcgacttcaaacaacaagtgtggacccgcaaggaggccgcatgaaatcgatctacaacaccccaggcttcagcgaggagttgttgctggtttgcgcctcgctgcgcgaggtcggactggacaatctggctgaccagttccgcgatgcagtgttcgaccgatccgtcgtcgaccaggccatcatcgcactgcgtgagcgggtgaagaccccttcgccggagcatgcggccgacaacgagccatggctgtactgcgactggcaggccaggcaaacagcttaccggctcctccagcgccttgagcgcgcaacacgctga

SEQ ID NO: 9803 - DNA, 432 bp, Pseudomonas aeruginosa
agcatcaccctacccacccctgccgggttctcccgtcagggagacctggccaaccacaggagcacacctatgggatggcttttctcacatcagacgaaggaagacctgctgcgtgagctgctggccccaaccagtactttcgcaggcagcaccaaggtgctggcacacgcagtctccggcaatgaactttggactgtcgtaaaacgaaccttccaccttgccggattctatttcggcaagccggccggtcactcgatcaccatgatcgagctgcacttgctggactgctcggccgggcaatggggctacaagaccattccagaaagtgccggcccgttctactacggctgtccgctggagttcctggacctggctcacgatgaggtcaaccaggagtggcgtgaacgtctgacgcacgaacaccaagcctga

SEQ ID NO: 9804 - DNA, 744 bp, Pseudomonas aeruginosa
agccgatgggctcagcttcgaccctcacaccaagagcgttcggtgaccaccacgctcccctgcaccagttggactacacccccgaggggcttcaccgcccctcgagggcggcgtggctcctccttcaaggaggttcctatgcccagtcccaccccgctctaccagatcgaagaatgcccagacctgtacgttgacgcctgcgtgtgcgacgagcagcgcaacctggtctttctttcggcctggggccgcgacaccgtgacacaagagttcctggccaggctgacgctggaccgggaagaaaatggcatcgaccatttccacattatcgtggacggccggcgcttacctgtcttcccaaaccaggatctcctggagaaacgcaccacccgccagttccgcggcacgttgttcggcagcctgctcaacctctggctgttcgatcggcgcgcctcggcgcccgaccgaggcaatcacctcgccttcgcactcctgcagcgcgatgaggatccacaccaaaggctctggccgctggtgatggagacctgtccgctccccctcctgcagcactggcgcgagccagtgatggaggtcctcacccagcaccagatgttgaccgccctgccagggacgatcggcaacgtctgcgcctggcgactcgccctgcgggtcgacgtgctcgagcccaccctcggtgagctgatccgcgaaagcattcttaccaccgatgctcaggcacaagcctga

SEQ ID NO: 9805 - DNA, 834 bp, Pseudomonas aeruginosa
ccgaccttgacgatcgtaccgcgcacttcgacgtcgccggcgcctcgcgcagcgtccgcatccaaccataggaccccgcacatgaacagaaccgtatcgctcctgtccggcctggtgctgctgagttatcccgcagtcggtcaggaggctgcggcaagccgagagaccagcagccagctgtccggtagccaactcggcacgctgaaacagcagacatctcagagcgacctggcccaggagtggggactgaaccaacaggaatggacccgttaccagacgctcatgcaaggccccaggggcgtgtactcgcctggcattgacccgctgactgcgctgggcatcgaggcgcgatcggcagaggaacggcggcggtatgccgatctacaggtccaggccgaacggcgccgggtcgagaaggaactcgcctaccagcgcgcatacgacgaagccttcgcccgcgcctatccaggcgagggggtgatccgcctcaccgaaagcagcacggccaacccgtcgggcaccccgaacatgagcccagcgttgcagagcagcgggcgcctggccctgttcgtccaggacaattgcaccgcctgcatccagcgggtccgcgacctgcagcagcagaacaaggagttcgacctctacttcgtcggtagccagaacgacgcagagcgagtgcggcattgggcaatcctcgccggcgtcgacccgaagaaggttcgcagcaagcagatcacgctcaatcatgacgagggccgctggatggccctgggactgggcggggcccttcccgccctggtccaggaggtgaacggccgatggcaacgtctgtaa

SEQ ID NO: 9806 - DNA, 1569 bp, Pseudomonas aeruginosa
cccatggctggccagtacccgctggaagcgctcttgcggccggccgtggagctctacaccaccaccgtgtgcttcaccgcggccgcgctctgtatcgtcgcgccgtggacgttcgccctcactccgctgttcggcatcgtggccgcactgggcttcgcctggctgggtatcgtgcggctgaagcaggccggcgtggtgctccgctaccggcggaacatccgccgactgccgaagtacacgatgaccagtgccgaaatgccggtcagcaacgaacacttgttcatcggcaagggctttcgctggacgcagaagcatacgcagcgcctggtagatacctacctgccccagttcgcctcctacgtcgagccctcgccgctctacgagcgcgcgcgccggctggagaagcagcttgagttcgcccccttccctctgaagctggtcgccaaagccactgcctgggacgtggcctggaaccccgcacggccgctgccgcccgtgggcggtttgcctcggctccatggcatcgagccgcgcgaacaggacgtaggcctgcaactgggcgagcgcgtcggccacacactggtactcggcactacgagggtgggtaagacgcgactcgcggagctgttcatcacccaggatattcgccgtacccactgccggggccgacgccggcgggcgaagatgggccggcggacccagacggttcaccacggccaccggcgccggcgcgcagaggagcagccggactacgaggtggtgatcgtcttcgacccgaaaggcgacgctgacttgctgaagcgtatgtacgtggaatgcgaacgtgccggccgcctcgatgagttctacgtgttccacctcggccaccctgacctgtcggcacgctacaacgccgtcggccggttcggccggatctccgaggtcgccacccgcgtcgccggccagctctccggcgaaggcaacagcgcggcgttccgcgagttcgcctggcggttcgtcaacatcatcgcccgcgcgctgcacgcgctgggtatccgcccggactaccagcagatcctccggcacgtcgtgaacatcgatgcgttattcgtcgagtatgcccagaagtacatcagcgagcacgacccgagggcctgggacaccatcatccacatcgagggcaagctcaacgacaagaacgtgccattcaacatgaaagggcggcccttccgtgtcgtggccatcgaccagtacctgacacagaaacgcatcgccgacccggtcatggaaggcctgaagagcgccgtgcgctacgacaagacctacttcgacaagatcgtggcctcgctgctgccgctactggagaaactcactaccgggcggatctcggagcttctttcgcccaactacgcggacctcaacgatccgcgaccgatcttcgactggatgcaggtcatccgcaagcgcgccgtggtctacgtcggcctcgacgcactatcggataccgaggtccgccgccgcggtgggcaactccatgttcagcgacctggtctcggtggcgggtcacatctacaagcatggagtcgatga

SEQ ID NO: 9807 - DNA, 669 bp, Pseudomonas aeruginosa
cggccctgcccggctcactcgcccggcggcaaggtccgcatcaacctgcatgccgacgagttcaacgagctgattggcgacgagttcatccccatggtcaacaaagcgggcggcgccggtgtgcaagtgacggcctacacccagaccatgagcgacatcgaggccaagatcggctcccgcgcgaaggccggtcagatcatcggcaacttcaacaacctgttcatgctgcgggtgcgcgagaccgccacggccgaacttctgaccaaccagctccccaaagtccagatctacaccagcacgccagcgagcggcgccaacgacgcgatcaacaacaagaaggcagccttcacctccagctcacacgaccaggtgcagatgaccagcgtgccgatgctcgagccggcccacatcgttggtctgcccaaaggacaagcgttcgcgctactcgagggcggcaatctctggaagatccgaatgccgctgccggcggtcgatcccgacgaggtgatgccgaaaagcctgcaggagctggctgccggtatgcgcaagggccaggccgcaaacagcgagtggtgggaggcaccgggatactccgccctgcaggatggtctgccccaggacctggtcgacgatttccgtcacctcggcgccggtgaggatgccgcctga

SEQ ID NO: 9808 - DNA, 687 bp, Pseudomonas aeruginosa
cccccagccgcgcccaaccgcgtgacccttcagacctatctgggaattacaccctgcgcggagggccgatgccgtgagcatgagcggagcccagacatcagcgttccaggccgccgctggctttcctccatcggccggcgaggggctgttcattggagcagcgatgaccttccttctgctgtggtccgcctgggcgatgtacagcacctggcgcggctgggccaccaacaacctcgacagcgccactgccggcgcttccgcgatacggatcttggtcctcctcggcatcacctccttcatcctcctcagctgacccatacggagacactcatgatgaaattcaccctccagaaactgtccaccctctgccggcgcctggcagccatctctttggcattcccaggtgtcacattgggtgcactccccaaacccgaggcacctacccgtggggagggctcggggatcatgcaaaccatccagaacttcggatatgacggagcaatgctcctcgcgctactcatctgcgtggctgtctttttgggagtctcctggcatacctacggcacctatcacgccatccatgatgggaagaagaagtggtcggatctcggggcaggcgtggccgtaggcatcggcctgctgatcttgatcatttatctcgtcaccaaagccaccaccatcatgtaa

SEQ ID NO: 9809 - DNA, 774 bp, Pseudomonas aeruginosa
cacctggttctatcgccaggtggagctggccctctcgctgcgctttcccgtcttcggcaaccgtcacctggtgacgcgctccggcgcctggaccagtcgacgcacggagtccccatgagtttcagaaaacacaccgcgcaacagcaggctcacatcaacacgttccggttcatcaccggcttcttgtgcatggtcatcgtggtgctggcctactgcgtctgggaagcccgcaaggacctctggatccacattccgcccgacttgcgttcagggagcacccggttgtggtgggacattccgccggagagtgtctatgcattcggcctctacatcttccagcaggtacagcgttggcccaaggacggcgaggtggactacaagggaaacctgttccgctacgccgcctacctcactccctcctgcaaagtcttcctggagaaagacttcgagtttcgtcgtaacgccggcgagctcagggggcgcgagcgcaccacctcggaaatccccggtcggggcattggcgagagcgatggccgcgtgatccagcactcgatcaatgactggaccgtcaacctggacatggacagcacggagtattacgccggcgagaagatcaagcgggcgctggcccgctacccgttgcacgtcatccgcgccgacgtcgacccggagaccaatcccttcggcctgcagtgggactgctactccgacacgcctcaacgtatcgaactcgaggagccggccgcccccaccaagcgggagggaggtctatga

SEQ ID NO: 9810 - DNA, 1068 bp, Pseudomonas aeruginosa
cacccaggcctcgatccacacccgcgaggacgtggccaccgttcgccgcctgatcggccgggagcacaagctctatcgcggttcgatcgctctgttcgtgcgcggccgcgaccatacccagctggaggagcgctgcatcaccctgagcaacgtgctgctcggcgccggccttgtgccggtcgaaccgcagaacgaagtcggaccgctgaacagctacctgcgctggctgccctgcaatttcgatccgaacgagaagcgagccctggagtggtacacccagatgatgttcgcgcagcacatcgccaacctgtcgcccatctgggggcgcaccaccggtaccgggcaccctggcttcacgctgttcaaccgtggcggtgcgccgttgaccttcgacccgttcaacaagctggaccggcagatgaatgcccacggcttcatcttcgggccaaccgggtccggcaagtcagcgtccctgaccaacctcatcagccagatgctcgccatgtacctgccacggatgttcgtcgcggaagcgggcaacagtttcggcctgctggccgacttcgccaagcggtttggcctctcggtccaccgggtccgcctcgccccgggctccggggtcagcctggcgccgtacgcggacgccatcaagctggtcgagagtcccgaccaggtgaaggtcctggatgccgaagacatcgaggcctcggactcggtccagggcagcaaggccgacctcgaggacgaccagcgagacatcctgggcgagatggagatcgtcgcccgcctgatgatcaccggcggcgaggaaaaggaagacgcgcgcctgacccgtgccgatcgcagcgccatccgccaggcgattctggcggcggccaggacctgcgccgccgcgaaccgcacggtgctgacccaggatgtgcgcgatgcgctctaccaggcctccaggagcgatggctccgcgccagaacgccgcgcgcgcctggccgaaatggcggaagccatgcagatgttctgcatgggtgccgacggcgagatgttcaatcgcgaaggcacgccctggcctga

SEQ ID NO: 9811 - DNA, 369 bp, Pseudomonas aeruginosa
tgcatagcgagtcggcgcattgccaggcttgcctggcggggtgtgcggggatcaaggcggcaccaaagcattctgcagcgcttgtacgcaatcttcgctcagtcggccggcaacgggggcgggttgcctagcggcacattagactttcctgaactggaccagtctcgactggagaaatgtgcgaaagacatggacctggaggaccagttgatcaagacggacatcgacactgcacggtcgaagagcattacagcgaccccgaccctagtcatccgggacaaccagacgggacgaagcgtgaagctagagggcatcgccgacgaaaccacgttgctgtcggcgatagactggctagccaaggatcactag

SEQ ID NO: 9812 - DNA, 474 bp, Pseudomonas aeruginosa
tcctgtctgctgtctgtaccttcctcgaaccggtacagacccatgcctcttcatcactctccccctggctggcggccacaaaagctggtcgttggcttactactggtactgctgagcggcgcgagccaggccgaaacctgggtcatcaccgacaaggctcatccggtcactgccaccggatcatcgcgagtcctgctcctggatgcccagcagcaccttgaggagcagctgactgacgctctacccaaggatcctcaacaagctcaggcagcatttcagcagttactacaaagccctgcggggcgacgcctgcaggcagaactggttaaggcacaacaagacgtcgccgatgcgtggagtctcggtgtcgagaagatccctgccgtagtagtcgacaggcagtacgtggtctacggcgaaccggatgtttcgcgcgcgcttgagctgatcgccaaggccaggaggtcgcgctga

SEQ ID NO: 9813 - DNA, 711 bp, Pseudomonas aeruginosa
ccaggacgtcctggcgcgccgcctggcgtccgatgtctccctgatggacgtgctcagcaaggccctgttgttgcagcgcctgatgttcgccggcgccaaggagcccaacgtcgccgccaacggcctggccacccaagccgtcgatcagcagaccagcctcctgcagcaggagatctccaatctcaagaccgaactggaactccgtcgcgagttggccagcaattcgcccatgcgggtcatcgagcgcgggcaacagcgcgcctcagggtccagtggcgtgttcgagtcggcgcccgatgccgatcgcctcgatcgcctgcaggccccctctgccgccgacggcaagacgggagggagaccgtgatggcagatacgctcaccacccgaaagctcctcggccagctactggtcggagtgctgatcgtcgtcggcctggcagtggtcggtacgctgctcagcctcttcgccctgaaccacttcggtggcatccagggcctggaggcctggcggcaaagcaactactggagtttgttcgcctggcgggcgctgctgtactgcgccctggccatcgcctggttccggctcaagcagcgcaaggaactgagcgcgcatgagcggcagcgcattcggcggatcgagatcctggtgctgttgctggtcctgctcatcgaattcagcaaagcctacttccgcacgggaggcgcagcatga

SEQ ID NO: 9814 - DNA, 543 bp, Pseudomonas aeruginosa
gaacctgaacatctggaccatcaaggtttctggtcctcgcaagacgaaagagctcaaggcatacctgctccaggatcccaaactgctgttccctgtgcagcctctggacaacccaagcctcacggtcatcaccgatgccgaagggggtgtggaatgaccccacttcaattgaccgaggaatatctcttcgcacacgacctcagagaggccagccagaagacctatcgagcagcaaccagagcgctcatgaagcacttcggcagcacagtcaccgtgcaggaaatcactcatcggagtgtattggaatggagacgaaaggtattggagcaggggctatccaaacgcagttggaacacttactcgagccacctgcgcaccgtttggggatatgccattgagtacgaactgctgacccacagccaaatcaatcctttcaagaaaaccggagtgacgccgccaaagcggccgagcaagacagtagcactcgatgccatacaaagcgctcgctcctggctgaaagtgctagatgtgaagctccaatag

SEQ ID NO: 9815 - DNA, 999 bp, Pseudomonas aeruginosa; identical to SEQ ID NO: 4525

SEQ ID NO: 9816 - DNA, 1206 bp, Pseudomonas aeruginosa
cgaccttccgccgatttgcccggcccccgcccctctgctagtgtcgcggggttttgtacacctcgccgagactcccccgatggcccgcaagaaaaccctcgatttcgaacagtccctcaccgagctgcaaaccctggtggaacgcctggaaagcggcgagctgtcgctggaagagtcgctgggcgccttcgagcagggcatccgcctgacccgcgaatgccagacgtcgctgagccaggccgaacagaaggtacagatactcctcgaacgcgacggcgagctcagcgaagcgccgttcgatgcggaaggcgacgaggcatgatcgcggcctaccaggcgcgctgccaggcgcgcgtcgatgccgccctggacgccctgttcgttgctccccgcgaagaactgcaacgcctctacgaggccatgcgctacagcgtgatgaacggtggcaagcgggttcgcccgctgctcgcctacgccgcctgcgaggccctcggcggagcgccgcagcgcgccgacgccgcggcctgcgcggtggagctgatccatgcctactcgctggtccacgacgacctgccggcgatggacgacgacgacctgcgccgtggccagccgaccacccaccgggccttcgacgaagccaccgcgatcctcgccgccgacggcttgcaggcgctggccttcgaagtgctcgccgacacccggcgcaatccgcaggaacatgccgtctgtctggaaatgctcacccgcctggcgcgcgccgcaggctccgccggcatggtcggcggccaggcgatcgacctcggctcggtcggcgtggccctcgaccaggcggccctggaagtcatgcaccggcacaagaccggcgcgctgatcgaagccagcgtgcgcctcggcgccctcgccagcggtcgcgccgagcccgcctcgctggccgccctggagcgctacgccgaagcgatcggcctggccttccaggtgcaggacgacatcctcgacgtggaaagcgacaccgccaccctcggcaagacccagggcaaggaccaggcgcacaacaagccgacctatcccgccctgctcggcctggaggccgccaaaggctatgccctggagctgcgcgacctggccctggccgccctcgacggttttccgccgagcgccgacccgctgcgccaactggcccgctacatcgtcgagcgacgcaactga

SEQ ID NO: 9817 - DNA, 1920 bp, Pseudomonas aeruginosa
actgctggcctctccggattgcataacgacagcctgatgcccaagacgctccatgagattccccgcgagcgccccgccacgcccctgctcgaccgcgcctcttcgccggccgaactgcgccggctgggcgaggcggacctggaaaccctggccgacgagctgcgccagtacctgctgtataccgtcggccagaccggcggtcatttcggcgccggcctcggcgtggtcgagctgaccattgccctgcactacgtcttcgacactccggacgaccgcctggtctgggacgtcggccaccaggcctatccgcacaagatcctcaccgagcgccgcgagctgatgggcaccctgcgccagaagaacggcctggcggccttcccgcgccgcgcagagagcgagtacgacaccttcggcgtcggccactccagcacctccatcagcgccgccctgggcatggccatcgccgcccgcctgcaaggcaaggagcgtaagtcggtggccgtgatcggcgacggtgcgctgaccgccggcatggccttcgaggcactcaaccacgcctcggaagtcgacgccgacatgctggtgatcctcaacgacaacgacatgtcgatctcgcacaacgtcggcgggctctccaactacctggcgaagatcctctccagccgcacctatagcagcatgcgcgagggcagcaagaaggtgctctcgcgcctgcccggggcctgggagatcgcccggcgcaccgaggaatacgccaagggcatgctggtccccggcaccctgttcgaggagctcggctggaactacataggcccgatcgacggccacgacctgccgaccctggtggctaccctgcgcaacatgcgcgacatgaagggcccgcagttcctccatgtggtgaccaagaaaggcaagggcttcgccccggccgaactggatccgatcggctaccacgcgatcaccaagctggaagctcccggcagtgcgccgaagaagaccggcggacccaagtattccagcgtcttcggccagtggctgtgcgacatggccgcccaggacgcgcgcctgctcggcatcaccccggcgatgaaggaaggttccgacctggtggccttcagcgaacgttatccggaacgctacttcgacgtcgccatcgccgaacagcatgccgtgaccctggccgccggcatggcctgcgagggcatgaagccggtggtagcgatctactcgaccttcctccagcgcgcctacgaccagttgatccatgacgtcgccgtgcagcacctcgacgtgctgttcgccatcgaccgcgccggcctggtcggcgaggacggcccgacccacgccggtagcttcgacatctcctacctgcgctgcatccccggcatgctggtgatgacccccagcgacgaggacgagctgcgcaagctgctcaccaccggctacctgttcgatggcccggccgcggtgcgctatccgcgcggcagcggccccaaccatccgatcgatccggacctgcaaccggtggagatcggcaagggcgtggtccgtcggcgcggcggcagggtcgcactgctggtcttcggcgtgcagttggcggaggcgatgaaggtcgccgaaagcctcgacgccacggtcgtcgacatgcgtttcgtcaaacccctcgacgaagccctggtacgcgaattggcgggcagccacgaactgctggtgaccatcgaggaaaacgccgtgatgggcggcgccggctcggcggtcggcgagttcctcgccagcgagggcctcgaagtcccgctgctgcaactgggcctgcccgactactacgtcgaacacgccaagcccagcgagatgctcgccgaatgcggcctggatgccgcgggcatcgaaaaggcagtacgccagcgtctcgaccggcagtag

SEQ ID NO: 9818 - DNA, 360 bp, Pseudomonas aeruginosa
aggagcacgccgcggccctcctcggcgatggcggcaagcgcgccttccagctggaaaccgcaatcgcagcgcaggctgaacagcgcgtcgccggtcaggcattcggaatgcaggcgaccaagcaccggcgcgccatcggcgatgtcgcccatgctcagggctacatgttccttgccgctctcctcgtcgaggaaaccatgcatggtgaattcgccgaagggagtcggcagtttggaggcggcgacgaacacgacggacaccggggaactcctagggaaacggaagtccgccattgtaccagcagcgtccggcgcccggtcagctcgaaatgccgcaaatacctatcgagatggacgatga

SEQ ID NO: 9819 - DNA, 720 bp, Pseudomonas aeruginosa
cgcgccagcagcggttcggccacctcggcgggcgccgatcttcgctccagcaccagttccagcgccgctccagcctcgccgagcgggcccccgacgcagagcaggtcgcccgggcgcgcaccggcgcgggtcagcgcctggccggccggcaccctgccgaatacggtcagggtcatgctcagcgggccgcgcgtggtgtcgccgccgaccagggccaggccgcactgccgggccatggcgtcgaggccgcgggcgaagccctgcaaccactcggcgtcggcctgcggcaaggtcagggccagggtgaaggccaggggcgcggcgcccatcgccgccaggtcgctggcggagaccgccagggcgcgctgggcaagaaggaaaggggcgcaaccggcgggaaaatgcacgccttccaccagggtatcggtggagaccgccagttgttcgccggctggcggcgccagcagggcgcagtcgtcgccgatgccgagggccacgtccgccgccggcgccgcgcaggcggccgcggcgaagaagcggcggatcagctcgaactcacccatgacgccgccggcgcgggatcagcgcttgccgccgcgcagctcggcggcgcgcaggcgcggcgccagcttgtcgagcacgccgttgacgaacttgtggccgtcggtggcgccgaaggtcttggccagctcaatgccctcgttgatcactaccttgtag

SEQ ID NO: 9820 - DNA, 558 bp, Pseudomonas aeruginosa
gaacgttacggccaccgagatggccgtgtggcgttttaccacagttgcgccgcttgtgcatcgtccgccgcgtcgccgcgcagcgaagttcaggcgtcccgcggatggggccgcgcggtgaccagccagtcgtcgcccaccgcgcggatgtcgtcgatccgcaactgcgccgcatcggccatccgcgccagcggccagtcgagcaaaggacgggcgctggagccgaggaacttcggcgcgacgaacagccggtactcatccaccagccccagccgggcgaaggcgccggccagacgcgggccggcctccaccagcacttcgttggcgccgcgcgccgccagttccaggagcagcttgtgcaaatcgacgtggccctcggcggagggcagcgccagcagttcgtggccggcgtcctggaagcgttcgcgcgccgaggcggcggcgcaggtcgccaccagcgccggaccgggcgtggtagaacgccgactccagcggcacccgcagggcgcccgtcgaccagcacccgcaacggctggcgagccgcggcgagcgcggtaa

SEQ ID NO: 9821 - DNA, 762 bp, Pseudomonas aeruginosa
ccagcacgcagccgacgcgcggattcggatgggtggagtacagcccctggcgcgccagttccagggcgcgggccatgtacagcgggtcggcggcgttcattccttggccggctcgcgggcgaggcgttcgatctcctcgcggaattcgttgaggtcctggaagcgccggtagaccgaggcgaaacggatgtaggcgacttcgtcgagcttctgcagctcggccatcaccagttcgcccagcacccgcgacttgatctcgcgctcgccggtggcgcgcaactggtgcttgatgtggccgatggccgcttccaggcgctcgacgctgaccggacgcttctccagggcgcgctgcatgccggcgcgcagcttgtcctcgtcgaacggctggcggctgccgtcctgcttgatcaggcgcggcatgaccagctcggcggtctcgaaggtggtgaagcgttcgccgcaggccaggcactcgcggcgccggcgcacctgatcgccctcggcgaccagtcgcgagtcaatcactttggtgtcatgggcaccgcagaagggacaatgcatggtgctgatacaggcgtagctgaaggaagccgcatggtagcgcatccgcgcccgaccgagcacccgcagaatcgaccggcgccggcacgctgggaaaggcgagaggaatcggacgttgcggcctacgcgaagcgcgacaagaatcacactttgcgctatacaagcgccgcccggattccaccgctatggagcagcccatga

SEQ ID NO: 9822 - DNA, 636 bp, Pseudomonas aeruginosa
tccagtccggccagttggcctggcgcctgcatccgttgcggatcgcccagccgaccacccagtccctcggcgaactgcgcctggtacgcgcgccgtgacggcaccgcaagccctgacccaggcgctgggcgagctgctcggcgacgcccggctcagcgccaccgcgctgcccggcaccgacctgcgcctgtggctgatcgacgcgcagaacatggaccgccagttcagcccggaggaaacccgccgcatcctcgaagagccgccgtactggtgcttctgctgggccagcgggctggtcctggcgcgctggctggcggagcgcccgcagtgggtccgcgacaagcgcgtgctggacttcggcagcggctccggggtggcggcgatcgccgcggcccgcgccggcgccgccgaggtggtggcttgcgacctggatcccctggcgctggcagcgagccgggcgaacgccgaactgaacggagtggagctgagctattcggcggacttcttcgccgaggacgatcgcttcgacctgatcctggtggccgacgtgctctacgaccgcgccaacctgccgctgctcgaccagttcctcagccgcggccgccaggcgctggtcgccgactcgcgggtccgtga

SEQ ID NO: 9823 - DNA, 1062 bp, Pseudomonas aeruginosa
cttccgtcatccgctgtaccggcgcctggacgtgctcgacgcctgtacctggccggacctcgccgagcccgccgaattccgcctggtcagcctgtatcacgccgaacgcgggcaagcctgaggcacgggcttgtttgcgcgcggcgcgcccccacttatagtggtcaccaccttgcgtttccgagaatcgacatgagcgatacgccctacatcttcgacgtcaccggcgccaacttcgagcagcaggtcatcgagaactcgttccacaagccggtcctggtggacttctgggccgactggtgcgccccgtgcaaggcgctgatgccactgctggcgcagatcgccgagtcctaccagggcgaattgctgctggccaaggtcaactgcgacgtcgagcaggacatcgtgatgcgcttcggcatccgcagcctgccgaccgtggtcctgttcaaggatggccagccggtcgacggtttcgccggcgcccagcccgaatcgcagatccgcgccctgctcgaaccccatgtgaaagcaccggcgctgcccgacgaagacccgctggaagtggcccaggcgctattcgccgaaggccgcatcggcgacgccgaagcgaccctgaaagccctgctggcggagaacaacgagaacgccgcggcgctgatcctctacgcccgctgcctggccgagcgcggcgaactggaagaggcgcaggccatcctcgacgcggtgaagagcgacgagcacaagcaggccctggccggcgcccgcgcgcagctgaccttcctgcgccaggctgccgacctgcccgacagcgcagagctgaagagccgcctggcggccgatgccggcgacgacgaggcagcctaccagttggccgtccagcagctcgcccggcagcagtacgaggcggccctggacggactgctcaagctgttcctgcgcaaccgcggctaccaggacgacctgccgcgcaagaccctggtgcaggtcttcgacctgcttggcaacgaccacccgctggtcaccgcctaccgccgcaagctgtaccaggcgctctactga

SEQ ID NO: 9824 - DNA, 612 bp, Pseudomonas aeruginosa
cgtaacaaactcttttccttccttgccggagtcccgttcatgcgcccactgctgttagccctcgtcttgctgccgttcgccgcccaggcccatgacgaccacgaccatgaccacgcccatggcagcctgggcaagcacgagcacggcgtcgcccagttgaacgtggcgctggacggcaagaccctcgaactggagctggacagcccggcgatgaacctggtcggtttcgaacacgccgccagcaccgacgcggacaaggccgccgtggccaaggcccgcgcgcagctggaaaaaccgctggagctgttcgccctgccagtcaccgccggctgctcggtggccagccaggaactgcggagtccgctgttcggcgacaaggcgccggcccacgcgcacaaggagaaggcaggccacgaacacgaacacggtcatgccgatatccatgcccattaccagctcagttgcgagaagcccgagctgctcaagctgctgaccctcgccgagttcttcaagcgcttccccgccacccagaaaattcaggtacaactgatcggtcccgacggccagaaaggcgccgacctggctccggccagcgccgagctgaagctgtag

SEQ ID NO: 9825 - DNA, 1536 bp, Pseudomonas aeruginosa
cccggcgcaggccgccagccatctgctcggccagctcggcctcggcggcgaactgcacgaacgccgcgccgacagcctgtccatcggccagcagcagcgggtcgccgccgcccgcgcgctgatcggccagccggagctggtgatcgccgacgagccgacctcggcgctcgacgccgacagccgcgaggcgtttctccagttgctcttcgccgaatgccgcgaggccggcgccagcctgctgttcgtcagccacgaccagagcctggccgggctgttcgaccgcagcctgtccctttccgatctcaaccgcgccgcccggccggcaggactctgagcatgtatctcttccgactggcactggccagcctggccaaccgccgcttcaccgccctgctgacgatcttcgccatcgccctctccgcctgcctgctgctcgcggtggagcgggtccgcaccgaggccaaggccagcttcgccagtaccatctccggaaccgacctgatcgtcggcgcgcgctccggctcggtgaacctgctgctctactcggtattccgcatcggcaacgcgaccaacaacatccgctgggacagctaccggcacttcgccggaaacccgcgggtgaagtgggcgatcccgatctccctcggcgactcgcaccgcggctaccgggtaatgggtaccgatgccggctatttcgagcactaccgctacggccgcggccaggaactgcaactggccgagggccgcgccttcggccaggacctgttcgacgtggtgctcggcgccgaggtggccgaagccctgcactacaggctcggcgagaagatcgtgctggcccatggggtgagcacggtgagcctggtcaagcacgacgacaagccgttcaccgtggtcggcatcctccagcgcaccggtaccccggtggaccgcaccctgcacatatccctcgccggcatggaggcgctgcacgtcgactggcgcaacggggtgccggcgatgggcgccgggcgcgtcagtgccgagcaggcgcggcacatggacctgcaaccacaggcgatcaccgcgttcctggtcggcctgaagagcaaggtggcgaccttcgccctgcaacgcgaggtcaacgactatcccggcgaaccgctgatggcgatcctcccccggtgtcgccctgcaggaactgtggggcctgatgggcaccgccgaaaaggcactgttcgtggtctcgctgttcgtcgtcctcaccggcctgatcggcatgctcacggcgatcctcaccagcctcaacggatcgccgccgggagatggccatcctgcgctcggtgggcgcgcgcccctggcacatcttcggcctgctgctggccgaggccttcagcctggcgctggccggcgtcgccctcggcctcggcctgctctacctcggcatcgccgccagccagggctacgtccaggccaactacggcatctacctgccgctggcctggccgagcgactatgagtggagcctgctcggggctatcctggcggccgccgtgctga

SEQ ID NO: 9826 - DNA, 705 bp, Pseudomonas aeruginosa
tcggctgcgtgccggcctggcgcgcctaccgccagtccctggccgatggcctgtcgatccgcctatgacccggagatattccccgatgctgcgctccctgaccgtcctcctgctggctttcgccctgctcctgggcagtgccgtggcgcgcgccgcgccgcgcgaactgacctggtcgcaactgatcccggccggcgccccgcccgccccggcgccgctgccgatccacgacctcgccaacgccctcagcgaagccggtccggcggccagccagcagagccccaacgccccggtggtgaaggcactggacggcatcgaggccaagctgccgggctacatcgtgccgctggaaatcagcgaggccgggctggtcaccgagttcctcctggtcccctactacggcgcctgcatccacgtaccgccgccgccgtcgaaccagatcgtctacgtgaagaccgccaagggcgtgcagatggacgagttgtatcagccattctgggtcgagggcaccttcaaggtggagaacgccagcagcgagctggcggcggccggctaccgcatgcaggcgagcaaggtgacgccctacgaatacgaaggtggctgaacgacatgcgacaatccgccgcgccatttacgttgcggcggtcacatttgctcctaggattgattgagctgtgtcaaggaaggcaactgttagctggctga

SEQ ID NO: 9827 - DNA, 198 bp, Pseudomonas aeruginosa
agaatccgcggcaggccggccatcagggtgttgatggtggcggctccggcaaacagcaggcccacgcccagccagatgcgtccgaacggtcccatcacctgctcggcgaatcgcgggatcgccatcggcgtctccagcaggtgcaggccgccgccgaagtcgaagttttccacctgccggcgcatcgccgcgccatag

SEQ ID NO: 9828 - DNA, 789 bp, Pseudomonas aeruginosa
cggacgggtcgatggcaatactcatgtgtgctcctcggcttggcgacggcgctgcgtcatgcatgcgcctactacccgggaatactctggacccgccgctcccccgctcgcttgctccagcctgccgggtttcttgccgctgcctgccaagccaggcagagagagacaagacggcgcgccggggcatggacattctgcccggcaggcaggacagtggacgtcccgccgcctcgtcccacgggagtcccgcgccatgccttcgaccctgtcgcccgacctcggcccgcgctgcatgcaggccttcacccaggtggtaccggccagcctgtgcgtgttctatcgcatcgacgaggactgccgcgcacacgatttccagctcctgcggatgccggccggcatgcaccgcgactacctgcgccactaccgcgactacgatccgctgcagccgcgccactgcctggccagcgcttcgccggtggtgccgctgcgccagggcatcgcccgccagcccgcggaggacagcgcgctgtaccagggcttcctgcgacgccacgggatctgcgacgtggtcgaggtgctggcgcatgcgcatcagcgtccggtggcggccctgtcgttactgcgcgacgcccgcctaggggccttctccgaccaggagctgcgacaattgcgcgccctgcatggcctgatggagctggcggcgcaggcatgcgccacgccagcggccagcgccgagcgcctgcaaggcctgacgccgagggaacgggagatcgccctgctgctgcgtga

SEQ ID NO: 9829 - DNA, 402 bp, Pseudomonas aeruginosa
agcaccctttacacggacgattcaaccatgacccacaaacgtttcttcctcgaactgcttctcgcgctggtcggctatgccgctgccgttctgatcagcggccagtcgctggcgggcacggaaccgggcgccggccgggtcttcctcgccctgctgccggtgccaccgatggtcgccctggcgctggtggtgatccgttacctgcggcgcctcgacgaaatggcccggcgcatccatctcgaagccctcgccctggccttcgtcggcaccgccctgctcaccttcacctacggtttcctcgaaaccaccggctttccgaaactctcgatgttcttcgtctggcccctgatgggcgcgttctgggtcatcggctgcgtcctgggactgaggcgctacgcatga

SEQ ID NO: 9830 - DNA, 213 bp, Pseudomonas aeruginosa
aagcgatcttcgacgaccgggaaggccagttggactgagtccggtcccgcttccgaaaacgtccggggcgcccctggcgaccccggcggcaagccccccttaccctgtaccaaatggcagttgccgcatttcccctcggggctagccttggaccaggcctatcgccagccttccccctggtccccgctcgatacgctgaaaaaccacggataa

SEQ ID NO: 9831 - DNA, 2136 bp, Pseudomonas aeruginosa
ccagcaattgagcgccttcgtggtcccccgccagcaggacggcgatgccagggccgtgctcgccgccatcaagaccgcactgcgccaggaactgcccgactacatgctgcccagccgctacctgtcgctggacagcctgccgaccacggtcaacggcaagatcgaccgccaggccctgcgtcgacacctggacgaacaatgccaggaacgactcgacgagcaacgcttcggcacccccggcgaactgcaagtggccctgtcctggcaggaagtgctggggcataccgacttcggcctggacgacagcttcttcgaggtcggcggccattccctgctggccgccgccctggtacgcgaattgagccgacgcttcggcaaccgtgcctacatccacgacatctaccgcaccccgagcgtgcgccaactggcggccagcctggcgcggcgcgccggcgaagcgccgccggcgctggacagcgaaccggcccaggagctgcaacgggacgtgcgcctgcccgccgacgtggatttcagccgccccatggacaccgcccaattgctggcgccacggcacatcctgctcaccggcgccagcgggctgatgggcgcccacctgctcgccgagctgctggccagccgcgaggccgacctgcattgtccggtccgtgcgcaaaacgacgcccatgccctcgaacgcctgcgccaggccgcccggcagcaccgcatcgaactcgccgagacggactggcgacgggtcagggcctacgccgccgacctcgcagaaccaggtttcggactaccggcggaaacctatcgcgagctggccggcagcgtcgaccaggtcttccattccgccagcgcggtgaacttcatccagccatacagctacatgaagcgcgacaacgtcgaggggctcggccaggtcctgcgcttctgcgccagcggccgctgcaagccgctgatgctgctgtcgagcatctcggtgtacagctggggccacctgcataccggcaagcgcctgatgcgcgaggacgacgacatcgaccagaacctgccggcggtggtcaccgacatgggctacgtgcgcagcaaatgggtgatggaaaagatcgccgacctcgccgccgaacgcggcctgccgctgatgaccttccgcctcggctacgccacctgccacagccgtaccggcgcctacgccgactaccagtggtggagccggctggcgcggacctgcctggagtaccgggccgtgccgctcctgcgcgagctgcgcgagggcctgaccacggtggactacatggtagaggcgatcagcgtcatcgcccgccagccttcggcgctgggcaagaaattcaacctggtgccgagcattccgcgctgcctgaccctggacgagttcttcggccgtctcgggcgacgcgccgggcgtccccttcggcagatgccgttcgacgactgggtaagtctctgggaagacaatcgcgacgccccgctctatcccctgctgagcatgttccgcgacaacatgtacgccggccgcagcaccgtcgagttgtaccaggacacctatctctgggactgcaccaacgtcgaggaacacctgcgcgggagcgccgtgcgcgagccggagttcgacgaccgcctgctcgacctgtacctcgccggcctgggcggcagcgccatgcggtaacgaggtcgccgcggcggttacgcagcgggacgcgcttgggtatcctgtccgctttatcgcccggagaacctcatgcacaacgttctgatcgtcggcgcctcgcgcggcatcggcctgggactggcggatgccttcctgcaacgcggcgcacaggtattcgccgtcgcccggcgaccgcaaggctctcccgggctacaggcactggcggagcgggccggggagcgcttgcaagcggtgaccggcgacctcaaccaacacgattgcgccgaacgcattggcgagatgctgggcgagcggcggatcgatcgcctgatcgtcaacgccggcatctacggcccgcagcaacaggatgtggcggaaatcgacgccgagcagaccgcccggctattcctgaccaacgccatcgcgccgctgcgcctggccagggcactgtccggccgggttag

SEQ ID NO: 9832 - DNA, 756 bp, Pseudomonas aeruginosa
ccggggtggcgtggtggcgttcatgagttcgcagatggccagcctggcgctgggcctgtcggccacgatgccgctctacggcgccagcaaggcggcgctgaacagcctggtacgcagctgggagggcgagttcgaggagttgccgttcagcctgttgctcctgcatcccggctgggtgcgtaccgaaatgggcggcgacagcgcgccgctgagcgtcgaggaaagcgccgccggactggtcgcggcggtggaggatgccgcgggcgtgaatgcctgtcgcttcgtcgattatcggaaccagccgctgccctggtgaagcgggccgatccgtcagggcatccggcaatagccctcggccgcatacctgatgaggtcggcatcgcgcttgatgccgagcttcttcatggcactgaccttctgcgtactgatggtctgcacgctgcgatgcgagcgctcggcgatttcggtgatggtcagtccggagccgaacagacggacgatttccgcctcccggggcgtcagccgttcgttgtgcgaggaaagcacctggttgacgaagatgtccctgatcgacggcgagaaatactggtttcgcgaataggccgcgctcaccgccgccagcaggtgactggtcgagtcggacttgctgaggatgcaattgataccctgcttgagaatggcccggataaggcccggattgttcagcatggtaaagacgaccaattgcagatgcggataacgtcgccgcagcaatga

SEQ ID NO: 9833 - DNA, 666 bp, Pseudomonas aeruginosa
tcgccactgacggtgccttccgacatggacgaaacgatgcgtccctggatctggttctcgccgaccaggccgccgatgcggctgcgcccgctgccgttgacggtactgctgctgcgcgccgacaggatcgaaccggcgttgctgccgaccaggccgccaaccgacgcactcgcagcggcgctgaccctgccgctggcatccacgttgaccagttcgccgccgttgtggccgacgagcccgcccaccagactgttgaacccgccgctcacgtcgccgcgcgagatcgcatgggcgacggaaccgccgaggttgtgtccaatcagcccgccgacgcgactgttgctgccgccgctgaccttgcccgtcgcctcggcggtctcgatggcgctctggctattgttgccgaccagcccgcccagatccgcgccgccctggtccgtgacgctgccgctggctttcaggtttccgagcatgccgttgccttctgccttgccgatcagcccgccggtcgccaggccgcccttgctgtacaccgacccgctcgcctgcgagcggaatatctcgccgccggaactcaggccgaccagcccgccggtattccccgcgccgccggcctccacctggccgctggcgctactatcggagacgtggccgaacatgttgtag

SEQ ID NO: 9834 - DNA, 645 bp, Pseudomonas aeruginosa
atgaaacgggtcccgatcacggacagcgaggcggaggcatcggccaccagcgccaccagcaggacccaggccgtgccgcatcgtcccaggccgacgccggtcacagcgtgcgctcccggtcggcggccgacgccgggcgacatgccagttgcaggacgggaggcgtcgtctcgcgcgggcccagcgcatagtcgaccaggcactgctgctgcggctcgttgccccagcgcacccgaaccgagccgcgatcctgctcgacccgcagcaccaggcggctgccctggccgacggcgcccaccgactgcccgctgtgggcatcaagcacttccgcggcgaacggcaggggctcgccgctgggcatccggctatccaccagcaagggccttgccacccgcgtcggatagtcgaggcgcaccaccgctccggcggtgggcgccacgttgcgcgaactggacctcagttcgatctcgtcggccatgccgttggggtcgaggtcgacgctgttcaactggtagggcagcaggttgggaatcaccgcatagccgtggcggtcgatccggcttcccgagtagccggcagccgcgcccctggcgtttggcgcgtggaccaggccgatcgtctcgcccagggtttgtgccgcggtga

SEQ ID NO: 9835 - DNA, 183 bp, Pseudomonas aeruginosa
gtgattttcttagtcccaggaggccgtgggaggctcaatcaggcgcaatcggtgattctgattgtatgggcacttccggattcggcgcgcctgttgagagggggcaagagtcgtaaatcaggcctcaggccttcatcgctgccatcaaggcaccgctgcccagcatggtcaacacgcgtttga

SEQ ID NO: 9836 - DNA, 1122 bp, Pseudomonas aeruginosa
gcgacgatgctcgccaccttactcggtggagagcaggtccatggagtggcggtccatcatctccagcgcacggccaccgccgcgagccacgcaggtcagcggctcctcggcgacgatcaccggcaggccggtttcctgtgccagcagcttgtccaggtcgcgcagcagcgcgccaccgccggtcaacaccaggccgcgctcggcgatatccgaggccagctccggcggcgattgctcgagggcgctcttgaccgcctggacgatggtcgccagggactcctgcagggcctcgaggacctcgttggagttcagggtgaagctgcgcggtacgccttcggccaggttacggccgcggacgtcgacttcgcgaacgtcgccgcccgggaaggcggtgccgatctcctgcttgatgcgctcggcggtggattcgccgatcaggctgccgtagttgcggcgcacgtaggtgacgatggcttcgtcgaagcggtcgccgccgacgcggacggattcggcgtagacaacaccgttgagggaaatcagggcgatctcggtagtgccgccgccgatgtctacgaccatcgagccgcgggcctcctcgaccggcaggccggcgccgatggcggcagccatcggctcttcgatcaggaacacctcgcgggcgccggcgcccagggcggattcgcggatggcccggcgctcaacctgggtggacttgcacggcacgcagatcagcacgcgtgggctgggctgcaggaagctgttctcgtggaccttgttgatgaagtactgcagcatcttctcgcagacgctgaaatccgcgatcacgccgtctttcatcggacggatggcggcgatgttgcccggggtacggccgagcatgcgcttggcctcggtgcccacggcgacgacgctcttctggctgccatggctgcgaatggcgaccacggacggttcgttcaggacgatgccgcgctcgcgcacataaataagggtattggcagtacccaggtcgatcgacagatcgctggaaaacatgccacgcaattttttgaacatgggaaagaaaccctaggcgaagcgtgggtgaaaaatacgcgggtaaaaaagtgcggcaaactctaa

SEQ ID NO: 9837 - DNA, 1818 bp, Pseudomonas aeruginosa
tcctcggcccgaccacgccgaacccggcctggaagatcggcgagaagaacgacgacccggtttcccagtacctggaagacatctacaccatcaccgccaacctcgccggcctgccggggctgtccatgcccgccggcttcgtcgacggcctgccggtgggtgtccagttgctcgcgccctacttccaggaaggccgcctgctcaacgtcgcgcaccagtaccagcaggtcagcgactggcacacccgcaccccggccggcttctaagccatggcaacgccacgcagtcccctcccctctcccggcgcggagagggcgacccgcagggtcggcagcgggactacgcaggcacagaaggattgaggaacaccacatgcaatgggaaaccgtgatcgggctggaaatccacgcacagctcgccacccaatcgaagatcttctccggcagctcgaccgccttcggcgccgcgccgaatacccaagccagcctggtcgacctggccatgccgggcaccctgccggtgctcaacgaggaggccgtacgcatggcctgcctgttcggcctggcgatcgacgcacggatcgaccggcagaacgtgttcgcccgcaagaactacttctaccccgacctgccgaagggctaccagaccagccagatggaccatcccatcgtcggcaagggccatctcgacatcaccctggaagacggcaccaccaagcgcatcggcatcacccgcgcgcacctggaggaggacgccggcaagagcctgcacgaagacttccagggcatgagcggcatcgacctgaaccgcgccggcacgccgttgctggagatcgtttccgagccggacatccgcagcgccaaggaagccgtggcctacgtcaaggcgatccacgccctggtgcgctacctgggcatctgcgacggcaacatggccgagggctcgctgcgctgcgactgcaacgtctcggtacgaccgaagggccaggccgaattcggcacccgcgccgagatcaagaacgtcaactccttccgcttcatcgagaaggcgatcaaccacgagatccagcgccagatcgagctgatcgaggacggcggcaaggtagtccaggaaacccgcctgtacgacccgaacaaggacgagacccgctccatgcgcggcaaggaagaagccaacgactaccgttacttcccctgtcccgacctgctgccggtggtcatcgagcccgagtacctggcgaagctgcgcgagcaactgccggaactgccggtgcagaagcgcgaacgcttcgagagccagtacggcctgtccgcctacgatgccagcgtgctgtccgccagccgcgagatggccgactacttcgagaaggtccagggcatctgcggcgacgccaagctggcggccaactgggtgatggtcgagctgggcagcctgctcaacaaggacggcctggagatcgagcagtccccggtgtccgccgagcaactgggcggcatgatcctgcgcatcaaggacaacaccatctccggcaagatcgccaagatggtcttcgaagccatggccaacggcgagggttccgccgaccagatcatcgaggccaagggcctgaagcaggtcaccgacagtggcgccatcgagaagatgctcgacgaggtgctggcggccaacgccgagcaggtcgagcagtaccgcgctgccgacgaggccaagcgcggcaagatgttcggcttcttcgtcggccaggcgatgaaggcctcgaaaggcaaggccaacccgcagcaggtgaacgagttgctgaagaaaaagctcgaagcgtga

SEQ ID NO: 9838 - DNA, 432 bp, Pseudomonas aeruginosa
agtcgctggattgagccaccttctacccacgacaggaaccttccgatgagcgaacaaggcaagaccggcctggagatccgacgtgaagtcatgggcgacgccttcgtcgagcgcgccatgggcaacgccaccgccttcacccagccattgcaggacttcgtcaacgagcatgcctggggctcggtctgggcccgcgaggcgctgccgcgcaagacccgcagcctgatcaccctggccgccctgaccgccctgaaatgcccgcaggaactcaaggggcacgtgcgcggtgcgctgaacaacggctgcacggtggaggaaatccgcgaggcactgctgcactgcgcggtctatgccggggtgccggcggcgatcgatgcgttccgtgcggcgcaggaagcgatcgatacctggcagggcgaacagcccgcctga

SEQ ID NO: 9839 - DNA, 1623 bp, Pseudomonas aeruginosa
acggcaagccggcctcacgcaggcgctgcgtcgccgtctcggcctgggcggccagcggcgcgggcaccgcgacccgcagttgccgtgcaaggtccaccgccagcactcgcgccgcggccaggccgacggccgagtccgggtcgcccagcaccaggccgtcgtcggcctccagcggggtccgcgcgcgccctgccctttgccggcgttggccagatcgttgagcaggccgccgagcagggtgttcaccggcaactgcatgtcgcgggcgaaagccaggatcagcgcacgctgcagcagcggggtctgcgtcgcctgcttggcgtagggctcgaggatgcgctgccagtgttcggccggcagttggatctccagtgcgcggctggcgtaccagtcggcgtagtaggcgtaggcggtgaggaaagcgtcgccatcgacgtcgccaccccaccaggcgaaccaggcgtccgggccggccatctgcaccaggcgcaggcgactgttctgcatgatcaggcgcaggcggtcgcgaatccgcggctcgccgccggccagcgccggataggcgatgctcagcggcagcagttggctggcggtctgctcgacgccgccgtagggatactccagcagatcatcgagattgcccaggtaggccgcggccgggccatcggccaggcgcaggcgtacgtcgcgcgcgtccgccggcagttgcagcgggttgctcgccgccgccaggctgaggttctgcacctgctccacctgccagccgtcggccagcaggttgaagcgcaccgccaggcggtcgcggacctgcccgtcctggcgcagctcggcgctccagtcgccatcgctgagcggctgttgcgccagcggaatgtagttgactcccttggccagctccagggtctggctgcgctggctgccaggcggcccgctgagcagctcggccttgaccggctgttcgccctggttgaagacgaacaggccgaggtcgggctggtcaccctggcggaagcgagtcggcccgctccacttcaggtacagcggcttctccgagcgaaggaactgcttcttctggccgacctggccgttgtcgtcgatggcccgcgcggtgatccgccagcgggtcagcgagtcgggcatgcggaagctgaagctggccttgccctgggcgtcggtgaccagctccggctgccaggcggcggtgtcgacatcctcgcggcgcggccgctccagtaccttgacgccgcgctcgctgcggttcgcccgtccgggtgcgctggtgctgccgggcaacgccacgtcgtagctgatgaaggccaggctggcgctggtgcgcacgttgttgcgccgcggatggtagaagaactggtcgatgccgggggcgatctccgcctgcagggcatagaccatctcatccaccacgctgacggtcaggtggctggaaaccggtttgccggcgaagcgcgtggccagggtcacggtcaccgtctcgcccggttcgtagcgctccttgtcggtggcgatgtcgatctctacctggggcatgccgaccttgatcccggcgttctggaagctgtagtcgccgcccttggtgtagagcaccgagaaggtcaggttcggtga

SEQ ID NO: 9840 - DNA, 2181 bp, Pseudomonas aeruginosa
gaactcctcgcgcaccgggatccacacgcggtactgggtcggattgagtttttccaggcgcagccagtcggcgcccttggacagcagggcggtggcctcgaccttgtcgcgctccagggacaacagcgcatcctccaccggctcggggaaggtgatcagtgcggaggcttcctcgccggtgcggtactcgggcttgtcgaacaccacctcgacggtgcccggcaccgacttcacgccctcgccgctcaccgagtggccggtggcgccaaggagctggcccttgtcgtcgcgcagctccacggaataggtaccggggcgctcgaaggtcagcgcgaagcggccgtcggcgaccggaccgctgtcggtggcgcggtcctccaggcggatccactggtagctgctcggcttgagcggggtcggctgttcgctggcatagctgaactcgaccttctcgccggcggcgctgaagcgctgcggcgcgctcaggcggtagcgcgcggcgccgcgctcgatgaggatctccttgctggtcttgacccggtaggcggcgccgtcgctggcgaagatggtcagcatgtagcgactgggtttctcggccggcggcaattcgatggcggcgcggcccttgccgtctgtggtcagttcggtgctgctcagttccaccgggaactggccgagatactgcagttcgttgtccaccatcgacaactgctgggcgcgcaggctcagttgcaggcgcgcgttggccaccggcttgccgtccggatagagcaggacgatctcgcccttcaccggctcggcggtcttgaagtccggcttggccaggtcgagggcgacttcgaagtgcggcttgatgtattcggcgacgcggaaggcgctgctgtaggtctgcccgcggtagtcgaagcgcaactcgtagccgccggcgacggcgttctccggcagttggaagcggccattggcgccgctcttcgcgtcgaagcggaggtccaggctttgcaataccgtgccgctggcgtcgatcacgctcaggcgcaccggcgcgctggcggcggcctgggattgccgggcgtccttgaactcgcggccgaccatcttcaacgagacccagtcgcccggccggtacagcgggcggtcggtgaaggcgtagatcttggtgtcgtagatctcgctgtcgtaatagaagttctcggagacgaagaccccgccctcgcggtcctcgccgatcacgtaggagcgctccggactggcgtgcttgagccgcagcaggccgtcggcgtcggtattgccgctgctcatcacgcccaggccgtcggtccacagcaccttggtgtcgggcaccggggtgccttcgtgcttgcgtgcggtccagaccagcagctcgtcgccggcgaccttgctcaccgccacgctgttggagacgaacaccacggtggtggcgcggtacttgccgacaagcgcctcgaccaggtacaggcccggcttcagcttgcccagcgggatgtagacattgcccggcacgacgttgatgaactcgctggaggaaccggccagcttgacgtcctgcggcggctcgatgggcttggcgtcccacagcggatagcggaactggctgaccagcggcaggccgggaatcggcgcgtattgcggctgcgcgtcgtagggcgtcggcgcggtcatggcgttgcccatcttcagctcgggcaccgcctcggtgacctgttgccgcgactcgtaggagaaggcgcgctgcatcacccggcgcgacttgcgataccagttgtcccagagataggccagggtgttcgacaggccttcgcccttgaactgtccctcggccaggacccggtgcaggttcttctgccgcttgaggaactccagcggctgttcgatccggtacaggcgcacgtcgaccccgccatagggctccatgcggtagcgccggtagtcgcggccgggcgcttcgagacggacccgcgcttcctcgtcggtggcgaagctgctgtcggcgagcaggaagaaggattcgccggccatcggcgtgtagccgctcggttccaccgtgtcttccgcctggacggcggcgaacggcagcaggaccagggcggcgaccgccaggctacggctgaaacggcgcaggttgctcattgctgtggtcttcactgggacgcgattcattga

SEQ ID NO: 9841 - DNA, 1530 bp, Pseudomonas aeruginosa
tccggcgtgtcctgctgggccagcgccaggccttcctcggcggagccggcggtgctgacccgcaggccgcgacggctcatggcccgcgccaggacccgggtaaaggtgggatcgtcgtccaccagcaggagatggggttgttcttccccttcgaagagcagctcttcagacataggcagggcctctcagacggatcactcaagccattccgtagctgcgcggcaagcgcagttcggtcagagtgccgccatcttcgtggttatacaacttcaccgttccaccagcgcgggtcacgctggcctgactgagaaacaggccgaggccgaagcccttgcccttggtggtgaagaacggtttgccgatctgttcggcgatcgccaggggcaccccgacgccgtggtcgcggatactcaggcagatactgctgctgtcccagtccaggcggatgtcgaggtcgtcgggacaggcgtccgccgcattgttcagcaggttcagcagagcctggctgaggtcggtcggcggggtcaggcgcggcgcggagccgaggcccaggcactggtagcggtaggaagcctccggacgcatcaggtgccagcggcgcagcaccgattccagccattccgcggcgctttgctcctcgatcgcctgacgacggtcggcctcggccgcccgtaccagttgctggagggtgtgcttgcactgcttgacctgttcctggagcaatgccaggtcttcctgcagggtcgggtcctgcgggcgctcctggcgcagctcgttgagcagcacgctcatggtcgccagcggcgtacccagttcgtgcgcggcaccggccgcctgggtggccaccgcgagcaactgctggtcgcgcatgctttcctcgcgccgctcggcctgcatgtgcgcctgccagcgcagcgcctcggacatcttcaccacgaagaaggtgatgaaggccgccgacagggcgaagttcagccacatgccgaacaggtgcaggttgatcagcatcgcctcgtgctgaaccgcctgcaggtgcagcgggtggtaccagatcagcagcagggtgtagccggtcagggccaggccggagagcaccatggagtagatccagggcagggtcgcagcggcgatggtcagcggtaccaggtaataggagacgaaggggttggtcgagccgcccgagtaatacagcaaggtgctgtggatgatcaggtcgcaggccagttgtaccgcgtactcctggtcggtcaccggccacggcgcgcgcaggcgcagcgcggtgaacagaatcaggcaggcggacaggccaagggtcaggccgagcgccagccacggcagcggcaacaggtcggagagccaggcgaaacccaccgagccggcctgcgcggccagcacgagaatacggatgaggagcagacggccaaggttctggcgactggcggagagcaggaaaaccggtgcgcgcatgttttcttccggaataagcgcgagtatagccaagacgctgtcggcaactctgcggcaaagtga

SEQ ID NO: 9842 - DNA, 924 bp, Pseudomonas aeruginosa
ctcagaaacctcgcaggtcgccatcctgccctgtttcgccgagcgctgtcagggctcagatcagtaaatttcacgttttttccgaaatcgcctaacccgttccgggaaaagccttcgtctcatggtccaagactggcgtataggcgtgtttgccacgcctgccggaacgatgctctacagtgtgaattcagccttagtacaaggagttgcccaatgtctgcgatttcccgcctggccgccgccgtcaccctctgcgccgccagcctctcggccgtcgccgaggaagcgccgcgctacaaccaggtctcgctgcacgccgaagtcagccagcaggtggcccacgacctgatgcaggtcaccctctacagcgaaaaccagggcagcgatccggccaagctcgccgccgagaccaccagcgtcctcaacgccgccgtcgccgacgcgcgcaaggtcaagggcgtgaccatcagcctgggcagtcgcaacagctatccggtctacgacgacaagggccagaagatcaccggctggcgcgagcgcgccgagctgcgcctggaaagctccgacttcgccgccctcggccagctttccgccgacctgctgggcaagctgaagatgggcggcatggacttcagcatcgccgatgcgacccgcaagaagaacgaggaccaattgatgaaaggcgccgtggacgcgttcaaggagcgcgcccagttgctcaccgaggcgctcggcggcaagggctacaagctggtcagcctgagcgtgaacagcgccggcgcaccgcgcccgtacccggtgatgcggatggcggcgatgaaggccgacgccagcttcggtggcgcccaggcaccggagatcgaggccgggaccagccaggtcacggtcaacgccgacggtgtgatcgaggtgcagatgccctga

SEQ ID NO: 9843 - DNA, 1866 bp, Pseudomonas aeruginosa
tccggtcggcgcgcaccacaagaggcagcctccgggctgcctcttgcgtttccactgtctctcgcgcagcaaacgcggcctgcgtcgcgtttgcgcaaattcgaaaatgcgacattccctttcaaacggataacaacatctacactgaaccgacctcgacgcttgcggccggcacatgccctgcatagcttcgcgcaagacagctcacgaggctgtccctcgcagacaatcaaaataaccagaggtcactccatgcgtagaaacgccgtcatccgctccgcgatcattccctcgctgctcggcgcagcgctggtcgccgccgttccccaggccttcgccagcaacctgatcttctgctcggaaggcagcccggccggcttcgatcccgcccagtacaccaccggtaccgatttcgacgccgcggcggaaaccgtcttcaaccgcctgacccagttcgagcgcggcggcaccaaggtccttcccggcctcgcggaaagctgggacgtcagcgacgacggcaagacctataccttccacctgcgcaagggcgtgaagttccacagtaccgactacttcaagccgacccgcgaattcaatgccgacgacgtgctgttcaccttcgaacgcatgctcgacaaggatcatccgttccgcaaggcctaccccaccgagtttccctacttcaccgacatgggcctggacaagaacatcgccagggtcgagaagctcgacgagcatacggtgaagttcaccctcaacgaggtcgacgcggccttcatccagaacctggcgatgcccttcccatcgatccagtccgccgaatacgccgcgcaactgctcaagcagggcaaggccagcgacatcaaccagaagccgatcggcaccggcccgttcgtgttcagccgctaccaaaaggatgcgcagatccgcttcaagggcaacaaggactactggaagccggacgaggtgaaggtcgacaacctgatcttcgccatcaacaccgacgcctcggtgcgcgcgcagaagctcaaggccggcgagtgccagatcaccctcaacccgcgccccgccgacctcgacgcgctgaagaaggacccgaacctgaacctgccgtcgcaggccggcttcaacctcggctacatcgcctacaacgtcacccacaagccgttcgacaagctggaagtacgccaggcgctggacatggcggtgaacaagaaggccatcatcgacgccgtctaccagggcgccggccagttggcgagcaacggcatgccaccgacccagtggtcctacgacgagaccatcaaggacgcgccctacgatccggccaaggccagggagctgctgaagaaggccggcgtcgccgagggcaccgagatcaccctgtgggccatgccggtacaacgcccctacaaccccaacgccaagctgatggcggaaatgctgcagaacgattgggcgaagatcggtatcaaggcgaagatcgtcacctacgaatggggcgaatacatcaagcgcgccaagggcggcgagcatgacgccatgctgatcggctggagcggcgacaacggcgacccggacaactggctcggcaccctctacggctgcgacgcggtggacggcaacaacttctccaaatggtgcgacgccggctacgacaagctggtcaaggatgccaagcgcaccaccgaccagggcaagcgcaccgagctgtacaagcaggcccagcacatcctcaaggaacaggtgccgatcaccccgatcgcccactccaccgtgtaccagccgatgcgcaagacggtacacgacttcaggatcagtcccttcggcctgaactcgttctacgaggtcagcgtcggcaagtag

SEQ ID NO: 9844 - DNA, 1692 bp, Pseudomonas aeruginosa
cttcgcctgccagccgcgccgccccgccacgagcgaggcggcgcctctccccggggcggccgacccggccgtcccgctccagaggagtcatccatgcgaccacgctctgccctgcgctacagcctgctgctgctcgccctcgccgccagcgccgccatccaggcccagccgaagaccctggcggtgtgcaccgaagcggcgccggaagggttcgatccggcccgctatacctccggctacaccttcgacgcctcagcccatccgctgtacaacgcgctggccgcgttcgctccgggcagcgccacggtgatcccggccctggcggaaagctgggacgtctccgctgacggcctcgtctacaccttccgcctgcgccagggcgtgaaattccacagcaccgactacttcaagccaacccgcgaattcgacgccgacgacgtgctgttcagcttccagcgcatgctcgatccgcagcaccccgcccacgacctttcgcccagcggctacccctacgccgacgccatgcaactgcgcgacatcatcgagcgcatcgagaagatcgacgaacatcaggtgcgcttcgtcctcaagcacccggaggcgccgttccttgccgacctggccatgccgttcggctcgatcctctccgccgaatatgccggccaactgatcgccaggggcaagggcgacgaactcaacagcaagccgatcggcaccggcccgttcgtcttcacccgctaccacaaggatgcccaggtgcgctacgcggccaaccccgactactggaagggtaagccggccatcgaccacctggtgctggcgatcaccctcgatcccaacgtgcgcgtgcagcgcctgcgccgcaacgaatgccagatcgccctgacgcccaagccggaagacgtcgccgcgttgcgccaggacccgcaactgacggtgctggaagaagcggcgatgatcacctcccacgccgcgatcaacacccggcacgaaccgttcgacgacccgcgcgtgcgccgggcgatcgccatgggcttcaacaagtcgtcctacctgaagatcgtcttcggcgaccaggcccgcccggccatcggcccctacccgccgatgctgctcggctacgacgacagcatccgcgactggccctacgaccccgaacgggccaaggccctgctgaaggaagccggcgtcatcccggacacacccctgaacctctacatcagcaccggcagcggccccggcggcaacccggcgcgagtggcgcaactgatccagtccgacctggccgccatcggcatccgggtgaacatccgccagttcgagtggggcgagatggtcaagcgcaccaaggccggcgaacacgacatgatgctctacagctggatcggcgataacggcgacccggacaacttcctcacccacaacctcggctgcgcctcggtggagtccggggaaaatcgcgcgcgctggtgcgacaagggcttcgacgaagccatccgcaaggcgcgcatgagcaacgacgagagccaacgggtagcgctgtacaaggaagcgcagcggatcttccacgagcagatgccctggttgccgctggcgcatcctttgatgttcgacgcgcaacgcaagaacgtcagcggctaccgcatgagcccgatgtcggcgcgggacttttcgcgggtgaagctggactga

SEQ ID NO: 9845 - DNA, 1656 bp, Pseudomonas aeruginosa
agggagcaatcaggtgatgagataccaacgagtgaccggcgcgacgctgggattggccttgatggcatcggccgcgccaggctgggcagcggacgagcaggcaaccccgccgaccccggacaatcccagctacgccgcccaggtgcagagcatccccagcgtggagaaaccgatcaagggccaggccggcgccagcgggctgttcgaggggcagagcctgaccctgaccacccgcaacttctactcgcgggaaaacatgaaggacagcttcaccttccgcattcccaaggccggcggcggctcccagcgcatccaccagcgcaacgcctgggtccagggcacggtgctcaagtacagctcgggctacacccagggcagcatcggcttcggcttcgacgtcgcagccttcaacgagatcgccctggagcgcggcaagggccgcatcggcggcggcggcaaccggaccctggcgaacagcgatggcgaggcgatcggcgagtggtccaagctgggcgtcgccaacatccgcctgcgcgcctcgaataccgaattcaaggccggtcgcttcctggtcaacactccagtgttcagctatatcgacaaccgtgccctgccctccagcttcaccggcttcgccgtgaccagcgaggagctggacaacctcagcctgcaggccggcagcttccgcaaggtcagcccgcggaccggttccggcgacgaggacatgaccaccgagtacggcacccgccaggtcaagggcgaccgcctgaactacctgggcggcaactacaagccgctcgacgggctggaaatctccctctatggctcgcatttccaggacgtctggaaccagtactacctgggcgtgacccacgacatcggcgacctcgagaacggcatcgccctgcgcaccgccttcaacggctaccacaccggcgacaccggcgcgcgcgaggccggctacatcgacaacgacacctggagcctggccttcactctcggccatcgcgcccacgccctgaccctggcctaccagcaggtcgacggcaacgaatacttcgactacgtgcacgagacctcggcgatcttcctggccaactcgatgctggccgactacaacagccccaacgagaagtccgcgcagatccgctacgagaccgactggagctactacggggtccccggcctgagcaccggcgtgtggtacgtgaagggctgggacatcgacggcacccactacgacggcgatcgcaacggtgcctacggcaactacgccgaggtgcgcgcccaggacggcgagaagcaccacgagctgggcctgatggcggcctacaaggtgcagaacgggccgatcaaggacagcaccttcaagctcacctacatgatgcacaaggccagccagaaccaggtcgacggcagcgtcaacgaactgcgcctggtcagcaccttccccttcaacctgctgtaaacctgcgacaaccggcggccccggcgacggggcccacgaggaggaccccatgctccatccgttgctccgacacctgcccctggccctggcgctatgcgccgccggcgcggcccaggcgaagaacctggtggtctgcaccgaggccagcccggaacgcttcgacatcgtccagtacaccggcgcggtga

SEQ ID NO: 9846 - DNA, 1086 bp, Pseudomonas aeruginosa
agccgtagaagaacaaggaccacagccccgccgccagcggggcgcacggtccgcgatgaggagttacccgccaacatgcttagtttcattgcacgacgattggggttgctgatccccaccttcttcggcgtgacgctgctcaccttcgcgctgatccgcctgattcccggcgacccggtggaggtgatgatgggcgaacgtcgcgtcgatccgcagatgcatgccgaggccctgcaccgcctgggcctggacaagccgttgtaccagcagtacctggactacgtgggcaacctggcacagggcaatctcggcgaatcgctgaccacccgcgaaggcgtctggcacgaattcctcaccctgttcccggcgaccctggaactgtccctggccgccatgctcttcgccggcaccttcggtctgctggccggggtgatcgccgccctgaaacgcggttcgctgttcgaccacggggtgatgacggtgtccctcgccggctattcgatgccgatcttctggtggggcctgatcctgatcatgctgttctccgtgtcgctgggctggacgccggtgtccggccgtctcgacctgctctacgacatcgagccgaagaccggcttcatgctgatcgacaccctgctttccgacgaacagggctcgttcctcgatgccgtgcgccacctgatcctgccggccatcgtgctgggcaccatcccgctggcggtgattgcccgcatgacccgctcggcgatgctcgaggtgttgcgcgaagactatgtgcgcaccgcccgcgccaagggcctgtcgccggcccgggtggtcttcgtgcacgccctgcgcaacgcgctgattccggtgctgacggtattcggcctgcaggtcggcacgctgctcgccggcgcggtgctgaccgaaaccatcttctcctggccgggcatcggcaagtggctgatcgacgccatcagccgtcgcgactacccggtggtgcagaacggcatcctgctggtcgccaccctggtcatcttggtcaatttcgtcgtggacatcctctacggcctggccaacccgcgcattcgccaccaacgctga

SEQ ID NO: 9847 - DNA, 1041 bp, Pseudomonas aeruginosa
agaacgcggcatgaggagcacaaccatgaacagcgcatccgtatccgcgccacaggagaccgccgcatgagcctcctcgatatcaagaacctcagcgtgcgcttcggcgacaccaccgccgtgcccgtggtcgacggcctcgacctgagcgtcgacaagggcgaggtgctggccatcgtcggcgagtccggctccggcaagtcggtgaccatgatggccctgatgggcctgatcgacgcccccggctgggtatccgccgatcacctgcgcttcgacggccacgacatgctcaccctcaagggccgccagcgccggcgcatcgtcggcaaggacatggcgatggtattccaggacccgatgaccgccctcaaccccagctacaccgtcggctaccagatcgaggaagtcctccgcctgcatctcggcctgcgcggcaaggccctgcgccagcgcgccctggaactgctcgaacgggtcgagatcccggccgccgccagccgtctcgacgcctacccgcaccagctctccggcggcatgagccagcgcgtggcgatcgccatggctatcgccgccgagcccaagctgctgatcgccgacgagccgaccaccgccctcgacgtgaccatccaggcgcagatcatggagctgctgctgaacctgcagcgcgaccaggacatggcgctgatcctgatcacccacgatctcgccgtggtcgccgagaccgcccagcgcgtctgcgtgatgtacgccggcgaagcggtggaaatcggcggcgtgccggcgctgttcgaccgcccgacccatccctacaccgaggcgctgatcaaggcgatccccgagcactgtgccggcgaagcccgcctggccaccctgcccggcatcgttccggggcgctacgaccgcccgcgcggttgcctgctgtcgccacgctgcccctatgcccaggagcattgccgccaggagcggccggccctggaggcacacgagcgcggcgcggtgcgctgcttctatccgttgaacctgctgaacgaggtggcctga

SEQ ID NO: 9848 - DNA, 972 bp, Pseudomonas aeruginosa
tggaaaccggttctgaccgcccgtgatctgacccgtcactacgaagtctcccgcggcctgttcaagggccacgcccaggtgcgcgcgctgaacggcgtatcgttcgaactggaagccggcaagaccctcgccgtggtcggcgagtccggctgcggcaagtcgaccctggcgcgcgccctgaccctgatcgaggaacccacctccggctcgctgaaaatcgccgggcaggaggtcaagggcgccagcaaggaccagcgccggcagttgcgccgcgacgtgcagatggtcttccagaacccctacgcctcgctcaatccgcgacagaagatcggcgaccagttggccgagccgctgctgatcaacaccgcgctgtcgcgcgaggaacgccgcgaaaaggtccagcagatgatgcgccaggtcggcctgcggccggagcattaccagcgctacccgcacatgttctccggcggccagcgccagcgcatcgccctggcccgggcgatgatgctgcaacccaaggtgctggtggcggacgagccgacctcggccctcgacgtgtcgatccaggcccaggtactgaaccttttcatggacctgcagcagcagttccgcaccgcctacgtgttcatctcgcacaacctggcggtggtccgccacgtcgccgacgacgtcctggtgatgtacctcggccgaccggcggagatggggccggcggacaagctctacgagaacccgctgcatccctatacccgtgcgctgctctcggcgaccccggcgatccacccggacccgacgaagccgaagatccgcatccagggcgaactgccgaacccgctgaacccgccggagggttgcgccttccacaagcgctgcccctacgccaccgagcgctgccgcagcgaggtgcccgagctgcgcctgctcgaccagcgccaggtggcctgccaccacgccgagcaattcctcggctga

SEQ ID NO: 9849 - DNA, 582 bp, Pseudomonas aeruginosa
accgccgagcccgtcgcgaacctggcaggcgacgctgcccagtaccggcctcgcccggaaaccgccggcgcaggccaggtaggcacgctgcccggcctcggcgaagcccagttcgatgcgttgcccgcggcggacccggaagcgactccagggcaggcattcgcgaccgtccaccgtcagcgccagacgcgctccggtcaacgccagccaggtcgcctccaccctgcactccagcaccaagccgccgaaagcgatttccagcaatggcgtcccccagggattaccgagcagacgattggcccaggctgccgcctggcggtccagagggccgccagcggatacgccgaggtgctgccagccgcgccggccgtcgtcctgcagcaggctttgcggtcccgccttgacgacccgcaaaccattcattcgcgcccgcccaggtcgaggaagtcctcgcgcccgatggcgacgaagcgcacccggtcgcccagcgccagtgggcacggaggagtggcggccggatcgaacggacgccacggactgcgtcccagcaggtgccagccgccgggcgaggcctgcggatag

SEQ ID NO: 9850 - DNA, 195 bp, Pseudomonas aeruginosa
cataggccacctgggcaccgagggaacggcagaaagcgtccagcgcaccgatctggtacagcaccatggcatgcacctcttcggcagagcaggccagcgagcgccggccgaagccgctcaggtcgggataggccgggtgcgcgccgatgctcacgccatggcgtaccgccagctccaccgcgcgccgcatggtga

SEQ ID NO: 9851 - DNA, 495 bp, Pseudomonas aeruginosa
ccgctctgcggttattcgccctacaccccgcaaagcccggcagtcccagtagctggcaacgaaaaggctcccttgggagcctttttcattcatccgttcagtacacgtcgcgtcggtaacgtccttcgtcggccaggcgttgcaaggcctcctcaccgagcacttcgcgcagtacccggtcgacaccaccggccatgccctgcaggctgccgcagacgtacaaggccgcgccctcgtcgatccagcgccgcagttcatccgccgcttcatgcaggcggtcctggacatagatcttctccgcctggtcgcgggagaaggccaggtccaggcgttgcagctcgcccctggccagggcttgctccagctccgcacgacagtagtagtcgtgggcgaaattgcgttcgccgaacagcagccagttgcgcttgcgcccggcggcaatgctggcgcgcaacaggctgcgcaggccggcgagcccggtaccgttgccgatga

SEQ ID NO: 9852 - DNA, 735 bp, Pseudomonas aeruginosa
gccagccggagcagatgcccaggctgccgtcggcatgctgctcctggcgtacgatcagttgcaggtcgccatcgctctgcagcgacgcgatggagtactggcgcacggaaagcggaatcagcgcatccagcagcgcctgcgggtgcaagccgaccaggtgttcgaaagaatccggcagcaggcgcccggccagggcctgctccaggctctgctcgacgccctcgaccgccacccgcacctggccgtccaggtgatgccgctgcagccattcgcggatgcgcgcgggcgcctggtgcggaacgatctccagcagatcgccggcgcgccattggatggcgctgtcggccggcgcacgcaggtccagcagccaggtcgactcgccctggctgccaggattcaggcactcccgccgcgccagcgaccagacctcgaaggccggcgcttcccaggccgccggggcggcaccgccggtcacctcggccaggctttcctgccattggcgcagggccgcggcgtcgccatcatcgacctccaccggggcgaacaggctccgcgcgccctgcccctgcaaccagccctgcatgcgccgggcgaagccgcagaactgctcgtactggcgatctcccaaggccagcagggcgtagctcaggccatcgaggctggcggcctggccaagcaccttgcgttcgaagccgcgggcgctgtccggcgcctcaccgtcgccgaaggtgctga

SEQ ID NO: 9853 - DNA, 1200 bp, Pseudomonas aeruginosa
gccccaggtgaagccggcgtcggtgaagttgtcctgcttggcggtcttgctgatcaggttcaggctgccaccggtggagccggcgccggtgtaggccgagcccgggcccttgctgacctcgatctgctcgacgttgaacacctcgcgggtttgcgaggcgacgtcgcgcataccgtcgaggaacgtatcgctctcggcgttgaagccacggatgaatggccggtcgcctgcggggttgccgccctcgcccgcgccgaaggtgatacccggggtggtgcgcagtgcgtcggccagggtcagggcgccagtgtccttgatcacctgctgcgggatcacggtgacggtcttcggcgtatccagcagcggcgcggtgtacttcttcgacgccgagcggtcgacgttgtaggtggtttcgtcctgctgctcgccgacgatggtggccgcatccagcgacagtactcggtccttgtcggtctttttctgcccggcctcgtcggcgtgggctgcctgcggtgcggcgatggcggtgatggccacaccgatggccgaagccagcagacgttgcgaagaaacggcggtatccgtggactgacgcgacattcgaaacccctccccgggagctgtgaaggtcgcggaatttattgcagatcagaattgttatcaattattacggattcgcattcgacaggaatttacattctttacaattttctcattacattttttcccatctcgctcgtctggaacatttggcggttttacatgaccaatgcaaatcaatatcattggcaatcatttcgccttcatggacagcgccatgttgctgcatattcccgccatcttcaccgccgaggaagtctcccggatccgcgcagccctggagcaggcggaatgggccgacggcaaggcgaccgccggctaccaatcggccaaggccaagcacaacctgcaactgccgcaggaccacccgctggcccgggagatcggcgaagccatgctgcagcgcctgtggaaccatcccctgttcatgtccgccgccctgccgctcaaggtcttcccgccgctattcaactgctataccggcgggggctcgttcgacttccacatcgacaacgccgtgcgcgacgtccatggcggccgcgagcgggtccgtaccgacctgtcctcgaccctcttcttcagcgacccggaggactatga

SEQ ID NO: 9854 - DNA, 1116 bp, Pseudomonas aeruginosa
cggcggcgaactggtgatccaggacacctacgccctgcaacaggtgaagctgcccgccggcgatctggtgctctaccccggcaccagcctgcacaaggtcaatccggtcacccgcggcgcgcgctacgcctcgttcttctggacccagagcctggtccgcgaagacagccagcgcaccctgctattcgaaatggaccagtcgatccagcgactcacccgcgacgtccccgaccatccctcgctgatccgcctcaccggtacctaccacaatctcctgcggcgctggtcggaactctgaacatgcgccacctgctgcttcgtcacgacgcgctggacgccgaaggtttcgccgcacaactggccggtaccccgggcgaggttgcccaggccatcctcggcgctgcgcgcgagggcctgacggaagcccaggccctgctcggacagatccttctggacggccaaggcatccagcgcgacccgaccctggcgcggacctggttcacgatcgccgccgaacgcggccacgcaatggcgcgcaatatgctcgctcgctgtcttgaacatggctggggcggcccggcggatccagccgcggcagccgtccactatcggatcgccgcccaggccggccttgactgggcccgctacaacctggccaatctccacgccaccggccgcggcgtgtcccaggaccagccgcgcgcctatgcgctgtatcggcaagcggccgagcagggccacgcgaaatcgatgaacctggtggggcgctaccacgaagaaggcctggtggtcgctcgcgacctggcgcaagctgcgcactggtatcgacgttccgccgagggcggcgattttcgcggccagttcagccacgccgcgatgctcagcgcctcgggccgccatgccgaagccgaaacctggctccggcgtgccctcgaaggcggcaacctgaacttcctgcgcagtgcccgccatggcctggagcagtcggcccacccgccgttccgcagcctggcgctggcctactaccgacgcgcggcgcagttgggcgacgacaccgatcgagaggctctggaacaggcgctcgaacgtcacgggtacgcacgactgcccgtctga

SEQ ID NO: 9855 - DNA, 1095 bp, Pseudomonas aeruginosa
cctgctcagcctttaccccatgtgcatgacagtgggatgtccccgtccgcccagcgttcaatcggatggacgaaaaacgtcccgcgcaggccttgcgcctacacccggaacgcgccgatcaggcgtttcagctgggtcacctgggcgcccagttcgcggctggcccgttcggtctggctggcgccttccgcggtgcgctcgccggcctggttgatctcgacgatgttctggtcgatatcgtgggccacggcggtctgttgctcggcggcggcggcgatctgctggttctggtcgacgatcatgcccaccgcgccgaggatattctccagtgcctgctgcacctgcgccgactcgttgaccgtgccatcggcggtatggtggctgctgcccatcgccttcaccgccgcatcgacgccgccctgcaggcgcaggatcatctgttcgatctcggcggtggattgctgggtgcgcttggccagcgtgcgcacctcgtcggccaccaccgcgaaaccgcgcccctgctccccggcacgagcggcctcgatcgccgcattgagcgccagcaggttggtctgttcggcgatgcccttgatcacatccagcacctggctgatcgaggcgctgtcactggccaggcgattgatcgccgccaccgactggtcgatctcgccggccaggcgctggatgctacccacctgcgactcgaccaggctgcgcccgctgagggtttcctggttcacgctgttcgcgctgctcaccgccatcgccgcgctgcgtgccacttcctgggcggtagcggccatctggttcatcgccgtggccacctgctcgatctggctgcgttgcccggctaccgcctggttgctttcggccgacaccgactcgacgcgcagggtctgccgctcgacctcgccgacggtctggctgacccgctcgatcaggtcgtggatcttcgccaccgattcgttgaacgattgtcccagctcgcccagttcgtcacggctgcgggcctggaagctgaccgtcatgtcgccgccggcgacgcgctccatcattcgcccgagatccttcagggtggcgcgggtggaaacgtag

SEQ ID NO: 9856 - DNA, 552 bp, Pseudomonas aeruginosa
agtacggtcttcacccagacgtctcctgattgttcttatcgttctgagagatgccgccgcgtggcgacattgacgcacggagtccgctcggtaatggcctttcgaaatcatgcggacacgttcacctgtgtacccgatatcggcctggtgttctgtaacttaaggttaacggggaatcgcaggcggattccccgtcgctgcgctcagaggaacagcgcgcagaaggcgaacacggcgtaccagagcacggccgcgcgcaccagcaattgccagagcgcatccaggctggcgacgccggcggcacccagttcgaccgcttcgacatcgctggcgacccgtccggccttgcccagcagcgcggccgccgagatgtcccaggccagcagccagtgcagcagcacgcggataaccgcgaggaagttgccgaccagggcgaagctcagcaccagcgcacgcaccggcaaccagtcgaggatatgccggacgcgcgccgcctgttcgcgcaacgccggctggcgggcgtgctccagcgccagtgccagcaggcgatag

SEQ ID NO: 9857 - DNA, 1722 bp, Pseudomonas aeruginosa
cccttctgcgattccttccccatgaacgacagcatccaactgagcggcctgtcccgacagctcgtccaagccaatctactcgacgaaaagaccgccgtgcaggcccaggcgcaggcgcagcgcaacaagctgtcgctggtgacgcacctggtgcagaacaagctggtaagcggcctggccctggccgaattatccgccgagcagttcggtatcgcctactgcgacctgaatagcctggacaaggaaagctttccgcgggacgccatcagcgaaaagctggtccgccagcaccgggtcatccctttgtggcggcgcggcaacaagctcttcgtaggcatctccgatcccgccaaccaccaggccatcaatgatgtccagttcagcaccggcctgacgaccgaagcgattctggtcgaagacgacaagcttggcctggccatcgacaaactgttcgaaagcgctaccgatggtctcgcaggcctcgacgatgttgacctcgagggactggatatcggtagcgcggaaaagtccacccaggaggataccagcgcagaagcggacgacgctcctgtagtacgtttcgtcaacaagatgctgctggatgccataaagggtggctcttccgacctgcacttcgagccctacgagaagatctaccgggtgcgcttccgtaccgacggcatgctccacgaagtggccaagccgccgatccagttggccagccgtatttccgcgcgactcaaggtgatggccggcctggacatttccgaacggcgcaaaccgcaggacggacggatcaagatgcgcgtgtcgaagagcaagtccatcgacttccgcgtcaacaccctgccgaccctgtggggcgagaagatcgtgatgcggatcctcgactcctccagcgcacaaatgggcatcgacgccctcggctacgaggaggaccagaaggaactctacctggccgcactcaagcagccacagggcatgatcctggtcaccggccccaccggctcgggcaagacggtatcgctatacaccggcctgaacatcctcaataccaccgacatcaacatttccaccgccgaagacccggtggagatcaacctggaaggcatcaaccaggtcaacgtcaacccgcgccagggcatggacttctcccaggcgctgcgcgccttcctgcgccaggacccggacgtgatcatggtcggcgagatccgcgacctggagaccgccgagatcgccatcaaggcggcgcagaccggacatatggtgatgtccaccctacacaccaacagcgccgccgagaccctgactcgcctgctgaacatgggcgtgccggcgttcaacctggcgacctcggtgaacctgatcatcgcccagcgccttgcgcgaaaactctgttcgcactgcaagaaagaacacgaggtgccgagggaaaccctgcttcacgagggctttccggaagacaagatcggtaccttcaagctttattcgccggtgggctgcgaccattgcaagaacggttacaagggccgtgtcggtatttatgaagtagttaaaaacaccccggccctgcagcggattatcatggaggaaggcaactccatcgagatcgccgagcaagcccgcaaagaaggcttcaacgatctgcgcacctcaggcctgctgaaagccatgcaggggatcaccagcctggaggaagtcaaccgcgtgaccaaggattaa

SEQ ID NO: 9858 - DNA, 1221 bp, Pseudomonas aeruginosa
tccatggcggataaagcgttaaaaacctgtgttttcgtctgggaaggcacggacaagaaaggggcaaaggtcaagggggagttggctggccagaacactatgctggtgaaggcgcaactgcgcaaacagggcataaatccgctcaaggtcagaaaaaagggcattacccttctcggcaagggaaagcgcgtaaagccgatggacatcgcactatttactcgtcagatggcaaccatgatgggtgctggggttcctctcttgcaatcgttcgacataatttccgaaggtttcgacaatcccaacatgcgtaagctggtcgacgagatcaaacaagaggtctcggcgggtaacagcctggcaaactccttgcgaaagaaacctctttattttgacgatctctattgcaacctggtggatgcaggtgaacaatctggcgccttggagactttgcttgaccgtgttgccacctataaggaaaaaaccgaatcgctaaaagccaagataaaaaaggctatgacataccccattgccgtcgtcttggtcgcgatcattgtttcagccattctcctgatcaaggtcgtaccccagttccaatccgttttctccagtttcggagcggaactaccagcctttacaatgatggtgataaacctgtcaaatcttttacaggaatggtggctagtcgtcctcatcggattattcagcgccagcttcgccatcaaggaatcgcataagcgttcagtaaatttccgtaacacggtagaccgctatatgttgaaaataccgataatcggaggaatactttacaaatcagccgtggcacgttacgcccgtacactttcaacaactttcgccgcaggtgttccattggtggaggcactagactctgtctctggagcgacaggaaacgtggtattccgcaacgcggtaagcaagatcaaacaggatgtatccacaggtatgcaattgaacttctccatgagaacgaccaatgtattccccaacatggcaatccagatgacagccatcggtgaggaatccggttctctggacgacatgttgggcaaggtggctgcgttctatgaggaggaagtagacaatgccgtcgacaatctgacaactctcatggaacctatgatcatggccgtgctcggcgtactggtcggcggcctgatcatcgctatgtatctaccgatcttccaactgggttccgttgtgtaa

SEQ ID NO: 9859 - DNA, 591 bp, Pseudomonas aeruginosa
cccggacctatctgcaattcgccggattcaaatgacccaaccctggatactaggcctcacgggcggtatcggcagcggcaagagcgcagccgccgagcatttcatttccctcggcgtccacctggtggacgccgaccatgctgcccgctgggtggtggagccggggcgtccggccctggcgaagatcgtcgaacgcttcggcgacggcatcctcctgcccgatggccagctcgaccgagccgccttgcgcgagcggatcttccaggcgccggaggaacggcgctggctggagcaattgctgcacccgctgatcggcgcggagatcgtccagtacctggccagggccgaatcgccctacgccatcctggtctcgccgctgctggtggagtccggccagcgccagatgacccaccgcgtgctggtggtggataccccggaacatctgcaactacagcgcaccatgcttcgcgacaaggtctccgaggagcaggtgcgctcgatcctccaggcccaggcccggcgcgacgagcgcttgaagcacgccgacgacgtgctggtcaacgacggcgacctgtcccacctgcagcgtga

SEQ ID NO: 9860 - DNA, 249 bp, Pseudomonas aeruginosa
agtcgaacgactgcacgccttctacctgaccttgcgaggaggccgagcatgagccagcccctgaccgtggagtgcccgacctgcggcgcgcccgtcgaatggaaaagcgacaacaagtaccgccccttctgctccgaccgctgcaagctgatcgatctcggcgcctgggccgccgaggaacatgcgatccccggcgacaccctggaagacgacatcttctccgccgacctgccgcctcgcgagcattga

SEQ ID NO: 9861 - DNA, 1158 bp, Pseudomonas aeruginosa
acgcaacgggccagccaatccggctggcccgttccttcaggggcgcatgaaagcgtagtcgcgctggtcatcgagattctccgcaagaaattgcagttcgctggccaggtcgccagcatcgcgctccgcccggttcagttcgacgattgcgctgagcaacgcgcgcaggcgcattgcccggtccgcctcgtcgctcttcgacagcaactctcgcaggccctgtcgggcccattcatggacacccatgttccgctcctcacctgggaaaacggcaggatcgcggccggcttcgtccgaaacactgacgcaagtcagccgctgcccgccatgaacctggcgaatgactggtcatcagggcttgcgctcttcgtccttccagggtgcctgcaggtagcgcgtgcgattgaaggtttccagccactccgggtagtagaccaccaggccggtgatcaccgtgccgttgatgaaggcctcggggaacatgatcagccacaggtaaccggcgaagtcctccagccagggcggcatcgggaaaaggccgtcgatccagaccacgccaaggccgagcagcaggaccaccaccgcggtgagggccgccgggaagaaaccgcagcagaagatgtagacgaacaggttgcgcggctggcgcttttccacgaacaacgccgccagctccgcgatcagcgcggggatcgccaccagcagcacgccgttgacgccgatcgccagccaatcctggcggccgagcaggcacaagcccagttgcgccaccagccccaccacgatcgccagcggccagtcgagcagcaaggtgacggcggtcatgccgatgaaatggaaggacagccccgattcgaagtcccggcgcaccagccagagcaggaacagcccgagcatggtaccgaacaccaggtgctggcggcgggtatcgctgaccagctcgacccagggcgcgcgccaggcggcgagcagcagcaccggcgcatagatggcccagcccagttccaggctttccgccgacagcaactcggcagcgatcacggctgcagttgttccagggcgatgcgcagggccaccggcgaatccaactggcgggtttccaacacgcggcgctgctccagcctgacccagagcaccttgccctcgtccgaggcatag

SEQ ID NO: 9862 - DNA, 615 bp, Pseudomonas aeruginosa
ccctttgggcgttccgccagcgccgccttgaccagcttcgagccgcccatgtcccgcgccaccagcaggacccgggtggagtcgtccagcgagtgcgccttttcgaactggtcctgcaacgtccagggttccagggtggagcccttctccagggccagtgccaggccgggcagcagcatggccagcagaacccaatgcaatcgtttcacgcgtgtccctcccgagtggaaaatacctggatgtccttgcgccgctcccagtccgactgggctcgccagaatgcctgggcctcctcggcggcatccaggacgaagacatgggatttgccgatcccctccctcgccaggcgtgccaacacctcgtcgagcatccgccgcgccagccccagccctcgataaccgggatcgaccaccaggtgctggaggtaaccacggcgaccgtcatgcccggccatcaggcaggcgatcacctccccttcggtttcgaccagcaggctcagcccggggttgcgttgaaggtaggcgaggaagaagggataggcgtcctccgcacggaggcggatacctggcgttcgcgaccatagcgcgaagagtgccgggtgatcggcggcgatga

SEQ ID NO: 9863 - DNA, 687 bp, Pseudomonas aeruginosa
cgagcgcggcatcgaccacggcgaactggacctgctggccttcgtcaacctgaagcgcgcggtgcccgatttcaatacgcccttcccgccgcccaccgaatacctgcgccaaggctggcgctctctgtcgatggtcggtccgacctttgcccgggtgctcttcgctcactccggcgcccccgaattcctgcgcgccaacctcggccgcagcatcctgttcgacgccggggtaggcctgtgagcgaagggcgggtgaagtggatcggcgtgcgctccggcagccgcgcgccgatccaggaactggaggcggtggaggcacggcgcggcctgggactgacaggcgaccacccgcacccgccgcgccaggtcaccctggtgcagtgggaacacatcgaggccctcggtaccctgctgggcaggccgctgttgcccaacgagatgcgccgcaacatcgccgtcgccggcatcaacctgctcagcctgaaggaccgtcgcttccgcctcggcggcgcgctgctggaaaccactggctggtaccaaccctgcggacgcctggaaaagcacatcgaccaccgcacactgaagagcgtgcgcgaacagggcggcatcaccgcgcgggtgatcggcagcggagtgatccgcctcgacgatccgctggtgatcgagccccctgtctgtctagaatga

SEQ ID NO: 9864 - DNA, 339 bp, Pseudomonas aeruginosa
ccgacatcgaaaacggaggcctgccatgtccagccgactgagccccgaagaccagcagaaggtcgagcagtacctcgcctcgccgctgcaccaggtcgagcgtgcgccgttccgcccgtggttcctgatgttcgtcctgctcgccgtggtcatcggcctgggcctgctcagccgcctcctcagctacctggcctgagtcgtccggtcgagccacgctcccgacgaccgcctcacggaattcccactatgagatatccacatgtcccatcgcatcgtgatcgtcggcggcggcgccggcgggctggagctcgccacccgtctcggccgcaccctgggtaa

SEQ ID NO: 9865 - DNA, 612 bp, Pseudomonas aeruginosa
attggttcccgagcgcgacatcgcctacgacaccctggtgatcgctgtcggcagcaccaccaacgacttcggcaccgagggcgctgcggaacattgcattttcctcgatacccgcgcccaggccgaacgcttccaccgacaactactcggccagtacctgcgtgcgcataccgggcacgacgcgaacaacaacgcagtgagtatcgccatcatcggcgccggcgccaccggcgtcgaactggctgcggaactgcaccacgccgcgcagatgctggccgcctatgggctcgaccggatccgcccggaagacctgcacatcagcctggtcgaagccggcccgcgggtgctgccggcgctgcccgagcgtatcagtcagccggtacaccagaccctgagcaagctcggcgtacgggtgatgaccggctccgcggtgagcaaggtagatacggacggcctctggaccggcgacggcgagttcgtcccggcgacgctcaaggtctgggcggcgggcatccgggctccggccttcctcaaggaactcgacggcctggaaagcaaccgtatcaaccaactggtggtccgcccgaccctgcagaccacccgcgacgatga

SEQ ID NO: 9866 - DNA, 2061 bp, Pseudomonas aeruginosa
ccgccacggtcgcgatacggaatcgcgctcagccgctacttccgccccactgtttccgccgcttccgcagccgagcccgttatcaccggagttttttcctacagcagtcctcccagtcccctacgaaaaccaagaagttctaccggccaacgccagaaaactacgattgtcgccgtttcagcctcgccccaggctatcgcccactcgattctccgccttgaaaccgatcgttctgcgacatgcctgcggatatcggtttcttttccctgcaagaaccgcgctccgggccgattgaccatgcatccagcttttccgcgtaaccaggctagcctttctttcccgccgccctccccaaagccttccggcagttccacttcgatcgttccatccctcagggccggaccgctgctccgtacgggcctcatgggaatggccatgctgtcgtccggccttgccagtgccgccccggatgcggggcaggcgctgcgtgacgtggaaagccgacgcctgaacctgcccgcgccggtggaactggacgccgagcgccccagccccgaggacggcgtatcacgggctgccgaagagggcggcccgacggtgctggtcaagcgcttccaactcagcggcaacaggcagttcgacgatcgacgcctgctggcgctcctgcacgacctgccgggccaggaactcaatctgagccaattgcacgccgccgccgcccgcatcggcgatttctatcgggaaaagggatatgtgctggcgcgcgccttcctcccggcacaggaaatccaggatggaacggtacgcatcgaagtgctcgaggggcgctacggcaggatcgaactgcacaacacgtcccgaacgctggaccgcgttctactccgccccttgagcgcactcgaacgagataccgcggtccagggctccgagctggagcgtgcgcttctgctcctgagcgacattcccggcctccaggccaaaggcaccctgctgccgggccaggcgcagggaaccacggacttgcgcgtcgaggcccgccccggcccgctggtcggcggcaggctggaggcagacaactatggcggccgctacatgggggaatatcgcctgggaaccaccctcgacttcaacagcccgctgcgactgggcgaccaggcgagactgagcctgctgggcagcgatcggcaccaacgctactaccgtgcagcctatcaactgccccttggttcccgaggcacgcgcatcggactggcccacgccgagacgacctatcgactggtacgcgacttctcgcgcctggacgcccatggccgggccattaccgacagtctgttcgtcagccagcccctgctgcgtagccgcagcttaagcctgtccacccagttgcaatatgaaaacaagcgacttcgcgatgaccaggagcgtaccgggaggcatagccgcaaggagatccgcctgtggaccgccagcatcagcggaaacgcccaggaccgcttgttcggcggtggacagagcggcttctcgctggcctatgcccacggccagctcgccatcgactccggcgaagagcggctgctggaccgctacaccatcggtaccgccggcagcttcgacaagatcatgctcaacgccgtacgcctgcagcacctgggcgaccgcctgcagttgttcgcccaactcaacgcccagtggagcggcggcaacctcgacagcgcggaacagttcgacatgggcggcccctacggcgttcgggcgttccccctgggcagctacaagggctacggcgacgaaggctggcaagccagtgcggagctgcgctacagcctggctccgggctggcagctgagttcgttcgtcgaccagggcgcggtgaaattcctcaagcaccccaacaccacggaaggcaatcgcaaccgcatggccgccgtcggcagcggcgcaacctggtacggaacggatcaccaggtcagcctgaccgccgcctggcccctgagccaggaaaacaacatcgagcccgagcgcactccccggctgtggttgcaagcgacccgctacttctga

SEQ ID NO: 9867 - DNA, 4248 bp, Pseudomonas aeruginosa
gcaagctcccgcccgccatgccggcgggccccactgaaaggaaaagccatgaacaagagctatacgctggtctggaaccaggccacaggctgttggaacgtcgcaagcgaaggtacccgtcggcgcagcaagagcggacgcggcaaggcgctcgtagtcgccggagcgtcactgctcggcctgttctgccaggcccccgccttcgccctgcccagcggcgccacggtcgtttcaggcgatgccggattccagacatccaccgatggccggcatatggtcatcgaccagcagagccacaagctgatcaccaattggaacgagttcagcgtccgtgccgatgagcgggtcagcttccaccagccgggccaggacgccgtcgccctgaaccgggtgatcggccgcaacggcagcgatatccaggggcggatagatgccaacggcaaggtcttcctggtcaatcccaacggcgtggtcttcggcaagtccgcccaggtcaatgtaggcggcctggtggcttccaccctggacctggccgacagggacttcctcgccggcaactaccagttctccggcgactccggcgcaaccgtaagcaatgccggcagcctgcaagccagcgaaggcggcagcatcgccctgctgggcgcccgggtcagcaacgacggcgtgatccaggcgcaactcggcgacgtggccctgggcgcaggccagggcatcaacctcaatttcgacggcgacggcctgctcaacctgcaggtggacaagggctcggtcgacgctctcgcacacaacggcggcctcatccgcgccgatggcggccaggtgctgatgagcgcccgcagcgccgacagcctgctcaagaccgtcgtcaacaaccagggcactctcgaggccaggacgctacgcagcgcggaaggacgcatcgtcctcgacggcggcgaacaggggaccgtgcgggtggccggcaagcaggacgccagcgccatcggcggaggcaatggcggcctggtgctgaaccagggcgcgaacgtcgagatacagcgaaccgcgcagctggacacccatgccgaccagggcgcaaccggcacctggaggattctctcgcacgaggtcagcgtagccgctgtcggccaggcaaacgctgccggtgatggttccggccaggtccatgtagcgcagggcccagccggggccaatgcgtccgatagcaacggcgtgaccatcgttcagcagcagccggccgtcgacctcgccgccggtgccaacggtacctccgcagtgcagagccagagcggcgccaacatcggctcgggcgccaatggcatcagcgtcgtgcaaagccagaatggcgccaatatcggcgccggcgcgagtgacatcagcgtcgtgcagagccagaacagccccaatatcggctcgggcgtcaatggcgtgactgtcgtgcagagccagaacggtgccaatatcggttctggcgcaagtggcatcaccgttgtgcaaagccagaatggcgcaaatatcggttcaggcgcgagtggcatcagcgtcgtgcagagccagagcggccccagcatcggctcgggcgtcaatggcgtcacaatcgtgcagagccagagcggtgccaacatcggccccggcgtcagcggaatcgatgtcgtccagacccagactctcaccaacctgagcccaggcgccaatggctccagcatcgtccaggtccagacgctacccgatatcgccgccgacgccggcaatgtgcatgtcgtgcaggtccagaccggcggtaacaaggtcttcggcaactccgccaccaacgtcaggtcacgtaccgttcaggcccggagtagcgagaatgtcggttccggcctggcgaatccaagcagcgcgggaaaaggcccgacgttgcatgccgataccctggcccgcaacctttccacaagcaacgtcgaagtggtcgctacccggggcaacgcgcatgtcggcgcgccgctgtcctgggacagcagcaacggcctgacgctaaccgccgagcgcggggacctcaggatcaatggcgcactgacggcccagggggaaaacgccagccttactctcaatgccgggcagcgccctctccgtatcgacgacagcctctctctcaccggccagggagcccgggtcgaattcaattcggacaagggttatgccctggccgaaggcgcccggatcaccctgtccggaaagaacgcaggattccgcgccaatgggcgggactacagcgtgatccaggacctgcagcagttgcgcggcatcgatagggacctgggcggcagctatgtcctcggcaatcgaatcgcaggcggccattccagcttcctgtcgataggcaacgccagcgccttcggcggtaccttcgacggcttgggcaacaccatcgataatctcgccgtctacggcaccggcgcctactccggcctgttcagcgtcaaccggggcaccctccgcaacctgaacctggaacgcatttccgccgatggagcacaggccacccactacaacgtccaggtcggtagcctggccgccgtcaacctcggtcgcatcgacaatgtgaacgccagcgacatccgtatcgccgcggcctcgcagctgaacagcctcggcgggctggtcgcgctgaacctgggcagcatcgacaacgccagcgccagcggcacgctggtcggcaaccgccaaacctatgctctgggcggactcgcagccgaaaacatcagcacagccaggggcgtggccagcatctccaacagccgggccgattttgccatctccggccagttgaaggaccatgccagccactacggcgcggggggcctggtaggcaggaaccgcggcggcctcatccgcagcagcggcagtcagggaacgctgtcgctgagcggtcacgggatgaacctgggaggactggtcggatacagctccgccggcggactggcggacgtttccgcctccgtcgacgtctcaggcaacggacagcgcggcctgtacggtgggctcatcggcctcaacgtaaacagtggtatcgcccacgccacggccagcggcaaggtccggggcacagacgcggaagcactgggcgggctgatcggccggaacctgaacgcggccatcaacaacgccagcgcccatggcgatgtcagcctgcaagccggtcgctacctgggaggcctgatcggccacaaccaggcaggcaacctggccaacgtcagtgccagcggcaacctgagtggtgggtcgctgctccaggccggcggcctgatcggtctcaacgccaatgcctcgctggtcaatgcctccgccaagggcaatgtcgctacccgcggagcagaagcggttggcggtctgctcggagaaaacctgtacggctccgtcatcaacggttccgccagtggcgaagtcaccgacggcagcggcaaaaccctgggtggcctgatagggtccaacctcggcggcaatcattccaacctgaaggcctccgggtgggtaaacgcaggggcgaacagtgacgtgggagggctgatcggccacaaccggggcggcaaccacagcaccctggcggcatccggcaatgtcaccgggggcaagggcagtcgcgtcggcggactcgtcggctataacgatgccgcctctctgacgaacgtctcggcttcgggcaacgtcagcgccagtggttccagggccatcggcgggttgatcggcagtgacctgcgaggttcgctgatgctcgccagcagtcatggaatcgtgaacgacaagaccggccacaacctgggagggttggtcggccgcggtgaaaacacctcgatccgctccgccaaggccagcggtgcggtgagcggaggcgccgggatcagggccggcggactggtcggctccctggagggctggcaggctctcatcctgggggcctcggccggcggcgatgtgacggcgggctacgacagctatattggcgggctggtgggcttcagcaccgccaccatcagcggcgcttccgcttccggcaaggtcggaggctcgggtctgctgggcggcctggtcgcctggaaccaggggaatgtcatgggttcttcggccagcggcaggctggagccacaaatccccaaccagatccatggcggactgatcggcatcaattttggctggcagtcctggaactcggtatacggggctgcggcgaccgttccaatgataggtcgccactacaacctgtga

SEQ ID NO: 9868 - DNA, 939 bp, Pseudomonas aeruginosa
gaagggtttccactcccgttacaacgagtctgtttagcagcctctaatgaccccacattagaggctgtagacatgaatgcgaaagcgacttcggttgtatccaccaagggtggtgtagggaaatccaccaccgccgccaacctcggtgcattttgcgccgatgctggcctgaagaccctcctcatcgacctggaccccgtccagccctccctatcttcgtactacgagctacctgaagtcgcccagggcggcatctacgacctgctcgccgccaacataactgacccagcgaggatcatctccaggacgattatccccaacctggacgtcgtgatttccaacgaccagaacaaccagctcaacaacctactgctccaggcgcccgatggccggctccggctggcaaacctcatgccgtccctgaaacagggctacgacctggtgctgatcgacacccaaggtgcgcgctccgctttactcgaaatggtcgtgctcgcatcggatctggttgtttcccccctgcagcccaacatgctcactgcccgcgagttcaaccgcggcaccatgcaaatgctcgatggactgcgcccctacgagcgcctcggcatgcggatccccaaggttcagatcgtcatcaactgcctggaccagaccaatgactcccgggcgattcacgagaatgtgcgtgccatcttcgatgagcatcaggatatttctgtactcgaaacgactgtcccggatgccgtcgtgtttcgcaatgcagcatcgcgcgggctaccagcgcaccgcctcgaaacgcggcaaccctcgaatcgcacatcagcgcccgcgctggaaatcatccgtaacctggccatcgaggtctttcccgagtggactgaccgtttcctcgcgctgacgccggaggcggtagcagcactggtcaagggagggcgctga

SEQ ID NO: 9869 - DNA, 588 bp, Pseudomonas aeruginosa
ctgcaccgcacagatcgctctgaccagcgaggagcaggaaacccttcagctctggacagacgctctgcaatcggctccggagggcctcatatgaacctccagaaccgcaacaacctcatcctgagcctgatcgccgagacccagttcgacgcctacgtgcaaggctacatggccaaagcaggcgctgccgccggtgcttccgacaatctgctggtcgaggctgaaggtgctgcgatgctgcagggccttgtcgctccggttcgcgctcagcagcgtgcctgtggacagcccctgcagaacgccctgctccaaatcgcccacgacctactgttgcagacgaagtcgcaactggccatcgcggccaatgccagctcgatccacgtgatccagcgggacatgaacagggctatctggaatatcgcgactgccatcgatcacctggccgagttcgcccaaccctcccaggacaccgtgaaggtcatcgagcggctgatgctcttcgtcggcagctcgcctagcccggaaggccagcaactggccgcagaggcaagtgcagtgcttggcatgagcgagggggggctggcatga

SEQ ID NO: 9870 - DNA, 663 bp, Pseudomonas aeruginosa
attgtgaccagcaccacccacaccacttggtgcgccaggttcttcccgccgagaacaccccagaaggagaagccgaggtgttggtctgcccctgctgcgggagctacgacgtccatcagttggaggctgtctttgatgaacactgaagcccgctttccgagtatccacgcctcggccgcgttcaccgactcggcggtggttcatgccaatcaagttggggtcaatccgatcgaactggacgccctcagccaagtgatctcgcgcctttcgcgggacgagagcacggtcgcacccagttcgatggagcgagagcttcgtgagctggaggaactggggtacatcgaaatctcgaccacccaggccgggaccctggtggtcactacgcgcgctccggggcaactgctttcggcttacttctggtcggtatggatcccgcgacacctgttcagttgctcgctgaaagtgagcctggtgccgcacctctgctgcggcactcaggactcccagcacctcaccgccgtattccgcattgcaggcagcaaggacgccgcgcgtgagttcctgcatcagttggccaacaactatcccgggcatgagccggagttgcccgaactggtggccgttcagatcggtgatgcactcagtaaggaggccgaatcatga

SEQ ID NO: 9871 - DNA, 246 bp, Pseudomonas aeruginosa
cgcgcgatgcctgacgtcaccgcttaccggccggttgctgacgagctcgctcaactgcgcacagaggtccgcatgctgcgttccgcgcatgacgacctggcctgcagccgacagaacgatcgtcgctgccttcaggaactggtgaaacgcctcctgactgctgctgccaccgacagccttccccgctccctggcagagatggagacctggctgcagctcaacagcgaggagaccactgatgcgtag

SEQ ID NO: 9872 - DNA, 1248 bp, Pseudomonas aeruginosa
tttccttcgcggcgcccgggaaagcgtccgccggctggtggccttcgctcaagccgaaggctggagcgtcgaccgctccgccggcggccacttgaagctcagcaagatcggctgcgcctcgatcttcatctcttccacgccaagcgacgcacgcggcgagctcaatgcccgcgccctgctccgtcgagccgacaggcagcgttccctgaaccaggagtctttctgatgcctatcaaacacgccatcgtccacctgatcgagaagaagcccgacggcaccccggccgtgctccacgcgcgcgacgccgagctgggcgactcccaggccatcgagaacctgctggccgacctcaacgaaagctacaacgccaagaacaaggcctggggcttcttccagggcgagtccggggcctacccgttcagcggctggctcggtgaatacctggagggcgaccgcgacttcgtcggcttcagccgcgaagcggtcgagcacctgcagaagctgatggaggagtccaatctctccaccggcggccacgtcctgttcgcccactaccagcaaggcatgaccgactacctggcgatcgccctgctgcaccacagcgaaggcgtggcggtgaacgagtcgctggaggtcaccccgtcgcgccacctggacctcggccagttgcacctggccgcgcggatcaacatttccgaatggcgcaacaacaagcagtcgaagcagtacatctcgttcatcaagggcaagggcgggaagaaggtctccgactatttccgcgacttcatcggctgccaggaaggggtggattcgccgagcgagacgcgcaccctgctgaaagccttcagcgatttcgtggaaagcgaggacatggccgaggaacaggcccgcgagaagaccgagacgctggtcgactacgccacctcccaggcgcgcatcggcgagccgatgaccctcgacgcgctttcggaactgatggacgaccagcaaccgcgggcgttctacgactacatccgtaacaaggactacggcctgtcgccggaaatcccggcggacaagcgcaccctcaaccagttccgccgcttcaccggccgcgccgaaggcctgtcgatcagcttcgaggcgcacctgctgggctccaggatcgagtacgacgaggagcgcgacacactccggatcagcagcctccccactcagcttcgcgaccagctcaagcgccgcaaggcggagcaggagagcacgtcatga

SEQ ID NO: 9873 - DNA, 1896 bp, Pseudomonas aeruginosa
ccaccgctcggccaacagcgagatcgtctaccggctggagcgcagcaacgcgctcgaagaagaactcgctcgagcgaaccgaatggtcgacgagctcttcgccaagaaccagcgtctgcaggcagagctggctgcggcgaacacgcctcaggtggcggaggcatgagtatggccaagatcaacccgcaagatctgaaagaccggctacttgcccctggtttcaccgcgccgcccgttctggaacagttgtcggacccgatcagcgacacgcccatggtgctgacactcgaccaggtcctcccctggcacgacaacccccggaccactcgaaacccgaaatacgatgagttgaaagaatcgatccggcatcgaggcctcgatacgccgccaccagtgactcgacgccctggggaagacaaataccgcattcgcaacggcggaaacactcgcctggaaattctcaacgagctctacaaagaaaccggcgacgaacgttacttccgcttcaactgcctgttcaggccctgggacaagcagcgcggcgaaatcatcgcgctgactggtcacctggctgagaacgatctgaagggtgacctcaagttcatcgagcgagccgtgggcattcagaaagcgaaagcctggtatgaggaggagaaaggcgaaccggtcggcatccgcgagctgtcacggaagctcaccgatgacggctatcctgtttcacattcacacatcagcaagatgctggatgccgttgagatactgctgccagccatccctgtgatgctgtattcagggctcggtaaaccgcaaatcgaaaaactcctgtcactcagaaagtcggcatcctcctgctgggcacgtctatacgccggtgaagggattgactttgaaatgctgttccaggacacgctggcaatcttcgacagtagccctgacgagttcatattcgaccgcttccaggacgagctcatcgaccagatgaagcggcccctgggcctgcgttatgaccagatcctgctcgagatcaccaacggccagcaggaacagcgccggggcactctggtcgatctgcccgcacctgccgcaccacctgaaatcccaccagtagggcaggaaagtcctgccgcgtcgactactggacaagcacaatcacagagccccgctgccggcctccaaacgtccaagaccaatagcctcccgggtaatccctctaccccgccaactccgccgctacctgtacaacagcagcaactgaccgatgaggagcgtgcagcgctcttggcaggccatatcgtgagtccggtatcgaccaagatccagcagactcgccaacgtctggccgctctcgagggtgaacatctacctgtcttcgatgaaacagccctgcaggcaatcccagtgcaagtcggcggtctgcacccgatcaccgacctctggtacatcgagcggtcgatcgatacccccgagatcctgcgacagcacatcgctgacctggctgaagagatcgctctgcacgtcggcgcccctggcgaaatcgtcaggatccagggcggtgtgggttacacgtatcgcgagcccaatgaagaccctgagattactgattcagcgctgcacctcatgacgctgcttcaagcgctcagcggccaggtccaagtcgtcctgaactcacacgaccagcagacctgccgcgatgcactgggtgaattccagttctcagctggcctcgctcagttgctgctgggccaacccaccacaagcgatcagccatccaaccaggcaggccgtctcaatgacgaagccctggtgaaactgttccggatcattcgtcttgcccgacgcctggttgaccttgagctgccgccggccaccttcgagcaagcagctaccgaccagtga

SEQ ID NO: 9874 - DNA, 783 bp, Pseudomonas aeruginosa
tttcgcacgatttggggagagatcgacatgtcgaagtcgttgatcaatgaagcggtcctgactcaagtgctcaaccacctgcgcaacggccagctcaggcgttgtgccgagatggggctgcggccggagattctggctcagctccaacagcctgccgtcatgagcatcctgaccaataccccggtttcttgggtagacgtcagagtgaacatcgacgtcatggagaaaatcctggccacagccgagcgcagcgcgcaggaagagctgcagatcgaacgcgcactgaagctgggagccaccacaacgatgattcagagctttttcggtctgtcgccggaggacaccgccaccaagcgcttgatcctggagatccacccgcgccgcggtcgctggcggcaacttgacgaacagaccgaacgccagatttggttccgctgggagcacctgatgcaggaaaaccaggtccgcctcgaggacagcatggagttgctggacatcgcgatgatcctcaccgaggaagtcaacgccggagtcgaacaagacagtccagagttcatcagcctcgccatcgtttggtctctcatccagagctggttgaaagacagcctctaccaaccaaacaggaaagagcaggccaagcccgccaccctttacctggccaacgtcagcgctcacctcccctcgcctacggctcacccgccacagagcccccgcttggagattgagtctgcgcagcagcaactcctcaacctggttcagtccgaaggcgatacgacaccatga

SEQ ID NO: 9875 - DNA, 480 bp, Pseudomonas aeruginosa
tgcggccccgcatcactctgccaggtcctgacctcggcaccggtggcgaactgggtgttgccactggcaacactctgccaaggatcgaactcggtgccgtcgacgagctgggtggtgccactggcaccacttcaccaggatccagcctcggcgccgtcgaggagttgggtgattccactggaatcaccccaccagggaccgaccccagcgccggcggcgagctgggtgttgccactggcaacactctgccaaggatcgacctcggcgccgtcgacgagttgggtgattccactggaatcaccccaccagggaccgaccccagcgccggcggcgagctgggtgttgccactggcaacactctgccaaggatcgacctcggcgccgtcgacgagttgggtggtgccactggcaccacttcaccaggaactgacttcggcgccggtggcgagttgggtggttccactggaaccactccactag

SEQ ID NO: 9876 - DNA, 342 bp, Pseudomonas aeruginosa
gaactgacttcggcgccggcggcgagttgggtggttccactggaatcaccccaccagggaccgaccccagcgccggcggcgagctgggtgttgccactggcaacactctgccaaggatcgacctcggcgccgtcgacgagttgggtgattccactggaatcaccccaccagggaccgaccccagcgccggcggcgagctgggtgttgccactggcaacactctgccaaggatcgacctcggcgccgtcgacgagttgggtggtgccactggcaccacttcaccaggaactgacttcggcgccggtggcgagttgggtggttccactggaaccactccactag

SEQ ID NO: 9877 - DNA, 285 bp, Pseudomonas aeruginosa
gaactgacttcggcgccggcggcgagttgggtggttccactggaaccactccaccaggaactgacttcggcgccggcggcgagttgggtggttccactggaatcaccccaccagggaccgaccccagcgccggcggcgagctgggtgttgccactggcaacactccgccaggaccaggcctcggcgccgtcgacgagctgggtggtgccactggcaccacttcaccaggaaccgacctccgcgccggtggcgagttgggtggttccactggaaccactccactag

SEQ ID NO: 9878 - DNA, 543 bp, Pseudomonas aeruginosa
gaactgacttcggcgccggcggcgagttgggtggttccactggaaccactccaccaggaactgacttcggcgccggcggcgagttgggtggttccactggaatcaccccaccagggaccgaccccagcgccggcggcgagctgggtgttgccactggcaacactccgccaggaccaggcctcggcgccgtcgacgagctgggtggtgccactggcaccacttcaccaggaaccgacctccgcgccggtggcgagttgggtggttccactggaaccacttcaccaggaactgacttcggcgccggtggcggctatcaacttctcccacccaataggaaccgaaaagatgtgcgactcaatcgtgtatgcccctatggacgaactcgaattcgagcggctgctagggctggcaaccctattcaacgacaacgatgaatggcctatcgactttacggagctgcaggaactgagcgagctgctcggcaaactcaaaagttgcgtcgacgtagcgatagacaacgcccctgaggcggccaagagctga

SEQ ID NO: 9879 - DNA, 885 bp, Pseudomonas aeruginosa
aggaggccaacctccatgagccgcaggcgggatgatgatgaacccgcactgccagcggaaataccccagcggcgaaccatgtatttcctactgcgcgctcctaccccgatcagcacgatgtggccgaaccccttccctataaaggaacactgcaccatggctgaaacccatcggcttcagatcggctctctccgcagcgatgtcgccctgacgcttcacacctatcacgccgcccgcatctggacaggccggcagaagtcggatgccaagcacagcatcctcggcctctccggcttctgcgcctacgtgaatcgcatgcaccgcggggcagcacaggacgatccgtactccgactggtggctggttcagatcgaagagaaagtcgagagctgccaagccgcgctcaaggccatcgaccagcgactggatgacgtcatggccaagctgcccgcgaccctcgatatctccgagaacctgtcagtcacaccggtcaaggtcccattgttcatctccaaccctctcggcttcaaggcggtctatctcctgaccaactacgacgaactcgcccgtcgaatcctgctggcccagcacgtcgggctggtcggtcgccgcgacatggaggtctggctcgacgaaggcgcgtcggtgctgcgcagcctctttggtctggcccagagctaccagttctcgggcgccactcgcgacgacttcgccgcgaacaacgctcgcgccgaagtcgcgcggaagatgtacgagaagttcggcgagatcccgcaggacatcctggagggcacccgacgctcgaacttcgctccgccgatcactcggggccgctctgacggtgatgccgatgatgacgctgaccgtgttgagcttgaggactga

SEQ ID NO: 9880 - DNA, 552 bp, Pseudomonas aeruginosa
actgctcgggtacgtggccagccgcgccactcgctcccccttcaaaccacgctccacccactaacccccgactcaaccgactggagattcatcatggctacccccgtcttctgggaaggcaacatcggctcggcgccggagcaccgcagcttccccaacggcaacaatcccccgcggcagttgctgcgtctcaacgtgatgttcgacaactcgattcccgatggccagggtggctacaaggatcgcggcggcttctggtgcagcgtcgagtggtggcatcaggatgcccagcgtttcgccgaactgttcgcgaaaggtatgcgcgtcaaggtcgaaggccgggcgatcatggaccgctggccggacaaagagtctggcgaagaagtacaggcgctgaaggtcgaagcctcgcgcatttccatccttccgcatcgcctggccgaggtcaccctgttgccgtcgaccaatggccaggcgacccagcatcagcagactcggcaagtctcgcagcaggactacgacagcgccttcgacgacgacatccccatgtag

SEQ ID NO: 9881 - DNA, 2169 bp, Pseudomonas aeruginosa
ccccgtaccggcagactcccctgccggccaggcttaccgctggttcatggaacggattcgctctggagccatagcgacgaacctgaactggcccgacatgaccgtccacatgacacgcttcgccgatggtcgctggaaggcgggcctcgccgaagccacggcgaagtggctgctcactcggttggaaaaccgatgagccgtccacgcctggtcaaccgtacctccgcgactccttcgacgcttctgcagcgggctatcttcgacggctacgacttcggcttgaagatcccctacatcgcaggcagcaaccgcgcgctgctggaactgtccggcttcttcatcagcgcccgggagcatccgttgcaccgctactggcgggtccccaagggcaagttgctgcccgaactggactcgctgtacaaccgactcgccgagctcgctggaggcctccactcacagtcctggcgggacttcagcggcatggtcgaatctgcacaggcctcgcttgaccgacaggccttcacctggggtttgctgctgcgcatcgcgccgctggccgagggcggcgtcttgctgtcaggcgagttccatcccggtgtggtggcggtggctcggcggatgcgcggggtgttcctgcgcccatcgagctcctggcgcatcgacgccacacctgagctgctccgcagcaacctgatcctggagcttggcctcgccgaggaacaattcgagatactggataccgtccaggagctgctcagcgacggtagcttcgcgccggcgaccgagctgcccagcatgagcatcggcggtccacagcaggaaccggcagcgccatccctggaggacgagtcagcttgtgacatctacctcgccgcggtgccagagatcgagcgcaccgagtacagctcggctgatatcgaggcggcgcttcagggctactcgctactggcccaccagcctgccggcatcgctcacttgctgcagagaaccagcgccctgttggccgacgacatgggattgggcaagacccgccaggcggtcatcgccgcttcgatccgagcggcgggcaggccaattctggtcatcaccctggccaccctgttgatcaattggcagcgcgaaatccaggaggtctatccctcggccaccgtggccatccagcaggacaacccagaggcgcagtggatcctggtcaactacgagcagttgagccccttcgtcgccaacgcttcgcgcttcgccgtgatggtcatcgacgaggcgcagcggatgaaggaaccgacggcgcaatgcacgcggcacggtttcgacattgccgcccaagtgccgaaccgctacctgcttaccggcacgccggtgctcaaccgtgaaaccgagctgcacaccctgcttcgcctctcaggccaccccatcggacaactgccgctgaaagagttctgcgaccgcttcgccggcaacccggagttccgccagagtctgcgggcggagctgggtgactggatgctgcgcaggcgcaaggatgtgctgcccagcctcaagggcaagcagcggcagttgctgaaggtggccctctccaccgaggaacggcagcagtacgacgtgctgcgcctcgaggaccgaccgattttcgcgcgactcggcgcgctgcggcgttacctggaaacggtgaaggttcgcgtggcgatggacctgctgagcgagctcgacgccgaggacaaggtgatcctgttctgcgagttcaagccgaccgtggctgcgctgaaggaactctgcgagcaggccgggctcggctgcgtcacgctggtgggcaatgactcgcttaccaagcggcagaaggcgatcgatcgcttccagcaggattccgactgccgggtgttcatctgcaccacggcggccgccgggacgggcaacaacctcactgcggcgaactacgtgtttttcctcggcctgccctggactcccggtcagcaggaacaagccgaagaccgcgcgtaccgcaacggccagctccgcatggtcgtggtgaagatcccactggtcgagggcacgatcgacgagcagctgtggcaactgctcaacgcgaaacgccaggttgcccaggacctcatcgagcccgagcaggtcgacggaaaccgtgcgcttttggccgcaagccttgccgaacgctga

SEQ ID NO: 9882 - DNA, 276 bp, Pseudomonas aeruginosa
cggaccaccgctgtcactgcggtcgtcgatcacattgtggtagacgtaaaccagttgtttatctttgagcctttcacgaccttcgtcgcgcgaccaggcctttacctcatcagctgttacggcgataccttggtactgagcgaggatcttgtctcgctgtatggtgccggcggtggactggccatcgacaaaaactgtatcggcggcactctctcggtattcaagcgtctggtgtgggaggagggaggccatgcccagggtcgtatagctgggtag

SEQ ID NO: 9883 - DNA, 441 bp, Pseudomonas aeruginosa
aacgcccaattggctggacagggttgcctcgctgtagcgtttttcattgatgcgctcgcgcagctcgactgcggcctcgtagcggaaagcatcactgatgatcacggctatacgcttgctacggtgtttctcgaactgcggctgtacccagcgttcgtagaagttctgctggttgggcacaccggcgatcttccaatgtgtcaggcgctgttcggcttctacgcagtcgccccagttgcggcccagttggtcgaggtaccagtaggcatagcactgctcaacttcttcatcgagcttcttcagcagttccacatgagcacgctgcgacgcagccacatagcgtcgataggcgctgtcgaagcggtacagctcgccctcgtaggccttgtacagcgcctccgtgccggaatagtggaagccggcaccaaactgcaggcgtag

SEQ ID NO: 9884 - DNA, 234 bp, Pseudomonas aeruginosa
taccgcaggccagtgcaacctgaacggcgactttgggtggactcgccaaccacggtgcgcgtgatgttgctcgatgaggccactggcgaatccctgctgctgaccggcctgccgtgccgcatctcgctgtcgcgcgctgaaatcgctggcttgatcgcctccatcgatgccgatgccgccgcgcttcggcccgctctgctgaacaagctcaagcgtccgcggctactcggctga

SEQ ID NO: 9885 - DNA, 318 bp, Pseudomonas aeruginosa
tgctggaagaccatggcgcggtcgacgccggggccgtcgatgggcctgccgtcgagcaggatctcgccgcgactcagcgtctccaggccggcgatgatgcgcagcagggtggacttgccgcagcccgaggcgccgacgaaggtgacgaactcgttgggctggatgtccaggtcgatcgactgcagcgcctgcacctcacggcgctcgctgacgaaggtcttgccgacctggtgtacacgaatcttggcatcggacatggtcatttcctcatccagggaaaggcgcggcggtgcaaccagcggaaggcctgatcggtga

SEQ ID NO: 9886 - DNA, 591 bp, Pseudomonas aeruginosa
tgctccgcaaatgacgtgcttcgggcgcgatcaggctggggggtcatggcgatccctccagttggctcagcagccgatggctgtcgatcacgctgccgaacaggccgccttccacctcgatcatcgccagcgcagccgcatgcagttgcgggtcggccgaggcgcaggcgtcgcggacggtcaggcagtcgaagccaaggtcgatggcctggcgcagcgtcgaggccacgcagacctcggtggtcacgccggtcaggatcagccgctcgatgccgcggcggcgcaggatcagttcgagatcggtatgggcgaaggcgctgtagcccggcttgtcgatcaccggctcgccggcgcgcggttgcagctcgtcgatcaggtcatggccgaattcgccgcgcaccagcaggcggccgagggggccagggctgccgatggcagcgccggtggcctgggcgcggcggcgtttgggctcgggcaggtcggaaagatccggtcgatggccttcacgggtgtgcaccaccagcatgcccacgccgcgcgcgcaatccagcagcgcctggatcgccgcgatcggtgcgcgcaggcggctga

SEQ ID NO: 9887 - DNA, 2022 bp, Pseudomonas aeruginosa
tccagtgccttgtgcatgtcacaccgccgtcaggaacgagacgcccacggcgccgtagaagttgtcggccttgttcggcccttcgctgaccaccccgtagtcatcgtccagcacgcgacgtacgcggtagcggtggaagctgccgagcagcttgcgcatcgggatgacctggttgtaggtgctgccgtacagctcggcgtgcagcttgggcaggcgataccagggcgccaccggcttctcgtggtgggcgttgtggaaggaaaagttgagcagcagcaggttcagcgccggccagcgctcggaaaccacgttgctgtaggtgttctgctgctcgtagctgcggtcgcggcgcttgtcctccggcagcttgccaccgtcctccagcacggcgaaggcctcgtaggtgtgctgataggcatcggcgaaacgcagcacgctgagcatgatcatccaggccacggcgtagagcagcaaggccttcagcgagagcaccgcgagcccggcaaagagcagtgtgcgaatggccagcaccgcggcgaccttgccgcgccgggcgcggtgcttgtcgttgtcggtgatgaagggaagggcgatcacatagaaatgcatgatcagctccaccgccggcacataggcccattccagcgccagcaccagcttctggaaccacagcgggcgtgccttgaggaaggccttgctgtcgaaggtgatcacgtcggcgcggtcgacgtggtggcgcatgtgcttcttgcgcaggtcctggaactcggcgtagcagctgccgcacagccagctgcagacattgccggcccattcgttgtgcttgggcacgctgaagatggcgccgtgggcgaattcgtggatcaggtaggcggcgatgatcatgccgtgggccagcagcagcgtgcccagcgcgttcagccagccgttaccggcgaacagcagagccaggccgccgccgtaggcgagcgcggtatagaggatcgccagcgtgttgggcaggcggccatcggcgtaacggtacagaggtttggcagtcatggtttttctccagcacaggcgggccgcggcccgcccggcgtcggcttactgggcgagcgcttcggtgaactgggcgtcgtaggtctggctgaaatccgggatggtcgggatctgcccgttgtccttgagcagcttggcgatgatcgcgccgctgccatggaaggaatgggtgtcgtcgcctggggtgaagctcttgcccatctccgcaagggggatgttgtaggcgccggccatctgctcgacggcttcctcggcgctgacgccgagcacgtcgccgatgatcttcgccgactcctcagggtgcgcctgcatgtaggccaggccgtcgagatagccctggatcatcgccttgatggcggcaggcttcttggcgatcaccgcctcgtcgaagaccagcacatcggtgatcagccccggtgcgtccttggacgaatagaccaccttgaatttgtcgccgccgcccatggagaggatctgcgagacgttgggctcgtaggtcacgccgaccggcaggttgcccgaggccatggcgccggggatgccttccggagtcatgttgacggcgttgatgtccttgtcgctcatgccgttctgctgcagcgcgtaggccagcaggaagtcggagggcgacagcgggttgaagccgaccttcttgcccttgaagtcggcgatggactggatcgacgcgtcggcaacgatggcgtcaccgccgttggagaagtcgatgggcatcaccacgcggtgcttcaagcccttggcgaccgaggccactacctgatcgtaggtgagcatgccaccgtccagcgcgcggctcaccatggcggtggggatcagcgccgggtcgttgaagaactgcaggtccacgtccaggccgtggggcttgaacaggtcgagcttgtcggcgacgtagaaggggccatagccggcccagaccacggtgccgatcttcagcttctcggcggcctggctggccagcggtga

SEQ ID NO: 9888 - DNA, 228 bp, Pseudomonas aeruginosa
ctggcttcggccgctgtggccgtgaagaaggtcacgcagtccagcgtacggcaggccgggacaacgccggcggtggagatcagccctttgctcgctttcaggcccaccaggttgttcagcgccgccggcacccggccggaaccggcggtatcggtgcccagcgcgaaggaacagagcccgagcgcaacggctagcgaggagccagcgctggagccgccggaggggtag

SEQ ID NO: 9889 - DNA, 1332 bp, Pseudomonas aeruginosa
cggccctggccgtacttctccatgacttcatcggcgttcagcacgccgccgaagctgtcgtgccagccgcaggtgtcggccgtgatggcggcgagtacgcgccccatgtccgagtacaggcaatgcccggcggtgagcttggcggtgtgctggcccttgagggtatccggcaggttcagccgctcgctcttctcctgggcgttgagcagcatcaggctgacgttggcgccgccttcgagatcggtcagacgcagcagttggccccgcttgaggatgaaggaggtgtggccgccgccaggaacggtttcctcgtacagcgtggggcggatcgcgagtgaagcactcatgtcaggctccttgataggcagtgcgaaaagagtcggcgagggcggtcggcatgcctgcggacgcgccgggagcatggcggccctcgtgcagcggaatgtcgtaggtcacccgtgcgccataggcacccggggcgtggggatcgatgcgcggtttgtcgaagaccaggatgcggctgccgagggtgaagccttccgagaggtcatgggtgaccatgaacaccgtcagccgggtttcccgccacagctccagcagcagctcatgcatgtccttgcgaatgccggggtcgagggcgccgaagggctcgtccagcaacagcacgcggggcttcatcaccagcgcctgggcgatggccagtcgctgttgcatgccgccggagagctgtgccgggtacttgtccagcgcatggccgaggccgaccttgtgcagcatctgcgcagcctgctcacgggcatcgcgcttgcggcgtccgagcagacgacccagcagcggggcgcgcgggagttccaggccgagggcgacgttgtccagcaccgtcaggtgcggaaataccgagtagcgctgaaagaccacgccgcgactggcgtccggttcgtctgccaatggctggccatccagcaggatctcgccacggctgggcgcttcctggccgagcagcagccgcaggaaggtcgacttgccgcaaccggaggcaccgaccagggtgcagaactcaccttcggcaatcttcaggttcaggcgctccagcaccacctggtcgccatactgctgccagacattcctgacctggatgaacggtctggcatcgcctgcgctgcggcttatagatgcgtcgtgctccaggtgggcgacggatccgcccgcaacggctgcgctctttctgtcgctcatgccttggctccttcataccaggggaacagcagctgggtcaggcgccgcagcgagaaatccatggcccacgccagcagggtgatccaggcgacgtag

SEQ ID NO: 9890 - DNA, 1785 bp, Pseudomonas aeruginosa
cgctgccgaacggcccttcctggtgaacgccagccggccgcagtccctgatcatcatcaaggagcgcaagaactgatgcgtgcccccctgaagaacctcttgccttgcctcctgatccccgcgctggccagttgttcggtcacacgggtgaacgagtcggcggatcgtgtcgaagctacggcagattccgcgtcgacgatcgcagcacagatgcgcaacacccgaccggatcgccgcgatacggtggtgttctccgacaaaccctgggtcagcacgaaacccctgagcgtttcgcacactttgtccagtgactgcatcgtgacgtggcgccctgcaggcgcagcgtcgctgcaggaggccgcccaggaagtcatcaaccaatgccacctggcggtcagtatcacgcccgacgcgctgaacccggccgcttttgccctgcaacctcagcagcgcgcgagcaacgccccgccgcccatccaaggcggccaggacatggccaccatgctgtttcctgcctccgtcgccaacggcatgtccctaggtgccggcggcagcatcgggtcgagcttcgggtcctacggcccgcggtctctgtacaacatcaaatggaacggcaaggtcagcgggttcctcgatctcatcgccgcccgcgccggcgtgtcctggcgctacaacccaaccgagaaacgggtcgagttctactacctggacactcggaccttccgcatctacgcctttgacgacgtcaacacggtggactccaccgtgcgttccggtatgacgacggccgccggcatcagcggggacggctccggatccaccggacagaatggcagctccggcatcagcggcgactccggcagcaagcagaccaccagttcggagctgaagacatcgatcctcagcgacatcgagaacagcatcaactcgatgctgacgccgagcatgggacgcatgtcgctgtcgcgtgccacgggcaccctgaccgtcaccgaccgaccagaggtcctcaaccgcgtccagcagctggtcaaccgggagaacgagagcatcaccaagcaggtgctgctgaacgtcaacgtgctctcggtcgccctgaccgacaaggatcaactggggatcgactggaacctggtctacaagtcgctcaacaacaagtggggcatcggcctgaagaacaccatgccgggcatcgaccaaagtgcgatctccggctccgtgagcatcctggataccgccaacagcgcctgggcaggatccaaggccatggtccaggcgctggcccagcagggccgtgtctcgaccgtccgctccccgtccgtgaccacgctcaaccttcagtcggcgccgatccagatcggccgctacgacagctacctggcctccagccagatctccaacgtcgcccaggtcggcagtaccacctcgctgatcccgggcgccgtgaccagcggctacaacatgagcctgctgccgttcgtgatggaaagcggcgagatgctgctgaagatcaacatcaacatgacctcccgccctacatttgaaatgcagaccagcggggactccaaagcccagttccctagctacgacatccagctgttcgaccagaaggtacgcctgcgcagcggtgagaccttggtgctctccggcttcgaccagaccaccgaggacaccaacaaggtcggcaccggcgacgccggattcttcggccttggcggcgggctgacccgcaataccaaacgcgaggtcatcgtggtgctgatcacccccgtcgtgctgggctga

SEQ ID NO: 9891 - DNA, 1329 bp, Pseudomonas aeruginosa
accatggagaagcctgacatcggtagccgtggaccagacgtctcgatcctgagctaccacggcaacaagttcgtcagcggcctgttctggcggccgctatccagccagcggcagtacatgaaggaagcgcgcaagctgggcaaggaagagcatctggacatcgttgccatccgccattcgccgacagtgatccaggccggcttcgtttcgaagtcgcaaggcgcagtcaagggcatgtactccctggcctcggcgctttcaggccagttcgaaggcgacttcctggcctgctggaaggtcgacgaggaccgctacgcactggtcgccacgctcgatggcgcgatcgtccccggccaggacctggtcaccaccttcgacgaagccagggaccggatcaggaagctctctacgcgcggcgtgcttcgaaacgcacaggtcttcgttcccgaaggattcgaattccccgtcaaggacttcgacatcgaggaactgctcgcgccgaagcgcctgcggcgcgactaccgcctccggcaactcaccttcggcttgtccgccagggagtggacggcagtggccctgctcggttgcttggtaggcgggtcgctaaccgcctactacctatggaatgcccaccagcaagagctcgccagacaagccgcgctcctcgaggagcagaggcgcctcgccgagctggccgagaagaatgcccaggccaagcagccgctggacctggcgtcattgcagaagccctggacgctcatgcctgacctcgaggacatgctacgcgcctgtagcaaggcaacgggggtactgtcgctgtcgatccagggctggctcttcgaatccagcaagtgcgacggcagggtcctggtcgccacctaccaccgtaccggcaacagcacggcagccgacctgacagcggccagccagcacctgttcgccgaccgccccgccttcgttatcgacaacggcaacaccgcggccctgaaggtcgacctgaaagtcgccatcggtagcgatgagccgctgcagccagccgacgacgcgctgcaggcgctcaccagccatctgtaccgtcagggtgtcgagcccaagctgtcgatcagccaggagacaactccgccccttcctggcgcggaagcagcgacggagcagcaagtggtgttgccttcctggaagaaattcaccttcagcgcccagaccaggctcccggcagacctgaccttccaggggctgcccgccgccggggtccgcatcaccaacctcgaaaccacgctcaaggacagccagttggactggactgtcacaggagaaatctatgcgaactga

SEQ ID NO: 9892 - DNA, 1791 bp, Pseudomonas aeruginosa
cgccgccagcggcgcggagctgccgggcaactaccgcgtcgagtcgatctccctggaccaggtcgtactcaccgacaaggacggcaaccgcgtgcccgtgggcttctccagcgttgcccccacccaagccgcctcctcggcccaaggcgcctccgttccgccggcgctgcccggggcggtaccgcagccgttcatccagtaggtaccgccatgacgaaccttcaaattgccgcgcttgcacagccctccatggtgacccaactgctcaccgccgacggtggcgagtgggaggtctcgaaacacctgcaagagatcatggccctggccgccgacggcacgctctatctatcggagagccaccagaacgacattcacgttctgtcgttcatcgaccgtctcgatcgccgtggcttccgataccagctcaacctcaccgacctgcagaccattcaccagctctaccgcgccgtcgccatggacggcctggtcgatagcgatggccagcgcgccacccagatgcaggagcgcgtggtcaagatcattcgtaaggccactgagctgcgcgccagtgacgtgcatttcgtcgtgagtcccgccggcaccggcagcaagatccgtttccgcgtcgacggcctgctgaagaccgtcgagcagtaccgcagccaggaactgcacgaactttgcgcaaccatctaccagtccatgtgcgacgtggccgagccgcttttcaagccacaacttgaccaggacgcgcggatgagccaggccttcgtcgagaagctgaacctgttcggcgcccggatcgcgacccgcccgcgcgccggtgggttcctgatgatcctgcggctgctctacgacgataccggcctcgacagcctggagcagctcggctacctgcccgagcagaacgcgctgttcgatcgcatgatgcgcatgccttacggcatcaacatcctgtccggccccaccgggtcagggaagtcgatgaccttgaaggtcaccatggaaggactcgataagctgcatggcggatccaagcatatcctgaccatcgaggatccaccggaataccgcattcgcggcgaaggcatcaaccagaccccactggtctatgacgccactgacccagacgcagaacgccaggcctgggccgcaggcatcgccaacggcatgcgcctggatccggactacatgatgatcggcgaagtgcgcgacctcttcgccgctgtcgccgccttccgtggcgcgatgaccgggcacggcctgtggtcgaccctgcacaccaatagcgcgatcggcattgtccagcgcctcaaggacctgggtgtcgaccccggcttgctgttcgatccggccctgctgaccggtctgatcaaccagagcctgctgcccaagctctgcccccactgcaaagtgcgcttccaagaccaccaagaccagctcgcgcccgatctggtcgaacgggtccagcgcttgaccgatgtttcccaggtgtacgtcaaggggcctggctgccaggcctgccgtggctccggagtcaacggccgctcgatcgtcgccgaggtggtgctgcccaccctggccttcatgcgtgtgttcgccaaaggcggcccagccgaggcacgcaactactgggtcaagaccatgcagggcatcaccaagcacgcccacgccatccgccgcatcaacgagggcatgttcgacccgcagatagtcgaggatttcattgggccactcgacttcgatgagcatctgctcgacgacagcttctactcgcaggaggcgtgctga

SEQ ID NO: 9893 - DNA, 285 bp, Pseudomonas aeruginosa
tcgaataccggccctcatcccgagggcctttcactacctacgctatgcgccactcttcatcgcatacccacccggggggcaccatctcccccagggcgtggtgttctccattatctggagatcatcatgagcaatatccaaatcgtagatctgcccgccctgccggaagtagaggaggttagcctcagcgacgtcgaggacgagctgctgctcagcagtcagttctgcaacttcgcctggctgttcctagccagcaacaatgcccaggtatctgccttggcctaa

SEQ ID NO: 9894 - DNA, 747 bp, Pseudomonas aeruginosa
gggcatgggcttcccggctactggagataccccatgactcaatataatccgtttatccacggctatactgacttcagaatcgagcgaacgctacagataacatacgaagatgattgccccccctgctatcgcgcgttgcatccatcgcagcaaatcctctccgatactcaactacagtgctttccatgcatcttcaatgacgacttcgccctagttactgaaggtcgagagatcgatactgcactttctgaccgctgtccttacaacggtctggtgcgcaatgtgctctacggcatccttgccgagcaggacggtcagcaaaagcacataggcgatctgtattccttggccgaagcccagagtgtcgttcgtcacctttcgttcggtggcggttacaaccgctgctgggagatcagaaaaacacatctacccatcagcgcgtggaatagcctctacgaaaggttctcgaccaagatgccaatccgcttgccctcggtgttggtatcgctcttctggtgtaacgagcacggtgcggtgggctttcgcttgcacaacaccccttggacggatgagtgtctggagatcctggagatgaccgcagccgctcttcgacaagaacagcttgccttcggcctcgacgaacacctggtcgatctacttcacctcgcgggacaagcagacattcggttcctggtactcgatccattcgcgcccacgcttaagggcctgccactttatgacgattga

SEQ ID NO: 9895 - DNA, 753 bp, Pseudomonas aeruginosa
gccttcctacctgcgcatcgagctgcaggaagaaagcctcccgggcaacccggataccgagtagttctcccctcaccacgatcccgcttcggcgggatcatccttttcgcaggtcacgccatgatcaacatacccggccagttggccattcgaaccatcaacggtcgcaatggcgagttcaacgtgggaaagctctcgacctcgatcggggagttcgtcatcaaggacgctctcctggaccagcacatcgaaggcaagtaccgcggtgatttcgccatcaccgagatccgtccctcctactacaccaccggcggccggctggtcgtcgagatccgcgcaaagctggacagcatgacgctggacgacgtggacaacctcagcgacgaggaggcagagcgtctctctggcaatgaggtggatccgctcgacgaagtgcccgcgatccagcagcccacagtagccccggcggtaccgccgaagtcgccccagaaaccgaagcctctgcgccccgctgcaacaggggaggacgcgcctttcggtatgtcccctccggctcctgcagagcaggccgccactccggacacagacgcagatgcagagctgttcgggacggtctggccgctaggcgaaatcgtcaagctggacaccacggtcgaccgcaagcggctacgtcaacagtgcgtgcggctcggcgcgctgggctatgagctcgacttcaaacaacaagtgtggacccgcaaggaggccgcatga

SEQ ID NO: 9896 - DNA, 306 bp, Pseudomonas aeruginosa
ggggcgccctcgagggcgctcctcgtctaccaccaggagcgcaccatgaacccgctgttcaccaacctcacccaggaaaccctcgcttacctcgaggaccaactgtccaacaacgacgtcgccggcgacgacgagctcatcgacctgttcatcgaggagctgtcgctgaccttggagcaggcggaagcggctgtcgcgctacgcgatcagtacctctgccaggtcttcctggtcggccaagggccgctgcaccgtcctgaagccgatgggctcagcttcgaccctcacaccaagagcgttcggtga

SEQ ID NO: 9897 - DNA, 2364 bp, Pseudomonas aeruginosa
cgactactgacctcgcccccacggcgattccttccactccaccctgcagggtatggcgatacccgaaagggacgtgcatgccctgctttcttccttcacctgcaggagatgcacatgaacgctcagacccaaccggccgccctggccgcctcctccctgaacatcaacctgaccgacttcatcgacgagttcggcgacgagctcctggagtcgctcaatcgctccaaccccccggtctataccggctccgacaacgctcaccgccagttggtgatggaccgactcaagcgcaagcccttcgcggcccaggccgaggtcgtccaggccatcaccgccctgctgctggaccgtaacgagcaggccgggatcatcaacgccgagatgggcaccgggaaaaccatgatggccatcgctgtcgcagcggtcatgcacgcggccggctatcgccggaccctggttgtctctccgccgcacctggtctacaagtggcgccgcgagattctggagaccatcccagccgcccgcgtctgggtactcaatggcccagatactctgctcaagctgctcaagctacgagatcagatgggcgacgcctacgacggacgccaggagttcttcatcctcggccgcgtgcggatgcggatgggtttccattggcggctcgcctgctggaagaagcgcgccgccggcggccaattgctcgctgcgtgcccggattgcggccaggtcctcgaggacctggaaggcaacctggtcacggtggaggagttcgagcgtggtgaccgtcgacgtacctgttcctcctgtcgtggggcgctctggacgctgatccggccaggcaagcctgacggcggcaaccggcgcgcaacgatcctcaagtcgatgtgtcggattccaaccatcggcccggtcagggcggagcgcctgctgaacgacttcggcgaggacttcctggccacgatgttggtggacaacgtctcggagttcatcaacctgatggacgccaagggcgacttcgtcttcagcgatcggcaggccaaacgcatggagcgatcgatggcgaacatcgagttcggcttcggcgaaggcggctaccaaccgaccgagttcataaaaagacaacttcccaacggctacttcgatctgttggtggtggatgaggggcatgagtacaagaacagcggttcggcccagggccaggccatgggcgttctcgcagccaaggcacggaaaaccgtgctgctgaccggaacgctcatgggcggctacgccgacgacctgttctacctcctgttccgcatcctcacccagcgcatgatcgaggacggctaccggcccaacgcgcgtggcagcatggctccagcagccatgtcgttcatgcgcgaccacggcgtgctcaaggacatctacaccgaacgcgatggtgactcgcacaagacagcccggggcaagaagctctcggtacgcacggtgaaggctcccggcttcggcccgaagggcatccaccgcttcgtattgccgttcaccgtgttcctgaagctcaaggatatcggtggcaacgtactgcccgactaccaggaggagttcgtcgacgtgccgatggcgcctgatcaggcttcggcctatcagcgcctggcggccacgctgacagcggagctccgccaggctctggcgcgacgagataccacgctcctgggcgtggtcctcaacgtgctgctggcttggccggactgctgtttccgaccggagatcgtcaagcatccgcgaagccgggacacactggccttcgtgccagcgatcttcggcgacgagcagttgatgcccaaggagcaggcgctggtggacctctgcctcgaggagaaagcgaagggccgcaaggttctggcatacaccgtctacagcgggacgcgcgacaccacgtccaggctgaagaaagtgctcgagcaatccgggctgaaggtggcagtgctacgtgcttcggtcgataccgctcgacgcgaggattggatcctcgaccaggtcgatcgcggcatcgatgtgctgatcaccaacccggagctggtgaagaccgggctggacctgctggacttcccgaccatcgcgttcctgcagacggggtacaacgtgtacaccttgcagcaggccgcgcggcggtcgtggcggatcgggcagaagcacccggtgcgggtggtgttcttcggctacgccggcagctcgcagatcacctgcttgcagttgatggcgaagaagatcgctgtggctcagagcacgtcgggagacgttcccgagtcaggtctcgattcgttgaaccaggacggggactcggtggagatggcgttggcacgacaactcattgcagcatga

SEQ ID NO: 9898 - DNA, 537 bp, Pseudomonas aeruginosa
ccaagtcctcggcgtcaacctactggtgaccaatccatgaagaagatccttgccacgctggcattttgcacggcgttcgcgactcaagcctgggccgccgggctgatcgttgtcgaagacctgggcggcgcctcggcgctcccctactaccaaggcctggatccgcagccatccgctgccgcaccaggacctggcgacctgggcgtccgtggctcaggtgcgtttccagttcgctccgcccgtctttcgccaggacaggtccaggggcgcgccatcaacgctccaggcctgcaaccgctgttcctggtcggcgacgacacgctgtctcaaacctggctgaaagagcgaggcgacgagctccgagacctccaagccgtgggcctggcagtgaacgtggccagcgaagcgcgcctgacggagatccgggcctgggggaaaggacttcagatattgccggcgccggcggacgacctggtcgaccggctagggctgcagcattaccccgccctcatcacatccaccgccatccagcagtag

SEQ ID NO: 9899 - DNA, 1554 bp, Pseudomonas aeruginosa
ctccacagccacagccccctgtttaaccagacacctaccaatctggaagccctcgtatctccggagacacctatgcagtggactcacgaacagtcaccgatcatccagtcgaaggcatcgaagatcctggtgcgggccttcgccggcactggcaagacgaccaccctggtgggctttgccaaggcgaaccctaccctgagaatcctctatctctgctacaacagctcggtggagaaagccgcgaagggcaagtttccccgcaacgtagtgtgcaagaccgcccacagcctggctcatgcggtgtacggcatccagtacgcccacaagaagacgaagaacctgcgtctgaccgatatcgcccgcggactcgatacccaagactgggagttggtacgtgacgtgctggccacgctgaacaactacatggccagcgccgacgcggaactcggccgaccgcacttcccgcgcttccgcgacaaggcgttcctcaccagtgcccaggaacgcttcctcaagcagggcctggacatggcgcgagtagtctggaggcgcatggtagatctccaggacaccggcatgctgatgccccatgacggctacctgaagctgtatcaactgagcaagcccgatttgagccagcgcttcgactgcatgctcctggacgagggacaggacatcaacccagtgatcgcggacattgcccactggcagcgcatcagaatggctatcgtcggcgatccccaccagcagctctaccggttcagaggcgcggaagatgccctgaacagcgactggatggtcggcgccgaggagcactacctgacccagagctggcggttcggccccgcgattgcgcacgtggccaacatcatcctctcctacaagggcgagacacggaaacttcaaggattgggcccgcagacgctggtgaaaaagtccctcccggcggaccttcctcaccgcactttcattcaccgcaccgttatcggcgtcatcgagaatgccctgcagctggtccgcaatcatccggagcccaaattccactgggtaggcggtatcgacagttactcgctgcgcgacctggaggatctgtacgcattcagccgaggcctacgccaaaacgtccagaacaagaaactgctccgtgactaccgcgactacacccagtacgtggagatcgccgagatcagccaggacggtgagatgcttcgctcgatcaagatcatatcgacctaccctgatctgcctgcgcggatccttgagcttcgctcactgacccttgacgatgagctggacgcaacaatcaccctgaccaccgcacacaaggccaaggggctggaatgggatttcgtttgcctgtacgacgacttcaacgcggacccgctgtcccccgacaccgacccaggcaagcgcgacgatgagttgaacctgatctacgtcgcagtgacccgagcgatgaagatcctcgccatcaacagcttggtgctgtcgatcatgcagcggtacgtggacgacagacaactgaaggagcagatagctatctgtaaaaaatga

SEQ ID NO: 9900 - DNA, 204 bp, Pseudomonas aeruginosa
ccttccatcgacaaacctaagcttctggtaccaaccattccttggtccgtatacccagttttcgacagtagcagccccccgcactatatagccactaccatccactgcgggcccttcaactttacggctatcagggttgccgcacttcctaagcacatcatcaatcaagtcaccctcactaacaattgccgacccgcatcgtaa

SEQ ID NO: 9901 - DNA, 288 bp, Pseudomonas aeruginosa
cccttcagacctatctgggaattacaccctgcgcggagggccgatgccgtgagcatgagcggagcccagacatcagcgttccaggccgccgctggctttcctccatcggccggcgaggggctgttcattggagcagcgatgaccttccttctgctgtggtccgcctgggcgatgtacagcacctggcgcggctgggccaccaacaacctcgacagcgccactgccggcgcttccgcgatacggatcttggtcctcctcggcatcacctccttcatcctcctcagctga

SEQ ID NO: 9902 - DNA, 435 bp, Pseudomonas aeruginosa
tcatttatctcgtcaccaaagccaccaccatcatgtaagggccttcccatgcccgaagaacatctgtttcaggatgggaccctcagcttcctgccgacccgtttgaaccggcaaccggtggtcatcggcggcctgaccgcagacgaaatgtggatcacggtcttcaccagcggagcagccgggttcgctcttggcattccagctgccttggtcgtaggtaacgctgcctgcattccactgggcgcgctgctggttggcgccctcggcctgggtatcggcagccgcgtcctgcggcggatgaagcgggggcggcctgacacctggttctatcgccaggtggagctggccctctcgctgcgctttcccgtcttcggcaaccgtcacctggtgacgcgctccggcgcctggaccagtcgacgcacggagtccccatga

SEQ ID NO: 9903 - DNA, 1578 bp, Pseudomonas aeruginosa
cgcgcggccgcggccttgccgacgcgctcctgccctccgccatcagccagatcgatcccaaaggaggccgtcgtggcgctgaccggtaatcccctcctgaaattgctggtcatccccgtcgtgatcggcgccatcctgatcggcgtgagcatgatgggcaagaaggaaagcgcgcaatcacaaggcgccgcaaccccgacggtaacgtcggaagaagcggcaaccctgggcatcgacggcgacacacccgccgacacactacgcaccatcgtggcggaaagccggcagctcaaggaccagatcagcaaggtcatccaggagaatgactcgctcaaagctgccaatgagaacctgcagggccgcctgcgcagcatcgatcagaacatcgagcagaagctcaacaacaccgcccaggagctgcagcaacagcaggagaaccgtagccagacgatcctggaccaggtacagaaacggctcgagaacctaacccacgttcccgaggccggcgacaccgacctgcccgtaggattcggcgtgcgaccagaggatggccagcactttcagggagcgggctcgtcttcatcggacatcgtctggatcgagccccaggacgcccgcgcagtcgatgccaatggccagccgctggccgccggctccaccacccaaccgagcggattcagcttcccgacctccttcggcaatgcggtcgatcgcggccagaacgcgctggagcggatcgatgacgggctgcaccccgtcggccaacagcgatccgacctcgagaaccgcaagctcgtccgcaagacctacacgctgccgcagaactcgacgctcatgggctcggtggccatgtctgcgctgatcggtcgtgtgccggtcgacgggacggtcaatgatccttacccgttcaaaatcctcatcggcccggacaacctcaccgccaacggcatcgagctgccggacgtcgccggcgcggtagccagcgggaccgcctcgggcgactggacactctcctgcgtgcgtgggcagatccgcagcctcacgttcgtgttcaacgacgggaccgtgcgcaccttcccggcgccggccgaggaggtgaatgacaaccagagcaacaacaaccagaccgccagcgccgaccagaaaaccatccagggcggcctcggctggatcagcgacccctacggcatcccctgcatcgccggtgatcgccgatccaatgccaaggagtacctgggcaatcagagcctactcacggctgccggggccggcatcgccaagctcctggacgccgacgagaacaacaccagtaccgtcttcagcggcaacggcaccagcttcgggacgaccggaaccaacagcaactcggccctcaacagcatcctctccggcggcgtcggcgatatccggcagtggatgaacaagttgtacggggaggccttcgccgccgtctacgtgcagccaggtgcgcgggtcgccgtgcatctcgatcagcaactggcgatcgactatgaactcaagggccgcaaggtcgattacagctctggagccgctcatgcaacagcagacttggactaa

SEQ ID NO: 9904 - DNA, 3150 bp, Pseudomonas aeruginosa
ccaggccgactacacccgcacggccagcaacgagatccacagccagttcaaacgactgcccaatcccgacctggtcatgtatgtgttcccgcacctggccggcagcgatcccgccccggtcccgggctacaccaccgtgttccccttctaccagcgagtccagtacgccatgccgggcgagcgcacggaggcctactgatggaattgcttcaattttttcgccgccgcgcccaaggacatgacgcggctattcaggaagggcagaacaccgctccacaagaagccaaagtccaagacgcactacgggaagaagccaccgagcgctatctggcgcgactggccgccatgggtattcctctgcccaacaccgggagcaagaatggcgccacgcaggctgaagcgtcacgcctctacgatcacgacccatcgttcgtcgacctgctgccctgggctgagtacctgcccgacgaacaggtgatgctcctggaagatgggcgttcgcgtgccgtcttcttcgagctggtgcccttgggcaccgagggccgcgaccccaattggatgcagaacgcccgggacgcattgaaagaagccctgcagaactccttcgacgagcacgaaacctcgccctggatcgtccagttctacgcccaggacgagatcagctgggacaatttccaggagcagttgaggcagtacgtccatcctcgagcgcgaggatcggccttcagcgagatgtacctggcgctcatgaagcatcacctggagggcatttcgaagccgggcggactgttcgtcgacaccgccgtcagcaagctgccctggcgaggacaacagcggcgcgtgcggatggtcgtctaccgccggatccgcaaggcggatgcgcagattcgcggacaggacccgacggcatatctgaaatccatctgcgagcgtatccaaggcggcctggcgaacgccggcatcgtcgcttcgcgcatgagcggccaggacgtcaggaactggttgattcgctggttcaacccgcacccggatcacctcggcaagaccgatgcggatctacgtcgcttctacgaactggtatgccggccggacgaaccgatcctgcaggacgagttgccgctggccgacggcaccgacttctcccagaacctgttctatcggcagcctgtttccgatgccacccagggcgtatggctcttcgatgccatgccgcaccgtgtgatcgtggtcgaccagttgaacaaggcgccgctgacaggccacttcactggcgagacgctcaaaggcgatggcctgaacgccctgttcgatcgcatgcccgaggacacgctgctgtgtatcaccatggtggtgacgccgcaggacatgctggaagggcatctgcagcagctctcgaaaaaggccgttggtgacacccaggcctcgatccacacccgcgaggacgtggccaccgttcgccgcctgatcggccgggagcacaagctctatcgcggttcgatcgctctgttcgtgcgcggccgcgaccatacccagctggaggagcgctgcatcaccctgagcaacgtgctgctcggcgccggccttgtgccggtcgaaccgcagaacgaagtcggaccgctgaacagctacctgcgctggctgccctgcaatttcgatccgaacgagaagcgagccctggagtggtacacccagatgatgttcgcgcagcacatcgccaacctgtcgcccatctgggggcgcaccaccggtaccgggcaccctggcttcacgctgttcaaccgtggcggtgcgccgttgaccttcgacccgttcaacaagctggaccggcagatgaatgcccacggcttcatcttcgggccaaccgggtccggcaagtcagcgtccctgaccaacctcatcagccagatgctcgccatgtacctgccacggatgttcgtcgcggaagcgggcaacagtttcggcctgctggccgacttcgccaagcggtttggcctctcggtccaccgggtccgcctcgccccgggctccggggtcagcctggcgccgtacgcggacgccatcaagctggtcgagagtcccgaccaggtgaaggtcctggatgccgaagacatcgaggcctcggactcggtccagggcagcaaggccgacctcgaggacgaccagcgagacatcctgggcgagatggagatcgtcgcccgcctgatgatcaccggcggcgaggaaaaggaagacgcgcgcctgacccgtgccgatcgcagcgccatccgccaggcgattctggcggcggccaggacctgcgccgccgcgaaccgcacggtgctgacccaggatgtgcgcgatgcgctctaccaggcctccaggagcgatggctccgcgccagaacgccgcgcgcgcctggccgaaatggcggaagccatgcagatgttctgcatgggtgccgacggcgagatgttcaatcgcgaaggcacgccctggcctgaagccgacctcaccgtggtggatttcgcgacttacgcgcgcgaaggctacgccgcccagctcgggatcgcctacatctcgctgctgaacaccgtgaacaacatcgccgaacgcgaccagttcaagggccggcccatcgtcaagatcaccgatgaggggcacatcatcaccaagcacccgctgctgctgccctacgccatgaagatcaccaagatgtggcggaaactgggcgcctggttctggctcgccacccagaacatcgacgacatcccagcctccggggcgccgatgcttaacatgatcgagtggtggctgtgcctgaacatgccccccgacgaggtagagaagatctccaggttccgcgagctgtcgccggcgcagaagtcgatgatgctctcggcccgcaaggaaagcggcaaattcaccgagggcgtgctcctggccaagggcaaggagtacctcttccgtgtggttcccccgagtctctacttagccctggccatgaccgaaaacgaagaaaagaaccagcgctacaacatcatgcaagccaccggctgcgacgagctcgaggcggccttgcaggtcgcagcggatctcgacaaggcgcgcggcctgccacccttccccattattttcccagaccaaccggcagtggagtgccaggacgaatga

SEQ ID NO: 9905 - DNA, 2025 bp, Pseudomonas aeruginosa
cgcgaccaccaactacaaggccgagaacagcatcggccgcttcaaggaagcggatgtgatcggccatcctggcggggccacgttcagccggttcgccagcgcctctgggtacgtttgccctggtgccaccttcccgctggtgccgtacttcctcagcacactggacgccattggctggcggcatggaattcccgagcaggtgtaccccgaagcgttggtcccagggctgcgcgaggtggggggagtcttctccggcgacatgtgggggaacctctatccgcgcagcggattcctgcaccagaccgacgactacaagacggcagccgtcatcgcccagcgcgccggcgacatcaccacgcgagtcggccaactccacgtctaccttcccatgcgcgcagcccccaaggacggctactggccggcgggcgagctgaaagagggcgatgcctcgaccgggaaatggcaggagctgaccccgtccctgagcctcaactgcgcggtgtttcccaactcagggccgaagacgcaagccgtcgacggcgattacgcctgggcgctctggcgtccctactcctgctgccagcgcaaggggcagatcttcctcggcagtaccgacttccaataaggacacggagacgaatcatgcgaatgaacatcacctcggtcgcgctgacgtgcctgctcgcagcgcaacttgcccaggccgacgacccgatcaatgtgtccaagaccggcacggttctcagcgacgaggtcctctacagcattggcggcggcagtgcggtgagcatgggcagcgccggccagatggactcgatcggcgtcggcttcggctggaacaacgaccttatgtgcggaaacatgaacctgagcaccaccctggagaaccagctcaacggtgccacacagggtttccagaacatcatgggctcagtcatccagaacgcgaccggcgcagtcatgtcgctgccggcgttgatcatccagcgcgcgaaccctcagctctacaacctgatcaccaatggcatcctgcaggcgcggatcgactacgaccgctcgaaagggacttgcagagcgatcgccgagaagatggctgacatcgctggcgagcagaccggctgggggaaaatcgccgaaggccaggccctgggtgccacactggcctctggcgggaaagacgccgtatccgccctcgaagcagtggagaagaagggcggcaacgatggcataacctgggtcggtggagacaaggccggcggctccggccagaagcccattcgcatcgtcaacgacgtgacccgggcgggctacaacctgttgaccagccgctcagtgaatgactcgtcgagcgtgccttccgccacttgcaacaacggcctggtctgcaacacctggtcctccccccaggaagccgccgcgttcgccacccgggttctgggcgaacaacagcaacagacctgtgaaggctgtcagaagacggtgacggcggcaggcgtcggcctgaccccgctgatccaagagacctacgacaagaagctccagtcgctgcaggagctgctgtcgaaaagtaagccactgaccgccgagaacctggctgcggccggcaccgatgccttgccgatcacccgcggcgtcatcgaggcgctgcgcgacgagcgtgaccaggacgtcctggcgcgccgcctggcgtccgatgtctccctgatggacgtgctcagcaaggccctgttgttgcagcgcctgatgttcgccggcgccaaggagcccaacgtcgccgccaacggcctggccacccaagccgtcgatcagcagaccagcctcctgcagcaggagatctccaatctcaagaccgaactggaactccgtcgcgagttggccagcaattcgcccatgcgggtcatcgagcgcgggcaacagcgcgcctcagggtccagtggcgtgttcgagtcggcgcccgatgccgatcgcctcgatcgcctgcaggccccctctgccgccgacggcaagacgggagggagaccgtga

SEQ ID NO: 9906 - DNA, 705 bp, Pseudomonas aeruginosa
tcaaacagctctgctacagattcagtttcagcttgtgaagtcatagttgagacatctcgacttggagaccctttagagacggagatgtcccctttaaccaaggcaaatcccaccagaaagacacacagtagagtcattgataccccagcaagccacataaaattctgtgacactacaagagccgctaacaagaataggctaactcgcttaacccaacgtagagctggacggcgatcatgcaggcagaaacgcacaagcatacccagaccaaaaccgatccgggaggcaaaacctttgttggtgtgcgcgttcatcatcaatctcctggctcccaaagggaggcatcctgctatcacctatacgccgaaaaagatgatttggcaagccttatggcatattatgccactagctatctgccgactggagtacctcatggcaacgcgaaacgtcgtccttcccgatccgctggagcaggatatcaacgagctggtggagaccggccgctatcagaatcgcagcgaagtcatccgggcaggattgcgcctgctgctgcaacaggaagcccagaatagcgccaagctcgaagctctccgcaacgcgacatccagtgggctgatgcaattggagcgcggtgaatacgacgagatcaccagcgacgacctgacccaatacctcgacgagctcggccaccaggcgagccactga

SEQ ID NO: 9907 - DNA, 1266 bp, Pseudomonas aeruginosa
ggtcaaggagtgtctatgtctcgcaaaccaagaacccagccggcagcgttgcctgtgattccttccgagttgctggagtcgtttggtgacggctcgatgacggccgaagctatcaatgcggcgtccctggctttcaagaaggccctgatcgagcgggccctggccggtgagctgaaccatcacctgggctacccggccggcacagccaagcccgagcggatgagtaatcagcgcaacggcaagggggccaagacggtgctgacccaggaggggccgatccgtatcgacgtgccccgagatcgcgagggcagctttgccccgctcctgatccccaagcatgagcgccgttttactggctttgatgacaagatcgtcgccatgtatgcccgcggcatgacggtgcgcgaaatccagggctttctgctggaacaatacggcacagacgtctcgccggacttcatcagctcggtcactgacgaggttatggccgaggtcaccgcctggcaggccaggccgctcgagcccatgtatccggtcgtgttctttgacgcgctgcgggtcaagatcagggaggatgctgtcgtgcgcaacaaggccgtctatctggccctgggcgtgctacccgacggcacacgcgatatcctgggtttgtggattgaaggcaccgaaggcgccaagttctggatgaaggtcttcaacgacctgaagacccggggcgtgggcgatatcctgatcgccgtgactgacgggttgaagggtatacccgaggcgctggccgcggtgttcccggccaccacactgcaaacctgcatcgtccatctgatccgcaacagcctcgattacgcgagctggaaggatcgcaaggcgctggccgccgcgatccgaccgatctataccgctgtcagtgctgaagcggccctggccgcgcttgacgcctttgccgatgggccgtggggtcagaagttccccaccgtctgcgcggcatggcgcaatgcctgggatcgcgtgattccgttcttcgcctttgcgccggagatccgcaaggtgatctacaccaccaacgccatcgagaatgtcaactcgcagctacgcaagatcatcaagacccggggccatttccctactgacgaagccgcctccaagttgatctggctcgcgctgcgaaacatcaccgccaaatggagccgatccgctcacgactggaagcaagccatgaaccaattcgctatcctttacgctgaccgattcagtcgcccttccgtgtaa

SEQ ID NO: 9908 - DNA, 1941 bp, Pseudomonas aeruginosa
atcgtcatggagcctcccatgtttcaactcctttcctggatctccaggaagccgtcccccagccaactaaccaaagctgccccagggggattcctccctcctctgagcagtatggagctgctcggcacacctcggcgccggcagctactggagaacatctggcagcgcgcctcgctatccaagcagcaattcgaggagatctaccggcggccactggccaactatgccgagctggtccagcagctccctgcttcggaaaaccatcaccatgcccatccaggcgggatgatcgatcacggcttggagatcgtggcctacgcactgaaggtacggcagacctatttgctcccgatcggcgcagcgccggagtcacagtcagcccaggctgaagcctggtcggccgccgcggcgtatggtgccctggctcacgacataggcaagatcgtcgtagacctgcaggttgagctgcaggacggcagcacatggcacccttggaacggaccgatcaaccagccttaccgcttcaagtacgtgaaatcccgcgaataccagctccacggcgctgcctcagcactcctcatccaccaactgctaccgcgcaccgcactcgattggctcagtcgctttccagagctgtgggctcaattgatctacctgttcgcaggtcagtacgagcacgccgggatcctcggcgagatcatcgtgaaggcagaccaggcctccgtcgcgcaggagttgggaggtaatccggatcgagcgctggctgcaccgaagcagtcgctgcagcggcagttggcagacggccttcgcttcttggtgaaggacaagttcaagttgaatcaacctagcggcccgtccgatggatggctgactcaggacgcactctggctggtgagcaagcccgcggccgatcagttgagagcctacctgctggctcagggaatcgaaggggtcccctcctccaacgcgccattcttcaacatgctccaggaccaggccgtcattcagacgaacgccgaagacaaggccatctggacggccacgatagacaatggtgctgggtggagaaacaagttcacgctcctcaagatcgctccagccttgatttgggctgaccctgccgagcggcctgattcctacagcggatcactcgtcattgaagagggcaacgcctcccctgaaaagccggaaacgacctgcgaaatccccaacgatccgattgaacagcagcaagcaccagaaaccaagatgacgctccgccaaccttcgccgagcgttgcgaaaccgtcaaaggagatacgggcgattgcgaacccgtcaattgatgatcaggaagaaacggacgacttatacgcgcttcttggtaatatcacttcgccaccaagcgggctagacactactagccacgcctcaccggctgcttctcctacgaacactcgcggggaggagaacctgcagcagccattaggaaccgcggagccagcagattgcgctcctgaaacagttgaagacgtatttatgcctagcagaagcactgatctgggacagggattcgttggctggatgaaagctggcatcgcggcccgtcgcctgttcatcaacgacaccaaagccttgatacataccgtcgacgggaccgccatgctggtcacaccaggaatcttcaagcgttatgtccatgagcatccagagctcgaaaagctggcccaggccaaggagacgaccggctggaagctggtgcaacgcgcgttcgagaaacagggtcttcaccgaaagaccaataagaacctgaacatctggaccatcaaggtttctggtcctcgcaagacgaaagagctcaaggcatacctgctccaggatcccaaactgctgttccctgtgcagcctctggacaacccaagcctcacggtcatcaccgatgccgaagggggtgtggaatga

SEQ ID NO: 9909 - DNA, 444 bp, Pseudomonas aeruginosa
cgggaaaggggaatactgcgttcccggacctcctggatgcgcatcgcctgtcggctcctcctcgctggacctctctccaccttagccaaggccgccgccatggtcgtcccgatcggtcgtagcgaccttccgccgatttgcccggcccccgcccctctgctagtgtcgcggggttttgtacacctcgccgagactcccccgatggcccgcaagaaaaccctcgatttcgaacagtccctcaccgagctgcaaaccctggtggaacgcctggaaagcggcgagctgtcgctggaagagtcgctgggcgccttcgagcagggcatccgcctgacccgcgaatgccagacgtcgctgagccaggccgaacagaaggtacagatactcctcgaacgcgacggcgagctcagcgaagcgccgttcgatgcggaaggcgacgaggcatga

SEQ ID NO: 9910 - DNA, 525 bp, Pseudomonas aeruginosa
accctgcatgaccagccaggcgaataccccggccaggacgtcgtcgagcatgatcccgacgccgccgtgcacgttgcggtccacccaactgatcggccagggcttgagaatatccacgatgcggaacacgacgaagccgatcagcagccaccaccagccctccggcaccagccagagggttatccacatgccgaccatctcgtcccagacgatgccttcgtggtcgtgcacgcgcaggtcgtcggcgaccttgccgcacagccagaagccgaacagcatggtcactcccagcatcagccagtagccccagtccggcagcatctgccacagcgggatgaacgggatggccaccagcgacccccaggtgcccggcgccttgggcagggtgccggagccgaagccgaaggcgaggaaatgccagggattgcgccagaccgacggcggcaccggctgcgccggcgcctgatcaggatgctcagtcacgttgggttccgaaatgttggtagccggccgcggccggtatga

SEQ ID NO: 9911 - DNA, 546 bp, Pseudomonas aeruginosa
aaaccagcacgtagtcgtcgccggcggccagttgctggcgcaaggcttcctcgccggcgagcaggccgctcaacgcggcgcttgcctgcaagcgctggcattcgaccaacagggcaacgccggaagcgcgggcgatatgcccgcagtcggcgagcagcccgtcggagatgtccagggcggcgctggccttgccgcgcagggcgaggcccagaccgaattgcggggccggcgtccagtagcgcgccagcagcggttcggccacctcggcgggcgccgatcttcgctccagcaccagttccagcgccgctccagcctcgccgagcgggcccccgacgcagagcaggtcgcccgggcgcgcaccggcgcgggtcagcgcctggccggccggcaccctgccgaatacggtcagggtcatgctcagcgggccgcgcgtggtgtcgccgccgaccagggccaggccgcactgccgggccatggcgtcgaggccgcgggcgaagccctgcaaccactcggcgtcggcctgcggcaaggtcagggccagggtga

SEQ ID NO: 9912 - DNA, 906 bp, Pseudomonas aeruginosa
tcactaccttgtagggcacgtcgatgcggttgcgcagctcgtaggtggacagccgcaggatggccagctcgaccgggtcgatctcggccagcgggcggtccaggcagggctcgaaggtggagtccagctcgctcttctgtcgcggcacgccgtgcaggatctcgtggaagtaggcgccgtcgacctcggagaagtcgttgtcggtgcggaactgcgcctcgatctcgtgcaggggctggccggcgatctgccaggagtacagggcctggacggccaggctgcgggccttgcggcgagcggcggtcttgcctttcggcggcttggctgccgggttgccgctgtcttgattgctcacttggcctccaactgcgccagcaggctgaccatttccagggccgacaacgcggcttcggcgcccttgttgccggccttggtgccggagcgctcgatggcctgctcgatggagtcgacggtgaggacgccgaaggcgaccgggatgccgaactgcagggacacctgggccaggcccttggtgcactcgccagccacgtattcgaagtgcggggtgccgccacggatcaccgcgccgagggcgatgatggcgtcgaagccgccttgctgggcgaccttctgggtcaccagcgggatctcgaaggcacccggggcgcggatgatggtgatctcgctttcagccacgccgtggcggaccagggcgtcgacggcgccgctgaccaggctttccacgacgaagctgttgaagcggccgaccaccagggcgtagcggcctttgggggcaatgaaggtaccttcgatggtcttcagggtcatgagcaggtctcatctgttaaagagccgggacgccgttgcgccccgagcgaaaagggtcgaaaggtccgtccagcatag

SEQ ID NO: 9913 - DNA, 855 bp, Pseudomonas aeruginosa
cgcccaccgcgatcttgcacgcggcgggcgggacaggccttattcggcgggcaggtattctacaacttccaggtcgaaaccggatatcgcattgaagcgcatcggcgcactcagcaggcgcatcttgcgcacgccgaggtcgcgcaggatctgcgaaccggcaccgacggtgctgtaggtggtggtggccttgggcgccggagccggcgccgaagcgatctcgcggacatgggcgagcaggtcgtcgccgccgatctggtgaccgagcagcagcaccacgccgctgcccgcctcggcgaccttggtcatcgccgcgcgcaggctccagcggcccggctggttgacctgcagcaggtcgcgcagcgggtccatgttatgcacgcggaccagggtcggctcttccgcgcagaccttgccgagggtcagcgccaggtgcacgtcgccctccaccgagtcgcggtaggtgatcaggttgaagtggcccagttcgctgtcgagcggctgctcagcgatgcgctcgacggtgcgctcatggatcagccggtagtggatcaggtcggcgatggtgccgatcttgatcccgtgctcggcggcgaacgcctccagttcgggccggcgagccatgctgccgtcgtcgttcatcacctcgcagatcaccccggacggctcgaacccggccatccgcgccaggtcgcaggccgcctcggtgtgcccggcgcgagccagggtaccgcccggctgggccatcagcgggaagatgtggccggggctgaacactttcggcggccacggcgttcttcgccgccgcagcctgcacggtgcgggcgcggtccgcggcggagatgccggtggtga

SEQ ID NO: 9914 - DNA, 807 bp, Pseudomonas aeruginosa
aacgccgactccagcggcacccgcagggcgcccgtcgaccagcacccgcaacggctggcgagccgcggcgagcgcggtaagctcggcgttcaggcccagttcgtcggggcgtacgttgagccgcgcatcgtccgccagcagcgtatcggcgccggacaacaccacgctggagcgagcgcgcaagcgctgcaccgccgaacgcgcggagggcccggtgatccactggctttccccgctggccatggcggtgcgcccgtccaggctcatcgccaacttgacccggacgaacggcaggccatgttccatgcgcttgatgaaaccgatgttgagttcccgcgcctcggcttcgaggacgccgctctgcaccgcgatgccggcctgcatcagacgcagcaggccgcgaccggcgacctcggggttgggatcctgcatcgccgcgaccacccgcgccaccccggcgcccaccagcgcatcggcgcacggcggggtgcggccgaagtggctgcagggctcgagggtcacgtaggcggtggcgccgcgtgcattctcgccggcctggcgcagggcatggacctcggcgtgcggctcgccggcgcggacgtgccagccctcgccgaccacctggccgtccttgaccagcacgcagccgacgcgcggattcggatgggtggagtacagcccctggcgcgccagttccagggcgcgggccatgtacagcgggtcggcggcgttcattccttggccggctcgcgggcgaggcgttcgatctcctcgcggaattcgttgaggtcctggaagcgccggtag

SEQ ID NO: 9915 - DNA, 1275 bp, Pseudomonas aeruginosa
cgcatccgcgcccgaccgagcacccgcagaatcgaccggcgccggcacgctgggaaaggcgagaggaatcggacgttgcggcctacgcgaagcgcgacaagaatcacactttgcgctatacaagcgccgcccggattccaccgctatggagcagcccatgaccctgcgcccgatcgccctgctggccgtccttctcctcgccgcttgttccagcgacaagccgaagcctgcgccaacgccgcaagcttcgcgcagcgtgaccatggtcgagccggtgctaccggcccacctgcgcgagctgagcggaacgctgagcagcatccagggcagcctgccacgcggcagcgaggtgcagatggcactgctggtgatcgacgagcgcgaccgtccacagcggctgctggccagcgagacggtgctggccaccggcgaactcatgcccttccgcctgccgttcaaccccgaatccttcccgccggccggtggcgcgctgcgcgtcgaactgcacgcgcgggtgatccagtccggccagttggcctggcgcctgcatccgttgcggatcgcccagccgaccacccagtccctcggcgaactgcgcctggtacgcgcgccgtgacggcaccgcaagccctgacccaggcgctgggcgagctgctcggcgacgcccggctcagcgccaccgcgctgcccggcaccgacctgcgcctgtggctgatcgacgcgcagaacatggaccgccagttcagcccggaggaaacccgccgcatcctcgaagagccgccgtactggtgcttctgctgggccagcgggctggtcctggcgcgctggctggcggagcgcccgcagtgggtccgcgacaagcgcgtgctggacttcggcagcggctccggggtggcggcgatcgccgcggcccgcgccggcgccgccgaggtggtggcttgcgacctggatcccctggcgctggcagcgagccgggcgaacgccgaactgaacggagtggagctgagctattcggcggacttcttcgccgaggacgatcgcttcgacctgatcctggtggccgacgtgctctacgaccgcgccaacctgccgctgctcgaccagttcctcagccgcggccgccaggcgctggtcgccgactcgcgggtccgtgacttccgtcatccgctgtaccggcgcctggacgtgctcgacgcctgtacctggccggacctcgccgagcccgccgaattccgcctggtcagcctgtatcacgccgaacgcgggcaagcctga

SEQ ID NO: 9916 - DNA, 669 bp, Pseudomonas aeruginosa
agagccgcctggcggccgatgccggcgacgacgaggcagcctaccagttggccgtccagcagctcgcccggcagcagtacgaggcggccctggacggactgctcaagctgttcctgcgcaaccgcggctaccaggacgacctgccgcgcaagaccctggtgcaggtcttcgacctgcttggcaacgaccacccgctggtcaccgcctaccgccgcaagctgtaccaggcgctctactgagtcgccgagccccgtccgcggggctcagtcctccagccagacgaacacctgggtgccgtcgaccacctcgaccttgacccgggcgtcatgccgcaggcgcacaagcagttgcttggcggcgccggcattgccgctgaacccctccaactccgccagcaactgcggcccctcgatccgcccgctgccgcgcagcaggtcctgggcggtctgccacaggcgatccaccggcgctgccggcgccggcgccctggccgccgcgacctgcggctcgcccagcggcggcgggggcacgtgttgcgccagctggcgccaatcctcggcgtccagttccagggtcaggtccaccggccagtcgccgatgcttccgcgaatccgcaccatctcgtttctccacaagcgaatcgcgccatgctcccacgtcggcgcgtag

SEQ ID NO: 9917 - DNA, 801 bp, Pseudomonas aeruginosa
agctgtaggatcgttccggaggcgccgcgagggattcggcgcggcgcccctccatccattctcgaggctccggcggagcgttccgcccctacccccatgagcgcactgatcaccctgaccaacctcggcttcgcctggcccggccaggcggagttgctggacattcccagcttccatctcgaacgcggcgagagcctgttcctcaaggggccttccggcagcggcaagaccaccctgctcggcctcctcggcggcgtgcagaagcccggccgcggcagcatccgcctgctcggcgaggacctggaaaagctgtccgccgcgcgccgcgaccatttccgcgtcgaccacaccggctacatcttccagcagttcaacctgctgccattcctctcggtacgcgagaacgtcgagctgccctgtcacttttccgcgttgcgccgtcagcgcgcccgcgaacgccacggtagcccggcgcaggccgccagccatctgctcggccagctcggcctcggcggcgaactgcacgaacgccgcgccgacagcctgtccatcggccagcagcagcgggtcgccgccgcccgcgcgctgatcggccagccggagctggtgatcgccgacgagccgacctcggcgctcgacgccgacagccgcgaggcgtttctccagttgctcttcgccgaatgccgcgaggccggcgccagcctgctgttcgtcagccacgaccagagcctggccgggctgttcgaccgcagcctgtccctttccgatctcaaccgcgccgcccggccggcaggactctga

SEQ ID NO: 9918 - DNA, 351 bp, Pseudomonas aeruginosa
tggcgatcctcccccggtgtcgccctgcaggaactgtggggcctgatgggcaccgccgaaaaggcactgttcgtggtctcgctgttcgtcgtcctcaccggcctgatcggcatgctcacggcgatcctcaccagcctcaacggatcgccgccgggagatggccatcctgcgctcggtgggcgcgcgcccctggcacatcttcggcctgctgctggccgaggccttcagcctggcgctggccggcgtcgccctcggcctcggcctgctctacctcggcatcgccgccagccagggctacgtccaggccaactacggcatctacctgccgctggcctggccgagcgactatga

SEQ ID NO: 9919 - DNA, 645 bp, Pseudomonas aeruginosa
gtggagcctgctcggggctatcctggcggccgccgtgctgatcggctgcgtgccggcctggcgcgcctaccgccagtccctggccgatggcctgtcgatccgcctatgacccggagatattccccgatgctgcgctccctgaccgtcctcctgctggctttcgccctgctcctgggcagtgccgtggcgcgcgccgcgccgcgcgaactgacctggtcgcaactgatcccggccggcgccccgcccgccccggcgccgctgccgatccacgacctcgccaacgccctcagcgaagccggtccggcggccagccagcagagccccaacgccccggtggtgaaggcactggacggcatcgaggccaagctgccgggctacatcgtgccgctggaaatcagcgaggccgggctggtcaccgagttcctcctggtcccctactacggcgcctgcatccacgtaccgccgccgccgtcgaaccagatcgtctacgtgaagaccgccaagggcgtgcagatggacgagttgtatcagccattctgggtcgagggcaccttcaaggtggagaacgccagcagcgagctggcggcggccggctaccgcatgcaggcgagcaaggtgacgccctacgaatacgaaggtggctga

SEQ ID NO: 9920 - DNA, 738 bp, Pseudomonas aeruginosa
cagcaccaacactttctaatacaaggaatggagctcatcatgcgtaagtcctggcttaccgcttccctgctggccctcaccgtcgcctccccgttcgccgctgcggatattcaaggacacaaggccggtgacttcatcatccgtggcggcttcgccaccgtcgatcccgacgacagcagttccgacatcaagctggacggcgccaagcagcgcggtaccaaggcgactgtcgacagcgacacccagctcggcctgaccttcacctacatgttcgccgacaagtggggcgtggaactggtcgccgccactccgttcaaccaccaggtcgacgtcaagggcctcggcccgggcctggacggcaagctggccgacatcaagcaactgccgccgaccctgctgctccagtattaccccatgggcggtaccaacagcgccttccagccctacggcggcctgggcgtgaactacaccaccttcttcgacgaagacctcgccagcaaccgcaaggcgcagggtttcagcagcatgaagctgcaggactcctggggcctggccggcgaactgggcttcgactacatgctcaacgagcacgcgctgttcaacatggccgtctggtacatggacatcgacaccaaggccagcatcaacggcccgagcgccctgggcgtgaacaagaccaaggtcgacgtggacgtcgatccgtgggtctacatgatcggtttcggctacaagttctga

SEQ ID NO: 9921 - DNA, 435 bp, Pseudomonas aeruginosa
ggcgctggcggagaatgtagcggcagacgctgtcgccctgctcctcgaacaaccggtacaactggcgcaccgagatgcgcaggcggccggcgagcatgtccggactcaggcgcggctcctgcagggattgctcgatcagacgctccgcgtgccggcgcagactgtagccatagagcccggccagcggtccctccaattcctcgccggcgtgctgtagcgccggcccgagcagggcgatcagcgcctcctgcaacgccccgccctcgtccgccaccgcccacggctgcagttctccggcgcacacctgctgcaccagcaggctcagcaggcgaccgctggcgcagttcggcgagagtttgccgaaggcccgctggctgggtggcaggtgccggcatacctcttcgcgggagagatggaacgaggtgtgttcgatga

SEQ ID NO: 9922 - DNA, 2568 bp, Pseudomonas aeruginosa
  unsure (550): Identity of nucleotide at the above locations are unknown.
gtctggagttggacatcgacgtatcctcgacggcagcgttgctgttgttgttcttgcgtcaggccctgcgggacgcaccggcgtcccgtacgctccgccggcaggcgaggcgtgtcgaacaaaaggctgccgcggagggcagcgaaagagccgaacgaatcggctccccccgattcatcgatatcagtaggcgatgcacaccgacttgttctcggtgtacgcctcgatcgccgcatggcccatctcgcgtccgatgccggactgcttgaagccgccgaacggcatcgacgggtcgagcaggttgtgggcgttcacccataccgtgccggccttgatcctgggtaccaggtccatgacctggcgcaggtcgttggaccagatgctcgcaccgagcccgtagatgctgtcgttggccaggcgcaccgcttcgtcgagatcgtcgaagggcgtcgccaccagcaccggcccgaagatttcctcgcgcaccaccagcatccccggggtgacgtcggcaaggatcgtcggctgcacgtagaaccccgtctcgccntggcgcgccccgccgcagaccacgctggcgccctcagccaccccgctttcgatcatccccagcacccgctcctgctgcctggccgagaccagcgggttgatctgcgtggtcggatccaggccggggccgatgctcaggtcgccggcgatggccgccaggcgctccagcacctggtcgaaacgcttgcgctgcacatagaggcgcgagccagcggtgcagacctgcccctggttgaagaagatcgcgccggcggaaccggcggcagccatgtccaggctggtgtcatcgaggatgatcaccggggatttgccgccgagttcgagggaaaaacgcgtcatgttctccaccgccgcatgcccgatcagcttgcccaccggggtcgagccggtgaacgccagcttatcgatgcccgggtgcgccgccagtgccgcgccggcctcggcgcccgtgccggtgacgatgttcaccacccctggtggaatccccgcctccaggcacaactggccgaggcgcagggcggtcagcggggtttcgtcggccggtttgaggactacggtgcagccgcaggccagggccgggacgatcttccagatcgccatcagcaaggggaaattccacggcacgatggctccgaccacgcccaccggctccggcaccgtgtaggcccggtagcgcgcgcctgggaccgcggcgatcgacaggtcgaggctgcgaccctcgatcttggtcgcccagccggccatgtagcggatgaactccaccgaggcgccgacctccagggcccgcgacaggttgatcgacttgccgttgttcagggtttccaactgcgccagttgctcgccatgcgcctcgacccgttccgccagtcgcagcagcaggcgctcgcgatcggccgggcgctggcctgcccagctgccttcgaacgcgcgccgcgcggcagcgactgcccggtcgacgtcttcggcgccggcgcgggccacgcgagccagctcggcgccggtcgccgggtcgtacagcggcatgtcggcgccggaacgcgccggcccggactcaccgtcgatcagcaggccatggggactgcgcaagaaagcgctgacggacgggtcgatggcaatactcatgtgtgctcctcggcttggcgacggcgctgcgtcatgcatgcgcctactacccgggaatactctggacccgccgctcccccgctcgcttgctccagcctgccgggtttcttgccgctgcctgccaagccaggcagagagagacaagacggcgcgccggggcatggacattctgcccggcaggcaggacagtggacgtcccgccgcctcgtcccacgggagtcccgcgccatgccttcgaccctgtcgcccgacctcggcccgcgctgcatgcaggccttcacccaggtggtaccggccagcctgtgcgtgttctatcgcatcgacgaggactgccgcgcacacgatttccagctcctgcggatgccggccggcatgcaccgcgactacctgcgccactaccgcgactacgatccgctgcagccgcgccactgcctggccagcgcttcgccggtggtgccgctgcgccagggcatcgcccgccagcccgcggaggacagcgcgctgtaccagggcttcctgcgacgccacgggatctgcgacgtggtcgaggtgctggcgcatgcgcatcagcgtccggtggcggccctgtcgttactgcgcgacgcccgcctaggggccttctccgaccaggagctgcgacaattgcgcgccctgcatggcctgatggagctggcggcgcaggcatgcgccacgccagcggccagcgccgagcgcctgcaaggcctgacgccgagggaacgggagatcgccctgctgctgcgtgacggcgtcagcaacaaatgcctggcgcagtgcctcggactcggcctgccgacggtgaagacccacctgctcaacctgttccgcaagaccggtgcgcgcagccgcaccgagctggtgaagcgactcttcctctag

SEQ ID NO: 9923 - DNA, 3024 bp, Pseudomonas aeruginosa
aaaaccacggataacgtcttttccaccggcaagacaggagtctcagccatgtcgaaagattctgttcttggcttattcaggcaacacgcagatacccatcccgaacgccccgccctcgtcgatcgcgagcgctcgttcagctaccgcgaactcgaccggctcagcgaccggctggccgcccacctggccaggcgcggcgtcgcccggggcgagctgctgcccctgctggccgaacgctcggccgaactggtcatcgccatcctggcggccgccaagtgcgcagcggcctacgtaccggtggaccgtcggcaacccgacaggcgcaagcgggaagtcctccgccagtgccaagcccccttggccctcgccacccatgccgaggacctgccggggcaaccggtggaggtcatcgcacaggcgctcgcgacgagtgcggcgggtgccgcgccgagaccggcgctcgacggcagcgaagcgctgtatgtgatcttcacctcgggcaccaccggcgaacccaagggcgtggtgatcgagagtcgctccctggccaacctcgtgggctggcacaaccggcgcttcaatatggatcaacggagccgcaccaccctgatggccggcgtcggcttcgacgtttcccaatgggaaatctggtccaccctgtgcgcaggcgcctgcctccacctggtgcccgacgaggtgcgcccagacccggcggcgctgctggcattcttcgccgagcagcggatcagccacgccttcgcgcctaccgtgatggtgcccgcgctggcggagcagcccgccccgccgtcgctggcgctgcgctacctgttctgcgccggggaaaaactgccgccggtcgcaaccggcgggctgccctataccgtggtggattactacggcccgaccgaggccacggtcttcgccacctgccgcatcgtcgacgccgaagcacatcggcgacccgcctcgatcggcacgcccatcgacggctgcgaggcattcatcctcgacgccgacgaccggccttgccatggcgaccgacccggtgagctgaacctggcgggcgtctgcctggcgcgcgaatacctgcgcgacccggacatgaccgccaggcgcttccactactcgcaggcactgcggcgtcggctctaccgcaccggcgacaaggcccgctggctggccgatggcagcctgcagttcctcggtcggctggacgaccaggtgaagatccgcggccaccgcgtcgaactcggcgacgtcgaggccgcgctgttgcgccagccggctatccacggcgcggtggtgctggcgcatgccgacccacgctccggtagccagcaattgagcgccttcgtggtcccccgccagcaggacggcgatgccagggccgtgctcgccgccatcaagaccgcactgcgccaggaactgcccgactacatgctgcccagccgctacctgtcgctggacagcctgccgaccacggtcaacggcaagatcgaccgccaggccctgcgtcgacacctggacgaacaatgccaggaacgactcgacgagcaacgcttcggcacccccggcgaactgcaagtggccctgtcctggcaggaagtgctggggcataccgacttcggcctggacgacagcttcttcgaggtcggcggccattccctgctggccgccgccctggtacgcgaattgagccgacgcttcggcaaccgtgcctacatccacgacatctaccgcaccccgagcgtgcgccaactggcggccagcctggcgcggcgcgccggcgaagcgccgccggcgctggacagcgaaccggcccaggagctgcaacgggacgtgcgcctgcccgccgacgtggatttcagccgccccatggacaccgcccaattgctggcgccacggcacatcctgctcaccggcgccagcgggctgatgggcgcccacctgctcgccgagctgctggccagccgcgaggccgacctgcattgtccggtccgtgcgcaaaacgacgcccatgccctcgaacgcctgcgccaggccgcccggcagcaccgcatcgaactcgccgagacggactggcgacgggtcagggcctacgccgccgacctcgcagaaccaggtttcggactaccggcggaaacctatcgcgagctggccggcagcgtcgaccaggtcttccattccgccagcgcggtgaacttcatccagccatacagctacatgaagcgcgacaacgtcgaggggctcggccaggtcctgcgcttctgcgccagcggccgctgcaagccgctgatgctgctgtcgagcatctcggtgtacagctggggccacctgcataccggcaagcgcctgatgcgcgaggacgacgacatcgaccagaacctgccggcggtggtcaccgacatgggctacgtgcgcagcaaatgggtgatggaaaagatcgccgacctcgccgccgaacgcggcctgccgctgatgaccttccgcctcggctacgccacctgccacagccgtaccggcgcctacgccgactaccagtggtggagccggctggcgcggacctgcctggagtaccgggccgtgccgctcctgcgcgagctgcgcgagggcctgaccacggtggactacatggtagaggcgatcagcgtcatcgcccgccagccttcggcgctgggcaagaaattcaacctggtgccgagcattccgcgctgcctgaccctggacgagttcttcggccgtctcgggcgacgcgccgggcgtccccttcggcagatgccgttcgacgactgggtaagtctctgggaagacaatcgcgacgccccgctctatcccctgctgagcatgttccgcgacaacatgtacgccggccgcagcaccgtcgagttgtaccaggacacctatctctgggactgcaccaacgtcgaggaacacctgcgcgggagcgccgtgcgcgagccggagttcgacgaccgcctgctcgacctgtacctcgccggcctgggcggcagcgccatgcggtaa

SEQ ID NO: 9924 - DNA, 762 bp, Pseudomonas aeruginosa
cgaggtcgccgcggcggttacgcagcgggacgcgcttgggtatcctgtccgctttatcgcccggagaacctcatgcacaacgttctgatcgtcggcgcctcgcgcggcatcggcctgggactggcggatgccttcctgcaacgcggcgcacaggtattcgccgtcgcccggcgaccgcaaggctctcccgggctacaggcactggcggagcgggccggggagcgcttgcaagcggtgaccggcgacctcaaccaacacgattgcgccgaacgcattggcgagatgctgggcgagcggcggatcgatcgcctgatcgtcaacgccggcatctacggcccgcagcaacaggatgtggcggaaatcgacgccgagcagaccgcccggctattcctgaccaacgccatcgcgccgctgcgcctggccagggcactgtccggccgggttagccggggtggcgtggtggcgttcatgagttcgcagatggccagcctggcgctgggcctgtcggccacgatgccgctctacggcgccagcaaggcggcgctgaacagcctggtacgcagctgggagggcgagttcgaggagttgccgttcagcctgttgctcctgcatcccggctgggtgcgtaccgaaatgggcggcgacagcgcgccgctgagcgtcgaggaaagcgccgccggactggtcgcggcggtggaggatgccgcgggcgtgaatgcctgtcgcttcgtcgattatcggaaccagccgctgccctggtga

SEQ ID NO: 9925 - DNA, 519 bp, Pseudomonas aeruginosa
ccagctcatgcgcctcctgggaagcctggggcttgtagttcaggaacaggctcaccggcctggcgaacagcaccgtgcctttcgccgtgccgctggtcagctcgttcaccacacgccagggcaagcctttgccattgtcgaacgagcagttcagggcgacctcgttcagggcccaggcctggccgccggtcaggcagcagaggccgagaacgagcgcctgccgagcctgcgcgccaggccggcggcgcagggaaacgcggccgggaaataacctcatgctcatggaactctccaagattgcgcctgcggaagagggccacactccaggcgagagcggccccggccgggaagggaggtccgccagggacctcccctgccggccttaccagatgttgccgtagtcgataccggcaggcggcaggagcgccgcctcgccgatcacgtagttgccgcccaggaccccatggttctcgccgacctgcgcaccgtagatctggccgtaatgggactgaggcttga

SEQ ID NO: 9926 - DNA, 1725 bp, Pseudomonas aeruginosa
aacgggtcccgatcacggacagcgaggcggaggcatcggccaccagcgccaccagcaggacccaggccgtgccgcatcgtcccaggccgacgccggtcacagcgtgcgctcccggtcggcggccgacgccgggcgacatgccagttgcaggacgggaggcgtcgtctcgcgcgggcccagcgcatagtcgaccaggcactgctgctgcggctcgttgccccagcgcacccgaaccgagccgcgatcctgctcgacccgcagcaccaggcggctgccctggccgacggcgcccaccgactgcccgctgtgggcatcaagcacttccgcggcgaacggcaggggctcgccgctgggcatccggctatccaccagcaagggccttgccacccgcgtcggatagtcgaggcgcaccaccgctccggcggtgggcgccacgttgcgcgaactggacctcagttcgatctcgtcggccatgccgttggggtcgaggtcgacgctgttcaactggtagggcagcaggttgggaatcaccgcatagccgtggcggtcgatccggcttcccgagtagccggcagccgcgcccctggcgtttggcgcgtggaccaggccgatcgtctcgcccagggtttgtgccgcggtgatcccgccgctgtgcgcgaccaggccccccgcggccttgaccgacaactgccgatagcccggtccctgcgagaggctggagccgagttcgacctgcggcagtcgatagtcgaggctggcgctcttcgaggtctgccggctgtcgcggtcatgggaggccgacagcgagtaggaggcctcgccacgcttgcccagcatgccggaaaccccgctggtgagctgggttccgctgttgctgtcgcgggtcaggtagctgctcagggtcggcgacccgcgtcccgcgccgcccagcggaatggacaggttcaggctgaacagcgtgctggtctcgccgcgcttgtcaccgctggaaaagccttcgtagtggctgcgcaggcgttgcgcggaaatggagtaactgacgtcgcgccactggttgctgtagccgacggagaagttgaccgcccgcccgccgccgctccagtagcgctgcgaggagccgttcaggtacaggttgccgccgttgcccagttgctggctgatgttggcgtcgagacggttgcgcaagcgcgagaacgactccagcggctcgcctcgctctacccggtcctgcatgaaggccgcgtcgcgcaggccgagatagccaccggtggagtaacgataggcgagcagcgaaaagttggtgccggtgttcggcaggttcttgctgtaggcgagacggtagctggagccgctaaggcggtcgtcgccgggaacctcggtacgcgccagcgtcacgtcaccggagaatccgcccaccggcgtgttcagcgccgcgcccatcaacccggacatgtagctgccggtgaaggccccgcccgcgtatgcggtgacgtcgttgcccaggccgcgctggtagacgccctgcagcatgttcggccgacgctccaggctgggatcgttgagccgcccggccgtcaggctgtagcgcgtggttccggggcgcagcagttgcacggtggtggcgaacggcacgatgaaactgcggacttccccgctggcttcggtcacccgcacttccaggtccccgccatagctggcggtctgcagttcgtccagaccgtgtaa

SEQ ID NO: 9927 - DNA, 459 bp, Pseudomonas aeruginosa
tccgctcctaggcgacgatgctcgccaccttactcggtggagagcaggtccatggagtggcggtccatcatctccagcgcacggccaccgccgcgagccacgcaggtcagcggctcctcggcgacgatcaccggcaggccggtttcctgtgccagcagcttgtccaggtcgcgcagcagcgcgccaccgccggtcaacaccaggccgcgctcggcgatatccgaggccagctccggcggcgattgctcgagggcgctcttgaccgcctggacgatggtcgccagggactcctgcagggcctcgaggacctcgttggagttcagggtgaagctgcgcggtacgccttcggccaggttacggccgcggacgtcgacttcgcgaacgtcgccgcccgggaaggcggtgccgatctcctgcttgatgcgctcggcggtggattcgccgatcaggctgccgtag

SEQ ID NO: 9928 - DNA, 468 bp, Pseudomonas aeruginosa
acaacaccgttgagggaaatcagggcgatctcggtagtgccgccgccgatgtctacgaccatcgagccgcgggcctcctcgaccggcaggccggcgccgatggcggcagccatcggctcttcgatcaggaacacctcgcgggcgccggcgcccagggcggattcgcggatggcccggcgctcaacctgggtggacttgcacggcacgcagatcagcacgcgtgggctgggctgcaggaagctgttctcgtggaccttgttgatgaagtactgcagcatcttctcgcagacgctgaaatccgcgatcacgccgtctttcatcggacggatggcggcgatgttgcccggggtacggccgagcatgcgcttggcctcggtgcccacggcgacgacgctcttctggctgccatggctgcgaatggcgaccacggacggttcgttcaggacgatgccgcgctcgcgcacataa

SEQ ID NO: 9929 - DNA, 663 bp, Pseudomonas aeruginosa
acgctccgacgtggaaaaaatcgcccatctcgcccgcctgggcctgagcgaggccgatcttccgcgcaccaccgagaccctgaacaacatcctcggcctgatcgaccagatgcaggcggtcgacaccagcggcgtcgaaccgctcgcccatccgctggaagccacccagcgcctgcgcccggacgcggtcaccgagaccgatcaccgcgacgcctaccagaccatcgcccccgccgtggaagaaggtatgtacctggttccgaaagtcatcgagtcataaggacgcggacacatgctgcatcaattgaccctcgccgagatcgcccgcgccctcgccgacaagcaattttccgccgaagagctgacccgcaccctgctcggtcgcatccggcagctggatccccagctcaacagtttcatcagcatcaccgacgacctggccatcgcccaggccaaggcagccgacgaacggcgcgccaacggcgagaacggcgccctgctcggcgcgccgatcgcccacaaggacctgttctgcacccagggcgtacgcaccagctgcggttcgaagatgctcgacaacttcgtctcgccctacgacgccaccgtggtcgagaagctcaccgccgccggcgccgttaccctcggcaagctgaacatggatga

SEQ ID NO: 9930 - DNA, 1209 bp, Pseudomonas aeruginosa
attcgccatgggctcgtcgaaccagtccagccactacggcgcggtgaagaacccctggagcctcgaccgcgtgccgggcggctcctccggcggttccgccgcggcagtcgccgcgcgcctgctgccggccgccaccggcaccgataccggcggctcgatccgccaaccggcggcgctgaccaacctcaccgggatcaagccaacctacggccgggtttcccgctggggcatgatcgcctacgcttccagcctcgaccagggcggcccgctggcgcgcaccgccgaggactgcgcgctgatgctgggggtgatggccggattcgatccgaaggactcgaccagcgtcgaacagccggtggacgactacctggccgccctgcagaagccgctgagcggcctgcgcatcggcctgccgcgggaatacttcggcgccggcctcgacagccgcatcgccgacgcggtgctggccgtagtcgaggagctgaagacgctcggcgccacggtgaaggacatttccctgccgaacatgcagcacgccatcccagcctactacgtgatcgcgccggccgaggcgtcctccaacctgtcgcgcttcgacggcgtgcgctatggctatcgttgcgacgccccgcagaacctggaagacctgtacaagcgctcgcgcgcggaaggcttcggcagcgaagtgaagaaccgcatcatggtcggcacctacgcactctcggccggctactacgatgcctattacctgcaggctcagaagattcgccggctgatcaagaacgacttcgtcagcgcctttgccgaagtggacgtgatcctcggcccgaccacgccgaacccggcctggaagatcggcgagaagaacgacgacccggtttcccagtacctggaagacatctacaccatcaccgccaacctcgccggcctgccggggctgtccatgcccgccggcttcgtcgacggcctgccggtgggtgtccagttgctcgcgccctacttccaggaaggccgcctgctcaacgtcgcgcaccagtaccagcaggtcagcgactggcacacccgcaccccggccggcttctaagccatggcaacgccacgcagtcccctcccctctcccggcgcggagagggcgacccgcagggtcggcagcgggactacgcaggcacagaaggattgaggaacaccacatgcaatgggaaaccgtga

SEQ ID NO: 9931 - DNA, 765 bp, Pseudomonas aeruginosa
ccggcacccgcgtctgcggttgcagccgttccagatcgagcaaccaggccggtgcctggcgcgcctgccattagccgcgccaggcctccggctgcaaggcgaggcgctgcggctcgaaatacagcccgcaggagcgcaccagggcgcggtcacgaccgatcgtctggccattctcgcagcagtagacctcctcgcggctgcgcccctggcaggtatagggcggctcggcctggccggtgtcgctcagccaggcgaagacgaacagtttccacaggctgcccagcggagcctgcaaatcggccggcaacggccggcgctcgagcacccgctggcgatccaggctcaccagttcgtagccctgggtcgtgcgccaggccagctggaccggcgcctccgctgcgcgaagcagcaacggcacggcgcacagcaggaccagccaggcgcgcaacgcaatcactcgaccttgaccttggccagcgccggcttggcttccagggcctgctgttccggcgcgtagagacgcaggtagcgggccggtggcaggttgaagctgcctttctgggagaaacgcaccaggtgacggaaacgctgctcgccactcaggctgtccaccggcaccccgtagaacaactcgcccggttcgttgcgcgcgcgctccagggtggtcgcttcgtcgccggccaggccgctgatcttgatgccccaggtggtgcgctcgacatccgcgccgggcggcagcggcagttccagcatgccgtagcgtag

SEQ ID NO: 9932 - DNA, 2097 bp, Pseudomonas aeruginosa
gcgccagctccgggggcaggtagcggttggacaggccgttggcgcgcagccacttgccatcgtggactttcagcgcctcgttggcggcgaagcgcaccaggccggcgcagtcctgctggtgccagcgcggactcggcccttggcgcaactgttcctgggcgatgcgcacgaaccaggcgcggaatacctgcgattgctgcgggtcgagcgttaccgcgggctcgccgcgggcaacgccgctggccagcaggagcagcgccaggccgaaggcagtcaggcgtctcacagcgaccgccattccagcggcagccattgccacggtgcgttggcctggcttccggcaggcagcccgagggcgtagctgcccttgccggcgagggttttcaggcgcggcatcaggtaggtgtcggcggcattgcggaataccggctccatgtcctgcggcaggctgtcgagggtttcccgttgcagcagttcggagagcggctgcggcgccaggtaggccggtaccagcgcatccttcggcaacacctcggcgagcggcggatagcgtttgtcgagggtgtccagggccttgccgagcaactggtcgtcgagggagaacagcagggtctggccatggcgcgccatgccgatgcggaagaacgcgcggccgctgatgctctccgggttgtccgcctggctggccggataggcgccgaagttcgagctgacctggcgggtccagcggcgggtctggccatccacccggtcttccaccgggaagctgccaccctcgaccttggcttccttcgcgccgatcacgcgaccgaacagcttgcccagctcgtcgtcgagttcggcactggccggcgcgctcaactggcccaccagcagcggcgaatgcagccgcgaactggcgtaccagcagagaccggcagcgccgctgagatgctcggagaaggcctgggccatcttctgctcggcccccagacgctccagcatcaccccgtacaggccaggggtgaccggcagcgccacgcaggcgctggcgcccatcggcatggcctgccagaccggggcgaagtccagcggcggctggcgttccacctcgttcagcgccaggtagctgctccagccctgctcgcccttctcgaagcgcaccccggcgaagctcgggatgaagcgctggtagcccatggccaggacgctggcattgagggtgatgcgctggcgcagctcgccgcggcccggcaggccgaagcgctcggggaacagttcgtcgccgtcgagcagtgcctccaggtcttcgctggccggagcgttcagcgggctgtcgtcgctttcgccaccatcgtcgaagagcatccgtgggttcgacagcaacaacagccggtcgcccttggacaggaacagcatcgccttgtcgttgccgtagcgcaggcgatagaccgaggttcccgccaactcgccgaccttgcgcaactgctggtcgtcggcggcgatatgggccagcggctcgagcacccgcgccaggccgccgcgcttgagcaccaccacgaagtcgcgcaggcggccgtcggcgccgcgccagagggcgacctgggccggttggtcgagcagttcctcgaccaggctgtccttcagggtcaggtcgtgctcgtagatgatccgccgcaacgtaccggtcaggccgaggcggtcgccattgttctcgtaatagaagacgaagtcctcggtcagggtatcgcgcagcaacggcacctcgaggatttccttcggcaggcggctcagcgacacgctctcgatcagcgcgtcgggcttgcgcaggtcacggtaggcacgtggcgcgtcggcgtccgcgggtgcctgggcgccgatcggctggccgaggtcctcttcggccgggcgccctccgccgagccgctccagccagcccatctgccaggccagcacaccgccggcggccagcgcggcgacgatccccagcaccggccacagggcgcttcgggtgcgcgcagcggcgggcgcaggggttccgttggcagggctgggggtgttgttctcgctcatggttcgctaatcccgtgtcatccgtacgaggggatgcttcagtag

SEQ ID NO: 9933 - DNA, 1068 bp, Pseudomonas aeruginosa
agctggactgatcgctgcgccgcacgcgggaagccctggtccttgccttcccgcgtgcggcgttatcgttcggccggatcagccgccgaggccgaagggatcgtcgatggacgggctcggttgggtgaaccagcgcggtccttccttcgtcatgtagaagtgatcctccaggcgaatgccgaactcgccgggcacgcagatcatcggttcgttgctgaagcacatgccgacatccagcggcgtgcgatcgccacgcaccaggtacgggccttcgtggacgtccatgccgatgccatgcccggtgcggtgcggcaggccaggcaggcggtagtccggtcccaggccgttggcctccagcgaacgccgcgcggcggcgtccaccgcctcgcagggccggcccagacgcgcggcctcgaaggccgccagttgggcgtcgcgctccatcccccagaattcgcgctggcgtgcgctgggcgtgccgaacacatagctgcgggtgatatccgactggtagccgtggacctggcagccggtatcgatcagcaccatgtcgccatccttcagcacctgcgcatgcttcaccccatgggggaaggcactggcggcaccgaacaggacgatgcagaaggtcgaaccgggcgcgcccaccttgcggtgcgcctggtggatgaactcggcgacttcggtggtgctgatgccttcgcggagaatgctcgccgcggccttctgcacttccagggtcatgtccttggcccgctgcatcagcgccagctcctcggccgacttgcgcatccgtccctggtcgatcagcggcgcggcgctgacgaagttcctgcccggcgcctgttggcgcaagcgctcgaacatgccgaacggcaggctcggacacagtgcgaccgtgctgcgctcgcccacgccgagcgcctccaggcgatcgagcagcaggcgatagggatcctggtgttcctcccaggtgtggatggcgccatcgaccacctggaagtcgcgcaccgtaccttcctcgaaggccggcgcaaggtattcgagggcgccctcggcgggcagtag

SEQ ID NO: 9934 - DNA, 609 bp, Pseudomonas aeruginosa
cgccccgcgctgggtatactgcgcctttcaacaagagtctccccaatgaccgtagaccgcatcggcgaacgcctgcgtcgctatcgccgcgccgccaagaagaccctgcaccaagtcgccagcgaatccggtctcaccgcgagcttcctctcccaggcggagcgcaacctcaccggtgtatcgatctcttccctggccaacatcgccaagtcgctgaatatcccgctcaatgccctgttcgaccaaccggcacaaccccagcccgactcccacgaaggcgagcgggtacgctacaccatcgagggccagccgctggcctacgaacgcctgtccagctccttccccggcaacctgatcaatgcggtcaagatgaacatgccggtgggctaccagtcggagctgatctcccatgagggcgccgagttctcctacgtcctgtccgggcagatcgtctacaccatcgaggggcgccagtaccccctcggcgccggcgactcggtgcacttcgacgcgaccaagacccattgcctggccaacgtcggcagcgatgtggcggaagtcctgaccatcaccaccatgggcctgttcgacgaccatccgacgccctga

SEQ ID NO: 9935 - DNA, 1491 bp, Pseudomonas aeruginosa
aacaggtgccatgacaacaataaagggagcaatcaggtgatgagataccaacgagtgaccggcgcgacgctgggattggccttgatggcatcggccgcgccaggctgggcagcggacgagcaggcaaccccgccgaccccggacaatcccagctacgccgcccaggtgcagagcatccccagcgtggagaaaccgatcaagggccaggccggcgccagcgggctgttcgaggggcagagcctgaccctgaccacccgcaacttctactcgcgggaaaacatgaaggacagcttcaccttccgcattcccaaggccggcggcggctcccagcgcatccaccagcgcaacgcctgggtccagggcacggtgctcaagtacagctcgggctacacccagggcagcatcggcttcggcttcgacgtcgcagccttcaacgagatcgccctggagcgcggcaagggccgcatcggcggcggcggcaaccggaccctggcgaacagcgatggcgaggcgatcggcgagtggtccaagctgggcgtcgccaacatccgcctgcgcgcctcgaataccgaattcaaggccggtcgcttcctggtcaacactccagtgttcagctatatcgacaaccgtgccctgccctccagcttcaccggcttcgccgtgaccagcgaggagctggacaacctcagcctgcaggccggcagcttccgcaaggtcagcccgcggaccggttccggcgacgaggacatgaccaccgagtacggcacccgccaggtcaagggcgaccgcctgaactacctgggcggcaactacaagccgctcgacgggctggaaatctccctctatggctcgcatttccaggacgtctggaaccagtactacctgggcgtgacccacgacatcggcgacctcgagaacggcatcgccctgcgcaccgccttcaacggctaccacaccggcgacaccggcgcgcgcgaggccggctacatcgacaacgacacctggagcctggccttcactctcggccatcgcgcccacgccctgaccctggcctaccagcaggtcgacggcaacgaatacttcgactacgtgcacgagacctcggcgatcttcctggccaactcgatgctggccgactacaacagccccaacgagaagtccgcgcagatccgctacgagaccgactggagctactacggggtccccggcctgagcaccggcgtgtggtacgtgaagggctgggacatcgacggcacccactacgacggcgatcgcaacggtgcctacggcaactacgccgaggtgcgcgcccaggacggcgagaagcaccacgagctgggcctgatggcggcctacaaggtgcagaacgggccgatcaaggacagcaccttcaagctcacctacatgatgcacaaggccagccagaaccaggtcgacggcagcgtcaacgaactgcgcctggtcagcaccttccccttcaacctgctgtaa

SEQ ID NO: 9936 - DNA, 1020 bp, Pseudomonas aeruginosa
tgtgctgtggaccttccagcgcgccctcgatccgaagcatccctggcatgcctcggcgctgcgcggctacgcctacttcgacgcgatgggcatgggcgagctgatcaagtcggtggaaaaggtcgacgagctcaccgtgcgcttcgtcctcaaccgtcccgaagcgccgttcctgcgcgatatggcgatgcccttcgcgtccatctattccgccgagtacggcgaccagttgctcgccgccggcaagcagggccagctgaacaaccagccgatcggcaccgggccgttcgtcttcaagcgctacgccaaggacgcccaggtccgctatacggcgaacccggactactacgccggcaagccgccgatcgacaacctggtgttcgccattaccctcgatcccaacgtgcgcatgcagaaggtccgtgccggcgagtgccaggtctcgctgtacccgaaaccggaggacgtgccgcgcctgaagcaggacccgaacctggcggtggacgagatcgatgccctgctgaccacctacattgccatcaacacccagcacaagccgctcgacgacccgcgcgtgcgccaggcgatcaacctcgcgctggacaagaaggccatgctcgacgcggtgttcggccccggcgcggccagtccggcggtcggtccctatcccccgaccctgctcggctacaaccattcgatccaggactggccgcacgatcccgaacgcgccagggcgctgctcaaggaagccggcgcggaaaatctcaggatcaccctgttcattcgcaacggcacctcgcctaccatccccaaccccgccctggcggcacagatgctgcaggcagacctggccaaggccggcatccagctgaccattcgttccctggaatggggcgagctgctcaagcgttcgaaggccggcgagcacgacctgtcgctgcttggctgggccggcgacaacggcgacccggacaacttcctcagcccgaacctgagctgcgccgccgccgagtcgggtga

SEQ ID NO: 9937 - DNA, 1116 bp, Pseudomonas aeruginosa
tcgacgccatcagccgtcgcgactacccggtggtgcagaacggcatcctgctggtcgccaccctggtcatcttggtcaatttcgtcgtggacatcctctacggcctggccaacccgcgcattcgccaccaacgctgatgagccagccgatgaacgccatgcacaacgctcccgccagcgacccgagcctggtctacccgtccccgctgaaggaattctggcaggccttcgcgcacaacaagggcgccctcggcggcctgctgttcatgctgctgatcgtgttctgcgcgctgttcgccccctgggtcgccccctacgatccgagcgagcagttccgggacttcctgctgaccccgccatcctggctggaaggcggccaggcgcgcttcctgctcggcaccgacgagctgggccgcgacctgctctcgcggctgatccacggcgcccgcctgtcgctgctgatcggcctgtcctcggtggtgatctcgctgatccccggcatcctcctcggcctgctcgccggcttctcgccgaaccgtgccgggccgctgatcatgcgcctgatggacatcatgctggcgctgccgtcgctgctgctggcggtggccatcgtggcgatcctcggcccgggcctgatcaacaccgtgatcgccatcgccatcgtctcgctgccggcctacgtacgcctgacccgcgccgcggtgatgaccgagctaaaccgcgactacgtcaccgcctcgcgcctggccggcgccggcaccctgcgactgatgttcgtctgcgtgctgccgaactgcatggcgccgctgatcgtccaggccaccctgagcttctcttcggcgatcctcgacgccgccgccctcggcttcctcggcctcggcgtgcaaccgccgacccccgagtggggcaccatgctcgcctccgcccgcgactacatcgagcgcgcctggtgggtggtcagcctgcccggcctgaccatcctgctcagcgtactggcgatcaacctgatgggcgacggcctgcgcgacgccctcgatccgaaactgaagaacgcggcatgaggagcacaaccatgaacagcgcatccgtatccgcgccacaggagaccgccgcatga

SEQ ID NO: 9938 - DNA, 480 bp, Pseudomonas aeruginosa
ccaccgcatcctcgccgccctccagcgcgacggccgcctgagcaacgtccagttggccgaggagatcggcctctccccgtccccctgcctgcgccgcgtgcgcctgctggaagaggccggggtgattcgcggctaccaggccagcatcgaccgcgacgaggtcggcctcggcctcacggtgttcgtcgggatcaaggtggaacgccaccgccaggagcaggccgaggccttccaccgtgcggtggtcgacctgccggaggtgatctcggtgcacctcgtctccggcgagtcggacttcctcctgcaagtggtggtccccgacctgcgcgcctacgaacgcctgctcagcgagaccctgctgcgcctgcccggggtcagcgacattcgcagcaacttcgcgatcaagacggtcaaggcgccctcgccgctgccgctcggccacctggccggctgagcgctcagccgcggaagaagcggtag

SEQ ID NO: 9939 - DNA, 963 bp, Pseudomonas aeruginosa
cgccttcgccgagcccctcgcgcagacgtctggccagctcggccaggcgcacagacaggtccacttcgggctcttcggcgagcgtcagcagcagggcttcggcaccagcgggttcgatgcggatcacaggctgtccagggccgcgcgcaggcgccggaggaccgccagcgactgcgggttgtcgccatgcacgcaaagactgtcggcggtcaggcgcagcgggttgccgtcgtagtcggggaaggcttcgccgcgggcgatggccagggcctgttcgatgatccgctgcggatcgtgatgcaccgcgccgccaagccgccgcggcgccagccgaccgtccggcaggtaggcgcgatcggcgaaggcctcgaacagcagcggcacgtcggcctcgtcggccagttccagctcgcggccgttgtcggccagggccagcaccatcagcggcaggcccttgcgataggcggcgcaggcgtcgagcacggcgcgcagcagctcatcatcgccgaccaggtcgttgtacagcgcgccatgcggcttgacataggccacctgggcaccgagggaacggcagaaagcgtccagcgcaccgatctggtacagcaccatggcatgcacctcttcggcagagcaggccagcgagcgccggccgaagccgctcaggtcgggataggccgggtgcgcgccgatgctcacgccatggcgtaccgccagctccaccgcgcgccgcatggtgagcggatcgccagcgtggaagccgcaagccaggttggcctggtcaaccagcggcatgctgtggacatcgtcgcccatgcgccaggcgccaaagctttcgcccatgtcgcagttgagcaggatacgccggccggtgtcgttcattgtgcgttcctttcgaggccaggattacggaaaaatgagcgcagtgctggcgaattagcgtcaggtagcatactcaggcactga

SEQ ID NO: 9940 - DNA, 933 bp, Pseudomonas aeruginosa
attctcctcttttgcaccgacgaccttgcattcatgaaagttctcatcctggcggcctatgcgctgagcatcctctatgtccatttccgcggccgggtacgccacaagctgtcgcgccaattgagcgaccactccagcttcctcgctccgatcaactgcctgatgtacctgttctcgaaggtaccgaaccgcccttacctggcaccgcagaccttccccgaactgcaggttctggtcgacaactggcaagccatccgcagcgaggcgctgcacctgcacgacgccggcaacatcaagcgttccgaacagtacgacgatatcggtttcaactcgttcttcaagagcggctggaagcgcttctacctgaaatggtacgacgaggcccatccctccgccggacaactctgcccgcagaccaccgccctgttgcggcagattccctcggtcaaggcggcgatgttcgccgaactgccgccgggctcgaagctggtgcgacaccgcgatccctacgccggctcgctgcgcttccacctgggactgttcacccccaacgacccggcctgcttcatcgaggtggacggcgagcgctaccactggcgcgacggcgaggcggtggtgttcgatgaaaccttcatccactacgcggaaaacgccaccgaacacaaccgcatcattctcttctgcgacatcgagcggccgctgacccagggctgggccaccgccttcaaccgctggttcagccgcaacgtgatggctgccgcggccgccccgaacaacgcaggcgaccggaccggcggactcaatcggatcttcgacagcctctacaagatccgcctgcagggcaaacgtttgaagaagcgcaaccgcaagctctactacctgcagaaatggggcttcttcgccctggtactggctttcatcctgtggatctga

SEQ ID NO: 9941 - DNA, 2232 bp, Pseudomonas aeruginosa
ctggcaacgaaaaggctcccttgggagcctttttcattcatccgttcagtacacgtcgcgtcggtaacgtccttcgtcggccaggcgttgcaaggcctcctcaccgagcacttcgcgcagtacccggtcgacaccaccggccatgccctgcaggctgccgcagacgtacaaggccgcgccctcgtcgatccagcgccgcagttcatccgccgcttcatgcaggcggtcctggacatagatcttctccgcctggtcgcgggagaaggccaggtccaggcgttgcagctcgcccctggccagggcttgctccagctccgcacgacagtagtagtcgtgggcgaaattgcgttcgccgaacagcagccagttgcgcttgcgcccggcggcaatgctggcgcgcaacaggctgcgcaggccggcgagcccggtaccgttgccgatgagaatcagcggcacgtcatcctccggcaggtggaaacccgcgttgcggcgcaggcgcagggtcagcgcggcgccgagcggcaggtactcggtgagccagccggagcagatgcccaggctgccgtcggcatgctgctcctggcgtacgatcagttgcaggtcgccatcgctctgcagcgacgcgatggagtactggcgcacggaaagcggaatcagcgcatccagcagcgcctgcgggtgcaagccgaccaggtgttcgaaagaatccggcagcaggcgcccggccagggcctgctccaggctctgctcgacgccctcgaccgccacccgcacctggccgtccaggtgatgccgctgcagccattcgcggatgcgcgcgggcgcctggtgcggaacgatctccagcagatcgccggcgcgccattggatggcgctgtcggccggcgcacgcaggtccagcagccaggtcgactcgccctggctgccaggattcaggcactcccgccgcgccagcgaccagacctcgaaggccggcgcttcccaggccgccggggcggcaccgccggtcacctcggccaggctttcctgccattggcgcagggccgcggcgtcgccatcatcgacctccaccggggcgaacaggctccgcgcgccctgcccctgcaaccagccctgcatgcgccgggcgaagccgcagaactgctcgtactggcgatctcccaaggccagcagggcgtagctcaggccatcgaggctggcggcctggccaagcaccttgcgttcgaagccgcgggcgctgtccggcgcctcaccgtcgccgaaggtgctgaccacgaacagcgccttgcgcgcctcggcgagttgcccggcatccaggcgcgccagcgattcgacccgcaccggcaacccggccgcctgcaactggccggcgctctgccaggccagttgctcggcaaaaccgctctggctggcgtagccgatcagccagggctcgccgctggcgccggcgctgctgcccaggtcggcgcggctcgcccgtactgcgcgtttcttgcgccggcggtcgaggtagagcagccagccggtgatgaagaacagcggcatcgccaggctggcgagcatcatcaggatgcgtccggccatgccgaaatagctgcctacgtgcaatgcatagacgctggccagcaactggctgccgaaagaacggtcgctatagcgttggtcgcttttcacctggccgttggccgggtccagggtcagggtgttgaaggcacgctcgtgcggcgcgtcggtcaggcgatagaacactgtcgccggctggccgcccgccggcggcaggcgcaggttgtaggcctgcaagcggtcgccgccggcctggcggatgctgttccataccgccgcgtagtcgaccaccagcggagccgcatcggccgggcgctcgccacgtccgcccggcttgccgcgctgcgcctgctggccggcgggcgcgtcgtcgagcagtttgaacaggccgttgcggtaccactcgtaggaccagtacaggccggtcagcgcagccagcaggtagagcgccaggcaccaggtgccggccacggcatgcaggtcccagttgaaactgcgccccttgcgcgaccagtcgagggtcagccaggcgcgccagtcgaaaaccttgcgcggccagcgcaggtagagaccggacaggcagaagaagatcaggatcagggtgcaggcggcggtgacctgcttgccgtactcgcccatggcgaggaaccggtgcagttgcatcattag

SEQ ID NO: 9942 - DNA, 732 bp, Pseudomonas aeruginosa
ccaatgcaaatcaatatcattggcaatcatttcgccttcatggacagcgccatgttgctgcatattcccgccatcttcaccgccgaggaagtctcccggatccgcgcagccctggagcaggcggaatgggccgacggcaaggcgaccgccggctaccaatcggccaaggccaagcacaacctgcaactgccgcaggaccacccgctggcccgggagatcggcgaagccatgctgcagcgcctgtggaaccatcccctgttcatgtccgccgccctgccgctcaaggtcttcccgccgctattcaactgctataccggcgggggctcgttcgacttccacatcgacaacgccgtgcgcgacgtccatggcggccgcgagcgggtccgtaccgacctgtcctcgaccctcttcttcagcgacccggaggactatgacggcggcgaactggtgatccaggacacctacgccctgcaacaggtgaagctgcccgccggcgatctggtgctctaccccggcaccagcctgcacaaggtcaatccggtcacccgcggcgcgcgctacgcctcgttcttctggacccagagcctggtccgcgaagacagccagcgcaccctgctattcgaaatggaccagtcgatccagcgactcacccgcgacgtccccgaccatccctcgctgatccgcctcaccggtacctaccacaatctcctgcggcgctggtcggaactctga

SEQ ID NO: 9943 - DNA, 558 bp, Pseudomonas aeruginosa
atatttcagccagtacttcaacccctggatgactctcggcctggtgctctacagcctggtcgccatcctcctctggcgccgcctgcgcccggtctacctgccgcgcttcagcgccctgccggtggcggtgctgctgatcgtcgcgaccatcggttatccgttctacaagcaactggtcagccagggccgacccttcgacgaagccctggacaaggtccaggcgcgcatggaaccggcggtgccctggcaattgctgatcggctaccagcaataccgccagcaactgggcagcatgcaggcgctgttgcaaaagaacgcggccctaccaccgctgaagaacctcgtcgatgccaatggcgatacgccgcgcacgctggtcctggtgatcggcgaatccacgtcgcgcaagcacatgagcctctacggctatccacgcgaaacgaccccgcagttggacgcactgaaggccgcgaaccggaacctcacggtattcaacaacgtggtggcgtcgcggccatacaccatcgaggtgctgcagcaggtgctgacgttcgctga

SEQ ID NO: 9944 - DNA, 207 bp, Pseudomonas aeruginosa
agtccgctggatcggcaacccctatgcccacaatggcttgcgcgacttcgacaagctgccgctggacaaggccgacgccgggcagcaggtagcccaggccggacgacccgcgccaacgacaccgcgcgcaccgtcccgccagccgaacgaaggctgaccgccgccaaagaaaacgccccgccgagcggggcgtttttccatccgtag

SEQ ID NO: 9945 - DNA, 1446 bp, Pseudomonas aeruginosa
aaaagccccgccgaggcggggctcttcgtagcagaggcgactgcgctagaggtagaacgccttcagcggcgggaagccgttgaactccaccgcactgtagctggtggtgtaggcgccggtagacagccagtaaaggcggtcgccgctcgccaggttcagcggcaggccatacttgtagtgctcgtacatgatgtcggcgctgtcgcaggtcgggccggcgatcaccacctcttccatctcgccctgcttctcggtccagatcgggaacttgatcgactcgtccatggtttcgatcagtccggagaacttgccgacgtcggcatagacccagcgctccacggcggtccgcgacttgcgggcgaccagcaccacttcgctgaccaggatgccggcattggcgatcagcgaacggcccggctcgaggatgatttccggcaggtcgtcgccgaagtcctccttgaggaagcggatgatctcctccgcataggtttccaggtcgttggtcttggtgatgtagttggccgggaagccgccgcccatgttgatcatcttcaggacgataccgtcttcttccttcaggcgctcgaagatcaccttgaccttggcgatcgccgcgtcccacaccgagatgtcgcgctgctgcgaaccgacgtggaaggaaatgccgtagggctccaggcccagctggcgggccaggatcagcaggtccatggccatgtcggtctggcagccgaacttgcgcgacaacggccagtctgcggtagtcgagccctcggtgagaatacgcacgtagaccttggcgccgggagcggccttggcgatgttgcgcaggtcggcttcggagtcggtggcgaacaggcgcacgcccttctcgtagaagtagcggatgtccttggatttcttgatggtgttgccgtagctgatgcgctccggaccgacgccggtcttcatcaccttgtccagttcgtagatcgaggcgatatcgaagttcgaacccttgtcgcgcagcagctcggtgatttcggtagcgggattggccttcaccgcgtagtagatcctggcgaaggggaagcagtcggtcagttggtcgtaggcatcggcgatggtctgcttgtcgatgactacaaagggggtttcctgcttgtcggcgaaggccttcatgcgctggaaggtttcaggggcgaaataatcctcgaccttgatggacatggttgggactcccaatggcaaaacacatggattcgtaggggtgaagctgaacgtctaatccgtttccccactttggttcgcctacttcccaaggcatgtcgccgagtatcacctgcctgccggcagccaccgcctgttcatcctggtaggtcgcgcgcgtgtcccgcgcgacgacctggccgcttgagcagcggacgtcgccttgccacaaggcgatctctcgtcgtcagtacttga

SEQ ID NO: 9946 - DNA, 789 bp, Pseudomonas aeruginosa
cgtcgccgcggccgagactgtagaccaccaccagaagatgcagcggaaggctcagccagccataggccaacggctgcagcaatgtcagcaacagggccagcggcagcaacggcaggactaccgcgagcagcagccccagccaggagcggcgggacaccgagggcagatcctcgaccaggctcagccaggcgagccaggcgccatcgcgctggatacgccggcgccagccggagaacttctccagcgcaagggccagcagcaacaccaggaacgtcatgtttcctccttggaatcggtcaatccggcgcggtagcgcgaccagtcgaaagcctcgccgggatcggtcttgcgctccggggcgatatcgcagtggccctggatgcgttccggggtgatccccgggaaggccgcgcgcaacagccgcgtcagcccggccagggcagtgtactgcgcgtccgtgtacggttccgtgtcggtcccctccagttcgatgccaagggagaagtcgttgcacgcctcgcgaccgtcgaagcaggaaaccccggcatgccaggcgcggtcgtgacaggagacgaactgggtgatggcgccgtcgcgttcgatgaggaaatgcgcggaaaccgtcaggtggcggatctcctcgaaatagggatgttcgttcgggtccaggcgattctggaagaacgcctggaccttaccggtgccgaactgtcccggcggcaggctgatattgtggataaccagcagcgacaccgcgtccccttgcggacgcaggttgaaattcggtga

SEQ ID NO: 9947 - DNA, 879 bp, Pseudomonas aeruginosa
tcatcgctatgtatctaccgatcttccaactgggttccgttgtgtaaagatggaactcctagactacctggccagccatccgctggcctttgtcttgtgcgctatcctccttggcctgctggtcggcagcttcctcaacgtcgtcgtgcatcgcctgccgaagatgatggagcgcaactggaaggccgaagcccgcgaagcgctcgggctggagccggaacccaagcaggcgacctacaacctggtgctgccgaattcggcgtgcccgcgctgcggccacgagatccgcccctgggaaaacatcccgctggtcagctacctggcgctgggcggcaagtgctcgtcctgcaaggccgccatcggcaaacgctaccccctggtggaactggccaccgcgctgctttccggctacgtcgcctggcatttcggcttcacctggcaggcgggcgcgatgctcctgctgacctggggtctgctggcgatgagcctgatcgatgccgatcaccaactgctgccggacgtgctggtgctgccgctgctctggctgggcctgatcgccaaccatttcggcctcttcgccagcctcgacgatgcgctgttcggcgcggtgttcggctacctgagcctgtggtcggtgttctggctgttcaagctggtgaccggcaaggagggcatgggctacggcgacttcaagctgctggccatgctcggtgcctggggtggctggcagatcctgccgctgaccatcctgctgtcgtcgctggtcggggcgatcctcggggtgatcatgctgcgcctgcgcaacgccgaaagcggcacgccgatccccttcggtccctatctggctattgccgggtggattgctttgctctggggtga

SEQ ID NO: 9948 - DNA, 651 bp, Pseudomonas aeruginosa
tcaaataacccggacctatctgcaattcgccggattcaaatgacccaaccctggatactaggcctcacgggcggtatcggcagcggcaagagcgcagccgccgagcatttcatttccctcggcgtccacctggtggacgccgaccatgctgcccgctgggtggtggagccggggcgtccggccctggcgaagatcgtcgaacgcttcggcgacggcatcctcctgcccgatggccagctcgaccgagccgccttgcgcgagcggatcttccaggcgccggaggaacggcgctggctggagcaattgctgcacccgctgatcggcgcggagatcgtccagtacctggccagggccgaatcgccctacgccatcctggtctcgccgctgctggtggagtccggccagcgccagatgacccaccgcgtgctggtggtggataccccggaacatctgcaactacagcgcaccatgcttcgcgacaaggtctccgaggagcaggtgcgctcgatcctccaggcccaggcccggcgcgacgagcgcttgaagcacgccgacgacgtgctggtcaacgacggcgacctgtcccacctgcagcgtgaagtcgaacgactgcacgccttctacctgaccttgcgaggaggccgagcatga

SEQ ID NO: 9949 - DNA, 552 bp, Pseudomonas aeruginosa
ccagcttcgagccgcccatgtcccgcgccaccagcaggacccgggtggagtcgtccagcgagtgcgccttttcgaactggtcctgcaacgtccagggttccagggtggagcccttctccagggccagtgccaggccgggcagcagcatggccagcagaacccaatgcaatcgtttcacgcgtgtccctcccgagtggaaaatacctggatgtccttgcgccgctcccagtccgactgggctcgccagaatgcctgggcctcctcggcggcatccaggacgaagacatgggatttgccgatcccctccctcgccaggcgtgccaacacctcgtcgagcatccgccgcgccagccccagccctcgataaccgggatcgaccaccaggtgctggaggtaaccacggcgaccgtcatgcccggccatcaggcaggcgatcacctccccttcggtttcgaccagcaggctcagcccggggttgcgttgaaggtaggcgaggaagaagggataggcgtcctccgcacggaggcggatacctggcgttcgcgaccatag

SEQ ID NO: 9950 - DNA, 639 bp, Pseudomonas aeruginosa
gctgagcccatgaacgaagcggattatctgcgcctgctcacccgtcaggccgaacaagccaacgacttcctctccaacgcacgtaaatgggaccgcgagcgctgggtctgccagcgcttcctcgaagccctcaacgtgccctatcgccaggaggacttcgccgcccccggggaacagccgccggacgtcatgttcaagggtgccggcttcgaggtgttcttcgtcctcgatgaaggtcgccggctgaacgaggagtggcgcgaggaactgacccgtcgccgccaggccgtcagcctgcgccaactgatccgccgcgaagagcggccacaacggatcgccgccgccgagctgcaggcacggctggcgccaaccctgcgcaagaaggcgcacaactatagcgagcgcggcatcgaccacggcgaactggacctgctggccttcgtcaacctgaagcgcgcggtgcccgatttcaatacgcccttcccgccgcccaccgaatacctgcgccaaggctggcgctctctgtcgatggtcggtccgacctttgcccgggtgctcttcgctcactccggcgcccccgaattcctgcgcgccaacctcggccgcagcatcctgttcgacgccggggtaggcctgtga

SEQ ID NO: 9951 - DNA, 201 bp, Pseudomonas aeruginosa
aatgaccgacatcgaaaacggaggcctgccatgtccagccgactgagccccgaagaccagcagaaggtcgagcagtacctcgcctcgccgctgcaccaggtcgagcgtgcgccgttccgcccgtggttcctgatgttcgtcctgctcgccgtggtcatcggcctgggcctgctcagccgcctcctcagctacctggcctga

SEQ ID NO: 9952 - DNA, 1317 bp, Pseudomonas aeruginosa
gatatccacatgtcccatcgcatcgtgatcgtcggcggcggcgccggcgggctggagctcgccacccgtctcggccgcaccctgggtaaacgcggcaaggcccaggtcaccctggtcgacgccaacctcacccacatctggaaacccctgctgcacgaagtcgctgccggctcgctcaactcctccgaggacgagctgaactacgtcgcccaggcgaagtggaaccacttcgaattccagctcggccgcatgcagggcctggatcgcgccggcaagcgggtccgcctggccgcactggcggacgagaatggcgttgaattggttcccgagcgcgacatcgcctacgacaccctggtgatcgctgtcggcagcaccaccaacgacttcggcaccgagggcgctgcggaacattgcattttcctcgatacccgcgcccaggccgaacgcttccaccgacaactactcggccagtacctgcgtgcgcataccgggcacgacgcgaacaacaacgcagtgagtatcgccatcatcggcgccggcgccaccggcgtcgaactggctgcggaactgcaccacgccgcgcagatgctggccgcctatgggctcgaccggatccgcccggaagacctgcacatcagcctggtcgaagccggcccgcgggtgctgccggcgctgcccgagcgtatcagtcagccggtacaccagaccctgagcaagctcggcgtacgggtgatgaccggctccgcggtgagcaaggtagatacggacggcctctggaccggcgacggcgagttcgtcccggcgacgctcaaggtctgggcggcgggcatccgggctccggccttcctcaaggaactcgacggcctggaaagcaaccgtatcaaccaactggtggtccgcccgaccctgcagaccacccgcgacgatgacatcttcgccttcggcgactgcgccgcctgtccccagccggcgcaaccgggagagcaaccgcgcaacgtgccgccacgcgcccaggccgcgcaccagcaggcctcgctgctggtgaaatcgctacatgcccgtctcgaaggcaagccgctgggcgaatatcactaccgcgactacggttcgctgatctcgctgtcgcgcttcagcgcggtcggcaacctgatgggcaatctgatgggtagcgtcatgctcgaaggctggctggcgcggatgttctacgtatcgctataccgcatgcaccagatggcgttgtacggtccgctgcgcaccgcgatgctgatgcttagcggccgcctgcgcagcaccgagccacgcctcaagctgcactga

SEQ ID NO: 9953 - DNA, 204 bp, Pseudomonas aeruginosa
cagttcatcgagcgcaccgcccagggcatcgggccgcccctggcggcggaacatgccgtcatgaagccggcgaaagaacgcatggaaatgcgtccggcgcaggccctgcaaatcggcgctgcgaaagaagccatccatcagccagctcttgccgcgcccgaccggcccccacaggtagaggctgcgcggcgcttgccggaatag

SEQ ID NO: 9954 - DNA, 477 bp, Pseudomonas aeruginosa
gcctgtccacccagttgcaatatgaaaacaagcgacttcgcgatgaccaggagcgtaccgggaggcatagccgcaaggagatccgcctgtggaccgccagcatcagcggaaacgcccaggaccgcttgttcggcggtggacagagcggcttctcgctggcctatgcccacggccagctcgccatcgactccggcgaagagcggctgctggaccgctacaccatcggtaccgccggcagcttcgacaagatcatgctcaacgccgtacgcctgcagcacctgggcgaccgcctgcagttgttcgcccaactcaacgcccagtggagcggcggcaacctcgacagcgcggaacagttcgacatgggcggcccctacggcgttcgggcgttccccctgggcagctacaagggctacggcgacgaaggctggcaagccagtgcggagctgcgctacagcctggctccgggctggcagctga

SEQ ID NO: 9955 - DNA, 765 bp, Pseudomonas aeruginosa
cagcactggtcaagggagggcgctgacatggcgaagcctcctatcacccaagcccgcgacgtcgacgcggaacttgtgctgcaactgaacaagttcggcagcgccgccgaccttcggagccaacaggccaagttgaccggcgctgcgcgagaaatacgcaagctgactggtggcggtaccgacctgttcgggaagctgggttgctacttgagcttcgagcaaaagcagctcctacaagacgctgcgcgcttgctcgactcggtgaaccagcaggtcgagcatgcgaaggaaaagcgtgatcgcgacgagaaacaggccaagaagcggcgtgagctgcgcgggcgcctggccaagcaactggtcgactcgaactacccgcttccgggaaatacgctcgaagagcggctggaaatcctgcagatcgcgttgatctacaaccgggccaaggtgttcgatcccctgtactccacgcaccagctccactcaaaactcaaacgctggctggagcgtcccaagcagctcatcgggtggcacagtgaagccgagtatttcgctagtcaggtggggagcctgcgatgtgacttcattagccatctgactcacgaaatcgcctacgacgatggcagtgaagtcgaggagcgcctgcgcgtcatcaagcagaaggtcgctgactgcaccgcacagatcgctctgaccagcgaggagcaggaaacccttcagctctggacagacgctctgcaatcggctccggagggcctcatatga

SEQ ID NO: 9956 - DNA, 285 bp, Pseudomonas aeruginosa
ccaggcttcgctgcacgcaggctgggagcacggcaaaaacactcgcctgcaccgcggcgtcagccggcgagttcagggcgcgctcgagcagggaggttcccgatgactcgcaaggacaacaacaagcagaacgtcgtcatcgacaacctggagctcatcacccgggccgaacgcatgcgccgcaactccatccatcgctatccacctgagctgaagagcgcaatccgcgtcatcagcaagctcaagcgcaccattcaggaggtcgagcatgaaaaacaagattga

SEQ ID NO: 9957 - DNA, 1536 bp, Pseudomonas aeruginosa
tcacctctttgccaccatcgaagggctgctggacgaagacaagcccctggatatcgaacgcgcgaaagcggtggctcatgtgggttcggtgatcatcgagtccgccaaggtggaggtgaaagcgctggagatcatcggcgccccgggcagcagcggaagcacattcctgcagatcggccaggaggactcgaagtgagcgcgctggagcttactcctcctcactcagtcgaggcagagcaagcggtactcggtggcctgatgctggacaacgcggcatgggacattgtcggcgatcacctgcataaagaggacttcttccggcatgaacatcggctgatcttcaccgccatcagcgagttggccgcgaaggacgccccgtttgacgtcgtgacggtgtcggaagcgatcgaagaccttccagaagccggcgggctggcctacctcggccagctcgctgacaacacgccctccgtggccaatatcgaggcttacgcgcagatcgttcgcgatcgggcgcacctgcggcagttgatgtctctcgggcaccactgcaccagaaccgcctcgaaccaccaggcgaatccctgtgaggttcaggaggagatcgagcagaagctgttcgccctcggccaagatcagcacaagtccgactttgtcgatatcaacaagggcctcgcgaagatcgtcgacaccatcgattaccgcttcaacaacaacgtgacggtaacgggggtcccgacaggcctgaaggatctcgacgagctctccggcggactacagaagtcggatctcatcatcgtcggtgcccgtccctcgatgggcaaaacgtcgtttgccctcaacttgatcgacgccgcgctacagagcgaccaacagaagtctgtccaggtttacagcatggaaatgccagcagagcagctgctgttcaggcttgctgccctgctcggccacctggaccttggcaagctgatgaagggccaactgcaagaagaggattggcccaggctgaccgtcgcgatccagcgcataaacgactatggcagccgactggtcatcaacgaccagggcaacctgacgccgacagagctgcgcgccaaggttcgccgtgcagccaggaagtacggccaccccgtactgatcctggtcgactacctgcagctgatgcgctgcccaggcctggaaaaccgagccaccgagatctcggaaatctcccgctcgctgaaagcactggccaaggaaatggattgccccgtcgtggccctgtcccagctcaatcgcagcctggagaaccggccgaacaagcgaccgaacaacgcagacctgcgtgagagcggcgcaatcgagcaggacgcggacgtgatcatgttcgtgtaccgcgacgaggtctaccaccccaacaccgaggccaagggcattgccgaaatcatcatcggcaagtaccgcaacggcccgatcggcaccgtccgcgccgccttcatcgccaaccagacccgcttcgccgaccttgcaccaacttggcagggagctcttgcatga

SEQ ID NO: 9958 - DNA, 1209 bp, Pseudomonas aeruginosa
gtcaggaacgcatgcctggatctggataagcatctcgtcgtatccaaagcggtattcgttcttcatgccggacctcctgtggtctgggtgggtttgtttggcgacgccaaccttaccaccggatgtgtccggctcccttctagcagcgaccgtcacgccttcagcgctaccggtcctgcaacctcatttttcatctcatctattgaacttccgatctctcgccggcgggagccggcaaggagtctagtcatgcgtgaccagcagaccacgaccaatcctcccgaggcttgcgcccagaatccagactggcgccaagacctgtcctatgcactaatcgagtccctcatggccgaacccgaagagcaggcaaaagccttcctgaaggctcatttggagcgactcccctactacgaacgcttcgggctctcacatgagaacctcgtcctcctgatggaggacctcttcaagcagttgcagtacaccttttccttcctgggtatcgatgcgacctggctcaggcagcgccagctcgagcgacaagtcgctcagacgaatgcttactctgtcttgaaggcactgcaaagcgccgtcacacagttgcggacccacgaagggccgagccccgtactctggttcacggggctcggccggacgacccggccgttcgttcgggccactgcattggagcacgccctacgccaggcgctcaccgacaaaggctggtcaaccccgcaaatcgaggacgcctggccaagcgcaggcctgcaaccctacctacaggcccttggcctgtgccggcagacgctcgccttcgcgcttgacgaccccagccaagccttggacctgccgacccagcgtgcagccgtcctggccgctcatgacgaactcatcattgagctgagagggcggcttctctgggagagctggaacagtccgccagcagactacgaatggggtgagagcgcgatcgttccaatgacctctagctcgcccacggatgctactgggcaagtgcttcccgccacacctcgaggtcgtcctccctactatctatgggaactggtccccgcacctgcctctcatcgcgccacacccgacgcgcctcttccgggacatgaagcggctccagctcatcgcatatggctagccatttttgagcaggagacagcgcctgcacctgctggggcgtccaggagtagcgccttatga

SEQ ID NO: 9959 - DNA, 432 bp, Pseudomonas aeruginosa
tggacgaccagcaaccgcgggcgttctacgactacatccgtaacaaggactacggcctgtcgccggaaatcccggcggacaagcgcaccctcaaccagttccgccgcttcaccggccgcgccgaaggcctgtcgatcagcttcgaggcgcacctgctgggctccaggatcgagtacgacgaggagcgcgacacactccggatcagcagcctccccactcagcttcgcgaccagctcaagcgccgcaaggcggagcaggagagcacgtcatgaaaggggttcgtcgcccaatcctgcgctaccacggaggcaagtggaaacttgctccctggatcatccagcacctggcgccacatcacacttacgtcgagcccttcggcggcgcagcctccgtcctgctccggaaagcccgcagctacgccgagatctataa

SEQ ID NO: 9960 - DNA, 336 bp, Pseudomonas aeruginosa
tgcgtctccatcgccctcattccagaccacggtcgctcagtactgagcgatctgcaggagaacaatatgaagaacgttacttcgatcgaccgcaaacacgcagaagacaagtttgttgtacgcatgccgcaagggctccgcgatcaactcaagcaaaaagccgcgcataaccaccgctcggccaacagcgagatcgtctaccggctggagcgcagcaacgcgctcgaagaagaactcgctcgagcgaaccgaatggtcgacgagctcttcgccaagaaccagcgtctgcaggcagagctggctgcggcgaacacgcctcaggtggcggaggcatga

SEQ ID NO: 9961 - DNA, 1239 bp, Pseudomonas aeruginosa
gcttgcccagggactgctggcccaggttcgtcgcccgcccttcactcttctgcccacccgactcatcgagcagcgcacatccgcacgcaccacctttcttcgctggcagcacattgcaacccggcggatgggcgtcggggtgtgggcggaaatgctgcgccaggacaagaccccggaatacctgctgcaagacctctacgagatggagctgcagcgcatcaccctcaacatgcagatcagcctgatccactccatcggcaagcaggccgccgagtgtgcggaaaagatgggccaggccgaggccgagttcatgggccgactgcagcagagtcagacccgccctggttccgtgggcatgtagctgtaccgctctaccttcgacgaaacgatcaccaacggagagacaacatgagcaacatcagcagcaagaccgtttccaacaccaaagcccagccctccaccgaggtcagcgtcgagatcatcggcggcaagcccaccacgaccagcctcgacgtcgccaagcattttcggaagaggcacgacaacgtgttacgggatatcaaaaacttggaatgtcccgaggattttgcactcctcaattttgaggagtgttcccgcacgggagcgaacaacaggccagagccatacgtgcgcatgactcgcgacggcttcacccttctctgcatggggttcactggcaaggaagctatgcactggaaggtcgcttacatcaacgccttcaacaagatggaacaggcgatcatcgagcaacccgagatcctcagccacaaccacctgctccagttcgctatcaagaccctcgacctgatgcgcgaccacaccctcggcgagccggcccgacccaggacagaacaggtcgtatgcaactacctggccgtcgagtccttggacgcggcgaatcccgagcagatcaagcaggccctgaacttcctccaggggcagatcatcggtgaaggtgtggccgccaagtccttgcccagcgtggccggctcctccatcgccaaggacctgctctacggcttgctgcgctccgctcatgacgcggagctgctgttcaactccctttacgacagcggcgtcgaaaagctggccagcgaagtgttcaaggagcacatggccaacaccttggctgcaacgtctcggcaaacccgtgaactgctcgggtacgtggccagccgcgccactcgctcccccttcaaaccacgctccacccactaa

SEQ ID NO: 9962 - DNA, 1986 bp, Pseudomonas aeruginosa
gaaagagaaatactttcaaaccgggctgagcattttcggtcgatacgcaacacaccggccggccacagtgctactcgcttacacaggagcaagcgcttgccaccactcgataacgcctcccctaccgagcagttgccggatccatccctagcccgttacagcgagcggcagctcgccgttgccaatacctgggcaacgcatttctccctcgcagggacagctcgaaccaagttcatccgtcactacctgcgcagcacctctacgaccaggtgctggtgcatcaccgtcgctgctgacaacggtgtgcgttacaccatcatgcgtgcagggccactgctccaggtgttcgacggtcaactgatcggtgcgtgggagtgcaggcctgcccatcgtgtcccagcaagcgcaccctccccagccggagcgttgaagctgctgcagcgcctccagaagttcgacgatgccgttcctgtactcagctcttacacccagcgggcgcatgggttggcgactcagttggcccgggaggacctcggctcattccccaagagtcagtatccatcagtcagccacaatcgctactactcgccgaggcgccagttctacctgaagcagatcggagcggtcttgcgaaccttcaggcagttcctggaccaagacctgctgttcgctatccgctcggttcggtgcctctcgccccagctctacaactggctggctcaaggcaaccaggcgcgccggctgcagatgctgaaggctcagccggtcttgacgccgctactggtggattgcgaggagggagtctggcctcacacgacgaccaacgacaacggcgagagcatctgccatttccttccttgccctttttccctgcttgtcagtgaacgaccgcaggccgccgccgtgccatgcgacttgtacctcgatatgggccgtattcttgggcaggtcgcggacgaagggatttcggtcatcaactttttcgcctggctatttcaggcgccacgggcctcgattcgatttcttagtcacgtcagtcccggccgtgcgggaggagctctcttccatcgcaaacgggaaggccgatattcgggatggcatactctccttatggcagcatcgctaggtaaccggcgtccgatcactcgcgctcaatggacagccttctatgccgcctacaatgcgatcccctggcagattcacaacgccaagcctgactacaaccggctcttcaacggctgccccttggattggcaggatccggcatggcttgcaatcactgcacgcctgagagacatcaaggagttctataccgccctcgaccaggggaactcacaggttgttcggcaggcgcgcagcgccctgaaggcgtatctgggtcattgtacctaccgacaggctggcaacctggtggacgactaccaccaggtccagagggaactgcgcgccacagtacagagcagcctgcccgatctggtcgacaccgacgagtacaccacctgggagggaatgctgcctgtcagccttatcgattgccccaatggcctgcagattgtcgagctccgctgccctgccgatctctatgccgaacatatcgcgctggcccattgcatcgatagctacgaccaggccgcctatcgaggagactgccgactgctctcagtacgtgaggctggccgtccactggcctctgccgaactggagctcaggcgtgagcatggcgagccactaggtaggccctggaatccccagcacctttctacggtgcaactgcgcaaactcgataatgaccccgtaccggcagactcccctgccggccaggcttaccgctggttcatggaacggattcgctctggagccatagcgacgaacctgaactggcccgacatgaccgtccacatgacacgcttcgccgatggtcgctggaaggcgggcctcgccgaagccacggcgaagtggctgctcactcggttggaaaaccgatga

SEQ ID NO: 9963 - DNA, 1392 bp, Pseudomonas aeruginosa
ctcggcgccttgcggcgtgtcgctggccatgattgccatcacctcgtaccaggcgccggtgactgccttgccgaacgcggggttgtcggccagcgtctcgctgttgacgatcagcaggtccttgacatggcccggcacgctggccgagtcgaagacctgatgtgcatccggtgtggcggcgacttcctgcagcagcggactccaggtcgccacgttgcgtacatcggccgtgctgaaggcagcgacgatgtcggcgtcggaggtgttgaccacctgcacgtccttctccgacaggcctacgctgtccagcgccttggccaggatgtaatgcgacaccgacagttccaccaggtgcacctgttggcccttgatctgtttgagatcgctggtgcccttcatcaccaggccgtcgttgccgttggagtagctgccgacgatcagcgcggtggtgtcgacgccaccggccgccggaatcgacagcgcatccatgctggtggcgaccacgccgtcgaactggccggcgctgtactggttgatggactcgacgtagtcgttgatctggctgatgttcacctcgatcccgtacttgtcggcccatttcttcatgattcccgactcgtcgacgtacttccagggcatccagccgacgtaaatggtccaggccaggttgaaggtctttttctcctccgcctgggccagcggggcgagggcggcgagggcaatggccccggcgcaaagcagctttttcatcatggtgccgtgcatggcggtactcccggttcagaagaacttcagatagcgctggatttcccagtcggaaacatgggtgtggtaggcattccattcgtcgcgcttgaactcgacaaaggcctggtacatggcatcgccgaacacctggcgcgacagcgggtcggcctcgaaggcgtcgatggcttcgctgagggtgcgcggcagggtctcgatacccatctgcgcgacctcccgttcgctgtagtgatacatgttctcgcggtgcggctggccgggatcgagcttgtcgcggatgccctccaggccggcggcgaggatcatcgcggcaccgaggtaggggttgcagccgatgtcggcggcgcggcattcgacccgcgcgccctgggatggaatgcgcagcatgttggtgcggttgttgttgccgtagcagcagaacaccggcgcccaggtcgagccggacatggcgcccttgcggatcagccgcttgtagctgttgaccgtaggcgcgatgaccgcgcagatggccttggcatgtttcagtaccccagcgatgaagtgataggccagcggggtcacgccgcagccgtaggggtcttcgccatcgacttcgaacagattcttgccggtctcgatgtcggctag

SEQ ID NO: 9964 - DNA, 984 bp, Pseudomonas aeruginosa
cgaaggtcttgccgacctggtgtacacgaatcttggcatcggacatggtcatttcctcatccagggaaaggcgcggcggtgcaaccagcggaaggcctgatcggtgatcaggccgatgagaccgatcaacaggatgccggcgaagatcttgtcggtgtgcatgtagcgctgcgccttgaggatggcgtagccgaggccggagttggccgcgaccagttcggctaccaccaggtaggtccaggcccagccacaggtgatgcgcagggtgtcgagcagcgcaggcttggccgacggcaggatcaccagcttgacgatctcgctgcggttggcgcccatggtctgcgccgcctcgatctgcgccatgggtacgcggcgcacatcctcggcgaccatcagcaccatctggaaaaaggtgccgatgaagatgatcagtaccttggagccttcgtcgatgccgacccagagcatcaccagcggaatgaaggccacggccggcatatagcggatgaagtcggtaagcggttcgagaaaggcctgcactggccggtacgtgccgatgtacagccccagcggcagggcgatcagtgccgaggcgccgaagccggccatgacccgccagacgctgatgccgatgtctcccagcagcccctcgctggtccaccagcggccgatgcgctcgagcactgcgccggggctgggcatgaacatcgggtcggccaggccgagggcggtccacagccaccagacgacgaagggcaggctcagcccggcgccggtgagcagccaggcgttgcgccgcgagagttcgccgcgaatacgccagaaactgcctttgcgcaccaccggttcggcctgtacggcgggtgctgtggtgtgtcgttgttgagcggagggaatgctgatctgtgcggtcatgcggggaccttctctgtagcggtgggcacatccagttcgacgcgttgccagccgccggccgccggataa

SEQ ID NO: 9965 - DNA, 876 bp, Pseudomonas aeruginosa
gcatcgggaacggttttcatgggtaatgctccgcaaatgacgtgcttcgggcgcgatcaggctggggggtcatggcgatccctccagttggctcagcagccgatggctgtcgatcacgctgccgaacaggccgccttccacctcgatcatcgccagcgcagccgcatgcagttgcgggtcggccgaggcgcaggcgtcgcggacggtcaggcagtcgaagccaaggtcgatggcctggcgcagcgtcgaggccacgcagacctcggtggtcacgccggtcaggatcagccgctcgatgccgcggcggcgcaggatcagttcgagatcggtatgggcgaaggcgctgtagcccggcttgtcgatcaccggctcgccggcgcgcggttgcagctcgtcgatcaggtcatggccgaattcgccgcgcaccagcaggcggccgagggggccagggctgccgatggcagcgccggtggcctgggcgcggcggcgtttgggctcgggcaggtcggaaagatccggtcgatggccttcacgggtgtgcaccaccagcatgcccacgccgcgcgcgcaatccagcagcgcctggatcgccgcgatcggtgcgcgcaggcggctgacgtccattccggcctggtcggcgtatccacccagcgcgcagaagtcgcgctgcatgtcgatcaccagcagcgccgtgtgctcgaggagcagcggatgcgtcgtcaggctcacagcgcaaactccttgcacaccgcggcggcgatgccttcgacgatgtcgtgggccagccgctggcctttcgccgcgctggagcctctggccgaggacagcaccccggagggcggcacccattcggtacgggtggggtacatgtcgtag

SEQ ID NO: 9966 - DNA, 594 bp, Pseudomonas aeruginosa
gcgggatttccatcttcatgctctcgaggatcaccagcacgtcgccggcatcgacccgcgtgccctcggccaccgacacctgccagaggttgccggcgatgtggctctcgatgccgagctggccggcgccgagcggggcgtcctcgccgaggtctgcggcgacttcctcgctctcgaagtgcgcctggcccgattcgatccagcgctggcgctcggcgtcgaaggcgccgcgctgctggcggcggaaggcgtcgatgctgtcggcctcggcggcaagaaagtcctggtagtcggacaggcgcagctcggtgttctcgatcttcagcgggtagcggccgagcggaaaatcgcggcggattctcgacagctcctcggccgagaccgggtagaagcggatctggtcgaagaagcgcaacagccacggctggccgccgaacgcctcgaccgcgcggtagcggttccacatctgcagggtgcggccgacgaactggtagccgcccgggccttccatgccgtagatgcacatgtaggcgccgccgatgcccaccgagttctccgcggtccaggtgcgcgccgggttgtacttggtggtga

SEQ ID NO: 9967 - DNA, 546 bp, Pseudomonas aeruginosa
actccaggttgctcgggcaccagggcgcgtccttgcgcaccgtggtcatgtacttctcgatggccaactggcaggccgggtcgtcccaggacagcggcaggtggacgatgcgcgagggcaccttcagatcctgcgcggcgcacacggcatcccacaggccggcgacgatctccaagagatcctccagcgccagggtctcgggctggtagtgcacctgcagggagcggatgccgggggtcaggtcgatcaccccatcgagctgcttggcttcgagggcctgcatcagtgcatgaccacggaagcgcagcaccaggtccagctccggcgcgccgatttccagcaacaggtgggtgtcgccggagaggggggcgaccaggcggctgtccgcttcaccgatatccagcacgatgggcgactgcagagctaccggcgtggcgaccactgccgccggcgcgaggctggcgcactcggcatcggcggccttggccaactggcgtgcggtcagcacatccaccgggacgaagcgcaccttgtcgccggccttga

SEQ ID NO: 9968 - DNA, 1224 bp, Pseudomonas aeruginosa
ggccaaacacccgcagctgttccggcgtcgggccgacgaaggcgatcccggcggcctcgcaggcttcggcaaacgccgcgttctcggagaggaatccgtagccggggtggatggctttcgcgccggtttcacgggcgatgcggagaatcttctccacgtccagataggtctgcgtggccgggccttcgcccaggctgtgggcctcgtcggcctgctgcagatgcaggctggcggcgtcggcctcggagtagacggccacgccgttcacattcaggttgcgcagcgtacgcaggatgcggcaggcaatggcgccgcggttggcgatcagcagtttgtcgaacatggtcagtaaccctcgaagggctggcgggccgtcccgcctttattcatcagtgccacggccgtccgtggttggggagggtttcttcgttgccggccgctcgggtcgctgcccggcgcgcgcctgcagcaacggcagcaggtagcgacgcaacagcggcatcagttccacaccagcacctcggccggcgtcgggttccagccgttgcaggggttgttcagctgcgggcagttggagatcagcacgatcacgtcctgctcggccttgagctccacatacttgcctggcgcggagatgccgtcggcgaaggtcaggccgccttcgggggtcaccggcacgttcatgaagaagttgatgttggcgccaatgtcgcgtttggtcaggcgaccgtcgttgaggctcgcgcgcaggaagttgtcacggcagctgtgcatgtagcgcttgtccagcgcgtagcgcaccacgttgctctcctgggcgcaggccccgccgagggtgtcatggcggccgcaggtgtcggcggtgatggtcagaagcggattgccgaggttcgaatagagcaccgtgccggtggtgaggtagacgcggttctgccggcgcagagtgcgctgcgggtcgtagcgctcgcgcgggtttttcgcgctgaagaacagcgtgtccaccgcctggttgccttcgagatcgagcaggcgcagggtctgtccggccttgacttcgaacaggtacggttcgccggccgggatcacatggcggaacgcggcggtttcggggtgcaggctgctttcggtaaggctcatcacggccacctcctcagatgtacaggcgttcggtgttgtgaaaggcacgaccgttttccgggcgcgaggtgcggcagagcacgctga

SEQ ID NO: 9969 - DNA, 435 bp, Pseudomonas aeruginosa
gcacccggggcgtggggatcgatgcgcggtttgtcgaagaccaggatgcggctgccgagggtgaagccttccgagaggtcatgggtgaccatgaacaccgtcagccgggtttcccgccacagctccagcagcagctcatgcatgtccttgcgaatgccggggtcgagggcgccgaagggctcgtccagcaacagcacgcggggcttcatcaccagcgcctgggcgatggccagtcgctgttgcatgccgccggagagctgtgccgggtacttgtccagcgcatggccgaggccgaccttgtgcagcatctgcgcagcctgctcacgggcatcgcgcttgcggcgtccgagcagacgacccagcagcggggcgcgcgggagttccaggccgagggcgacgttgtccagcaccgtcaggtgcggaaataccgagtag

SEQ ID NO: 9970 - DNA, 408 bp, Pseudomonas aeruginosa
aagaccacgccgcgactggcgtccggttcgtctgccaatggctggccatccagcaggatctcgccacggctgggcgcttcctggccgagcagcagccgcaggaaggtcgacttgccgcaaccggaggcaccgaccagggtgcagaactcaccttcggcaatcttcaggttcaggcgctccagcaccacctggtcgccatactgctgccagacattcctgacctggatgaacggtctggcatcgcctgcgctgcggcttatagatgcgtcgtgctccaggtgggcgacggatccgcccgcaacggctgcgctctttctgtcgctcatgccttggctccttcataccaggggaacagcagctgggtcaggcgccgcagcgagaaatccatggcccacgccagcagggtga

SEQ ID NO: 9971 - DNA, 393 bp, Pseudomonas aeruginosa
acctttgcaatcctgagtcgcatagtccaatcccttccaggaggtgttatgcgccattcgaccgttacctgccattgctgcggaaaaatcatggtgccacgcacgacgtatagccgaggtctgctggggtattcgcctaccagcagtcattgcccgttctgtctgagcgataattggcacggtggcaatccgagcttgcatgaacgcattttctggctaatggggttcggcttgggagttcttgcatgcgtcatggtgggtgctttgttgttcaagctgcaatggctggctggtatcgaaggtgtatatccatggctcaccctactgactaatgctgttgcgatctgggctggctatcgcttctatgcctggtttttggcagaagaggactga

SEQ ID NO: 9972 - DNA, 1173 bp, Pseudomonas aeruginosa
agcatggcgattggcctgccattgtgtgccccatcatcaaagggggcctcaatgaccaggcagttgaccactctcacgctgtgcctgctgctcgccagctgcacgacccacaaggctgagccggccaggcccgccttcgacagcagccgcaatccagacctgctctcaccggacctgtacccgaatggcgtacaaccggagaaggagcccgtcgtgcgctacgggcgctacaccctggtcagcacccagccggacgctggccagcgcgacctgatggcacagatcatcgacgtgaccatcccgtcgagcatgaacccgagtgtcaaggatgccatgcagtacgtgatgagccgctcgggttactcgctgtgcccggcagaggccggtcatgtgaacatcctctacacccggccgctgccggcggctcagtacaagctcggccccatgaccctgcgcaacaccctccaggtcctctccggtccagcctggcaggttaaggtcgacgaagtggcgcggcaggtctgcttcgtgcttcgcccgggctatcaacttcccccggcgccgaggccgaaaccagtccagcaactgtatgcgaagcccgctgccccaactccagcggcggtagcgcaaccctcctccacggagaaagtcagcacgctggagtcgcccgtcgtggtcgcctcggtgccaacgccggcgccgatcacaaccagccccgctccgaccaagaagcctgaatccaccactgtgttccccccagcagcaccggccaaggatggccacccctcttctcctcccgcggctttggcaccgatcaagcccttggcttccgccgtgaagtccatgccgcccactccggccgtggcttccgcccctccggtcaaggtgctcacgccggcggagccgagccggcagttggcacagtcctggtcagccgagacgggatcaaccctgcgcgacaccttggaagcctgggccaagcgcgcacgctggacggtccgctgggagccgcaggatctcaactatccgatcgaagctcccctgagcttccacggctccttcgaggacgcggtatccgagctgttcccgctgtatgacgctgccgaacggcccttcctggtgaacgccagccggccgcagtccctgatcatcatcaaggagcgcaagaactga

SEQ ID NO: 9973 - DNA, 630 bp, Pseudomonas aeruginosa
ccttccaggggctgcccgccgccggggtccgcatcaccaacctcgaaaccacgctcaaggacagccagttggactggactgtcacaggagaaatctatgcgaactgagccgatcggcatggccgtggccgtgctcttcctcctcgcgtccggccaggcctgcgccggcaccgttggcgaactggcggagatccaggcccaggccatcctcaccgaggccaaggtgcgtctggccacggcgcagcggcaactggagggcaaaggcgaaaccggccagatcgtcagcgcccaggggcagacgttcgccatgccggtgccggcggcgccgccgacgatcacgcagccggttccgccggtggtgcggaccatctacggcgccggcggcaagatgactgccacattcttgttcccgggcgggtacgagattgacgccgccagcggcgcggagctgccgggcaactaccgcgtcgagtcgatctccctggaccaggtcgtactcaccgacaaggacggcaaccgcgtgcccgtgggcttctccagcgttgcccccacccaagccgcctcctcggcccaaggcgcctccgttccgccggcgctgcccggggcggtaccgcagccgttcatccagtag

SEQ ID NO: 9974 - DNA, 1401 bp, Pseudomonas aeruginosa
gggacagcatccgtttcatccggtggccatcgccagtcgcgaagcgctgatggggctgtccaacggcaagcgtctggccaccgccatggcgctctatctgcccgcccaggagcgagcgctgatcgaggccggcgagatgagcggcaacctggttcaggccatgggcgatgccgtctccctggtcgaggcccaggccaggatccgcgccaccatctggcaggcgctgctctatccctcggcgctgtccgccatgatggtgttcctgctgtgcatcgtggcctatcgcatggtccccagcctggccaggctctccgatccagtcacgtggaccggcccgctcgccacgctcaacgccattgccagcttcgtcacaggacctggtatctacgttctggtcgccgtcatcaccctcacggtggtggtcatcgtcacgttaccgacctaccgctggaaaggccgggtctggctggaccggatgctgccgccctggtccatctaccgcatgctccagggcaccaccttcctgctgaacatggccgtcatgctcaacgccggcatacgcccctacgacagcctggccagcatgatcaagatctccccgccctggctgaagcagcgcttggaagctgcccgctacggcgtgggcctgggccagaacctgggagtcgcccttcgcagcgccggtcacgatttccccgaccgacaggccatccagtacctgtgcatcctcgccaaccggggaggcttctccgaagctctggtcaagttcagccgccgctggcaggagaccagcctcaagcagatcgagctggccgccgggctggtgaagaacttcgccctgatcttcatcggcgcgctgatgatcctggtcctgctcggcgcctaccaggcacagcagctcatccaatccatgaaccactgaaacctcaccaaggagcgctccatgagcactacgcaacgcacctcccgtccgacgcagggcggtttcgtttccatcgagatgatcatcgtgctgatcatcatcgccatcggggtcggcctgggcctggccgcagcggctgggatgttcagttcgtccaacgccaacgaggaacagcgcaacatcagcgtcattgcggccaacgcacgtgccctgaagacctcttcgggctacggctccagcggtaccaacctgatcccgagcctgatcgcaatcaacggcgtgccgaagaacatgagtgtctcctccggcgtcgtctacaacgtctacggcggatcggtcactgtctcgtccaccggcatgggcttctcgatcaccaccagcaagctgcccaaggatgcctgtatcaccctgggcaccaaaatcgcgaagaacaccttcgagcagaccaagatcaacagcggcaccgctatcactggtga

SEQ ID NO: 9975 - DNA, 984 bp, Pseudomonas aeruginosa
caacagcattacctggacctacagttcgtgagtgtgaacccgatcattcaggctcagttcgtcgacctttacctcggtgaaggcttcgccgacgtgaagggcctggccggcgtcggcgcgcgccgagtcgaggtgcctcgcgagtgggagtcgcacgcccaggaactgctccagctctgcaggcaaacgctggaggagctgcaggatcccgagttcgccatcgtcgtcgacggtgtgctgctgcgcgtcacccaactggaagatgctttcaacggcgggagtgtcttcgtgctgcgccggtcgacagcccaagttcgaagcttcgaggatatcggctatccgagcgaggtggtcgctacgctcctgaacccgcaactgcagggcttgatcctgttctgtggcgatatggcgaccggcaagaccagctccgccgcctcgctgattctcgcccgactgcagaccctgggcggggttggcttcacagtcgaggatccacaagaaaccaatctcagcggccaacatggactcggccgctgtatccaagtcagaacctcacgacgctcgggaggctacagcgaagccctgttgcgcaccctgcgtaccggagccgacctgatattgatcggcgagatccgcgacgaagacaccgcctatcaggcttgcaaagcttcgctgaacggcaacctggtcatatcgaccatccacgccaagaactgcccgcaagccatcgaacggctgatcaccctggccaaacccctcgcgtccaatgcctacgacgtcgtggctgaaggcattcaggccgtgatctgccaggagttggtaagtgatggcggcgctcgaagactgcacgcagaaccgttgcttttcaccggagtggactccgtcgccatgcgcgataagatccgccggcagcagattcatctacttgaggacgatgtgaatcgccaggctcgcaaaagcctgtgggagcctatctatgaataa

SEQ ID NO: 9976 - DNA, 576 bp, Pseudomonas aeruginosa
agacgcctcgatctccgccatggtgaaagccggacaccggttctgcctttacagcaccgttgtgctcgcaggattcggcaactccgccggcatgcgtgtgacggccacctacctcaactagggagtcctccagatatcatgccgctgctctggattgccctattgctcaccctgctcaccggaacctggctgagtgtacaaagcgaccacgcgacctcgagcgccgaactggccgaggtcgataccctggccaggagcttgctgctctaccgctccaggctggcggagtacgcacacgccaaccccggtttcagcggttcgccggcggactccgctcttggtttaccggcctggttccgcaagccagcgcggcttcagggctacatcgccgccgacaccagctacgccttcatcgcctcgccgccggcagggctggcggcagccgtggatgccggtacggaatccgacctagttggtgtcaggcgcaacggccagttagtcacgcgccgcctcggagccactgccattgcgctccctgcgcccatccccgagggcgcggtggtcgcggtcaaataa

SEQ ID NO: 9977 - DNA, 654 bp, Pseudomonas aeruginosa
aagctcccttccgcaacccagcggggaatccacttccccgccagggccagtgttttctccgcaccctcaacctgcaggagaaacaccatgtccaagcaatccaccagcttcgaaatcggctttgccctcggcagtgttgtgcgtgagttccgcagagcgctcaggcgccctccggtcgtagtgcaagcacaagcgccggttgcgttgagcgtccagcgcatcgatcctgccttcctggccggcccgaccgctggcgagctagaacacatcagcgacatcccagccatcgtccggctgaagaatgtcaacctgaatgactggtatctagccaatacgcgcgaggtgcaaaagcccaagcgcgcacgcaaacccaagccggccaaggcgaccgccaaagctgaaacgccagtcaggaaggagctcaagatgggttccctcgaccatttgattgcacccaactccgaaagcgaaatggggaggccccctctccagttagagtccctgaacgatcatgagattgctcttttgccagcacctcctggtagcgcagtctcttgggaactccatcggcgtactcaggagcaataccaccaacgctggcaggactacttgtccaccatgacggatgaacaagtagctgctctcggccgctaa

SEQ ID NO: 9978 - DNA, 600 bp, Pseudomonas aeruginosa
tggaagccctctccctcagatttacctcccaataccgacccatgcggggaatacttttccctgacgggcaaggtgtttctccgctttcgcttacgaaactggagaaccatcatgagcaacaacacccaagcccaagaagccaaatatttcgacctgcacaccaccggtatcggctacctcaatcgcatccgcgaagtaccgatccgccgaggtgaaccgttcctcgccgctactgttgctgccctccatggcgcggcagacagcgtggaatactcctacatcgattgcaaagtggtcggcgcccaagctgaaaagcttgtccgccgttgcaaggaagcagtcgaggccgagaagaaggtgctgatttctttccgtatcggcgacatctgggcggatcccttcacctacgagaaaggcgagaaaaaaggccagtccggcgcaagcctcaaaggccggctgctcttcatctcctggatcaaagtggatggcaccaccgtctacgatgcgaaggaagaagctgagaaagcccagcaaggccaaggcgaaccgcaaggtgaacccgcagcccccgctgagcacgctgaacaagccgctgcttga

SEQ ID NO: 9979 - DNA, 249 bp, Pseudomonas aeruginosa
gggacctcagtccccttgggactggtgtttcctaccgaaaggagaatcaccatgcaatacggaaagcgggcactcgcccatcttcgtctcgaactgccgctgcaggttcttatgtccaacgccggcttttatatcggcacccttgatgaagaaggaccagcttcgcgcgagtcggttgaatactacccctcccgcgaacttgcccaacaggcattagacaacggcacgtggtcgcaacgggaatattaa

SEQ ID NO: 9980 - DNA, 423 bp, Pseudomonas aeruginosa
tggagtgcatcctacccacccacgcggggacctcatccccgcgggagaggcctgcgtattcggagacctctcatgacctctctcaacaaccactccagcgcaggccacactgctgcgtacctcaaactcccgatcgttctcaccaacgcggcctggctgcgcctggtctatctcgccaaccctgccagggtcgacgagatgggcacccggctggccagtgtcgttcaaaccgcctggcaggagctttcgctccagccgaccgcgaagcacatccaattccacctgtaccacaaggaggaagaggggcaggaccgcgcgctcgcgctgctggtcctctcgatagtcgagccgtccgatgagccttcctacctgcgcatcgagctgcaggaagaaagcctcccgggcaacccggataccgagtag

SEQ ID NO: 9981 - DNA, 1524 bp, Pseudomonas aeruginosa
gctgatccgcgaaagcattcttaccaccgatgctcaggcacaagcctgagccatccctctcagactcaaggaggccccatggccctcatgttcccgcgcttggcgcgcaactttgcacgcaacggctacttccctaccgatgaggtcaccctcgaacgcgctctgcaagccctcgctcccgccccgtcgggcaggatgaggatctgtgatccctgcgccggtgagggggttgccctggctgaggcagcacacatcctcggccgcgacaaggtccaagccctcgctgtcgagtacgaccgcgagcgcgccgaccatgctcgaggcttgcttgagcgagtgctgcacagtgaccttttcgacaccatgatcagcaggcagtcgttcggactgctctggctcaacccgccttatggcgacctggtggcggaccactccggtgcgtcgcagtaccagggcagcggccgcaggcgtctggagaaagcgttctaccagcgctgcctgccgttgctgcagtacggcggcgtcatggtcctgattgttcctcactacgtcttggacgatgagctgaccggttggttgagcaaccacttcaccggcctgcgcatgtacgcagccgcggatcctaccttcaaacaggtggtgatcttcggcatccgggtccgtcgacaggacctggcccgggcggacgccaatcaggtgaggtctcgcctgcaggcgatcggcgcgggccaggaaaaggccgaggaaattccagcggcttggccgtgggaaccctatgtggttctgccggccaccagcgagctggagcacttctatcgagtaaccctggagccggagcagttcgccggcgagatccagcggctgcgaggtctctggcctgacttcaacctgcacttcgcgcaagcggggctgcagccccgcccaccagtccgcgagctgtctcgctggcacctggccctggccttggccgccggcgcgatttccggcgtcgtgcgctcgaagtcgggccggatcctggtcgtgaagggtgacacctacaaggacaaggcccgcaagaccgaattcaccgaagacgaagacggcaacatcaccgaggtgaggatcctcacagaccgtttcatcccgatcatccgggcatgggaaatgacaccctcctcggtcaatcagggccgcgtgctgaccatcagctcgtcggctgcgaccacggaagaggctgaagagccccaacctgagccggcccccgaaccgctgctgttcagccctggccaagtcgtaatgaccgctgccgtgagccacctggtggaaaccggtcaactcaacccagcgcctttgctgaaccgccatctggcgggagattgggggacgctggaccaggaagactggaacaccaaccagagagccctgaagttcggcgataggctgctgtcgtcctacgacatcgatgccggcggcgaatccaggctctggatcatcaccgaggcagaccgcagctcaaccacgcttttgctccctagcgactactga

SEQ ID NO: 9982 - DNA, 213 bp, Pseudomonas aeruginosa
gcattttcctcggtaatcagacctttgccaactcgccctccagaactcgcaaatgagtgggtcgatgaggcaaccacgcccgaacgggcagagcagatggtactgcaggaaagtgaggctccagaagtgttcacctggtatcgcgtcgaccgcgcggtcggcaatgttcgcaatcaaggggtacacctcatagagcctcagcggaccgggtag

SEQ ID NO: 9983 - DNA, 819 bp, Pseudomonas aeruginosa
cgaatcaggcccggcgattcgccagaatcctatccaaaaaaatcccacccccactcaccgagtatttcctactgcctcaatgggggcagtctgagagggtgtctctggcttcgcgcgaggacactcatgaaacgcccatcccctgcatcaatgattcttggcctctgcttgacagcaatggccggcctgctgggctaccagcagtaccaactcattcagctccgatcaggcgtggacagtgccgcggaaaagacctcgctagaggcgatcctggcgcgcttgaatcgagtcgacgagcgcctcgacgccgtggatggacagcacctggtcagcaacgaggacttccgctcaggccagcaggcgctgtccaaccgcattgacgccgcgcaggccttcgccaagcaggcctccgacgccgtcgagaacctggctcaaaccaccgcctcggccggcgatctcctggtgctcaaggcaacagtggagacgctggacggttctgtccgcacgctgcaagagaagcaagccaaggctccgccgctgatcgtgcctccaccgaagcgcggtgccttccctgtcaagcccaagccgaaacccaagccgatcgagcctccgcccttctcaatcctcggcgtggagtatcgcgggggcgaacggtttctgtcggttgcacctccgggatccacccagctcagccagatctacctcattcgccagggcgatgccgtcgccggcacgacctggcgcctgaccgaccttgacgatcgtaccgcgcacttcgacgtcgccggcgcctcgcgcagcgtccgcatccaaccatag

SEQ ID NO: 9984 - DNA, 651 bp, Pseudomonas aeruginosa
cgagggccgctggatggccctgggactgggcggggcccttcccgccctggtccaggaggtgaacggccgatggcaacgtctgtaatccgcgccctccaactggccgccctgctggtcctggccaacatcgctcaggccgccgtggatccaccgccggcgtataagcagatcgccctgcccaaaggggttccggccgaggtgctctactcggtcgcgctgaccgagagcaaggtcctgctgcgcggcgaatacgttccctggccttggacattgaacgtcgccgggaaatcctactactacgcgacccgcaccgccgcctgcaccgcgctactcgcggcgatcaacctctacggggccaagagcgtcgattccggcctcggccaggtcaacatcggctggaacggacatcgtttctccagcccctgcgagtccctggatccgtacaagaacctggacgccacctccgacatcctgatcgagcagcgggacgccctgtatgcatccgccccgggaagaccggtggactggatccaagttgccggccgctaccaccgccccgccggcggcgcgcctgccgccaaataccgtaggacggtatcccgccaccttagccaagtcctcggcgtcaacctactggtgaccaatccatga

SEQ ID NO: 9985 - DNA, 1353 bp, Pseudomonas aeruginosa
cctgtcggcacgctacaacgccgtcggccggttcggccggatctccgaggtcgccacccgcgtcgccggccagctctccggcgaaggcaacagcgcggcgttccgcgagttcgcctggcggttcgtcaacatcatcgcccgcgcgctgcacgcgctgggtatccgcccggactaccagcagatcctccggcacgtcgtgaacatcgatgcgttattcgtcgagtatgcccagaagtacatcagcgagcacgacccgagggcctgggacaccatcatccacatcgagggcaagctcaacgacaagaacgtgccattcaacatgaaagggcggcccttccgtgtcgtggccatcgaccagtacctgacacagaaacgcatcgccgacccggtcatggaaggcctgaagagcgccgtgcgctacgacaagacctacttcgacaagatcgtggcctcgctgctgccgctactggagaaactcactaccgggcggatctcggagcttctttcgcccaactacgcggacctcaacgatccgcgaccgatcttcgactggatgcaggtcatccgcaagcgcgccgtggtctacgtcggcctcgacgcactatcggataccgaggtccgccgccgcggtgggcaactccatgttcagcgacctggtctcggtggcgggtcacatctacaagcatggagtcgatgacggccctgcccggctcactcgcccggcggcaaggtccgcatcaacctgcatgccgacgagttcaacgagctgattggcgacgagttcatccccatggtcaacaaagcgggcggcgccggtgtgcaagtgacggcctacacccagaccatgagcgacatcgaggccaagatcggctcccgcgcgaaggccggtcagatcatcggcaacttcaacaacctgttcatgctgcgggtgcgcgagaccgccacggccgaacttctgaccaaccagctccccaaagtccagatctacaccagcacgccagcgagcggcgccaacgacgcgatcaacaacaagaaggcagccttcacctccagctcacacgaccaggtgcagatgaccagcgtgccgatgctcgagccggcccacatcgttggtctgcccaaaggacaagcgttcgcgctactcgagggcggcaatctctggaagatccgaatgccgctgccggcggtcgatcccgacgaggtgatgccgaaaagcctgcaggagctggctgccggtatgcgcaagggccaggccgcaaacagcgagtggtgggaggcaccgggatactccgccctgcaggatggtctgccccaggacctggtcgacgatttccgtcacctcggcgccggtga

SEQ ID NO: 9986 - DNA, 759 bp, Pseudomonas aeruginosa
ggatgccgcctgatggctgaagtcactcaacgtgcagagcagcaacaagagagccagaagacccttgtcggcaccatcatcagtacgcccttccaatttctcggcgtgatgttcggttcgctggtcggcgcaatcatcgtggagtgggtttgcctgtatttcttctggcctgacgcgggctggaagcatgcccaggccatgttcgagtacgaactcagttggctgtcgcaggggctgctacacagcgtcgtcgtgcaggagccaggtcgaaccgccacctggctggcccagttggcctatgactggttgttcgtgaagaccgggatagtcgactggatgaccaacatgaccaccatcgcgcaggcagggccacggagccctctggacgttcgctatctcaccgcccagggtgtctccacgctgcagaactacggcctggccgcgctgtacacggtgctgacattcgtcgtgcgcctggtgattctggtcatgacgatcccgttgttcctgatggccgcgttcaccggcctggtggacggcctggtgcgccgggacctgcgcaagttcggcgccggccgggagtccagctacctctaccacaaggcgcgcggcagcatcattccgctagcggtcgtcccttggaccctctacctggcgatccccatcagcatcaaccccttgctcatcctgctgccctgcgccgcgctgctcggcgtaacggtgtgcatcacagcatccaccttcaagaaatacctctag

SEQ ID NO: 9987 - DNA, 1194 bp, Pseudomonas aeruginosa
ggcaaagagatttgtaaccaactcattcagcctaggaagtactcacaccaagactttaacgttaggtcacagcggagcattgagatgaaacttatccttgatttcgacggacgccttctaaatccaagcaacatgctagaggccctatcaaaagcaggaaagaatacaagcatcagcataagcaacgcgcaagcactaaatatagacactcttctcaaggcaacaaccgctgcagaaaacacaaaaaacctctcaacaactttcaacggcgcagagctgactgctaacaaccttcagcaagtcataaactcagcaggatcactaaccagagtatccacaatagccgcacaagccatcaatataaacacacttctttccgcaatatctacagcaggcaactcaaagagttttagcgcagaattcaatggagcccaactcagcagcgacaacctacttagagcagtaaatgcggcaggaacaaacactagcataagcgtcaacaccgcacaagcggcaaatataaccgcccttcttcagactattcatgcagcaggtaacacaaaaacattcagcgcagagttcaacggcgctcaacttacttcaaacaacattcaacaagctttagacgccgcaggaacccgaacatccattagcgtcaacactgctcaggcggttaatataagcaccctgctagccctcatcaattctgccaaagacacgaaaaaatttagcgccgacttcaatggtgcacaactaacagcagacaaccttcagcaagcgatcagcgctgcggcctcgggaaccagtatcagcgtcaacaccgctcaagcggcgaatatatccacccttttacaggccatcaacatcgcgggcaacactaaaagattcagcgccaactttaatggtgcccaactcacttcaaacaacatccagcaggcgctccgagcggcaggatcaaacacatcaatcagcatgaactccgcacaatccgccaaccaaagcactctacttgaacttctagacatagcaagttccagcaagcaattccaagccaattacaacggcggcatgtctaatccgagcaacctacaacagatagtttctcgtgcaggcgctagtacaaccgtgtttatttccgacgcacaaggcctaccaatcgcaaatatccttacccttatatcatctgccggatga

SEQ ID NO: 9988 - DNA, 339 bp, Pseudomonas aeruginosa
aaccgtgcggttcgacccgaaccgctccaggagcacgtcatgaagcagaccttcgaataccatgtcgagaacatcgatattccctacaaaactctcaccaagggcgtcgcgatgttcaaacacaaagaagagaccttggaacccgacgaccacgccttgctcaaccctctgcgctgggccgaggtcgtgcgtctgggccgggaaggctgggagctggtgagcgttcagccactcatgcggggcgtaaccgagatcggcaatcaaaacgcccagggctgggcctggggcatcgctctgcccgtcagctacctgctgtttttcaagcgcgcaacctcataa

SEQ ID NO: 9989 - DNA, 432 bp, Pseudomonas aeruginosa
aaaaataccccggacccgcgccgagtatttcttgcggaatggaatcagggcgatcggcaagctgatcgcaccctgatctgcaagagattcgccgtgaacactccacatcaaccccttcgccgaacctgcctggccgtattggcctgcggtgcgctggtcgcacagggagccttcgcagcgagcgcctccgagcaggcgaacctggcggtgatgatccggcagctcaatgcccttgaggacaccgcccgccgcagtgcccagggcgccgatgagcccggacagcgcttctacttcgactactcgcgcctggccgctgacctgcagcgcatccgccaaggcctgcaggactacatgacccccagccgcgcccaaccgcgtgacccttcagacctatctgggaattacaccctgcgcggagggccgatgccgtga

SEQ ID NO: 9990 - DNA, 1089 bp, Pseudomonas aeruginosa
ctggaccgtcaacctggacatggacagcacggagtattacgccggcgagaagatcaagcgggcgctggcccgctacccgttgcacgtcatccgcgccgacgtcgacccggagaccaatcccttcggcctgcagtgggactgctactccgacacgcctcaacgtatcgaactcgaggagccggccgcccccaccaagcgggagggaggtctatgatccggaagtcgacaggctcgctcttgctaatgcttgccctacccacactggcccacgcggtggagattctgcgctgggagcgcattccgttggccattccattgacggtcggccaggaacgcattgtctttgtcgacagaaacgtgcgagttggcgttcctcgggatctgcagggcaagctgcgcgtccagagtaccggcggcgcactctacctgctcgccaacgagccgattcctccagcgcgcctgcgcctgcaggacgcgaccaatggcgagcagatgctcatcgatatcgccgcctccgaggcagcggccgatcaacagccgcgcgagccggtcaggatcgtcgccggcgagcccgtggctccgcactatggccagccccgggaagcccagccatcggcagcagcgaaacagaccgcgcaggcagaagcaccgaaggccgtgccgcgcgaaacgcccgtccccgtggttctgacgcgctatgcggcgcagatgctctatgccccacttcgcacggtggaaccggtggatggagtcggtcaggtgcgcgtcaagcgacagctcgacctgaataccctgctccccagtctgcccatcacggctaccgccttgggcgcctggcggctggacgactactacgtcacggcggtgaagctgcagaacgccagcgcccagcacctggccctggatcccagggacctgatgggcaatttcatcgccgcaaccttccagcacccgtacttggggaccccggggcgacgcttccgacaccaccaccgtgtatctggtgacgcgcggccgcggccttgccgacgcgctcctgccctccgccatcagccagatcgatcccaaaggaggccgtcgtggcgctga

SEQ ID NO: 9991 - DNA, 579 bp, Pseudomonas aeruginosa
acaagttgtacggggaggccttcgccgccgtctacgtgcagccaggtgcgcgggtcgccgtgcatctcgatcagcaactggcgatcgactatgaactcaagggccgcaaggtcgattacagctctggagccgctcatgcaacagcagacttggactaacccccttcttcgtctctgcgccggcctggcctgcgcgctggttctggcagcgtgctccaccagcaaggaggagatgctgccccacggcgaggccaacatgctcgacgtctgggagcgaggtgcgaccagctcgataggcaacagccgtggccggctgctcctcgatgccaggcaaacgctgcggcgcccaatcgatccgcagcaggctgcctccgcgaatgaccaggccgactacacccgcacggccagcaacgagatccacagccagttcaaacgactgcccaatcccgacctggtcatgtatgtgttcccgcacctggccggcagcgatcccgccccggtcccgggctacaccaccgtgttccccttctaccagcgagtccagtacgccatgccgggcgagcgcacggaggcctactga

SEQ ID NO: 9992 - DNA, 726 bp, Pseudomonas aeruginosa
tacggcccaacaggcgctcatcgaggccgtggaccgcgcggaaatcctacagcggaggcaagcgtgagactgttgaagggcggctgggcagcgaaacgatttcaaggtcctgccctgccctgggcggggctgctgctggtcttgctggctgcatccgccgtagcggtagagcttctggtgaaggggctgccagccaaccacagcctctacggcgatgcgaaagcgcgctggacgatcaatgaatacgccgacctggagtgccccttctgcaaggtctacaccccgcggctcaagcgctgggtagacagccatccggacgtgaacctggtttggcgccatcttcccctgcagatgcatggcgaggcggcccgccaccaggctcgcctggtggagtgcgcagggatccaaggcggcgccaaagccttctggagcgctatcgatgcgatcttcgctcagtcggccggcaacgggggcgggctgcctggcggcacattggactttcctgaattggaccagtctcgactggagaaatgtgcaaaagacaacgagctggttgactcatccatcaagtcggacatcgacattgcacggtcgaagggcattacagcgacccctagcctgattatccaagacaaccagacgaaacgaagcgtgaagctggagggcatggccgacgaaaccaccttgctgtcggcgatagactggttgatccatagtggagattaa

SEQ ID NO: 9993 - DNA, 297 bp, Pseudomonas aeruginosa
gttatctacaatgaccaccccatagagataaggcagcagtctatattcatcaatattgtacccgcgccgatcattataatcgatatcaccagagttgaacttacaatcatacaccataatcgagggtttagtcataatctccgcggattccctcataaccctttcaagaacccctaccccctgaagcgcattaaacgtgtagccaataaagctgggaacatcctctctacgaataactacagttttaagatccccagtattcttaaatatcaaactaaggaccaaccctccatctaa

SEQ ID NO: 9994 - DNA, 969 bp, Pseudomonas aeruginosa
gctgatcgccaaggccaggaggtcgcgctgatgaccagccacaacctccgccgcctggcagcggcggccgccaccttcagcctctcgttcacggcctcggccgcgatcaacagcgcggccatcgtctcctccaccctttcccctcagtgcctcgaatacaaggtcgtcgggatctgttactggctgctatgcggcccgcatggctgcaaagtgaagacgtcggtcaaggtccgccactacgtgcctgacgcagtcgtctccagctacgcgaatacagggagcaacccctggaccgaggtgtcggcgctgggtacaccgaatccactcgcccaggccggcaatgacgcgaccaccaactacaaggccgagaacagcatcggccgcttcaaggaagcggatgtgatcggccatcctggcggggccacgttcagccggttcgccagcgcctctgggtacgtttgccctggtgccaccttcccgctggtgccgtacttcctcagcacactggacgccattggctggcggcatggaattcccgagcaggtgtaccccgaagcgttggtcccagggctgcgcgaggtggggggagtcttctccggcgacatgtgggggaacctctatccgcgcagcggattcctgcaccagaccgacgactacaagacggcagccgtcatcgcccagcgcgccggcgacatcaccacgcgagtcggccaactccacgtctaccttcccatgcgcgcagcccccaaggacggctactggccggcgggcgagctgaaagagggcgatgcctcgaccgggaaatggcaggagctgaccccgtccctgagcctcaactgcgcggtgtttcccaactcagggccgaagacgcaagccgtcgacggcgattacgcctgggcgctctggcgtccctactcctgctgccagcgcaaggggcagatcttcctcggcagtaccgacttccaataa

SEQ ID NO: 9995 - DNA, 1605 bp, Pseudomonas aeruginosa
gcggcagcgcattcggcggatcgagatcctggtgctgttgctggtcctgctcatcgaattcagcaaagcctacttccgcacgggaggcgcagcatgaccttcatgaccaatgactacctggagtattacctcaccctcctcggttggatcatcaacaacgggatctggaacatgatctcggatacagggctgttcgcggtgcccttcgtggccattgtgatgcgtgagtggctgaaagttcgcggggaaggcgccgacgagggcaacaaaggcgtgctgtctctggcccgcatcgagacgcatatctacgtcggatacatcgtggtcgccctggcgggaatcccggtcgtcaacgtgagcttcgacaccatcgagttcgaccaggcccgcgcccagcagtgccagtacaacctgccggcgccggcagacaccggctggtcgacctccttcagcagcctggccggcaagagtgcgcagatgccgctctggtgggcgatgatgcacgccctgtccaagggcttcaccgccggcgcggtcgcggccattccgtgcggcacggatctgcggcagatgcgaatggaagtggacaatacgcgcgtgaacaacccgctgctggcacaagaaatcgctgacttttccagggactgctacggaccttcccgtgcgcggctgttcatgcggcaacccgatctgggctccatcgccgaggacaacaaggcgctgcaggacctgaactggatcggctcccgattcctgttgaacaccccggggtactacgacaccgactactcgaagagtccccgtcagtcgtggccctacaacgccacccgcgacgccgggctgccccaggtgggcggtggtggtggctacccaacctgcaagcagtggtgggctgactcagggatcggcttgcgtgatcggatcaagggccaggtggatccggacctgatgaccagcttcctcaagtgggcgaaatggctgaaccaggacgaggtaaccgaggcagtcattcgccaggtgatctccccctccagccaggtcaagggcaacgtctataccgattacggcgggcaggttggcggcaccgtctggaacggcatcgcgagaaccgcaggaaccttcggcgttgccctgggcagcctggcctatttcccggcgatggatatggtccgccaagcgctgccgatggtgatgtcgttcctcaagatggccatggtcatctgcattccgatggtcctggtcatcggcacctatcaactgaaagttgccatgacgatgacggtcgtcttctttgcgatgatgttcgtcgatttctggtttcagttagccagatatatcgatagcacgatacttgatgccttctatggttcgggatcaccgcatctttcatttgacccagtcatggggctgaatacggctactcaagatgcgatcttgaacttcgttatgggttctatgttcattgttttaccactactgtggatgacagcgatcggctggtccggaattcaagcagggtctgttctgaacggattgagcagagggactgaaggagttcaagccgccggcaaggaagcaggaaatagagttaaaaacgcagtttga

SEQ ID NO: 9996 - DNA, 204 bp, Pseudomonas aeruginosa
tcaattcagcctgtatcgattagccatccggctccaccagccctcgggaagttcggggaccaccccttcatgctcggccattttcaagcactgaagaacggtgctcaagccaagggagaaggcgtgatgtttatcctgcagcgcaaagatgagctcgtcatggcacaggctcccgctgtcatccccgttttgctcttggagtag

SEQ ID NO: 9997 - DNA, 204 bp, Pseudomonas aeruginosa
agggcgaagggaatggttcacaagggtaaaagccctacccgaaagggcctgccggaaggcagaaagggctgcgttcgcgccggcgaacacgaaaaggctacgggtgaacatccaccagcaggtgcccaatggttaagcctggcccagttcctcccaggcaaagcacaagacgggcctgtcagtaatttcgtgtttggggcataa

SEQ ID NO: 9998 - DNA, 510 bp, Pseudomonas aeruginosa; identical to SEQ ID NO: 4421

SEQ ID NO: 9999 - DNA, 444 bp, Pseudomonas aeruginosa
tcttggcgtgggtgtagccgagatcgacgaagcgccgcagttcctcttccaggcgtcccaggtcgtcgtgcggataggggtagccgccgccggcgtagaccggtacgcgctgcggatagtcttccgccagccccaggcgtcgcgccaggaagcgatgcagcggcaggccggcggccttggccgcggcatcccacagcgccatgtccagggcgcccaccgcgacgcagcgttcgccgtggccgccgggcttctcgtcgcgcatcatcaggtcccaggctcgcaacggatcgatgccactgccgtcgtcgctcgccaggctgtccgccggagcccccagcaggcgcggggcgaaacgctcgcggatcagcccgccctgggcgtagcgccctaccgaggcgtggccgtagccgaccacacgccgaccgtcgcgcacgatatcggtga

SEQ ID NO: 10000 - DNA, 1071 bp, Pseudomonas aeruginosa
gccaggccgaacagaaggtacagatactcctcgaacgcgacggcgagctcagcgaagcgccgttcgatgcggaaggcgacgaggcatgatcgcggcctaccaggcgcgctgccaggcgcgcgtcgatgccgccctggacgccctgttcgttgctccccgcgaagaactgcaacgcctctacgaggccatgcgctacagcgtgatgaacggtggcaagcgggttcgcccgctgctcgcctacgccgcctgcgaggccctcggcggagcgccgcagcgcgccgacgccgcggcctgcgcggtggagctgatccatgcctactcgctggtccacgacgacctgccggcgatggacgacgacgacctgcgccgtggccagccgaccacccaccgggccttcgacgaagccaccgcgatcctcgccgccgacggcttgcaggcgctggccttcgaagtgctcgccgacacccggcgcaatccgcaggaacatgccgtctgtctggaaatgctcacccgcctggcgcgcgccgcaggctccgccggcatggtcggcggccaggcgatcgacctcggctcggtcggcgtggccctcgaccaggcggccctggaagtcatgcaccggcacaagaccggcgcgctgatcgaagccagcgtgcgcctcggcgccctcgccagcggtcgcgccgagcccgcctcgctggccgccctggagcgctacgccgaagcgatcggcctggccttccaggtgcaggacgacatcctcgacgtggaaagcgacaccgccaccctcggcaagacccagggcaaggaccaggcgcacaacaagccgacctatcccgccctgctcggcctggaggccgccaaaggctatgccctggagctgcgcgacctggccctggccgccctcgacggttttccgccgagcgccgacccgctgcgccaactggcccgctacatcgtcgagcgacgcaactgaccgacgggtcgtcggaagtccccggcaaaggtaggggctcccttgcttgggcgcggccggtgcatcaggtaaactgctggcctctccggattgcataa

SEQ ID NO: 10001 - DNA, 435 bp, Pseudomonas aeruginosa
gattccccgcgagcgccccgccacgcccctgctcgaccgcgcctcttcgccggccgaactgcgccggctgggcgaggcggacctggaaaccctggccgacgagctgcgccagtacctgctgtataccgtcggccagaccggcggtcatttcggcgccggcctcggcgtggtcgagctgaccattgccctgcactacgtcttcgacactccggacgaccgcctggtctgggacgtcggccaccaggcctatccgcacaagatcctcaccgagcgccgcgagctgatgggcaccctgcgccagaagaacggcctggcggccttcccgcgccgcgcagagagcgagtacgacaccttcggcgtcggccactccagcacctccatcagcgccgccctgggcatggccatcgccgcccgcctgcaaggcaaggagcgtaa

SEQ ID NO: 10002 - DNA, 636 bp, Pseudomonas aeruginosa
cttcgacatctcctacctgcgctgcatccccggcatgctggtgatgacccccagcgacgaggacgagctgcgcaagctgctcaccaccggctacctgttcgatggcccggccgcggtgcgctatccgcgcggcagcggccccaaccatccgatcgatccggacctgcaaccggtggagatcggcaagggcgtggtccgtcggcgcggcggcagggtcgcactgctggtcttcggcgtgcagttggcggaggcgatgaaggtcgccgaaagcctcgacgccacggtcgtcgacatgcgtttcgtcaaacccctcgacgaagccctggtacgcgaattggcgggcagccacgaactgctggtgaccatcgaggaaaacgccgtgatgggcggcgccggctcggcggtcggcgagttcctcgccagcgagggcctcgaagtcccgctgctgcaactgggcctgcccgactactacgtcgaacacgccaagcccagcgagatgctcgccgaatgcggcctggatgccgcgggcatcgaaaaggcagtacgccagcgtctcgaccggcagtagcgccaaacccagcgacaacggcggataaccgcgttgcggttattcgccctaccccccaattgccgtag

SEQ ID NO: 10003 - DNA, 903 bp, Pseudomonas aeruginosa
acagcggcatcgccaggccatggggaaggggttgcagttcgccgaggaagaactcgaccaggatcagcggcaacagcgccaacgccagttgcaaccaccaggcacgtcccagcgcgccgcgggcttgctggcgactcacgtggtttccgcctcgccctggtgcaggctgccgagcatgtgcccgagcttgccggccttggtcgccaggtagcgcctgttgtgcttgttcaggcccttttgcagcggcacgcgctccgccacggtgatggcgtagctttccagcgccttgaccttgcgcggattgttggtcatcaggcgcagggaggagacgcccaggtgcgcgagcatcggctggcacatggcgtagtcgcgctggtcggcgccaaaacccagttgcaggttcgcctcgacggtgtcggcaccgccatcctgcaattcataggcacggatcttgttcagcaggccgatgccgcgaccttcctggcgcaggtagaggagcacgccgcggccctcctcggcgatggcggcaagcgcgccttccagctggaaaccgcaatcgcagcgcaggctgaacagcgcgtcgccggtcaggcattcggaatgcaggcgaccaagcaccggcgcgccatcggcgatgtcgcccatgctcagggctacatgttccttgccgctctcctcgtcgaggaaaccatgcatggtgaattcgccgaagggagtcggcagtttggaggcggcgacgaacacgacggacaccggggaactcctagggaaacggaagtccgccattgtaccagcagcgtccggcgcccggtcagctcgaaatgccgcaaatacctatcgagatggacgatgaatagaaccccgggttatgagcgagcgacattcaatgcttggcctcgataa

SEQ ID NO: 10004 - DNA, 723 bp, Pseudomonas aeruginosa
caggcggaaccggctcaggccctccagtggcggcggcggattgtctttcagggaaagcacggcgatcggatcgacgtcatagggccagcgagggtaaagcgcttcgtcgatttccccgcggtaggcgccgacccaggcgtcggcctcgccgcgcaggaccaggccgaccgcccgggtatagggctcgttggcgatccgcaggcgtaccccggccggctcgtagacggcccgcagcaggtcccaggccaccccgcgaccgtcctcctgggtgtagcgcgtccaggtttcgctgaccacgcggatctcgcccacggcgggggcggcggaagcgacgccgggcagcagccacaggcagcagaaaaggacgagcagacgcatgggaggcctcagaccagccagtgtacccatccccagactagaccctgcatgaccagccaggcgaataccccggccaggacgtcgtcgagcatgatcccgacgccgccgtgcacgttgcggtccacccaactgatcggccagggcttgagaatatccacgatgcggaacacgacgaagccgatcagcagccaccaccagccctccggcaccagccagagggttatccacatgccgaccatctcgtcccagacgatgccttcgtggtcgtgcacgcgcaggtcgtcggcgaccttgccgcacagccagaagccgaacagcatggtcactcccagcatcagccagtag

SEQ ID NO: 10005 - DNA, 1902 bp, Pseudomonas aeruginosa
tcaggatgctcagtcacgttgggttccgaaatgttggtagccggccgcggccggtatgagttcctttccgtcggcgtcgagcaggtgcaccccctgtcccgcctcgacccggccgatggcggccgtggccggccacgcggcgcgaatctcgccaaggtactcaggcggcagggtgaaaaccagcacgtagtcgtcgccggcggccagttgctggcgcaaggcttcctcgccggcgagcaggccgctcaacgcggcgcttgcctgcaagcgctggcattcgaccaacagggcaacgccggaagcgcgggcgatatgcccgcagtcggcgagcagcccgtcggagatgtccagggcggcgctggccttgccgcgcagggcgaggcccagaccgaattgcggggccggcgtccagtagcgcgccagcagcggttcggccacctcggcgggcgccgatcttcgctccagcaccagttccagcgccgctccagcctcgccgagcgggcccccgacgcagagcaggtcgcccgggcgcgcaccggcgcgggtcagcgcctggccggccggcaccctgccgaatacggtcagggtcatgctcagcgggccgcgcgtggtgtcgccgccgaccagggccaggccgcactgccgggccatggcgtcgaggccgcgggcgaagccctgcaaccactcggcgtcggcctgcggcaaggtcagggccagggtgaaggccaggggcgcggcgcccatcgccgccaggtcgctggcggagaccgccagggcgcgctgggcaagaaggaaaggggcgcaaccggcgggaaaatgcacgccttccaccagggtatcggtggagaccgccagttgttcgccggctggcggcgccagcagggcgcagtcgtcgccgatgccgagggccacgtccgccgccggcgccgcgcaggcggccgcggcgaagaagcggcggatcagctcgaactcacccatgacgccgccggcgcgggatcagcgcttgccgccgcgcagctcggcggcgcgcaggcgcggcgccagcttgtcgagcacgccgttgacgaacttgtggccgtcggtggcgccgaaggtcttggccagctcaatgccctcgttgatcactaccttgtagggcacgtcgatgcggttgcgcagctcgtaggtggacagccgcaggatggccagctcgaccgggtcgatctcggccagcgggcggtccaggcagggctcgaaggtggagtccagctcgctcttctgtcgcggcacgccgtgcaggatctcgtggaagtaggcgccgtcgacctcggagaagtcgttgtcggtgcggaactgcgcctcgatctcgtgcaggggctggccggcgatctgccaggagtacagggcctggacggccaggctgcgggccttgcggcgagcggcggtcttgcctttcggcggcttggctgccgggttgccgctgtcttgattgctcacttggcctccaactgcgccagcaggctgaccatttccagggccgacaacgcggcttcggcgcccttgttgccggccttggtgccggagcgctcgatggcctgctcgatggagtcgacggtgaggacgccgaaggcgaccgggatgccgaactgcagggacacctgggccaggcccttggtgcactcgccagccacgtattcgaagtgcggggtgccgccacggatcaccgcgccgagggcgatgatggcgtcgaagccgccttgctgggcgaccttctgggtcaccagcgggatctcgaaggcacccggggcgcggatgatggtgatctcgctttcagccacgccgtggcggaccagggcgtcgacggcgccgctgaccaggctttccacgacgaagctgttgaagcggccgaccaccagggcgtag

SEQ ID NO: 10006 - DNA, 714 bp, Pseudomonas aeruginosa
tggatcaggtcggcgatggtgccgatcttgatcccgtgctcggcggcgaacgcctccagttcgggccggcgagccatgctgccgtcgtcgttcatcacctcgcagatcaccccggacggctcgaacccggccatccgcgccaggtcgcaggccgcctcggtgtgcccggcgcgagccagggtaccgcccggctgggccatcagcgggaagatgtggccggggctgaacactttcggcggccacggcgttcttcgccgccgcagcctgcacggtgcgggcgcggtccgcggcggagatgccggtggtgacgccctcggcggcctcgatggagacagtgaacttggtgccgaagccggagccgttgcgctgcaccatcagcggcaggccgaggcgctcgcaacgctcgcgggtcatcggcatgcagaccaggccgcgggcatgcttgaccatgaagttgatgtcttcggtgcggacgcattcggcggccatgatcaggtcgccttcgttctcgcggtcctcgtcatccatcaggatgaccatcttgccttggcggatgtcttcgatcagttcgtcgatcgtgttgagtgccatgggcacccccttatgcaattcgtgggttacttgagaaaaccgttctcggcgagaaacgcttcgctgatgccggaggcgctgggctcggcggccttgtcgccaagcagcaggcgctccaggtaa

SEQ ID NO: 10007 - DNA, 1098 bp, Pseudomonas aeruginosa
ccttgtcgtccggcggtggccggtccggcaagcgctcgcgggctaggcgccttgcgcgccattaccgccggtggggactttcaccccgccctgagaacgttacggccaccgagatggccgtgtggcgttttaccacagttgcgccgcttgtgcatcgtccgccgcgtcgccgcgcagcgaagttcaggcgtcccgcggatggggccgcgcggtgaccagccagtcgtcgcccaccgcgcggatgtcgtcgatccgcaactgcgccgcatcggccatccgcgccagcggccagtcgagcaaaggacgggcgctggagccgaggaacttcggcgcgacgaacagccggtactcatccaccagccccagccgggcgaaggcgccggccagacgcgggccggcctccaccagcacttcgttggcgccgcgcgccgccagttccaggagcagcttgtgcaaatcgacgtggccctcggcggagggcagcgccagcagttcgtggccggcgtcctggaagcgttcgcgcgccgaggcggcggcgcaggtcgccaccagcgccggaccgggcgtggtagaacgccgactccagcggcacccgcagggcgcccgtcgaccagcacccgcaacggctggcgagccgcggcgagcgcggtaagctcggcgttcaggcccagttcgtcggggcgtacgttgagccgcgcatcgtccgccagcagcgtatcggcgccggacaacaccacgctggagcgagcgcgcaagcgctgcaccgccgaacgcgcggagggcccggtgatccactggctttccccgctggccatggcggtgcgcccgtccaggctcatcgccaacttgacccggacgaacggcaggccatgttccatgcgcttgatgaaaccgatgttgagttcccgcgcctcggcttcgaggacgccgctctgcaccgcgatgccggcctgcatcagacgcagcaggccgcgaccggcgacctcggggttgggatcctgcatcgccgcgaccacccgcgccaccccggcgcccaccagcgcatcggcgcacggcggggtgcggccgaagtggctgcagggctcgagggtcacgtag

SEQ ID NO: 10008 - DNA, 633 bp, Pseudomonas aeruginosa
aggaagccgcatggtagcgcatccgcgcccgaccgagcacccgcagaatcgaccggcgccggcacgctgggaaaggcgagaggaatcggacgttgcggcctacgcgaagcgcgacaagaatcacactttgcgctatacaagcgccgcccggattccaccgctatggagcagcccatgaccctgcgcccgatcgccctgctggccgtccttctcctcgccgcttgttccagcgacaagccgaagcctgcgccaacgccgcaagcttcgcgcagcgtgaccatggtcgagccggtgctaccggcccacctgcgcgagctgagcggaacgctgagcagcatccagggcagcctgccacgcggcagcgaggtgcagatggcactgctggtgatcgacgagcgcgaccgtccacagcggctgctggccagcgagacggtgctggccaccggcgaactcatgcccttccgcctgccgttcaaccccgaatccttcccgccggccggtggcgcgctgcgcgtcgaactgcacgcgcgggtgatccagtccggccagttggcctggcgcctgcatccgttgcggatcgcccagccgaccacccagtccctcggcgaactgcgcctggtacgcgcgccgtga

SEQ ID NO: 10009 - DNA, 978 bp, Pseudomonas aeruginosa
tggtcaccaccttgcgtttccgagaatcgacatgagcgatacgccctacatcttcgacgtcaccggcgccaacttcgagcagcaggtcatcgagaactcgttccacaagccggtcctggtggacttctgggccgactggtgcgccccgtgcaaggcgctgatgccactgctggcgcagatcgccgagtcctaccagggcgaattgctgctggccaaggtcaactgcgacgtcgagcaggacatcgtgatgcgcttcggcatccgcagcctgccgaccgtggtcctgttcaaggatggccagccggtcgacggtttcgccggcgcccagcccgaatcgcagatccgcgccctgctcgaaccccatgtgaaagcaccggcgctgcccgacgaagacccgctggaagtggcccaggcgctattcgccgaaggccgcatcggcgacgccgaagcgaccctgaaagccctgctggcggagaacaacgagaacgccgcggcgctgatcctctacgcccgctgcctggccgagcgcggcgaactggaagaggcgcaggccatcctcgacgcggtgaagagcgacgagcacaagcaggccctggccggcgcccgcgcgcagctgaccttcctgcgccaggctgccgacctgcccgacagcgcagagctgaagagccgcctggcggccgatgccggcgacgacgaggcagcctaccagttggccgtccagcagctcgcccggcagcagtacgaggcggccctggacggactgctcaagctgttcctgcgcaaccgcggctaccaggacgacctgccgcgcaagaccctggtgcaggtcttcgacctgcttggcaacgaccacccgctggtcaccgcctaccgccgcaagctgtaccaggcgctctactgagtcgccgagccccgtccgcggggctcagtcctccagccagacgaacacctgggtgccgtcgaccacctcgaccttga

SEQ ID NO: 10010 - DNA, 594 bp, Pseudomonas aeruginosa
ccacgcccatggcagcctgggcaagcacgagcacggcgtcgcccagttgaacgtggcgctggacggcaagaccctcgaactggagctggacagcccggcgatgaacctggtcggtttcgaacacgccgccagcaccgacgcggacaaggccgccgtggccaaggcccgcgcgcagctggaaaaaccgctggagctgttcgccctgccagtcaccgccggctgctcggtggccagccaggaactgcggagtccgctgttcggcgacaaggcgccggcccacgcgcacaaggagaaggcaggccacgaacacgaacacggtcatgccgatatccatgcccattaccagctcagttgcgagaagcccgagctgctcaagctgctgaccctcgccgagttcttcaagcgcttccccgccacccagaaaattcaggtacaactgatcggtcccgacggccagaaaggcgccgacctggctccggccagcgccgagctgaagctgtaggatcgttccggaggcgccgcgagggattcggcgcggcgcccctccatccattctcgaggctccggcggagcgttccgcccctacccccatga

SEQ ID NO: 10011 - DNA, 471 bp, Pseudomonas aeruginosa
ccaacctcggcttcgcctggcccggccaggcggagttgctggacattcccagcttccatctcgaacgcggcgagagcctgttcctcaaggggccttccggcagcggcaagaccaccctgctcggcctcctcggcggcgtgcagaagcccggccgcggcagcatccgcctgctcggcgaggacctggaaaagctgtccgccgcgcgccgcgaccatttccgcgtcgaccacaccggctacatcttccagcagttcaacctgctgccattcctctcggtacgcgagaacgtcgagctgccctgtcacttttccgcgttgcgccgtcagcgcgcccgcgaacgccacggtagcccggcgcaggccgccagccatctgctcggccagctcggcctcggcggcgaactgcacgaacgccgcgccgacagcctgtccatcggccagcagcagcgggtcgccgccgcccgcgcgctga

SEQ ID NO: 10012 - DNA, 354 bp, Pseudomonas aeruginosa
tcggcatgctcacggcgatcctcaccagcctcaacggatcgccgccgggagatggccatcctgcgctcggtgggcgcgcgcccctggcacatcttcggcctgctgctggccgaggccttcagcctggcgctggccggcgtcgccctcggcctcggcctgctctacctcggcatcgccgccagccagggctacgtccaggccaactacggcatctacctgccgctggcctggccgagcgactatgagtggagcctgctcggggctatcctggcggccgccgtgctgatcggctgcgtgccggcctggcgcgcctaccgccagtccctggccgatggcctgtcgatccgcctatga

SEQ ID NO: 10013 - DNA, 1410 bp, Pseudomonas aeruginosa
ctgcggcaacgggaacagcggcgagcggtaggcgcgcggcaggtccgggcgacggatgcgcagcagcaccacggagagggtcaccagcaggtaggcggtgccccaggcgcagaccgcagccaggaccaggtggatgatcccttcgctgtcgccgcccagccaccaggcgtgcaggcagggaatcgccgctgccacggcgatgcacagcaacggtgtcttgaagcgcgggtgcaggtaggtgaaggccttcggcaaggcgccatccagcgccatcccgtagagaatccgcggcaggccggccatcagggtgttgatggtggcggctccggcaaacagcaggcccacgcccagccagatgcgtccgaacggtcccatcacctgctcggcgaatcgcgggatcgccatcggcgtctccagcaggtgcaggccgccgccgaagtcgaagttttccacctgccggcgcatcgccgcgccatagatgaacatgcagcaggccaccccgatcaaccccagggccatcgcccgcggcagggtccgcgaagcgtggcgcacctccggcgccatcggcgtgacaaattcgcaaccgacgaacatgaacatcgccatgcccaccagcgacagcagggtcggcaggtcgtcgccgaccatcgaggccccgaaccagccctgcaactccaccgcgggcaggcgcaacaggccggccacggcgaaaatcatcagggtgctccacatgccgaaggtgaggatcacttcggcgcgaccgaaggcggtgatccccagcgcattcagcaggccgaagcagagcaccatgccgacgcccaccagccaggcgccgccgcccggctcggtgagggtattcagcgactcgaagttgaccagcgccatggtgccgctgagcatggtctcggcggtgccggcgaacacatggacgatcaggtaggccgacagcgtgccggtgatcgcgaagaagcgcccgaggccgcacgacaggtagtcgtagaccgagccacgggtcggcagcaggcaggcggcctcggcgaaggtggtggactgcgccagcatcagcagcagcgccaccagcatcgccacggcgaaggttccgccgcccaggccgaagccggtggtggcggtgaggatcaccgggctggccatgatcaacccgaccgaactggccagggcggtggggaaaccaacccgcccgcggagcaggtgctgggtgagtctggagttggacatcgacgtatcctcgacggcagcgttgctgttgttgttcttgcgtcaggccctgcgggacgcaccggcgtcccgtacgctccgccggcaggcgaggcgtgtcgaacaaaaggctgccgcggagggcagcgaaagagccgaacgaatcggctccccccgattcatcgatatcagtag

SEQ ID NO: 10014 - DNA, 465 bp, Pseudomonas aeruginosa
aggcgcgagccagcggtgcagacctgcccctggttgaagaagatcgcgccggcggaaccggcggcagccatgtccaggctggtgtcatcgaggatgatcaccggggatttgccgccgagttcgagggaaaaacgcgtcatgttctccaccgccgcatgcccgatcagcttgcccaccggggtcgagccggtgaacgccagcttatcgatgcccgggtgcgccgccagtgccgcgccggcctcggcgcccgtgccggtgacgatgttcaccacccctggtggaatccccgcctccaggcacaactggccgaggcgcagggcggtcagcggggtttcgtcggccggtttgaggactacggtgcagccgcaggccagggccgggacgatcttccagatcgccatcagcaaggggaaattccacggcacgatggctccgaccacgcccaccggctccggcaccgtgtag

SEQ ID NO: 10015 - DNA, 987 bp, Pseudomonas aeruginosa
cggatgaactccaccgaggcgccgacctccagggcccgcgacaggttgatcgacttgccgttgttcagggtttccaactgcgccagttgctcgccatgcgcctcgacccgttccgccagtcgcagcagcaggcgctcgcgatcggccgggcgctggcctgcccagctgccttcgaacgcgcgccgcgcggcagcgactgcccggtcgacgtcttcggcgccggcgcgggccacgcgagccagctcggcgccggtcgccgggtcgtacagcggcatgtcggcgccggaacgcgccggcccggactcaccgtcgatcagcaggccatggggactgcgcaagaaagcgctgacggacgggtcgatggcaatactcatgtgtgctcctcggcttggcgacggcgctgcgtcatgcatgcgcctactacccgggaatactctggacccgccgctcccccgctcgcttgctccagcctgccgggtttcttgccgctgcctgccaagccaggcagagagagacaagacggcgcgccggggcatggacattctgcccggcaggcaggacagtggacgtcccgccgcctcgtcccacgggagtcccgcgccatgccttcgaccctgtcgcccgacctcggcccgcgctgcatgcaggccttcacccaggtggtaccggccagcctgtgcgtgttctatcgcatcgacgaggactgccgcgcacacgatttccagctcctgcggatgccggccggcatgcaccgcgactacctgcgccactaccgcgactacgatccgctgcagccgcgccactgcctggccagcgcttcgccggtggtgccgctgcgccagggcatcgcccgccagcccgcggaggacagcgcgctgtaccagggcttcctgcgacgccacgggatctgcgacgtggtcgaggtgctggcgcatgcgcatcagcgtccggtggcggccctgtcgttactgcgcgacgcccgcctag

SEQ ID NO: 10016 - DNA, 894 bp, Pseudomonas aeruginosa
aggaaaaaccgggaaatacccagggcaggttcaacaggtaccaggccagggcgccgacgtcggcgaaatgcagcacttcccagccttcgccgcctgccaccggcagcagctccgcggcctccagctgggcgcgggcgaaacccagattccagtgcggtgcctccggcggcggcgccatttcgccattcacccagaggccgcccgctaccatccccgagtctacccgccaaggcaagtccatgcagatgtaaagcttgcttgacaaaaaacagcctcccgtccaatgtaaagcaccctttacacggacgattcaaccatgacccacaaacgtttcttcctcgaactgcttctcgcgctggtcggctatgccgctgccgttctgatcagcggccagtcgctggcgggcacggaaccgggcgccggccgggtcttcctcgccctgctgccggtgccaccgatggtcgccctggcgctggtggtgatccgttacctgcggcgcctcgacgaaatggcccggcgcatccatctcgaagccctcgccctggccttcgtcggcaccgccctgctcaccttcacctacggtttcctcgaaaccaccggctttccgaaactctcgatgttcttcgtctggcccctgatgggcgcgttctgggtcatcggctgcgtcctgggactgaggcgctacgcatgaggaaccgcgttcgcgagttgcgcgcggagcgcggttggtcacaggcggagctggccggaaagctggaggtatcgcggcagacggtgaacgccatcgaaaccggccgctacgatccaagcctgcccttggcgttcaagctcgcccgggtgttcggactggccatagaagcgatcttcgacgaccgggaaggccagttggactga

SEQ ID NO: 10017 - DNA, 3435 bp, Pseudomonas aeruginosa
cctcatgctcatggaactctccaagattgcgcctgcggaagagggccacactccaggcgagagcggccccggccgggaagggaggtccgccagggacctcccctgccggccttaccagatgttgccgtagtcgataccggcaggcggcaggagcgccgcctcgccgatcacgtagttgccgcccaggaccccatggttctcgccgacctgcgcaccgtagatctggccgtaatgggactgaggcttgaagtcgatcttgccgctgacgccggagtactcgatcgatcccaggttgacgccggccagcccgcccatggagacgtagtagtcgccactgacggtgccttccgacatggacgaaacgatgcgtccctggatctggttctcgccgaccaggccgccgatgcggctgcgcccgctgccgttgacggtactgctgctgcgcgccgacaggatcgaaccggcgttgctgccgaccaggccgccaaccgacgcactcgcagcggcgctgaccctgccgctggcatccacgttgaccagttcgccgccgttgtggccgacgagcccgcccaccagactgttgaacccgccgctcacgtcgccgcgcgagatcgcatgggcgacggaaccgccgaggttgtgtccaatcagcccgccgacgcgactgttgctgccgccgctgaccttgcccgtcgcctcggcggtctcgatggcgctctggctattgttgccgaccagcccgcccagatccgcgccgccctggtccgtgacgctgccgctggctttcaggtttccgagcatgccgttgccttctgccttgccgatcagcccgccggtcgccaggccgcccttgctgtacaccgacccgctcgcctgcgagcggaatatctcgccgccggaactcaggccgaccagcccgccggtattccccgcgccgccggcctccacctggccgctggcgctactatcggagacgtggccgaacatgttgtagccgaccaggccgccgacgttcaggccgggccggtaggtctcgaccttcccctggctgccggacgccctgatcgtggccttcgcattcagtccgaccaggccgccgacgccgcccaggctgttgcgctcggtggactgtgcagccacatggacgttgctgtgggcgttctcgatgaccgcctccggcccccaggcggtggtgaagttctcccccaccagacctccgaccgccgtgctcgccgcataagcggtgacgccgccgctgacggatgcgttcgtgatctgcccgttgatattgcgcccgaccaggccgcccagtgcgttggagcgcagtcggctgccgacgaccgagaccccgctggcgctgacgttggcgatacgcccgctgttgatcccgaccagggcgccgagcgaagacggaccggagccgtaggtgttatcggatacccgcaggttgttcagtttcaggttgctcagggtgcccgaggagcgggcgaacagcccgacattcggcccggtgttgctgatcgagagattgccgatgctgttgccgagaccgtccagggtgccgctgaagacgccggcgggcccgccgatggactgcagtgccgtgcagtaatagctgccgcccaggatattgccgccgagcacgtacaggccgtccaggttcttgttgatcgcctgcaactgcgccaggttctgcaccaccgtgtagtaatagccgccggagacgtaggtcgcgttggccccggccagggagaccgacgccgtgccgttcacccggtggccttcgccggcatccatggccagcgcgctgccagccccgccgagaacgatcttgtcattgatatcgatagcgccttcggccttcagctccagcccagccttggcgccactggcattcagcctgccattcagcgtcaggtcggccgcggagcccagccccagccggttgcccgatgcccagctcaccgagccgtcgaggtccaggtcgcccttggtcgaaaccagttcgatattggtgctcgccaggttccgcgacagggtgtcggcatgaacggtgacgccatccgacaccgccgacgggcgcacgtcgatcttgtcggcagcaatcttccaggtaccgttgaggccattgctggcgagcgtgttcacctgggtgcccagggccacctccaccgcctgcccccggacctcgaccgtcccgccgtgccccggtccgttcagcgcattggcggacaaggcgcctcccaccatgaccttgccgtccgggccgccatcgagcacgatccgcccgttcttgccgcgcagcgagcgggcctcgatggcaccctgggtgttcaccaccgtgtagagcagcgcattggcggtcatggccgccatcaggactcgccccccgtcggccttgagcagaccgccgttgcttgccagcgcattggcgaccccggcgtcgacgcggatgtcgagcagcttgttgccgtcgaaattcagtgtcaggtcgctgcccgcaccgagcccgacaccgcccatttgcgccaggaccgtcccgcggttgtcgacctgcgcgccgagcagggcgatgctgccgccttccgccgcggtgatggcgcctccctggttgaggacaccgttggtagagggacccgtgaaacggtatctggaggagttgccgttgaactcggcatccgtgatgtccagcgtggaagccaccaggccgccgacattgacctgggcgccgcgaccgaagagcacgccgttggggttgaccaggaagacctggccgttggcatcgatccggccctggatatcgctggccttggtgccgatcacccgattcagggcaatcgagctactgctcggctggttgaagatcacccgctcgccggcggcaacgctgaaggagtcccagttggcgatgagcttgtcgaccttctggttgaccgacaggctgttgccgcccgacaggtgtatctccccgttcgcgctcccgccgaccaccgttcccccgcttggcagcgcataggccggagccagggccgtggcgcccagcagggccaggacggaggcgatcgccgccttggcgccggcgggcttgccgcgcctgcgactgccttcgctgacgacgttccagcagccctgggatacgttccagaccagtgcatagcatttgttcatgtgcttccttcctccagtgaaaccccgcgacctattcgcagggccgtgctacggcaggagcccaactccccgggccctgccgaactcctacgggtatctctctgccggcgcgtcgccgcgctcgatctggccgtcatcccccaccgcatcgaaatggacccgcgccgcctcgccgggcacggccggcagactcaacggggtaacggcgaaaggcggcaaggtgacgctgccgagggacatggcgaggtcgccctcgcccagctctag

SEQ ID NO: 10018 - DNA, 648 bp, Pseudomonas aeruginosa
gcgcaccagggaaacgtgatagggactgcggttgtccgcctccagcagcacccgctgccccggccgtaccgccggacgcaggcgccagacgacctggcgcgcggcggctcgcggatcgccggccagaccctgcggacggaacaggagcttcatccgcaggcggtagctcaccagcagcaggttgccgctgccgtcctcccgccccggcacctccagcaggttgacccagaacagcgattcccggtcgtccggcagcggctcgccggtatggcgaatctggagcgcctgggtctcctgcgggtccatgcgcaacagcggcggcgacaggatgaacggcaccgtgacagcgctcgggtccgccgtctcgtcgccgcgatcgagccaggcctggaccagggccgggcgcgtcccgacgttaccgacgcggatcgtcagcgcggaaacgcccgccggatagatgaaacgggtcccgatcacggacagcgaggcggaggcatcggccaccagcgccaccagcaggacccaggccgtgccgcatcgtcccaggccgacgccggtcacagcgtgcgctcccggtcggcggccgacgccgggcgacatgccagttgcaggacgggaggcgtcgtctcgcgcgggcccagcgcatag

SEQ ID NO: 10019 - DNA, 549 bp, Pseudomonas aeruginosa
cgtcgggacgcgcccggccctggtccaggcctggctcgatcgcggcgacgagacggcggacccgagcgctgtcacggtgccgttcatcctgtcgccgccgctgttgcgcatggacccgcaggagacccaggcgctccagattcgccataccggcgagccgctgccggacgaccgggaatcgctgttctgggtcaacctgctggaggtgccggggcgggaggacggcagcggcaacctgctgctggtgagctaccgcctgcggatgaagctcctgttccgtccgcagggtctggccggcgatccgcgagccgccgcgcgccaggtcgtctggcgcctgcgtccggcggtacggccggggcagcgggtgctgctggaggcggacaaccgcagtccctatcacgtttccctggtgcgcctagagctgggcgagggcgacctcgccatgtccctcggcagcgtcaccttgccgcctttcgccgttaccccgttgagtctgccggccgtgcccggcgaggcggcgcgggtccatttcgatgcggtgggggatga

SEQ ID NO: 10020 - DNA, 1008 bp, Pseudomonas aeruginosa
ctcgattgccctgaatcgggtgatcggcaccaaggccagcgatatccagggccggatcgatgccaacggccaggtcttcctggtcaaccccaacggcgtgctcttcggtcgcggcgcccaggtcaatgtcggcggcctggtggcttccacgctggacatcacggatgccgagttcaacggcaactcctccagataccgtttcacgggtccctctaccaacggtgtcctcaaccagggaggcgccatcaccgcggcggaaggcggcagcatcgccctgctcggcgcgcaggtcgacaaccgcgggacggtcctggcgcaaatgggcggtgtcgggctcggtgcgggcagcgacctgacactgaatttcgacggcaacaagctgctcgacatccgcgtcgacgccggggtcgccaatgcgctggcaagcaacggcggtctgctcaaggccgacggggggcgagtcctgatggcggccatgaccgccaatgcgctgctctacacggtggtgaacacccagggtgccatcgaggcccgctcgctgcgcggcaagaacgggcggatcgtgctcgatggcggcccggacggcaaggtcatggtgggaggcgccttgtccgccaatgcgctgaacggaccggggcacggcgggacggtcgaggtccgggggcaggcggtggaggtggccctgggcacccaggtgaacacgctcgccagcaatggcctcaacggtacctggaagattgctgccgacaagatcgacgtgcgcccgtcggcggtgtcggatggcgtcaccgttcatgccgacaccctgtcgcggaacctggcgagcaccaatatcgaactggtttcgaccaagggcgacctggacctcgacggctcggtgagctgggcatcgggcaaccggctggggctgggctccgcggccgacctgacgctgaatggcaggctgaatgccagtggcgccaaggctgggctggagctgaaggccgaaggcgctatcgatatcaatga

SEQ ID NO: 10021 - DNA, 465 bp, Pseudomonas aeruginosa
cacctacggctccggtccgtcttcgctcggcgccctggtcgggatcaacagcgggcgtatcgccaacgtcagcgccagcggggtctcggtcgtcggcagccgactgcgctccaacgcactgggcggcctggtcgggcgcaatatcaacgggcagatcacgaacgcatccgtcagcggcggcgtcaccgcttatgcggcgagcacggcggtcggaggtctggtgggggagaacttcaccaccgcctgggggccggaggcggtcatcgagaacgcccacagcaacgtccatgtggctgcacagtccaccgagcgcaacagcctgggcggcgtcggcggcctggtcggactgaatgcgaaggccacgatcagggcgtccggcagccaggggaaggtcgagacctaccggcccggcctgaacgtcggcggcctggtcggctacaacatgttcggccacgtctccgatag

SEQ ID NO: 10022 - DNA, 987 bp, Pseudomonas aeruginosa
ccagagcgccatcgagaccgccgaggcgacgggcaaggtcagcggcggcagcaacagtcgcgtcggcgggctgattggacacaacctcggcggttccgtcgcccatgcgatctcgcgcggcgacgtgagcggcgggttcaacagtctggtgggcgggctcgtcggccacaacggcggcgaactggtcaacgtggatgccagcggcagggtcagcgccgctgcgagtgcgtcggttggcggcctggtcggcagcaacgccggttcgatcctgtcggcgcgcagcagcagtaccgtcaacggcagcgggcgcagccgcatcggcggcctggtcggcgagaaccagatccagggacgcatcgtttcgtccatgtcggaaggcaccgtcagtggcgactactacgtctccatgggcgggctggccggcgtcaacctgggatcgatcgagtactccggcgtcagcggcaagatcgacttcaagcctcagtcccattacggccagatctacggtgcgcaggtcggcgagaaccatggggtcctgggcggcaactacgtgatcggcgaggcggcgctcctgccgcctgccggtatcgactacggcaacatctggtaaggccggcaggggaggtccctggcggacctcccttcccggccggggccgctctcgcctggagtgtggccctcttccgcaggcgcaatcttggagagttccatgagcatgaggttatttcccggccgcgtttccctgcgccgccggcctggcgcgcaggctcggcaggcgctcgttctcggcctctgctgcctgaccggcggccaggcctgggccctgaacgaggtcgccctgaactgctcgttcgacaatggcaaaggcttgccctggcgtgtggtgaacgagctgaccagcggcacggcgaaaggcacggtgctgttcgccaggccggtgagcctgttcctgaactacaagccccaggcttcccaggaggcgcatga

SEQ ID NO: 10023 - DNA, 657 bp, Pseudomonas aeruginosa
ggagacgcaaggatgtccctacatcgcattcgcgtaatggttgcggatgatcatcccgccatttcgctgggtatttcctacgaactgagtcagtgcggttctttggagatgctcggtcaagtttccaattctaccgagttgatcggtcggctcgacgaaggcgactgcgatgtcgttatcgtcgactatacgatgccgggcgggaaatatggcgatggactggcattgttgtcattgctgcggcgacgttatccgcatctgcaattggtcgtctttaccatgctgaacaatccgggccttatccgggccattctcaagcagggtatcaattgcatcctcagcaagtccgactcgaccagtcacctgctggcggcggtgagcgcggcctattcgcgaaaccagtatttctcgccgtcgatcagggacatcttcgtcaaccaggtgctttcctcgcacaacgaacggctgacgccccgggaggcggaaatcgtccgtctgttcggctccggactgaccatcaccgaaatcgccgagcgctcgcatcgcagcgtgcagaccatcagtacgcagaaggtcagtgccatgaagaagctcggcatcaagcgcgatgccgacctcatcaggtatgcggccgagggctattgccggatgccctga

SEQ ID NO: 10024 - DNA, 285 bp, Pseudomonas aeruginosa
tcgggcagttcctggcgcagtgcggtcttgatggcggcgagcacggccctggcatcgccgtcctgctggcgggggaccacgaaggcgctcaattgctggctaccggagcgtgggtcggcatgcgccagcaccaccgcgccgtggatagccggctggcgcaacagcgcggcctcgacgtcgccgagttcgacgcggtggccgcggatcttcacctggtcgtccagccgaccgaggaactgcaggctgccatcggccagccagcgggccttgtcgccggtgcggtag

SEQ ID NO: 10025 - DNA, 423 bp, Pseudomonas aeruginosa
atcgtccgtgtaaagggtgctttacattggacgggaggctgttttttgtcaagcaagctttacatctgcatggacttgccttggcgggtagactcggggatggtagcgggcggcctctgggtgaatggcgaaatggcgccgccgccggaggcaccgcactggaatctgggtttcgcccgcgcccagctggaggccgcggagctgctgccggtggcaggcggcgaaggctgggaagtgctgcatttcgccgacgtcggcgccctggcctggtacctgttgaacctgccctgggtatttcccggtttttccttcaggcgccaccgcaagggcctgcgcggcctgcacgagagcggcgagccgctggtggtgcggcagttcctcttctggctggaggcgcgcaacccccaggccgcgcgcggctag

SEQ ID NO: 10026 - DNA, 1917 bp, Pseudomonas aeruginosa
acgcccacaacctgctcgacccgtcgatgccgttcggcggcttcaagcagtccggcatcggacgcgagatgggccatgcggcgatcgaggcgtacaccgagaacaagtcggtgtgcatcgcctactgatatcgatgaatcggggggagccgattcgttcggctctttcgctgccctccgcggcagccttttgttcgacacgcctcgcctgccggcggagcgtacgggacgccggtgcgtcccgcagggcctgacgcaagaacaacaacagcaacgctgccgtcgaggatacgtcgatgtccaactccagactcacccagcacctgctccgcgggcgggttggtttccccaccgccctggccagttcggtcgggttgatcatggccagcccggtgatcctcaccgccaccaccggcttcggcctgggcggcggaaccttcgccgtggcgatgctggtggcgctgctgctgatgctggcgcagtccaccaccttcgccgaggccgcctgcctgctgccgacccgtggctcggtctacgactacctgtcgtgcggcctcgggcgcttcttcgcgatcaccggcacgctgtcggcctacctgatcgtccatgtgttcgccggcaccgccgagaccatgctcagcggcaccatggcgctggtcaacttcgagtcgctgaataccctcaccgagccgggcggcggcgcctggctggtgggcgtcggcatggtgctctgcttcggcctgctgaatgcgctggggatcaccgccttcggtcgcgccgaagtgatcctcaccttcggcatgtggagcaccctgatgattttcgccgtggccggcctgttgcgcctgcccgcggtggagttgcagggctggttcggggcctcgatggtcggcgacgacctgccgaccctgctgtcgctggtgggcatggcgatgttcatgttcgtcggttgcgaatttgtcacgccgatggcgccggaggtgcgccacgcttcgcggaccctgccgcgggcgatggccctggggttgatcggggtggcctgctgcatgttcatctatggcgcggcgatgcgccggcaggtggaaaacttcgacttcggcggcggcctgcacctgctggagacgccgatggcgatcccgcgattcgccgagcaggtgatgggaccgttcggacgcatctggctgggcgtgggcctgctgtttgccggagccgccaccatcaacaccctgatggccggcctgccgcggattctctacgggatggcgctggatggcgccttgccgaaggccttcacctacctgcacccgcgcttcaagacaccgttgctgtgcatcgccgtggcagcggcgattccctgcctgcacgcctggtggctgggcggcgacagcgaagggatcatccacctggtcctggctgcggtctgcgcctggggcaccgcctacctgctggtgaccctctccgtggtgctgctgcgcatccgtcgcccggacctgccgcgcgcctaccgctcgccgctgttcccgttgccgcagctattctccagcgccggaatcctgctggggatgttctacatcacgccgccggggatgaaccccgccgacatctacctgccgttcgccctgatgctcggcctggcggccgcctacgccctgttctggaccctgtgcgtacagcgggtgaatccgttccgtccgctggcggtggaagaggtgctggagaaggaattcgccgaagaggaccagcagcagcgggagagggcgcatgtccgcctgggcgcgctggtatgagcgtcactggcgcgactggcggccagccgcctatcgccccggagccaccctggccctggtgcggcgcaacctggctgcgtgcgacggcgaggcgcaggacggcaggctgttgctgcgtacgaaagagctga

SEQ ID NO: 10027 - DNA, 336 bp, Pseudomonas aeruginosa
ttgccgcgccatacaacaataacgatggccgttgccgtcaggaggtgcccggtgcataccctgtcttccgcacacaacagcttcgaagcctggaaccaggcgttgcgccaggtctgcgggcgcttcgaatcgcaacccgcgctgaaccggacgctgttcattggcgatatctcgcggcaggacctcggcggtctggagttggcgcagatccgcaccaacgcagggcgcatcgcccgccaggccacccatgccgatcatgacgacgaccgccactgcttcctggtcgtccagcgcagcggccatgcgcaactgcgccagggtggggacagcatataa

SEQ ID NO: 10028 - DNA, 783 bp, Pseudomonas aeruginosa
cctggcgccaggggaaatggcgctgatggactccgcgggcggctgcgaaatcattccccacggactcatcgaacacacctcgttccatctctcccgcgaagaggtatgccggcacctgccacccagccagcgggccttcggcaaactctcgccgaactgcgccagcggtcgcctgctgagcctgctggtgcagcaggtgtgcgccggagaactgcagccgtgggcggtggcggacgagggcggggcgttgcaggaggcgctgatcgccctgctcgggccggcgctacagcacgccggcgaggaattggagggaccgctggccgggctctatggctacagtctgcgccggcacgcggagcgtctgatcgagcaatccctgcaggagccgcgcctgagtccggacatgctcgccggccgcctgcgcatctcggtgcgccagttgtaccggttgttcgaggagcagggcgacagcgtctgccgctacattctccgccagcgcctcagccgcagcgccgccgacctcggcaacccacggctgcgcggcgaatcgatcacctccatcgccttcaagtggggtttcagcgactcggcgcatttcagccgggcgttcaagaagcagttcgaggtttcgcccaaggactatcgggccggcgcgctaccggcctgacgccgccgcgcgctgccattcgtcccgccgatccgcgccgcaggcggagctggcccggtgaatgcttgacgcttcaccggaggcacagcaagaatgcggcgtgtcaggttgcatga

SEQ ID NO: 10029 - DNA, 1020 bp, Pseudomonas aeruginosa
tggtctgcaagaagatcctccacaccttcggcatcaagccgcgcgcctggcgcgcaggtttgccggctctattggacaggtactacaggcatgtttgaacgccccatcctgatcaccggcggcgccggtttcatcggctcccacctgaccgacgcgctgctggcgcgcggctaccgcgtgcgtgtgctggacaacctgtccaccggcaagcgcgacaacctgcccctggacgacgaacgggtagagctgctcgaaggcgacgccgccgacgcggcgaccctggcggccgccctgaagggctgcgcggcggtcgcccacctggccgcggtcgcctcggtacaggcctcggtggacgacccggtcgccacccaccagagcaatttcatcgccaccctgaacctctgcgaagcgatgcgcgagcagggcgtgaagcgcgtggtgttcgcttccagcgcagcggtctacgggcagaacggcgaaggcacggcgatcgacgaagacaccccgaagtcgccgctgacgccctacgcgtcggacaagctggccagcgagtactacctcgatttctatcgccgccagcatgggctggaaccggcgatcttccgcttcttcaacgtctacgggccacgccaggacccgtcctcgccctattccggggtgatcagcatattcaccgagcgcgccctgaaggggacgccgatcaccgtgttcggcgacggcgagcagacccgcgacttcatctacgtcgccgacctggtcgatttcctggtccaggcgctggaggcgacggcggtggaacccggggcggtgaacgtcggcctgaatcgcagcatcagcctgaagcagttgctggcagagatcggccaggtgctcggtggcctgccgccggtgacccacgccgacgcgcgagccggtgacatcaggcattcgcgggcgaacaacgagcgcctgctgcggcgtttccgcttcgaccagccgacgccgatgggcgtgggcctggcgcgcctgctcggacgctga

SEQ ID NO: 10030 - DNA, 453 bp, Pseudomonas aeruginosa
tcaccaccagggcttgttcagcgccaggtagaagatcccgcccagcagggtgaggctgaggacgctgagcaggcccttgccggggccccgcgccatccgcagggcgaacgccgcgcagacgatgtagcccagcaacagccccagcttcgccagcagccagagcggcagcggccagggcatcgccaggtgcaccaggccgagcgcgctgagcagcagcagggtgtccaccagatgcggtccccagcggcggatgccgctggccttgcgccccgaccagttccaggccaggcgccagacgaacagggcggcgctgctgagggcgaaggtgatgtgcagggtcttcagccagaggtacatggggtccgtttccgcaggatgaaaaaaggcgcccgaaggcgccttttcccgttgggggcgcaagccccgcgacagtctacgactcagaacttgtag

SEQ ID NO: 10031 - DNA, 1395 bp, Pseudomonas aeruginosa
aggcctcggccagcagcaggccgaagatgtgccaggggcgcgcgcccaccgagcgcaggatggccatctcccggcggcgatccgttgaggctggtgaggatcgccgtgagcatgccgatcaggccggtgaggacgacgaacagcgagaccacgaacagtgccttttcggcggtgcccatcaggccccacagttcctgcagggcgacaccgggggaggatcgccatcagcggttcgccgggatagtcgttgacctcgcgttgcagggcgaaggtcgccaccttgctcttcaggccgaccaggaacgcggtgatcgcctgtggttgcaggtccatgtgccgcgcctgctcggcactgacgcgcccggcgcccatcgccggcaccccgttgcgccagtcgacgtgcagcgcctccatgccggcgagggatatgtgcagggtgcggtccaccggggtaccggtgcgctggaggatgccgaccacggtgaacggcttgtcgtcgtgcttgaccaggctcaccgtgctcaccccatgggccagcacgatcttctcgccgagcctgtagtgcagggcttcggccacctcggcgccgagcaccacgtcgaacaggtcctggccgaaggcgcggccctcggccagttgcagttcctggccgcggccgtagcggtagtgctcgaaatagccggcatcggtacccattacccggtagccgcggtgcgagtcgccgagggagatcgggatcgcccacttcacccgcgggtttccggcgaagtgccggtagctgtcccagcggatgttgttggtcgcgttgccgatgcggaataccgagtagagcagcaggttcaccgagccggagcgcgcgccgacgatcaggtcggttccggagatggtactggcgaagctggccttggcctcggtgcggacccgctccaccgcgagcagcaggcaggcggagagggcgatggcgaagatcgtcagcagggcggtgaagcggcggttggccaggctggccagtgccagtcggaagagatacatgctcagagtcctgccggccgggcggcgcggttgagatcggaaagggacaggctgcggtcgaacagcccggccaggctctggtcgtggctgacgaacagcaggctggcgccggcctcgcggcattcggcgaagagcaactggagaaacgcctcgcggctgtcggcgtcgagcgccgaggtcggctcgtcggcgatcaccagctccggctggccgatcagcgcgcgggcggcggcgacccgctgctgctggccgatggacaggctgtcggcgcggcgttcgtgcagttcgccgccgaggccgagctggccgagcagatggctggcggcctgcgccgggctaccgtggcgttcgcgggcgcgctga

SEQ ID NO: 10032 - DNA, 423 bp, Pseudomonas aeruginosa
cctggccgatttggcccctacgcgccgacgtgggagcatggcgcgattcgcttgtggagaaacgagatggtgcggattcgcggaagcatcggcgactggccggtggacctgaccctggaactggacgccgaggattggcgccagctggcgcaacacgtgcccccgccgccgctgggcgagccgcaggtcgcggcggccagggcgccggcgccggcagcgccggtggatcgcctgtggcagaccgcccaggacctgctgcgcggcagcgggcggatcgaggggccgcagttgctggcggagttggaggggttcagcggcaatgccggcgccgccaagcaactgcttgtgcgcctgcggcatgacgcccgggtcaaggtcgaggtggtcgacggcacccaggtgttcgtctggctggaggactga

SEQ ID NO: 10033 - DNA, 648 bp, Pseudomonas aeruginosa
cggtggaatccgggcggcgcttgtatagcgcaaagtgtgattcttgtcgcgcttcgcgtaggccgcaacgtccgattcctctcgcctttcccagcgtgccggcgccggtcgattctgcgggtgctcggtcgggcgcggatgcgctaccatgcggcttccttcagctacgcctgtatcagcaccatgcattgtcccttctgcggtgcccatgacaccaaagtgattgactcgcgactggtcgccgagggcgatcaggtgcgccggcgccgcgagtgcctggcctgcggcgaacgcttcaccaccttcgagaccgccgagctggtcatgccgcgcctgatcaagcaggacggcagccgccagccgttcgacgaggacaagctgcgcgccggcatgcagcgcgccctggagaagcgtccggtcagcgtcgagcgcctggaagcggccatcggccacatcaagcaccagttgcgcgccaccggcgagcgcgagatcaagtcgcgggtgctgggcgaactggtgatggccgagctgcagaagctcgacgaagtcgcctacatccgtttcgcctcggtctaccggcgcttccaggacctcaacgaattccgcgaggagatcgaacgcctcgcccgcgagccggccaaggaatga

SEQ ID NO: 10034 - DNA, 810 bp, Pseudomonas aeruginosa
gttcgagctgatccgccgcttcttcgccgcggccgcctgcgcggcgccggcggcggacgtggccctcggcatcggcgacgactgcgccctgctggcgccgccagccggcgaacaactggcggtctccaccgataccctggtggaaggcgtgcattttcccgccggttgcgcccctttccttcttgcccagcgcgccctggcggtctccgccagcgacctggcggcgatgggcgccgcgcccctggccttcaccctggccctgaccttgccgcaggccgacgccgagtggttgcagggcttcgcccgcggcctcgacgccatggcccggcagtgcggcctggccctggtcggcggcgacaccacgcgcggcccgctgagcatgaccctgaccgtattcggcagggtgccggccggccaggcgctgacccgcgccggtgcgcgcccgggcgacctgctctgcgtcgggggcccgctcggcgaggctggagcggcgctggaactggtgctggagcgaagatcggcgcccgccgaggtggccgaaccgctgctggcgcgctactggacgccggccccgcaattcggtctgggcctcgccctgcgcggcaaggccagcgccgccctggacatctccgacgggctgctcgccgactgcgggcatatcgcccgcgcttccggcgttgccctgttggtcgaatgccagcgcttgcaggcaagcgccgcgttgagcggcctgctcgccggcgaggaagccttgcgccagcaactggccgccggcgacgactacgtgctggttttcaccctgccgcctga

SEQ ID NO: 10035 - DNA, 771 bp, Pseudomonas aeruginosa
gctgctggcgctgttcgaccggcgcatgcggcagttgcatgccagcggcgagctggagcggatcttcgcccgctggaactggccctatgcgccgttgaaggcaatcctgccacccaaggagtgatcatgctgcggctgtgcgtcgccctgttttccagcgttctcgcgttgtcctcgctggccgcgccccaggtgttcgtggtcggcctgttccccggcgcggcggtactcaacgtcgatggccagcgcaagctggtcagggtcggccagaccggcccgcagggcgtccaggtggtcagcgccgacagccgcaaggcggtgctgcggatcgacggcgtcgagcgcacctacgaactgagccgcgaatacaacgaggcaggctattcggcgccgcagcggcaaagcttcagcatcgcccgcggtacgggcgggcactattgggtggctggctcggtgaacgggcagaacatgcagttcctggtggataccggcgccaccagcatcgccatgaacgagaacgaggcgcgccgcctgggtatcgattaccgggtggacggcaagccgatggtcgcctccactgccagcggaacctcgcgcggctggcgggtgaccctggaccgggtgaagatcggcggtatcgagttgctgggtgtcgaggcggcggtgatcgagggtggctatccgaccgaagccctgctcggcatgagtttcctcaaccgggtgcgttggcgcgaggaacagggaatgctgcttatcgaggccaagcattga

SEQ ID NO: 10036 - DNA, 717 bp, Pseudomonas aeruginosa
attgcaggatggcggtgccgacaccgtcgaggcgaacctgcaactgggttttggcgccgaccagcgcgactacgccatgtgccagccgatgctcgcgcacctgggcgtctcctccctgcgcctgatgaccaacaatccgcgcaaggtcaaggcgctggaaagctacgccatcaccgtggcggagcgcgtgccgctgcaaaagggcctgaacaagcacaacaggcgctacctggcgaccaaggccggcaagctcgggcacatgctcggcagcctgcaccagggcgaggcggaaaccacgtgagtcgccagcaagcccgcggcgcgctgggacgtgcctggtggttgcaactggcgttggcgctgttgccgctgatcctggtcgagttcttcctcggcgaactgcaaccccttccccatggcctggcgatgccgctgttcatcgccgcgctgctgtcgatgttcgtcaacctgccgctgttcggtgcctacaagcgtggtctcatcgccacccagaaagcgctggatacggcggaggaagccgccgcctggacccgtctggcgcaggtgcgccgcaaggccctgttcggcgccagcctgccggcctggatcggcgtgccgggtgtgttcgccgggctcaacggcgttgcgctgatcctgctcggggtcaccagcctggtgctgttctggctctaccgtattccgcgtcaactcggttga

SEQ ID NO: 10037 - DNA, 4515 bp, Pseudomonas aeruginosa
ccgcaacgcggttatccgccgttgtcgctgggtttggcgctactgccggtcgagacgctggcgtactgccttttcgatgcccgcggcatccaggccgcattcggcgagcatctcgctgggcttggcgtgttcgacgtagtagtcgggcaggcccagttgcagcagcgggacttcgaggccctcgctggcgaggaactcgccgaccgccgagccggcgccgcccatcacggcgttttcctcgatggtcaccagcagttcgtggctgcccgccaattcgcgtaccagggcttcgtcgaggggtttgacgaaacgcatgtcgacgaccgtggcgtcgaggctttcggcgaccttcatcgcctccgccaactgcacgccgaagaccagcagtgcgaccctgccgccgcgccgacggaccacgcccttgccgatctccaccggttgcaggtccggatcgatcggatggttggggccgctgccgcgcggatagcgcaccgcggccgggccatcgaacaggtagccggtggtgagcagcttgcgcagctcgtcctcgtcgctgggggtcatcaccagcatgccggggatgcagcgcaggtaggagatgtcgaagctaccggcgtgggtcgggccgtcctcgccgaccaggccggcgcggtcgatggcgaacagcacgtcgaggtgctgcacggcgacgtcatggatcaactggtcgtaggcgcgctggaggaaggtcgagtagatcgctaccaccggcttcatgccctcgcaggccatgccggcggccagggtcacggcatgctgttcggcgatggcgacgtcgaagtagcgttccggataacgttcgctgaaggccaccaggtcggaaccttccttcatcgccggggtgatgccgagcaggcgcgcgtcctgggcggccatgtcgcacagccactggccgaagacgctggaatacttgggtccgccggtcttcttcggcgcactgccgggagcttccagcttggtgatcgcgtggtagccgatcggatccagttcggccggggcgaagcccttgcctttcttggtcaccacatggaggaactgcgggcccttcatgtcgcgcatgttgcgcagggtagccaccagggtcggcaggtcgtggccgtcgatcgggcctatgtagttccagccgagctcctcgaacagggtgccggggaccagcatgcccttggcgtattcctcggtgcgccgggcgatctcccaggccccgggcaggcgcgagagcaccttcttgctgccctcgcgcatgctgctataggtgcggctggagaggatcttcgccaggtagttggagagcccgccgacgttgtgcgagatcgacatgtcgttgtcgttgaggatcaccagcatgtcggcgtcgacttccgaggcgtggttgagtgcctcgaaggccatgccggcggtcagcgcaccgtcgccgatcacggccaccgacttacgctccttgccttgcaggcgggcggcgatggccatgcccagggcggcgctgatggaggtgctggagtggccgacgccgaaggtgtcgtactcgctctctgcgcggcgcgggaaggccgccaggccgttcttctggcgcagggtgcccatcagctcgcggcgctcggtgaggatcttgtgcggataggcctggtggccgacgtcccagaccaggcggtcgtccggagtgtcgaagacgtagtgcagggcaatggtcagctcgaccacgccgaggccggcgccgaaatgaccgccggtctggccgacggtatacagcaggtactggcgcagctcgtcggccagggtttccaggtccgcctcgcccagccggcgcagttcggccggcgaagaggcgcggtcgagcaggggcgtggcggggcgctcgcggggaatctcatggagcgtcttgggcatcaggctgtcgttatgcaatccggagaggccagcagtttacctgatgcaccggccgcgcccaagcaagggagcccctacctttgccggggacttccgacgacccgtcggtcagttgcgtcgctcgacgatgtagcgggccagttggcgcagcgggtcggcgctcggcggaaaaccgtcgagggcggccagggccaggtcgcgcagctccagggcatagcctttggcggcctccaggccgagcagggcgggataggtcggcttgttgtgcgcctggtccttgccctgggtcttgccgagggtggcggtgtcgctttccacgtcgaggatgtcgtcctgcacctggaaggccaggccgatcgcttcggcgtagcgctccagggcggccagcgaggcgggctcggcgcgaccgctggcgagggcgccgaggcgcacgctggcttcgatcagcgcgccggtcttgtgccggtgcatgacttccagggccgcctggtcgagggccacgccgaccgagccgaggtcgatcgcctggccgccgaccatgccggcggagcctgcggcgcgcgccaggcgggtgagcatttccagacagacggcatgttcctgcggattgcgccgggtgtcggcgagcacttcgaaggccagcgcctgcaagccgtcggcggcgaggatcgcggtggcttcgtcgaaggcccggtgggtggtcggctggccacggcgcaggtcgtcgtcgtccatcgccggcaggtcgtcgtggaccagcgagtaggcatggatcagctccaccgcgcaggccgcggcgtcggcgcgctgcggcgctccgccgagggcctcgcaggcggcgtaggcgagcagcgggcgaacccgcttgccaccgttcatcacgctgtagcgcatggcctcgtagaggcgttgcagttcttcgcggggagcaacgaacagggcgtccagggcggcatcgacgcgcgcctggcagcgcgcctggtaggccgcgatcatgcctcgtcgccttccgcatcgaacggcgcttcgctgagctcgccgtcgcgttcgaggagtatctgtaccttctgttcggcctggctcagcgacgtctggcattcgcgggtcaggcggatgccctgctcgaaggcgcccagcgactcttccagcgacagctcgccgctttccaggcgttccaccagggtttgcagctcggtgagggactgttcgaaatcgagggttttcttgcgggccatcgggggagtctcggcgaggtgtacaaaaccccgcgacactagcagaggggcgggggccgggcaaatcggcggaaggtcgctacgaccgatcgggacgaccatggcggcggccttggctaaggtggagagaggtccagcgaggaggagccgacaggcgatgcgcatccaggaggtccgggaacgcagtattcccctttcccgttacgccggcgtggcggctgccaccggtggtttgagcaccagcctggtggcggtgctcaccgatatcgtgcgcgacggtcggcgtgtggtcggctacggccacgcctcggtagggcgctacgcccagggcgggctgatccgcgagcgtttcgccccgcgcctgctgggggctccggcggacagcctggcgagcgacgacggcagtggcatcgatccgttgcgagcctgggacctgatgatgcgcgacgagaagcccggcggccacggcgaacgctgcgtcgcggtgggcgccctggacatggcgctgtgggatgccgcggccaaggccgccggcctgccgctgcatcgcttcctggcgcgacgcctggggctggcggaagactatccgcagcgcgtaccggtctacgccggcggcggctacccctatccgcacgacgacctgggacgcctggaagaggaactgcggcgcttcgtcgatctcggctacacccacgccaagatcaagatcggcgcggcccgggctggaccaggaccggcgccgtatcgacagggcgctgcgggttctcggcgacgcttcgcggctggcggtcgacgcgatgaaccgctacgacgcggagggcgcggtcgacgcagcgaaagccctggcgccgctggggttgtggtggttcgaggacatctgcgacccccacgatttccctacccaggccgaagtggcggatatctatccggggcccatcggtgccggcgaggccttgttctccctggccgaggctcgcttgctggatctctatggcggcttgcggcgggagcgcgacgtgctggtgttcgaccccgtgcattgctatggcctgccgggctacctggcgatactcgaccacctgtgcgcccggggttggccgcgcgcggccttccgcccgcacgccggctacctgttcagcctgcacttggtggcggccctgcgcctgggttgggccgaggctacgccgtcggctttccggccattcgacgatttcgccggtgccctgccgttttcctcgggattggcgggattgccacaatcgcctggtataggcttcgagcgccaggcgacacttgccgggctgttccgcaagcttctggaggcctagatgtgaagcgtcaagaggttatttcttga

SEQ ID NO: 10038 - DNA, 786 bp, Pseudomonas aeruginosa
cctgaactcacgcgagcggaacgccgcgccgttgtccgtcagcagtcgctgcacggtgatgcccaggcgggcgtaataggccacggcattgcgcaggaacaggaccgcctgcgccgtcttctcatcgggatgcatggcggtgaacgccaaccttgcgtgatcatcgatggccacgaacagcgtctcccagcctgcaccatcgaccgagtcgcgacggttgcctgtgacgcggtggctgggccgcacgatgcgcccgagcttcttggtgtcgatgtgcagcaggtccccgggcgcctcgtgctcgtagcgcacaacggcttcgacgggctccaggtcgctcaacctggacatgcccgctcgcgccagaacgcggctgaccgtggactccgagacgcccacactgcgtgcgatgcgagcctgcagcattcgacgtttgcgcagctcgacgatgagcaaagccttgcccgcatcgatggccctgggcgatcgcagcggcctggaagaggcatcggccaaggcggcttggccaccggccaggtaacgaccgagccacttcctggccgttggcgcagtgacgccgtgcgcggctgcggctcgcacggcatccaagccttccagcgtcatctgcttgaccatctcgagtcggcgggcaaaggtaagtcgggcatgcttatgggtgttcatccggttgggcgtcctgagtggattgggtgtttggcgacttccagtctctcaaacccaatccggatgaacaccggatacaacctattggagcttcacatctag

SEQ ID NO: 10039 - DNA, 1263 bp, Pseudomonas aeruginosa
cgcatcgatgttcacgacgtgccggaggatctgctggtagtccgggcggatacccagcgcgtgcagcgcgcgggcgatgatgttgacgaaccgccaggcgaactcgcggaacgccgcgctgttgccttcgccggagagctggccggcgacgcgggtggcgacctcggagatccggccgaaccggccgacggcgttgtagcgtgccgacaggtcagggtggccgaggtggaacacgtagaactcatcgaggcggccggcacgttcgcattccacgtacatacgcttcagcaagtcagcgtcgcctttcgggtcgaagacgatcaccacctcgtagtccggctgctcctctgcgcgccggcgccggtggccgtggtgaaccgtctgggtccgccggcccatcttcgcccgccggcgtcggccccggcagtgggtacggcgaatatcctgggtgatgaacagctccgcgagtcgcgtcttacccaccctcgtagtgccgagtaccagtgtgtggccgacgcgctcgcccagttgcaggcctacgtcctgttcgcgcggctcgatgccatggagccgaggcaaaccgcccacgggcggcagcggccgtgcggggttccaggccacgtcccaggcagtggctttggcgaccagcttcagagggaagggggcgaactcaagctgcttctccagccggcgcgcgcgctcgtagagcggcgagggctcgacgtaggaggcgaactggggcaggtaggtatctaccaggcgctgcgtatgcttctgcgtccagcgaaagcccttgccgatgaacaagtgttcgttgctgaccggcatttcggcactggtcatcgtgtacttcggcagtcggcggatgttccgccggtagcggagcaccacgccggcctgcttcagccgcacgatacccagccaggcgaagcccagtgcggccacgatgccgaacagcggagtgagggcgaacgtccacggcgcgacgatacagagcgcggccgcggtgaagcacacggtggtggtgtagagctccacggccggccgcaagagcgcttccagcgggtactggccagccatgggttacaccttcaggctcgccggcgagtccaggcggcccggttggcggcgcttggcatgaagttccagcacctgtttcctggcttgctctacctcatcatcaggcagcatctgttccagcagctcgcagagggtcgactcgtcctccaaggccttggacgtcacctcaccgccgtagcgtga

SEQ ID NO: 10040 - DNA, 273 bp, Pseudomonas aeruginosa
ttaccgaggaaaatgctcatgactaagcagttctaccccaggctcacggaaaataagaaccaagagccaagccgccaggcttgggttttcatggtcgcaatgccggccttcgtcctgggttgtattttcacgttcgctatcttgtggttcggcccggtggccgtgcgtgacaaggtaatcgcagagtatgaggccgatgttatgctcctggccaaacagctggacgaggccgaaaaataccggcgcataccatcgccagcagcggcaaactga

SEQ ID NO: 10041 - DNA, 282 bp, Pseudomonas aeruginosa
ggtcagtgcgggcggtgccgatggttaaacttcgtaagcttgcgcttgaggttgggccaatcggcccaggccgccatcgacaagcacactacaagcaaggcggtcagcatgatcacgccgaaagtcgtttggctcatctcaagattcctcctgagtcaggtagatacctgtagaccagattaccacacctaccgacagcgcaagggcagtcaggatgcgatgctcgccgagaaaaataccgatcaaaccagcggctaccgccgtggttccaatcttgcgtag

SEQ ID NO: 10042 - DNA, 303 bp, Pseudomonas aeruginosa
gtggaggccgcaatgaccgagcaaatttatgattatgaccccgcgcaagcgctggatagcccggaggccatggctctgttcatcgcagacgctttggatactggagacaccgcctatatcgctaaggctatgggagtcgtggcccgcgccaaggggatgacggagttggccaaggaaacgggtttggccagggagcagctttacaaatcgtttagtgagcgcgggaaccctacattgaaaaccatgctggcagtaatgcgagctctgggagttgatctgaccgcccgcccgcatgctcagtga

SEQ ID NO: 10043 - DNA, 939 bp, Pseudomonas aeruginosa
tccgcacgcagctcctgcgccatccccaaacactggagggtttgccatgtgcccgctcgtatcggctctgccgttcaccaccctgcccgttctagcagctgtcgcaaaccggggcacctgtccatgcgcctgatcaatcgaacgccgagccgcagcggctggcttgctctggccatactgcccttcgccctgatgctggcgctgtacctgaccagctctacccagcgcctggaaatcaatcccaacgacaagctcctgcccagcttcgaccagatgagcgcggctgtcgaacgcctcgccttcaccccggacaaacgctcgggcgactacctgttctggcaggacaccgcctcgagtctcaagcgcctcggtagcgggctggccatcgccgccgtggccggcctctgcctgggcgtcgccgctggcaccctgccgctgttcggtgcgcctctgtcgcctctgctgaccgtgctgtcgatggtgccaccgctggcgatcctgccgatcctgtttatcgtgttcgggctgggcgagctgtccaaggtgatgctgatcgtcatcggcatcaccccgatcctcgcccgcgacctcgagcagcgtgctcgcgagataccccgcgaactgctgatcaaggcgcagaccctcggcgccaacacctggacgctgatcctgcgcctggtgttgccgcagctactgccacgcctgctcatcagcctgcgcctggtgctcggctcggcctggctgttcctcatcgctgccgaagccattgcctccacggatgggctcggctaccgcatcttcctcgtacgccgctacatggccatggacgtgatcctgccctacgtcgcctggatcaccctgctggcgtgggccatggatttctcgctgcggcgcctgacccagctgctgttcccctggtatgaaggagccaaggcatga

SEQ ID NO: 10044 - DNA, 834 bp, Pseudomonas aeruginosa
cctacgacattccgctgcacgagggccgccatgctcccggcgcgtccgcaggcatgccgaccgccctcgccgactcttttcgcactgcctatcaaggagcctgacatgagtgcttcactcgcgatccgccccacgctgtacgaggaaaccgttcctggcggcggccacacctccttcatcctcaagcggggccaactgctgcgtctgaccgatctcgaaggcggcgccaacgtcagcctgatgctgctcaacgcccaggagaagagcgagcggctgaacctgccggataccctcaagggccagcacaccgccaagctcaccgccgggcattgcctgtactcggacatggggcgcgtactcgccgccatcacggccgacacctgcggctggcacgacagcttcggcggcgtgctgaacgccgatgaagtcatggagaagtacggccagggccgctatcaggaactgcgcaatggcttcttccgcaatggcaccgacaacctgctggtggaaatgggcaagtggaacctgaacctgcaggacctgctcatggtgctcaatctgttcagtcgggtggacgtcaccgccgacggtgccttcgccttccatagcggcaactcccaggccggcgactacctggaactgtacgcaccgatggacaccctggtgatcctcaccgccctgcagcatccgctggacccgaacccggtgtacgcgcccaggccggtcaagctgtcctggcatcaggtggccagcgacggcatcagcgtgctctgccgcacctcgcgcccggaaaacggtcgtgcctttcacaacaccgaacgcctgtacatctga

SEQ ID NO: 10045 - DNA, 3639 bp, Pseudomonas aeruginosa
aggcgggacggcccgccagcccttcgagggttactgaccatgttcgacaaactgctgatcgccaaccgcggcgccattgcctgccgcatcctgcgtacgctgcgcaacctgaatgtgaacggcgtggccgtctactccgaggccgacgccgccagcctgcatctgcagcaggccgacgaggcccacagcctgggcgaaggcccggccacgcagacctatctggacgtggagaagattctccgcatcgcccgtgaaaccggcgcgaaagccatccaccccggctacggattcctctccgagaacgcggcgtttgccgaagcctgcgaggccgccgggatcgccttcgtcggcccgacgccggaacagctgcgggtgtttggcctcaagcacaccgcccgcgccttggccaaacaacgcggcgtaccgatgctggagggcaccgagctgctcgacagcctcgccgatgccctcggcgcagccgagcaggtcggctacccggtgatgctgaaaagcaccgccggtggtggtggtatcggcatgcgcgtgtgccgcacggcggcggagctcactgatgccttcgacgcggtcaagcgcctggggcagaacaacttcagcgattcgggcgtgttcatcgagaagtacatcgagcgtgcccgccacctggaggtacaggtgttcggcgacggcgccggcgacgtcatcgccctgggcgtgcgcgactgctcggtgcagcggcgcaaccagaaggtgctggaggaaaccccggcgccgaacctgccgaccggcatggccgaggccctgtgcgaggcggcaatcaccctggccaaggcggtcagttaccgcagcgccggcaccgtcgagttcgtctacgacgccgaagcccagcgcttctacttcctcgaggtgaacacccgcctgcaggtggagcacggcgtcaccgagcaggtctggggcgtggatctggtgcgctggatgatcgagctggccgccggcgacctgccgcctttggtcgagctggtgaagggtctcaagcccagcggccactcgatccaggcgcgcgtctacgccgaggacccgggccgggacttccagccgagcccgggcctgttgaccgccgtggccttcccggccgccgacggcaagagcctgcgcatcgacacctgggtcgaagccggctgcgagatcccgccgtatttcgacccgatgatcgccaaggtcatcagctgggcgccgagccgcgaagcggcccgcgccgcgctggacgccgccctcggcgacaccctgatctacggcgtggaaaccaaccgcgattatctgcgccagattcttgccttcaccccattcgccagcggcaacccctggacccgttgtctgaagggcctcagctacaaggccaacaccttcgaggtcatcagcgccggcacccagaccaccgtgcaggacttccccggtcgcctcggctactgggcggtgggcgtgccgccgtccggcccgatggacagccgcgcgctgcgcctgggcaacgccctgttggacaaccccgaggacgccgccgggctggaaatcaccatgagcggaccgatcctgcgcttcaataccgatgcggtggtggcgctgactggcgccgagatccccgtgaagctcgatgacgtcgcgcagccgatgtgcaccgccattttcgtcccggccggcagcaccctgaccatcggcaccatcaccggcgccggtgcccgctcctacctggccgtgcgcggcggcgtgcaggtgccggagtatctgggcagcaagagcacctttaccctcggccagttcggcggccacggtggccgcgccctgcgtgccggcgacgtgctgcacctggcaccgctgagcgactcgtcggccggcgccaggctcgccgccgagctgtgcagcgccctgccggcggtgcgcgagctgcgggtgatctacggcccgcacggcgcgccggaatacttcaccgagggctacatcgcgcgcttcttcgccaccgactgggaagtgcacttcaactccagccgcaccggggtgcgcctgatcggcccgaaacccgagtgggtgcgcgagagcggcggcgaggccggcctgcacccgtcgaacatccacgacaacccctacgccatcggcgcggtcgatttcaccggcgatatgccggtgatcctcggcccggacggcccgagcctgggcggcttcgtctgcccggtgaccatcatcgaggcagatctgtggcagctcggccagctcaaggccggcgacaaggtgcgcttcgtcccggtggatgtgctgaccgcacgccagttggccaaggccgccgatgccgagtgcgccagcctcgcgccggcggcagtggtcgccacgccggtagctctgcagtcgcccatcgtgctggatatcggtgaagcggacagccgcctggtcgcccccctctccggcgacacccacctgttgctggaaatcggcgcgccggagctggacctggtgctgcgcttccgtggtcatgcactgatgcaggccctcgaagccaagcagctcgatggggtgatcgacctgacccccggcatccgctccctgcaggtgcactaccagcccgagaccctggcgctggaggatctcttggagatcgtcgccggcctgtgggatgccgtgtgcgccgcgcaggatctgaaggtgccctcgcgcatcgtccacctgccgctgtcctgggacgacccggcctgccagttggccatcgagaagtacatgaccacggtgcgcaaggacgcgccctggtgcccgagcaacctggagttcatccgccgcatcaacgacctgcccaacctcgacgcggtgtaccgcacggtgttcgacgccagctacttggtgatgggcctcggcgacgtgtatctcggtgcgccggtggccactccgctggacccgcgccaccgcctggtcaccaccaagtacaacccggcgcgcacctggaccgcggagaactcggtgggcatcggcggcgcctacatgtgcatctacggcatggaaggcccgggcggctaccagttcgtcggccgcaccctgcagatgtggaaccgctaccgcgcggtcgaggcgttcggcggccagccgtggctgttgcgcttcttcgaccagatccgcttctacccggtctcggccgaggagctgtcgagaatccgccgcgattttccgctcggccgctacccgctgaagatcgagaacaccgagctgcgcctgtccgactaccaggactttcttgccgccgaggccgacagcatcgacgccttccgccgccagcagcgcggcgccttcgacgccgagcgccagcgctggatcgaatcgggccaggcgcacttcgagagcgaggaagtcgccgcagacctcggcgaggacgccccgctcggcgccggccagctcggcatcgagagccacatcgccggcaacctctggcaggtgtcggtggccgagggcacgcgggtcgatgccggcgacgtgctggtgatcctcgagagcatgaagatggaaatcccgctcaccgcgccggtcgccggcgtggtcaaggaagtccgcgcccagccagggtcgccggtgcgcgctggccagcgggtggtggtgatcgaggaggcgtga

SEQ ID NO: 10046 - DNA, 1932 bp, Pseudomonas aeruginosa
ggcccctcggcacccgaagcaaccgtagggtggatcgcgctttatcgatccacccaccggcccagcgggccggcaacgaacatcgcggtggaaaaggtttcgccgttttcaccttacgagggacatgagatgaccacgacattcgacctgcgcctcgccaccctgagcgccgcctacaccgccggggacatcaccccgcgccagctgatcctcggcctgcgtgacaaggccgccgcgctcaacggcgagttcaacgcctttatccacctgctgagcgccgaggaacttgagccatacctggccacgctggagagcaagacgcccgccgagctgccgctctacggcgtgcccttcgccatcaaggacaatatcgatctcgcaggcgtgcccaccaccgccgcctgtcccgcgtatgcctacacaccggagaccagcgccaccgtcgtcgatcagttgatcgccctcggcgcagtgccgctgggcaagaccaacctcgaccagttcgccaccggcctcaacggcacccgctcgccctacggcgaatgccgcaactcggtgcacccggactacccctccggcggctccagcgctggctcctcgctagccgttgcgctcgggctctgttccttcgcgctgggcaccgataccgccggttccggccgggtgccggcggcgctgaacaacctggtgggcctgaaagcgagcaaagggctgatctccaccgccggcgttgtcccggcctgccgtacgctggactgcgtgaccttcttcacggccacagcggccgaagccagtcagctgctggcgctcaccaccaggctcgatccgcgcgacgagtacagccgcagcaacccgctgtgtaatgacggctcggccttcggccagatcaagaccttccgcttcggcataccccagcacctggaatttttcggctgcgcggaaagcgcggcgttgttcgccgccaccatcgaacagctgaaagccctcggcggcgagccggtggaagtggacttcgcccccttcctcgaagctgcacgcctgctttacgaaggcccctgggtggccgaacgctacagcgtggcgggcgcgctgatcgagcagcagcccgacgccgtgctgccggtaataaaagccgttctggagaaagcccccggtacaaccgccgtgcagctgttccaggcgcaataccgcctgcagcaactcaaggccgtctgcgaccgcaccatggccgaggtcgattgtgtgctgacgcccgcctacccgcgcccagtgacgctcgccgaacttcacgccgagccggtcaagcgcaattcggacctgggctactacaccaacttcatgaacatgctcgactacgccgctgtcgcggtgccggccgccaccatgcacaacggcctgccctggggcgtgacgctgttcggccgggtgttcaccgaccagtacctgctgagcctggccgatgcgctgcagcatcagacagggctgaagttgatcggcggtaacgcgctcattaccccgccgccccggaatccggcccgcaacgaccgcgcccgcctggtggtctgcggagcgcacctggacggcctgccgctgaactggcaactcaggcagcgtggcggacggctgctggaaaccacccgcagctcgccggactacaagctctacgccctggccggcgggccaccgctgcgcccgggcatggttcgcgtcgccgaaggcggagcggccgtcgaggttgaagtctgggagctgccgaaccaggagctcggctcctttctcaccggcattccggcaccgctcggcctgggcaaggtgcagctcgccgacggccgctgggaaacaggcttcatctgcgagccctacggcctggacggcgcccaggacatcaccgaacttggcggctggcgcacctatctgaagcgtcgcagctga

SEQ ID NO: 10047 - DNA, 1104 bp, Pseudomonas aeruginosa
ggcagacgaggagcgacggggttgcactgcggccatcccgtcgcattgtcggaacatccagcgccgggccgacctccgatgcagagccacgccgactccggtcggcaccatctgcatccgaaggaggactccatgcgtatcaccctgccacgcatcggtctcggcggcgcaccgctgggcaacatgttccatccgctcagcgaagaaaccgccgacgccaccctcaatgccgcctgggacgccggctttcgctattacgacgtgtcgccgcactacggcgcgggcctcgccgagcagcgcttcgggcgcctgctgagtggcaagccgcgtgacgagtacgtcctgagcaccaaggtcgggcgcctgctgcagccggccagccagccggaaaacgccaagcccttcgtcgacgagctgcccaacaagcgtgtgccggattattcggccgacggcgcacgccgctccatcgaggacagcctggagcgcatgggcgtcgatcgcctcgatgtggtgttcatccacgacgtttccgaagaccaatggggcccgcaatggcgcgagtacttccagcaggccatgaacggcgcggcgaaggcgctgacccagctgcgcgatgaaggcgtgattcgcggctggggcctgggggtcaacctggtggagccatgccgcctggctctggagcagagcgacccgaacgtgttcctgctggccggccgctactcgctgctggagcacgacgaggcgctggacaccctgttcccgacctgccaggcacgcgacgttggcgtcgtcgttggcgggccgttcaactccggcgtcctggccggtggcgatcactatgagtacgaccagatcccaccacaggtcgcccagcgcagggagcagctcaaggccgctgccgagcactgcggcgtcgatctgcgggccgccgccctgcatttctgcctggccaacccggtggtcgcctcggtcatcccgggcacggccaatcccgagcgtccccggcagtacatggaagacttcaacgcccaggtgccccgggagttctggcagaccctcaagcaagacggcctgctgcgcgaggatgcgccggtgccgatctga

SEQ ID NO: 10048 - DNA, 345 bp, Pseudomonas aeruginosa
tccagggctatctcgacggcctggcctacatgcaggcgcaccctgaggagtcggcgaagatcatcggcgacgtgctcggcgtcagcgccgaggaagccgtcgagcagatggccggcgcctacaacatcccccttgcggagatgggcaagagcttcaccccaggcgacgacacccattccttccatggcagcggcgcgatcatcgccaagctgctcaaggacaacgggcagatcccgaccatcccggatttcagccagacctacgacgcccagttcaccgaagcgctcgcccagtaagccgacgccgggcgggccgcggcccgcctgtgctggagaaaaaccatga

SEQ ID NO: 10049 - DNA, 801 bp, Pseudomonas aeruginosa
cggcggtgtgacatgcacaaggcactggattaccgaggccgttgcgtggtcatcactggcgccgccgggggcatcggccggggcctggcgcagagcttcgccgctgccggcgccaccctggagctgctggaccgtgacgccgacgccctcgcccggctcgccgacgaactcgctggcgagacgctgctgcactgcaccgcactggacctgggtgatcggcaggcggtgcagcagtacgccgatgacctcgcctgccgcggcctcaacgccgatgtgctgatcaacaacgccggcgtcgagtacgccacgccgctgggcgagtgcagcttcgaggccgatcagcgctggtcggccctgctggagaacaacgtcggttccatgcagcgcctgacccgcgcattgctgccacgcctgcgcgccggcgccagcgtgatcaaccaggcctccatctggggactgaaaggcgtgccgggcttttccgcctatgtcgccagcaagcacgcggtggtcggcctgacccgctcgctggcctgggagctgggcccgcgacgcattcgggtgaacgcggtgtgccccggctggatcggcaccgatgcggccatgcgctcgctgaaggtgatggcggacgccaacggccgcagcgacagcgccgagctcgcggcgatactcgccaaccaggccattccggagctgctgacaccggccgatctaagcggcaccttcctgttcctcggctcaccgctggccgccgccctgaccggccaggcgctgtcggtcagccacggcgaggtgatgcactga

SEQ ID NO: 10050 - DNA, 2052 bp, Pseudomonas aeruginosa
cgggcgactacttcctgttcgccgccgagcggccgattctgctgccggccagctcggggcatctgcgtgaacagctggccgccgtcgagcccgcgttgtggccgcagctgctggcctgcgagctgtccttcggccgccaccgcaacggcgccacgccctggcagatcacccattcgacgctgcccggccgcgtcggcgacgctctgctgtcgagctactggaacttcgccgaccccgccagtctgcccgccgcggacctcgccgcgctgggccgttatccggcggccggcggctggcaacgcgtcgaactggatgtgcccaccgctacagagaaggtccccgcatgaccgcacagatcagcattccctccgctcaacaacgacacaccacagcacccgccgtacaggccgaaccggtggtgcgcaaaggcagtttctggcgtattcgcggcgaactctcgcggcgcaacgcctggctgctcaccggcgccgggctgagcctgcccttcgtcgtctggtggctgtggaccgccctcggcctggccgacccgatgttcatgcccagccccggcgcagtgctcgagcgcatcggccgctggtggaccagcgaggggctgctgggagacatcggcatcagcgtctggcgggtcatggccggcttcggcgcctcggcactgatcgccctgccgctggggctgtacatcggcacgtaccggccagtgcaggcctttctcgaaccgcttaccgacttcatccgctatatgccggccgtggccttcattccgctggtgatgctctgggtcggcatcgacgaaggctccaaggtactgatcatcttcatcggcacctttttccagatggtgctgatggtcgccgaggatgtgcgccgcgtacccatggcgcagatcgaggcggcgcagaccatgggcgccaaccgcagcgagatcgtcaagctggtgatcctgccgtcggccaagcctgcgctgctcgacaccctgcgcatcacctgtggctgggcctggacctacctggtggtagccgaactggtcgcggccaactccggcctcggctacgccatcctcaaggcgcagcgctacatgcacaccgacaagatcttcgccggcatcctgttgatcggtctcatcggcctgatcaccgatcaggccttccgctggttgcaccgccgcgcctttccctggatgaggaaatgaccatgtccgatgccaagattcgtgtacaccaggtcggcaagaccttcgtcagcgagcgccgtgaggtgcaggcgctgcagtcgatcgacctggacatccagcccaacgagttcgtcaccttcgtcggcgcctcgggctgcggcaagtccaccctgctgcgcatcatcgccggcctggagacgctgagtcgcggcgagatcctgctcgacggcaggcccatcgacggccccggcgtcgaccgcgccatggtcttccagcactacagcctctacccctggctgacggtgatgcagaacatcaagttctgccgccagctcaaggtgatcggcgataccgtgcgccacgatggagacgtggagtccgccgccggccgcgccgatgccctgctcaacctgatgggtctgacgcgcttcgccgatgcctaccccagccagctctccggcggcatgcagcaacgcgttgccattgcccgcgccctgctgcccaaacccgcgacactgctgatggacgagccgttcggcgcgctggatgcgcaaacccgcgaagtcatgcacgacctgatccgtcacgtgcaccggctggagaagagcaccatcctgttcgtcacccacgatgtcgaagaagccatctatctgggcagccgcatcgtgctgatggcgccacgccccgggcgcatcgattccatctacgaggtgccgctgccggcccagcgccaccaggacatgaagctcgcgccggaattcaccgagctcaagcgcgagatcctcgcccggatccgcgaaacctccggcatgcagaccgacctcgagcaactggccaaactcagcgccgtggccggctga

SEQ ID NO: 10051 - DNA, 2400 bp, Pseudomonas aeruginosa
ctccaaggagcgcaagccgatgaccagctttcccctctcctccgtcgaggagttgaaacagcagttgcaggacaagggtgtgaagtacgcgatggccagctacgtcgacatccacggcgtgatcaagggcaagttcgtcccaatcgcccatctcggccagatgctccgcggctccgagctctacaccggtgcggcgctggacggcgtcccgcaggagatcagcgacaacgaggtggccgcgatgccagacccggcgaccgccacccagtgcagctggaaccgcgatctcgcctggttcgccagcgacctctacctggacggcaagcccttcgacgcctgctcgcgcggcatcctcaagcgccagaccgaagccgctgcagcgctgggctacaccttcaacctgggcatcgagaccgagttcttcctgttcaaggacaccccggatggcggcttcgcgcccatttccgagcgcgacgacatggccaagccctgctacgacccgcgcctgctgatggacaacctgcccatcgtcgacgaactggtacaggcgatgaacgagatgggctggggcgtctactccttcgaccacgaggacgccaacggccagttcgaaaccgatttcaagtacaccgacgccctcggcatggccgaccgcttcgtgttcttccgcatgatggccaacgagatcgcccgcaagcacggcgccttcgccaccttcatgcccaagccctcggccaaccgcaccggcagcggcgcgcactacaacatgtcgctagccgacatcgagaccggcaagaatctgttcgaagtcgatggcgaagacccctacggctgcggcgtgaccccgctggcctatcacttcatcgctggggtactgaaacatgccaaggccatctgcgcggtcatcgcgcctacggtcaacagctacaagcggctgatccgcaagggcgccatgtccggctcgacctgggcgccggtgttctgctgctacggcaacaacaaccgcaccaacatgctgcgcattccatcccagggcgcgcgggtcgaatgccgcgccgccgacatcggctgcaacccctacctcggtgccgcgatgatcctcgccgccggcctggagggcatccgcgacaagctcgatcccggccagccgcaccgcgagaacatgtatcactacagcgaacgggaggtcgcgcagatgggtatcgagaccctgccgcgcaccctcagcgaagccatcgacgccttcgaggccgacccgctgtcgcgccaggtgttcggcgatgccatgtaccaggcctttgtcgagttcaagcgcgacgaatggaatgcctaccacacccatgtttccgactgggaaatccagcgctatctgaagttcttctgaaccgggagtaccgccatgcacggcaccatgatgaaaaagctgctttgcgccggggccattgccctcgccgccctcgccccgctggcccaggcggaggagaaaaagaccttcaacctggcctggaccatttacgtcggctggatgccctggaagtacgtcgacgagtcgggaatcatgaagaaatgggccgacaagtacgggatcgaggtgaacatcagccagatcaacgactacgtcgagtccatcaaccagtacagcgccggccagttcgacggcgtggtcgccaccagcatggatgcgctgtcgattccggcggccggtggcgtcgacaccaccgcgctgatcgtcggcagctactccaacggcaacgacggcctggtgatgaagggcaccagcgatctcaaacagatcaagggccaacaggtgcacctggtggaactgtcggtgtcgcattacatcctggccaaggcgctggacagcgtaggcctgtcggagaaggacgtgcaggtggtcaacacctccgacgccgacatcgtcgctgccttcagcacggccgatgtacgcaacgtggcgacctggagtccgctgctgcaggaagtcgccgccacaccggatgcacatcaggtcttcgactcggccagcgtgccgggccatgtcaaggacctgctgatcgtcaacagcgagacgctggccgacaaccccgcgttcggcaaggcagtcaccggcgcctggtacgaggtgatggcaatcatggccagcgacacgccgcaaggcgccgagctacgcgcccagctgggcgcagcttccggtaccgaccaggccggctacgaggcgcaactcaagggcacccacatgttctatcagccagccgaagcggtcgccttcatctccggcgaaccggcccacgaagcgatggacagcgtgcgcaagttctccttcgaccacggcctgctgggcgacggtgccgattcggcggactttgtcggtatcgccatgccggccggcgcgctcggtga

SEQ ID NO: 10052 - DNA, 396 bp, Pseudomonas aeruginosa
ttggtgctaacagccctacagagcttgcacttgttcggcctgcgggcctttggcgcctgcggtaacgaagaagcttacacgctgcccttcgtcaagggacttgtaaccgctagcttcgatctgtcggaagtgaacaaaaacatctgcgccgctttccggggtgatgaaaccgaaacctttaacttcgttaaaccacttaacagtaccagtttggcgagttgccatgatgtatatctccaaaatttgagagtgcgcaggttcaaagcctggctagagctgaatgcagagagaagacaaaccgaggagatgaggatcgaacagactgaacatcaaggcgggacgctaaactgggcacgcagtagagaccaccatacaggtttcggtgagattagatag

SEQ ID NO: 10053 - DNA, 624 bp, Pseudomonas aeruginosa
cccgcgcgggttgtcgaagtcaggttggccgttcctggtgggatagccgactttgcagccggtggtgcgatagccgctgcagccccagaagtcgaagccgcccttgccagctttcttgcggtggaccaggggcagaccgcacttgccgcagaggaagtcactggccggcgccgtgggagcgctggcggtagagcttgctcgcgggtcgccctgtgcgctggggtgcgcgcgcagcgtctgcagctccgactgcaggagctggtagaactgctggaccacgttcatgtaggtgtcctcgctgttagcgatccggtccagggcgacctccaggttgcgggtaaagtcgaggctgaggaagctgaagttgtgctccaggagcgcgatggtggcctcgcccagctcgccggggatcaggcttcggcccttcatctgcacctggcccttgtcgatgatgttcttcacgatcgaggcgtaggaggatggccggccaatcccgcggcgcttcatctcgcccaccaggctggcatcggtgaagcgcttgggaggggaggttttcttctccaggacctcgccgctgtagaccttgaggatctggcctggctccagctccgggatggggtttga

SEQ ID NO: 10054 - DNA, 225 bp, Pseudomonas aeruginosa
agtggtgccagtggcaccacccagctcgtcgacggcgccgaggcctggtcctggcggagtgttgccagtggcaacacccagctcgccgccggcgctggggtcggtccctggtggggtgattccagtggaaccacccaactcgccgccggcgccgaagtcagttcctggtggagtggttccagtggaaccacccaactcgccgccggcgccgaagtcagttcctag

SEQ ID NO: 10055 - DNA, 225 bp, Pseudomonas aeruginosa; identical to SEQ ID NO: 10054

SEQ ID NO: 10056 - DNA, 300 bp, Pseudomonas aeruginosa
accaccgccgagtcggtgaacgcggccgaggcgtggatactcggaaagcgggcttcagtgttcatcaaagacagcctccaactgatggacgtcgtagctcccgcagcaggggcagaccaacacctcggcttctccttctggggtgttctcggcgggaagaacctggcgcaccaagtggtgtgggtggtgctggtcacaattcatgcactggtgggtgaccaggggctgggaagtgttcatgtatgggctccttgccggcgtgggccggcaactggcagcggaagacgagatgaaaaatga

SEQ ID NO: 10057 - DNA, 555 bp, Pseudomonas aeruginosa
ggttgcaggaccggtagcgctaaaggcgtgacggtcgcagctagaagggagccggacgcatccggtggtaaggttggcgtcgccaaacaaacccacccagaccacaggaggtccggcatgaaaggagacaaaatcgggacgtcacaggccgtagagccgtatgaacgcacactctcccgcctaatcgagcgatataggcaggagaatggtttggaaaaggagcagccgctgaccactgaagatgtaatggtgctccagcagcagtatttgctcagcgtcttgggcactgcacttgcagaaaagcacagctggtccttgggcgagatcgtcgcaatcgacttcgcgctcataaggcgctactcctggacgccccagcaggtgcaggcgctgtctcctgctcaaaaatggctagccatatgcgatgagctggagccgcttcatgtcccggaagaggcgcgtcgggtgtggcgcgatgagaggcaggtgcggggaccagttcccatagatagtagggaggacgacctcgaggtgtggcgggaagcacttgcccagtag

SEQ ID NO: 10058 - DNA, 258 bp, Pseudomonas aeruginosa
tggcgacctatcattggaacggtcgccgcagccccgtataccgagttccaggactgccagccaaaattgatgccgatcagtccgccatggatctggttggggatttgtggctccagcctgccgctggccgaagaacccatgacattcccctggttccaggcgaccaggccgcccagcagacccgagcctccgaccttgccggaagcggaagcgccgctgatggtggcggtgctgaagcccaccagcccgccaatatag

SEQ ID NO: 10059 - DNA, 606 bp, Pseudomonas aeruginosa
acggtacgtgacctgacgttggtggcggagttgccgaagaccttgttaccgccggtctggacctgcacgacatgcacattgccggcgtcggcggcgatatcgggtagcgtctggacctggacgatgctggagccattggcgcctgggctcaggttggtgagagtctgggtctggacgacatcgattccgctgacgccggggccgatgttggcaccgctctggctctgcacgattgtgacgccattgacgcccgagccgatgctggggccgctctggctctgcacgacgctgatgccactcgcgcctgaaccgatatttgcgccattctggctttgcacaacggtgatgccacttgcgccagaaccgatattggcaccgttctggctctgcacgacagtcacgccattgacgcccgagccgatattggggctgttctggctctgcacgacgctgatgtcactcgcgccggcgccgatattggcgccattctggctttgcacgacgctgatgccattggcgcccgagccgatgttggcgccgctctggctctgcactgcggaggtaccgttggcaccggcggcgaggtcgacggccggctgctgctga

SEQ ID NO: 10060 - DNA, 669 bp, Pseudomonas aeruginosa
acgatggtcacgccgttgctatcggacgcattggccccggctgggccctgcgctacatggacctggccggaaccatcaccggcagcgtttgcctggccgacagcggctacgctgacctcgtgcgagagaatcctccaggtgccggttgcgccctggtcggcatgggtgtccagctgcgcggttcgctgtatctcgacgttcgcgccctggttcagcaccaggccgccattgcctccgccgatggcgctggcgtcctgcttgccggccacccgcacggtcccctgttcgccgccgtcgaggacgatgcgtccttccgcgctgcgtagcgtcctggcctcgagagtgccctggttgttgacgacggtcttgagcaggctgtcggcgctgcgggcgctcatcagcacctggccgccatcggcgcggatgaggccgccgttgtgtgcgagagcgtcgaccgagcccttgtccacctgcaggttgagcaggccgtcgccgtcgaaattgaggttgatgccctggcctgcgcccagggccacgtcgccgagttgcgcctggatcacgccgtcgttgctgacccgggcgcccagcagggcgatgctgccgccttcgctggcttgcaggctgccggcattgcttacggttgcgccggagtcgccggagaactggtag

SEQ ID NO: 10061 - DNA, 702 bp, Pseudomonas aeruginosa
cggtcgccgtggttacctccagcacctggtggtcgatcccggttatcgagggctggggctggcgcggcggatgctcgacgaggtgttggcacgcctggcgagggaggggatcggcaaatcccatgtcttcgtcctggatgccgccgaggaggcccaggcattctggcgagcccagtcggactgggagcggcgcaaggacatccaggtattttccactcgggagggacacgcgtgaaacgattgcattgggttctgctggccatgctgctgcccggcctggcactggccctggagaagggctccaccctggaaccctggacgttgcaggaccagttcgaaaaggcgcactcgctggacgactccacccgggtcctgctggtggcgcgggacatgggcggctcgaagctggtcaaggcggcgctggcggaacgcccaaagggctacctggaggcgcgccacgcgctgttcctggcggacatcagccgcatgccggcgctgatttcccggcttttcgcggtgccggccatgcgtgactacagttatccggtgctgctcgatcgcgacgcggccatcgcttctcgctatgcctcggacgagggcaaggtgctctgggtcaggctggagcagcgccgcgtgttggaaacccgccagttggattcgccggtggccctgcgcatcgccctggaacaactgcagccgtga

SEQ ID NO: 10062 - DNA, 456 bp, Pseudomonas aeruginosa
ccagcacgtcgtcggcgtgcttcaagcgctcgtcgcgccgggcctgggcctggaggatcgagcgcacctgctcctcggagaccttgtcgcgaagcatggtgcgctgtagttgcagatgttccggggtatccaccaccagcacgcggtgggtcatctggcgctggccggactccaccagcagcggcgagaccaggatggcgtagggcgattcggccctggccaggtactggacgatctccgcgccgatcagcgggtgcagcaattgctccagccagcgccgttcctccggcgcctggaagatccgctcgcgcaaggcggctcggtcgagctggccatcgggcaggaggatgccgtcgccgaagcgttcgacgatcttcgccagggccggacgccccggctccaccacccagcgggcagcatggtcggcgtccaccaggtggacgccgagggaaatga

SEQ ID NO: 10063 - DNA, 885 bp, Pseudomonas aeruginosa
ggcctagtatccagggttgggtcatttgaatccggcgaattgcagataggtccgggttatttgatcaccccagagcaaagcaatccacccggcaatagccagatagggaccgaaggggatcggcgtgccgctttcggcgttgcgcaggcgcagcatgatcaccccgaggatcgccccgaccagcgacgacagcaggatggtcagcggcaggatctgccagccaccccaggcaccgagcatggccagcagcttgaagtcgccgtagcccatgccctccttgccggtcaccagcttgaacagccagaacaccgaccacaggctcaggtagccgaacaccgcgccgaacagcgcatcgtcgaggctggcgaagaggccgaaatggttggcgatcaggcccagccagagcagcggcagcaccagcacgtccggcagcagttggtgatcggcatcgatcaggctcatcgccagcagaccccaggtcagcaggagcatcgcgcccgcctgccaggtgaagccgaaatgccaggcgacgtagccggaaagcagcgcggtggccagttccaccagggggtagcgtttgccgatggcggccttgcaggacgagcacttgccgcccagcgccaggtagctgaccagcgggatgttttcccaggggcggatctcgtggccgcagcgcgggcacgccgaattcggcagcaccaggttgtaggtcgcctgcttgggttccggctccagcccgagcgcttcgcgggcttcggccttccagttgcgctccatcatcttcggcaggcgatgcacgacgacgttgaggaagctgccgaccagcaggccaaggaggatagcgcacaagacaaaggccagcggatggctggccaggtagtctag

SEQ ID NO: 10064 - DNA, 492 bp, Pseudomonas aeruginosa
agcagggtttccctcggcacctcgtgttctttcttgcagtgcgaacagagttttcgcgcaaggcgctgggcgatgatcaggttcaccgaggtcgccaggttgaacgccggcacgcccatgttcagcaggcgagtcagggtctcggcggcgctgttggtgtgtagggtggacatcaccatatgtccggtctgcgccgccttgatggcgatctcggcggtctccaggtcgcggatctcgccgaccatgatcacgtccgggtcctggcgcaggaaggcgcgcagcgcctgggagaagtccatgccctggcgcgggttgacgttgacctggttgatgccttccaggttgatctccaccgggtcttcggcggtggaaatgttgatgtcggtggtattgaggatgttcaggccggtgtatagcgataccgtcttgcccgagccggtggggccggtgaccaggatcatgccctgtggctgcttgagtgcggccaggtag

SEQ ID NO: 10065 - DNA, 666 bp, Pseudomonas aeruginosa
gaaggtcgggggttcgattcctctatccggcaccagttgcataaaaaagccccgcttcggcggggctttttattgcctgcgattcgttcagagggtgaggcgcatggacaggtcgacggccctgacgtccttggtcagggtgccgatggagatgtagtcgacgccggtctcggcgatgttgcgcagggtgctctcgttgattccgccggaagcttccagcttggcacggccggcggtgagggcgacggcggtgcgcatgtcgtccaggctgagttcgtcgagcatgacgatatcggcgccggcctccagcgcctggcgcagttcatcgaggttctccacttccacttccaccggcttgccgggtgctatgcgccgggcttcggcgattgcccgatcgataccgccgcaggcggcgatgtggttttccttgatcaggaaggcatcgtagaggccgatgcgatggttgtggcaaccgccgcaggtgaccgcgtacttctgcgccaggcgcaggccgggcagggtcttgcgcgtgtcgaggagcttcaccgcggtgccggcgaccaggtcggcgtagtgctggctgcgggtggcggtaccggaaagcagttggaggaagttcagcgcgctgcgctcgccggtgagcagggcgcgggccggaccttttag

SEQ ID NO: 10066 - DNA, 1743 bp, Pseudomonas aeruginosa
  unsure (1666): Identity of nucleotide at the above locations are unknown.
cgcctggaaattgacgttacggacgacgccaatcgatcctctgtgcccgatttttgccattccatgcgcggccgcgagggtggcaggagagtcccgatgcagaacgatgccaatgtggtgcacctgaccagggtcgcttccgagccgtcgccgaacgccggagcggggcgcctgccggtcatcctcgtgcaggtgcgcgacaaggcggcgttgcagctgaaacaggcgttgcaggcgttgttcgacaacgccgacgacaccctcttcgaaatggccgaccgagccaccagcaacctcgaacagaacgctttcttcgaagccatgcgcgacctgcgcctcaagcgcaagagtatcgagcgggtctacctgcagaaggtcttcgaggagttctcggcgctcaaccaggtacagtccggcaaatccgtgccgaccctggataccgtgtccttcgacagcctcagcctggtacagaacgaggaactggaggagtccgtcgcggtggacgcgatggtggcgcgggtgatgagccgcgatgccaccgcgctggcccacctgagcacccgcctgaacaccctggtcggccggaaggtcgacgagaagagcaatcccctcgctccgcgtccgctgaccgcggctttcctcgatgcctgccaggggctcggcgtcgagatcaaggtcaagctgatcattctcaagctgttcgagaagtacgtcctggcccattgcgaccagttgtacgccgaggccaaccagatcctggttgctgcgggcgtgctgccggaactcaaatccgcactgccgcggcgtcagcccgctgtccgtcccgaagcggtacgcgatgccgggaccaagcaggcacaggttgcgatactagagggcggccagcaggaagtcttcggcgcgctgcaggaactgctggcgcaggtccgcgacaatccttccttctaccgtcgcgaaacgcctgagaatgccgcgccgatttccagcaacgacctgatgcgcctgctttcccacctgcagcagcacctgccgggccccggcgccgcggagttcgacgtccgcgacggggtcgaccaactgctccagcgggtcagccacaagagcggccgttctcgggtggtcggccaggtggacgatgacgtcatcaacctggtgtcgatgctgttcgaattcattctcgatgaccgcaccctgcctgattcgctgaaggccctgatcggtcggatgcagatcccgatgctcaaggtggccctgctcgacaagaccttcttcagccgcggtagccatccggcgcgtcgcctgctcaacgagatcgcatccgcgtcgctgggctgggccgaacacaatgatgcccggcgcgacagcctgtaccagaagatcgaacaggtcgtgatgcggctgttgaacgacttcgtcgacgacccggcgatcttcgccgagttgctggaggacttcattgccttcaccggcgacgagcgccgccgcagcgagctcctcgagcagcggcacccgcgacgccgaggaaggccgcgccaaggccgaactggctcggcaggacgtggagcaggtgctgaaccagcgactgctcggcaaggtcctgccggaggtggtggtgcgcctgctgcgggatgcctggagcaaggtgatgctgctgatctgcctcaancatggcaaggcttccgccgagtggcgggaggccctggataccatggaccagctgatctggagcgtcggcccgcatga

SEQ ID NO: 10067 - DNA, 1254 bp, Pseudomonas aeruginosa
ggtccaggcgttcttccagaatcgcctggacccgaacgaacatccctatttcgaggagatccgccacctgacggtttccgcgcatttcctcatcgaacgcgacggcgccatcacccagttcgtctcctgtcacgaccgcgcctggcatgccggggtttcctgcttcgacggtcgcgaggcgtgcaacgacttctcccttggcatcgaactggaggggaccgacacggaaccgtacacggacgcgcagtacactgccctggccgggctgacgcggctgttgcgcgcggccttcccggggatcaccccggaacgcatccagggccactgcgatatcgccccggagcgcaagaccgatcccggcgaggctttcgactggtcgcgctaccgcgccggattgaccgattccaaggaggaaacatgacgttcctggtgttgctgctggcccttgcgctggagaagttctccggctggcgccggcgtatccagcgcgatggcgcctggctcgcctggctgagcctggtcgaggatctgccctcggtgtcccgccgctcctggctggggctgctgctcgcggtagtcctgccgttgctgccgctggccctgttgctgacattgctgcagccgttggcctatggctggctgagccttccgctgcatcttctggtggtggtctacagtctcggccgcggcgacgtcatggccgacctcgggccgttccgcgacgcctggcggcgcgaggaggcccaggctgccttccatgtcgccgaacgcgatctggggatcctgggcggcagcgagagcgaactgatcggccgggtgcacggccatctgctctggcagggctaccagagcttcttcgcagtgatcttctggtatgccttgctcggcccggtggcggccctggcctatcgcctgctggcactggcgctggagcacgcccgccagccggcgttgcgcgaacaggcggcgcgcgtccggcatatcctcgactggttgccggtgcgtgcgctggtgctgagcttcgccctggtcggcaacttcctcgcggttatccgcgtgctgctgcactggctgctggcctgggacatctcggcggccgcgctgctgggcaaggccggacgggtcgccagcgatgtcgaagcggtcgaactgggtgccgccggcgtcgccagcctggatgcgctctggcaattgctggtgcgcgcggccgtgctctggtacgccgtgttcgccttctgcgcgctgttcctctga

SEQ ID NO: 10068 - DNA, 2043 bp, Pseudomonas aeruginosa
gaacaatcaggagacgtctgggtgaagaccgtactctatcccgccatcgcgctgatgaaccggctcagcttcggcatgaagttcggcctgatcagcgtgctgttcttcctgccgctgctgatcaccagcttctatctggtgcgcgatgcctatcgccagttcagcgacacccggatcgaactgcagagcttgacgctgctgggtagcggactgcagatccggcgtggcctggagtccctcaacgatctgttgcagatcaatgcggtcatcggccagtccggcaaggccggcgatctggaagcgcgcatcgcggacgtccagaaggggctgcgcgggcggctcgaggcgctggcgccgctcagcgaggatggtgcggcggtagccgaattcgaggcccagcgcgaccggttgctcaacggcttgcaggccgtggaggccgaagggtccttgcagggcaagggcgcacgggcggagaagctgctcggtagcgcacaggtattcatcaagttgcttatcgcccaggccgggctcagccaggacagccagcgccaggtgcgccagctcagcgagctggtcggttcgataacgccggaggtgacggcggccatcagcaaggggcgcgccatcggcgcctactccctgggccagggtttcctcaattcgtcctccagcgcgcggctcgacgaactgctgctggagttcgagaaactgcatggcgagtacggcctgaagctgcaggagtccctggccggcagcccaccggcgctcgaggaggccgcccaggcgagtcgcgagaccctgaagagcctggggcagttgttcgaggaccgggtgatcgtggccgagacgctggataccccgtggacgcagttctacgatcaggtcagcgcggcgatggacaagacctaccagctcgacgacgccgttctcggctatctcgatacccagttgcaaaagcgcctgcaacaggtgcgcacgcagatgctgttgctagtcgccgcgctggccgtggtttttgcagcgatcctatacctctacggcggtttctacgtttccacccgcgccaccctgaaggatctcgggcgaatgatggagcgcgtcgccggcggcgacatgacggtcagcttccaggcccgcagccgtgacgaactgggcgagctgggacaatcgttcaacgaatcggtggcgaagatccacgacctgatcgagcgggtcagccagaccgtcggcgaggtcgagcggcagaccctgcgcgtcgagtcggtgtcggccgaaagcaaccaggcggtagccgggcaacgcagccagatcgagcaggtggccacggcgatgaaccagatggccgctaccgcccaggaagtggcacgcagcgcggcgatggcggtgagcagcgcgaacagcgtgaaccaggaaaccctcagcgggcgcagcctggtcgagtcgcaggtgggtagcatccagcgcctggccggcgagatcgaccagtcggtggcggcgatcaatcgcctggccagtgacagcgcctcgatcagccaggtgctggatgtgatcaagggcatcgccgaacagaccaacctgctggcgctcaatgcggcgatcgaggccgctcgtgccggggagcaggggcgcggtttcgcggtggtggccgacgaggtgcgcacgctggccaagcgcacccagcaatccaccgccgagatcgaacagatgatcctgcgcctgcagggcggcgtcgatgcggcggtgaaggcgatgggcagcagccaccataccgccgatggcacggtcaacgagtcggcgcaggtgcagcaggcactggagaatatcctcggcgcggtgggcatgatcgtcgaccagaaccagcagatcgccgccgccgccgagcaacagaccgccgtggcccacgatatcgaccagaacatcgtcgagatcaaccaggccggcgagcgcaccgcggaaggcgccagccagaccgaacgggccagccgcgaactgggcgcccaggtgacccagctgaaacgcctgatcggcgcgttccgggtgtag

SEQ ID NO: 10069 - DNA, 1248 bp, Pseudomonas aeruginosa
aaccttccagcgcatgaaggccttcgccgacaagcaggaaaccccctttgtagtcatcgacaagcagaccatcgccgatgcctacgaccaactgaccgactgcttccccttcgccaggatctactacgcggtgaaggccaatcccgctaccgaaatcaccgagctgctgcgcgacaagggttcgaacttcgatatcgcctcgatctacgaactggacaaggtgatgaagaccggcgtcggtccggagcgcatcagctacggcaacaccatcaagaaatccaaggacatccgctacttctacgagaagggcgtgcgcctgttcgccaccgactccgaagccgacctgcgcaacatcgccaaggccgctcccggcgccaaggtctacgtgcgtattctcaccgagggctcgactaccgcagactggccgttgtcgcgcaagttcggctgccagaccgacatggccatggacctgctgatcctggcccgccagctgggcctggagccctacggcatttccttccacgtcggttcgcagcagcgcgacatctcggtgtgggacgcggcgatcgccaaggtcaaggtgatcttcgagcgcctgaaggaagaagacggtatcgtcctgaagatgatcaacatgggcggcggcttcccggccaactacatcaccaagaccaacgacctggaaacctatgcggaggagatcatccgcttcctcaaggaggacttcggcgacgacctgccggaaatcatcctcgagccgggccgttcgctgatcgccaatgccggcatcctggtcagcgaagtggtgctggtcgcccgcaagtcgcggaccgccgtggagcgctgggtctatgccgacgtcggcaagttctccggactgatcgaaaccatggacgagtcgatcaagttcccgatctggaccgagaagcagggcgagatggaagaggtggtgatcgccggcccgacctgcgacagcgccgacatcatgtacgagcactacaagtatggcctgccgctgaacctggcgagcggcgaccgcctttactggctgtctaccggcgcctacaccaccagctacagtgcggtggagttcaacggcttcccgccgctgaaggcgttctacctctagcgcagtcgcctctgctacgaagagccccgcctcggcggggctttttcatgtcgctctggaagcctcgcggcgctcgtgtcagccttgttcgacaacccatgacaaggacgccgacatga

SEQ ID NO: 10070 - DNA, 1590 bp, Pseudomonas aeruginosa
ccctcggggtcgccgatctggcccgctcctctctctactaccaggcgctgggctggcagccctcttcggacggcaacgagcaggtggtatttctcaagggccgcaacctggtcctcggcctctacggacgcagcgccctcgccgaggatgcgcaggtggaagatcgtccgaccggcttcgcggctatcaccctggcctgcaactgcgcctcgcgggatgaggtggaccgtctgttctccgcagctacggcggccggcgggcaggcgaccaagatgccgcaggaagtgttctggggtggctactccggatatgtcgccgacccggatggacacctttgggaaattgcctacaacccgttctggccgttcgacgagcagggcaacctggtcttgccctgagggcgctacggatggaaaaacgccccgctcggcggggcgttttctttggcggcggtcagccttcgttcggctggcgggacggtgcgcgcggtgtcgttggcgcgggtcgtccggcctgggctacctgctgcccggcgtcggccttgtccagcggcagcttgtcgaagtcgcgcaagccattgtgggcataggggttgccgatccagcggacttcatgctggaagtcgttgctcaccaggctcttggtcggatcgaagaggtcatagttgaggccggcgaggtcggaccaggtatggatcaggtcttcgctgctgtagcgtcggtcgaccagggcctgcaggtcgcgcggatgggtctgctgccagctgggcgaagtccagaccaggaagggcacggtgtacatgccgcgggtcgggtcgccttcgttgcggccgagacggtcgtgcggggcttcgtcgaagacttcctcgccatggtccgagaggtagaccaggaagccgttcggatcgctgttggcgaagcccttgatcaggctggagaccacgtagtcgttgtacagcacggcgttgtcgtagctgttgtagacctccacctggtcatcgctgagggccgccggggcgccctggcggtcgacgaagcgagcgtagtcggcgggatagcggtacttgtagttcatgtgggtgccgagcagatggaccacgatgaatttcttcggcgccgggtcgtccagcaccttggcgaagggcgccagcaccgcgccgtccagctggctggcgttctggctgcgctggttgttcaggtagaactgcgcatcggtctgctgggcgaaggtcgtcagcatggtgttgcgcttggtcatggtctgctggttggtgatccagaaggttttgtagccggcctgcttcatcaggttcatcagcgacggatcggtgaggaagcggtcgggatgctcctggtcagcgaacgtcagcacctgctgcagcacctcgatggtgtatggccgcgacgccaccacgttgttgaataccgtgaggttccggttcgcggccttcagtgcgtccaactgcggggtcgtttcgcgtggatagccgtagaggctcatgtgcttgcgcgacgtggattcgccgatcaccaggaccagcgtgcgcggcgtatcgccattggcatcgacgaggttcttcagcggtggtag

SEQ ID NO: 10071 - DNA, 600 bp, Pseudomonas aeruginosa
tggcgacgccgcggccctgcgccaatggcaggaaagcctggccgaggtgaccggcggtgccgccccggcggcctgggaagcgccggccttcgaggtctggtcgctggcgcggcgggagtgcctgaatcctggcagccagggcgagtcgacctggctgctggacctgcgtgcgccggccgacagcgccatccaatggcgcgccggcgatctgctggagatcgttccgcaccaggcgcccgcgcgcatccgcgaatggctgcagcggcatcacctggacggccaggtgcgggtggcggtcgagggcgtcgagcagagcctggagcaggccctggccgggcgcctgctgccggattctttcgaacacctggtcggcttgcacccgcaggcgctgctggatgcgctgattccgctttccgtgcgccagtactccatcgcgtcgctgcagagcgatggcgacctgcaactgatcgtacgccaggagcagcatgccgacggcagcctgggcatctgctccggctggctcaccgagtacctgccgctcggcgccgcgctgaccctgcgcctgcgccgcaacgcgggtttccacctgccggaggatga

SEQ ID NO: 10072 - DNA, 1047 bp, Pseudomonas aeruginosa
gctgctgcgcgccgtgctcgacgcctgcgccgcctatcgcaagggcctgccgctgatggtgctggccctggccgacaacggccgcgagctggaactggccgacgaggccgacgtgccgctgctgttcgaggccttcgccgatcgcgcctacctgccggacggtcggctggcgccgcggcggcttggcggcgcggtgcatcacgatccgcagcggatcatcgaacaggccctggccatcgcccgcggcgaagccttccccgactacgacggcaacccgctgcgcctgaccgccgacagtctttgcgtgcatggcgacaacccgcagtcgctggcggtcctccggcgcctgcgcgcggccctggacagcctgtgatccgcatcgaacccgctggtgccgaagccctgctgctgacgctcgccgaagagcccgaagtggacctgtctgtgcgcctggccgagctggccagacgtctgcgcgaggggctcggcgaaggcgtcagggatctggtgccgggctggaccaccctgatgctgcattacgacccctaccgcatcgccccgcaggtactggaagaacgcctgggtccgctgctggcggagtggcacgcctggcgccccgccgaggatgccgggcgcctgcacgagattcccgtctggtacgccggcgaggacctcgcgacggtagcggttgcctgcggattgactggcgaaggagtgatcgaactgcacagcgcggccgaataccgggtcggcgcgatcggtttcgctccgggattcgcctacctcggcggcctcgatccgcgcctggtcctgccgcggcgggccaccccgcgggcgcgtgtaccggccggcagcctggccattgccgaggcgcagacggcgatctatccgcaggcctcgcccggcggctggcacctgctgggacgcagtccgtggcgtccgttcgatccggccgccactcctccgtgcccactggcgctgggcgaccgggtgcgcttcgtcgccatcgggcgcgaggacttcctcgacctgggcgggcgcgaatga

SEQ ID NO: 10073 - DNA, 669 bp, Pseudomonas aeruginosa
aatcgttatccgggtcaccttcctggagccgatacgatggacacgagcgctttcctgattgccctggcggtggtttacctggtgcccggaccagacatgctcctgctgttccagaccggcgcccgccagggccgtcgcgcggcgctggtcaccgccctcggcctggcgctggctcgggcctgccatgtgctgatggccgcgactggactggcgctgctgttccgtaccgctccctggaccttcgacctggtgcgcctgctcggcgccgcctacctcgcctggcttggcctgcagatgctgcgcggtggcggactggccttgccgaccagcgacgcgggctccgcgccggtggtccctcacgccgaccgccgggccttgctgcgcggactcctgaccaacctgctgaaccccaaggccctgctgttctgttcggtgctgctgccgcagttcgtcagccccggggccggttcgctggccgtccagttcgccgcgctcggtacggtcctggttctggttggcctggccttcgactgcgcctatgcgctggccggtggccgcctgggccgctggctggcgtcccggccgcgggcacagcgcctgcagcagtggggcttcggtgggttgttgatagggttcggggtaaggctggcgctgctgcgccagctctga

SEQ ID NO: 10074 - DNA, 594 bp, Pseudomonas aeruginosa
tcggcggatacccagccgggggcgtcgatcaggcccatcagggccatcatggtcaccgacttgccggagccggactcgccgacgatggccagcacctcgcccttgtcgacgctcaggtcgaggccgtcgaccacgggcacggcggtggtgtcgccgaagcgcacgctgaggttcttgatatcgaggaggctcatgcggcggtctcctgtggcgcggatacggatgcgctgttcatggttgtgctcctcatgccgcgttcttcagtttcggatcgagggcgtcgcgcaggccgtcgcccatcaggttgatcgccagtacgctgagcaggatggtcaggccgggcaggctgaccacccaccaggcgcgctcgatgtagtcgcgggcggaggcgagcatggtgccccactcgggggtcggcggttgcacgccgaggccgaggaagccgagggcggcggcgtcgaggatcgccgaagagaagctcagggtggcctggacgatcagcggcgccatgcagttcggcagcacgcagacgaacatcagtcgcagggtgccggcgccggccaggcgcgaggcggtgacgtagtcgcggtttag

SEQ ID NO: 10075 - DNA, 615 bp, Pseudomonas aeruginosa
ctcggtcatcaccgcggcgcgggtcaggcgtacgtaggccggcagcgagacgatggcgatggcgatcacggtgttgatcaggcccgggccgaggatcgccacgatggccaccgccagcagcagcgacggcagcgccagcatgatgtccatcaggcgcatgatcagcggcccggcacggttcggcgagaagccggcgagcaggccgaggaggatgccggggatcagcgagatcaccaccgaggacaggccgatcagcagcgacaggcgggcgccgtggatcagccgcgagagcaggtcgcggcccagctcgtcggtgccgagcaggaagcgcgcctggccgccttccagccaggatggcggggtcagcaggaagtcccggaactgctcgctcggatcgtagggggcgacccagggggcgaacagcgcgcagaacacgatcagcagcatgaacagcaggccgccgagggcgcccttgttgtgcgcgaaggcctgccagaattccttcagcggggacgggtagaccaggctcgggtcgctggcgggagcgttgtgcatggcgttcatcggctggctcatcagcgttggtggcgaatgcgcgggttggccaggccgtag

SEQ ID NO: 10076 - DNA, 1824 bp, Pseudomonas aeruginosa
tccaggtactgctggtacaacggcttgtccaggcccaggcggtgcagggcctcggcatgcatctgcggatcgacgcgacgttcgcccatcatcacctccaccgggtcgccgggaatcaggcggatcagcgcgaaggtgagcagcgtcacgccgaagaaggtggggatcagcaaccccaatcgtcgtgcaatgaaactaagcatgttggcgggtaactcctcatcgcggaccgtgcgccccgctggcggcggggctgtggtccttgttcttctacggcttcaccgaggtggtggcgaagttgttgttgctcaacggattgatcacgtagccctgcaccgtgttccgccggacgttgaacagcttcgggtaggccagcggtatccatggggcctgttcgtggaataccacctgggcctgctcgtacagtttcgcccgctcggccggatcgctcacctcgcgggccttgcgcatcagcgcctcgaagtccttgtcgcaccagcgcgcctggttttcacccgactcggcggcggcgcagctcaggttcgggctgaggaagttgtccgggtcgccgttgtcgccggcccagccaagcagcgacaggtcgtgctcgccggccttcgaacgcttgagcagctcgccccattccagggaacgaatggtcagctggatgccggccttggccaggtctgcctgcagcatctgtgccgccagggcggggttggggatggtaggcgaggtgccgttgcgaatgaacagggtgatcctgagattttccgcgccggcttccttgagcagcgccctggcgcgttcgggatcgtgcggccagtcctggatcgaatggttgtagccgagcagggtcgggggatagggaccgaccgccggactggccgcgccggggccgaacaccgcgtcgagcatggccttcttgtccagcgcgaggttgatcgcctggcgcacgcgcgggtcgtcgagcggcttgtgctgggtgttgatggcaatgtaggtggtcagcagggcatcgatctcgtccaccgccaggttcgggtcctgcttcaggcgcggcacgtcctccggtttcgggtacagcgagacctggcactcgccggcacggaccttctgcatgcgcacgttgggatcgagggtaatggcgaacaccaggttgtcgatcggcggcttgccggcgtagtagtccgggttcgccgtatagcggacctgggcgtccttggcgtagcgcttgaagacgaacggcccggtgccgatcggctggttgttcagctggccctgcttgccggcggcgagcaactggtcgccgtactcggcggaatagatggacgcgaagggcatcgccatatcgcgcaggaacggcgcttcgggacggttgaggacgaagcgcacggtgagctcgtcgaccttttccaccgacttgatcagctcgcccatgcccatcgcgtcgaagtaggcgtagccgcgcagcgccgaggcatgccagggatgcttcggatcgagggcgcgctggaaggtccacagcacatcatcggcattcaggctccgggtcggcttgaagtagtcggtggtatggaatttcacgccggggcgcaggtggaaggtatagctcagtccgtcggcgctgacgtcccagcgctcggccagccccgggatcacctcggtggtgccggggcggaaggcgagcaggcggttgaacacggtttccgcggaggcgtcggcggtcaccgcgccggtgtactggacgatgtcgaagcgttccgggctggcctcggtgcagaccaccaggttcttcgcctgggccgcgccggcggcgcatag

SEQ ID NO: 10077 - DNA, 1701 bp, Pseudomonas aeruginosa
agtacgggtcgtgccgttcttctgcaccccggtcgtttcacgaccggggtggcgtcggcatcagggctggttggctacgccatagaaggcgttccgcgagaaggggctgatcttgaagtcatgcaccgacttgttcatcggctggtacacggtggagtgggcgatcggggtgatcggcacctgctccttgaggatgtgctgggcctgcttgtacagctcgctgcgcttgtcctggtcggagacccgcttggcagccttgaccagcttgtcgtaggccgcgtcgcaccatttcgatacgttgttgccgttgatcgagtcgcagccgtagagggtcgccagccagttgtccggatcgccgttgtcgccggtccagccgaacagcatggcgtcatgctcgccggcatgggcgcgcttgatgtactcgccccactcgtagctgacgatcctggccttgatgccgatcttcgcccagtcggcctggatcatctccgccatcagcttggcgttggggttgtagggacgctgcaccggcatcgcccacagggtgatctcggtgccctcggcgatgccggccttcttcagcagttcccgggccttggccggatcgaacggggcgtccttgatggtttcgtcataggaccactgggtcggcggcatgccgttcaccgccagttgcccggcaccctggtagacggcgtcgatgatggcctgcttgttcaccgccatgtccagcgcctggcgtacttcgagctggtcgaacggcttgtgggtgacgttgtaggcgatgtagccgaggttgaagcctggctgcgagggcaccttcaggttcgccgcttcctgcagggccttgagatcggcggggcgtgggttgagggtgatctggcactcgccggccttgagcttctgtgcgcgcaccgcggcgtcggtgttgatcgagaagatcaggttgtcgatcttcacgtcttcgggtttccagtagtccttgttgcccttgaagcggatctgcgcatccttctggtagcggctcaggatgaaaggcccggtgccgatcggcttctggttgatctgctgtggcttgccggcctcgagcaactgcccggcgtactcggcggactggatcgaggcgacgtccatcgccaggttctggatgaaggcggcgtcgacctcgttgagggtgaacttcaccctgtgctcgtcgagcttctcgaccctggcgatgttcttgtccaggcccatgtcggtgaagtagggaaactcggtggggtaggccttgcggaacggatgattcttgtcgagcatgcgctggaaggtgaacagcacatcgtcggcgttgaattcgcgggtcggcttgaagtagtcggtgctgtggaacttcacacccttgcgcaggtggaaggtgtaggtcttgccgtcgtcgccgatgtcccagctttccgccagggccgggatcgcccgggtgccgccgcgctcgaactggacgaggcggttgaacagggtgaccgaggtcgcgtcgtagtcggtgccggtggtgtactgggcgggatcgaagccggccgggctgccctccgagcagaacaccaggttgctggcggcgtgggagaacggggagccgaggatcagaccggctgccagccaggcccgaaggggaaggatcttacgcatgcaaacctcattttttctttttctaagggcatcgtctga

SEQ ID NO: 10078 - DNA, 573 bp, Pseudomonas aeruginosa
gaggccctgcctatgtctgaagagctgctcttcgaaggggaagaacaaccccatctcctgctggtggacgacgatcccacctttacccgggtcctggcgcgggccatgagccgtcgcggcctgcgggtcagcaccgccggctccgccgaggaaggcctggcgctggcccagcaggacacgccggactatgccgtgctcgacctgaagatggaaggcgactccggcctggtgctgctgccgaagctgctggagctgcacgcggacatgcgggtggtgatcctcaccggctattccagcatcgccaccgcggtggaggcgatcaagcgcggcgcctgcaactacctgtgcaagccggcggatgccgatgacgtgttggccgcgctgctctccgagcacgccgacctggacaccctggtgccggaaaacccgatgtcggtggatcgcctgcaatgggagcacatccagcgcgtgctcgccgagcacgagggcaacatctccgccaccgcccgcgccctgggcatgcatcgacggaccttgcagcgcaagctgcagaagcggccggtacggcgctga

SEQ ID NO: 10079 - DNA, 2163 bp, Pseudomonas aeruginosa
cctgcgcaagcccgacgcgctgatcgagagcgtgtcgctgagccgcctgccgaaggaaatcctcgaggtgccgttgctgcgcgataccctgaccgaggacttcgtcttctattacgagaacaatggcgaccgcctcggcctgaccggtacgttgcggcggatcatctacgagcacgacctgaccctgaaggacagcctggtcgaggaactgctcgaccaaccggcccaggtcgccctctggcgcggcgccgacggccgcctgcgcgacttcgtggtggtgctcaagcgcggcggcctggcgcgggtgctcgagccgctggcccatatcgccgccgacgaccagcagttgcgcaaggtcggcgagttggcgggaacctcggtctatcgcctgcgctacggcaacgacaaggcgatgctgttcctgtccaagggcgaccggctgttgttgctgtcgaacccacggatgctcttcgacgatggtggcgaaagcgacgacagcccgctgaacgctccggccagcgaagacctggaggcactgctcgacggcgacgaactgttccccgagcgcttcggcctgccgggccgcggcgagctgcgccagcgcatcaccctcaatgccagcgtcctggccatgggctaccagcgcttcatcccgagcttcgccggggtgcgcttcgagaagggcgagcagggctggagcagctacctggcgctgaacgaggtggaacgccagccgccgctggacttcgccccggtctggcaggccatgccgatgggcgccagcgcctgcgtggcgctgccggtcacccctggcctgtacggggtgatgctggagcgtctgggggccgagcagaagatggcccaggccttctccgagcatctcagcggcgctgccggtctctgctggtacgccagttcgcggctgcattcgccgctgctggtgggccagttgagcgcgccggccagtgccgaactcgacgacgagctgggcaagctgttcggtcgcgtgatcggcgcgaaggaagccaaggtcgagggtggcagcttcccggtggaagaccgggtggatggccagacccgccgctggacccgccaggtcagctcgaacttcggcgcctatccggccagccaggcggacaacccggagagcatcagcggccgcgcgttcttccgcatcggcatggcgcgccatggccagaccctgctgttctccctcgacgaccagttgctcggcaaggccctggacaccctcgacaaacgctatccgccgctcgccgaggtgttgccgaaggatgcgctggtaccggcctacctggcgccgcagccgctctccgaactgctgcaacgggaaaccctcgacagcctgccgcaggacatggagccggtattccgcaatgccgccgacacctacctgatgccgcgcctgaaaaccctcgccggcaagggcagctacgccctcgggctgcctgccggaagccaggccaacgcaccgtggcaatggctgccgctggaatggcggtcgctgtgagacgcctgactgccttcggcctggcgctgctcctgctggccagcggcgttgcccgcggcgagcccgcggtaacgctcgacccgcagcaatcgcaggtattccgcgcctggttcgtgcgcatcgcccaggaacagttgcgccaagggccgagtccgcgctggcaccagcaggactgcgccggcctggtgcgcttcgccgccaacgaggcgctgaaagtccacgatggcaagtggctgcgcgccaacggcctgtccaaccgctacctgcccccggagctggcgctcagtcccgagcaacggcgcctggcgcagaactggcagcagggtggcggccaggtcgggccctacgtgaatgcgatcaagctggtgcagttcaacagccggctggtcggtcgcgacctcaaccaggcgcgccccggcgacctgatgttctacgaccagggcgacgaccagcacctgatgatctggatgggccgctccatcgcctatcacaccggcagcagcaccccgaccgataacggcatgcgctcggtcagcctgcaacaactcatgacatggaaggacacccgatggatccccgacgaatccaatcccaactttatcggcatctatcggctggctttcctctctcaatga

SEQ ID NO: 10080 - DNA, 462 bp, Pseudomonas aeruginosa
agtggagcgggccgactcgcttccgccagggtgaccagcccgacctcggcctgttcgtcttcaaccagggcgaacagccggtcaaggccgagctgctcagcgggccgcctggcagccagcgcagccagaccctggagctggccaagggagtcaactacattccgctggcgcaacagccgctcagcgatggcgactggagcgccgagctgcgccaggacgggcaggtccgcgaccgcctggcggtgcgcttcaacctgctggccgacggctggcaggtggagcaggtgcagaacctcagcctggcggcggcgagcaacccgctgcaactgccggcggacgcgcgcgacgtacgcctgcgcctggccgatggcccggccgcggcctacctgggcaatctcgatgatctgctggagtatccctacggcggcgtcgagcagaccgccagccaactgctgccgctga

SEQ ID NO: 10081 - DNA, 1179 bp, Pseudomonas aeruginosa
ggccggcttgccgttcaccgatgccttgctggcctctcgctcggccgtggatggccagcaggccagcgctctgctgcaacgcctggcgccggcgcaatcgaccctggaacgcgccctggccctgacctggctgcagggcgcgttggcccaggcgccgcagggcaagctgccgcagccgccgaaggactggcaggcgcagcgcggcgccagcggcgaaacctactggcaatggcgcggccgcggcattccgagctgggtcgacctggacgaggcgccggcccggccgttgccggttgcgctcagctaccgcagcgcccaggcgccgagcgggcaactgccggtgcagatcagccgtcgtctgctgcgcctggtgcccggcgagggagcgttcgagttcaaggtcgaggaggtcggcgacaagccgctttccagcgacgaactgtatctcgacgaagtgaccctgaacgttccggaagacaccgctctacgctacggcatgctggaactgccgctgccgcccggcgcggatgtcgagcgcaccacctggggcatcaagatcagcggcctggccggcgacgaagcgaccaccctggagcgcgcgcgcaacgaaccgggcgagttgttctacggggtgccggtggacagcctgagtggcgagcagcgtttccgtcacctggtgcgtttctcccagaaaggcagcttcaacctgccaccggcccgctacctgcgtctctacgcgccggaacagcaggccctggaagccaagccggcgctggccaaggtcaaggtcgagtgattgcgttgcgcgcctggctggtcctgctgtgcgccgtgccgttgctgcttcgcgcagcggaggcgccggtccagctggcctggcgcacgacccagggctacgaactggtgagcctggatcgccagcgggtgctcgagcgccggccgttgccggccgatttgcaggctccgctgggcagcctgtggaaactgttcgtcttcgcctggctgagcgacaccggccaggccgagccgccctatacctgccaggggcgcagccgcgaggaggtctactgctgcgagaatggccagacgatcggtcgtgaccgcgccctggtgcgctcctgcgggctgtatttcgagccgcagcgcctcgccttgcagccggaggcctggcgcggctaa

SEQ ID NO: 10082 - DNA, 1263 bp, Pseudomonas aeruginosa
tggcaggcgcgccaggcaccggcctggttgctcgatctggaacggctgcaaccgcagacgcgggtgccggttaaggagcttctggagcagttgcagcaactgcaggcccagggcgaggcgcggcgggtactgctcgacgtggcgttgcaggccggcgacggccatgccgtggccagccttggcggccgcctgcgggtgaagacctggagctggctcgacgaccatgacccgcaggcgcgccagggcggtttcgctggctggctggtcgatggaacgccgctctggctcggcggcccgggaaccagcaagatgattctggaccgctacgccgaggtgctcgggcgcttcctgccgagtccgtggccggccgatccgggccgttgcgtggaagtgaacctgttcagccgctatccgctgcgctcggtcagcgatccctccggccacccggccgccgaaggcctgctgcatggtccgcagcaagtgctcttcgccaacggcaatcgactggacatcgccagcgccggcgacctcttcctgcaacgggtggatggcgtgccgcggctggtcgcgcgggtttcgcgcgaagagtacgtggcgcgggtgctggagcgcgaagcctcggcgcagccgaaggaagccgctcgcgcgctggcggtgaccattcgcacctatctattgcaaaacgccgcgccgcgcggcgaatgcctggccatcgatgacagcagccagcgccagcgcgtggcgccgcgcccggccagcgcgccgacgcggcggatcgctgcctggagcgccgacctggtgctggccggggcgaccgtcaactatcactccgaccagcctggtccggcgcgcctgtcctggaagcacgcggtggagcaagccgggcagggactgggctacgacagcatcctcgcccaggctttcccgcgcagcagcctgagccgctgggacaacccggtggccgcctgccagccgttgccggctgccgaagactggctgcgcaagcagcgccggcagtggcgcgagcgtctcgaccgagagcccggctacgaggagattccgagtttttccgtgtgccgcctggcttccgggcggccctatgtcgatcgcgagcgcgaacgcatcttcgtccgcggcctgtattccctacaggaacgcttggacctcacccacgaatacctgcacctggccttccgcgcccatcccagcggccaggacgaaaactatatcgaaagcctggcccggcgcctgctactggaatga

SEQ ID NO: 10083 - DNA, 1233 bp, Pseudomonas aeruginosa
accgcgcagtgcagcagtgcctcgcggatttcctccaccgtgcagccgttgttcagcgcaccgcgcacgtgccccttgagttcctgcgggcatttcagggcggtcagggcggccagggtgatcaggctgcgggtcttgcgcggcagcgcctcgcgggcccagaccgagccccaggcatgctcgttgacgaagtcctgcaatggctgggtgaaggcggtggcgttgcccatggcgcgctcgacgaaggcgtcgcccatgacttcacgtcggatctccaggccggtcttgccttgttcgctcatcggaaggttcctgtcgtgggtagaaggtggctcaatccagcgactctatccgaaccggcgccacgccgctgcggatcatacccaggccttcggcggccttgcgcgatacatcgatgatccgcccgcggcggaacggcccgcgatcgttgatccgcaccaccacgctgcggcggttgtcgaggttggttacccgcacgcgggtaccgaacggcaacgtgcggtgggcagcggtcattgcgttggggttgtagcgctcgccgctagcggtacgcaggcctgcgtggcggctgccatagtaggaggcttcgccggtatccgcggaaccgctgccggcgaggctggagcagccggcgaggaacaggggcaggacggcgagggcgaggcgcgcggcggcggatggggtgggcatggacaacaggctcctggcggacaagaagacgccgggcgaacccggcgtctggctttgactcacgcttcgagctttttcttcagcaactcgttcacctgctgcgggttggccttgcctttcgaggccttcatcgcctggccgacgaagaagccgaacatcttgccgcgcttggcctcgtcggcagcgcggtactgctcgacctgctcggcgttggccgccagcacctcgtcgagcatcttctcgatggcgccactgtcggtgacctgcttcaggcccttggcctcgatgatctggtcggcggaaccctcgccgttggccatggcttcgaagaccatcttggcgatcttgccggagatggtgttgtccttgatgcgcaggatcatgccgcccagttgctcggcggacaccggggactgctcgatctccaggccgtccttgttgagcaggctgcccagctcgaccatcacccagttggccgccagcttggcgtcgccgcagatgccctggaccttctcgaagtag

SEQ ID NO: 10084 - DNA, 1818 bp, Pseudomonas aeruginosa
ttcttgcgggcgaacacgttctgccggtcgatccgtgcgtcgatcgccaggccgaacaggcaggccatgcgtacggcctcctcgttgagcaccggcagggtgcccggcatggccaggtcgaccaggctggcttgggtattcggcgcggcgccgaaggcggtcgagctgccggagaagatcttcgattgggtggcgagctgtgcgtggatttccagcccgatcacggtttcccattgcatgtggtgttcctcaatccttctgtgcctgcgtagtcccgctgccgaccctgcgggtcgccctctccgcgccgggagaggggaggggactgcgtggcgttgccatggcttagaagccggccggggtgcgggtgtgccagtcgctgacctgctggtactggtgcgcgacgttgagcaggcggccttcctggaagtagggcgcgagcaactggacacccaccggcaggccgtcgacgaagccggcgggcatggacagccccggcaggccggcgaggttggcggtgatggtgtagatgtcttccaggtactgggaaaccgggtcgtcgttcttctcgccgatcttccaggccgggttcggcgtggtcgggccgaggatcacgtccacttcggcaaaggcgctgacgaagtcgttcttgatcagccggcgaatcttctgagcctgcaggtaataggcatcgtagtagccggccgagagtgcgtaggtgccgaccatgatgcggttcttcacttcgctgccgaagccttccgcgcgcgagcgcttgtacaggtcttccaggttctgcggggcgtcgcaacgatagccatagcgcacgccgtcgaagcgcgacaggttggaggacgcctcggccggcgcgatcacgtagtaggctgggatggcgtgctgcatgttcggcagggaaatgtccttcaccgtggcgccgagcgtcttcagctcctcgactacggccagcaccgcgtcggcgatgcggctgtcgaggccggcgccgaagtattcccgcggcaggccgatgcgcaggccgctcagcggcttctgcagggcggccaggtagtcgtccaccggctgttcgacgctggtcgagtccttcggatcgaatccggccatcacccccagcatcagcgcgcagtcctcggcggtgcgcgccagcgggccgccctggtcgaggctggaagcgtaggcgatcatgccccagcgggaaacccggccgtaggttggcttgatcccggtgaggttggtcagcgccgccggttggcggatcgagccgccggtatcggtgccggtggcggccggcagcaggcgcgcggcgactgccgcggcggaaccgccggaggagccgcccggcacgcggtcgaggctccaggggttcttcaccgcgccgtagtggctggactggttcgacgagcccatggcgaattcatccatgttcagcttgccgagggtaacggcgccggcggcggtgagcttctcgaccacggtggcgtcgtagggcgagacgaagttgtcgagcatcttcgaaccgcagctggtgcgtacgccctgggtgcagaacaggtccttgtgggcgatcggcgcgccgagcagggcgccgttctcgccgttggcgcgccgttcgtcggctgccttggcctgggcgatggccaggtcgtcggtgatgctgatgaaactgttgagctggggatccagctgccggatgcgaccgagcagggtgcgggtcagctcttcggcggaaaattgcttgtcggcgagggcgcgggcgatctcggcgagggtcaattgatgcagcatgtgtccgcgtccttatga

SEQ ID NO: 10085 - DNA, 666 bp, Pseudomonas aeruginosa
gagcggatcatcaaaccgctattctccaaaggcccgtcgctgggcgttcgcctgttggtgctggccgtgctgtcggtcagcctgatggtggtggacgcccggttcgactatctggagcccgtccgtagcaagctggggatggtgctcacgcctttttacggcctggcggaaatgccggtgcgcgcctgggaaggcgtgcgcgaccagttcagcagccgtagcgagctgatcgccgagaacgaacgcctcaaggccgagtccctgctgatgcagcgccgggtgcagaaactcgccgcgctcaccgagcagaacgtgcgcctgcgcgagctgctcaattccgccgcgctggtcgacgacaaggtactggtcagcgagctgatcggcgtcgatccgaaccccttcacccaacgcatcatgatcgacaagggcgagaacgacggcgttttcgtcggccagccggtgctcgatgccagcggcctgatgggccaggtggtcgaggtgatgccctataccgcgcgggtcctggtgctcaccgacaccacccacagtatcccggtgcaggtcaatcgcaacggcctgcgcgccatcgccgtcggcaccggcaatcccgagcgcctggaattgcgctacgtcgccgacaccgccgaaatcagccgagtcttcacc

SEQ ID NO: 10086 - DNA, 954 bp, Pseudomonas aeruginosa
tgcccacagcgggcagtcggtgggcgccgtcggccagggcagccgcctggtgctgcgggtcgagcaggatcgcggctcggttcgggtgcgctggggcaacgagccgcagcagcagtgcctggtcgactatgcgctgggcccgcgcgagacgacgcctcccgtcctgcaactggcatgtcgcccggcgtcggccgccgaccgggagcgcacgctgtgaccggcgtcggcctgggacgatgcggcacggcctgggtcctgctggtggcgctggtggccgatgcctccgcctcgctgtccgtgatcgggacccgtttcatctatccggcgggcgtttccgcgctgacgatccgcgtcggtaacgtcgggacgcgcccggccctggtccaggcctggctcgatcgcggcgacgagacggcggacccgagcgctgtcacggtgccgttcatcctgtcgccgccgctgttgcgcatggacccgcaggagacccaggcgctccagattcgccataccggcgagccgctgccggacgaccgggaatcgctgttctgggtcaacctgctggaggtgccggggcgggaggacggcagcggcaacctgctgctggtgagctaccgcctgcggatgaagctcctgttccgtccgcagggtctggccggcgatccgcgagccgccgcgcgccaggtcgtctggcgcctgcgtccggcggtacggccggggcagcgggtgctgctggaggcggacaaccgcagtccctatcacgtttccctggtgcgcctagagctgggcgagggcgacctcgccatgtccctcggcagcgtcaccttgccgcctttcgccgttaccccgttgagtctgccggccgtgcccggcgaggcggcgcgggtccatttcgatgcggtgggggatgacggccagatcgagcgcggcgacgcgccggcagagagatacccgtag

SEQ ID NO: 10087 - DNA, 3105 bp, Pseudomonas aeruginosa
cacggccctgcgaataggtcgcggggtttcactggaggaaggaagcacatgaacaaatgctatgcactggtctggaacgtatcccagggctgctggaacgtcgtcagcgaaggcagtcgcaggcgcggcaagcccgccggcgccaaggcggcgatcgcctccgtcctggccctgctgggcgccacggccctggctccggcctatgcgctgccaagcgggggaacggtggtcggcgggagcgcgaacggggagatacacctgtcgggcggcaacagcctgtcggtcaaccagaaggtcgacaagctcatcgccaactgggactccttcagcgttgccgccggcgagcgggtgatcttcaaccagccgagcagtagctcgattgccctgaatcgggtgatcggcaccaaggccagcgatatccagggccggatcgatgccaacggccaggtcttcctggtcaaccccaacggcgtgctcttcggtcgcggcgcccaggtcaatgtcggcggcctggtggcttccacgctggacatcacggatgccgagttcaacggcaactcctccagataccgtttcacgggtccctctaccaacggtgtcctcaaccagggaggcgccatcaccgcggcggaaggcggcagcatcgccctgctcggcgcgcaggtcgacaaccgcgggacggtcctggcgcaaatgggcggtgtcgggctcggtgcgggcagcgacctgacactgaatttcgacggcaacaagctgctcgacatccgcgtcgacgccggggtcgccaatgcgctggcaagcaacggcggtctgctcaaggccgacggggggcgagtcctgatggcggccatgaccgccaatgcgctgctctacacggtggtgaacacccagggtgccatcgaggcccgctcgctgcgcggcaagaacgggcggatcgtgctcgatggcggcccggacggcaaggtcatggtgggaggcgccttgtccgccaatgcgctgaacggaccggggcacggcgggacggtcgaggtccgggggcaggcggtggaggtggccctgggcacccaggtgaacacgctcgccagcaatggcctcaacggtacctggaagattgctgccgacaagatcgacgtgcgcccgtcggcggtgtcggatggcgtcaccgttcatgccgacaccctgtcgcggaacctggcgagcaccaatatcgaactggtttcgaccaagggcgacctggacctcgacggctcggtgagctgggcatcgggcaaccggctggggctgggctccgcggccgacctgacgctgaatggcaggctgaatgccagtggcgccaaggctgggctggagctgaaggccgaaggcgctatcgatatcaatgacaagatcgttctcggcggggctggcagcgcgctggccatggatgccggcgaaggccaccgggtgaacggcacggcgtcggtctccctggccggggccaacgcgacctacgtctccggcggctattactacacggtggtgcagaacctggcgcagttgcaggcgatcaacaagaacctggacggcctgtacgtgctcggcggcaatatcctgggcggcagctattactgcacggcactgcagtccatcggcgggcccgccggcgtcttcagcggcaccctggacggtctcggcaacagcatcggcaatctctcgatcagcaacaccgggccgaatgtcgggctgttcgcccgctcctcgggcaccctgagcaacctgaaactgaacaacctgcgggtatccgataacacctacggctccggtccgtcttcgctcggcgccctggtcgggatcaacagcgggcgtatcgccaacgtcagcgccagcggggtctcggtcgtcggcagccgactgcgctccaacgcactgggcggcctggtcgggcgcaatatcaacgggcagatcacgaacgcatccgtcagcggcggcgtcaccgcttatgcggcgagcacggcggtcggaggtctggtgggggagaacttcaccaccgcctgggggccggaggcggtcatcgagaacgcccacagcaacgtccatgtggctgcacagtccaccgagcgcaacagcctgggcggcgtcggcggcctggtcggactgaatgcgaaggccacgatcagggcgtccggcagccaggggaaggtcgagacctaccggcccggcctgaacgtcggcggcctggtcggctacaacatgttcggccacgtctccgatagtagcgccagcggccaggtggaggccggcggcgcggggaataccggcgggctggtcggcctgagttccggcggcgagatattccgctcgcaggcgagcgggtcggtgtacagcaagggcggcctggcgaccggcgggctgatcggcaaggcagaaggcaacggcatgctcggaaacctgaaagccagcggcagcgtcacggaccagggcggcgcggatctgggcgggctggtcggcaacaatagccagagcgccatcgagaccgccgaggcgacgggcaaggtcagcggcggcagcaacagtcgcgtcggcgggctgattggacacaacctcggcggttccgtcgcccatgcgatctcgcgcggcgacgtgagcggcgggttcaacagtctggtgggcgggctcgtcggccacaacggcggcgaactggtcaacgtggatgccagcggcagggtcagcgccgctgcgagtgcgtcggttggcggcctggtcggcagcaacgccggttcgatcctgtcggcgcgcagcagcagtaccgtcaacggcagcgggcgcagccgcatcggcggcctggtcggcgagaaccagatccagggacgcatcgtttcgtccatgtcggaaggcaccgtcagtggcgactactacgtctccatgggcgggctggccggcgtcaacctgggatcgatcgagtactccggcgtcagcggcaagatcgacttcaagcctcagtcccattacggccagatctacggtgcgcaggtcggcgagaaccatggggtcctgggcggcaactacgtgatcggcgaggcggcgctcctgccgcctgccggtatcgactacggcaacatctggtaa

SEQ ID NO: 10088 - DNA, 1245 bp, Pseudomonas aeruginosa
ggccggcaggggaggtccctggcggacctcccttcccggccggggccgctctcgcctggagtgtggccctcttccgcaggcgcaatcttggagagttccatgagcatgaggttatttcccggccgcgtttccctgcgccgccggcctggcgcgcaggctcggcaggcgctcgttctcggcctctgctgcctgaccggcggccaggcctgggccctgaacgaggtcgccctgaactgctcgttcgacaatggcaaaggcttgccctggcgtgtggtgaacgagctgaccagcggcacggcgaaaggcacggtgctgttcgccaggccggtgagcctgttcctgaactacaagccccaggcttcccaggaggcgcatgagctggtcatcggggggaactggtccggggtgggctatccggggccctacggcacggtggcgtccgacgtcaaaggcatcggctatcggatctcggtggatgcccaggacggcgtcaagcgggtgattccggtcgacaaccagccccatgcgctggacaagcgagtcacgagcttttccggaagcacgaccagcgactacctacaggaactggtcctgacggtcgaccccggcgagttgcctgccggcgacctgaaggtaaccagcgtatccggcagcgccaccctgaatctctgggcggtggacaggctgaagggcgaagcgtccatcggcagcgtcctggcggtgcctgcggacaactaccccaccggggtttgccgaaagccctattcgctgatcggcccggcctccatcgggatcggcggcggtcccccgccgccgccgatcccgaagaaatgcaaggtcgaggtgggacgggaaatcaacgtcaaactgggtagcgtcgcgttgaagaacttcccgcgggtcaacgacacctccacggagcgttccttcgatatttctctcagcgagtgtgcggcgctggccaagccggaaatcgctttccgcgacaagtatgtctcggcgcagcaagcggacccgacgatcctcagcttgaagagcggcggcgcggcggggttcggcatcgtcgtgaagaacggcctggaccagcagcggatacgtttcgacggcacgccctacccgatgcggcgtgtcggcgacagcgccgacctcccgctgagtgccgcctacatccgtatcggcgcggagggcgaattgaaggccggggtcgccgacggcgccgccgagttcacgtttaccttcccctga

SEQ ID NO: 10089 - DNA, 492 bp, Pseudomonas aeruginosa
cgccgtcacgcagcagcagggcgatctcccgttccctcggcgtcaggccttgcaggcgctcggcgctggccgctggcgtggcgcatgcctgcgccgccagctccatcaggccatgcagggcgcgcaattgtcgcagctcctggtcggagaaggcccctaggcgggcgtcgcgcagtaacgacagggccgccaccggacgctgatgcgcatgcgccagcacctcgaccacgtcgcagatcccgtggcgtcgcaggaagccctggtacagcgcgctgtcctccgcgggctggcgggcgatgccctggcgcagcggcaccaccggcgaagcgctggccaggcagtggcgcggctgcagcggatcgtagtcgcggtagtggcgcaggtagtcgcggtgcatgccggccggcatccgcaggagctggaaatcgtgtgcgcggcagtcctcgtcgatgcgatagaacacgcacaggctggccggtaccacctgggtga

SEQ ID NO: 10090 - DNA, 651 bp, Pseudomonas aeruginosa
gtccgggccggcgcgttccggcgccgacatgccgctgtacgacccggcgaccggcgccgagctggctcgcgtggcccgcgccggcgccgaagacgtcgaccgggcagtcgctgccgcgcggcgcgcgttcgaaggcagctgggcaggccagcgcccggccgatcgcgagcgcctgctgctgcgactggcggaacgggtcgaggcgcatggcgagcaactggcgcagttggaaaccctgaacaacggcaagtcgatcaacctgtcgcgggccctggaggtcggcgcctcggtggagttcatccgctacatggccggctgggcgaccaagatcgagggtcgcagcctcgacctgtcgatcgccgcggtcccaggcgcgcgctaccgggcctacacggtgccggagccggtgggcgtggtcggagccatcgtgccgtggaatttccccttgctgatggcgatctggaagatcgtcccggccctggcctgcggctgcaccgtagtcctcaaaccggccgacgaaaccccgctgaccgccctgcgcctcggccagttgtgcctggaggcggggattccaccaggggtggtgaacatcgtcaccggcacgggcgccgaggccggcgcggcactggcggcgcacccgggcatcgataa

SEQ ID NO: 10091 - DNA, 525 bp, Pseudomonas aeruginosa
  unsure (34): Identity of nucleotide at the above locations are unknown.
gggcgccagcgtggtctgcggcggggcgcgccanggcgagacggggttctacgtgcagccgacgatccttgccgacgtcaccccggggatgctggtggtgcgcgaggaaatcttcgggccggtgctggtggcgacgcccttcgacgatctcgacgaagcggtgcgcctggccaacgacagcatctacgggctcggtgcgagcatctggtccaacgacctgcgccaggtcatggacctggtacccaggatcaaggccggcacggtatgggtgaacgcccacaacctgctcgacccgtcgatgccgttcggcggcttcaagcagtccggcatcggacgcgagatgggccatgcggcgatcgaggcgtacaccgagaacaagtcggtgtgcatcgcctactgatatcgatgaatcggggggagccgattcgttcggctctttcgctgccctccgcggcagccttttgttcgacacgcctcgcctgccggcggagcgtacgggacgccggtgcgtcccgcagggcctga

SEQ ID NO: 10092 - DNA, 1533 bp, Pseudomonas aeruginosa
cgcaagaacaacaacagcaacgctgccgtcgaggatacgtcgatgtccaactccagactcacccagcacctgctccgcgggcgggttggtttccccaccgccctggccagttcggtcgggttgatcatggccagcccggtgatcctcaccgccaccaccggcttcggcctgggcggcggaaccttcgccgtggcgatgctggtggcgctgctgctgatgctggcgcagtccaccaccttcgccgaggccgcctgcctgctgccgacccgtggctcggtctacgactacctgtcgtgcggcctcgggcgcttcttcgcgatcaccggcacgctgtcggcctacctgatcgtccatgtgttcgccggcaccgccgagaccatgctcagcggcaccatggcgctggtcaacttcgagtcgctgaataccctcaccgagccgggcggcggcgcctggctggtgggcgtcggcatggtgctctgcttcggcctgctgaatgcgctggggatcaccgccttcggtcgcgccgaagtgatcctcaccttcggcatgtggagcaccctgatgattttcgccgtggccggcctgttgcgcctgcccgcggtggagttgcagggctggttcggggcctcgatggtcggcgacgacctgccgaccctgctgtcgctggtgggcatggcgatgttcatgttcgtcggttgcgaatttgtcacgccgatggcgccggaggtgcgccacgcttcgcggaccctgccgcgggcgatggccctggggttgatcggggtggcctgctgcatgttcatctatggcgcggcgatgcgccggcaggtggaaaacttcgacttcggcggcggcctgcacctgctggagacgccgatggcgatcccgcgattcgccgagcaggtgatgggaccgttcggacgcatctggctgggcgtgggcctgctgtttgccggagccgccaccatcaacaccctgatggccggcctgccgcggattctctacgggatggcgctggatggcgccttgccgaaggccttcacctacctgcacccgcgcttcaagacaccgttgctgtgcatcgccgtggcagcggcgattccctgcctgcacgcctggtggctgggcggcgacagcgaagggatcatccacctggtcctggctgcggtctgcgcctggggcaccgcctacctgctggtgaccctctccgtggtgctgctgcgcatccgtcgcccggacctgccgcgcgcctaccgctcgccgctgttcccgttgccgcagctattctccagcgccggaatcctgctggggatgttctacatcacgccgccggggatgaaccccgccgacatctacctgccgttcgccctgatgctcggcctggcggccgcctacgccctgttctggaccctgtgcgtacagcgggtgaatccgttccgtccgctggcggtggaagaggtgctggagaaggaattcgccgaagaggaccagcagcagcgggagagggcgcatgtccgcctgggcgcgctggtatga

SEQ ID NO: 10093 - DNA, 624 bp, Pseudomonas aeruginosa
gcgtcactggcgcgactggcggccagccgcctatcgccccggagccaccctggccctggtgcggcgcaacctggctgcgtgcgacggcgaggcgcaggacggcaggctgttgctgcgtacgaaagagctgagcctcgaggttcgcgagcgggtccaggcgcacctgttcatgcatatcgtcagcaccgagttcagcctgttcgtggcggcgcccggggggccgccggccagcctggagctgcgtcacgccggttgcttgcggcgtcgcggcatcctttgcaaggtacgcagcgggagcgggctcgagccgttgcgggaggccttgcaggggggcgaccgggtcttgctggagcagctcatgccgctggacttccggagtttgcgcctctgccgcgacgacaggggctggaccgtgagcctggaacacctgggggcgtgcgaggtggtcaaccgcttccccgcctatcgccgctacatccctctggtcgccgagcagcgcctggccctgctgggcgccttcgcccaattgcagcgcctgctttctcccgcctgaacggcccttgccggctctcccggatgcgtatccgccggtccatttgcgctagcttgtgggtatatcgataa

SEQ ID NO: 10094 - DNA, 858 bp, Pseudomonas aeruginosa
accggacgctgttcattggcgatatctcgcggcaggacctcggcggtctggagttggcgcagatccgcaccaacgcagggcgcatcgcccgccaggccacccatgccgatcatgacgacgaccgccactgcttcctggtcgtccagcgcagcggccatgcgcaactgcgccagggtggggacagcatataacctggcgccaggggaaatggcgctgatggactccgcgggcggctgcgaaatcattccccacggactcatcgaacacacctcgttccatctctcccgcgaagaggtatgccggcacctgccacccagccagcgggccttcggcaaactctcgccgaactgcgccagcggtcgcctgctgagcctgctggtgcagcaggtgtgcgccggagaactgcagccgtgggcggtggcggacgagggcggggcgttgcaggaggcgctgatcgccctgctcgggccggcgctacagcacgccggcgaggaattggagggaccgctggccgggctctatggctacagtctgcgccggcacgcggagcgtctgatcgagcaatccctgcaggagccgcgcctgagtccggacatgctcgccggccgcctgcgcatctcggtgcgccagttgtaccggttgttcgaggagcagggcgacagcgtctgccgctacattctccgccagcgcctcagccgcagcgccgccgacctcggcaacccacggctgcgcggcgaatcgatcacctccatcgccttcaagtggggtttcagcgactcggcgcatttcagccgggcgttcaagaagcagttcgaggtttcgcccaaggactatcgggccggcgcgctaccggcctga

SEQ ID NO: 10095 - DNA, 864 bp, Pseudomonas aeruginosa
tgcccttggacaggcgctgatccgcctaggggcggaggaagacatcggtttcctcgcgcccagaccacccgagcagggctgggatgccgccagcctcaccaccctgctggacgaaacgcgccccgacgcggtgatcaacctcgccttctaccacgactggttccaggccgagcaggtcgaggcggagcgcctgggcgcccaggagcgcgccgtcgagcgcctcgcggagctctgccagcactacgagatcctgctggtccagccgtccagctaccgggtcttcgacggcgcccgcgccaccgcctacagcgagaaggacgagacccttccgctgggcctgcgtggccaggcgctctggcgcatggagcagagcgtgcgcgcggcctgcccgcgacatgtgctgatccgcttcggctggctgctggacgaaagcccgaacggcttgctgggacgtttcctcagccgcgccgagcaaccgcagccgctgttcctcgccgacgaccggcgcggcaacccgacgccggtggacgacgccgcgcgggtggtgctctcggtgctcaagcagctcgactgccaggcgccgctgtggggcacctaccactacggcggactggaagcgaccaccaccctggcgctgggacaggtgatcctcaacgaggcgcgtacctatcgctccaacctgatccaggagccttcggcggaggcccatgccgcgcgcccggacgcgctcgacgagccgcagcacgcggtgatggtctgcaagaagatcctccacaccttcggcatcaagccgcgcgcctggcgcgcaggtttgccggctctattggacaggtactacaggcatgtttgaacgccccatcctga

SEQ ID NO: 10096 - DNA, 1248 bp, Pseudomonas aeruginosa
tggccgagctgcagaagctcgacgaagtcgcctacatccgtttcgcctcggtctaccggcgcttccaggacctcaacgaattccgcgaggagatcgaacgcctcgcccgcgagccggccaaggaatgaacgccgccgacccgctgtacatggcccgcgccctggaactggcgcgccaggggctgtactccacccatccgaatccgcgcgtcggctgcgtgctggtcaaggacggccaggtggtcggcgagggctggcacgtccgcgccggcgagccgcacgccgaggtccatgccctgcgccaggccggcgagaatgcacgcggcgccaccgcctacgtgaccctcgagccctgcagccacttcggccgcaccccgccgtgcgccgatgcgctggtgggcgccggggtggcgcgggtggtcgcggcgatgcaggatcccaaccccgaggtcgccggtcgcggcctgctgcgtctgatgcaggccggcatcgcggtgcagagcggcgtcctcgaagccgaggcgcgggaactcaacatcggtttcatcaagcgcatggaacatggcctgccgttcgtccgggtcaagttggcgatgagcctggacgggcgcaccgccatggccagcggggaaagccagtggatcaccgggccctccgcgcgttcggcggtgcagcgcttgcgcgctcgctccagcgtggtgttgtccggcgccgatacgctgctggcggacgatgcgcggctcaacgtacgccccgacgaactgggcctgaacgccgagcttaccgcgctcgccgcggctcgccagccgttgcgggtgctggtcgacgggcgccctgcgggtgccgctggagtcggcgttctaccacgcccggtccggcgctggtggcgacctgcgccgccgcctcggcgcgcgaacgcttccaggacgccggccacgaactgctggcgctgccctccgccgagggccacgtcgatttgcacaagctgctcctggaactggcggcgcgcggcgccaacgaagtgctggtggaggccggcccgcgtctggccggcgccttcgcccggctggggctggtggatgagtaccggctgttcgtcgcgccgaagttcctcggctccagcgcccgtcctttgctcgactggccgctggcgcggatggccgatgcggcgcagttgcggatcgacgacatccgcgcggtgggcgacgactggctggtcaccgcgcggccccatccgcgggacgcctga

SEQ ID NO: 10097 - DNA, 1491 bp, Pseudomonas aeruginosa
agagagaacgggattgcctgcctgggcgtaccctgtgcgcccgcaagatccccttcgatccaaaaagccctgtttttcacgaaacaggagttcgtcatatgtcttcatcttggaatacccgcgctatggcacgcaggccgctcggcgtcgcgccggccatgctgcgcgcctgtgcggcggaaaaacgggaggtcgcatgttcaccggcataatcgagtcgatcggcagcgtccgcgcaatgacgcccaagggcggcgacctgcgggtctacatcgccaccggcaagctcgacctgggcgacgtcaagctcggcgacagcatcgcggtcaacggcgtctgcctgaccgcggtggaactgcccggcgatggcttctgggccgacgtcagccgcgagagcctggcgcgcaccgccttccagcacctgaaggtgggcagccgggtgaacctggaaaaggccctgacgccgaccacccgcctcggcggacacctggtgagcggccacgtcgacggcgtcggcgaggtgctcaagcgcgaggagaacgcccgcgccatccagttcaccgtgcgggccccgcgcgaactggccaggtacatcgcgcacaagggctcgatcaccgtcgacggcaccagcctcacggtgaacgcggtgaacggcgcggagttcgagctgaccatcgtcccgcatacgctcagcgaaaccatcatggccgagtaccagcccggacgccgggtcaacctcgaggtcgacctgctggcccgttacctggagcgcctgctgcttggcgacaaggccgccgagcccagcgcctccggcatcagcgaagcgtttctcgccgagaacggttttctcaagtaacccacgaattgcataagggggtgcccatggcactcaacacgatcgacgaactgatcgaagacatccgccaaggcaagatggtcatcctgatggatgacgaggaccgcgagaacgaaggcgacctgatcatggccgccgaatgcgtccgcaccgaagacatcaacttcatggtcaagcatgcccgcggcctggtctgcatgccgatgacccgcgagcgttgcgagcgcctcggcctgccgctgatggtgcagcgcaacggctccggcttcggcaccaagttcactgtctccatcgaggccgccgagggcgtcaccaccggcatctccgccgcggaccgcgcccgcaccgtgcaggctgcggcggcgaagaacgccgtggccgccgaaagtgttcagccccggccacatcttcccgctgatggcccagccgggcggtaccctggctcgcgccgggcacaccgaggcggcctgcgacctggcgcggatggccgggttcgagccgtccggggtgatctgcgaggtgatgaacgacgacggcagcatggctcgccggcccgaactggaggcgttcgccgccgagcacgggatcaagatcggcaccatcgccgacctgatccactaccggctgatccatga

SEQ ID NO: 10098 - DNA, 813 bp, Pseudomonas aeruginosa
aagcgagatcaccatcatccgcgccccgggtgccttcgagatcccgctggtgacccagaaggtcgcccagcaaggcggcttcgacgccatcatcgccctcggcgcggtgatccgtggcggcaccccgcacttcgaatacgtggctggcgagtgcaccaagggcctggcccaggtgtccctgcagttcggcatcccggtcgccttcggcgtcctcaccgtcgactccatcgagcaggccatcgagcgctccggcaccaaggccggcaacaagggcgccgaagccgcgttgtcggccctggaaatggtcagcctgctggcgcagttggaggccaagtgagcaatcaagacagcggcaacccggcagccaagccgccgaaaggcaagaccgccgctcgccgcaaggcccgcagcctggccgtccaggccctgtactcctggcagatcgccggccagcccctgcacgagatcgaggcgcagttccgcaccgacaacgacttctccgaggtcgacggcgcctacttccacgagatcctgcacggcgtgccgcgacagaagagcgagctggactccaccttcgagccctgcctggaccgcccgctggccgagatcgacccggtcgagctggccatcctgcggctgtccacctacgagctgcgcaaccgcatcgacgtgccctacaaggtagtgatcaacgagggcattgagctggccaagaccttcggcgccaccgacggccacaagttcgtcaacggcgtgctcgacaagctggcgccgcgcctgcgcgccgccgagctgcgcggcggcaagcgctga

SEQ ID NO: 10099 - DNA, 987 bp, Pseudomonas aeruginosa
tcccgcgccggcggcgtcatgggtgagttcgagctgatccgccgcttcttcgccgcggccgcctgcgcggcgccggcggcggacgtggccctcggcatcggcgacgactgcgccctgctggcgccgccagccggcgaacaactggcggtctccaccgataccctggtggaaggcgtgcattttcccgccggttgcgcccctttccttcttgcccagcgcgccctggcggtctccgccagcgacctggcggcgatgggcgccgcgcccctggccttcaccctggccctgaccttgccgcaggccgacgccgagtggttgcagggcttcgcccgcggcctcgacgccatggcccggcagtgcggcctggccctggtcggcggcgacaccacgcgcggcccgctgagcatgaccctgaccgtattcggcagggtgccggccggccaggcgctgacccgcgccggtgcgcgcccgggcgacctgctctgcgtcgggggcccgctcggcgaggctggagcggcgctggaactggtgctggagcgaagatcggcgcccgccgaggtggccgaaccgctgctggcgcgctactggacgccggccccgcaattcggtctgggcctcgccctgcgcggcaaggccagcgccgccctggacatctccgacgggctgctcgccgactgcgggcatatcgcccgcgcttccggcgttgccctgttggtcgaatgccagcgcttgcaggcaagcgccgcgttgagcggcctgctcgccggcgaggaagccttgcgccagcaactggccgccggcgacgactacgtgctggttttcaccctgccgcctgagtaccttggcgagattcgcgccgcgtggccggccacggccgccatcggccgggtcgaggcgggacagggggtgcacctgctcgacgccgacggaaaggaactcataccggccgcggccggctaccaacatttcggaacccaacgtgactga

SEQ ID NO: 10100 - DNA, 1254 bp, Pseudomonas aeruginosa
tcaggcgccggcgcagccggtgccgccgtcggtctggcgcaatccctggcatttcctcgccttcggcttcggctccggcaccctgcccaaggcgccgggcacctgggggtcgctggtggccatcccgttcatcccgctgtggcagatgctgccggactggggctactggctgatgctgggagtgaccatgctgttcggcttctggctgtgcggcaaggtcgccgacgacctgcgcgtgcacgaccacgaaggcatcgtctgggacgagatggtcggcatgtggataaccctctggctggtgccggagggctggtggtggctgctgatcggcttcgtcgtgttccgcatcgtggatattctcaagccctggccgatcagttgggtggaccgcaacgtgcacggcggcgtcgggatcatgctcgacgacgtcctggccggggtattcgcctggctggtcatgcagggtctagtctggggatgggtacactggctggtctgaggcctcccatgcgtctgctcgtccttttctgctgcctgtggctgctgcccggcgtcgcttccgccgcccccgccgtgggcgagatccgcgtggtcagcgaaacctggacgcgctacacccaggaggacggtcgcggggtggcctgggacctgctgcgggccgtctacgagccggccggggtacgcctgcggatcgccaacgagccctatacccgggcggtcggcctggtcctgcgcggcgaggccgacgcctgggtcggcgcctaccgcggggaaatcgacgaagcgctttaccctcgctggccctatgacgtcgatccgatcgccgtgctttccctgaaagacaatccgccgccgccactggagggcctgagccggttccgcctgtcatggatgcgtggctacgccttcgcccgctatttccctaccctgaccccgcacagcgagttgcagcgccgcacctcggcgctgccgatgctgctcaaccaccgggtcgactatttcatcgattcgcgtccggaactcgaggaaatgctcgcaggggccggagcgctggcggctgagtaccgcatcaccgacgtcactcggttgccgctgtatcttggcttctccgattcccccaggggccgtgagctgctggcgctgttcgaccggcgcatgcggcagttgcatgccagcggcgagctggagcggatcttcgcccgctggaactggccctatgcgccgttgaaggcaatcctgccacccaaggagtga

SEQ ID NO: 10101 - DNA, 699 bp, Pseudomonas aeruginosa
gtatttgcggcatttcgagctgaccgggcgccggacgctgctggtacaatggcggacttccgtttccctaggagttccccggtgtccgtcgtgttcgtcgccgcctccaaactgccgactcccttcggcgaattcaccatgcatggtttcctcgacgaggagagcggcaaggaacatgtagccctgagcatgggcgacatcgccgatggcgcgccggtgcttggtcgcctgcattccgaatgcctgaccggcgacgcgctgttcagcctgcgctgcgattgcggtttccagctggaaggcgcgcttgccgccatcgccgaggagggccgcggcgtgctcctctacctgcgccaggaaggtcgcggcatcggcctgctgaacaagatccgtgcctatgaattgcaggatggcggtgccgacaccgtcgaggcgaacctgcaactgggttttggcgccgaccagcgcgactacgccatgtgccagccgatgctcgcgcacctgggcgtctcctccctgcgcctgatgaccaacaatccgcgcaaggtcaaggcgctggaaagctacgccatcaccgtggcggagcgcgtgccgctgcaaaagggcctgaacaagcacaacaggcgctacctggcgaccaaggccggcaagctcgggcacatgctcggcagcctgcaccagggcgaggcggaaaccacgtga

SEQ ID NO: 10102 - DNA, 1086 bp, Pseudomonas aeruginosa
tcctgctcggggtcaccagcctggtgctgttctggctctaccgtattccgcgtcaactcggttgatgcgctcgttctggctgctcgcctgcctgctcctcagcctttccgccggggcggcgcagcgggtggtcagcctggcgccttcgctgaccgacagcgtcctcgaactcggcgcagcgcgccgcctggtcggcgtgctggatggcggcgagcgtccggcggcgattggcgacctgccttccgtcggccgctacggccaggtcaatctcgaacgcctgctggaactgcagcccgacctgatcctggtctggcccggcagcgtgcccgaggcgcagttgcagcgcctgcgggacttcggcatcgccctcttcatcgccgaaccgcacagcctcgacgaactggccctgcaactggctgcgctgggcgaggcattgggcgaggccgaggccggccagcggttgtcggccaggttccgcgaaggcatgcggcgcctggccgagcgctaccggcgggacaagccgctgaaagtgttctaccaggtctgggaccggccgctgtacaccattggcggacgccaggtgatcagcgatgcgctgcgcgtctgcggcgccgagaacctattcggcgacctgccgcagccggcgccgcaggtcagcgtcgaggcggttctggcgcgcgatccggcggtcatcgtcgccggcagtcacgcccagctcgaactctggcggcaatggccggcgctggcggcgacgcggcgcggacagctgtaccggatcgaagacaagaacctcgagcggccgagcttcgccatgctggcggcgaccgagaaactctgccgctcgctcgccggggcgcgctgaatgcttgccggtatcgcgcgctgtatcggcggataacgccggtggcgttattcgccctacggcaattggggggtagggcgaataaccgcaacgcggttatccgccgttgtcgctgggtttggcgctactgccggtcgagacgctggcgtactgccttttcgatgcccgcggcatccaggccgcattcggcgagcatctcgctgggcttggcgtgttcgacgtag

SEQ ID NO: 10103 - DNA, 345 bp, Pseudomonas aeruginosa
tcgggcaggcccagttgcagcagcgggacttcgaggccctcgctggcgaggaactcgccgaccgccgagccggcgccgcccatcacggcgttttcctcgatggtcaccagcagttcgtggctgcccgccaattcgcgtaccagggcttcgtcgaggggtttgacgaaacgcatgtcgacgaccgtggcgtcgaggctttcggcgaccttcatcgcctccgccaactgcacgccgaagaccagcagtgcgaccctgccgccgcgccgacggaccacgcccttgccgatctccaccggttgcaggtccggatcgatcggatggttggggccgctgccgcgcggatag

SEQ ID NO: 10104 - DNA, 396 bp, Pseudomonas aeruginosa
cgctccagggcggccagcgaggcgggctcggcgcgaccgctggcgagggcgccgaggcgcacgctggcttcgatcagcgcgccggtcttgtgccggtgcatgacttccagggccgcctggtcgagggccacgccgaccgagccgaggtcgatcgcctggccgccgaccatgccggcggagcctgcggcgcgcgccaggcgggtgagcatttccagacagacggcatgttcctgcggattgcgccgggtgtcggcgagcacttcgaaggccagcgcctgcaagccgtcggcggcgaggatcgcggtggcttcgtcgaaggcccggtgggtggtcggctggccacggcgcaggtcgtcgtcgtccatcgccggcaggtcgtcgtggaccagcgagtag

SEQ ID NO: 10105 - DNA, 888 bp, Pseudomonas aeruginosa
tgcgcgacgagaagcccggcggccacggcgaacgctgcgtcgcggtgggcgccctggacatggcgctgtgggatgccgcggccaaggccgccggcctgccgctgcatcgcttcctggcgcgacgcctggggctggcggaagactatccgcagcgcgtaccggtctacgccggcggcggctacccctatccgcacgacgacctgggacgcctggaagaggaactgcggcgcttcgtcgatctcggctacacccacgccaagatcaagatcggcgcggcccgggctggaccaggaccggcgccgtatcgacagggcgctgcgggttctcggcgacgcttcgcggctggcggtcgacgcgatgaaccgctacgacgcggagggcgcggtcgacgcagcgaaagccctggcgccgctggggttgtggtggttcgaggacatctgcgacccccacgatttccctacccaggccgaagtggcggatatctatccggggcccatcggtgccggcgaggccttgttctccctggccgaggctcgcttgctggatctctatggcggcttgcggcgggagcgcgacgtgctggtgttcgaccccgtgcattgctatggcctgccgggctacctggcgatactcgaccacctgtgcgcccggggttggccgcgcgcggccttccgcccgcacgccggctacctgttcagcctgcacttggtggcggccctgcgcctgggttgggccgaggctacgccgtcggctttccggccattcgacgatttcgccggtgccctgccgttttcctcgggattggcgggattgccacaatcgcctggtataggcttcgagcgccaggcgacacttgccgggctgttccgcaagcttctggaggcctag

SEQ ID NO: 10106 - DNA, 828 bp, Pseudomonas aeruginosa
gtcagcccaccactgcttgcaggttgggtagccaccaccaccgcccacctggggcagcccggcgtcgcgggtggcgttgtagggccacgactgacggggactcttcgagtagtcggtgtcgtagtaccccggggtgttcaacaggaatcgggagccgatccagttcaggtcctgcagcgccttgttgtcctcggcgatggagcccagatcgggttgccgcatgaacagccgcgcacgggaaggtccgtagcagtccctggaaaagtcagcgatttcttgtgccagcagcgggttgttcacgcgcgtattgtccacttccattcgcatctgccgcagatccgtgccgcacggaatggccgcgaccgcgccggcggtgaagcccttggacagggcgtgcatcatcgcccaccagagcggcatctgcgcactcttgccggccaggctgctgaaggaggtcgaccagccggtgtctgccggcgccggcaggttgtactggcactgctgggcgcgggcctggtcgaactcgatggtgtcgaagctcacgttgacgaccgggattcccgccagggcgaccacgatgtatccgacgtagatatgcgtctcgatgcgggccagagacagcacgcctttgttgccctcgtcggcgccttccccgcgaactttcagccactcacgcatcacaatggccacgaagggcaccgcgaacagccctgtatccgagatcatgttccagatcccgttgttgatgatccaaccgaggagggtgaggtaatactccaggtagtcattggtcatgaaggtcatgctgcgcctcccgtgcggaagtag

SEQ ID NO: 10107 - DNA, 669 bp, Pseudomonas aeruginosa
gttgggaaacaccgcgcagttgaggctcagggacggggtcagctcctgccatttcccggtcgaggcatcgccctctttcagctcgcccgccggccagtagccgtccttgggggctgcgcgcatgggaaggtagacgtggagttggccgactcgcgtggtgatgtcgccggcgcgctgggcgatgacggctgccgtcttgtagtcgtcggtctggtgcaggaatccgctgcgcggatagaggttcccccacatgtcgccggagaagactccccccacctcgcgcagccctgggaccaacgcttcggggtacacctgctcgggaattccatgccgccagccaatggcgtccagtgtgctgaggaagtacggcaccagcgggaaggtggcaccagggcaaacgtacccagaggcgctggcgaaccggctgaacgtggccccgccaggatggccgatcacatccgcttccttgaagcggccgatgctgttctcggccttgtagttggtggtcgcgtcattgccggcctgggcgagtggattcggtgtacccagcgccgacacctcggtccaggggttgctccctgtattcgcgtagctggagacgactgcgtcaggcacgtagtggcggaccttgaccgacgtcttcactttgcagccatgcgggccgcatag

SEQ ID NO: 10108 - DNA, 849 bp, Pseudomonas aeruginosa
gactgtatgactgtgaggctggttggtaccgctgtagggtgcattaattacaaaggtcaatttgctgctttaatctataatctcaagtttagcgatggcagctctctttcggtgagtatgggtgagatggtatgtgcacagttggcttcgttgtttcaaggttacttagtcgaagtaggaggggttagcgagtcaccggaggcggagagagagtttaaaaggaatgagggggtgatgcctcgttctatgttagagaatccaagtcttgataccgtcgttagccatgttgttagtaggatgttagatggagggttggtccttagtttgatatttaagaatactggggatcttaaaactgtagttattcgtagagaggatgttcccagctttattggctacacgtttaatgcgcttcagggggtaggggttcttgaaagggttatgagggaatccgcggagattatgactaaaccctcgattatggtgtatgattgtaagttcaactctggtgatatcgattataatgatcggcgcgggtacaatattgatgaatatagactgctgccttatctctatggggtggtcattgtagataactcaggtgctggcagaaaagttgttgctggattctttcttaagtcggccttgactagtaatgatcctaagctcagggagcacttggctgacgcggccaagcagattgttggaagtgactattttgtaagtaaggaactttcgttattgcacacaaatgtttttgtgtctgacggtgagccattgagtatagaggaaatgcaaaattttctcgctaagctgtatcttgagcactctgtcggtggagtcgcatag

SEQ ID NO: 10109 - DNA, 1458 bp, Pseudomonas aeruginosa
gctgcggtctgcctcggtgatgatccagagcctggattcgccgccggcatcgatgtcgtaggacgacagcagcctatcgccgaacttcagggctctctggttggtgttccagtcttcctggtccagcgtcccccaatctcccgccagatggcggttcagcaaaggcgctgggttgagttgaccggtttccaccaggtggctcacggcagcggtcattacgacttggccagggctgaacagcagcggttcgggggccggctcaggttggggctcttcagcctcttccgtggtcgcagccgacgagctgatggtcagcacgcggccctgattgaccgaggagggtgtcatttcccatgcccggatgatcgggatgaaacggtctgtgaggatcctcacctcggtgatgttgccgtcttcgtcttcggtgaattcggtcttgcgggccttgtccttgtaggtgtcacccttcacgaccaggatccggcccgacttcgagcgcacgacgccggaaatcgcgccggcggccaaggccagggccaggtgccagcgagacagctcgcggactggtgggcggggctgcagccccgcttgcgcgaagtgcaggttgaagtcaggccagagacctcgcagccgctggatctcgccggcgaactgctccggctccagggttactcgatagaagtgctccagctcgctggtggccggcagaaccacatagggttcccacggccaagccgctggaatttcctcggccttttcctggcccgcgccgatcgcctgcaggcgagacctcacctgattggcgtccgcccgggccaggtcctgtcgacggacccggatgccgaagatcaccacctgtttgaaggtaggatccgcggctgcgtacatgcgcaggccggtgaagtggttgctcaaccaaccggtcagctcatcgtccaagacgtagtgaggaacaatcaggaccatgacgccgccgtactgcagcaacggcaggcagcgctggtagaacgctttctccagacgcctgcggccgctgccctggtactgcgacgcaccggagtggtccgccaccaggtcgccataaggcgggttgagccagagcagtccgaacgactgcctgctgatcatggtgtcgaaaaggtcactgtgcagcactcgctcaagcaagcctcgagcatggtcggcgcgctcgcggtcgtactcgacagcgagggcttggaccttgtcgcggccgaggatgtgtgctgcctcagccagggcaaccccctcaccggcgcagggatcacagatcctcatcctgcccgacggggcgggagcgagggcttgcagagcgcgttcgagggtgacctcatcggtagggaagtagccgttgcgtgcaaagttgcgcgccaagcgcgggaacatgagggccatggggcctccttgagtctgagagggatggctcaggcttgtgcctga

SEQ ID NO: 10110 - DNA, 303 bp, Pseudomonas aeruginosa
tccatggttgaagtcaaacaaaccgccactttcatggcatgggaaagcaagctaaaggatcggcgggcaaaggccgtgatcgccgcccgtatcttccgattggcgaatggactacccggcgatgtgtcaccagtcggccagggtgtgagcgagttgaggattcactatggcccaggctatcgggtgtacttccagcagcgcgggacggaaatcgtcatcctgctatgtggtggagacaagagcagccaggccagggatatagaaatggcgaaacgcctggcaaatgagtggaggccgcaatga

SEQ ID NO: 10111 - DNA, 705 bp, Pseudomonas aeruginosa
atgccgaccacccgacaggtggaagaggcgccatcgcaaggaaatgcaatgaatgatttggcggttttgcctacccccagcaaagtattccggtcattgctaacggctaccggctaccgcccttgcctggaaggtaaaggatttggtcgagatcttgatcacctagccctcgaagagcgctcgggcagcaacttcgacttattggagaactgtcaagctcaatggctacggaccattcgggacgatgctggggcggactggagcaatctggccgagtccgcctggaataggcacagcaacctgctgcgctcactggcgcgaaaggcagataccaccgggatgattcaggatcgtgcgcgacctgccatctttaggatgctggtgatccctgagatttcaggctttgttcgtcgcgtgcatcaagagttaccgttgctagatattcggcagtggtgggattccccctttgccacctggcttatcgctgcacaacaacaaagctcactttctgcacaaaaattgttagagcggcttgccaatcacgtagatctggacgagcgcacgctggagcgctggcagcagggtaacgctatcggtaaaagcctgtggccgtaccgcgatacggttactccccgcgccgcgtgcaccacaacgcggcgcggcctgcccgaaatacaggcagcaccccgtgctcatgccccatga

SEQ ID NO: 10112 - DNA, 816 bp, Pseudomonas aeruginosa
tcctcaccgccctgcagcatccgctggacccgaacccggtgtacgcgcccaggccggtcaagctgtcctggcatcaggtggccagcgacggcatcagcgtgctctgccgcacctcgcgcccggaaaacggtcgtgcctttcacaacaccgaacgcctgtacatctgaggaggtggccgtgatgagccttaccgaaagcagcctgcaccccgaaaccgccgcgttccgccatgtgatcccggccggcgaaccgtacctgttcgaagtcaaggccggacagaccctgcgcctgctcgatctcgaaggcaaccaggcggtggacacgctgttcttcagcgcgaaaaacccgcgcgagcgctacgacccgcagcgcactctgcgccggcagaaccgcgtctacctcaccaccggcacggtgctctattcgaacctcggcaatccgcttctgaccatcaccgccgacacctgcggccgccatgacaccctcggcggggcctgcgcccaggagagcaacgtggtgcgctacgcgctggacaagcgctacatgcacagctgccgtgacaacttcctgcgcgcgagcctcaacgacggtcgcctgaccaaacgcgacattggcgccaacatcaacttcttcatgaacgtgccggtgacccccgaaggcggcctgaccttcgccgacggcatctccgcgccaggcaagtatgtggagctcaaggccgagcaggacgtgatcgtgctgatctccaactgcccgcagctgaacaacccctgcaacggctggaacccgacgccggccgaggtgctggtgtggaactga

SEQ ID NO: 10113 - DNA, 384 bp, Pseudomonas aeruginosa
acggcgtggccgtctactccgaggccgacgccgccagcctgcatctgcagcaggccgacgaggcccacagcctgggcgaaggcccggccacgcagacctatctggacgtggagaagattctccgcatcgcccgtgaaaccggcgcgaaagccatccaccccggctacggattcctctccgagaacgcggcgtttgccgaagcctgcgaggccgccgggatcgccttcgtcggcccgacgccggaacagctgcgggtgtttggcctcaagcacaccgcccgcgccttggccaaacaacgcggcgtaccgatgctggagggcaccgagctgctcgacagcctcgccgatgccctcggcgcagccgagcaggtcggctacccggtga

SEQ ID NO: 10114 - DNA, 291 bp, Pseudomonas aeruginosa
agatcgagaacaccgagctgcgcctgtccgactaccaggactttcttgccgccgaggccgacagcatcgacgccttccgccgccagcagcgcggcgccttcgacgccgagcgccagcgctggatcgaatcgggccaggcgcacttcgagagcgaggaagtcgccgcagacctcggcgaggacgccccgctcggcgccggccagctcggcatcgagagccacatcgccggcaacctctggcaggtgtcggtggccgagggcacgcgggtcgatgccggcgacgtgctggtga

SEQ ID NO: 10115 - DNA, 504 bp, Pseudomonas aeruginosa
ttcgcggctggggcctgggggtcaacctggtggagccatgccgcctggctctggagcagagcgacccgaacgtgttcctgctggccggccgctactcgctgctggagcacgacgaggcgctggacaccctgttcccgacctgccaggcacgcgacgttggcgtcgtcgttggcgggccgttcaactccggcgtcctggccggtggcgatcactatgagtacgaccagatcccaccacaggtcgcccagcgcagggagcagctcaaggccgctgccgagcactgcggcgtcgatctgcgggccgccgccctgcatttctgcctggccaacccggtggtcgcctcggtcatcccgggcacggccaatcccgagcgtccccggcagtacatggaagacttcaacgcccaggtgccccgggagttctggcagaccctcaagcaagacggcctgctgcgcgaggatgcgccggtgccgatctgacccctgccaagccgtaacgggctga

SEQ ID NO: 10116 - DNA, 1095 bp, Pseudomonas aeruginosa
cgccggggtgatcctggaaaagccctttctcgaaaccagcgaggcggactgggcaagggtactgggcgtcgacctcgccggcgtctaccgctgctgccgccatgcactggcacagatgcagccgcggcgcagcggcgccatcgtcaatgtcgcctcggacctcggatttctcggccgcgaacagtacgtcgcctactgcacggccaaggccggggtgatcggcctgacccgctcactggcccgcgagttcgctgcagacggcatccgcatcaatggcgtcgcacccggccccatcgccacggcgatggtcagcccggagcacatgagcgacgagtggatggccaaggagctggcgatccccatggcgcgcctgggcacgccggaggaagtcgcggcggccatcgtcttcctgctttcgccgcaggcgagctatttcaccggacagctgctcgggcccaacggcggctcctggatgggcgcatgaacagcctgatgccacagggcatgctgatcggcggcgccatcatgtgggggctgggctggctgccgctgcagttcttcgcggcccgcggcctggccggcatgccgctggtgctgctgacctattcactgctcagcctgctggcgttgctggtgctctggcagcagcgccgccagtgggcgagccagtatcgccaggtgctcaccatgggcctgtgcggtggctgggccaccgccgccctggttaccgccctggccgagggcaacgtggtacgggtgatgctgctgttctacctggcgccagtctgggcgatggtcggcggctggctgctgctgggcgaacgcctcagcggcacgcggctgttcgccctggggctggcgatgctcggcatcggcctgaccctcggcgtcacgagcgaagcgctggacgcacccggcgcgaacgactggctggcgctttccgccggcctcgccttcagcctcaacaacctcgccactcgcgccgccgaccgggtgccactggcgagcaaggcgctggtcagtttcatcgggcaacgcgctgcctcgggagggctgttctgcctgctgctgccaccaacccacttccgcccctga

SEQ ID NO: 10117 - DNA, 1113 bp, Pseudomonas aeruginosa
gttccatcgccacggtgtgcgccgcctggtgctggtgctcggccattacgagaaccagtggttcgtcgccgagggcatccagctggcgctgcgcgacctcgggccggacgccgggctggaggtaatgcgcctggagcattgggatttctgccacgagcagaccctgaccgacatcttcccggaaggcttccccggtttcgcgctggagcatgccgcggtgatcgagacctcgctgatgctgcatttccatccgcaactggtcgcgctggagaagattcccgacgacgccccggccgactttccgccctacgacatgtaccccacccgtaccgaatgggtgccgccctccggggtgctgtcctcggccagaggctccagcgcggcgaaaggccagcggctggcccacgacatcgtcgaaggcatcgccgccgcggtgtgcaaggagtttgcgctgtgagcctgacgacgcatccgctgctcctcgagcacacggcgctgctggtgatcgacatgcagcgcgacttctgcgcgctgggtggatacgccgaccaggccggaatggacgtcagccgcctgcgcgcaccgatcgcggcgatccaggcgctgctggattgcgcgcgcggcgtgggcatgctggtggtgcacacccgtgaaggccatcgaccggatctttccgacctgcccgagcccaaacgccgccgcgcccaggccaccggcgctgccatcggcagccctggccccctcggccgcctgctggtgcgcggcgaattcggccatgacctgatcgacgagctgcaaccgcgcgccggcgagccggtgatcgacaagccgggctacagcgccttcgcccataccgatctcgaactgatcctgcgccgccgcggcatcgagcggctgatcctgaccggcgtgaccaccgaggtctgcgtggcctcgacgctgcgccaggccatcgaccttggcttcgactgcctgaccgtccgcgacgcctgcgcctcggccgacccgcaactgcatgcggctgcgctggcgatgatcgaggtggaaggcggcctgttcggcagcgtgatcgacagccatcggctgctgagccaactggagggatcgccatga

SEQ ID NO: 10118 - DNA, 1140 bp, Pseudomonas aeruginosa
acagctggccgccgtcgagcccgcgttgtggccgcagctgctggcctgcgagctgtccttcggccgccaccgcaacggcgccacgccctggcagatcacccattcgacgctgcccggccgcgtcggcgacgctctgctgtcgagctactggaacttcgccgaccccgccagtctgcccgccgcggacctcgccgcgctgggccgttatccggcggccggcggctggcaacgcgtcgaactggatgtgcccaccgctacagagaaggtccccgcatgaccgcacagatcagcattccctccgctcaacaacgacacaccacagcacccgccgtacaggccgaaccggtggtgcgcaaaggcagtttctggcgtattcgcggcgaactctcgcggcgcaacgcctggctgctcaccggcgccgggctgagcctgcccttcgtcgtctggtggctgtggaccgccctcggcctggccgacccgatgttcatgcccagccccggcgcagtgctcgagcgcatcggccgctggtggaccagcgaggggctgctgggagacatcggcatcagcgtctggcgggtcatggccggcttcggcgcctcggcactgatcgccctgccgctggggctgtacatcggcacgtaccggccagtgcaggcctttctcgaaccgcttaccgacttcatccgctatatgccggccgtggccttcattccgctggtgatgctctgggtcggcatcgacgaaggctccaaggtactgatcatcttcatcggcacctttttccagatggtgctgatggtcgccgaggatgtgcgccgcgtacccatggcgcagatcgaggcggcgcagaccatgggcgccaaccgcagcgagatcgtcaagctggtgatcctgccgtcggccaagcctgcgctgctcgacaccctgcgcatcacctgtggctgggcctggacctacctggtggtagccgaactggtcgcggccaactccggcctcggctacgccatcctcaaggcgcagcgctacatgcacaccgacaagatcttcgccggcatcctgttgatcggtctcatcggcctgatcaccgatcaggccttccgctggttgcaccgccgcgcctttccctggatgaggaaatga

SEQ ID NO: 10119 - DNA, 1596 bp, Pseudomonas aeruginosa
cagagccgcgcattgcgcaggcgttcgccgttttcgaggcgcatttcgcccagcgcaaaaaatttcttttccctttttatttcaatcatctgcgtgactcctacagtggcgcgaagggcgccaggcggcaccagcgtcggcccgtttctatacacgctggcatgtatattggatgaaggaatcgtgccagcggccccggccgccattcatgactccaaggagcgcaagccgatgaccagctttcccctctcctccgtcgaggagttgaaacagcagttgcaggacaagggtgtgaagtacgcgatggccagctacgtcgacatccacggcgtgatcaagggcaagttcgtcccaatcgcccatctcggccagatgctccgcggctccgagctctacaccggtgcggcgctggacggcgtcccgcaggagatcagcgacaacgaggtggccgcgatgccagacccggcgaccgccacccagtgcagctggaaccgcgatctcgcctggttcgccagcgacctctacctggacggcaagcccttcgacgcctgctcgcgcggcatcctcaagcgccagaccgaagccgctgcagcgctgggctacaccttcaacctgggcatcgagaccgagttcttcctgttcaaggacaccccggatggcggcttcgcgcccatttccgagcgcgacgacatggccaagccctgctacgacccgcgcctgctgatggacaacctgcccatcgtcgacgaactggtacaggcgatgaacgagatgggctggggcgtctactccttcgaccacgaggacgccaacggccagttcgaaaccgatttcaagtacaccgacgccctcggcatggccgaccgcttcgtgttcttccgcatgatggccaacgagatcgcccgcaagcacggcgccttcgccaccttcatgcccaagccctcggccaaccgcaccggcagcggcgcgcactacaacatgtcgctagccgacatcgagaccggcaagaatctgttcgaagtcgatggcgaagacccctacggctgcggcgtgaccccgctggcctatcacttcatcgctggggtactgaaacatgccaaggccatctgcgcggtcatcgcgcctacggtcaacagctacaagcggctgatccgcaagggcgccatgtccggctcgacctgggcgccggtgttctgctgctacggcaacaacaaccgcaccaacatgctgcgcattccatcccagggcgcgcgggtcgaatgccgcgccgccgacatcggctgcaacccctacctcggtgccgcgatgatcctcgccgccggcctggagggcatccgcgacaagctcgatcccggccagccgcaccgcgagaacatgtatcactacagcgaacgggaggtcgcgcagatgggtatcgagaccctgccgcgcaccctcagcgaagccatcgacgccttcgaggccgacccgctgtcgcgccaggtgttcggcgatgccatgtaccaggcctttgtcgagttcaagcgcgacgaatggaatgcctaccacacccatgtttccgactgggaaatccagcgctatctgaagttcttctga

SEQ ID NO: 10120 - DNA, 1083 bp, Pseudomonas aeruginosa
accgggagtaccgccatgcacggcaccatgatgaaaaagctgctttgcgccggggccattgccctcgccgccctcgccccgctggcccaggcggaggagaaaaagaccttcaacctggcctggaccatttacgtcggctggatgccctggaagtacgtcgacgagtcgggaatcatgaagaaatgggccgacaagtacgggatcgaggtgaacatcagccagatcaacgactacgtcgagtccatcaaccagtacagcgccggccagttcgacggcgtggtcgccaccagcatggatgcgctgtcgattccggcggccggtggcgtcgacaccaccgcgctgatcgtcggcagctactccaacggcaacgacggcctggtgatgaagggcaccagcgatctcaaacagatcaagggccaacaggtgcacctggtggaactgtcggtgtcgcattacatcctggccaaggcgctggacagcgtaggcctgtcggagaaggacgtgcaggtggtcaacacctccgacgccgacatcgtcgctgccttcagcacggccgatgtacgcaacgtggcgacctggagtccgctgctgcaggaagtcgccgccacaccggatgcacatcaggtcttcgactcggccagcgtgccgggccatgtcaaggacctgctgatcgtcaacagcgagacgctggccgacaaccccgcgttcggcaaggcagtcaccggcgcctggtacgaggtgatggcaatcatggccagcgacacgccgcaaggcgccgagctacgcgcccagctgggcgcagcttccggtaccgaccaggccggctacgaggcgcaactcaagggcacccacatgttctatcagccagccgaagcggtcgccttcatctccggcgaaccggcccacgaagcgatggacagcgtgcgcaagttctccttcgaccacggcctgctgggcgacggtgccgattcggcggactttgtcggtatcgccatgccggccggcgcgctcggtgatcagggcaatctcaagctgcgcttcgacaccacctacatgaagatggccgccgacggcgctctgtga

SEQ ID NO: 10121 - DNA, 471 bp, Pseudomonas aeruginosa
gcttgttcagcagagcgggccgaagcgcggcggcatcggcatcgatggaggcgatcaagccagcgatttcagcgcgcgacagcgagatgcggcacggcaggccggtcagcagcagggattcgccagtggcctcatcgagcaacatcacgcgcaccgtggttggcgagtccacccaaagtcgccgttcaggttgcactggcctgcggtactacacccgatgactgtggcatccatatcgccggcaccaccgatctgggccgcaaagcagatcacgatctgctgactctaccctcaccgtatctgctggaaacagctgtgttgcaaagcagcattcgttgggaaactcagcgcggctgcccgtctaagtgctcgttctgccagcaccgtgagccaggcatacgtctcaagcatcaatggtttgatggccatcggctgatcccggctttcgtgagtgcgtacttgatgagctaa

SEQ ID NO: 10122 - DNA, 213 bp, Pseudomonas aeruginosa
ccaggcgaaaaagttgatgaccgaaatcccttcgtccgcgacctgcccaagaatacggcccatatcgaggtacaagtcgcatggcacggcggcggcctgcggtcgttcactgacaagcagggaaaaagggcaaggaaggaaatggcagatgctctcgccgttgtcgttggtcgtcgtgtgaggccagactccctcctcgcaatccaccagtag

SEQ ID NO: 10123 - DNA, 237 bp, Pseudomonas aeruginosa
actgggcacgcagtagagaccaccatacaggtttcggtgagattagatagctttcattttaccgaggtgagaaacctgacggacggcggccatgagtggaagctagagaaattgcctgaaaacgacacaggcaacacatgttgcctgctctttttccggagtatccgtggcgccgcgaatactacctatagcccgcgcgggttgtcgaagtcaggttggccgttcctggtgggatag

SEQ ID NO: 10124 - DNA, 1848 bp, Pseudomonas aeruginosa
ccgccaccggcgccgaagtcagttcctggtgaagtggttccagtggaaccacccaactcgccaccggcgcggaggtcggttcctggtgaagtggtgccagtggcaccacccagctcgtcgacggcgccgaggcctggtcctggcggagtgttgccagtggcaacacccagctcgccgccggcgctggggtcggtccctggtggggtgattccagtggaaccacccaactcgccgccggcgccgaagtcagttcctggtggagtggttccagtggaaccacccaactcgccgccggcgccgaagtcagttcctagtggagtggttccagtggaaccacccaactcgccaccggcgcggaggtcggttcctggtgaagtggtgccagtggcaccacccagctcgtcgacggcgccgaggcctggtcctggcggagtgttgccagtggcaacacccagctcgccgccggcgctggggtcggtccctggtggggtgattccagtggaaccacccaactcgccgccggcgccgaagtcagttcctggtggagtggttccagtggaaccacccaactcgccgccggcgccgaagtcagttcctagtggagtggttccagtggaaccacccaactcgccaccggcgcggaggtcggttcctggtgaagtggtgccagtggcaccacccagctcgtcgacggcgccgaggcctggtcctggcggagtgttgccagtggcaacacccaactcgtcgacggcgccgaggtcgatccttggcagagtgttgccagtggcaacacccaactcgccgccggcgccgaagtcagttcctggtggagtggttccagtggaaccacccaactcgccgccggcgccgaagtcagttcctagtggagtggttccagtggaaccacccaactcgccaccggcgccgaagtcagttcctggtgaagtggtgccagtggcaccacccaactcgtcgacggcgccgaggtcgatccttggcagagtgttgccagtggcaacacccagctcgccgccggcgctggggtcggtccctggtggggtgattccagtggaatcacccaactcgtcgacggcgccgaggtcgatccttggcagagtgttgccagtggcaacacccagctcgccgccggcgctggggtcggtccctggtggggtgattccagtggaaccacccaactcgccgccggcgccgaagtcagttcctagtggagtggttccagtggaaccacccaactcgccaccggcgccgaagtcagttcctggtgaagtggtgccagtggcaccacccaactcgtcgacggcgccgaggtcgatccttggcagagtgttgccagtggcaacacccagctcgccgccggcgctggggtcggtccctggtggggtgattccagtggaatcacccaactcgtcgacggcgccgaggtcgatccttggcagagtgttgccagtggcaacacccagctcgccgccggcgctggggtcggtccctggtggggtgattccagtggaatcacccaactcctcgacggcgccgaggctggatcctggtgaagtggtgccagtggcaccacccagctcgtcgacggcaccgagttcgatccttggcagagtgttgccagtggcaacacccagttcgccaccggtgccgaggtcaggacctggcagagtgatgcggggccgcatcaccaaaaaacacgacgcccgaccgagactttctcatggctcatcaccccgctcggatggcacgctcgatccgtgcctgggccgaatgaggtccttgagccggctgaggacctcgttccctgtccgggtatcccccttcggctga

SEQ ID NO: 10125 - DNA, 564 bp, Pseudomonas aeruginosa
ggttgcaggaccggtagcgctgaaggcgtgacggtcgctgctagaagggagccggacacatccggtggtaaggttggcgtcgccaaacaaacccacccagaccacaggaggtccggcatgaagaacgaataccgctttggatacgacgagatgcttatccagatccaggcatgcgttcctgactcacaaaagggggacggattgcctatgacgatggccagagcgcaatggataagccaagtctttgtgctgtgtacccttggtaactcactggcacgtgacaaaggctggaggctatggggaatggatgccattgagtatgcgctcatgcgtcgctactcctggccactggaaaccattcgggagatgccaattcgggataggtggctagcactgcatgaagaactggcggatttgcaatgggatgaagaggctcagcaggtatggctagcgaagatcgaaccagtgctgccaggcgcaccggggacggactacgacgtctggcgttcggatgcgccaggatttcaattaccccaagctcctggctatctagtggtccggtaa

SEQ ID NO: 10126 - DNA, 684 bp, Pseudomonas aeruginosa
aggggctcatgcaagagctccctgccaagttggtgcaaggtcggcgaagcgggtctggttggcgatgaaggcggcgcggacggtgccgatcgggccgttgcggtacttgccgatgatgatttcggcaatgcccttggcctcggtgttggggtggtagacctcgtcgcggtacacgaacatgatcacgtccgcgtcctgctcgattgcgccgctctcacgcaggtctgcgttgttcggtcgcttgttcggccggttctccaggctgcgattgagctgggacagggccacgacggggcaatccatttccttggccagtgctttcagcgagcgggagatttccgagatctcggtggctcggttttccaggcctgggcagcgcatcagctgcaggtagtcgaccaggatcagtacggggtggccgtacttcctggctgcacggcgaaccttggcgcgcagctctgtcggcgtcaggttgccctggtcgttgatgaccagtcggctgccatagtcgtttatgcgctggatcgcgacggtcagcctgggccaatcctcttcttgcagttggcccttcatcagcttgccaaggtccaggtggccgagcagggcagcaagcctgaacagcagctgctctgctggcatttccatgctgtaaacctggacagacttctgttggtcgctctgtag

SEQ ID NO: 10127 - DNA, 1140 bp, Pseudomonas aeruginosa
aattccgtctcggtttacggtccctctcaggctgagcatcaacggcgtgtgtctttcggttctttttcgcggcgttcacccatgaccggcaccaagcccaaaacgcccgtagcccgctatttccaccaagaggcgcaacggcgcggctatgtgctggacgcagcccagggcaatgccattcttcatctcgatcgattggcggagcgcttgcgtcgaggtccgtcgctattccggcaagcgccgcgcagcctctacctgtgggggccggtcgggcgcggcaagagctggctgatggatggcttctttcgcagcgccgatttgcagggcctgcgccggacgcatttccatgcgttctttcgccggcttcatgacggcatgttccgccgccaggggcggcccgatgccctgggcggtgcgctcgatgaactgctaggagattgccggctgctttgcttcgacgaattccatgtccacgacattggcgacgcgatgctgataacacgcctgttcagggagctgttccgcaggaagatcaccctggtctgcacctccaactacgcgccgcggcaactgctgcccaatccgctctaccacgaacgcttcctgccggcgatccggttgatcgagacgcgcatggaagtgctggaagtagccggcgcccgggactaccggacgatttcgccgcggcaggagatcgcttccggttatgccagcggcgggtattgctggccagcctcatgcgcttgcctggacgagctgggcttgtccgcgcccgagccctcgcaacgcgtgaccctgcaaagcggcgcgaggacgttgcaggcgcgcgcggtgtgcggcgacctggtgtggttcgccttcgccgacctttgcgaggcgccaaccgcggtgatggactaccttgccctcggcgaacgcttctctacctgggtgctggagggcgtaccgccgatggcgcgctgttcggtcgccgcccagcagcgcttcatcaatctcgtcgacgtcctttacgacaatgaccggcgttttttcctgagtgccgaaaaggcgctgccggacctggtcgagggcagcgacctgcctgcggacatgcagcgtaccgccagtcggctggcgcagttgcgccagcttcgctgttga

SEQ ID NO: 10128 - DNA, 591 bp, Pseudomonas aeruginosa
cgatttcaccagcagcgaggcctgctggtgcgcggcctgggcgcgtggcggcacgttgcgcggttgctctcccggttgcgccggctggggacaggcggcgcagtcgccgaaggcgaagatgtcatcgtcgcgggtggtctgcagggtcgggcggaccaccagttggttgatacggttgctttccaggccgtcgagttccttgaggaaggccggagcccggatgcccgccgcccagaccttgagcgtcgccgggacgaactcgccgtcgccggtccagaggccgtccgtatctaccttgctcaccgcggagccggtcatcacccgtacgccgagcttgctcagggtctggtgtaccggctgactgatacgctcgggcagcgccggcagcacccgcgggccggcttcgaccaggctgatgtgcaggtcttccgggcggatccggtcgagcccataggcggccagcatctgcgcggcgtggtgcagttccgcagccagttcgacgccggtggcgccggcgccgatgatggcgatactcactgcgttgttgttcgcgtcgtgcccggtatgcgcacgcaggtactggccgagtag

SEQ ID NO: 10129 - DNA, 465 bp, Pseudomonas aeruginosa
ttgtcggtggaagcgttcggcctgggcgcgggtatcgaggaaaatgcaatgttccgcagcgccctcggtgccgaagtcgttggtggtgctgccgacagcgatcaccagggtgtcgtaggcgatgtcgcgctcgggaaccaattcaacgccattctcgtccgccagtgcggccaggcggacccgcttgccggcgcgatccaggccctgcatgcggccgagctggaattcgaagtggttccacttcgcctgggcgacgtagttcagctcgtcctcggaggagttgagcgagccggcagcgacttcgtgcagcaggggtttccagatgtgggtgaggttggcgtcgaccagggtgacctgggccttgccgcgtttacccagggtgcggccgagacgggtggcgagctccagcccgccggcgccgccgccgacgatcacgatgcgatgggacatgtggatatctcatag

SEQ ID NO: 10130 - DNA, 1314 bp, Pseudomonas aeruginosa
cctggcgcggcgggtgcgggtggtcgcctgtcagtcccaggccgcgccgtgcctccaccgcctccagttcctggatcggcgcgcggctgccggagcgcacgccgatccacttcacccgcccttcgctcacaggcctaccccggcgtcgaacaggatgctgcggccgaggttggcgcgcaggaattcgggggcgccggagtgagcgaagagcacccgggcaaaggtcggaccgaccatcgacagagagcgccagccttggcgcaggtattcggtgggcggcgggaagggcgtattgaaatcgggcaccgcgcgcttcaggttgacgaaggccagcaggtccagttcgccgtggtcgatgccgcgctcgctatagttgtgcgccttcttgcgcagggttggcgccagccgtgcctgcagctcggcggcggcgatccgttgtggccgctcttcgcggcggatcagttggcgcaggctgacggcctggcggcgacgggtcagttcctcgcgccactcctcgttcagccggcgaccttcatcgaggacgaagaacacctcgaagccggcacccttgaacatgacgtccggcggctgttccccgggggcggcgaagtcctcctggcgatagggcacgttgagggcttcgaggaagcgctggcagacccagcgctcgcggtcccatttacgtgcgttggagaggaagtcgttggcttgttcggcctgacgggtgagcaggcgcagataatccgcttcgttcatgggctcagcttagtctgccggcgggcccgctttccagcccgcaggcgttccggctgcgacaatccgtcccggagcgcgccagcggcgaggctcggtgtacactgccgttccccttgggccggagccgttccgatgcaacttcgcagcgtcatcgccgccgatcacccggcactcttcgcgctatggtcgcgaacgccaggtatccgcctccgtgcggaggacgcctatcccttcttcctcgcctaccttcaacgcaaccccgggctgagcctgctggtcgaaaccgaaggggaggtgatcgcctgcctgatggccgggcatgacggtcgccgtggttacctccagcacctggtggtcgatcccggttatcgagggctggggctggcgcggcggatgctcgacgaggtgttggcacgcctggcgagggaggggatcggcaaatcccatgtcttcgtcctggatgccgccgaggaggcccaggcattctggcgagcccagtcggactgggagcggcgcaaggacatccaggtattttccactcgggagggacacgcgtga

SEQ ID NO: 10131 - DNA, 525 bp, Pseudomonas aeruginosa
gtgcttgttgaggatcaggcgttaggcctatacatatcaatggagaaattcatgaaagctgctcaaaaaggctttaccttgatcgaattgatgatcgtggtcgcgatcatcggtattctggctgccatcgctattccagcgtatcaggactacaccgcacgcgctcagcttagcgaagccatgaccctggccagtggtctcaagacgaaagtgagcgatatcttctctcaggatgggtcctgcccggctaatactgctgccacggcaggcatcgagaaagataccgacatcaacggcaagtatgttgccaaggtaacaactggtggcaccgcagctgcgtctggtggttgcactatcgttgctactatgaaagcctctgatgtggctactcctctgagggggaaaactctgactttgactctaggaaatgctgacaagggttcttacacttgggcctgtacttccaacgcagataacaagtacctgccaaaaacctgccagactgctaccactaccactccgtaa

SEQ ID NO: 10132 - DNA, 948 bp, Pseudomonas aeruginosa
  unsure (261): Identity of nucleotide at the above locations are unknown.
acgacttcgtcgacgacccggcgatcttcgccgagttgctggaggacttcattgccttcaccggcgacgagcgccgccgcagcgagctcctcgagcagcggcacccgcgacgccgaggaaggccgcgccaaggccgaactggctcggcaggacgtggagcaggtgctgaaccagcgactgctcggcaaggtcctgccggaggtggtggtgcgcctgctgcgggatgcctggagcaaggtgatgctgctgatctgcctcaancatggcaaggcttccgccgagtggcgggaggccctggataccatggaccagctgatctggagcgtcggcccgcatgacgatccgctgtcccgccaacagttgctggagcgtgtgcctggcctgctcaaggcgctgcgtgagggattggccagcgcacccttcgatccgttttccaccggagaattcttcagccagctggaaaccctgcatgtccagggtctgcagcgcgacaagcgcggcgaggcggcggtcgcggacagccccctgctcgacgaagcgagcccgggcacggccgcggaaaagccccgggcgccggtcatgctgcgggtggtcgaagaaatcgtcctgacctcgccggacgccgccccggcgcctgttgagagcgaagtgcgcctgccggacaacgacgaggcactgctgcgggtcgatgcgctgcgtgtcggcagttgggtggagatccaggaggacgccgagcacaagctgcgctgcaagctggcggcagtgatccggcccaccggtcgctacatcttcgtcaatcgcaccgggatgaaggtcctggaaaagacccgcatgggcctggcggtggagtttcgccggcaggcggtacgcctgctggacgatgccttgctgttcgaccgggccctggagtcggtgatcggcaacctgcggcgcctcaagggcgcctag

SEQ ID NO: 10133 - DNA, 618 bp, Pseudomonas aeruginosa
tcgtcattccggcgccgctggattagagtgggggctcgttcaggagcccgtatgcatttcgattccgttaccggctgggtccgtggcgtccgccactgcccttcaccgaatttcaacctgcgtccgcaaggggacgcggtgtcgctgctggttatccacaatatcagcctgccgccgggacagttcggcaccggtaaggtccaggcgttcttccagaatcgcctggacccgaacgaacatccctatttcgaggagatccgccacctgacggtttccgcgcatttcctcatcgaacgcgacggcgccatcacccagttcgtctcctgtcacgaccgcgcctggcatgccggggtttcctgcttcgacggtcgcgaggcgtgcaacgacttctcccttggcatcgaactggaggggaccgacacggaaccgtacacggacgcgcagtacactgccctggccgggctgacgcggctgttgcgcgcggccttcccggggatcaccccggaacgcatccagggccactgcgatatcgccccggagcgcaagaccgatcccggcgaggctttcgactggtcgcgctaccgcgccggattgaccgattccaaggaggaaacatga

SEQ ID NO: 10134 - DNA, 1218 bp, Pseudomonas aeruginosa
acgttcagcttcacccctacgaatccatgtgttttgccattgggagtcccaaccatgtccatcaaggtcgaggattatttcgcccctgaaaccttccagcgcatgaaggccttcgccgacaagcaggaaaccccctttgtagtcatcgacaagcagaccatcgccgatgcctacgaccaactgaccgactgcttccccttcgccaggatctactacgcggtgaaggccaatcccgctaccgaaatcaccgagctgctgcgcgacaagggttcgaacttcgatatcgcctcgatctacgaactggacaaggtgatgaagaccggcgtcggtccggagcgcatcagctacggcaacaccatcaagaaatccaaggacatccgctacttctacgagaagggcgtgcgcctgttcgccaccgactccgaagccgacctgcgcaacatcgccaaggccgctcccggcgccaaggtctacgtgcgtattctcaccgagggctcgactaccgcagactggccgttgtcgcgcaagttcggctgccagaccgacatggccatggacctgctgatcctggcccgccagctgggcctggagccctacggcatttccttccacgtcggttcgcagcagcgcgacatctcggtgtgggacgcggcgatcgccaaggtcaaggtgatcttcgagcgcctgaaggaagaagacggtatcgtcctgaagatgatcaacatgggcggcggcttcccggccaactacatcaccaagaccaacgacctggaaacctatgcggaggagatcatccgcttcctcaaggaggacttcggcgacgacctgccggaaatcatcctcgagccgggccgttcgctgatcgccaatgccggcatcctggtcagcgaagtggtgctggtcgcccgcaagtcgcggaccgccgtggagcgctgggtctatgccgacgtcggcaagttctccggactgatcgaaaccatggacgagtcgatcaagttcccgatctggaccgagaagcagggcgagatggaagaggtggtgatcgccggcccgacctgcgacagcgccgacatcatgtacgagcactacaagtatggcctgccgctgaacctggcgagcggcgaccgcctttactggctgtctaccggcgcctacaccaccagctacagtgcggtggagttcaacggcttcccgccgctgaaggcgttctacctctag

SEQ ID NO: 10135 - DNA, 873 bp, Pseudomonas aeruginosa
ttgataacaattctgatctgcaataaattccgcgaccttcacagctcccggggaggggtttcgaatgtcgcgtcagtccacggataccgccgtttcttcgcaacgtctgctggcttcggccatcggtgtggccatcaccgccatcgccgcaccgcaggcagcccacgccgacgaggccgggcagaaaaagaccgacaaggaccgagtactgtcgctggatgcggccaccatcgtcggcgagcagcaggacgaaaccacctacaacgtcgaccgctcggcgtcgaagaagtacaccgcgccgctgctggatacgccgaagaccgtcaccgtgatcccgcagcaggtgatcaaggacactggcgccctgaccctggccgacgcactgcgcaccaccccgggtatcaccttcggcgcgggcgagggcggcaaccccgcaggcgaccggccattcatccgtggcttcaacgccgagagcgatacgttcctcgacggtatgcgcgacgtcgcctcgcaaacccgcgaggtgttcaacgtcgagcagatcgaggtcagcaagggcccgggctcggcctacaccggcgccggctccaccggtggcagcctgaacctgatcagcaagaccgccaagcaggacaacttcaccgacgccggcttcacctggggctcagaccagactcgccgcactactctcgacgtgaaccggatgattggcgacaacgccgccttccgcctcaacctgatgaagcacgatgcccacgtcgcagggcgcgacgaagtcagcgtcagccgctggggcgtggctccgaccgttaccttcgggttcgacacgccgacccgcgccaccctgtcctattaccatctcagcaccgatga

SEQ ID NO: 10136 - DNA, 2655 bp, Pseudomonas aeruginosa
ttatcaaatagaattgcccgccgacgtcctcgtgtcgtctggccggcgcttggcgtcggcgtagtcccgttgttgccgcgcggcggccgtgaaggtgatcctgtgaagaaagtctggttccagttgcattggttcttcggtatcagcgccggcctggtgctggcgctgatgggcgtcaccggagcgaccctgtcgttccaggacgagctgatgcgcgcgctcaaccctgacgtgctggtggtgcagaagcgccccgagggcgtgctgccgctggacgaactggtgcgccgtatcgaaggcgccgagccggggcggaaagtggccttcgtctgggtcgagatggacagcgacaaggccgggcggatcttctacaccccgccgccgggacagcgccgcggcgagtcgcgctggatcgatccctacaccggggctttcgtcggcgagccgcgcggcgagggtttcttcaacctaatgatgcaactgcaccggttcctcgccatgggcgagtacggcaagcaggtcaccgccgcctgcaccctgatcctgatcttcttctgcctgtccggtctctacctgcgctggccgcgcaaggttttcgactggcgcgcctggctgaccctcgactggtcgcgcaaggggcgcagtttcaactgggacctgcatgccgtggccggcacctggtgcctggcgctctacctgctggctgcgctgaccggcctgtactggtcctacgagtggtaccgcaacggcctgttcaaactgctcgacgacgcgcccgccggccagcaggcgcagcgcggcaagccgggcggacgtggcgagcgcccggccgatgcggctccgctggtggtcgactacgcggcggtatggaacagcatccgccaggccggcggcgaccgcttgcaggcctacaacctgcgcctgccgccggcgggcggccagccggcgacagtgttctatcgcctgaccgacgcgccgcacgagcgtgccttcaacaccctgaccctggacccggccaacggccaggtgaaaagcgaccaacgctatagcgaccgttctttcggcagccagttgctggccagcgtctatgcattgcacgtaggcagctatttcggcatggccggacgcatcctgatgatgctcgccagcctggcgatgccgctgttcttcatcaccggctggctgctctacctcgaccgccggcgcaagaaacgcgcagtacgggcgagccgcgccgacctgggcagcagcgccggcgccagcggcgagccctggctgatcggctacgccagccagagcggttttgccgagcaactggcctggcagagcgccggccagttgcaggcggccgggttgccggtgcgggtcgaatcgctggcgcgcctggatgccgggcaactcgccgaggcgcgcaaggcgctgttcgtggtcagcaccttcggcgacggtgaggcgccggacagcgcccgcggcttcgaacgcaaggtgcttggccaggccgccagcctcgatggcctgagctacgccctgctggccttgggagatcgccagtacgagcagttctgcggcttcgcccggcgcatgcagggctggttgcaggggcagggcgcgcggagcctgttcgccccggtggaggtcgatgatggcgacgccgcggccctgcgccaatggcaggaaagcctggccgaggtgaccggcggtgccgccccggcggcctgggaagcgccggccttcgaggtctggtcgctggcgcggcgggagtgcctgaatcctggcagccagggcgagtcgacctggctgctggacctgcgtgcgccggccgacagcgccatccaatggcgcgccggcgatctgctggagatcgttccgcaccaggcgcccgcgcgcatccgcgaatggctgcagcggcatcacctggacggccaggtgcgggtggcggtcgagggcgtcgagcagagcctggagcaggccctggccgggcgcctgctgccggattctttcgaacacctggtcggcttgcacccgcaggcgctgctggatgcgctgattccgctttccgtgcgccagtactccatcgcgtcgctgcagagcgatggcgacctgcaactgatcgtacgccaggagcagcatgccgacggcagcctgggcatctgctccggctggctcaccgagtacctgccgctcggcgccgcgctgaccctgcgcctgcgccgcaacgcgggtttccacctgccggaggatgacgtgccgctgattctcatcggcaacggtaccgggctcgccggcctgcgcagcctgttgcgcgccagcattgccgccgggcgcaagcgcaactggctgctgttcggcgaacgcaatttcgcccacgactactactgtcgtgcggagctggagcaagccctggccaggggcgagctgcaacgcctggacctggccttctcccgcgaccaggcggagaagatctatgtccaggaccgcctgcatgaagcggcggatgaactgcggcgctggatcgacgagggcgcggccttgtacgtctgcggcagcctgcagggcatggccggtggtgtcgaccgggtactgcgcgaagtgctcggtgaggaggccttgcaacgcctggccgacgaaggacgttaccgacgcgacgtgtactga

SEQ ID NO: 10137 - DNA, 1023 bp, Pseudomonas aeruginosa
cgccgttggcgtcatgcgccccacggagctagcggagccttgcgtcgccgggcctcagatccacaggatgaaagccagtaccagggcgaagaagccccatttctgcaggtagtagagcttgcggttgcgcttcttcaaacgtttgccctgcaggcggatcttgtagaggctgtcgaagatccgattgagtccgccggtccggtcgcctgcgttgttcggggcggccgcggcagccatcacgttgcggctgaaccagcggttgaaggcggtggcccagccctgggtcagcggccgctcgatgtcgcagaagagaatgatgcggttgtgttcggtggcgttttccgcgtagtggatgaaggtttcatcgaacaccaccgcctcgccgtcgcgccagtggtagcgctcgccgtccacctcgatgaagcaggccgggtcgttgggggtgaacagtcccaggtggaagcgcagcgagccggcgtagggatcgcggtgtcgcaccagcttcgagcccggcggcagttcggcgaacatcgccgccttgaccgagggaatctgccgcaacagggcggtggtctgcgggcagagttgtccggcggagggatgggcctcgtcgtaccatttcaggtagaagcgcttccagccgctcttgaagaacgagttgaaaccgatatcgtcgtactgttcggaacgcttgatgttgccggcgtcgtgcaggtgcagcgcctcgctgcggatggcttgccagttgtcgaccagaacctgcagttcggggaaggtctgcggtgccaggtaagggcggttcggtaccttcgagaacaggtacatcaggcagttgatcggagcgaggaagctggagtggtcgctcaattggcgcgacagcttgtggcgtacccggccgcggaaatggacatagaggatgctcagcgcataggccgccaggatgagaactttcatgaatgcaaggtcgtcggtgcaaaagaggagaatttactcctgttctcagtgcctgagtatgctacctga

SEQ ID NO: 10138 - DNA, 780 bp, Pseudomonas aeruginosa
tcctggcctcgaaaggaacgcacaatgaacgacaccggccggcgtatcctgctcaactgcgacatgggcgaaagctttggcgcctggcgcatgggcgacgatgtccacagcatgccgctggttgaccaggccaacctggcttgcggcttccacgctggcgatccgctcaccatgcggcgcgcggtggagctggcggtacgccatggcgtgagcatcggcgcgcacccggcctatcccgacctgagcggcttcggccggcgctcgctggcctgctctgccgaagaggtgcatgccatggtgctgtaccagatcggtgcgctggacgctttctgccgttccctcggtgcccaggtggcctatgtcaagccgcatggcgcgctgtacaacgacctggtcggcgatgatgagctgctgcgcgccgtgctcgacgcctgcgccgcctatcgcaagggcctgccgctgatggtgctggccctggccgacaacggccgcgagctggaactggccgacgaggccgacgtgccgctgctgttcgaggccttcgccgatcgcgcctacctgccggacggtcggctggcgccgcggcggcttggcggcgcggtgcatcacgatccgcagcggatcatcgaacaggccctggccatcgcccgcggcgaagccttccccgactacgacggcaacccgctgcgcctgaccgccgacagtctttgcgtgcatggcgacaacccgcagtcgctggcggtcctccggcgcctgcgcgcggccctggacagcctgtga

SEQ ID NO: 10139 - DNA, 405 bp, Pseudomonas aeruginosa
ggctggcgctgctgcgccagctctgaagggctgcggggcggcgagcgccccgtggcgctcagccgaggaattgctcggcgtggtggcaggccacctggcgctggtcgagcaggcgcagctcgggcacctcgctgcggcagcgctcggtggcgtaggggcagcgcttgtggaaggcgcaaccctccggcgggttcagcgggttcggcagttcgccctggatgcggatcttcggcttcgtcgggtccgggtggatcgccggggtcgccgagagcagcgcacgggtatagggatgcagcgggttctcgtagagcttgtccgccggccccatctccgccggtcggccgaggtacatcaccaggacgtcgtcggcgacgtggcggaccaccgccaggttgtgcgagatga

SEQ ID NO: 10140 - DNA, 477 bp, Pseudomonas aeruginosa
gccagcggtatccatggggcctgttcgtggaataccacctgggcctgctcgtacagtttcgcccgctcggccggatcgctcacctcgcgggccttgcgcatcagcgcctcgaagtccttgtcgcaccagcgcgcctggttttcacccgactcggcggcggcgcagctcaggttcgggctgaggaagttgtccgggtcgccgttgtcgccggcccagccaagcagcgacaggtcgtgctcgccggccttcgaacgcttgagcagctcgccccattccagggaacgaatggtcagctggatgccggccttggccaggtctgcctgcagcatctgtgccgccagggcggggttggggatggtaggcgaggtgccgttgcgaatgaacagggtgatcctgagattttccgcgccggcttccttgagcagcgccctggcgcgttcgggatcgtgcggccagtcctggatcgaatggttgtag

SEQ ID NO: 10141 - DNA, 2007 bp, Pseudomonas aeruginosa
ctcagtccgtcggcgctgacgtcccagcgctcggccagccccgggatcacctcggtggtgccggggcggaaggcgagcaggcggttgaacacggtttccgcggaggcgtcggcggtcaccgcgccggtgtactggacgatgtcgaagcgttccgggctggcctcggtgcagaccaccaggttcttcgcctgggccgcgccggcggcgcatagcgccagggccaggggcaggtgtcggagcaacggatggagcatggggtcctcctcgtgggccccgtcgccggggccgccggttgtcgcaggtttacagcaggttgaaggggaaggtgctgaccaggcgcagttcgttgacgctgccgtcgacctggttctggctggccttgtgcatcatgtaggtgagcttgaaggtgctgtccttgatcggcccgttctgcaccttgtaggccgccatcaggcccagctcgtggtgcttctcgccgtcctgggcgcgcacctcggcgtagttgccgtaggcaccgttgcgatcgccgtcgtagtgggtgccgtcgatgtcccagcccttcacgtaccacacgccggtgctcaggccggggaccccgtagtagctccagtcggtctcgtagcggatctgcgcggacttctcgttggggctgttgtagtcggccagcatcgagttggccaggaagatcgccgaggtctcgtgcacgtagtcgaagtattcgttgccgtcgacctgctggtaggccagggtcagggcgtgggcgcgatggccgagagtgaaggccaggctccaggtgtcgttgtcgatgtagccggcctcgcgcgcgccggtgtcgccggtgtggtagccgttgaaggcggtgcgcagggcgatgccgttctcgaggtcgccgatgtcgtgggtcacgcccaggtagtactggttccagacgtcctggaaatgcgagccatagagggagatttccagcccgtcgagcggcttgtagttgccgcccaggtagttcaggcggtcgcccttgacctggcgggtgccgtactcggtggtcatgtcctcgtcgccggaaccggtccgcgggctgaccttgcggaagctgccggcctgcaggctgaggttgtccagctcctcgctggtcacggcgaagccggtgaagctggagggcagggcacggttgtcgatatagctgaacactggagtgttgaccaggaagcgaccggccttgaattcggtattcgaggcgcgcaggcggatgttggcgacgcccagcttggaccactcgccgatcgcctcgccatcgctgttcgccagggtccggttgccgccgccgccgatgcggcccttgccgcgctccagggcgatctcgttgaaggctgcgacgtcgaagccgaagccgatgctgccctgggtgtagcccgagctgtacttgagcaccgtgccctggacccaggcgttgcgctggtggatgcgctgggagccgccgccggccttgggaatgcggaaggtgaagctgtccttcatgttttcccgcgagtagaagttgcgggtggtcagggtcaggctctgcccctcgaacagcccgctggcgccggcctggcccttgatcggtttctccacgctggggatgctctgcacctgggcggcgtagctgggattgtccggggtcggcggggttgcctgctcgtccgctgcccagcctggcgcggccgatgccatcaaggccaatcccagcgtcgcgccggtcactcgttggtatctcatcacctgattgctccctttattgttgtcatggcacctgttttacccaccaggtttgcgccggtttcgcccgcgcctgggcgcggcggtcgaatacggcgaggcgagcgctcctggcggaacgcgcgcagcgccgttctggaacacgggcaggaaaagcaaagaaatgaagtacgggtcgtgccgttcttctgcaccccggtcgtttcacgaccggggtggcgtcggcatcagggctggttggctacgccatag

SEQ ID NO: 10142 - DNA, 1251 bp, Pseudomonas aeruginosa
atttcagcccggtccagacgaggagaacaacaaatgaccgtgggtgttggcgggagtacccctgcgcaggcgctggagcgtctgcggaacatgatggacggcgcgcagccgatcggcctggcgtcttaccgtgcgcgaatcgccgcggcccaggcgtggatgggcgagcatggcatcgccgcggcgtacctgcatgcaggcagcaacctgcgttacttcagcggcgtgcaatggcaccccagtgaacgcctggtgggtgctctactgcccgccgagggcgccctcgaataccttgcgccggccttcgaggaaggtacggtgcgcgacttccaggtggtcgatggcgccatccacacctgggaggaacaccaggatccctatcgcctgctgctcgatcgcctggaggcgctcggcgtgggcgagcgcagcacggtcgcactgtgtccgagcctgccgttcggcatgttcgagcgcttgcgccaacaggcgccgggcaggaacttcgtcagcgccgcgccgctgatcgaccagggacggatgcgcaagtcggccgaggagctggcgctgatgcagcgggccaaggacatgaccctggaagtgcagaaggccgcggcgagcattctccgcgaaggcatcagcaccaccgaagtcgccgagttcatccaccaggcgcaccgcaaggtgggcgcgcccggttcgaccttctgcatcgtcctgttcggtgccgccagtgccttcccccatggggtgaagcatgcgcaggtgctgaaggatggcgacatggtgctgatcgataccggctgccaggtccacggctaccagtcggatatcacccgcagctatgtgttcggcacgcccagcgcacgccagcgcgaattctgggggatggagcgcgacgcccaactggcggccttcgaggccgcgcgtctgggccggccctgcgaggcggtggacgccgccgcgcggcgttcgctggaggccaacggcctgggaccggactaccgcctgcctggcctgccgcaccgcaccgggcatggcatcggcatggacgtccacgaaggcccgtacctggtgcgtggcgatcgcacgccgctggatgtcggcatgtgcttcagcaacgaaccgatgatctgcgtgcccggcgagttcggcattcgcctggaggatcacttctacatgacgaaggaaggaccgcgctggttcacccaaccgagcccgtccatcgacgatcccttcggcctcggcggctga

SEQ ID NO: 10143 - DNA, 1272 bp, Pseudomonas aeruginosa
gtcactttgccgcagagttgccgacagcgtcttggctatactcgcgcttattccggaagaaaacatgcgcgcaccggttttcctgctctccgccagtcgccagaaccttggccgtctgctcctcatccgtattctcgtgctggccgcgcaggccggctcggtgggtttcgcctggctctccgacctgttgccgctgccgtggctggcgctcggcctgacccttggcctgtccgcctgcctgattctgttcaccgcgctgcgcctgcgcgcgccgtggccggtgaccgaccaggagtacgcggtacaactggcctgcgacctgatcatccacagcaccttgctgtattactcgggcggctcgaccaaccccttcgtctcctattacctggtaccgctgaccatcgccgctgcgaccctgccctggatctactccatggtgctctccggcctggccctgaccggctacaccctgctgctgatctggtaccacccgctgcacctgcaggcggttcagcacgaggcgatgctgatcaacctgcacctgttcggcatgtggctgaacttcgccctgtcggcggccttcatcaccttcttcgtggtgaagatgtccgaggcgctgcgctggcaggcgcacatgcaggccgagcggcgcgaggaaagcatgcgcgaccagcagttgctcgcggtggccacccaggcggccggtgccgcgcacgaactgggtacgccgctggcgaccatgagcgtgctgctcaacgagctgcgccaggagcgcccgcaggacccgaccctgcaggaagacctggcattgctccaggaacaggtcaagcagtgcaagcacaccctccagcaactggtacgggcggccgaggccgaccgtcgtcaggcgatcgaggagcaaagcgccgcggaatggctggaatcggtgctgcgccgctggcacctgatgcgtccggaggcttcctaccgctaccagtgcctgggcctcggctccgcgccgcgcctgaccccgccgaccgacctcagccaggctctgctgaacctgctgaacaatgcggcggacgcctgtcccgacgacctcgacatccgcctggactgggacagcagcagtatctgcctgagtatccgcgaccacggcgtcggggtgcccctggcgatcgccgaacagatcggcaaaccgttcttcaccaccaagggcaagggcttcggcctcggcctgtttctcagtcaggccagcgtgacccgcgctggtggaacggtgaagttgtataa

SEQ ID NO: 10144 - DNA, 864 bp, Pseudomonas aeruginosa
atcgcacgaccagggattgatcatgcgtatcttcggttcgagtgccggctgcctgtcggtgctgttcggactggccttcgggctgcctgcactagccgagccttcggtggacctggatggtccgacggcaggctggcgctattccggcctgctcgagcagcccgatgccccgcgtgtcgcctatccgactccgcccatcgatcgcggcggccagcgcggccgcagcctgatcgaaggacacctgcgcgaactggtcggcaccgagcgcgcccagcgcctggtggtcaacggcaatcctctccctctctataccgacggcgccgggcgcttcgtccgcccctatgcgttcggccacggctccaacggcgtccaggtcggcagcgccgacggcaagatcctcaagcgcgtacagttctacgaggccaatcgctcccaactgccgccgcgcgtgcgcgtggtgctgggttgggacgatccgaaggccgagctcgacctgcatatcgtcacccccgatggccagcacgcctactgggcgcatccgcgcctgagcaacagcggcggcctcgatccggacggcgtcgacgggcccggcccggagatgttcaccatgggcgcgccgctgcacggcacctacctgatctacgtgaactactggggcaacctcaacaaccagggctacaacttccaggccggcagcaacgtacaggacgtgatcaccgcgcaggtcaacctggtgttcaacgaaaacagcgtcgacgagaagcacgagaccttcgtcgtgcccctgcgcaccatcggcgacctggtgctggtcaagacctttacctactgaagcatcccctcgtacggatgacacgggattag

SEQ ID NO: 10145 - DNA, 1776 bp, Pseudomonas aeruginosa
cgaaccatgagcgagaacaacacccccagccctgccaacggaacccctgcgcccgccgctgcgcgcacccgaagcgccctgtggccggtgctggggatcgtcgccgcgctggccgccggcggtgtgctggcctggcagatgggctggctggagcggctcggcggagggcgcccggccgaagaggacctcggccagccgatcggcgcccaggcacccgcggacgccgacgcgccacgtgcctaccgtgacctgcgcaagcccgacgcgctgatcgagagcgtgtcgctgagccgcctgccgaaggaaatcctcgaggtgccgttgctgcgcgataccctgaccgaggacttcgtcttctattacgagaacaatggcgaccgcctcggcctgaccggtacgttgcggcggatcatctacgagcacgacctgaccctgaaggacagcctggtcgaggaactgctcgaccaaccggcccaggtcgccctctggcgcggcgccgacggccgcctgcgcgacttcgtggtggtgctcaagcgcggcggcctggcgcgggtgctcgagccgctggcccatatcgccgccgacgaccagcagttgcgcaaggtcggcgagttggcgggaacctcggtctatcgcctgcgctacggcaacgacaaggcgatgctgttcctgtccaagggcgaccggctgttgttgctgtcgaacccacggatgctcttcgacgatggtggcgaaagcgacgacagcccgctgaacgctccggccagcgaagacctggaggcactgctcgacggcgacgaactgttccccgagcgcttcggcctgccgggccgcggcgagctgcgccagcgcatcaccctcaatgccagcgtcctggccatgggctaccagcgcttcatcccgagcttcgccggggtgcgcttcgagaagggcgagcagggctggagcagctacctggcgctgaacgaggtggaacgccagccgccgctggacttcgccccggtctggcaggccatgccgatgggcgccagcgcctgcgtggcgctgccggtcacccctggcctgtacggggtgatgctggagcgtctgggggccgagcagaagatggcccaggccttctccgagcatctcagcggcgctgccggtctctgctggtacgccagttcgcggctgcattcgccgctgctggtgggccagttgagcgcgccggccagtgccgaactcgacgacgagctgggcaagctgttcggtcgcgtgatcggcgcgaaggaagccaaggtcgagggtggcagcttcccggtggaagaccgggtggatggccagacccgccgctggacccgccaggtcagctcgaacttcggcgcctatccggccagccaggcggacaacccggagagcatcagcggccgcgcgttcttccgcatcggcatggcgcgccatggccagaccctgctgttctccctcgacgaccagttgctcggcaaggccctggacaccctcgacaaacgctatccgccgctcgccgaggtgttgccgaaggatgcgctggtaccggcctacctggcgccgcagccgctctccgaactgctgcaacgggaaaccctcgacagcctgccgcaggacatggagccggtattccgcaatgccgccgacacctacctgatgccgcgcctgaaaaccctcgccggcaagggcagctacgccctcgggctgcctgccggaagccaggccaacgcaccgtggcaatggctgccgctggaatggcggtcgctgtga

SEQ ID NO: 10146 - DNA, 2331 bp, Pseudomonas aeruginosa
cctggcggtcgccgccctggtcctgctgccgttcgccgccgtccaggcggaagacacggtggaaccgagcggctacacgccgatggccggcgaatccttcttcctgctcgccgacagcagcttcgccaccgacgaggaagcgcgggtccgtctcgaagcgcccggccgcgactaccggcgctaccgcatggagccctatggcggggtcgacgtgcgcctgtaccggatcgaacagccgctggagttcctcaagcggcagaagaacctgcaccgggtcctggccgagggacagttcaagggcgaaggcctgtcgaacaccctggcctatctctgggacaactggtatcgcaagtcgcgccgggtgatgcagcgcgccttctcctacgagtcgcggcaacaggtcaccgaggcggtgcccgagctgaagatgggcaacgccatgaccgcgccgacgccctacgacgcgcagccgcaatacgcgccgattcccggcctgccgctggtcagccagttccgctatccgctgtgggacgccaagcccatcgagccgccgcaggacgtcaagctggccggttcctccagcgagttcatcaacgtcgtgccgggcaatgtctacatcccgctgggcaagctgaagccgggcctgtacctggtcgaggcgcttgtcggcaagtaccgcgccaccaccgtggtgttcgtctccaacagcgtggcggtgagcaaggtcgccggcgacgagctgctggtctggaccgcacgcaagcacgaaggcaccccggtgcccgacaccaaggtgctgtggaccgacggcctgggcgtgatgagcagcggcaataccgacgccgacggcctgctgcggctcaagcacgccagtccggagcgctcctacgtgatcggcgaggaccgcgagggcggggtcttcgtctccgagaacttctattacgacagcgagatctacgacaccaagatctacgccttcaccgaccgcccgctgtaccggccgggcgactgggtctcgttgaagatggtcggccgcgagttcaaggacgcccggcaatcccaggccgccgccagcgcgccggtgcgcctgagcgtgatcgacgccagcggcacggtattgcaaagcctggacctccgcttcgacgcgaagagcggcgccaatggccgcttccaactgccggagaacgccgtcgccggcggctacgagttgcgcttcgactaccgcgggcagacctacagcagcgccttccgcgtcgccgaatacatcaagccgcacttcgaagtcgccctcgacctggccaagccggacttcaagaccgccgagccggtgaagggcgagatcgtcctgctctatccggacggcaagccggtggccaacgcgcgcctgcaactgagcctgcgcgcccagcagttgtcgatggtggacaacgaactgcagtatctcggccagttcccggtggaactgagcagcaccgaactgaccacagacggcaagggccgcgccgccatcgaattgccgccggccgagaaacccagtcgctacatgctgaccatcttcgccagcgacggcgccgcctaccgggtcaagaccagcaaggagatcctcatcgagcgcggcgccgcgcgctaccgcctgagcgcgccgcagcgcttcagcgccgccggcgagaaggtcgagttcagctatgccagcgaacagccgaccccgctcaagccgagcagctaccagtggatccgcctggaggaccgcgccaccgacagcggtccggtcgccgacggccgcttcgcgctgaccttcgagcgccccggtacctattccgtggagctgcgcgacgacaagggccagctccttggcgccaccggccactcggtgagcggcgagggcgtgaagtcggtgccgggcaccgtcgaggtggtgttcgacaagcccgagtaccgcaccggcgaggaagcctccgcactgatcaccttccccgagccggtggaggatgcgctgttgtccctggagcgcgacaaggtcgaggccaccgccctgctgtccaagggcgccgactggctgcgcctggaaaaactcaatccgacccagtaccgcgtgtggatcccggtgcgcgaggagttctcaccgaacctgaccttctcggtgctctacaccaagggcggcgactacagcttccagaacgccgggatcaaggtcggcatgccccaggtagagatcgacatcgccaccgacaaggagcgctacgaaccgggcgagacggtgaccgtgaccctggccacgcgcttcgccggcaaaccggtttccagccacctgaccgtcagcgtggtggatga

SEQ ID NO: 10147 - DNA, 1410 bp, Pseudomonas aeruginosa
tctgctggagtatccctacggcggcgtcgagcagaccgccagccaactgctgccgctgagcatcgcctatccggcgctggccggcggcgagccgcggattcgcgaccgcctgcgcctgatcatgcagaacagtcgcctgcgcctggtgcagatggccggcccggacgcctggttcgcctggtggggtggcgacgtcgatggcgacgctttcctcaccgcctacgcctactacgccgactggtacgccagccgcgcactggagatccaactgccggccgaacactggcagcgcatcctcgagccctacgccaagcaggcgacgcagaccccgctgctgcagcgtgcgctgatcctggctttcgcccgcgacatgcagttgccggtgaacaccctgctcggcggcctgctcaacgatctggccaacgccggcaaagggcagggcgcgcgcggaccccgctggaggccgacgacggcctggtgctgggcgacccggactcggccgtcggcctggccgcggcgcgagtgctggcggtggaccttgcacggcaactgcgggtcgcggtgcccgcgccgctggccgcccaggccgagacggcgacgcagcgcctgcgtgaggccggcttgccgttcaccgatgccttgctggcctctcgctcggccgtggatggccagcaggccagcgctctgctgcaacgcctggcgccggcgcaatcgaccctggaacgcgccctggccctgacctggctgcagggcgcgttggcccaggcgccgcagggcaagctgccgcagccgccgaaggactggcaggcgcagcgcggcgccagcggcgaaacctactggcaatggcgcggccgcggcattccgagctgggtcgacctggacgaggcgccggcccggccgttgccggttgcgctcagctaccgcagcgcccaggcgccgagcgggcaactgccggtgcagatcagccgtcgtctgctgcgcctggtgcccggcgagggagcgttcgagttcaaggtcgaggaggtcggcgacaagccgctttccagcgacgaactgtatctcgacgaagtgaccctgaacgttccggaagacaccgctctacgctacggcatgctggaactgccgctgccgcccggcgcggatgtcgagcgcaccacctggggcatcaagatcagcggcctggccggcgacgaagcgaccaccctggagcgcgcgcgcaacgaaccgggcgagttgttctacggggtgccggtggacagcctgagtggcgagcagcgtttccgtcacctggtgcgtttctcccagaaaggcagcttcaacctgccaccggcccgctacctgcgtctctacgcgccggaacagcaggccctggaagccaagccggcgctggccaaggtcaaggtcgagtga

SEQ ID NO: 10148 - DNA, 1119 bp, Pseudomonas aeruginosa
gccgctgggacaacccggtggccgcctgccagccgttgccggctgccgaagactggctgcgcaagcagcgccggcagtggcgcgagcgtctcgaccgagagcccggctacgaggagattccgagtttttccgtgtgccgcctggcttccgggcggccctatgtcgatcgcgagcgcgaacgcatcttcgtccgcggcctgtattccctacaggaacgcttggacctcacccacgaatacctgcacctggccttccgcgcccatcccagcggccaggacgaaaactatatcgaaagcctggcccggcgcctgctactggaatgactccatgaaccgaatgtcccttgccgccctgctcagttgccttcccctcgtcgcctgggcggacaaccccgtgaaactggatacgccggtctccggctggcgtgccggcgacggttccgccgccaattaccggcaggtggtgaactacccggcgtcctcggtcaacgtcgccgccgaccaggcgaccaccgcgcgcattcgcggcgcgatcgagagccagcccaaggaccgcccggcgacgctggtggtgaacggtgtgagcatgccactgaaggtggacgccgatggcagcttcgaccgcccgttcgccttcccgtccggcagcaacagcgtcgaggtgcgcaacgccgccgggcagtcgcgacgggtccagttctatcacggtggcggcggcggggaagtgccggccaagctgcgcgtgctgctgtcctgggacagtgacaacaccgacctcgacctgcacctggtgaccccggacggcgaccatgtctggtatggcaatcgttcgctggccaacggcgcgaccctggatgtcgacgtcaccaccggctacggcccggaaatcatcgccacgccgacgccgcagaaggggccctacctggtctacgtcaactacttcggcggtggctacggcagcagcgaggatggcgccgaacaggccgcccaggacctgaccacggcgcgcatcaccctggtcaccgaagagggcacgccgaacgagaaacaggaaaccttcctggtgccgatgcgcaagcctggcgagctgacgctggtgaaacgcttcagttatccgtag

SEQ ID NO: 10149 - DNA, 693 bp, Pseudomonas aeruginosa
tacaacgtgcaggcagcggtcgatgcgaagcaccacttgatcgtgacgtacgaggtcacgaacgacggagtcgatcgagaccagctgagcgccatggccaagcaggcgcgagaggccatgggtgtcgaggaactctcggcggtcgcagacagagggtatttcaaaggcgaagaaatcctcgcctgtcatgaggctggaatcactgttttcgtgcccaaaacgctgacctcgggcgcgacagcggcgggccgcttcggcaaaggtgatttcatctatgacgcagcaaagaacgagtaccgatgccctgctgggcaaagcctgatctggcgtttctctagcgtcgagaaagggctaaagctgcaccgttactggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagatctggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 10150 - DNA, 1650 bp, Pseudomonas aeruginosa
tcgccatcgcttgctgcgtttttacacggtctggacgaactgcagaccgccagctatggcggggacctggaagtgcgggtgaccgaagccagcggggaagtccgcagtttcatcgtgccgttcgccaccaccgtgcaactgctgcgccccggaaccacgcgctacagcctgacggccgggcggctcaacgatcccagcctggagcgtcggccgaacatgctgcagggcgtctaccagcgcggcctgggcaacgacgtcaccgcatacgcgggcggggccttcaccggcagctacatgtccgggttgatgggcgcggcgctgaacacgccggtgggcggattctccggtgacgtgacgctggcgcgtaccgaggttcccggcgacgaccgccttagcggctccagctaccgtctcgcctacagcaagaacctgccgaacaccggcaccaacttttcgctgctcgcctatcgttactccaccggtggctatctcggcctgcgcgacgcggccttcatgcaggaccgggtagagcgaggcgagccgctggagtcgttctcgcgcttgcgcaaccgtctcgacgccaacatcagccagcaactgggcaacggcggcaacctgtacctgaacggctcctcgcagcgctactggagcggcggcgggcgggcggtcaacttctccgtcggctacagcaaccagtggcgcgacgtcagttactccatttccgcgcaacgcctgcgcagccactacgaaggcttttccagcggtgacaagcgcggcgagaccagcacgctgttcagcctgaacctgtccattccgctgggcggcgcgggacgcgggtcgccgaccctgagcagctacctgacccgcgacagcaacagcggaacccagctcaccagcggggtttccggcatgctgggcaagcgtggcgaggcctcctactcgctgtcggcctcccatgaccgcgacagccggcagacctcgaagagcgccagcctcgactatcgactgccgcaggtcgaactcggctccagcctctcgcagggaccgggctatcggcagttgtcggtcaaggccgcggggggcctggtcgcgcacagcggcgggatcaccgcggcacaaaccctgggcgagacgatcggcctggtccacgcgccaaacgccaggggcgcggctgccggctactcgggaagccggatcgaccgccacggctatgcggtgattcccaacctgctgccctaccagttgaacagcgtcgacctcgaccccaacggcatggccgacgagatcgaactgaggtccagttcgcgcaacgtggcgcccaccgccggagcggtggtgcgcctcgactatccgacgcgggtggcaaggcccttgctggtggatagccggatgcccagcggcgagcccctgccgttcgccgcggaagtgcttgatgcccacagcgggcagtcggtgggcgccgtcggccagggcagccgcctggtgctgcgggtcgagcaggatcgcggctcggttcgggtgcgctggggcaacgagccgcagcagcagtgcctggtcgactatgcgctgggcccgcgcgagacgacgcctcccgtcctgcaactggcatgtcgcccggcgtcggccgccgaccgggagcgcacgctgtga

SEQ ID NO: 10151 - DNA, 426 bp, Pseudomonas aeruginosa
gcggcgggttcaacagtctggtgggcgggctcgtcggccacaacggcggcgaactggtcaacgtggatgccagcggcagggtcagcgccgctgcgagtgcgtcggttggcggcctggtcggcagcaacgccggttcgatcctgtcggcgcgcagcagcagtaccgtcaacggcagcgggcgcagccgcatcggcggcctggtcggcgagaaccagatccagggacgcatcgtttcgtccatgtcggaaggcaccgtcagtggcgactactacgtctccatgggcgggctggccggcgtcaacctgggatcgatcgagtactccggcgtcagcggcaagatcgacttcaagcctcagtcccattacggccagatctacggtgcgcaggtcggcgagaaccatggggtcctgggcggcaactacgtga

SEQ ID NO: 10152 - DNA, 2058 bp, Pseudomonas aeruginosa
tccgaaacctggttctgcgaggtcggcggcgtaggccctgacccgtcgccagtccgtctcggcgagttcgatgcggtgctgccgggcggcctggcgcaggcgttcgagggcatgggcgtcgttttgcgcacggaccggacaatgcaggtcggcctcgcggctggccagcagctcggcgagcaggtgggcgcccatcagcccgctggcgccggtgagcaggatgtgccgtggcgccagcaattgggcggtgtccatggggcggctgaaatccacgtcggcgggcaggcgcacgtcccgttgcagctcctgggccggttcgctgtccagcgccggcggcgcttcgccggcgcgccgcgccaggctggccgccagttggcgcacgctcggggtgcggtagatgtcgtggatgtaggcacggttgccgaagcgtcggctcaattcgcgtaccagggcggcggccagcagggaatggccgccgacctcgaagaagctgtcgtccaggccgaagtcggtatgccccagcacttcctgccaggacagggccacttgcagttcgccgggggtgccgaagcgttgctcgtcgagtcgttcctggcattgttcgtccaggtgtcgacgcagggcctggcggtcgatcttgccgttgaccgtggtcggcaggctgtccagcgacaggtagcggctgggcagcatgtagtcgggcagttcctggcgcagtgcggtcttgatggcggcgagcacggccctggcatcgccgtcctgctggcgggggaccacgaaggcgctcaattgctggctaccggagcgtgggtcggcatgcgccagcaccaccgcgccgtggatagccggctggcgcaacagcgcggcctcgacgtcgccgagttcgacgcggtggccgcggatcttcacctggtcgtccagccgaccgaggaactgcaggctgccatcggccagccagcgggccttgtcgccggtgcggtagagccgacgccgcagtgcctgcgagtagtggaagcgcctggcggtcatgtccgggtcgcgcaggtattcgcgcgccaggcagacgcccgccaggttcagctcaccgggtcggtcgccatggcaaggccggtcgtcggcgtcgaggatgaatgcctcgcagccgtcgatgggcgtgccgatcgaggcgggtcgccgatgtgcttcggcgtcgacgatgcggcaggtggcgaagaccgtggcctcggtcgggccgtagtaatccaccacggtatagggcagcccgccggttgcgaccggcggcagtttttccccggcgcagaacaggtagcgcagcgccagcgacggcggggcgggctgctccgccagcgcgggcaccatcacggtaggcgcgaaggcgtggctgatccgctgctcggcgaagaatgccagcagcgccgccgggtctgggcgcacctcgtcgggcaccaggtggaggcaggcgcctgcgcacagggtggaccagatttcccattgggaaacgtcgaagccgacgccggccatcagggtggtgcggctccgttgatccatattgaagcgccggttgtgccagcccacgaggttggccagggagcgactctcgatcaccacgcccttgggttcgccggtggtgcccgaggtgaagatcacatacagcgcttcgctgccgtcgagcgccggtctcggcgcggcacccgccgcactcgtcgcgagcgcctgtgcgatgacctccaccggttgccccggcaggtcctcggcatgggtggcgagggccaagggggcttggcactggcggaggacttcccgcttgcgcctgtcgggttgccgacggtccaccggtacgtaggccgctgcgcacttggcggccgccaggatggcgatgaccagttcggccgagcgttcggccagcaggggcagcagctcgccccgggcgacgccgcgcctggccaggtgggcggccagccggtcgctgagccggtcgagttcgcggtagctgaacgagcgctcgcgatcgacgagggcggggcgttcgggatgggtatctgcgtgttgcctgaataa

SEQ ID NO: 10153 - DNA, 2079 bp, Pseudomonas aeruginosa
  unsure (1713): Identity of nucleotide at the above locations are unknown.
cgacagggccgccaccggacgctgatgcgcatgcgccagcacctcgaccacgtcgcagatcccgtggcgtcgcaggaagccctggtacagcgcgctgtcctccgcgggctggcgggcgatgccctggcgcagcggcaccaccggcgaagcgctggccaggcagtggcgcggctgcagcggatcgtagtcgcggtagtggcgcaggtagtcgcggtgcatgccggccggcatccgcaggagctggaaatcgtgtgcgcggcagtcctcgtcgatgcgatagaacacgcacaggctggccggtaccacctgggtgaaggcctgcatgcagcgcgggccgaggtcgggcgacagggtcgaaggcatggcgcgggactcccgtgggacgaggcggcgggacgtccactgtcctgcctgccgggcagaatgtccatgccccggcgcgccgtcttgtctctctctgcctggcttggcaggcagcggcaagaaacccggcaggctggagcaagcgagcgggggagcggcgggtccagagtattcccgggtagtaggcgcatgcatgacgcagcgccgtcgccaagccgaggagcacacatgagtattgccatcgacccgtccgtcagcgctttcttgcgcagtccccatggcctgctgatcgacggtgagtccgggccggcgcgttccggcgccgacatgccgctgtacgacccggcgaccggcgccgagctggctcgcgtggcccgcgccggcgccgaagacgtcgaccgggcagtcgctgccgcgcggcgcgcgttcgaaggcagctgggcaggccagcgcccggccgatcgcgagcgcctgctgctgcgactggcggaacgggtcgaggcgcatggcgagcaactggcgcagttggaaaccctgaacaacggcaagtcgatcaacctgtcgcgggccctggaggtcggcgcctcggtggagttcatccgctacatggccggctgggcgaccaagatcgagggtcgcagcctcgacctgtcgatcgccgcggtcccaggcgcgcgctaccgggcctacacggtgccggagccggtgggcgtggtcggagccatcgtgccgtggaatttccccttgctgatggcgatctggaagatcgtcccggccctggcctgcggctgcaccgtagtcctcaaaccggccgacgaaaccccgctgaccgccctgcgcctcggccagttgtgcctggaggcggggattccaccaggggtggtgaacatcgtcaccggcacgggcgccgaggccggcgcggcactggcggcgcacccgggcatcgataagctggcgttcaccggctcgaccccggtgggcaagctgatcgggcatgcggcggtggagaacatgacgcgtttttccctcgaactcggcggcaaatccccggtgatcatcctcgatgacaccagcctggacatggctgccgccggttccgccggcgcgatcttcttcaaccaggggcaggtctgcaccgctggctcgcgcctctatgtgcagcgcaagcgtttcgaccaggtgctggagcgcctggcggccatcgccggcgacctgagcatcggccccggcctggatccgaccacgcagatcaacccgctggtctcggccaggcagcaggagcgggtgctggggatgatcgaaagcggggtggctgagggcgccagcgtggtctgcggcggggcgcgccanggcgagacggggttctacgtgcagccgacgatccttgccgacgtcaccccggggatgctggtggtgcgcgaggaaatcttcgggccggtgctggtggcgacgcccttcgacgatctcgacgaagcggtgcgcctggccaacgacagcatctacgggctcggtgcgagcatctggtccaacgacctgcgccaggtcatggacctggtacccaggatcaaggccggcacggtatgggtgaacgcccacaacctgctcgacccgtcgatgccgttcggcggcttcaagcagtccggcatcggacgcgagatgggccatgcggcgatcgaggcgtacaccgagaacaagtcggtgtgcatcgcctactga

SEQ ID NO: 10154 - DNA, 660 bp, Pseudomonas aeruginosa
atccgttccgtccgctggcggtggaagaggtgctggagaaggaattcgccgaagaggaccagcagcagcgggagagggcgcatgtccgcctgggcgcgctggtatgagcgtcactggcgcgactggcggccagccgcctatcgccccggagccaccctggccctggtgcggcgcaacctggctgcgtgcgacggcgaggcgcaggacggcaggctgttgctgcgtacgaaagagctgagcctcgaggttcgcgagcgggtccaggcgcacctgttcatgcatatcgtcagcaccgagttcagcctgttcgtggcggcgcccggggggccgccggccagcctggagctgcgtcacgccggttgcttgcggcgtcgcggcatcctttgcaaggtacgcagcgggagcgggctcgagccgttgcgggaggccttgcaggggggcgaccgggtcttgctggagcagctcatgccgctggacttccggagtttgcgcctctgccgcgacgacaggggctggaccgtgagcctggaacacctgggggcgtgcgaggtggtcaaccgcttccccgcctatcgccgctacatccctctggtcgccgagcagcgcctggccctgctgggcgccttcgcccaattgcagcgcctgctttctcccgcctga

SEQ ID NO: 10155 - DNA, 1092 bp, Pseudomonas aeruginosa
atgcttgacgcttcaccggaggcacagcaagaatgcggcgtgtcaggttgcatgaaaataacggcggcgctgtccggggtacctgccgcgacaagcagcacccgatgcccgcacctttcatgtcgccagcgaggcgcaggatgtcattgccttggggcgtgcgccgcgtcgctattcactatcagatttcgagtgcccccctacaccatgcgaatgcgcctgatgcttttgggcggcggtaatgcccttggacaggcgctgatccgcctaggggcggaggaagacatcggtttcctcgcgcccagaccacccgagcagggctgggatgccgccagcctcaccaccctgctggacgaaacgcgccccgacgcggtgatcaacctcgccttctaccacgactggttccaggccgagcaggtcgaggcggagcgcctgggcgcccaggagcgcgccgtcgagcgcctcgcggagctctgccagcactacgagatcctgctggtccagccgtccagctaccgggtcttcgacggcgcccgcgccaccgcctacagcgagaaggacgagacccttccgctgggcctgcgtggccaggcgctctggcgcatggagcagagcgtgcgcgcggcctgcccgcgacatgtgctgatccgcttcggctggctgctggacgaaagcccgaacggcttgctgggacgtttcctcagccgcgccgagcaaccgcagccgctgttcctcgccgacgaccggcgcggcaacccgacgccggtggacgacgccgcgcgggtggtgctctcggtgctcaagcagctcgactgccaggcgccgctgtggggcacctaccactacggcggactggaagcgaccaccaccctggcgctgggacaggtgatcctcaacgaggcgcgtacctatcgctccaacctgatccaggagccttcggcggaggcccatgccgcgcgcccggacgcgctcgacgagccgcagcacgcggtgatggtctgcaagaagatcctccacaccttcggcatcaagccgcgcgcctggcgcgcaggtttgccggctctattggacaggtactacaggcatgtttga

SEQ ID NO: 10156 - DNA, 834 bp, Pseudomonas aeruginosa
tgtgcagggtcttcagccagaggtacatggggtccgtttccgcaggatgaaaaaaggcgcccgaaggcgccttttcccgttgggggcgcaagccccgcgacagtctacgactcagaacttgtagccgaaaccgatcatgtagacccacggatcgacgtccacgtcgaccttggtcttgttcacgcccagggcgctcgggccgttgatgctggccttggtgtcgatgtccatgtaccagacggccatgttgaacagcgcgtgctcgttgagcatgtagtcgaagcccagttcgccggccaggccccaggagtcctgcagcttcatgctgctgaaaccctgcgccttgcggttgctggcgaggtcttcgtcgaagaaggtggtgtagttcacgcccaggccgccgtagggctggaaggcgctgttggtaccgcccatggggtaatactggagcagcagggtcggcggcagttgcttgatgtcggccagcttgccgtccaggcccgggccgaggcccttgacgtcgacctggtggttgaacggagtggcggcgaccagttccacgccccacttgtcggcgaacatgtaggtgaaggtcaggccgagctgggtgtcgctgtcgacagtcgccttggtaccgcgctgcttggcgccgtccagcttgatgtcggaactgctgtcgtcgggatcgacggtggcgaagccgccacggatgatgaagtcaccggccttgtgtccttgaatatccgcagcggcgaacggggaggcgacggtgagggccagcagggaagcggtaagccaggacttacgcatgatgagctccattccttgtattag

SEQ ID NO: 10157 - DNA, 945 bp, Pseudomonas aeruginosa
agcggcggttggccaggctggccagtgccagtcggaagagatacatgctcagagtcctgccggccgggcggcgcggttgagatcggaaagggacaggctgcggtcgaacagcccggccaggctctggtcgtggctgacgaacagcaggctggcgccggcctcgcggcattcggcgaagagcaactggagaaacgcctcgcggctgtcggcgtcgagcgccgaggtcggctcgtcggcgatcaccagctccggctggccgatcagcgcgcgggcggcggcgacccgctgctgctggccgatggacaggctgtcggcgcggcgttcgtgcagttcgccgccgaggccgagctggccgagcagatggctggcggcctgcgccgggctaccgtggcgttcgcgggcgcgctgacggcgcaacgcggaaaagtgacagggcagctcgacgttctcgcgtaccgagaggaatggcagcaggttgaactgctggaagatgtagccggtgtggtcgacgcggaaatggtcgcggcgcgcggcggacagcttttccaggtcctcgccgagcaggcggatgctgccgcggccgggcttctgcacgccgccgaggaggccgagcagggtggtcttgccgctgccggaaggccccttgaggaacaggctctcgccgcgttcgagatggaagctgggaatgtccagcaactccgcctggccgggccaggcgaagccgaggttggtcagggtgatcagtgcgctcatgggggtaggggcggaacgctccgccggagcctcgagaatggatggaggggcgccgcgccgaatccctcgcggcgcctccggaacgatcctacagcttcagctcggcgctggccggagccaggtcggcgcctttctggccgtcgggaccgatcagttgtacctgaattttctgggtggcggggaagcgcttga

SEQ ID NO: 10158 - DNA, 426 bp, Pseudomonas aeruginosa
acgggactccggcaaggaaggaaaagagtttgttacgttataacgaatttttccgcctgcctagcctggccgatttggcccctacgcgccgacgtgggagcatggcgcgattcgcttgtggagaaacgagatggtgcggattcgcggaagcatcggcgactggccggtggacctgaccctggaactggacgccgaggattggcgccagctggcgcaacacgtgcccccgccgccgctgggcgagccgcaggtcgcggcggccagggcgccggcgccggcagcgccggtggatcgcctgtggcagaccgcccaggacctgctgcgcggcagcgggcggatcgaggggccgcagttgctggcggagttggaggggttcagcggcaatgccggcgccgccaagcaactgcttgtgcgcctgcggcatga

SEQ ID NO: 10159 - DNA, 477 bp, Pseudomonas aeruginosa
gcagtccgtccagggccgcctcgtactgctgccgggcgagctgctggacggccaactggtaggctgcctcgtcgtcgccggcatcggccgccaggcggctcttcagctctgcgctgtcgggcaggtcggcagcctggcgcaggaaggtcagctgcgcgcgggcgccggccagggcctgcttgtgctcgtcgctcttcaccgcgtcgaggatggcctgcgcctcttccagttcgccgcgctcggccaggcagcgggcgtagaggatcagcgccgcggcgttctcgttgttctccgccagcagggctttcagggtcgcttcggcgtcgccgatgcggccttcggcgaatagcgcctgggccacttccagcgggtcttcgtcgggcagcgccggtgctttcacatggggttcgagcagggcgcggatctgcgattcgggctgggcgccggcgaaaccgtcgaccggctggccatccttga

SEQ ID NO: 10160 - DNA, 1443 bp, Pseudomonas aeruginosa
cgtcgaagatgtagggcgtatcgctcatgtcgattctcggaaacgcaaggtggtgaccactataagtgggggcgcgccgcgcgcaaacaagcccgtgcctcaggcttgcccgcgttcggcgtgatacaggctgaccaggcggaattcggcgggctcggcgaggtccggccaggtacaggcgtcgagcacgtccaggcgccggtacagcggatgacggaagtcacggacccgcgagtcggcgaccagcgcctggcggccgcggctgaggaactggtcgagcagcggcaggttggcgcggtcgtagagcacgtcggccaccaggatcaggtcgaagcgatcgtcctcggcgaagaagtccgccgaatagctcagctccactccgttcagttcggcgttcgcccggctcgctgccagcgccaggggatccaggtcgcaagccaccacctcggcggcgccggcgcgggccgcggcgatcgccgccaccccggagccgctgccgaagtccagcacgcgcttgtcgcggacccactgcgggcgctccgccagccagcgcgccaggaccagcccgctggcccagcagaagcaccagtacggcggctcttcgaggatgcggcgggtttcctccgggctgaactggcggtccatgttctgcgcgtcgatcagccacaggcgcaggtcggtgccgggcagcgcggtggcgctgagccgggcgtcgccgagcagctcgcccagcgcctgggtcagggcttgcggtgccgtcacggcgcgcgtaccaggcgcagttcgccgagggactgggtggtcggctgggcgatccgcaacggatgcaggcgccaggccaactggccggactggatcacccgcgcgtgcagttcgacgcgcagcgcgccaccggccggcgggaaggattcggggttgaacggcaggcggaagggcatgagttcgccggtggccagcaccgtctcgctggccagcagccgctgtggacggtcgcgctcgtcgatcaccagcagtgccatctgcacctcgctgccgcgtggcaggctgccctggatgctgctcagcgttccgctcagctcgcgcaggtgggccggtagcaccggctcgaccatggtcacgctgcgcgaagcttgcggcgttggcgcaggcttcggcttgtcgctggaacaagcggcgaggagaaggacggccagcagggcgatcgggcgcagggtcatgggctgctccatagcggtggaatccgggcggcgcttgtatagcgcaaagtgtgattcttgtcgcgcttcgcgtaggccgcaacgtccgattcctctcgcctttcccagcgtgccggcgccggtcgattctgcgggtgctcggtcgggcgcggatgcgctaccatgcggcttccttcagctacgcctgtatcagcaccatgcattgtcccttctgcggtgcccatga

SEQ ID NO: 10161 - DNA, 1644 bp, Pseudomonas aeruginosa
ctcgcgactggtcgccgagggcgatcaggtgcgccggcgccgcgagtgcctggcctgcggcgaacgcttcaccaccttcgagaccgccgagctggtcatgccgcgcctgatcaagcaggacggcagccgccagccgttcgacgaggacaagctgcgcgccggcatgcagcgcgccctggagaagcgtccggtcagcgtcgagcgcctggaagcggccatcggccacatcaagcaccagttgcgcgccaccggcgagcgcgagatcaagtcgcgggtgctgggcgaactggtgatggccgagctgcagaagctcgacgaagtcgcctacatccgtttcgcctcggtctaccggcgcttccaggacctcaacgaattccgcgaggagatcgaacgcctcgcccgcgagccggccaaggaatgaacgccgccgacccgctgtacatggcccgcgccctggaactggcgcgccaggggctgtactccacccatccgaatccgcgcgtcggctgcgtgctggtcaaggacggccaggtggtcggcgagggctggcacgtccgcgccggcgagccgcacgccgaggtccatgccctgcgccaggccggcgagaatgcacgcggcgccaccgcctacgtgaccctcgagccctgcagccacttcggccgcaccccgccgtgcgccgatgcgctggtgggcgccggggtggcgcgggtggtcgcggcgatgcaggatcccaaccccgaggtcgccggtcgcggcctgctgcgtctgatgcaggccggcatcgcggtgcagagcggcgtcctcgaagccgaggcgcgggaactcaacatcggtttcatcaagcgcatggaacatggcctgccgttcgtccgggtcaagttggcgatgagcctggacgggcgcaccgccatggccagcggggaaagccagtggatcaccgggccctccgcgcgttcggcggtgcagcgcttgcgcgctcgctccagcgtggtgttgtccggcgccgatacgctgctggcggacgatgcgcggctcaacgtacgccccgacgaactgggcctgaacgccgagcttaccgcgctcgccgcggctcgccagccgttgcgggtgctggtcgacgggcgccctgcgggtgccgctggagtcggcgttctaccacgcccggtccggcgctggtggcgacctgcgccgccgcctcggcgcgcgaacgcttccaggacgccggccacgaactgctggcgctgccctccgccgagggccacgtcgatttgcacaagctgctcctggaactggcggcgcgcggcgccaacgaagtgctggtggaggccggcccgcgtctggccggcgccttcgcccggctggggctggtggatgagtaccggctgttcgtcgcgccgaagttcctcggctccagcgcccgtcctttgctcgactggccgctggcgcggatggccgatgcggcgcagttgcggatcgacgacatccgcgcggtgggcgacgactggctggtcaccgcgcggccccatccgcgggacgcctgaacttcgctgcgcggcgacgcggcggacgatgcacaagcggcgcaactgtggtaaaacgccacacggccatctcggtggccgtaacgttctcagggcggggtga

SEQ ID NO: 10162 - DNA, 984 bp, Pseudomonas aeruginosa
aagtccccaccggcggtaatggcgcgcaaggcgcctagcccgcgagcgcttgccggaccggccaccgccggacgacaaggtcagcagacccggtgcgattccggggccgacggtcatagtccggataaagagagaacgggattgcctgcctgggcgtaccctgtgcgcccgcaagatccccttcgatccaaaaagccctgtttttcacgaaacaggagttcgtcatatgtcttcatcttggaatacccgcgctatggcacgcaggccgctcggcgtcgcgccggccatgctgcgcgcctgtgcggcggaaaaacgggaggtcgcatgttcaccggcataatcgagtcgatcggcagcgtccgcgcaatgacgcccaagggcggcgacctgcgggtctacatcgccaccggcaagctcgacctgggcgacgtcaagctcggcgacagcatcgcggtcaacggcgtctgcctgaccgcggtggaactgcccggcgatggcttctgggccgacgtcagccgcgagagcctggcgcgcaccgccttccagcacctgaaggtgggcagccgggtgaacctggaaaaggccctgacgccgaccacccgcctcggcggacacctggtgagcggccacgtcgacggcgtcggcgaggtgctcaagcgcgaggagaacgcccgcgccatccagttcaccgtgcgggccccgcgcgaactggccaggtacatcgcgcacaagggctcgatcaccgtcgacggcaccagcctcacggtgaacgcggtgaacggcgcggagttcgagctgaccatcgtcccgcatacgctcagcgaaaccatcatggccgagtaccagcccggacgccgggtcaacctcgaggtcgacctgctggcccgttacctggagcgcctgctgcttggcgacaaggccgccgagcccagcgcctccggcatcagcgaagcgtttctcgccgagaacggttttctcaagtaa

SEQ ID NO: 10163 - DNA, 882 bp, Pseudomonas aeruginosa
tggtgcagcgcaacggctccggcttcggcaccaagttcactgtctccatcgaggccgccgagggcgtcaccaccggcatctccgccgcggaccgcgcccgcaccgtgcaggctgcggcggcgaagaacgccgtggccgccgaaagtgttcagccccggccacatcttcccgctgatggcccagccgggcggtaccctggctcgcgccgggcacaccgaggcggcctgcgacctggcgcggatggccgggttcgagccgtccggggtgatctgcgaggtgatgaacgacgacggcagcatggctcgccggcccgaactggaggcgttcgccgccgagcacgggatcaagatcggcaccatcgccgacctgatccactaccggctgatccatgagcgcaccgtcgagcgcatcgctgagcagccgctcgacagcgaactgggccacttcaacctgatcacctaccgcgactcggtggagggcgacgtgcacctggcgctgaccctcggcaaggtctgcgcggaagagccgaccctggtccgcgtgcataacatggacccgctgcgcgacctgctgcaggtcaaccagccgggccgctggagcctgcgcgcggcgatgaccaaggtcgccgaggcgggcagcggcgtggtgctgctgctcggtcaccagatcggcggcgacgacctgctcgcccatgtccgcgagatcgcttcggcgccggctccggcgcccaaggccaccaccacctacagcaccgtcggtgccggttcgcagatcctgcgcgacctcggcgtgcgcaagatgcgcctgctgagtgcgccgatgcgcttcaatgcgatatccggtttcgacctggaagttgtagaatacctgcccgccgaataa

SEQ ID NO: 10164 - DNA, 486 bp, Pseudomonas aeruginosa
gacctgctcatgaccctgaagaccatcgaaggtaccttcattgcccccaaaggccgctacgccctggtggtcggccgcttcaacagcttcgtcgtggaaagcctggtcagcggcgccgtcgacgccctggtccgccacggcgtggctgaaagcgagatcaccatcatccgcgccccgggtgccttcgagatcccgctggtgacccagaaggtcgcccagcaaggcggcttcgacgccatcatcgccctcggcgcggtgatccgtggcggcaccccgcacttcgaatacgtggctggcgagtgcaccaagggcctggcccaggtgtccctgcagttcggcatcccggtcgccttcggcgtcctcaccgtcgactccatcgagcaggccatcgagcgctccggcaccaaggccggcaacaagggcgccgaagccgcgttgtcggccctggaaatggtcagcctgctggcgcagttggaggccaagtga

SEQ ID NO: 10165 - DNA, 744 bp, Pseudomonas aeruginosa
gcggcctgctcgccggcgaggaagccttgcgccagcaactggccgccggcgacgactacgtgctggttttcaccctgccgcctgagtaccttggcgagattcgcgccgcgtggccggccacggccgccatcggccgggtcgaggcgggacagggggtgcacctgctcgacgccgacggaaaggaactcataccggccgcggccggctaccaacatttcggaacccaacgtgactgagcatcctgatcaggcgccggcgcagccggtgccgccgtcggtctggcgcaatccctggcatttcctcgccttcggcttcggctccggcaccctgcccaaggcgccgggcacctgggggtcgctggtggccatcccgttcatcccgctgtggcagatgctgccggactggggctactggctgatgctgggagtgaccatgctgttcggcttctggctgtgcggcaaggtcgccgacgacctgcgcgtgcacgaccacgaaggcatcgtctgggacgagatggtcggcatgtggataaccctctggctggtgccggagggctggtggtggctgctgatcggcttcgtcgtgttccgcatcgtggatattctcaagccctggccgatcagttgggtggaccgcaacgtgcacggcggcgtcgggatcatgctcgacgacgtcctggccggggtattcgcctggctggtcatgcagggtctagtctggggatgggtacactggctggtctga

SEQ ID NO: 10166 - DNA, 1305 bp, Pseudomonas aeruginosa
acaagcacaacaggcgctacctggcgaccaaggccggcaagctcgggcacatgctcggcagcctgcaccagggcgaggcggaaaccacgtgagtcgccagcaagcccgcggcgcgctgggacgtgcctggtggttgcaactggcgttggcgctgttgccgctgatcctggtcgagttcttcctcggcgaactgcaaccccttccccatggcctggcgatgccgctgttcatcgccgcgctgctgtcgatgttcgtcaacctgccgctgttcggtgcctacaagcgtggtctcatcgccacccagaaagcgctggatacggcggaggaagccgccgcctggacccgtctggcgcaggtgcgccgcaaggccctgttcggcgccagcctgccggcctggatcggcgtgccgggtgtgttcgccgggctcaacggcgttgcgctgatcctgctcggggtcaccagcctggtgctgttctggctctaccgtattccgcgtcaactcggttgatgcgctcgttctggctgctcgcctgcctgctcctcagcctttccgccggggcggcgcagcgggtggtcagcctggcgccttcgctgaccgacagcgtcctcgaactcggcgcagcgcgccgcctggtcggcgtgctggatggcggcgagcgtccggcggcgattggcgacctgccttccgtcggccgctacggccaggtcaatctcgaacgcctgctggaactgcagcccgacctgatcctggtctggcccggcagcgtgcccgaggcgcagttgcagcgcctgcgggacttcggcatcgccctcttcatcgccgaaccgcacagcctcgacgaactggccctgcaactggctgcgctgggcgaggcattgggcgaggccgaggccggccagcggttgtcggccaggttccgcgaaggcatgcggcgcctggccgagcgctaccggcgggacaagccgctgaaagtgttctaccaggtctgggaccggccgctgtacaccattggcggacgccaggtgatcagcgatgcgctgcgcgtctgcggcgccgagaacctattcggcgacctgccgcagccggcgccgcaggtcagcgtcgaggcggttctggcgcgcgatccggcggtcatcgtcgccggcagtcacgcccagctcgaactctggcggcaatggccggcgctggcggcgacgcggcgcggacagctgtaccggatcgaagacaagaacctcgagcggccgagcttcgccatgctggcggcgaccgagaaactctgccgctcgctcgccggggcgcgctga

SEQ ID NO: 10167 - DNA, 429 bp, Pseudomonas aeruginosa
tgcaccggccgcgcccaagcaagggagcccctacctttgccggggacttccgacgacccgtcggtcagttgcgtcgctcgacgatgtagcgggccagttggcgcagcgggtcggcgctcggcggaaaaccgtcgagggcggccagggccaggtcgcgcagctccagggcatagcctttggcggcctccaggccgagcagggcgggataggtcggcttgttgtgcgcctggtccttgccctgggtcttgccgagggtggcggtgtcgctttccacgtcgaggatgtcgtcctgcacctggaaggccaggccgatcgcttcggcgtagcgctccagggcggccagcgaggcgggctcggcgcgaccgctggcgagggcgccgaggcgcacgctggcttcgatcagcgcgccggtcttgtgccggtgcatga

SEQ ID NO: 10168 - DNA, 702 bp, Pseudomonas aeruginosa
gcatttccagacagacggcatgttcctgcggattgcgccgggtgtcggcgagcacttcgaaggccagcgcctgcaagccgtcggcggcgaggatcgcggtggcttcgtcgaaggcccggtgggtggtcggctggccacggcgcaggtcgtcgtcgtccatcgccggcaggtcgtcgtggaccagcgagtaggcatggatcagctccaccgcgcaggccgcggcgtcggcgcgctgcggcgctccgccgagggcctcgcaggcggcgtaggcgagcagcgggcgaacccgcttgccaccgttcatcacgctgtagcgcatggcctcgtagaggcgttgcagttcttcgcggggagcaacgaacagggcgtccagggcggcatcgacgcgcgcctggcagcgcgcctggtaggccgcgatcatgcctcgtcgccttccgcatcgaacggcgcttcgctgagctcgccgtcgcgttcgaggagtatctgtaccttctgttcggcctggctcagcgacgtctggcattcgcgggtcaggcggatgccctgctcgaaggcgcccagcgactcttccagcgacagctcgccgctttccaggcgttccaccagggtttgcagctcggtgagggactgttcgaaatcgagggttttcttgcgggccatcgggggagtctcggcgaggtgtacaaaaccccgcgacactag

SEQ ID NO: 10169 - DNA, 948 bp, Pseudomonas aeruginosa
attgattattttcatggagagcggtgcgctatggatgtctacaagttgaagccagaggaaaccgatgagcgaccaatcgagcgcgaacgtttcgaagaagaaacgcgacgccaggagccttggttctccacctctgaaaatggtacggagggacatttcgctgtctgtcccgcctgcgacaatccagtacaaatcataggtctttatcatttgcccgccaatgtgactcgtccttatgggcgtcattacgctcgttcggttcgagatcttgccgaagcggatgaggaggcgcgagagaactgcccttatttcaaaccaagggtacaccaaaagacagagcgaaaagcctcggtagacggcacgcctctgaaaatactaaaaatactgatcgagcagttcgacagggttgtctacctgctgcggaaagaactgggtgtgaatatctctcaaaacctggctatccggatgctggaacagtacagaagggagaaaggatatctttatactggggcaacgctgaccaatatcccctggatatttgcctatatggctgattctcagagtcttttcggacagcttttacttgatgatgagcttatcaaggcagtctccactgaagtgtcagcagcctcgattgatgaatatggccgagtttcctcgaaggtggatgcgtcagggaggaaggagtatttcgatctcaatatgtgctttgtgaagcaccggtttcgtaaggacagccttgagggtgagttgatcgaggggatggagatgctggtttccacagagcggaaaggaaaggctatcgacatatataagaagtcgattgtatttaaccgtcagtatttccagcgtttgattgctttgcccgaggatcatccgcgtagagaccgtagcttggtcgaggcggcgcggagggtgctgggtgacttgctgcccggcgaacgatga

SEQ ID NO: 10170 - DNA, 1092 bp, Pseudomonas aeruginosa
gtagagactcgggggaaccacacggaagaggtactccttgcccttggccaggagcacgccctcggtgaatttgccgctttccttgcgggccgagagcatcatcgacttctgcgccggcgacagctcgcggaacctggagatcttctctacctcgtcggggggcatgttcaggcacagccaccactcgatcatgttaagcatcggcgccccggaggctgggatgtcgtcgatgttctgggtggcgagccagaaccaggcgcccagtttccgccacatcttggtgatcttcatggcgtagggcagcagcagcgggtgcttggtgatgatgtgcccctcatcggtgatcttgacgatgggccggcccttgaactggtcgcgttcggcgatgttgttcacggtgttcagcagcgagatgtaggcgatcccgagctgggcggcgtagccttcgcgcgcgtaagtcgcgaaatccaccacggtgaggtcggcttcaggccagggcgtgccttcgcgattgaacatctcgccgtcggcacccatgcagaacatctgcatggcttccgccatttcggccaggcgcgcgcggcgttctggcgcggagccatcgctcctggaggcctggtagagcgcatcgcgcacatcctgggtcagcaccgtgcggttcgcggcggcgcaggtcctggccgccgccagaatcgcctggcggatggcgctgcgatcggcacgggtcaggcgcgcgtcttccttttcctcgccgccggtgatcatcaggcgggcgacgatctccatctcgcccaggatgtctcgctggtcgtcctcgaggtcggccttgctgccctggaccgagtccgaggcctcgatgtcttcggcatccaggaccttcacctggtcgggactctcgaccagcttgatggcgtccgcgtacggcgccaggctgaccccggagcccggggcgaggcggacccggtggaccgagaggccaaaccgcttggcgaagtcggccagcaggccgaaactgttgcccgcttccgcgacgaacatccgtggcaggtacatggcgagcatctggctgatgaggttggtcagggacgctga

SEQ ID NO: 10171 - DNA, 819 bp, Pseudomonas aeruginosa
cttgccggacccggttggcccgaagatgaagccgtgggcattcatctgccggtccagcttgttgaacgggtcgaaggtcaacggcgcaccgccacggttgaacagcgtgaagccagggtgcccggtaccggtggtgcgcccccagatgggcgacaggttggcgatgtgctgcgcgaacatcatctgggtgtaccactccagggctcgcttctcgttcggatcgaaattgcagggcagccagcgcaggtagctgttcagcggtccgacttcgttctgcggttcgaccggcacaaggccggcgccgagcagcacgttgctcagggtgatgcagcgctcctccagctgggtatggtcgcggccgcgcacgaacagagcgatcgaaccgcgatagagcttgtgctcccggccgatcaggcggcgaacggtggccacgtcctcgcgggtgtggatcgaggcctgggtgtcaccaacggcctttttcgagagctgctgcagatgcccttccagcatgtcctgcggcgtcaccaccatggtgatacacagcagcgtgtcctcgggcatgcgatcgaacagggcgttcaggccatcgcctttgagcgtctcgccagtgaagtggcctgtcagcggcgccttgttcaactggtcgaccacgatcacacggtgcggcatggcatcgaagagccatacgccctgggtggcatcggaaacaggctgccgatagaacaggttctgggagaagtcggtgccgtcggccagcggcaactcgtcctgcaggatcggttcgtccggccggcataccagttcgtagaagcgacgtag

SEQ ID NO: 10172 - DNA, 654 bp, Pseudomonas aeruginosa
atccgcatcggtcttgccgaggtgatccgggtgcgggttgaaccagcgaatcaaccagttcctgacgtcctggccgctcatgcgcgaagcgacgatgccggcgttcgccaggccgccttggatacgctcgcagatggatttcagatatgccgtcgggtcctgtccgcgaatctgcgcatccgccttgcggatccggcggtagacgaccatccgcacgcgccgctgttgtcctcgccagggcagcttgctgacggcggtgtcgacgaacagtccgcccggcttcgaaatgccctccaggtgatgcttcatgagcgccaggtacatctcgctgaaggccgatcctcgcgctcgaggatggacgtactgcctcaactgctcctggaaattgtcccagctgatctcgtcctgggcgtagaactggacgatccagggcgaggtttcgtgctcgtcgaaggagttctgcagggcttctttcaatgcgtcccgggcgttctgcatccaattggggtcgcggccctcggtgcccaagggcaccagctcgaagaagacggcacgcgaacgcccatcttccaggagcatcacctgttcgtcgggcaggtactcagcccagggcagcaggtcgacgaacgatgggtcgtgatcgtagaggcgtga

SEQ ID NO: 10173 - DNA, 669 bp, Pseudomonas aeruginosa
gctctgattgcccaggtactccttggcattggatcggcgatcaccggcgatgcaggggatgccgtaggggtcgctgatccagccgaggccgccctggatggttttctggtcggcgctggcggtctggttgttgttgctctggttgtcattcacctcctcggccggcgccgggaaggtgcgcacggtcccgtcgttgaacacgaacgtgaggctgcggatctgcccacgcacgcaggagagtgtccagtcgcccgaggcggtcccgctggctaccgcgccggcgacgtccggcagctcgatgccgttggcggtgaggttgtccgggccgatgaggattttgaacgggtaaggatcattgaccgtcccgtcgaccggcacacgaccgatcagcgcagacatggccaccgagcccatgagcgtcgagttctgcggcagcgtgtaggtcttgcggacgagcttgcggttctcgaggtcggatcgctgttggccgacggggtgcagcccgtcatcgatccgctccagcgcgttctggccgcgatcgaccgcattgccgaaggaggtcgggaagctgaatccgctcggttgggtggtggagccggcggccagcggctggccattggcatcgactgcgcgggcgtcctggggctcgatccagacgatgtccgatga

SEQ ID NO: 10174 - DNA, 1017 bp, Pseudomonas aeruginosa
gcctcggctgaatgcgtacagatcctccaggtcgcgcagcgagtaactgtcgataccgcctacccagtggaatttgggctccggatgattgcggaccagctgcagggcattctcgatgacgccgataacggtgcggtgaatgaaagtgcggtgaggaaggtccgccgggagggactttttcaccagcgtctgcgggcccaatccttgaagtttccgtgtctcgcccttgtaggagaggatgatgttggccacgtgcgcaatcgcggggccgaaccgccagctctgggtcaggtagtgctcctcggcgccgaccatccagtcgctgttcagggcatcttccgcgcctctgaaccggtagagctgctggtggggatcgccgacgatagccattctgatgcgctgccagtgggcaatgtccgcgatcactgggttgatgtcctgtccctcgtccaggagcatgcagtcgaagcgctggctcaaatcgggcttgctcagttgatacagcttcaggtagccgtcatggggcatcagcatgccggtgtcctggagatctaccatgcgcctccagactactcgcgccatgtccaggccctgcttgaggaagcgttcctgggcactggtgaggaacgccttgtcgcggaagcgcgggaagtgcggtcggccgagttccgcgtcggcgctggccatgtagttgttcagcgtggccagcacgtcacgtaccaactcccagtcttgggtatcgagtccgcgggcgatatcggtcagacgcaggttcttcgtcttcttgtgggcgtactggatgccgtacaccgcatgagccaggctgtgggcggtcttgcacactacgttgcggggaaacttgcccttcgcggctttctccaccgagctgttgtagcagagatagaggattctcagggtagggttcgccttggcaaagcccaccagggtggtcgtcttgccagtgccggcgaaggcccgcaccaggatcttcgatgccttcgactggatgatcggtga

SEQ ID NO: 10175 - DNA, 201 bp, Pseudomonas aeruginosa
gccatgaatacagaccttccccagctcgaacaaaccatcatcgatatagcgcgccaggaactggccgccgtggctgctttttatcgcaagagggaggcagggattgagagcgcgcacgtcgatgaggcatggagcgaatacctggctcgctaccatgcactgagcacgcttttggtgctcggccagttgcctataggttga

SEQ ID NO: 10176 - DNA, 288 bp, Pseudomonas aeruginosa
ggggttattatgagtggtgaaaacagtcttctcgagaggatggttaatggtaagttggggccaggctcagatattggtcctgccgattcacaaatagagggtacttaccggcgcggctatcaccaagctatggcggaggttgcatattacctgaagaatgggggaaccttgtccgcggcctcactgaatgattgggtgagcgaggaccttcgtcgctggcgacaggggaaggataacgccccgattcatcgccagatacttcctcctgcaattcctggcagccgatag

SEQ ID NO: 10177 - DNA, 243 bp, Pseudomonas aeruginosa
ggccgatgttatgctcctggccaaacagctggacgaggccgaaaaataccggcgcataccatcgccagcagcggcaaactgattgagggaagcgacgtgagtttgctggcgatctattcgctgaatataaaacggtcactaggtaggagagaaaagggccatgccgcgataccacgtccatttcatgtccgtgcgccaggggaaggggctttccaacaggcatacgagacaaatagacattga

SEQ ID NO: 10178 - DNA, 1398 bp, Pseudomonas aeruginosa
cactgccaccttcagcccggattgctcgagcactttcttcagcctggacgtggtgtcgcgcgtcccgctgtagacggtgtatgccagaaccttgcggcccttcgctttctcctcgaggcagaggtccaccagcgcctgctccttgggcatcaactgctcgtcgccgaagatcgctggcacgaaggccagtgtgtcccggcttcgcggatgcttgacgatctccggtcggaaacagcagtccggccaagccagcagcacgttgaggaccacgcccaggagcgtggtatctcgtcgcgccagagcctggcggagctccgctgtcagcgtggccgccaggcgctgataggccgaagcctgatcaggcgccatcggcacgtcgacgaactcctcctggtagtcgggcagtacgttgccaccgatatccttgagcttcaggaacacggtgaacggcaatacgaagcggtggatgcccttcgggccgaagccgggagccttcaccgtgcgtaccgagagcttcttgccccgggctgtcttgtgcgagtcaccatcgcgttcggtgtagatgtccttgagcacgccgtggtcgcgcatgaacgacatggctgctggagccatgctgccacgcgcgttgggccggtagccgtcctcgatcatgcgctgggtgaggatgcggaacaggaggtagaacaggtcgtcggcgtagccgcccatgagcgttccggtcagcagcacggttttccgtgccttggctgcgagaacgcccatggcctggccctgggccgaaccgctgttcttgtactcatgcccctcatccaccaccaacagatcgaagtagccgttgggaagttgtctttttatgaactcggtcggttggtagccgccttcgccgaagccgaactcgatgttcgccatcgatcgctccatgcgtttggcctgccgatcgctgaagacgaagtcgcccttggcgtccatcaggttgatgaactccgagacgttgtccaccaacatcgtggccaggaagtcctcgccgaagtcgttcagcaggcgctccgccctgaccgggccgatggttggaatccgacacatcgacttgaggatcgttgcgcgccggttgccgccgtcaggcttgcctggccggatcagcgtccagagcgccccacgacaggaggaacaggtacgtcgacggtcaccacgctcgaactcctccaccgtgaccaggttgccttccaggtcctcgaggacctggccgcaatccgggcacgcagcgagcaattggccgccggcggcgcgcttcttccagcaggcgagccgccaatggaaacccatccgcatccgcacgcggccgaggatgaagaactcctggcgtccgtcgtaggcgtcgcccatctgatctcgtag

SEQ ID NO: 10179 - DNA, 216 bp, Pseudomonas aeruginosa
atgtgtttttctgatctcccagcagcggttgtaaccgccaccgaacgaaaggtgacgaacgacactctgggcttcggccaaggaatacagatcgcctatgtgcttttgctgaccgtcctgctcggcaaggatgccgtagagcacattgcgcaccagaccgttgtaaggacagcggtcagaaagtgcagtatcgatctctcgaccttcagtaactag

SEQ ID NO: 10180 - DNA, 1296 bp, Pseudomonas aeruginosa
ctggatcggagagcctggccaggctggggaccatgcgataggccacgatgcacagcaggaacaccatcatggcggacagcgccgagggatagagcagcgcctgccagatggtggcgcggatcctggcctgggcctcgaccagggagacggcatcgcccatggcctgaaccaggttgccgctcatctcgccggcctcgatcagcgctcgctcctgggcgggcagatagagcgccatggcggtggccagacgcttgccgttggacagccccatcagcgcttcgcgactggcgatggccaccggatgaaacggatgctgtccctcatgagcgaagatcttgtgcacctctgccacagcgtccttcaacgggaccccgttttcgagcagggtggacatgctttcgtagaactgcaggcgttccttgcggccgaactgcttgctgtagaaggcgaactgcaactgctcccagaagccccccatcagcacgcctcctgcgagtagaagctgtcgtcgagcagatgctcatcgaagtcgagtggcccaatgaaatcctcgactatctgcgggtcgaacatgccctcgttgatgcggcggatggcgtgggcgtgcttggtgatgccctgcatggtcttgacccagtagttgcgtgcctcggctgggccgcctttggcgaacacacgcatgaaggccagggtgggcagcaccacctcggcgacgatcgagcggccgttgactccggagccacggcaggcctggcagccaggccccttgacgtacacctgggaaacatcggtcaagcgctggacccgttcgaccagatcgggcgcgagctggtcttggtggtcttggaagcgcactttgcagtgggggcagagcttgggcagcaggctctggttgatcagaccggtcagcagggccggatcgaacagcaagccggggtcgacacccaggtccttgaggcgctggacaatgccgatcgcgctattggtgtgcagggtcgaccacaggccgtgcccggtcatcgcgccacggaaggcggcgacagcggcgaagaggtcgcgcacttcgccgatcatcatgtagtccggatccaggcgcatgccgttggcgatgcctgcggcccaggcctggcgttctgcgtctgggtcagtggcgtcatagaccagtggggtctggttgatgccttcgccgcgaatgcggtattccggtggatcctcgatggtcaggatatgcttggatccgccatgcagcttatcgagtccttccatggtgaccttcaaggtcatcgacttccctga

SEQ ID NO: 10181 - DNA, 1344 bp, Pseudomonas aeruginosa
cggccgccagaacaggccgctgacgaacttgttgccgtggtagctcaggatcgagacgtctggtccacggctaccgatgtcaggcttctccatggttcagcccagcacgacgggggtgatcagcaccacgatgacctcgcgtttggtattgcgggtcagcccgccgccaaggccgaagaatccggcgtcgccggtgccgaccttgttggtgtcctcggtggtctggtcgaagccggagagcaccaaggtctcaccgctgcgcaggcgtaccttctggtcgaacagctggatgtcgtagctagggaactgggctttggagtccccgctggtctgcatttcaaatgtagggcgggaggtcatgttgatgttgatcttcagcagcatctcgccgctttccatcacgaacggcagcaggctcatgttgtagccgctggtcacggcgcccgggatcagcgaggtggtactgccgacctgggcgacgttggagatctggctggaggccaggtagctgtcgtagcggccgatctggatcggcgccgactgaaggttgagcgtggtcacggacggggagcggacggtcgagacacggccctgctgggccagcgcctggaccatggccttggatcctgcccaggcgctgttggcggtatccaggatgctcacggagccggagatcgcactttggtcgatgcccggcatggtgttcttcaggccgatgccccacttgttgttgagcgacttgtagaccaggttccagtcgatccccagttgatccttgtcggtcagggcgaccgagagcacgttgacgttcagcagcacctgcttggtgatgctctcgttctcccggttgaccagctgctggacgcggttgaggacctctggtcggtcggtgacggtcagggtgcccgtggcacgcgacagcgacatgcgtcccatgctcggcgtcagcatcgagttgatgctgttctcgatgtcgctgaggatcgatgtcttcagctccgaactggtggtctgcttgctgccggagtcgccgctgatgccggagctgccattctgtccggtggatccggagccgtccccgctgatgccggcggccgtcgtcataccggaacgcacggtggagtccaccgtgttgacgtcgtcaaaggcgtagatgcggaaggtccgagtgtccaggtagtagaactcgacccgtttctcggttgggttgtagcgccaggacacgccggcgcgggcggcgatgagatcgaggaacccgctgaccttgccgttccatttgatgttgtacagagaccgcgggccgtaggacccgaagctcgacccgatgctgccgccggcacctag

SEQ ID NO: 10182 - DNA, 477 bp, Pseudomonas aeruginosa
ttgagatcctgcggctcccagcggaccgtccagcgtgcgcgcttggcccaggcttccaaggtgtcgcgcagggttgatcccgtctcggctgaccaggactgtgccaactgccggctcggctccgccggcgtgagcaccttgaccggaggggcggaagccacggccggagtgggcggcatggacttcacggcggaagccaagggcttgatcggtgccaaagccgcgggaggagaagaggggtggccatccttggccggtgctgctggggggaacacagtggtggattcaggcttcttggtcggagcggggctggttgtgatcggcgccggcgttggcaccgaggcgaccacgacgggcgactccagcgtgctgactttctccgtggaggagggttgcgctaccgccgctggagttggggcagcgggcttcgcatacagttgctggactggtttcggcctcggcgccgggggaagttga

SEQ ID NO: 10183 - DNA, 900 bp, Pseudomonas aeruginosa
aggagccaaggcatgagcgacagaaagagcgcagccgttgcgggcggatccgtcgcccacctggagcacgacgcatctataagccgcagcgcaggcgatgccagaccgttcatccaggtcaggaatgtctggcagcagtatggcgaccaggtggtgctggagcgcctgaacctgaagattgccgaaggtgagttctgcaccctggtcggtgcctccggttgcggcaagtcgaccttcctgcggctgctgctcggccaggaagcgcccagccgtggcgagatcctgctggatggccagccattggcagacgaaccggacgccagtcgcggcgtggtctttcagcgctactcggtatttccgcacctgacggtgctggacaacgtcgccctcggcctggaactcccgcgcgccccgctgctgggtcgtctgctcggacgccgcaagcgcgatgcccgtgagcaggctgcgcagatgctgcacaaggtcggcctcggccatgcgctggacaagtacccggcacagctctccggcggcatgcaacagcgactggccatcgcccaggcgctggtgatgaagccccgcgtgctgttgctggacgagcccttcggcgccctcgaccccggcattcgcaaggacatgcatgagctgctgctggagctgtggcgggaaacccggctgacggtgttcatggtcacccatgacctctcggaaggcttcaccctcggcagccgcatcctggtcttcgacaaaccgcgcatcgatccccacgccccgggtgcctatggcgcacgggtgacctacgacattccgctgcacgagggccgccatgctcccggcgcgtccgcaggcatgccgaccgccctcgccgactcttttcgcactgcctatcaaggagcctga

SEQ ID NO: 10184 - DNA, 1350 bp, Pseudomonas aeruginosa
agcggacagccgcctggtcgcccccctctccggcgacacccacctgttgctggaaatcggcgcgccggagctggacctggtgctgcgcttccgtggtcatgcactgatgcaggccctcgaagccaagcagctcgatggggtgatcgacctgacccccggcatccgctccctgcaggtgcactaccagcccgagaccctggcgctggaggatctcttggagatcgtcgccggcctgtgggatgccgtgtgcgccgcgcaggatctgaaggtgccctcgcgcatcgtccacctgccgctgtcctgggacgacccggcctgccagttggccatcgagaagtacatgaccacggtgcgcaaggacgcgccctggtgcccgagcaacctggagttcatccgccgcatcaacgacctgcccaacctcgacgcggtgtaccgcacggtgttcgacgccagctacttggtgatgggcctcggcgacgtgtatctcggtgcgccggtggccactccgctggacccgcgccaccgcctggtcaccaccaagtacaacccggcgcgcacctggaccgcggagaactcggtgggcatcggcggcgcctacatgtgcatctacggcatggaaggcccgggcggctaccagttcgtcggccgcaccctgcagatgtggaaccgctaccgcgcggtcgaggcgttcggcggccagccgtggctgttgcgcttcttcgaccagatccgcttctacccggtctcggccgaggagctgtcgagaatccgccgcgattttccgctcggccgctacccgctgaagatcgagaacaccgagctgcgcctgtccgactaccaggactttcttgccgccgaggccgacagcatcgacgccttccgccgccagcagcgcggcgccttcgacgccgagcgccagcgctggatcgaatcgggccaggcgcacttcgagagcgaggaagtcgccgcagacctcggcgaggacgccccgctcggcgccggccagctcggcatcgagagccacatcgccggcaacctctggcaggtgtcggtggccgagggcacgcgggtcgatgccggcgacgtgctggtgatcctcgagagcatgaagatggaaatcccgctcaccgcgccggtcgccggcgtggtcaaggaagtccgcgcccagccagggtcgccggtgcgcgctggccagcgggtggtggtgatcgaggaggcgtgaggcccctcggcacccgaagcaaccgtagggtggatcgcgctttatcgatccacccaccggcccagcgggccggcaacgaacatcgcggtggaaaaggtttcgccgttttcaccttacgagggacatga

SEQ ID NO: 10185 - DNA, 636 bp, Pseudomonas aeruginosa
cggctcggccttcggccagatcaagaccttccgcttcggcataccccagcacctggaatttttcggctgcgcggaaagcgcggcgttgttcgccgccaccatcgaacagctgaaagccctcggcggcgagccggtggaagtggacttcgcccccttcctcgaagctgcacgcctgctttacgaaggcccctgggtggccgaacgctacagcgtggcgggcgcgctgatcgagcagcagcccgacgccgtgctgccggtaataaaagccgttctggagaaagcccccggtacaaccgccgtgcagctgttccaggcgcaataccgcctgcagcaactcaaggccgtctgcgaccgcaccatggccgaggtcgattgtgtgctgacgcccgcctacccgcgcccagtgacgctcgccgaacttcacgccgagccggtcaagcgcaattcggacctgggctactacaccaacttcatgaacatgctcgactacgccgctgtcgcggtgccggccgccaccatgcacaacggcctgccctggggcgtgacgctgttcggccgggtgttcaccgaccagtacctgctgagcctggccgatgcgctgcagcatcagacagggctgaagttgatcggcggtaa

SEQ ID NO: 10186 - DNA, 1014 bp, Pseudomonas aeruginosa
ggaaatcacgccatgtccacactgcgctcgctgaacaagaccctcctcgccgccggcctggccgtcgcgacgttgttttcaccgctggccagccaggccgccgagaagctgaagatcggcaccgtggtctgggccggctatggccccttctacgtcgccgacaagctcgacctgttcaagccccacggcctggacgtggacctgcagttcttcaacgacccggcgctgatccccaccgccatggtgagccgcgcgctggacggtggcatgctcacctacgatcaggtagtggcctcggtcgccaagggcttgaagcaccgcgtggtgatgcccatcgacttctccaacggcggtgacgccatcgttgccgacgcgtcgatccagtccatcgccgacttcaagggcaagaaggtcggcttcaacccgctgtcgccctccgacttcctgctggcctacgcgctgcagcagaacggcatgagcgacaaggacatcaacgccgtcaacatgactccggaaggcatccccggcgccatggcctcgggcaacctgccggtcggcgtgacctacgagcccaacgtctcgcagatcctctccatgggcggcggcgacaaattcaaggtggtctattcgtccaaggacgcaccggggctgatcaccgatgtgctggtcttcgacgaggcggtgatcgccaagaagcctgccgccatcaaggcgatgatccagggctatctcgacggcctggcctacatgcaggcgcaccctgaggagtcggcgaagatcatcggcgacgtgctcggcgtcagcgccgaggaagccgtcgagcagatggccggcgcctacaacatcccccttgcggagatgggcaagagcttcaccccaggcgacgacacccattccttccatggcagcggcgcgatcatcgccaagctgctcaaggacaacgggcagatcccgaccatcccggatttcagccagacctacgacgcccagttcaccgaagcgctcgcccagtaa

SEQ ID NO: 10187 - DNA, 1068 bp, Pseudomonas aeruginosa
gccgacgccgggcgggccgcggcccgcctgtgctggagaaaaaccatgactgccaaacctctgtaccgttacgccgatggccgcctgcccaacacgctggcgatcctctataccgcgctcgcctacggcggcggcctggctctgctgttcgccggtaacggctggctgaacgcgctgggcacgctgctgctggcccacggcatgatcatcgccgcctacctgatccacgaattcgcccacggcgccatcttcagcgtgcccaagcacaacgaatgggccggcaatgtctgcagctggctgtgcggcagctgctacgccgagttccaggacctgcgcaagaagcacatgcgccaccacgtcgaccgcgccgacgtgatcaccttcgacagcaaggccttcctcaaggcacgcccgctgtggttccagaagctggtgctggcgctggaatgggcctatgtgccggcggtggagctgatcatgcatttctatgtgatcgcccttcccttcatcaccgacaacgacaagcaccgcgcccggcgcggcaaggtcgccgcggtgctggccattcgcacactgctctttgccgggctcgcggtgctctcgctgaaggccttgctgctctacgccgtggcctggatgatcatgctcagcgtgctgcgtttcgccgatgcctatcagcacacctacgaggccttcgccgtgctggaggacggtggcaagctgccggaggacaagcgccgcgaccgcagctacgagcagcagaacacctacagcaacgtggtttccgagcgctggccggcgctgaacctgctgctgctcaacttttccttccacaacgcccaccacgagaagccggtggcgccctggtatcgcctgcccaagctgcacgccgagctgtacggcagcacctacaaccaggtcatcccgatgcgcaagctgctcggcagcttccaccgctaccgcgtacgtcgcgtgctggacgatgactacggggtggtcagcgaagggccgaacaaggccgacaacttctacggcgccgtgggcgtctcgttcctgacggcggtgtga

SEQ ID NO: 10188 - DNA, 1311 bp, Pseudomonas aeruginosa
cctcgcctgccgcggcctcaacgccgatgtgctgatcaacaacgccggcgtcgagtacgccacgccgctgggcgagtgcagcttcgaggccgatcagcgctggtcggccctgctggagaacaacgtcggttccatgcagcgcctgacccgcgcattgctgccacgcctgcgcgccggcgccagcgtgatcaaccaggcctccatctggggactgaaaggcgtgccgggcttttccgcctatgtcgccagcaagcacgcggtggtcggcctgacccgctcgctggcctgggagctgggcccgcgacgcattcgggtgaacgcggtgtgccccggctggatcggcaccgatgcggccatgcgctcgctgaaggtgatggcggacgccaacggccgcagcgacagcgccgagctcgcggcgatactcgccaaccaggccattccggagctgctgacaccggccgatctaagcggcaccttcctgttcctcggctcaccgctggccgccgccctgaccggccaggcgctgtcggtcagccacggcgaggtgatgcactgatggctgccatctttaccgggctgaccgctctggtcaccggcgcagcgaccggcatcggccgtgccaccgcactcgcgctggccgccgaaggcgcgcgggtctggatcaatcatcgggatcaacacgacctggcggaacgagtggtcgagcagatcatcgccagcggcggctgcgcctgggccatcgaggccgatgtcagcgatccggttgcggtggcggcgatgttcgagaccatcgaggcacagggaccgctggatctgctggtcaataacgccggggtgatcctggaaaagccctttctcgaaaccagcgaggcggactgggcaagggtactgggcgtcgacctcgccggcgtctaccgctgctgccgccatgcactggcacagatgcagccgcggcgcagcggcgccatcgtcaatgtcgcctcggacctcggatttctcggccgcgaacagtacgtcgcctactgcacggccaaggccggggtgatcggcctgacccgctcactggcccgcgagttcgctgcagacggcatccgcatcaatggcgtcgcacccggccccatcgccacggcgatggtcagcccggagcacatgagcgacgagtggatggccaaggagctggcgatccccatggcgcgcctgggcacgccggaggaagtcgcggcggccatcgtcttcctgctttcgccgcaggcgagctatttcaccggacagctgctcgggcccaacggcggctcctggatgggcgcatga

SEQ ID NO: 10189 - DNA, 1248 bp, Pseudomonas aeruginosa
ccctcggcgtcacgagcgaagcgctggacgcacccggcgcgaacgactggctggcgctttccgccggcctcgccttcagcctcaacaacctcgccactcgcgccgccgaccgggtgccactggcgagcaaggcgctggtcagtttcatcgggcaacgcgctgcctcgggagggctgttctgcctgctgctgccaccaacccacttccgcccctgaatctgaccctgagctggcagatcgccctgctcgccctcggctggctggtcagcatggccgccgtgcagtacggcctgactcatctggaagccggccgcgccgcggtgctggtggtgttcgagctgatcgccgcggtgctgtcgtccgcctggttcggcagccacgccatcggcccgaacgaatggctcggcgccgccctgatcaccaccgccgcgctgatcgccggctggccggaacgtcccctttcaatcgcgacaaggagcacctgcgcatgaccgtgcacatggatcaactgagctgggtcgattacgaacgccgcgtgcgcgaaggcgccgtggtctttttgccctgcggcgccaccgagcaacatggcccgcacctgccgctgggcaccgacgcgctactggccagtgccatcagcgcggacgtggcggcacgagtcggcggactggtggcaccggcgctgtcatacggctacaagtcgcaaccgaaatgcggcggcggccagcacttctgcggcaccaccagcctggatggcgcgaccttgagcgccctggtgcgcgacgcggtgcgtgagttccatcgccacggtgtgcgccgcctggtgctggtgctcggccattacgagaaccagtggttcgtcgccgagggcatccagctggcgctgcgcgacctcgggccggacgccgggctggaggtaatgcgcctggagcattgggatttctgccacgagcagaccctgaccgacatcttcccggaaggcttccccggtttcgcgctggagcatgccgcggtgatcgagacctcgctgatgctgcatttccatccgcaactggtcgcgctggagaagattcccgacgacgccccggccgactttccgccctacgacatgtaccccacccgtaccgaatgggtgccgccctccggggtgctgtcctcggccagaggctccagcgcggcgaaaggccagcggctggcccacgacatcgtcgaaggcatcgccgccgcggtgtgcaaggagtttgcgctgtga

SEQ ID NO: 10190 - DNA, 846 bp, Pseudomonas aeruginosa
tcgcgcccgaagcacgtcatttgcggagcattacccatgaaaaccgttcccgatgcctatctcggcgtctggcgccgccgcctgctgaccaccacggccggcctgcgcgacgaaaccagcgaagtctactggctgcagaccgcctgcctgcacgccgacctgcgtctgccggggggtcaacccgtggcaccggcagcttcgcttgaaacctgcagccatgcccagcagttggcgctgagtgaacaggccggctttgccggcatcaccgaggtcaacggcgatatctgccagtggcatcgcctgatcgacttccagccgccgggcgggcctgcggatatcggcctgatgcgcttcgagaccccggaacggctgctggaagacggactggacggcagctatcacgaaatctggcagcgcctgccggaatcgcaggggcgaaactgggggatctggctgcgcgcgtcggagcagccagcccgccaggcctgcctgctggtagcgggcgactacttcctgttcgccgccgagcggccgattctgctgccggccagctcggggcatctgcgtgaacagctggccgccgtcgagcccgcgttgtggccgcagctgctggcctgcgagctgtccttcggccgccaccgcaacggcgccacgccctggcagatcacccattcgacgctgcccggccgcgtcggcgacgctctgctgtcgagctactggaacttcgccgaccccgccagtctgcccgccgcggacctcgccgcgctgggccgttatccggcggccggcggctggcaacgcgtcgaactggatgtgcccaccgctacagagaaggtccccgcatga

SEQ ID NO: 10191 - DNA, 939 bp, Pseudomonas aeruginosa
ggtgcaggcgctgcagtcgatcgacctggacatccagcccaacgagttcgtcaccttcgtcggcgcctcgggctgcggcaagtccaccctgctgcgcatcatcgccggcctggagacgctgagtcgcggcgagatcctgctcgacggcaggcccatcgacggccccggcgtcgaccgcgccatggtcttccagcactacagcctctacccctggctgacggtgatgcagaacatcaagttctgccgccagctcaaggtgatcggcgataccgtgcgccacgatggagacgtggagtccgccgccggccgcgccgatgccctgctcaacctgatgggtctgacgcgcttcgccgatgcctaccccagccagctctccggcggcatgcagcaacgcgttgccattgcccgcgccctgctgcccaaacccgcgacactgctgatggacgagccgttcggcgcgctggatgcgcaaacccgcgaagtcatgcacgacctgatccgtcacgtgcaccggctggagaagagcaccatcctgttcgtcacccacgatgtcgaagaagccatctatctgggcagccgcatcgtgctgatggcgccacgccccgggcgcatcgattccatctacgaggtgccgctgccggcccagcgccaccaggacatgaagctcgcgccggaattcaccgagctcaagcgcgagatcctcgcccggatccgcgaaacctccggcatgcagaccgacctcgagcaactggccaaactcagcgccgtggccggctgaaggctagcggccaagcagttcggccattgccgcgaacacctggcgcatggccgccgcgctgcggcccggcccaccggcacaatggccccagtccgattcgagcacccgcagctcggcacccggaatcagcgcggcctcgtggcgggcatcctcgacggtga

SEQ ID NO: 10192 - DNA, 477 bp, Pseudomonas aeruginosa
aatacagatcgctgctgccgggcatcaggatggaccgcgcacggatgcgacccagcgcttcggccagcgagcccgcagcgaaactgcgggccgggtcggccgattgccaggtatgcagcacgcagagcaggtcgttggcgtcctgctccagatgatcctgttcccagtagtcgagcagcgcctcgaggctctcgaaacccatctcgcgccacagctcatgacgatagaacgcctgcgaataggcccagccggcataggcacggccgaaagcccgcagcccgcgttccggcggcatgctgtagcgccctcccagccaggcggcgtcggcgcacagcgccgccttcaccccttcgagaaacacccggttatgtggccagcagcgtgccgtacagcagaacggcaggatggcacgcatccgttccggataggccattgcccagaacagcgtctgcatgccgcccatggaccagccgctga

SEQ ID NO: 10193 - DNA, 315 bp, Pseudomonas aeruginosa
tggcaatcatggccagcgacacgccgcaaggcgccgagctacgcgcccagctgggcgcagcttccggtaccgaccaggccggctacgaggcgcaactcaagggcacccacatgttctatcagccagccgaagcggtcgccttcatctccggcgaaccggcccacgaagcgatggacagcgtgcgcaagttctccttcgaccacggcctgctgggcgacggtgccgattcggcggactttgtcggtatcgccatgccggccggcgcgctcggtgatcagggcaatctcaagctgcgcttcgacaccacctacatga

SEQ ID NO: 10194 - DNA, 732 bp, Pseudomonas aeruginosa
agatggccgccgacggcgctctgtgagggcttgccacgcagcgggccttgccggcacgctgcgtggccgccgcgcatttcgaggagcctcatgcgccgtaccaaagaagacgccgaacagacccgcctcaagatcatcgccgcggcgctcgagctgttcagccgcaacggctattcgaacaccaccctggcgatgatcgccgaggccgccggcttcagccgtggcccgatctactggcacttcaagagcaaggacgagctgtacgaagcggtgctggcctactcccaggagccgctggagcagctgatcgagcagagtcgccagctggccggtagcccgcaggctgcgctggagcacttcgtcggcgaatggtttcgcctgctgctggacgagcgctggtatcggcagtccttcgagatcctgctgaacaagaccgaactcaccgcgcagatggcgagcaccctgaaacgcgaacgcaagctcacccgtgccatggtgcagttgctggaagagctgattgccaaggcgcacgcggatgaaggatcggcgcgatcactggccttgctgctctattcgagcctgatgggcatcacccatacctggctgctgtcgcccaagctcttttcgctgagggaacaggcaccgtttctcaccagacgtctgttgagctcgctggcgccgggcttggagatggcaggcgggacaagcggaacgggtcgatcagccgagtag

SEQ ID NO: 10195 - DNA, 2856 bp, Pseudomonas aeruginosa
gctaatggcgcatgcagacattgcagtgaataccactcacttgactgcggaagccttggcaatcgaattggagcggaggatcagacggctcccgctcagctgagcaaacatgctcgtggccggatcgctgatcatgcgttcgcaccggccatgctacgcgactcttccggtagactgctgccagccccaatggggaatctttattcgcgcgcccaaggaatttcctggatggactcaaagcagctgacccaaggcctgcaccaggctttttttgctgaaaaccatcgaatcgtcttctggtatgaccccgagcaaaactttgccgatgcactgaacgagctcgacttgcctgatgtgcaggtgctgaacatgcagggcaagtcgacctttggcactaagttgcagctggaacttgaagatacccagggtaaatacctgctgtatttcccctgtgccgagcctgacgcggaagatgactggctgcttgatatcaagctgttctcacgaagcttttatgcagaccgggtgtcgatgatttttaacgagttgggtttgcagcaggtgagcctgcgcgagcatctatctcgtagagaaagcttcctcaaaagtaccgcgcgggtttctgcgctcaagcgccttatccaatcgaatgcgactgccgaagagttggaccaggcaatgattgcggtgcttctggggtctgcggcgtgcgatatcaccaccttgctttgcacgttggcggatcagatcgttcgggatgatctcggtcttgagagcaatcctggcgttatcgacgagctgtatcagcatggactgatgccagcgttgctgcaggctctgcgtgacgaagtgggttacccggccagtgctgaagaaataagtggcgagaagccattcagctttgggcattttctgattcgccttttggcaaccggcttctgtgaaagcatttctgagatccctgactgggcttctgcaatcgcaatcccgtcagccagcgcccgtgctacatctcgagccctgctatcgcgctggcgagacagctctcggttttacaaaagctatgacgttgtatcgtcctgggttggagaggcattgcgcatctccgacaagcttggcgagctgtcgctggaaacactggccaatgtcgccaccttcgaagcggtggagcggcagatcattatcgatctgaaccaagccatccctagcgccgctccaagcgacctgcaggtattctcacgcatcatcggcgagcgcctcgacaactactgggcatcgcgccacaaggacgacgagatccgtcgcaagtatcgactgctctatagcgccctggccgcagccatcgagctgttcggcctacgcctgcagtttggtgccggcttccactattccggcacggaggcgctgtacaaggcctacgagggcgagctgtaccgcttcgacagcgcctatcgacgctatgtggctgcgtcgcagcgtgctcatgtggaactgctgaagaagctcgatgaagaagttgagcagtgctatgcctactggtacctcgaccaactgggccgcaactggggcgactgcgtagaagccgaacagcgcctgacacattggaagatcgccggtgtgcccaaccagcagaacttctacgaacgctgggtacagccgcagttcgagaaacaccgtagcaagcgtatagccgtgatcatcagtgatgctttccgctacgaggccgcagtcgagctgcgcgagcgcatcaatgaaaaacgctacagcgaggcaaccctgtccagccaattgggcgttctacccagctatacgaccctgggcatggcctccctcctcccacaccagacgcttgaataccgagagagtgccgccgatacagtttttgtcgatggccagtccaccgccggcaccatacagcgagacaagatcctcgctcagtaccaaggtatcgccgtaacagctgatgaggtaaaggcctggtcgcgcgacgaaggtcgtgaaaggctcaaagataaacaactggtttacgtctaccacaatgtgatcgacgaccgcagtgacagcggtggtccgtcagagtcagacactttccagcatgtggaagtggccatcgaagagctgaccgagctgacccgcaagatactcatgcacttcaacaccagcaccgtcatagtcacagctgaccacggcttcctcttccagcaaagcaagttggaggcggctgaccgcactgcgctggtcgacaagccaggtagcgccttcaagagtaaaaagcgttatgtccttggccatacgctgccagaggccaaggatgtctggcaggggtcaacaaagcatacggcgggcaccgaatcggatacacgcttctggattccgaagggcgctaatcgcttccacttcgtcggtggcgcacgcttcgtgcacggaggggccatgcctcaggaaatcgtcgtgccggtgctgaccgtcaatcagctgcgcggtgagaaagccgagaaacgcacccgccgcaaggtcggcgtgatttcgcccaagtccgttctgaagatggttaacagcattcagcgcttcgacctgatgcagactgaagcggtcagtgagcaggtactcccggtaacggtagcggttgctattttcgaaggcggacagattatttccagtgaagaagtggtcactttcgactgcaccactgattccatgaatgaccgcttgaaacaagtacggctatcgctggctggcagtgactttgatcgcaagaaagattatttcctggtcatccgagacaaggatctgaataccgagctggagcgctaccgggtcacgatagacttggccttcactgatgatttcttttaa

SEQ ID NO: 10196 - DNA, 2181 bp, Pseudomonas aeruginosa
gagcgggcacgcatggacaacgaactcaataaagacctcgatcatctgctgaacgagcactttgccgggcgtgtggtacgcaaggatctgaccaagctcatcaaggaaggggcaaacgttcccgtctatgtgcttgagtacctgctaggcatgtactgcgcctccgacgacgccgaagtcatcgagcagggcctgaagaacgtcaaaaccgtactggctgaaaactatgtccgaccggacgaagctgagaaggttaaatccctggtacgcgagcgcggtacctacaaggtcattgaccgcgttaccgtgcgcctgaacgaaaggaaagaccgctacgaggcatctttcagcaacctgggcattaaggatgcggaaatctccgctggcatcgtcaaagagtacgaaaaacttctggtcgggggcatctgggttatcgcgaccctgagttattaccacgaggagggtcagtcaggatcgcccttcggtgtaactctgctcaaacccattcagatgcccaacatgaacatgcaggagctgttcaccggtcgctcggcgctgaccaccctgcagtggcgcgagactctgatccgttcaatcggcatggaaccttcgaccctggacgagtcagttcagtggcacctccttgcgcgcatggttccctttgtcgagaacaactacaacgtctgcgagctggggccacgaggtaccggcaagagtcatatctacaaggaatgctcccccaacagcatgctggtatctggtggccagaccacagtagccaacctgttctacaacatgagcagccggcgtattggcctggttggcctgtgggatgtcgtcgcgttcgacgaagtcgccgggatcaacttcaaggacaaagacggcgtgcagatcatgaaggactacatggcctccggatccttcggtcgcggtcgagagcagatggaagcctcggcctctatggtttttgtcggcaacatcaaccagagcgttgaatcgctggtgaagaccagccacctgctggctcctttcccagagcaaatgatcgattcagccttcttcgaccgtttccacgcctatatccctggctgggaaatcccgaagatgcgcccggagttcttcaccaacaaatacggcctgatcgtcgactacctggccgagtttttccgcgagatgcgcaagcgcagctttgccgatgccatcgacaagcacttcaagctgggcaacaacctcaaccagcgtgatgtaatcgcggtgcgcaagaccgtgtccggtctgctcaagctgctctacccgcacgatcaattcaccaaagaagacgtgcgccagtgcttggaatacgccctacaggttcgccgccgggtgaaagaacagctgaagaagatcggcggcatggagttctatgatgtgcacttcagctacatcgataacgagaccctggaggaatgcttcatcgccgtgaaagagcaaggcggtggtgggctgattgcggaggggccgggtaagccaggtttcatccacaccatcggcctgagcggtaaaggtatgccggggctttaccgcatcgaactgcaggtcaccaagggcagcgggaagctggccacctcaggcctttggaactccaccatggccaaggagcaggtgaagatcgccttcgacttcttcaaggccaacgcctcgcgaatcagcgcctcgaccaaggtgctggaacacgacttccacctgcatgtggtcgagttgcaaaacaccggcccgctaacccatatggcacttcccagcctggttgctttcgcctctggtcttctgggtcgtcctacacagtcacagatggtggtgcttggcgatatgagcctgggtggcaacatcacgcccgtggaaagcatcgcagaatgcctgcaggtggcgtttgatgcaggtggtaaacgtgtttgcttaccgatgagcagcgccattgatataccgacgattcctgccgaattattcaccaagtttcagacgagcttctatagcgagccagtggatgcggtctttaaggcgctgggggtggaccaatgtcatcaacctaagctgcagccctgcccaaggcaagccccccgaagcagccagccgccatggccgtcgggcgatgaccaggcctctgccgctcaatcaggcggtctagctgggctggcggtgatgtga

SEQ ID NO: 10197 - DNA, 1194 bp, Pseudomonas aeruginosa
cgtgctctcctgctccgccttgcggcgcttgagctggtcgcgaagctgagtggggaggctgctgatccggagtgtgtcgcgctcctcgtcgtactcgatcctggagcccagcaggtgcgcctcgaagctgatcgacaggccttcggcgcggccggtgaagcggcggaactggttgagggtgcgcttgtccgccgggatttccggcgacaggccgtagtccttgttacggatgtagtcgtagaacgcccgcggttgctggtcgtccatcagttccgaaagcgcgtcgagggtcatcggctcgccgatgcgcgcctgggaggtggcgtagtcgaccagcgtctcggtcttctcgcgggcctgttcctcggccatgtcctcgctttccacgaaatcgctgaaggctttcagcagggtgcgcgtctcgctcggcgaatccaccccttcctggcagccgatgaagtcgcggaaatagtcggagaccttcttcccgcccttgcccttgatgaacgagatgtactgcttcgactgcttgttgttgcgccattcggaaatgttgatccgcgcggccaggtgcaactggccgaggtccaggtggcgcgacggggtgacctccagcgactcgttcaccgccacgccttcgctgtggtgcagcagggcgatcgccaggtagtcggtcatgccttgctggtagtgggcgaacaggacgtggccgccggtggagagattggactcctccatcagcttctgcaggtgctcgaccgcttcgcggctgaagccgacgaagtcgcggtcgccctccaggtattcaccgagccagccgctgaacgggtaggccccggactcgccctggaagaagccccaggccttgttcttggcgttgtagctttcgttgaggtcggccagcaggttctcgatggcctgggagtcgcccagctcggcgtcgcgcgcgtggagcacggccggggtgccgtcgggcttcttctcgatcaggtggacgatggcgtgtttgataggcatcagaaagactcctggttcagggaacgctgcctgtcggctcgacggagcagggcgcgggcattgagctcgccgcgtgcgtcgcttggcgtggaagagatgaagatcgaggcgcagccgatcttgctgagcttcaagtggccgccggcggagcggtcgacgctccagccttcggcttga

SEQ ID NO: 10198 - DNA, 1311 bp, Pseudomonas aeruginosa
ggcccggccgctccatcgaacaggaagcctcccggtacgggtaccgggagaatcgattcacaggttgtagtggcgacctatcattggaacggtcgccgcagccccgtataccgagttccaggactgccagccaaaattgatgccgatcagtccgccatggatctggttggggatttgtggctccagcctgccgctggccgaagaacccatgacattcccctggttccaggcgaccaggccgcccagcagacccgagcctccgaccttgccggaagcggaagcgccgctgatggtggcggtgctgaagcccaccagcccgccaatatagctgtcgtagcccgccgtcacatcgccgccggccgaggcccccaggatgagagcctgccagccctccagggagccgaccagtccgccggccctgatcccggcgcctccgctcaccgcaccgctggccttggcggagcggatcgaggtgttttcaccgcggccgaccaaccctcccaggttgtggccggtcttgtcgttcacgattccatgactgctggcgagcatcagcgaacctcgcaggtcactgccgatcaacccgccgatggccctggaaccactggcgctgacgttgcccgaagccgagacgttcgtcagagaggcggcatcgttatagccgacgagtccgccgacgcgactgcccttgcccccggtgacattgccggatgccgccagggtgctgtggttgccgccccggttgtggccgatcagccctcccacgtcactgttcgcccctgcgtttacccacccggaggccttcaggttggaatgattgccgccgaggttggaccctatcaggccacccagggttttgccgctgccgtcggtgacttcgccactggcggaaccgttgatgacggagccgtacaggttttctccgagcagaccgccaaccgcttctgctccgcgggtagcgacattgcccttggcggaggcattgaccagcgaggcattggcgttgagaccgatcaggccgccggcctggagcagcgacccaccactcaggttgccgctggcactgacgttggccaggttgcctgcctggttgtggccgatcaggcctcccaggtagcgaccggcttgcaggctgacatcgccatgggcgctggcgttgttgatggccgcgttcaggttccggccgatcagcccgcccagtgcttccgcgtctgtgccccggaccttgccgctggccgtggcgtgggcgataccactgtttacgttgaggccgatgagcccaccgtacaggccgcgctgtccgttgcctga

SEQ ID NO: 10199 - DNA, 546 bp, Pseudomonas aeruginosa
tggccgggcatgacggtcgccgtggttacctccagcacctggtggtcgatcccggttatcgagggctggggctggcgcggcggatgctcgacgaggtgttggcacgcctggcgagggaggggatcggcaaatcccatgtcttcgtcctggatgccgccgaggaggcccaggcattctggcgagcccagtcggactgggagcggcgcaaggacatccaggtattttccactcgggagggacacgcgtgaaacgattgcattgggttctgctggccatgctgctgcccggcctggcactggccctggagaagggctccaccctggaaccctggacgttgcaggaccagttcgaaaaggcgcactcgctggacgactccacccgggtcctgctggtggcgcgggacatgggcggctcgaagctggtcaaggcggcgctggcggaacgcccaaagggctacctggaggcgcgccacgcgctgttcctggcggacatcagccgcatgccggcgctgatttcccggcttttcgcggtgccggccatgcgtga

SEQ ID NO: 10200 - DNA, 855 bp, Pseudomonas aeruginosa
ctacagttatccggtgctgctcgatcgcgacgcggccatcgcttctcgctatgcctcggacgagggcaaggtgctctgggtcaggctggagcagcgccgcgtgttggaaacccgccagttggattcgccggtggccctgcgcatcgccctggaacaactgcagccgtgatcgctgccgagttgctgtcggcggaaagcctggaactgggctgggccatctatgcgccggtgctgctgctcgccgcctggcgcgcgccctgggtcgagctggtcagcgatacccgccgccagcacctggtgttcggtaccatgctcgggctgttcctgctctggctggtgcgccgggacttcgaatcggggctgtccttccatttcatcggcatgaccgccgtcaccttgctgctcgactggccgctggcgatcgtggtggggctggtggcgcaactgggcttgtgcctgctcggccgccaggattggctggcgatcggcgtcaacggcgtgctgctggtggcgatccccgcgctgatcgcggagctggcggcgttgttcgtggaaaagcgccagccgcgcaacctgttcgtctacatcttctgctgcggtttcttcccggcggccctcaccgcggtggtggtcctgctgctcggccttggcgtggtctggatcgacggccttttcccgatgccgccctggctggaggacttcgccggttacctgtggctgatcatgttccccgaggccttcatcaacggcacggtgatcaccggcctggtggtctactacccggagtggctggaaaccttcaatcgcacgcgctacctgcaggcaccctggaaggacgaagagcgcaagccctga

SEQ ID NO: 10201 - DNA, 312 bp, Pseudomonas aeruginosa
ccagtcattcgccaggttcatggcgggcagcggctgacttgcgtcagtgtttcggacgaagccggccgcgatcctgccgttttcccaggtgaggagcggaacatgggtgtccatgaatgggcccgacagggcctgcgagagttgctgtcgaagagcgacgaggcggaccgggcaatgcgcctgcgcgcgttgctcagcgcaatcgtcgaactgaaccgggcggagcgcgatgctggcgacctggccagcgaactgcaatttcttgcggagaatctcgatgaccagcgcgactacgctttcatgcgcccctga

SEQ ID NO: 10202 - DNA, 258 bp, Pseudomonas aeruginosa
aaggcgtgcagtcgttcgacttcacgctgcaggtgggacaggtcgccgtcgttgaccagcacgtcgtcggcgtgcttcaagcgctcgtcgcgccgggcctgggcctggaggatcgagcgcacctgctcctcggagaccttgtcgcgaagcatggtgcgctgtagttgcagatgttccggggtatccaccaccagcacgcggtgggtcatctggcgctggccggactccaccagcagcggcgagaccaggatggcgtag

SEQ ID NO: 10203 - DNA, 837 bp, Pseudomonas aeruginosa
cgataccgtcttgcccgagccggtggggccggtgaccaggatcatgccctgtggctgcttgagtgcggccaggtagagttccttctggtcctcctcgtagccgagggcgtcgatgcccatttgtgcgctggaggagtcgaggatccgcatcacgatcttctcgccccacagggtcggcagggtgttgacgcggaagtcgatggacttgctcttcgacacgcgcatcttgatccgtccgtcctgcggtttgcgccgttcggaaatgtccaggccggccatcaccttgagtcgcgcggaaatacggctggccaactggatcggcggcttggccacttcgtggagcatgccgtcggtacggaagcgcacccggtagatcttctcgtagggctcgaagtgcaggtcggaagagccaccctttatggcatccagcagcatcttgttgacgaaacgtactacaggagcgtcgtccgcttctgcgctggtatcctcctgggtggacttttccgcgctaccgatatccagtccctcgaggtcaacatcgtcgaggcctgcgagaccatcggtagcgctttcgaacagtttgtcgatggccaggccaagcttgtcgtcttcgaccagaatcgcttcggtcgtcaggccggtgctgaactggacatcattgatggcctggtggttggcgggatcggagatgcctacgaagagcttgttgccgcgccgccacaaagggatgacccggtgctggcggaccagcttttcgctgatggcgtcccgcggaaagctttccttgtccaggctattcaggtcgcagtaggcgataccgaactgctcggcggataa

SEQ ID NO: 10204 - DNA, 567 bp, Pseudomonas aeruginosa
cagcgcctcgatcagccaggtgctggatgtgatcaagggcatcgccgaacagaccaacctgctggcgctcaatgcggcgatcgaggccgctcgtgccggggagcaggggcgcggtttcgcggtggtggccgacgaggtgcgcacgctggccaagcgcacccagcaatccaccgccgagatcgaacagatgatcctgcgcctgcagggcggcgtcgatgcggcggtgaaggcgatgggcagcagccaccataccgccgatggcacggtcaacgagtcggcgcaggtgcagcaggcactggagaatatcctcggcgcggtgggcatgatcgtcgaccagaaccagcagatcgccgccgccgccgagcaacagaccgccgtggcccacgatatcgaccagaacatcgtcgagatcaaccaggccggcgagcgcaccgcggaaggcgccagccagaccgaacgggccagccgcgaactgggcgcccaggtgacccagctgaaacgcctgatcggcgcgttccgggtgtaggcgcaaggcctgcgcgggacgtttttcgtccatccgattga

SEQ ID NO: 10205 - DNA, 558 bp, Pseudomonas aeruginosa
aggcgttctacctctagcgcagtcgcctctgctacgaagagccccgcctcggcggggctttttcatgtcgctctggaagcctcgcggcgctcgtgtcagccttgttcgacaacccatgacaaggacgccgacatgacaggcaatggtgtttccctggtgaccctcggggtcgccgatctggcccgctcctctctctactaccaggcgctgggctggcagccctcttcggacggcaacgagcaggtggtatttctcaagggccgcaacctggtcctcggcctctacggacgcagcgccctcgccgaggatgcgcaggtggaagatcgtccgaccggcttcgcggctatcaccctggcctgcaactgcgcctcgcgggatgaggtggaccgtctgttctccgcagctacggcggccggcgggcaggcgaccaagatgccgcaggaagtgttctggggtggctactccggatatgtcgccgacccggatggacacctttgggaaattgcctacaacccgttctggccgttcgacgagcagggcaacctggtcttgccctga

SEQ ID NO: 10206 - DNA, 2310 bp, Pseudomonas aeruginosa
tctgcaataaattccgcgaccttcacagctcccggggaggggtttcgaatgtcgcgtcagtccacggataccgccgtttcttcgcaacgtctgctggcttcggccatcggtgtggccatcaccgccatcgccgcaccgcaggcagcccacgccgacgaggccgggcagaaaaagaccgacaaggaccgagtactgtcgctggatgcggccaccatcgtcggcgagcagcaggacgaaaccacctacaacgtcgaccgctcggcgtcgaagaagtacaccgcgccgctgctggatacgccgaagaccgtcaccgtgatcccgcagcaggtgatcaaggacactggcgccctgaccctggccgacgcactgcgcaccaccccgggtatcaccttcggcgcgggcgagggcggcaaccccgcaggcgaccggccattcatccgtggcttcaacgccgagagcgatacgttcctcgacggtatgcgcgacgtcgcctcgcaaacccgcgaggtgttcaacgtcgagcagatcgaggtcagcaagggcccgggctcggcctacaccggcgccggctccaccggtggcagcctgaacctgatcagcaagaccgccaagcaggacaacttcaccgacgccggcttcacctggggctcagaccagactcgccgcactactctcgacgtgaaccggatgattggcgacaacgccgccttccgcctcaacctgatgaagcacgatgcccacgtcgcagggcgcgacgaagtcagcgtcagccgctggggcgtggctccgaccgttaccttcgggttcgacacgccgacccgcgccaccctgtcctattaccatctcagcaccgatgacatgccggactacggcctgccgctgaccaacgtcaaccgcagcaaagccaatccgagcaagccggcctcggtggatcgcgataacttctatggcctgaaggaccgcgactaccgcaagagcaccaccgacagcggcaccttccgcatcgagcatgacctgaacgacaacctgaccctgtcgaatagcacccgcctggtgcgcacgacgctcgataacatcgtcagcaaccccgacgacagccgtggcaacgttgccaacggctacgtctaccgttcggcgaaaagccgcaattcgacctcgaagggctgggtcaaccagaccgacctgaaggccaacttcgaaaccggcttcatcaagcacaccctggtgaccggcctggagttcagctacgaggacgtgcacaaccgtccgtacgccattacttccggtggcggcgccggcaacacctgcaatgcacgattgctcgccagtggcgactgcaccagcctgaatcgcccgactccgggcgacaactggaccggcagcatcaccgacggcctggcctataccgataccgacaccaagaccagcgcggcttatgtgttcgataccctgaagctaagcgaacaatgggagctgaatctcggtctgcgctacgacgacttcgataccaagtccagcggctaccagacggctggccgcaacggtcccgccggctacttcaagcgcgagaacaacagccacttctggaactaccagaccggcctggtctacaaaccggcgcccaacggcagcatctacctggcctggtcgacctcgagcaaccccaccggcgagaccggcggcgagggccaggcggatatcagcgtaggcaacaacgggttggatccggagcgtaaccgtaacctcgaactgggtaccaagtgggccttcttcgacgatgctctgtcgctgaacgccgcgcttttccgcaccgacaagaccaatgcccgggtcgcttcgccggatgtctccactcttcaggtactggacggcgagcagcgggtgcagggcgtcgagctgggcttcaatggcaagctgaccgagaagtggaaggtcttcggcggctacacctacctcgacagcgaaatccgcaagtcgacggtgaagagcgacgaaggcaacaagatgccgcagaccgcgcagaacaacttcactctgtggaccacctacgatctgttgcagaacttcactatcggcggtggtaccacctatgtggacaagcagtacggcaacactgcgaactctacctatatcccgtcctactggcgctatgacgccatggccagctacaaggtgagcaagaacgtcgacctgcaactgaacgtgcagaacctgaccgacaagcgctacttcgaccaggtctacagcacgcacatggcccacgtcgctccgggccgcacggcattgctcggggtgaacttccacttctga

SEQ ID NO: 10207 - DNA, 1686 bp, Pseudomonas aeruginosa
ccgccgacagtctttgcgtgcatggcgacaacccgcagtcgctggcggtcctccggcgcctgcgcgcggccctggacagcctgtgatccgcatcgaacccgctggtgccgaagccctgctgctgacgctcgccgaagagcccgaagtggacctgtctgtgcgcctggccgagctggccagacgtctgcgcgaggggctcggcgaaggcgtcagggatctggtgccgggctggaccaccctgatgctgcattacgacccctaccgcatcgccccgcaggtactggaagaacgcctgggtccgctgctggcggagtggcacgcctggcgccccgccgaggatgccgggcgcctgcacgagattcccgtctggtacgccggcgaggacctcgcgacggtagcggttgcctgcggattgactggcgaaggagtgatcgaactgcacagcgcggccgaataccgggtcggcgcgatcggtttcgctccgggattcgcctacctcggcggcctcgatccgcgcctggtcctgccgcggcgggccaccccgcgggcgcgtgtaccggccggcagcctggccattgccgaggcgcagacggcgatctatccgcaggcctcgcccggcggctggcacctgctgggacgcagtccgtggcgtccgttcgatccggccgccactcctccgtgcccactggcgctgggcgaccgggtgcgcttcgtcgccatcgggcgcgaggacttcctcgacctgggcgggcgcgaatgaatggtttgcgggtcgtcaaggcgggaccgcaaagcctgctgcaggacgacggccggcgcggctggcagcacctcggcgtatccgctggcggccctctggaccgccaggcggcagcctgggccaatcgtctgctcggtaatccctgggggacgccattgctggaaatcgctttcggcggcttggtgctggagtgcagggtggaggcgacctggctggcgttgaccggagcgcgtctggcgctgacggtggacggtcgcgaatgcctgccctggagtcgcttccgggtccgccgcgggcaacgcatcgaactgggcttcgccgaggccgggcagcgtgcctacctggcctgcgccggcggtttccgggcgaggccggtactgggcagcgtcgcctgccaggttcgcgacgggctcggcggtttacagggcgatggccggatcctggcggagggcgattgcctgccgtgtgccgaagcgggagcggcgtgtccgtgggatgccagcgtgccctggcgtttccagccggactaccggcagcagcggcccttgcgcgtgctgctcggcggcgatgcggcggccttcgacgcagccagccggcaagccttcttcgccagcgcctggcgaatcagcccgcggtccgatcgcatgggtgtccgcctggccggcgagccactgcgcggggcgccgcgcgcctggtcgcagggcgtggtggagggcgctatccaggttccgcccgatggccaacccatcgtgctgatggccgaccgccagagcatgggcggctatccgctgctgggcttcgtccatccactggacctctcgcgcctggcgcaaagccccgcgcatagcgaggtaaccttcgtcgagagcgacctggcgacgcagcaggccgatctgctgcgcttctaccgcttcttccgcggctga

SEQ ID NO: 10208 - DNA, 2805 bp, Pseudomonas aeruginosa
gctggtggaaaacgcaagcacctgccctgccttgcgggcatagaatcgttatccgggtcaccttcctggagccgatacgatggacacgagcgctttcctgattgccctggcggtggtttacctggtgcccggaccagacatgctcctgctgttccagaccggcgcccgccagggccgtcgcgcggcgctggtcaccgccctcggcctggcgctggctcgggcctgccatgtgctgatggccgcgactggactggcgctgctgttccgtaccgctccctggaccttcgacctggtgcgcctgctcggcgccgcctacctcgcctggcttggcctgcagatgctgcgcggtggcggactggccttgccgaccagcgacgcgggctccgcgccggtggtccctcacgccgaccgccgggccttgctgcgcggactcctgaccaacctgctgaaccccaaggccctgctgttctgttcggtgctgctgccgcagttcgtcagccccggggccggttcgctggccgtccagttcgccgcgctcggtacggtcctggttctggttggcctggccttcgactgcgcctatgcgctggccggtggccgcctgggccgctggctggcgtcccggccgcgggcacagcgcctgcagcagtggggcttcggtgggttgttgatagggttcggggtaaggctggcgctgctgcgccagctctgaagggctgcggggcggcgagcgccccgtggcgctcagccgaggaattgctcggcgtggtggcaggccacctggcgctggtcgagcaggcgcagctcgggcacctcgctgcggcagcgctcggtggcgtaggggcagcgcttgtggaaggcgcaaccctccggcgggttcagcgggttcggcagttcgccctggatgcggatcttcggcttcgtcgggtccgggtggatcgccggggtcgccgagagcagcgcacgggtatagggatgcagcgggttctcgtagagcttgtccgccggccccatctccgccggtcggccgaggtacatcaccaggacgtcgtcggcgacgtggcggaccaccgccaggttgtgcgagatgaacacgtaggcggtgcggaactgctgctgcaggtccatgaaaaggttcagtacctgggcctggatcgacacgtcgagggccgaggtcggctcgtccgccaccagcaccttgggttgcagcatcatcgcccgggccagggcgatgcgctggcgctggccgccggagaacatgtgcgggtagcgctggtaatgctccggccgcaggccgacctggcgcatcatctgctggaccttttcgcggcgttcctcgcgcgacagcgcggtgttgatcagcagcggctcggccaactggtcgccgatcttctgtcgcggattgagcgaggcgtaggggttctggaagaccatctgcacgtcgcggcgcaactgccggcgctggtccttgctggcgcccttgacctcctgcccggcgattttcagcgagccggaggtgggttcctcgatcagggtcagggcgcgcgccagggtcgacttgccgcagccggactcgccgaccacggcgagggtcttgccggcttccagttcgaacgatacgccgttcagcgcgcgcacctgggcgtggcccttgaacaggccgcgggagacttcgtagtgacgggtcagatcacgggcggtcagaaccggtttccatcaggccacctcgttcagcaggttcaacggatagaagcagcgcaccgcgccgcgctcgtgtgcctccagggccggccgctcctggcggcaatgctcctgggcataggggcagcgtggcgacagcaggcaaccgcgcgggcggtcgtagcgccccggaacgatgccgggcagggtggccaggcgggcttcgccggcacagtgctcggggatcgccttgatcagcgcctcggtgtagggatgggtcgggcggtcgaacagcgccggcacgccgccgatttccaccgcttcgccggcgtacatcacgcagacgcgctgggcggtctcggcgaccacggcgagatcgtgggtgatcaggatcagcgccatgtcctggtcgcgctgcaggttcagcagcagctccatgatctgcgcctggatggtcacgtcgagggcggtggtcggctcgtcggcgatcagcagcttgggctcggcggcgatagccatggcgatcgccacgcgctggctcatgccgccggagagctggtgcgggtaggcgtcgagacggctggcggcggccgggatctcgacccgttcgagcagttccagggcgcgctggcgcagggccttgccgcgcaggccgagatgcaggcggaggacttcctcgatctggtagccgacggtgtagctggggttgagggcggtcatcgggtcctggaataccatcgccatgtccttgccgacgatgcgccggcgctggcggcccttgagggtgagcatgtcgtggccgtcgaagcgcaggtgatcggcggatacccagccgggggcgtcgatcaggcccatcagggccatcatggtcaccgacttgccggagccggactcgccgacgatggccagcacctcgcccttgtcgacgctcaggtcgaggccgtcgaccacgggcacggcggtggtgtcgccgaagcgcacgctgaggttcttgatatcgaggaggctcatgcggcggtctcctgtggcgcggatacggatgcgctgttcatggttgtgctcctcatgccgcgttcttcagtttcggatcgagggcgtcgcgcaggccgtcgcccatcaggttga

SEQ ID NO: 10209 - DNA, 1149 bp, Pseudomonas aeruginosa
acagcaggccgccgagggcgcccttgttgtgcgcgaaggcctgccagaattccttcagcggggacgggtagaccaggctcgggtcgctggcgggagcgttgtgcatggcgttcatcggctggctcatcagcgttggtggcgaatgcgcgggttggccaggccgtagaggatgtccacgacgaaattgaccaagatgaccagggtggcgaccagcaggatgccgttctgcaccaccgggtagtcgcgacggctgatggcgtcgatcagccacttgccgatgcccggccaggagaagatggtttcggtcagcaccgcgccggcgagcagcgtgccgacctgcaggccgaataccgtcagcaccggaatcagcgcgttgcgcagggcgtgcacgaagaccacccgggccggcgacaggcccttggcgcgggcggtgcgcacatagtcttcgcgcaacacctcgagcatcgccgagcgggtcatgcgggcaatcaccgccagcgggatggtgcccagcacgatggccggcaggatcaggtggcgcacggcatcgaggaacgagccctgttcgtcggaaagcagggtgtcgatcagcatgaagccggtcttcggctcgatgtcgtagagcaggtcgagacggccggacaccggcgtccagcccagcgacacggagaacagcatgatcaggatcaggccccaccagaagatcggcatcgaatagccggcgagggacaccgtcatcaccccgtggtcgaacagcgaaccgcgtttcagggcggcgatcaccccggccagcagaccgaaggtgccggcgaagagcatggcggccagggacagttccagggtcgccgggaacagggtgaggaattcgtgccagacgccttcgcgggtggtcagcgattcgccgagattgccctgtgccaggttgcccacgtagtccaggtactgctggtacaacggcttgtccaggcccaggcggtgcagggcctcggcatgcatctgcggatcgacgcgacgttcgcccatcatcacctccaccgggtcgccgggaatcaggcggatcagcgcgaaggtgagcagcgtcacgccgaagaaggtggggatcagcaaccccaatcgtcgtgcaatgaaactaagcatgttggcgggtaa

SEQ ID NO: 10210 - DNA, 1491 bp, Pseudomonas aeruginosa
cgccgcacgcgggaaggcaaggaccagggcttcccgcgtgcggcgcagcgatcagtccagcttcacccgcgaaaagtcccgcgccgacatcgggctcatgcggtagccgctgacgttcttgcgttgcgcgtcgaacatcaaaggatgcgccagcggcaaccagggcatctgctcgtggaagatccgctgcgcttccttgtacagcgctacccgttggctctcgtcgttgctcatgcgcgccttgcggatggcttcgtcgaagcccttgtcgcaccagcgcgcgcgattttccccggactccaccgaggcgcagccgaggttgtgggtgaggaagttgtccgggtcgccgttatcgccgatccagctgtagagcatcatgtcgtgttcgccggccttggtgcgcttgaccatctcgccccactcgaactggcggatgttcacccggatgccgatggcggccaggtcggactggatcagttgcgccactcgcgccgggttgccgccggggccgctgccggtgctgatgtagaggttcaggggtgtgtccgggatgacgccggcttccttcagcagggccttggcccgttcggggtcgtagggccagtcgcggatgctgtcgtcgtagccgagcagcatcggcgggtaggggccgatggccgggcgggcctggtcgccgaagacgatcttcaggtaggacgacttgttgaagcccatggcgatcgcccggcgcacgcgcgggtcgtcgaacggttcgtgccgggtgttgatcgcggcgtgggaggtgatcatcgccgcttcttccagcaccgtcagttgcgggtcctggcgcaacgcggcgacgtcttccggcttgggcgtcagggcgatctggcattcgttgcggcgcaggcgctgcacgcgcacgttgggatcgagggtgatcgccagcaccaggtggtcgatggccggcttacccttccagtagtcggggttggccgcgtagcgcacctgggcatccttgtggtagcgggtgaagacgaacgggccggtgccgatcggcttgctgttgagttcgtcgcccttgcccctggcgatcagttggccggcatattcggcggagaggatcgagccgaacggcatggccaggtcggcaaggaacggcgcctccgggtgcttgaggacgaagcgcacctgatgttcgtcgatcttctcgatgcgctcgatgatgtcgcgcagttgcatggcgtcggcgtaggggtagccgctgggcgaaaggtcgtgggcggggtgctgcggatcgagcatgcgctggaagctgaacagcacgtcgtcggcgtcgaattcgcgggttggcttgaagtagtcggtgctgtggaatttcacgccctggcgcaggcggaaggtgtagacgaggccgtcagcggagacgtcccagctttccgccagggccgggatcaccgtggcgctgcccggagcgaacgcggccagcgcgttgtacagcggatgggctga

SEQ ID NO: 10211 - DNA, 1749 bp, Pseudomonas aeruginosa
ctcctctggagcgggacggccgggtcggccgccccggggagaggcgccgcctcgctcgtggcggggcggcgcggctggcaggcgaagctacttgccgacgctgacctcgtagaacgagttcaggccgaagggactgatcctgaagtcgtgtaccgtcttgcgcatcggctggtacacggtggagtgggcgatcggggtgatcggcacctgttccttgaggatgtgctgggcctgcttgtacagctcggtgcgcttgccctggtcggtggtgcgcttggcatccttgaccagcttgtcgtagccggcgtcgcaccatttggagaagttgttgccgtccaccgcgtcgcagccgtagagggtgccgagccagttgtccgggtcgccgttgtcgccgctccagccgatcagcatggcgtcatgctcgccgcccttggcgcgcttgatgtattcgccccattcgtaggtgacgatcttcgccttgataccgatcttcgcccaatcgttctgcagcatttccgccatcagcttggcgttggggttgtaggggcgttgtaccggcatggcccacagggtgatctcggtgccctcggcgacgccggccttcttcagcagctccctggccttggccggatcgtagggcgcgtccttgatggtctcgtcgtaggaccactgggtcggtggcatgccgttgctcgccaactggccggcgccctggtagacggcgtcgatgatggccttcttgttcaccgccatgtccagcgcctggcgtacttccagcttgtcgaacggcttgtgggtgacgttgtaggcgatgtagccgaggttgaagccggcctgcgacggcaggttcaggttcgggtccttcttcagcgcgtcgaggtcggcggggcgcgggttgagggtgatctggcactcgccggccttgagcttctgcgcgcgcaccgaggcgtcggtgttgatggcgaagatcaggttgtcgaccttcacctcgtccggcttccagtagtccttgttgcccttgaagcggatctgcgcatccttttggtagcggctgaacacgaacgggccggtgccgatcggcttctggttgatgtcgctggccttgccctgcttgagcagttgcgcggcgtattcggcggactggatcgatgggaagggcatcgccaggttctggatgaaggccgcgtcgacctcgttgagggtgaacttcaccgtatgctcgtcgagcttctcgaccctggcgatgttcttgtccaggcccatgtcggtgaagtagggaaactcggtggggtaggccttgcggaacggatgatccttgtcgagcatgcgttcgaaggtgaacagcacgtcgtcggcattgaattcgcgggtcggcttgaagtagtcggtactgtggaacttcacgcccttgcgcaggtggaaggtataggtcttgccgtcgtcgctgacgtcccagctttccgcgaggccgggaaggaccttggtgccgccgcgctcgaactgggtcaggcggttgaagacggtttccgccgcggcgtcgaaatcggtaccggtggtgtactgggcgggatcgaagccggccgggctgccttccgagcagaagatcaggttgctggcgaaggcctggggaacggcggcgaccagcgctgcgccgagcagcgagggaatgatcgcggagcggatgacggcgtttctacgcatggagtgacctctggttattttgattgtctgcgagggacagcctcgtga

SEQ ID NO: 10212 - DNA, 1380 bp, Pseudomonas aeruginosa
cagcgctcggcgaaacagggcaggatggcgacctgcgaggtttctgagtcactttgccgcagagttgccgacagcgtcttggctatactcgcgcttattccggaagaaaacatgcgcgcaccggttttcctgctctccgccagtcgccagaaccttggccgtctgctcctcatccgtattctcgtgctggccgcgcaggccggctcggtgggtttcgcctggctctccgacctgttgccgctgccgtggctggcgctcggcctgacccttggcctgtccgcctgcctgattctgttcaccgcgctgcgcctgcgcgcgccgtggccggtgaccgaccaggagtacgcggtacaactggcctgcgacctgatcatccacagcaccttgctgtattactcgggcggctcgaccaaccccttcgtctcctattacctggtaccgctgaccatcgccgctgcgaccctgccctggatctactccatggtgctctccggcctggccctgaccggctacaccctgctgctgatctggtaccacccgctgcacctgcaggcggttcagcacgaggcgatgctgatcaacctgcacctgttcggcatgtggctgaacttcgccctgtcggcggccttcatcaccttcttcgtggtgaagatgtccgaggcgctgcgctggcaggcgcacatgcaggccgagcggcgcgaggaaagcatgcgcgaccagcagttgctcgcggtggccacccaggcggccggtgccgcgcacgaactgggtacgccgctggcgaccatgagcgtgctgctcaacgagctgcgccaggagcgcccgcaggacccgaccctgcaggaagacctggcattgctccaggaacaggtcaagcagtgcaagcacaccctccagcaactggtacgggcggccgaggccgaccgtcgtcaggcgatcgaggagcaaagcgccgcggaatggctggaatcggtgctgcgccgctggcacctgatgcgtccggaggcttcctaccgctaccagtgcctgggcctcggctccgcgccgcgcctgaccccgccgaccgacctcagccaggctctgctgaacctgctgaacaatgcggcggacgcctgtcccgacgacctcgacatccgcctggactgggacagcagcagtatctgcctgagtatccgcgaccacggcgtcggggtgcccctggcgatcgccgaacagatcggcaaaccgttcttcaccaccaagggcaagggcttcggcctcggcctgtttctcagtcaggccagcgtgacccgcgctggtggaacggtgaagttgtataaccacgaagatggcggcactctgaccgaactgcgcttgccgcgcagctacggaatggcttga

SEQ ID NO: 10213 - DNA, 960 bp, Pseudomonas aeruginosa
caacgggggcgccgcatggcgcccctgtgctttccgctttccgtcgaatcgcggtggatttcgcacattccgccggtcgccggggatatccagcggacagcgcaatcgttaagatgcagctttcatgaatcgcacgaccagggattgatcatgcgtatcttcggttcgagtgccggctgcctgtcggtgctgttcggactggccttcgggctgcctgcactagccgagccttcggtggacctggatggtccgacggcaggctggcgctattccggcctgctcgagcagcccgatgccccgcgtgtcgcctatccgactccgcccatcgatcgcggcggccagcgcggccgcagcctgatcgaaggacacctgcgcgaactggtcggcaccgagcgcgcccagcgcctggtggtcaacggcaatcctctccctctctataccgacggcgccgggcgcttcgtccgcccctatgcgttcggccacggctccaacggcgtccaggtcggcagcgccgacggcaagatcctcaagcgcgtacagttctacgaggccaatcgctcccaactgccgccgcgcgtgcgcgtggtgctgggttgggacgatccgaaggccgagctcgacctgcatatcgtcacccccgatggccagcacgcctactgggcgcatccgcgcctgagcaacagcggcggcctcgatccggacggcgtcgacgggcccggcccggagatgttcaccatgggcgcgccgctgcacggcacctacctgatctacgtgaactactggggcaacctcaacaaccagggctacaacttccaggccggcagcaacgtacaggacgtgatcaccgcgcaggtcaacctggtgttcaacgaaaacagcgtcgacgagaagcacgagaccttcgtcgtgcccctgcgcaccatcggcgacctggtgctggtcaagacctttacctactga

SEQ ID NO: 10214 - DNA, 4026 bp, Pseudomonas aeruginosa
cggcatgcgctcggtcagcctgcaacaactcatgacatggaaggacacccgatggatccccgacgaatccaatcccaactttatcggcatctatcggctggctttcctctctcaatgaatcgcgtcccagtgaagaccacagcaatgagcaacctgcgccgtttcagccgtagcctggcggtcgccgccctggtcctgctgccgttcgccgccgtccaggcggaagacacggtggaaccgagcggctacacgccgatggccggcgaatccttcttcctgctcgccgacagcagcttcgccaccgacgaggaagcgcgggtccgtctcgaagcgcccggccgcgactaccggcgctaccgcatggagccctatggcggggtcgacgtgcgcctgtaccggatcgaacagccgctggagttcctcaagcggcagaagaacctgcaccgggtcctggccgagggacagttcaagggcgaaggcctgtcgaacaccctggcctatctctgggacaactggtatcgcaagtcgcgccgggtgatgcagcgcgccttctcctacgagtcgcggcaacaggtcaccgaggcggtgcccgagctgaagatgggcaacgccatgaccgcgccgacgccctacgacgcgcagccgcaatacgcgccgattcccggcctgccgctggtcagccagttccgctatccgctgtgggacgccaagcccatcgagccgccgcaggacgtcaagctggccggttcctccagcgagttcatcaacgtcgtgccgggcaatgtctacatcccgctgggcaagctgaagccgggcctgtacctggtcgaggcgcttgtcggcaagtaccgcgccaccaccgtggtgttcgtctccaacagcgtggcggtgagcaaggtcgccggcgacgagctgctggtctggaccgcacgcaagcacgaaggcaccccggtgcccgacaccaaggtgctgtggaccgacggcctgggcgtgatgagcagcggcaataccgacgccgacggcctgctgcggctcaagcacgccagtccggagcgctcctacgtgatcggcgaggaccgcgagggcggggtcttcgtctccgagaacttctattacgacagcgagatctacgacaccaagatctacgccttcaccgaccgcccgctgtaccggccgggcgactgggtctcgttgaagatggtcggccgcgagttcaaggacgcccggcaatcccaggccgccgccagcgcgccggtgcgcctgagcgtgatcgacgccagcggcacggtattgcaaagcctggacctccgcttcgacgcgaagagcggcgccaatggccgcttccaactgccggagaacgccgtcgccggcggctacgagttgcgcttcgactaccgcgggcagacctacagcagcgccttccgcgtcgccgaatacatcaagccgcacttcgaagtcgccctcgacctggccaagccggacttcaagaccgccgagccggtgaagggcgagatcgtcctgctctatccggacggcaagccggtggccaacgcgcgcctgcaactgagcctgcgcgcccagcagttgtcgatggtggacaacgaactgcagtatctcggccagttcccggtggaactgagcagcaccgaactgaccacagacggcaagggccgcgccgccatcgaattgccgccggccgagaaacccagtcgctacatgctgaccatcttcgccagcgacggcgccgcctaccgggtcaagaccagcaaggagatcctcatcgagcgcggcgccgcgcgctaccgcctgagcgcgccgcagcgcttcagcgccgccggcgagaaggtcgagttcagctatgccagcgaacagccgaccccgctcaagccgagcagctaccagtggatccgcctggaggaccgcgccaccgacagcggtccggtcgccgacggccgcttcgcgctgaccttcgagcgccccggtacctattccgtggagctgcgcgacgacaagggccagctccttggcgccaccggccactcggtgagcggcgagggcgtgaagtcggtgccgggcaccgtcgaggtggtgttcgacaagcccgagtaccgcaccggcgaggaagcctccgcactgatcaccttccccgagccggtggaggatgcgctgttgtccctggagcgcgacaaggtcgaggccaccgccctgctgtccaagggcgccgactggctgcgcctggaaaaactcaatccgacccagtaccgcgtgtggatcccggtgcgcgaggagttctcaccgaacctgaccttctcggtgctctacaccaagggcggcgactacagcttccagaacgccgggatcaaggtcggcatgccccaggtagagatcgacatcgccaccgacaaggagcgctacgaaccgggcgagacggtgaccgtgaccctggccacgcgcttcgccggcaaaccggtttccagccacctgaccgtcagcgtggtggatgagatggtctatgccctgcaggcggagatcgcccccggcatcgaccagttcttctaccatccgcggcgcaacaacgtgcgcaccagcgccagcctggccttcatcagctacgacgtggcgttgcccggcagcaccagcgcacccggacgggcgaaccgcagcgagcgcggcgtcaaggtactggagcggccgcgccgcgaggatgtcgacaccgccgcctggcagccggagctggtcaccgacgcccagggcaaggccagcttcagcttccgcatgcccgactcgctgacccgctggcggatcaccgcgcgggccatcgacgacaacggccaggtcggccagaagaagcagttccttcgctcggagaagccgctgtacctgaagtggagcgggccgactcgcttccgccagggtgaccagcccgacctcggcctgttcgtcttcaaccagggcgaacagccggtcaaggccgagctgctcagcgggccgcctggcagccagcgcagccagaccctggagctggccaagggagtcaactacattccgctggcgcaacagccgctcagcgatggcgactggagcgccgagctgcgccaggacgggcaggtccgcgaccgcctggcggtgcgcttcaacctgctggccgacggctggcaggtggagcaggtgcagaacctcagcctggcggcggcgagcaacccgctgcaactgccggcggacgcgcgcgacgtacgcctgcgcctggccgatggcccggccgcggcctacctgggcaatctcgatgatctgctggagtatccctacggcggcgtcgagcagaccgccagccaactgctgccgctgagcatcgcctatccggcgctggccggcggcgagccgcggattcgcgaccgcctgcgcctgatcatgcagaacagtcgcctgcgcctggtgcagatggccggcccggacgcctggttcgcctggtggggtggcgacgtcgatggcgacgctttcctcaccgcctacgcctactacgccgactggtacgccagccgcgcactggagatccaactgccggccgaacactggcagcgcatcctcgagccctacgccaagcaggcgacgcagaccccgctgctgcagcgtgcgctgatcctggctttcgcccgcgacatgcagttgccggtgaacaccctgctcggcggcctgctcaacgatctggccaacgccggcaaagggcagggcgcgcgcggaccccgctggaggccgacgacggcctggtgctgggcgacccggactcggccgtcggcctggccgcggcgcgagtgctggcggtggaccttgcacggcaactgcgggtcgcggtgcccgcgccgctggccgcccaggccgagacggcgacgcagcgcctgcgtgaggccggcttgccgttcaccgatgccttgctggcctctcgctcggccgtggatggccagcaggccagcgctctgctgcaacgcctggcgccggcgcaatcgaccctggaacgcgccctggccctga

SEQ ID NO: 10215 - DNA, 540 bp, Pseudomonas aeruginosa
cggcggcgctcatgccgttgcggatggctcctgggctcaggcgggctgttcgccctgccaggtatcgatcgcttcctgcgccgcacggaacgcatcgatcgccgccggcaccccggcatagaccgcgcagtgcagcagtgcctcgcggatttcctccaccgtgcagccgttgttcagcgcaccgcgcacgtgccccttgagttcctgcgggcatttcagggcggtcagggcggccagggtgatcaggctgcgggtcttgcgcggcagcgcctcgcgggcccagaccgagccccaggcatgctcgttgacgaagtcctgcaatggctgggtgaaggcggtggcgttgcccatggcgcgctcgacgaaggcgtcgcccatgacttcacgtcggatctccaggccggtcttgccttgttcgctcatcggaaggttcctgtcgtgggtagaaggtggctcaatccagcgactctatccgaaccggcgccacgccgctgcggatcatacccaggccttcggcggccttgcgcgatacatcgatga

SEQ ID NO: 10216 - DNA, 1683 bp, Pseudomonas aeruginosa
cggtacgcaggcctgcgtggcggctgccatagtaggaggcttcgccggtatccgcggaaccgctgccggcgaggctggagcagccggcgaggaacaggggcaggacggcgagggcgaggcgcgcggcggcggatggggtgggcatggacaacaggctcctggcggacaagaagacgccgggcgaacccggcgtctggctttgactcacgcttcgagctttttcttcagcaactcgttcacctgctgcgggttggccttgcctttcgaggccttcatcgcctggccgacgaagaagccgaacatcttgccgcgcttggcctcgtcggcagcgcggtactgctcgacctgctcggcgttggccgccagcacctcgtcgagcatcttctcgatggcgccactgtcggtgacctgcttcaggcccttggcctcgatgatctggtcggcggaaccctcgccgttggccatggcttcgaagaccatcttggcgatcttgccggagatggtgttgtccttgatgcgcaggatcatgccgcccagttgctcggcggacaccggggactgctcgatctccaggccgtccttgttgagcaggctgcccagctcgaccatcacccagttggccgccagcttggcgtcgccgcagatgccctggaccttctcgaagtagtcggccatctcgcggctggcggacagcacgctggcatcgtaggcggacaggccgtactggctctcgaagcgttcgcgcttctgcaccggcagttccggcagttgctcgcgcagcttcgccaggtactcgggctcgatgaccaccggcagcaggtcgggacaggggaagtaacggtagtcgttggcttcttccttgccgcgcatggagcgggtctcgtccttgttcgggtcgtacaggcgggtttcctggactaccttgccgccgtcctcgatcagctcgatctggcgctggatctcgtggttgatcgccttctcgatgaagcggaaggagttgacgttcttgatctcggcgcgggtgccgaattcggcctggcccttcggtcgtaccgagacgttgcagtcgcagcgcagcgagccctcggccatgttgccgtcgcagatgcccaggtagcgcaccagggcgtggatcgccttgacgtaggccacggcttccttggcgctgcggatgtccggctcggaaacgatctccagcaacggcgtgccggcgcggttcaggtcgatgccgctcatgccctggaagtcttcgtgcaggctcttgccggcgtcctcctccaggtgcgcgcgggtgatgccgatgcgcttggtggtgccgtcttccagggtgatgtcgagatggcccttgccgacgatgggatggtccatctggctggtctggtagcccttcggcaggtcggggtagaagtagttcttgcgggcgaacacgttctgccggtcgatccgtgcgtcgatcgccaggccgaacaggcaggccatgcgtacggcctcctcgttgagcaccggcagggtgcccggcatggccaggtcgaccaggctggcttgggtattcggcgcggcgccgaaggcggtcgagctgccggagaagatcttcgattgggtggcgagctgtgcgtggatttccagcccgatcacggtttcccattgcatgtggtgttcctcaatccttctgtgcctgcgtag

SEQ ID NO: 10217 - DNA, 504 bp, Pseudomonas aeruginosa
tgcggttcttcacttcgctgccgaagccttccgcgcgcgagcgcttgtacaggtcttccaggttctgcggggcgtcgcaacgatagccatagcgcacgccgtcgaagcgcgacaggttggaggacgcctcggccggcgcgatcacgtagtaggctgggatggcgtgctgcatgttcggcagggaaatgtccttcaccgtggcgccgagcgtcttcagctcctcgactacggccagcaccgcgtcggcgatgcggctgtcgaggccggcgccgaagtattcccgcggcaggccgatgcgcaggccgctcagcggcttctgcagggcggccaggtagtcgtccaccggctgttcgacgctggtcgagtccttcggatcgaatccggccatcacccccagcatcagcgcgcagtcctcggcggtgcgcgccagcgggccgccctggtcgaggctggaagcgtaggcgatcatgccccagcgggaaacccggccgtaggttggcttga

SEQ ID NO: 10218 - DNA, 1050 bp, Pseudomonas aeruginosa
ggtttctttcccatgttcaaaaaattgcgtggcatgttttccagcgatctgtcgatcgacctgggtactgccaatacccttatttatgtgcgcgagcgcggcatcgtcctgaacgaaccgtccgtggtcgccattcgcagccatggcagccagaagagcgtcgtcgccgtgggcaccgaggccaagcgcatgctcggccgtaccccgggcaacatcgccgccatccgtccgatgaaagacggcgtgatcgcggatttcagcgtctgcgagaagatgctgcagtacttcatcaacaaggtccacgagaacagcttcctgcagcccagcccacgcgtgctgatctgcgtgccgtgcaagtccacccaggttgagcgccgggccatccgcgaatccgccctgggcgccggcgcccgcgaggtgttcctgatcgaagagccgatggctgccgccatcggcgccggcctgccggtcgaggaggcccgcggctcgatggtcgtagacatcggcggcggcactaccgagatcgccctgatttccctcaacggtgttgtctacgccgaatccgtccgcgtcggcggcgaccgcttcgacgaagccatcgtcacctacgtgcgccgcaactacggcagcctgatcggcgaatccaccgccgagcgcatcaagcaggagatcggcaccgccttcccgggcggcgacgttcgcgaagtcgacgtccgcggccgtaacctggccgaaggcgtaccgcgcagcttcaccctgaactccaacgaggtcctcgaggccctgcaggagtccctggcgaccatcgtccaggcggtcaagagcgccctcgagcaatcgccgccggagctggcctcggatatcgccgagcgcggcctggtgttgaccggcggtggcgcgctgctgcgcgacctggacaagctgctggcacaggaaaccggcctgccggtgatcgtcgccgaggagccgctgacctgcgtggctcgcggcggtggccgtgcgctggagatgatggaccgccactccatggacctgctctccaccgagtaa

SEQ ID NO: 10219 - DNA, 519 bp, Pseudomonas aeruginosa
tctcgctccgctggaggttcgccgccagcaacggcgcgggttgcgcaaccgcccaggacaccaggggtccgtactgcgtccagtcccaacctttctgccagtccagggcctgctccaggttcgccaccggcttgccggtcccgagttgtacgcggaccgcatccacccgtggttgctggccgggatcgagcatttccagcagcaggctgccctgcgcccgatattcgcccagggcctgcgccagccacagttccacggcatgatgatcgggattgtcgtgcttctcgccgacgatcactcgcggcgcggccgccaggcgtgcgaccagttgctgcgggctcagcgtcacgccgctgcgcaattcgacgattcgtcccgtctgcggatcgtcgcgcccttccgggctctgccaatcaggcagcggcggcagttgggactggcagccgcccagcagcagacagaaagcgaacaggcgaatgcgcatggcgactccttcaacgggcgacgatcagcggatga

SEQ ID NO: 10220 - DNA, 447 bp, Pseudomonas aeruginosa
ctgcgcccggccagatgcctggcgtcggccgccgccaaggcctcggcgacgatctgcacatcgcgctcgcggccgctggaatggggcagccgaccgaagccgaccaccgcctccaccggaaaggcgaagcccagcgacgaactctgcggcagcaccgccaggcgctgcgcgcgagcgacgcccggccagtcgtcgaggccgcgctcgtcgagcagcaccagcccttcggccggctccagttcgccacagagagcgccaagcaaggtgctcttgccagcgccgttggggccgagtacgccgagcatctcgccaggccgcagctccagctcgaggccttccagtacagtctttccgccacggcggatggacaggttctccacgcgcagcatcaggcccgcccccgcaatagcagataaaggaagaacggcgcgccgatcagtgccgtga

SEQ ID NO: 10221 - DNA, 450 bp, Pseudomonas aeruginosa
acagtccgatcaccgcgccggacagcgcggtcaaggcgatccctgccagcaacatggtggccacgctggtctggccatcgcggcggccaagtcgatagaccagccaggtcacccccaggccgccgccgaaggcgcacagcgacagcaggtagggcgcgaggaacgccggcaagccacccagcgaggcgccgaatacgatggccagcgccgcgccgagggccgcgccgctggacaccccgaccagccctggatcggccagcgggttgcggaacaggccctgcatcgccaccccggacagcgccagcaccgcgcccacggccaggccgagcagggtccgcggcaggcggatctggccgaggatcatttccgcctgggccaggcccgttccatcgagcggcagcccggccaggcgcagcgcggcgcgcagggtatcgcccagcggcaggctga

SEQ ID NO: 10222 - DNA, 966 bp, Pseudomonas aeruginosa
cgggaccgagggcgagggacaaccagaggaccaacacgagcgaaatccccagcgcaccgaacagtgcgcggggacgaacaaccgatttcaatgggcggcttccgtactcagcggtttcgcggaaggataaaaggctgcggagagagccgccaggccatccggcaggcgcggaccgaggccgcccaccaggagcgtcgggtccagcaccagcagtcgtccgtcacgcgccgcgcgggttgcggcgaggccggggttctgcttgagcagcgcggcacgcgccgcatcaccttcgaggctgcggtcggcgatcaccaccgcgaccggatcgagcgctgccagggcttccaccgagatcggcttgtaaccctcatgggtagccaggttgcgtgctccggcccggttcaggacccaatcgccgccggtattgcgcccggctaccagcaactgaccgccggcgttgccgatcaccagcaggacgcccggggccggctggctcttctgcgcggccgcgatccagtccgcctggcgccgcagccgctgacgatagtcaagttcggcggcctcggcgcgctggggcacgccgagccagtcgccgagcttcttcagattgctttccagtgcctccagatccggcttggcggagagggtctcgactcgcacgccggcgccttcgagctgcttgagtaccggcggaggccccatttcctcggtgccgatgaggatatccggacgcaacgccagcacgccctcggcagccagttggcgctggtagccgacgctcggcaactgtttcagcgcctgcggatgctggctggtggtgtccaccccgaccaacttgctctcgccgcccaacgccaccacccattcgctcagcgagccgcccgcgctcacccagcgttgcggcagctcggcggcctgggccatgccggtgccgagcaggatgcccagcgccaacccgttgaatag

SEQ ID NO: 10223 - DNA, 1008 bp, Pseudomonas aeruginosa
tcgatcgatacgcatgatctctcctcagagcgccttgaaggattcggccagttcgcgccagtcgtcgcgctcgggctcgccgggcttgcgcgcgccgaacagttgcacgatcagttcgccgtcggcgtcgaaggcctcccagctggttacgatgccatcggtgctcggcttgcgcacccgccaaagttcggcgatgccggtggtcttcaagtgcaggttgaattccggatcgagcacgttgaaccagtcgtccagccacttcaggttgcacactggcccggtatggatctggatgcagtgggcgttgccgacgaacaccatgatcggcaatccgctttcggccgccgcttcgaagagtttcgccaggtcgccattgtccaggcgctcggcccattcgccgccagccaggcgcagcgcctgggtgcgctgcgcgccatgcttcttcagcagggcgtggaaatgatgggtgtccttcaacgcggcccagccttcgcgcaaggcggcggcatcgatctgcgcatcgacgagcgtcgcagccggtgcgcggggttcgtgcagcgccagcacggcatcctgctcggcagcccgcaggcgctcgaccagcggctcccaggcgcggacgtcgctggcctcggtaaggaacaccttgtgcaccgccacgccctgctggtcgaacacctggatgctgcgctgggtaccccgcgctgtctcctcggcaatggcgaagacagcgttccaaccccccaggaacaggcgcaggtcgatatccggcgagaccaccaggcccatctgcccattggcagagaccgtcacttcgcgatacggccccttgcgttcgtggacgcaatgctcgttgcgggtcagcgccatgatcggccccagttcgccgagcgccggcagcaaggcggcccagtccggccgcaggcgcacagcatcgatgccgacccggctggcgaccagctcgccttcgctgacctgcaacagcgcggcggcgtcgcgcgcgcgtag

SEQ ID NO: 10224 - DNA, 252 bp, Pseudomonas aeruginosa
cctacgacttcgcccagcactacacctggtacggccaatacgcccagggcttccgcacgcccaccgccaaggcgctgtacggtcgattcgagaacctgcaggcgggctaccacatcgagcctaaccccaacctcaagccggaaaagagccagagcttcgagaccgggctgcgcggcaagttcgacgaaggcagcttcggcgtggcggtgttctacaacaaatatcgcgacttcatcgacgaagacgccctga

SEQ ID NO: 10225 - DNA, 627 bp, Pseudomonas aeruginosa
ggacagcagacccaaaccgcgccgacgagttcgctgcgacaatccgtccctgcccaacggcaacccggcgcggcgggcagcgcatcgcttcgtcacaagtggatacagctcaccggctgggtggcggcgggtgccagcggtatgctcccggcattcgctcgcagcaaggagaatcccatgcgccgcttcgcccccctggccgtcctggccgccaccctgctccacggttccctggtccaggccgccgaaccgctggccatcgacgtccaccgcgacgccaactgcggctgctgcaaggactggatcaagcacctcgaagccaacggtttcaaggtcaccgaccatgtggaagcagacatgagcgcagtcaagagccgtctcggcgtgccctacagcatgggctcctgtcataccggagtgatcgacggcaagttcgtcgaaggccacgtgccggcagccgacatcctcaagctgcgcgaacgcgccgacctggtcggcgccgccgtaccgggcatgccggtcggctcgccgggcatggaaatgggcgaccgccaggacgcctaccaggtcgtcggcctgaccaggagcggccaggcctcggtactggcggagtacccgggacgctaa

SEQ ID NO: 10226 - DNA, 540 bp, Pseudomonas aeruginosa
aggccgataggctgcttgtcgagtcccccctcgcgtttttcattccatttcacaggaaaaggcccatgtcccgacgctactggcaactcgatgtgttcgccgagcgtccgctcaccggcaacggcctggccgtattcgacgacgccagcaccctcgatgacgccgccatgcaggcctggacccgcgaactgcgccagttcgaatcgatcttcctgctaccgggcgacgacccacgggccttccgcgcacggatcttcaccctggaggaagaactgccgttcgccggccacccgctgctcggcgccgccgccctgctccatcacctgcgcggcggcgacaacgaacagcactggacgctgcacctggccagcaaatcggtggccctgcgcagcgtgcgggcgggcagcggtttctacgccgagatggaccagggccgcgccgaattcggcgccaccccggacgccgggacctgccgctggttcgccgaagccttctcgctatcggccaacgacctgtccgggcatccaccgcgggtggtga

SEQ ID NO: 10227 - DNA, 921 bp, Pseudomonas aeruginosa
agaagcgaaacgtacaggagaaccgccatgctctggcgcaaaggacgacgcagtgacaacgtgattgatgcccggggcgaaggaggcgcaggcggcggtggcggcatgcgcatcggcggcaagggcctcagcctgggtggggtggccatcgtggtggtggtcggcctgctgatgggccaggacccgatgcagatcctcgggtcgctgctcggccagatggacagcccggcgccggccacccagcagcaggccggcggtcgggccccggcggccaatgacgagcagagcgagttcgtccgctcgatcctcggcgacaccgaggacacctgggaacagatcttcgccagcggccaggcacaataccaacagcccaagctggtgctgttcagcaatggggtgaattccgcctgcggcttcgcctcgtcggccactgggccgttctactgtccggccgaccgccgggtctacctcgacctggagttcttccgcgagatggaacagcgcttctccgccgccggcgacttcgcccaggcctatgtgatcgcccacgaggtcggccaccacgtgcagaacctgatgggcatctcggccaagatcaacgcagcccgccagcgcggcgcgcgcatggagggcgccaacggcctgtcggtacgccaggaactgcaggcggactgcttcgccggggtttgggccaaccgtgcacagcagcggctgaactggctggagccgggcgacatcgaggaagccctgaacgccgccaacgccatcggcgacgatcgcctgcaacgccagggccgcggcatggtggtgccggactccttcacccatggctcctcggcgcaacgcatgcgctggttcaagaccggcttcgagagcggctcgccggccagttgcgataccttcaaggcccagacgctctga

SEQ ID NO: 10228 - DNA, 1443 bp, Pseudomonas aeruginosa
tcaagctgggcttcttcaacgcatgagccgtccacagttcgaccccagcgcctacgccgcacaactggaagacaagaagtcccgcctcgccggtttgctggccccgttcgcggcacccgcgcccgagatcttcgagtcgccgcgcgagcattaccggctgcgcgccgaatttcgtctgtggcgggaaaccggcaacgagaagcgtcactacgcgatgttcgagcagggcgacaagcacacgccgatcctgatcgaggatttccccatcgccagccgccgcatcaacgaactgatgccgcgcctgaaggcggcctgggccgacccggcgctgggcttcaagctgttccaggtggagtttctcaccaccctggccggcgacgcgctgatcaccctctgctaccaccggccgatcgacgacgcctggcgacaggcagcggaaaagctggcggcggaactgggcgtgaacctggtcgggcgttcgcgcggcaagcgtatcgtcgtcggacgcgactatgtggaggaggaactgtcggtcgccggccggcgcttccgctaccgccagcccgagggggctttcacccagcccaacggcgaggtcaaccagaagatgctcggctgggcctacgaggcgctcggccagcgcgacgacgacctgctcgaactgtactgcggcaacggcaacttcaccctgcccctggccacccgggtacgcaaggtgctggccaccgagatcagcaagtcctcggtcaatgcggcgctggccaacctggccgacaacgcggtggacaacgtcagcctggtgcgcctgtcggccgaagagctgacccaggcgctgaacgaggttcgcccgttccgccgcctggccgacatcgacctgaagagctacgccttcggcagtgtcttcgtcgatccgccacgagccggcatggatccggacacctgcgagctgacccggcgcttcgagcgcatcctgtacatttcgtgcaacccggaaaccctggcgcagaacatcgctcaactgcacgacacgcaccggatcagccgctgcgcgctgttcgaccagttcccctacacccaccacatggaaagcggcgtcctgctcgaacgccgctgagcgagtggccgcgccccacggcgcggccatgcctcagagtcgcaccgggaggcgccgcgccaggtgcaatccttccgtcgtcacctcggcgccataggccagcacctcgacgcccgcttgcgccgcctcgcgcaacgccttgccataggctggatcgatctcgtcggcggggcgcaccgcctcgaccccggaaaggttcacgcagtacagctgcaccgcgcggatcccctcccgcgccagcgccgccagttcgcgcaggtgcttggcgccgcgcagcgtcaccgcgtcgggaaaggccgccacggcggtttcgtcgaagcccagggtga

SEQ ID NO: 10229 - DNA, 534 bp, Pseudomonas aeruginosa
gttcgcccgcttgcgaccgcggggccggagagccggcgagggaaccctgccgcggacaggattagcgaaagtgagaggcggccattcatgtccaccaaagcaaaacaacagagcagccagcagatgacccgcggcttcgaaccctatcaggaaaccaagggcgaggagtacatgagcgagcgcatgcgcgcgcacttcaccgcgatcctgaacaaatggaaacaggagctgatggaagaggtcgaccgtaccgtgcatcacatgcaggacgaagcggccaacttccccgatccggccgaccgcgccagccaggaagaagaattcagcctggaactgcgcgcccgcgaccgcgagcgcaagctgatcaagaagatcgacgagaccctgcaactgatcgaagacgaagagtacggctggtgcgactcctgcggcgtcgagatcggcatccgtcgcctggaggcgcgccccaccgcgaccctctgcatcgactgcaagaccctcgcggaaatccgcgagaagcaactcggctcctga

SEQ ID NO: 10230 - DNA, 618 bp, Pseudomonas aeruginosa
gggattcgccgggatctacccgggcttctgccgcgacgccgggcacgcccgcgaggatgcggcgatccgcctgcgcgtgccggagctggaatatcgcttcgtcgaccgcgtgcagggcgaagtccaccagcatctcggccgcgaggtcggcgatttcgtcatccagcgccgcgatggcttctacgcctaccaactggcggtggtgctggacgacgcctggcagggcatcaccgacatcgtccgcggcgccgacctgctcgagtggaccccgcgccagctttacctccaggaattgctggggttgagccagccgcgctacctgcacgtgccgctgatcgtccagccggacgggcacaagctcggcaagtcctaccgctccccgccactgcccgccgagcaggccgccgcgccgcagacccgcgccctgcgcgcgctcggccagcggccgccggccgaactggcccaggccagcgccagcgaggcgctggcgtggggcgtcgcgcactgggacgccacgcgcatcccgcgctgcgctacccttcccgaggaacgcctgtagcccgcccggcggcttgccggcacccacccgcagcctgtagcctgccggcccaagcatga

SEQ ID NO: 10231 - DNA, 447 bp, Pseudomonas aeruginosa
atacatggcacatattctgatcgtcgaagacgaaaccattatccgatctgcattgcgacgcctgctggagcgcaaccagtaccaggtcagcgaagccggctcggtgcaggaagcccaggagcgctacaccatcccctccttcgacatggtggtcagcgacctgcgcctgccgggcgcccccggcaccgaactgatcaagctcgccgaaggcattccggtgctgatcatgaccagctacgccagcctgcgttcggcggtggattcgatgaagatgggcgcggtggactacatcgccaagcctttcgaccacgacgaaatgctccaggccgtggcgcgcatcctcaaggaccgccaggagaaccgcagcgcggccccggtcctccgccaacggcggcaaggccggcggcgagcgcggcgccagcccggcggcagccgacggcgagatag

SEQ ID NO: 10232 - DNA, 216 bp, Pseudomonas aeruginosa
tcgaatccgagctgttcggccatgaaaaaggcgccttcaccggtgccagcgccgggcgcgccgggctggtcgaagcggccgacggcggcaccctgttcctcgacgagatcggcgaactgccgctggaggcccaggcccgcctgctgcgcgtattgcaggaaggcgagatccgccgggtcggctcggtgcaatcgcagaaggtcgacgtgcgcctga

SEQ ID NO: 10233 - DNA, 543 bp, Pseudomonas aeruginosa
tccagaccattcgttcccccctgcgccgtccgcgcgccgtccgtacaaccccggaagtcatcggtaacaaccagcactccctgcgccgggaccagttcagccggaacgccgtcaaggtcgtcgagatcctccagcgggccggctaccaggcctacgtggtcgggggctgcgtacgcgaccagatgctcggcatcgctcccaaggacttcgatgtcgccaccagcgccacgccggagcaggtccgcgccgaattccgcaacgcgcggatcatcggccgccgcttcaaactggtacacgtgcacttcggccgcgagatcatcgaggtcgccaccttccgcgcccatcatccggaaggccaggacgatggcgatagccgcgcgtccagcaacgaaagcggccgcatcctgcgcgacaacgtctatggcagcctggaagacgacgcccagcgccgtgacttcaccatcaatgccctgtacttcgacgtcaccagcgagcggctgctggactacgccaatggcgttcacgacatccgcaatcgcctga

SEQ ID NO: 10234 - DNA, 1422 bp, Pseudomonas aeruginosa
caaaggttccctgatcgtcaccgacctggccttcgaatccagccattccgtggcccagacccttgccgacgcggtccgcctgatgcaggccggcgcacacatggtcaagctggagggtggggcctggctggcggagccgatcgcccgcctggcacagatgggcgtgccggtctgcgcgcatctcggcctgaccccgcaggcggtcaacctgttcggcggcttcaaggtccagggccgccaggaaacccaggcgcgccagttgcgcgccgatgccatcgccctggagcaggccggcgccgccatgctgctgctggagtgcgtgcccagcgtgctggccgaagagatcacccaggcggtgaagatcccggtgatcgggattggcgccggtgcggcgaccgatggccaggtgctggtcatgcacgacatgctcggtctctcgctgaccggccgctcgcccaagttcgtcaaggatttcatgcaaggccaggagagcatcccggccgccatcgcggcctatgtccgcgccgtcaaggacgtgtccttccccgccgccgaacacggattcaacgcatgaacaccgtcaagaccgtccgtgaactgcgcgccgcggtggcgcgcgcccgcagcgaaggcaagcgcatcggcttcgtgccgaccatgggcaacctccacgccggccatgccgcgctggtaaagaaagccggcgaacgcgccgacttcgtggtcgtcagcatcttcgtcaacccgctgcaattcggccccagcgaagacctcgacaaatacccgcggaccctcgcagccgaccaggaacgcctgctcgaagccggctgccacctgctgttcaccccgaccgtcgaggaaatgtaccccgacggcatggacgggcagacccgcatccatgttcccggcgtctccgaaggcctttgcggcgccagtcgtcccggccatttcgaaggcgtggcgaccgtggtcagcaagctgctgaacatggtccagccggacctcgcgctgttcggcgaaaaggatttccagcagttggcggtgatccgcaagctggtccgcgacctcaacctgccggtgcagatcttcggcgagccgacggtgcgcgccgccgatggcctcgcgttgtcctcgcgcaacggttacctcgacgagcagcagcgcgccgccgccccggcgatctaccgcaccctgcggcagctcggcgaacgcatccgcgccggcgccgaggacttcccggcattgctcgccgacgcccgccaggccctggaacaggccgggctgcgccccgactacctggaaatccgcgagccgatcagcctgcgccccggggtacccggcgaccgccaactggtgatcctggccgccgcctacctgggcagtacgcggctgatcgacaacctctcagtccacctcgattga

SEQ ID NO: 10235 - DNA, 441 bp, Pseudomonas aeruginosa
gcgctcaccacggactcgccatactctgccgccccccgcggacccgataggagtcgccccatgcacgccataatgctcaaagccaagttgcatcgcgccgaagtcacccatgccgtcctcgactacgaaggctcctgcgccatcgacggcgattggctggacctctccgaaatccgcgagtacgaacagatccagatctacaacgtcgacaacggcgagcgcttcaccacctatgcgatccgcgccgagaacggctcgaagatgatctcggtgaacggcgccgcggcacacaaggccaaggtcggcgaccgcgtgatcatctgcgcctacgcacactacagcgaagccgaactggccagccacaagccgcgcatgctgtacatggcgccgggcaaccagctcagccataccagcgaggcgattccgatacaggtcgcctga

SEQ ID NO: 10236 - DNA, 477 bp, Pseudomonas aeruginosa
agaacgcccaggccgcacgcgcctggtacctggcccagggcggcaccgaggaagagctttaccgccatttcatcgccgtctccagcaacaaggaagccgcgatcgccttcggcatccgcgaggaaaacatcttccccatgtgggactgggtcggcggccgctactcgctgtggtcggccatcggcctgccgatcgccatgtccatcggcatctccaacttcaaggaactgctgtccggcgcctacaacatggaccagcatttccagaccgcgccgttcgaacgcaacatcccggtgctgctcggcctgctcggcgtctggtacggcgacttctggggcgcgaacagccacgcgatcctgccctacgactactatctgcggaatatcaccgaccacctgcaacaactggacatggaatccaacggcaagagcgtgcgccaggacggcacgccggtcaccagcggcaccgggccggtga

SEQ ID NO: 10237 - DNA, 2103 bp, Pseudomonas aeruginosa
gccgggctttttcattccgtccggcgattgaccccggcgccttccccgctcgcgcctttggcacttgaacatggctctcgcctggcccacccttggtcgaacctggagaggggccgcgtgcggtctctcgacaccttgcggagcagaaaaacaaaggaaaccgccatgttcgagatcagcgtccacccggtgccggacgccgtccgccagcgtgcctacctgaacgacgacgactaccagcgcctgtaccgccaatccgtcgagaaccccgacgagttctggggcgagcaggccaaggccttcctcgattggttcaagccctggcacagcgtccaccacggcgacctgaggaaaggccaggccacctggttcaagggcggccagttgaacgtcgcctacaactgcatcgatcgccacctggaacgccgcggcgaacagatcgcgatcgtctgggaaggcgacaaccccagcgaatccgcgcacatcacctaccgcaagctgcaccacaacgtctgccgcctggctaacgtgctgaagagccgcggcgtggaaaagggcgaccgggtctgcatctacatgccgatgattcccgaggccgcctacgccatgctcgcctgcgcccgtatcggggcggtgcactcggtggtgttcggcggcttctcgccggactcgctgcgcgaccgcatcctcgatgccgactgccgcaccgtgatcaccgccgacgagggcgtgcgcggcggcaagtacatcccgctgaagcagaatgtggaaaaggcactgaaggactgcccggacgtctctaccgtggtggtggtcgagcgcacccagggcgacataccctgggtcgaaggccgcgacatctggtaccacgaggcgctccacgcggcctcagccgactgcccggcggaagcgatggacgccgaggacccgctgttcatcctctatacctccggcagcaccggcaagccgaagggcgtgttgcacaccaccgggggctacctgctcggcgcggcgatgacccacaagtacgtgttcgactaccacgatggcgacgtctactggtgcaccgccgacgtcggctgggtcaccggacacagctatatcgtctacggcccgctggccaacggcgccaccaccctcatgttcgagggcgtgcccaactacccggacgcctcgcgcttctggcaggtgatcgacaagcaccaggtgaatatcttctacaccgcgccgaccgcgatccgcgcgctgatgcgcgaaggcgacgccccggtccgccagacctcgcgcagcagcctgcgcctgctcggctcggtgggcgagccgatcaacccggaggcttgggagtggtactaccaggtggtcggcgagaagcgctgccccatcgtcgatacctggtggcagaccgagaccggcagcatcctgatcaccccgttgcccggcgccactgcgctaaagccaggctcggctacccgcccgttcttcggcgtgcaacccgtgctgctcgacgagaaaggcaaggaaatcgacggcgcgggcagcggcgtactggcgatcaaggccagttggccgagtcagatccgcagcgtctacggcgaccaccagcggatgatcgacacctacttcaagccctaccccgggtattacttcagcggcgacggcgcgcgccgcgacgaggacggctactactggatcaccggccgggtcgacgacgtgatcaatgtctccggacaccggatcggcaccgccgaggtcgagagcgcgctggtcctgcacgatgcggtggccgaggcggcagtggtcggctgcccgcatgacgtgaagggccaggccatctacgcgttcgtcaccctgatggccggcagtcagcccagcgaggcgctacaacaggaattgctggccctggtcggcaaggagatcggcagcttcgccaagccggatcacctgcaatgggcgcccagcctgccgaagacccgctccggcaagatcatgcggcgtatcctgcgcaagatcgcctgcaacgagctggacagtctcggcgatacctcgaccctggccgatccgggagtggtgcaggggttgatcgacaaccgcctcaaccgctga

SEQ ID NO: 10238 - DNA, 894 bp, Pseudomonas aeruginosa
cgagccccccatggaaagcgtccgtcgccatatcgaaagccaggtgctgagccttaccgggctcgccgtcggcggtgtcgacttcgagtcgccgaaaggcgatccgggcctgttcggccccgatgccgcctgctggaaggtccacggcgacttcagcagcatgatgatcggcggcatcggcgcgctgctcctgcagatgctccatccgctggccctggcgggggtgtgggaccactccaatttccgcgacgacctgctcgggcgcctgcgtcgcaccggtcagttcatctcggccaccacctacggcccgctggccgatgccgagcgactgatcgagcgggtccggcgcatccacgaaagcgtcatcggccagttgcccgacggcacgcccctactccgccagcggacccggacctgctgacctgggtgcatgtcgccgaggtcagcagctttctcaagtcctacctgcgctatctcaatcccgacctgccgggcagcgagcaggaccgttactactcggaaatcgccctggtcgccgaacgcctcggcgcccgcgcggtaccgcgcgaccgccagcagatcgccgcctacctggaggcgatgcgtccacgcctgcgttgcgacgaacgcacccgcgaagtggtgcggattctcttcaacgcaccagcgcccagcaccctggccaggccgttcggcgcgctgatgctgcgcgcaggcgccgagctgttgccggaatgggccggatcgatgctcgacctcccgttcagtccgctacaacgccgcctgatccgcggcagcgtcaggcgcagcgtacccttgctgcgctgggcggtgcgcaacgcttcgatgcatcgagcctgccggcgcatgggtctgccgccggtgagccactga

SEQ ID NO: 10239 - DNA, 3375 bp, Pseudomonas aeruginosa
cagcgagaatacccgtccaaaggctctgaaacggcgcgaatcacggtcggaaccttgaggccgtgccatactccaacgcaccgcttagaacggaaaacgaaagagagccatgcccaaaggactgaaacgcgctgtcagcgccctgctgatcaccttcctcgtctattgcctgctgggctttctgctcatacccggcatcgggctgcgcgtcgccaaccagcaactggcgcaatacgccaccgtccccgcacgtctcgaacgtatcgaattcaaccccttcagcctggaattgaccctctggggtctgcgcctgggcgaggagaaaaaccccagctcgccttccgccggctgtacgccaacctgcagctggacagcctgtggaaacgccagctgcacctggccgacgtcgagctggaaggtccgcataccgaactgctgttcgacgagaagggccagctcaacctggccagcctgttcaggatcccgccgagcgaatcgcccgagcctgaacagccgagcgacccgttcccgctgcgcatcgaccgcatccaactggccgagggcagcctgcacttccaggacctgcgaccgagcgagccggtggacttcagcttcgatccgctgggcttcgagctgcacaacctcagcaccctgcccgacgacggcgcgaagatgaccctggtcgccaccggcccgaacggcggccgcctcgactgggaaggcgacctgaccctggtgccgatcacgtccaggggccacgtgagcgtcaaggatatccagctcaaggcatggtggccctatgtccgcgacaatgccccgctggtgctggagaacggcgtggtcagcctctccagcgactatcgcctggacctgtccaaggacacccagctgctgctcgacaaggccgcgctgaaactcgccgacttcagcatcaattcgccccagggcaagccgctggccaagctcgccagcctcgacgtggccgctaccaccctggacctggccaagcaggaagtggtgctcggcgaagtccgcagccagggcctggaggcctgggccgcgcgcgagaaggacggccagctcgactggcagaaactgttcgccgacttcactccgccgccacgcaaggcgcctgcacccaagccggcggaaaacaccgatcccgccgctgccccgaccgacgcggcgaagaccacccgcgaaccggcaaccgacggtgccgccaaggcagccgtgatagcctcgggcgaagcgggcaaggacaggccggcggagaaggacgccagcgtcgccgagacggaaagggcaacggacgacaaagagtccgccaaggtcgcggaaggcgctgccgacaaggtagccaagcaagagacgagcaaggctccgaagaccggcaaggcaaccgggcaggaaacggccaagactgcggaaatcgacaaggcagccagcgactctccgcaacagctcgccgacactgcaaagacgcctccgccggaaagtacgaaagccgccgcggagacgcccgccaagccctggcacatcgtcctgcgcgacgcccagctgcgcggctacaaggcgcacctggtggatcgccagccggccaccgaggtcccgctggaagtcggcccgctggacctcgacctgcagaacgtcgacagcctcggcaagacccccttcgacctcaagctcaagaccggcctcggcaaccgcggccaggtccaggccagcggccaggtggtgctcgacccggtcagcgccaggctcaaggtcagtacccgcgacatcgacctgcgcgtggcccaggcctacatctcgccgttcatccgcctggaactgcgcagcggcttccttggcagcgagctggcggtcgacctgaagagcgtcgagccgctggccttcagcgtcgacggcagcgccgaagtcagccagttgcataccctggataccatcaaggaccgcgacttcgtcaaatggaccaagctgaccctcaacggcctcgcctatcggcacgaggacagcctgtcgatccagagcgtgtccttcgaggagccctacgcccgcttcatcatcaacgaagatcgcagcaccaacgtcagcgagctgatcatcccgcaaccgggtagttcgtccggcaaggccgccgccgaaagcaagaacgcgccggcgagcaagccgctgggcatccacatcggcggcgtacggatcaacaacggctcggcgaacttcgccgacctgaccctgatgccgccgttcggtaccgccatccagcagctcagcggcgaagtcggcaccctcgacacgcgcaactcgcagccggccaaggtggacatcaagggcaaggtcgacaagtacgcaccggtgaccatcgccggcgaactggacccattcgacccgctgaagaaactcgacatcaccaccagcttcaagcgcgtcgagctgaccaccctgacgccctattccggcaagttcgccggctaccgcatccgtaaggggcgactcaacctggacctgcactaccagatcgaacgcagccaactgaaggcggaaaacaaggtcctgctggaaggcctgcaactcggcgagaaggtcgacagcccggatgccgtaaacctgccggtgaagctggcggtagccctgctcaaggacaccaagggcaacatcgatatccagttgccggtggccggcgatctgaacaacccggagttcagcgtcatgccgatcgtctggcagaccctgcgcaacctggtcctgcgcgccgtgcaggcgccgttcaagttcatcgccggcctcgccgccggcggcaacgaggatctcggcacggtacccttcgccgcgggcagcgacgagctgacgccggaagcccaggccaacctcgacaagctcgccgatgcgctcaaggagcggccggcgctgcgcctggaagtggaaggcgtggcctccgccgcggctgacggtccctcgatcggcgccaagcgtctcgaactggaataccagaacacctactaccgcatgctccaacgtcgcggcgacaaggtcccgagcgacgccaagcaactcgaggtaccggagaacatgcaggcgccgctgctcgaaggcatctaccggacccgcctgaagcagcagccaccagccgagtggaaggaactggacagcgacgaacgcaccgcgaagatgcgcgaagcggtgatcgcttcctgggccaagagccaggtgctgctgcgccagatcggccaggcccgggccacccggatcaaggattacctggtggagaaaggccagttgccggacgatcgcatctacttgatcgacgtcagtttcgccgaaggcgaagacaagggtaatgtcgacacccaactgcacctggatagcgagtga

SEQ ID NO: 10240 - DNA, 609 bp, Pseudomonas aeruginosa
taccttgcacaagcgattcgccgccctggcggcccccctgctctaccttgcctgcgcgagcgcgcaggccgacaccatgcgttgcggcagtgcgctggtcagcgtcggcgaccgggccttcgaagtacagcaaaagtgcggcgatccggatcaccgcgacgacgtcggctataccctgggcagctacgatcggcgggaattcaaggtcgaggagtgggtgtacggcccgcgcaacggcgtgacctacatcctgaccttcgaagccaacaagctgaaacgcatcgagttcaagcgttgaatcgctcgcttccgcgcaccgggctggtggcgttgctgtccctgctgccgttggcacatgctcaggccgattcgctgcgttgcggcagccgcctggtgagtaccggcgacagcagcgccgacgtccttgcgcgctgcggcgagccacgcagccgcgacagcctgggttatcgcgaggtcgtcggggaatggggcaagcgctacgaggtcgaggtccaggaatgggtctatggcccatggaacggcatgctgtatttcgtccgtttcgagggcaaccgcctcagcgccatccagagccggcgcggcgactga

SEQ ID NO: 10241 - DNA, 525 bp, Pseudomonas aeruginosa
atcttcacgctgccatcgtcctcgatgtcgatcgaggccttggtctcttcgcagataccacggatggtcgcgccgcccttgccgatgacgtcgcggatcttgtccgagtcgatcttcatctgcagcatggtcggggcgttctcggacagctcggcgcgcggcttggcgatgacctggttcatctggccgaggatgttcaggcgagcttccagggcctggcccagggcgatctccatgatctcttcggtgataccgttgatcttgatgtccatctgcagggcggtgacgcccttgtcggtaccggcaaccttgaagtccatgtcgcccaggtggtcttcgtcaccgaggatgtcggtcaggacggcgaacttctcgccttccttgaccaggcccatggcgataccggcgaccggcgccttgaccggcacaccggcatccatcagcgccagggaggcgccgcacacggaggccatcgagctggaaccgttggactcggtgatctcggaaaccacgcgaatggtgtag

SEQ ID NO: 10242 - DNA, 657 bp, Pseudomonas aeruginosa
ccgatttccggatggaaaccgacgcgggcggcgccgatcgggccggcgaacggaatgccggagatcgccagggcggcggaggtgccgatcatcgcggcgatgtccggatcggacttcttgttggtggagacgacggtgcagacgacctgcacttcattcatgaaaccttcggggaacagcggacggatcggacggtcgatcaggcgcgaggtcagggtttcccttctcggaaggacgtccttcacgcttgaagaaaccgccggggatacggcctgcggcgtaggtcttttcctggtagtgcacggacagcgggaagaagtcgcggccttcggccggcgacttggcgccgaccacggtgaccagcacgctgacgtcgtccatggtgaccagtacggcgccggtggcctggcgagcaatacggccggtctcgagagtgacggtcgactgaccgaactggaattgcttggttaccgggttcacggtgtctttaccttctatgttgccttgggggaaatcggtggaatgccgggagtcggacccgaatcgattcctagaaagcgcgaagctggaagcccgacgccgatacccgcctcgtgtgcgggtatcgacgccagacttccagctccttgcttcaagctgccgaccggcgtcgcttag

SEQ ID NO: 10243 - DNA, 4665 bp, Pseudomonas aeruginosa
tggagcggcggatacgcttcacctgggccacgctcagtcctcggtctcgtcgccgtggcggcggccgtcttcggccaccgcacgttcgatcagcgcggacagctcggcgccgcggcggatgctttcgtcgtagtggaaatgcagttgcggcacgctgcgcagcttcatcgacttgcccagcaacatgcgcaggtagccggcggcgtcgttgaggatttccatgttcagggcgatcttgccggcatcgtcctggcccatgacggtgatgaacaccttggcgtgcgccacgtcgcggctgacctcgacaccggtgatggtgaccaggcccaggcgcgggtccttgatctcgcgctggatcagttgagccagttcgcgttgcatctgatcgccgatacgctgggtacggctgtagtcttttgccatttttcaacctgcctccagcgacacccggccactggaaaaaaaagcgacaaacgcccgggacagctggaagccggcccgggcgctgtggttacgcactcgccatcaaaggctgcgtgcgacttcgaccttctcgaacacttcgatcttgtcgccgaccttgacgtcgttgtagctcttcacgccgatgccgcactccatgccggcacgcacttcggcgacgtcgtccttgaagcgacggagagactccagctcgccttcgaagatgaccacatcgtcgcgcagcacgcggatcggacggttgcggtgcaccatgccctcggtgaccatgcagccggcgatcgcgccgaacttcggcgagcggaacacgtcgcgcacctcggcgatgcccaggatgttctcccgcagatcgctgccgagcatgccggtcagggccttcttgacgtcctcgatgatgtcgtagatcacgttgtagtaacgcatatccagaccttcggcttcgacgatcttgcgcgcgccggcgtcggcgcgcacgttgaagccgaacagcaccgcgttggaagccagcgccaggttggcgtcggactcggtgatgccaccgacgccgccaccgaccacgcggacctgcacttcgtcgttgcccaggccgctgagcgagccttgcagagcctcgagcgaaccgcgcacatcggccttgaggacgatgttcagggtcttcttctcttcctggcccatgttctcgaagatgttttccagcttgccggcatgggcacgcgccagtttcacctcacggaacttgccttgacggaacagggcgacttcgcgggccttcttctcgtcggcgaccacggtcatctcgtcaccggcatccggcgtaccgtccaggccgaggatctcgaccgggatcgacgggccggcttccttgatcggcttgccgttctcgtcgagcatggcgcggacacgaccgtagttgatgccgaccagcaccatgtcgccctggcgcagggtaccgtcctggaccagcacggtggccaccgggccgcgtcccttgtccaggcgcgactcgaccaccacgccacggcccggggccgacggagtggctttcagttcgagcacttccgcctgcagcaggaccgcttcgagcagttcatcgacgccagtaccgagcttcgccgaaaccgggacgaagggagcgtcgccgccccactcttccgggatcacgtcgagagcggccaggccgttcttgatgttgtccgggttggcctcgggcttgtcgatcttgttcaccgcgaccacgatcggcacgcccgccgctttcgcgtgctgcacggcttcctgggtctgcggcatgacgccgtcgtcggccgcgaccaccaggatcacgatatcggtcgcctgggcgccacgggcacgcatcgcggtgaacgcggcgtggccgggggtatccaggaaggtcaccatgccacgctcggtttcgacgtggtaggcaccgatatgctgggtgatgccaccggcctcgcccgcggcgaccttggcgcgacggatgtagtcgagcagcgaggtcttgccgtggtcgacgtggcccatgacggtgacgaccggcgcgcgggtgaccgcctcgccttcgaacttcagggactcggccagttgttcttccagcgcgttctcgctgaccagcttgaccttgtggcccagctcttcggcgaccagttgggcggtctcctggtccaggacctggttgatggtcaccggggagcccatcttgaacatgaacttgacgacttcggcgcccttgaccgacatctgggcggccaactcggctacggtgatggtctcaccgatgttcacttcacgcacgatcggtcctgtcgggttctggaacccgtgctggttgcgcttcttcagcttcgacttgccaccacgaccgccgcgacggtaaccatcgctttcctcgtcggtgctgcgtggagccacgcgcggagcaggaaccttttccttctccttgaccgagggacggtgctgggtgtgcttgcggtcgcggcggtcatcgtcctcgtcacgcttgggcgcgcggcgcggctcttccttcttgcgttcttccacggcggcaggcttggccaccggttcggcagccgcgacatccgccaccacggcaggctcggcaccggcagtagccgctgcttcctgggcagccttggcacgcgcagcttcctcggccttgcgcgcttcctcttcggcacgctggcgggcagcggcctcttcggccttcagacgctccgcctcttccgccgcgcgctgctcctcgagttcgcgctggcgctcggcctcgatctcgtcggggctgcgcttgacataggttttcttcttgcgaacttcgacgctcaccgtcttgctgccacccactttcagcgtggtagtggtcttgcgttgcagggtgatcttgcgcggctcgctggcgcgatcgccatggctgcctttcaggtgggtcagcagggcttgcttctcgctatccgttacaacttgttcggcactggtgtgcggcagacctgcgtcacgcatctgcagcagcaggcgctccaccggtgtgtcgaccacctgggccagttctttcaccgtgacttgcgtcatgcacttctctcctcaggccgcgactgcttactcgaaccaatgggcccgggcggccatgatcaacttgccggcacgctcttcgtccatgccgtcgatgtcgagcagatcgtcgatcgattgctcggccagatcttcacgggtggttacgccacgcagcgccaggtccagggccagctccttgctcatgccatcgaggctgagcaggtcttctgccggttgtgcgtcggcgagcttctcttcggtcgcaatggccttggtcagcaggcgatccttggcacgggagcgcagctcgttgacgatgtcttcgtcgaagccatcgatgctgagcatctcttccatcggtacgtaggcgatttcctcaagagtcgtgaagccctcttccaccagtacctgggccagttcctcgtcgacatccagctcgtcgacgaagcgctgcaggatatccccggtctcggcctgttgcttggcctggatatccgcctcggtcatcacattcagggtccagccggtcaactggctggccagacggacgttctggccactgcggccgatagcctgcgccagattgtcctcggcgacggcgatatccatggtatgggtatcctcgtcgacgatgatcgccgccacctcggccggagccatggcgttgatcacgaattgcgccgggttgtcgtcccacaggacgatatccacccgctctccaccgatctcgccggataccgcctggacccgcgaaccgcgcatgccgatgcaggcgccctgcgggtcgatgcgtttgtccttggaacgaacggcgatcttggcgcgcgagcccgggtcacgggcggctgccatcacgtcgatcaactgctcggcgatttccggcacttcgatgcggaacagctcgatcagcatttccggcgcggtacgcgacaggaccagttgaggaccgcggttctcggtccggatctccttcagcagggcacgcacgcgggtgccaacgcggaaggtctcgcgcggaatgatctggtcgcgggccagcagcgcctcggcgttgttgccgagatcgacgatgacgttgtcgcgggtgaccttcttcacggtaccggaaatgatctcgccgaccttctcgcggtaggcatcgaccacctgggcgcgctcggcctcgcggaccttttgcacgatgacctgcttggcagtctgcgcagcgatgcggccgaactcgatggattcgatcttttcttcgatgacctcgccaaccttcgcgcccggcttctgctcctggacgtcctcgacggtgatctcggtggcggggtcctggtagtcctcgtcggcgacgacgtgccaacgacggaaagtctcgtagctgccgttatgacgattgatctcgacgcgcaggtcgacctcgtcctcgaaacgtttcttggtggcggtcgccagagccagctccagcgcctcgaaaatcacgccggccggtacgcccttttcgttggataccgactcaacaaccagcagtacttctttgctcattgtacgcctcgcctttcaatccattggatccgcggattcgcgtctcaatcaaaacggggaatgatgttggccttgtcgatcgaatcgatcggcagcaggtactcgtga

SEQ ID NO: 10244 - DNA, 1386 bp, Pseudomonas aeruginosa
cggaaccttggcttccgaaaacagttgccgaagcacctgcaccgaaagaagcccctgcatccgcacccttgccatgctgaacgaggatcaggccaacaagacccaatgccatcagcaggtgcacgacaattacgaccttttccagcatcttcagcttcccgcggcacgacagatcgcgccgaactcatccgcattgagggaggctccacctaccagccccccatcgatatccggcatgccgaacaactcggctgcacttgccgcctttacactgccgccgtaaaggagtcgcacaccttttgcgacctcggcattttccgctgccagttgcgcgcggatcgccgcgtgcacttcctgggcttgcgcgggggacgcggtcaacccggtcccgatcgcccagaccggctcgtaagccacgactgcgcgagcaaaagctccaacacccaactcgtcgatcacgcttcccagctgccttgcgacaacctccagcgtcttgcccgcctcgcgctccgcccgggtctccccgacacacagcaccggcaccaggccgcacgactgagccgcggcaaacttgcgactcacaacctcgtcactctcgccgagaatcaggcgacgctccgagtggcccacgaggaccatgctacaaccgacatccgccaactgactgggagcagtctcaccggtcagcgcgccttgcatcggctcgacggcgctgttctgcgcacctacatcgatcgccttgccggccaggccctggatgacctggctgatgaacaagcaaggcggcatcacagctacatcgactccgctcggcaacgccagctgacgcaagcctttgatcaactcggccacactggaatgcgtaccgtgcattttccagttaccggccaccaagggtcgacgcatgctgtacctcgcggggcaaagtgggcgcagatgttactcaacagtttccagactggcaagcaaaatcaagcacatacctcagaaacaatttttgccagctgttcggcgtgggcacgaacgctagcttcctcgtcaccctcgaccatcacccggaccaacggctctgtgccggatttgcgcagcaggacacgaccgcgcccgcccatttgctcggtgacgcggacgctggcctccttcaccgaggggtgctcgagcggatcgttttcgcccttgaagcgcacattgatcagcacctgggggcacttgcgaatcccctggcgcgcctcggccagggtctggccgcgatgcttgagcgccatcagcacctgtagcgccgcgatgatggcatcgcccgtcgtggtgttctggcagcagacgatatgtcccgaattctcccctcccagcatccagttccgagccagcagttcggccatcacatag

SEQ ID NO: 10245 - DNA, 2691 bp, Pseudomonas aeruginosa
gctgccgtagaggcgttcgtccacctcccgccccagtaccttgccgatcatgctcttgcgcgaaacgccgaccaacaacggcaagcccaggccatggagtgcctgcagatgcctgaacagcaccaggttgtgctccagtgtcttggcaaaaccgaaacccggatccagcaacagccgctcgcggtcgattccggccgccacgcaggcattcacacgctcctgcaggaacgcgccgacttccgccaccacatcctggtaggcaggcgcatcctgcatggtctgcggttctccacgcatgtgcatgaggcagaccgccaggccgctatccaccgcagcatccagcgcaccgtcgcgctgcagcgaacggacgtcgttgatcagacccgctccgagacgcgcagtttcgcgcatgaccgcgggcgtggaggtatccaccgaaatcacgacgtccagctcgcgagcgatgcgttcgactaccggagcgacccgctccagctcctccgtcggagaaacgctgcgcgcaccgggacgggtcgactcgccgccgacgtcgatgagcgttgcgccttcccgcaccatgcgctcggcatgccgcagggcatcgtccagccggtcgtaacggccgccatcggaaaaggaatcgggggtgacattgaggatgcccatgacatgtgggcgggccaaatcaagaacccgactgccgcaaggcagtcgggtcgggtattgcggattgctcattcagggctctcagtgctcgccggccggcccaccgatgggaggggtattctcgcggcggcccgactcttccaggttggccggcggggtgccggtacccgaaccaccctgccagtcacgcggctcgcgcggcacgcgaccggccatgatgtcgtcgatctggtcggagtcgatggtttcgtacttcatcagtgcgtcggccatcatctccagcttgtcgcggttctcgtcgagcagtcgcttggcggtaccgtagcagtcgtcgatgatgcgccggacttcctggtcgatcatcttggcggtctcgcccgacacattggcgtgctggctgccggcgctacggccgaggaacacctcgccctcctcctccgcgtacatcagcgggccgagcttctcggacagaccccacttggtcaccatgttccgcgccaactgggtagcacgcatgatgtcgttggaagcgccagtggtgacgccttcgaagccgagggtcatctcttccgcgatacggccgccgaacagcgagcagatctggctttccagcgcgcgcttggacaggctgtagcgatcttcctcggggaggaacatggtcacgcccagggcgcgtccgcgcggaatgatggacaccttgtagaccgggtcatgctccggcaccaggcgaccgacgatggcgtggccggcttcgtggtaggcggtgttgcgcttctccttctcggacatgaccatggtcttgcgctcggcgcccatcatgatcttgtccttggccagctcgaactcgcgcatgtcgacgatgcgcttgttggagcgcgcggcgaacagcgaggcctcgttgaccaggttggccaggtcggcgccggagaaaccgggcgtaccgcgggcgatgacggcaggatcgacatggtcgcccagcggcaccttacgcatgtgcaccttgaggatctgttcgcgcccgcggatatccggcaagccgaccaccacctggcggtcgaagcggcccggacgcagcagcgccgggtccagaacgtccggacggttggtggcagcgatgacgatgatgccatcgttcatctcgaagccatccatctccaccagcaactggttgagggtctgctcgcgctcgtcgtgaccaccgcccaggccggcgccgcgatggcggccgacggcgtcgatctcgtcgatgaagatgatgcacggcgcatgcttcttggcctggtcgaacatgtcgcggacacgggaagcgcccacgccgacgaacatctcgacgaagtcggaaccggaaatggtgaagaacggcaccttggcttcgccggcgatggccttggccagcagggtcttgccggtgccgggcgggccgaccatcagcacgccgcgcgggatacggccgcccaggcgctggaacttgcccggatcgcgaaggaactcgaccagctcgctgacctcctccttggcctcgtcgcagccggcgacgtcagcgaaggtggtcttgacctggtcctcggacagcaggcgcgccttgctcttgccgaagctcatcgggccgccgcgaccgccgccgccaccctgcatctggcgcatgaagaacatgaagacggcgatgatcaccaggatcgggaagctggcgaccagcaactgggtccagatgctctgctgttcgggctgcttgccctcgaccacgacgttgttgttgaccaggtcgccgatcaggccgttgtcctggatcgccgggcggatggtcttgaaggtatcgccgtcgctacgcttgccggtgatgacatagccatccacggtcactcgctcgaccttgccatccttgacctgctggatgaagtccgagtagttcagcgtctgtggctcgctcgggctcgagaaattgttcatcacggtcaccagtaccgccgcgatgatcagccacagaatcagattctttgccatgtcgttcaattgactaccctctga

SEQ ID NO: 10246 - DNA, 432 bp, Pseudomonas aeruginosa
gccttggcaaaggcttcggcaaagctatcaccgacgcccatcacttcaccagtggacttcatttccgggccgaggatcggatcgacgccggggaacttggcgaacgggaacaccgcttccttgacgctgaagaacggcgggatgatttcctgggtgaagccgacctcggccagggtcttgccggccatgacgcgggcggcgaccttggccagcgactcgccgacgcacttggagacgaacggcacggtacgcgaggcgcgcggattgacctcgatgacgaagatatcctcgccctgcaccgccatctgcacgttcatcaggccgaccacgccaagctccagggccattttcttgacctgctcgcggatctcgtcctggatgtgctgcggcagcgagtacggcggcagcgaacaggcggagtcgccggagtga

SEQ ID NO: 10247 - DNA, 516 bp, Pseudomonas aeruginosa
accggcagcaccttcagcttgtggcgatggctgcgcaggttcttctcggtgacgcctagcagcttggccaggcgcgcgtcggagaagcccttgcgcttgagcttgtacatcagctcgcgatcgatggaggacaggccgagggtcttgaccttctcctcgtccttgaccaggtcctcgatctgcaccaggaaccattcgtcgatgcgggtcagctcgaacacttcctcgacgctcttgccggcgcggaaggcgtcggcgacgtaccagacacgctcggcgctgggcacggtcagctcgcgcttgaggatgctgtcggcctccgggtcgttcaggtcgagcttcggatcgaagccggtggcgccgacttccaggccgcgcaaggctttctgcaccgactcctggaaggtccggccgatggccatgacttcgccgaccgacttcatctgggtggtcaggcgggcatcagctttcgggaacttctcgaaggcgaagcgcgggatcttggtcaccacgtag

SEQ ID NO: 10248 - DNA, 441 bp, Pseudomonas aeruginosa
ccgaccgccagcttggcggcgatcttggcgatcgggaaaccggtggccttggaggccagggccgaggagcgggaaacccgcgggttcatctcgatcaccaccatgcgcccggtgttcgggcagatgccgaactgcacgttggaaccgccggtttccacgccgatctcgcgcaataccgccagcgaggcgttgcgcatgatctggtattccttgtcggtcagggtctgcgccggcgccacggtgatcgagtcaccggtgtgcacgcccatcgggtcgaagttctcgatggagcagacgatgatgcagttgtccttcttgtcgcggaccacctccatctcgtattccttccagccgatcagcgactcgtcgatcaacagctcgttggtcggcgacaggtcgaggccacgggcgcagatctcttcgaactcttcacggttgtag

SEQ ID NO: 10249 - DNA, 816 bp, Pseudomonas aeruginosa
tcaggacagggttgcggtggccagcttcacaccaaagccgacgaacagggcgccgacgcccgaagtggcgccggcagccaaccgttgccgccggcggaaccaggccgccagccgcacaccggtgaaaatcaggaagctcaggtaaagggcgctgaccagttccaggatcaccgccagcaccaggaacgacagccccggataggcatagccgggatcgacgaactggatgaagaaggagatgaagaacaggatcgccttgggattcgacaggctgagcagcagcgccttgcggaacggctggtggacatccaccttttcggcctgcgccgccgtcgcctcgggattgcgcagcttgcgccaggcgccccgcagcatgccgacgccgagatagaacaggtaggccgcaccgaggtacttcaggccgatgaacagcatcggctcggccttcagcagggaggccacaccgagggccgacagcagcatcagcaccgcgtctccgaggaacacgccgcaggcggcccggtagccggtcgccacgccacgctgggccgaagtcgcgaggacgaacaacgagttcggtccgggcaacaggatcacgaaaaccacacccagcacgtaggtccagaaatcggttatccccagggtcggcatggctctgctcctcagcgacgctcggccatcgccgagatgaagcggtcgaacagcggggcgacgtcatgcggaccggggctcgcctcggggtggccctggaagctgaaagcgaccttgtcggtgcgctcgataccctgcagggtaccgtcgaacagcgacttgtga

SEQ ID NO: 10250 - DNA, 1260 bp, Pseudomonas aeruginosa
gtcgtcgaagaaacgcttcatgccttcgaaccagccactggccttgggcgaatgcgaggtgtcgctctgcaacgacttgcggaactcctcgagcagctcgcgctggcgcttgtccaggttcaccggggtttccaccaccaccttgcacatcaggtcgccggcgccgccgccgcgcaccggggccacgcccttgccgcgcaggcggaacagcttgccggtctgggtgctttccggaatcttcagcttgacccggccatccagggtcggcacttccagctcgccgcccagcgcagcgtcggcgaaactgatcggcacttcgcagtacagatgcttgccgtcgcgctggaagatcgggtgctcgcgcacattgaccaccacgtacaggtcgcccgccggaccacccatgctgccggcctcgccttcgccggtgaggcggatgcggtcgccggtgtcgacgccggccggcaccttcaccgacagggtcttctgctcttccacgcgcccctggccatggcaggagccacagggatcggaaatcatcttgccggtgccgtggcagcgcgggcaggtctgctggaccgagaagaagccctgctgcatgcgcacctggccgataccgccgcaagtggtgcaggtgaccggtgtggtaccgggcttggcgccgctgccgttgcaggtcttgcaaccgaccagggtcggcacgcggatggtgacggtggtgccacgtaccgcctcctccaggtcgaggtccagggtgtagcgcaggtccgcgccgcgctgcgcgccgccgcgcgagccaccgcgggcaccgccgccaccgaagaaatcgctgaacacatcgccgaagatgtcggagaagctcgccccgccgaaaccggcgccagcgcccccacccatattcggatcgacgccggcatggccgtactggtcgtaggccgcccgcttgctggcatcggagaggacctcgtaggcctcgttggcctccttgaacttgtcctcggcttccttgtcgccaggattgcggtccgggtgatatttcatcgccaggcggcggtaggccttcttcaggtccgcctcgctggcgccacgctcaacccccagaacctcgtaaaagtctcgtttcgccataacctttccgtctcaattaaggaccctccagacacgccaacgcgggagcaggctcccgcgtggcggatcatgcgtaccggcctggccggcacgcggggcagaagcaagccggggcttacttgttgtccttga

SEQ ID NO: 10251 - DNA, 408 bp, Pseudomonas aeruginosa
tcacgatggactgctgcttgccggtggccttgtccttcgccgagacgtgcaggatgccgttggcatcgatatcgaaggtcacctcgatctgcggcacgccgcgcggagccggcggaatgtcggccaggtcgaacttgcccagcgacttgttctgcgcggcctgcttgcgctcgccctgcagcacgtggatggtcaccgcgccctggttgtcgtcggcggtggagaacacctgcgacttcttggtcgggatggtggtgttcttctcgatcagaccggtcatcacgccgcccagggtctcgatgccgagggtcagcggggtcacgtcgagcagcagcacgtccttcacgtcgccggccaggaccgcgccctggatggcggcaccgacagccacggcttcgtccgggttga

SEQ ID NO: 10252 - DNA, 681 bp, Pseudomonas aeruginosa
ttttgcccatattcactctccagaaactttgattccgtgcgacccgcccgtgggtctcgtgctcggttgactacccagatggggtcgtcgcgtcgaatttcaagcctgctcgtcgatggacggcggggtttccgccggcgccttgctgactaccaccatcgccggacgcagcaggcggccgttgagcaggtagcctttctggaacaccttgaggacactgcccggctcggccgaagcgctttcctgcatggccatcgcctggtgctgctcggggttgaaaggctcgccttccgggttcagcgcctccacctggtagcggcgcagggtgtcgtcgaacatcttcagggtcagttccatcccttcgcgcatcggcttgatcgcctcgtcgttgggatcggacatctccaggccgcgctcgagggtgtcgaccaccgccagcaggtcgccggcgaatttctccagcgcgaacttgtgcgccttctcgacatcctgctccgcacgccggcgtacgttctgcagatccgcgaccatgcgcagcgcctggtcctgggcggcagccagctgctcctccagttcctgcacgcgggcggtcaggtcctcggcggcgccggtgggctgctcgggggtctgttgatccagggtctgctgttcgtcagccatgccactctccttcaaaaataa

SEQ ID NO: 10253 - DNA, 576 bp, Pseudomonas aeruginosa
tcgggcttttatttgcccagccaagatagtggaagtcgctcaccgatgcaaaacgccaagctcatgctgacctgtctcgctttcgcggggcttgccgcactcgccggttgctcgtttcctggcgtctataaaatcgacatccagcaaggcaacgtcgtaacgcaggacatgatagaccagttgcgtcccggaatgacccgacgccaagtgcggtttatcatgggcaacccgctcatcgtcgataccttccacgccaatcgttgggactacctctacagcatccagccgggcggcggtcgtcgccagcaggagcgcgtcagcctgttcttcaacgacagcgaccagctggccggcctgaacggcgacttcatgcccggcgtcagccgcgacgaagcgatcctcggcaaggaaggcagcaccaccgtcacccagccggccgaccagcagaaaccggaagcgcagaaagaagagccgccgaaaccgggctccaccctggaacagctccagcgcgaagtggacgaagcccagccggtaccggttccgactcccgaacctctggatcccagcccgcaatga

SEQ ID NO: 10254 - DNA, 1824 bp, Pseudomonas aeruginosa
gcgctcgcttttgtaaattggtcttaccaattatgcgagctttgccaggttcggctgcccagcgcccttgcacacacaggtcttggcgcgtgtccgatctggtcacaggcaaacccaacaacaattagggagccaacccccatgcaagcctggcaacaactctatacccccctgggcagtctcggcctgtcggccgccgcggccgtcatcccgatcgtgttcttcttcctcgccctggcggtattccgcctcaagggccacatcgccggcagcatcaccctggcgctggccatcgcggtagccatcttcgccttccacatgcccgccgacatggccttcgccgccgccggctacggcttcctctacggtctctggccgatcgcctggatcatcgtcgccgcggtcttcctctacaaactgacggtgaagagcggccagttcgaggtgatccgcagctcggtactgtcgattaccggcgaccagcgcctgcaggtactgctgatcggcttctccttcggcgccttcctcgaaggcgccgccggtttcggcgcgccggtggcgatcaccgccgccctgctcgtcggcctcggcttcaatccgctctacgccgccggcctgtgcctgatcgccaacactgcgccggtggccttcggcgcactgggcatcccgatcatcgtcgccggccaggtgaccggcatcgacgccttcaagatcggcgccatgaccggccgccaactgccgttcctgtcgatcctggtaccgttctggctggtgttcatgatggacggctggcgcggcatccgcgaaacctggccggccgccatcgtcgccggcggcagcttcgccatcacccagtacctgacgtccaacttcatcggcccggagttgccggacatcacctcagcactggtcagcctggtctccctgaccctgttcctcaaggtctggcagccgcagggcgccagcgaagcgctcgccgcaggcggcggcgcggccgtggccggtggcagcttcggcgggcaacgcagcgtcgaaccgtccgcctacagcttcggcgagatcctcaaggcctggtcgccgttcctggtgctcaccgtactggtgaccatctggaccctgaaacctttcaaggccctgttcgccccgggcggcgagctctactggctagtgttcaacttcgccatcccgcacctcgaccaactggtggtcaagggcgcgccgatcgccaccagcgccacgccgatcgcggcggtattcaagttcgacccgatctccgccaccggcacggcgatcttcctctcggcgttggtatcgatgttcattctgcgcatcggagtgaaaattggtattaccactttcaaggaagtcctggtagagctgaagtggccgatcctgtccatcggcatggtcctggccttcgccttcgtcaccaactactcgggcatgtccaccaccctggccctggtcctggccggtaccggcgcggcgttcccgttcttctcgccgttcctcggctggctgggggtattcctgaccggttcggatacgtcctccaacgccctgttcagctccctgcagtcgaccaccgcgcaccagatcggggtcagcgacaccctgctggtggccgccaataccagcggcggcgtgaccggcaagatgatctccccgcaatccatcgccgtggcctgcgccgcgaccgggatggtcggcaaggaatccgacctgttccgcttcaccctgaagcacagcctgatcttcgccgcgctggtcggactgatcaccctggcccaggcatacctattcaccggcatgctggtgcactga

SEQ ID NO: 10255 - DNA, 945 bp, Pseudomonas aeruginosa
ccgcgccctgatcggccgcgcgtcggcgatactgcgcaggaaatggcccggggaggctcgcctacgatcgtaggcccggctcccttggccatttccgccgtgtcccgctccactgcgctcgatgcaaaacctttcgacacaacggaagagcccaatgatcatttccgcttccaccgactaccgcgccgccgcccaacgcaagctgccgccgttcctcttccactacatcgacggcggcgcctacgccgagtacaccctgcgccgcaacgtcgaggacctgtcggccatcgccctgcgtcagcgggtgctgaagaacatgtccgagctgagcctggaaacccgcctgttcgacgagaccctagcgatgccggtggcgctcgccccggtcggtctcaccggcatgtatgcccgccgcggcgaggtccaggcggcgcgcgcggcggcggcgaagggcgtgcccttcaccctgtcgacggtatcggtgtgcccgatcgaggaggtcgccccggccatcgaccggccgatgtggttccagctctacgtgctgaaggaccgcggcttcatgcgcaacgccctggagcgggccaaggccgccggcgtcaccaccctggtgttcaccgtcgacatgccggtccccggcgcccgctaccgcgacgcccattccggcatgagcggcccctacgccgcgccgcgccgcatcctgcaagccatgacccacccggcctgggcctgggacgtcggcctgctgggcaagccccacgacctcggcaacatttccgcctaccgcggcaacccgaccggactggaggactacatcggctggctgggcgccaacttcgacccgtcgatttcctggaaggacctggagtggatccgcgagttctgggacggcccgatggtgatcaagggcatcctcgacccggaggatgccaggggatgcggtga

SEQ ID NO: 10256 - DNA, 2190 bp, Pseudomonas aeruginosa
ccgtcgtcccagggccgaggaaagccgatgagcctgccgattccctttctcgagaccgtcgagcggctgataccgcgcgaacgccgcttcgacgacccgctgtcgaccctggccttcggcaccgacgccagtttctaccggttgattcccaagctggtgctgcgcgtcgaaagcgaggacgaggtcgccgcgatcctatccgccgcctaccgcgagcaggtcccggtgaccttccgcgccgccggcaccagcctctccggccaggccatcagcgactcggtgctgctcgtcctcggcgacaactggaacggccgggaaatccgcgccgacggcgcgcagatccgcctgcagccgggtgtcatcggcgcccaggcgaacgcctggctggcgccgttcggccgcaagatcggtcccgacccggcctcgatcaacgcctgcaagatcggcggcatcgtcgccaacaacgccagcggcatgtgctgcggcaccgcgcagaacagctaccacaccctcgccggcctgcgcctgctgctggccgacggcacccgcctggacagcgaggacccggccagcgtcgcggccttccgcgccagccacggcgagctgctggaacggctcgccgaactcggccgcgagacccgcgccaacgccgaactggccgcgaagatccgccacaagtaccggctgaagaacaccaccggcctgtcgctgaacgcgctggtcgactacgacgagccgctggacatcctcacccacctgatggtcggctccgagggcaccctcggcttcatcagcgcggtgacctacgacaccgtcccggaacacccgcacaaggcctcggcgctgctggttttccccacggtggaaacctgctgcacggcggtcgcggtgctcaagcgccagccggtaatcggggggggactgttcgatcggcgcagcatgcgctcggtggagaacatgcagggcatgccggaatgggtgaagagtctttccgccggtgcatgcgccctgctcatcgagtcccgcgcggcgagccgcacgctgctgcacgaacagctcgggcggatcatggcctccatcgccgaatatccgctggagaagcaggtcgacttcagcgaagacccggcggtctacaaccagctctggcgcatccgcaaggacaccttcccggctgtcggcgcggtgcgcgagaccggcaccacggtgatcatcgaggacgtcaccttccccgtcgaacgactggccgagggagtcaaccgcctgatcgagctgttcgacaagcaccgctacgatgaggcgatcctcttcggccacgcgctggagggcaacctgcacttcgtcttcacccagggcttcgactcgcccgagcagatcgcccgctactcggcgttcatggacgacgtggcgcacctggtggcggtggagtacggcggctcgctgaaggccgagcatggcaccgggcgcaacatggcgccgttcgtcgaactggagtggggcgaggacgcctatcgcttgatgtggcagctcaagcgcctgctcgacccgcgcggcatcctcaacccgggcgtggtcctcagcgacgacccgcagagtcacctgaagaacctcaagccgctgccggccgccgacgagatcgtcgacaagtgcatcgagtgcggtttctgcgaaccggtctgcccgtcgcgcggactgaccctcacgccacgccagcgcatcgtcctgtggcgcgacatccaggcgaagaagcgcgccggcgtcgacaccacggcgctggagcgcgactaccgctaccagggcatcgacacctgcgccgccaccggcctatgcgcccagcgctgtcctgtgaacatcaacaccggcgagctgatccgcaagctgcgcggcgccgacgcccgccacgctggtggcgccacctggctggcgcgcaactttgccggagccatgcgcgctgcgcgcttcgccctgctcgctgccgacggcgcccggcgcctgcttggcgcgcccctgctggccagcgccagccgcggcctcagccaggccagcggcggccgcgtgccgcaatggacgccggcgctgccgcagccggtacgcttggcgccgccgcccgccccgctcgacgacgagcggccgagggtggtctatctcgccgcctgcgtctcgcgtgccatgggcccggccttcggcgactaa

SEQ ID NO: 10257 - DNA, 651 bp, Pseudomonas aeruginosa
cgcgagccgctgctggacaagacccgccgtctactggaaaaggccggctaccaggtggtgttcccggataacctggacaacctctgctgcggccagccgttcgcgtccaaggggtatgcgaagcaggccgacgacaagcgcgacgagctgctcgccgccctgctccaggccagccgcggcggcctcgacccgatctactgcgacaccagcccctgcaccctgcgcctggtccagggtctggacgatccgcgactgcagatccacgacccggtgaaattcatccgcagtcacctgctcgatcgcctggagttcatcccgcaggacaaaccggtagcggtgcacgtcacctgcagcacccagcacctcggcgagagccaggcgctgatcgacctggtcggccgctgcacccgcgaggtggtgatcccggaaggcattcactgctgcggcttcgccggcgacaagggcttcaccacgccggaactgaacgctcactccctgcgcaacctgaaggatgccgtgcagttctgcaaggaaggcgtgtccaccagccgtacctgcgacatcggcctcagcgagcacggcgggatcgactaccgcggggtggtctacctggtggaccgggtgacgcaggcgaagggcacgcctcggtag

SEQ ID NO: 10258 - DNA, 651 bp, Pseudomonas aeruginosa
cgccgctggcgctgttcgccctacgtcaggcgaaatggctgctccggcgtcgtcggcccgcgccgggtcgggcaaaaatccgtcgttaagcacctcttaagtcagccgcgcctatcgtgccttccaccgcgaggacatccctcgccgaaacggaagcaggaggccttcatggcaattcaaccgttgcgactcgatccgatcaccgtgctcggcaagcaactggtcatcgagctgttcgactgcgtcgaccagcgcttcgacgatatccagtggatcgaggaaagcatgctcgaggccgcccgccaggccaacgccaccatcatcacctcggcgttccacaagttcagcccgatcggcatctccggcgtggtggtgatcgccgaatcgcacctggcgatccatacctggccggagtacggctatgccgcggtcgacgtgttcacctgcggcgacgtactcgatggcgcccaggccgtgcgcgtgctcagcgaacgcctgggcagccgtcggcacctgatctcgagcatggaccgcggcctcggcggccatcgcctggggctgctcagccgcagcctggccggcaatggcccggtcgacgaagacagcccgaccctgcgctgggcgctgggccagggcacgggggtggcctga

SEQ ID NO: 10259 - DNA, 1086 bp, Pseudomonas aeruginosa
gccaggcccgttacgccgtcgacctcaccggcctggtgccggcggaggtcgccgccggggctgccgccgctgccgccgaaccacttctatttctatccgccggacccgctgctggaaggcgacggcgcgatcaccgcgatcgaggacagcgaccccttcgaccagtacgtctaccgcctgcgccgggtgctctaccagggccgcacgcgctggcagaacgtgctgatcgccgacacctacaactacgaccgcgtgctgatgctcgacggcgcgatccagagcgccgagagcgatgagtcgctgtaccacgagctgctggtgcagccggccatgctcgcccacgacgagccgcgcgacgtactgatcatcggcggcggcgaaggcgccaccctgcgcgaggtgctgtcccatgccagcgtgcggcgggcggtgatggtcgatctcgaccgggagctggtggaactgtgtcgcgaacacctgttccagtggcaccagggcgccttcgacgacccacgctgcgaactgctcgccgaggacggccgggcctatctcgagcgcgacccgtcgctctatgacgtggtcatcatcgacgtcgtcgacatgctcgacaacggcccggcccaggctctctatacccgccagttctacgagctgctgcattcgcgcctgcgaccgggcggggtggtcgcggtgcaggggctggagttctcccacagcgacgacaagccccacgcggccctcgcccgcaccctgcgcagtgtcttctcccaggtccacagctaccgcgccacggtgccctcgttcctctcctcctggggcttcctgctggcttccgactggctcgacacgaaccactggcaggccgaggacatcgaccgacgcatcgaacgcaagctcggcccgctgtggctcgaccacctcgacggcgactacctcaaggcctgcttcgtgatggaccgggaaacccgcttcctgctcgcccaaccgggaccggtactggaagacggcgtacccttcgtcgcaccgccggatatcgaggagatcgagttcggcccggcacaattgccggccctggcgaggacctga

SEQ ID NO: 10260 - DNA, 678 bp, Pseudomonas aeruginosa
aacgaggctgccatgagaatactgctggccgaggacgacctgctgctcggcgacggcatccgcgccgggctgcgcctggaaggcgataccgtggaatgggtgaccgacggcgtggccgcggagaacgcgctggtcaccgacgagttcgacctgctggtgctcgacatcggactgccgcgccgcagcggcctggacatcctgcgtaacctgcgccaccagggccggctcaccccggtgctgctgctcaccgcgcgggacaaggtggccgaccgggtcgccgggctcgacagcggtgccgacgactacctgaccaagcccttcgatctcgacgaactgcaggcacgggtgcgcgccctgacccgccgcaccaccggtcgcgccctgccgcaactggtgcacggcgagctgcgcctggacccggcgacccaccaggtgaccctgtccgggcaggcggtggaactggcgccgcgcgaatacgcactgctgcgcctgctgctggagaacagcggcaaggtgctctcgcgcaaccaactggagcagagcctctacggctggagcggcgacgtcgagagcaacgccatcgaagtccacgtccaccacctgcggcgcaagctcggcaaccagttgatccgcaccgtccgcggcatcggctacggcatcgaccagccggcgccctga

SEQ ID NO: 10261 - DNA, 465 bp, Pseudomonas aeruginosa
gttcgatgctttccgccaccgcctgttccagccgctgcatctccacgtccagcgcctcggcgctgtcggcgtagcgccgggcaacctcggcgaaagcgtcggccacggcgacgaaggcctccaccagccgtgggtcgaattcactgccggcgccggcctggatcagcagcaccgcctcggcatgcgccagcggcggccggtaggcgtgccggctggtcagttcatcgtagcggtcggccagggcgacgatccgcgccgccaggggaatccgctcgcccgcaaggccttccggaaagccccggccatcccagcgttcgtgatgactgtaggcgatctgccgggcgaagcggaggaatccggaaggctggccgagccgccgctcggcgctggccagggcgtcgcgcccggcgcgggtatggccctgtagcagggcggtgtcggcggcgtccagttgcccggggttga

SEQ ID NO: 10262 - DNA, 1287 bp, Pseudomonas aeruginosa
agacgctggagacgacttctgcacgtccggtcaggcgcccggggcgaccgttcagggcgtcaggcggaaacgcagtggcgaatcctcggcctcggcgccgttctcgctctcgccgaaggcccggcgctcgatggggtcctggccgaaatactccttgatcggcgactcgatggccttgccgccggggctcacgtgactggcgcaaccgccaaggaacaccaggaccacaccgatgaccagcgctttcatcttcgtacccccgtcagcccggcccatccgggcgctgcgccgcagcatggcgcagcccgccttagggatcgcttaaggcattcaggcagcggcgcggctggcgcgccactggggcaggccgatgagcaccacggcgctgatgatcaccagcatcgccagcccctcgataccgccgatccgctcgccggcgaacagggtgccgagcaacaccgccaccgccggattgacgtaggcatagctggtggccgccgccggccgtacgttgcgcagcaggtactggtaggcgctgaaggcgatgatcgagccgaacaggatcaggtacaccagcgccagccagccgctggtgctcggccaatgctccaggcgctcgccgctggccaggctgccgaccagcagcaccgcgccgccgaccagcatttccgcggcgctggccatcggtccggccggcagcgacaggcgccggctccacaccgagccgaaggcccaggacgcggcggcgaacaggatcaggccggcgccggcagggctggcctggaggttcgaaccgaggttgagcaggacgatgccgaacagcccgagcacgatgccgccccattccagcgtggtgttgcgctggccgaacaactggctgaacagcagggtgaacagcggcaccgtagccaccgcaagggccgccaccccggaagacacgccccagtgctcggccaccgtcaccccgccgttgccgcaactgagcaggaggattccgacgatccccgcgccgcgccactcgcgccaggtcggcaacggcgcgccgcgccagcgcaaccaggcgaacatcaggccgccggcgatgacgaagcgcaccccggccatcagcatcggaggccaggactcgacgccgaagcggatcgccaggtaagtggagccccagatgaagtacagggcgaagaacgcaccgaaaagcaacagcggaaggcgacgggcaggcatggaaagcactcgacagggcaggcgggagaaagacttcattttatgaggtcgctacccgccggttaa

SEQ ID NO: 10263 - DNA, 681 bp, Pseudomonas aeruginosa
ggcacagccgctggttatcgggacgtaacacttttctttccatggaaatcggccatgctttccggtcgattcgacaaccggggacccatcatggacaaatacgaccgtgcgctcctcgccgccctgatcgacaacggccgcctgaccttcgccgaactggcccggcgcatcaacctgtcgcccccggcggtggccgaccgggtggccaagctggaggccgaaaggggtgatcaccggctaccacgcctcggtgaacctggccaagctcggcctgcccatcgagtgcgtgatcgaactgcggatcaccgagaaggattgccagtcggtgctcgacgaactggcccggatcccccaactgaccctctgccaccggatcaccggcgacgcctgcgtgctgatgaaggccgccgtggcttcgatgccggagctgcaggacctgatcgaccggctgatgaagttcggcatcagcaagacctcgatgatcctctccacccccttcgccgaccgccagccggcaagcctgcgggggcaggacggcaatggcggatgtgcggcgtgagccctacgccggggttatccggcaggcgtcgggatccgtacttcatcgccgccacgaacccgaacggtagggcgcataacgccaacggcgttatccgccgcagcggcactcccggccgatag

SEQ ID NO: 10264 - DNA, 1185 bp, Pseudomonas aeruginosa
gctgcccttgacgttgagcttgctgcggtcgatggagcccagcggctggtcgaggccgaggcgggtcttgcagtactcggggtcttcccaggccttcagggtgcagagcacctgggcggcgaaggcctcgtggatctcgtagtagtcgaagtcctgcaggctcaggccgttgcgtgccagcagccgcggcaccgcgtagaccggcgccatcagcaggccctcctggcgatcgacgaagttcaccgccgccgcctcgccgtccttgaaataggccaggatcggcaggccgcgcgccttcgcccactcctcgctggccagcagtaccaccgaggcgccgtcggtcagcggcgtcgagttggccgccgtgagggtgccgcgcgaaccgcgctcgaacaccggcttgagggtgccgatcttctccaggtcgatatccgggcgcagtttctggtcgcgggtcaggccgcggaacggcgtcatcaagtcgttctgccagccctcctcataggccgcggccagcttgtggtggctctcgaaggccagcctgtcctgctcgtcgcgggggatctgccaggtctgcgccatcagttcgcaggactcccccatcgacagcccggtgcgcggctcgccgttgcgcgggatggccgggaccacgtggcgcgggcggatcttcagcaggctcttgagcttgtccaggttgctcttgccgcggttggcctcgaggagaatcttgcgcaggccctcgttgaccccgatcggcgcgtcggaagtggtatcgacgccgccggcgatgccgctgtcgatctgcccgagggcgatcttgttggccaccaggatcgccgcctccaggccggtaccgcaggcctgctggatatcgtaggccggggtttccggggccaggcgcgaaccgagcacgcattcgcgggtcaggttgaagtcgcgcgaatgcttcagcacggcgccggccaccacctcgccaaggcgctctccgtgcaggttgtagcgctccaccaggccttccagggcggaagtgagcatctcctggttgctcgccgtggcgtacacggtgttcgagcgggcgaagggaatacggttgccgccgacaatggcgacccggcgcagctgggtcatggaagaactccttgctggaatcgtttacgccgagccgaggctcgacccgttaactga

SEQ ID NO: 10265 - DNA, 1167 bp, Pseudomonas aeruginosa
ccgacgcggtgttcgccgccgtcgagggacagttcgagctgccgcgctggaccgccgaaacacagcccgcgggccaaggcggtgctgttcgatgccagcggcctgacccgcttcgagcagttggtggcgctgcgcgacttcttccagccggtgctcaagggcctcgacacatgcccgaaggtggtggtcctcggacgcgcccccgagtctctcaaggacccggtcgccgccagcgtgcaacgcagcctggaaggtttcacccgctccctgggcaaggaaatccgtcgcggcggcaacgtgcagttgctgtacgtcggcaagggcgccgaggaccaactggaaggcgcgctgcgcttcttcctctcgccgaagagcgcctacgtctccggccaggtgatccgtcttgccgccaacagcgcccaggtccacgactggagcaagccgctggccggccagcgcgcactggtcaccggcgccgcccgcggcattggcgcggccatcgcggaaaccctggcgcgcgacggcgcggaagtggtgctgctcgacgtgccgccggccagggaggccctcgaaggcctcgccgcgcgcctcggcggtcgtgccgtggccctcgacatctgcgccgcggacgccgggcagcaactggtggacgcgctgccggagggcgtcgatatcgtcgtgcacaacgccgggatcacacgcgacaagaccctggcgaagatgagcagcgacttctggaactcggtgatcaacgtcaacctcaatgccccgcaggtgctgacccaggccctgctcgacggcggcaagctgcatgacaacggccgggtggtgttgctggcgtcgatcagcggcatcgccggcaacctcgggcagagcaactacgcggtgagcaaggccggcctgatcggcctggcccaggcctgggcgccggcgctgggcaagcgcggcatcaccatcaacgcggtggcgccgggcttcatcgagacgcagatgaccgccgccattccgctgaccatccgcgaggccggccggcggatgaactccatgagccagggcggcctgccgcaggacgtcgccgaaacggtggcctggttcgcccagccgtcgtccggcgcggtcagcggccaggtgctgagggtgtgcgggcagagcctgctgggggcctga

SEQ ID NO: 10266 - DNA, 351 bp, Pseudomonas aeruginosa
agcgcaccccggccatcgccaggcgttcgcgcagacgtcgggccggcatgccgaggcgcgcggcgacctgctccagggtggcgcctccgtccaccagcaactcgccgatcagttcgcggacctggcgcaccaggtccaggcgctccacctcggccagttgccggcgcgccagcgactcgtgcatgcgcagcagttccggggcggcgtggcgcgagggtttgtccagcaccgcggcatcgaataccagcgcgtagcgcggcatgccgaggatcgtcgggcagccgtagaccgcacggtagcgctccatcggcgcgccggtttcgttcatcagttgcacttccagcggcttga

SEQ ID NO: 10267 - DNA, 402 bp, Pseudomonas aeruginosa
tcgccggcgattcgcccagcgacagcaccgcgcgctcgccctccacctccagttgcgcctgcagggtgtcggacagcaggcgtacgtagcgcagggaatggcgcaggccggcgccgaaggtatcgctggagaggaacaggtattccaggagcaggccgtggaacgccggcaggtgctcggccaggtgcaggccgacatgctcttcgccgcactcgtcggcggcggccttccagaacaggttctgtgcggaatgggggaaacggccggccggcaggccacccggtggcagcccgacacggaccaggacccggtccggatcgcagccgctggcgcgcagggcgtcgatcaccgggcgcatcagcgctacatcgtcggtcagatcacgcatggtgttttttctag

SEQ ID NO: 10268 - DNA, 2169 bp, Pseudomonas aeruginosa
cccatcccgcatgacggaaaaaccctcagatcgactagccgccggcgtggtcgaaaatctcgatgcagacgcatcccggagccgattgaccgccctgccagcggcgtcggccaggcggccaatgcctgctgcgggtgctcgactaagctgacagccacctatttcgaggagatgtccaatgcccaccgcctggctcgacctgcccgccccacccgccctgcccggcctgttcctgcgcgccgcactgcgccgcggcatccgcggcaaggccctgcccgagcgcggcctgcgcagccaggtcacggtggacccgaagcacctcgagcgctaccgccaggtctgcggcttccgcgacgacggcctgctgccgccgacctacccgcacatcctcgccttcccgctgcagatggcgctgctcaccgacaagcgcttccccttcccgctgctcggcctggtccacctggagaaccgcatcgacgtgctgcgcgcgctcggcggcctcggcccgttcaccgtgagcgtcgcggtggaaaacctgcaaccgcacgacaagggcgccaccttcagcatcgtcacccgcctggaagaccagcttggcctgctctgggtcggcgacagcaaggtgctctgccgcggcgtcaaggtgcccggcgaaattccgccgaaagccgagcaggagccgctgccgctggagccggtcgacaactggaaggcgcccgccgacatcggccggcgctatgcccgtgccgccggcgactacaacccgatccacctgtcggcgcccagcgccaagctgttcggctttccccgcgccatcgcccacggcctgtggaacaaggctcgcagcctggccgccctcggcgagcgactgccagcctcgggctatcgggtcgaggtgcgcttccagaagccggtgctgctgccggccagcctcaccctcctggccagcgcggcggcggcggacggccagttcagcctgcgcggcaaggacgacctgccgcacatggccgggcattggagccggctacagggctgacgccggtccgccatgccttgaagcttcgggcgcaaagcccgaagctatgcggctgcttaccgccaccgcgaagaatcccccatggacctgcacgaactcaccgcgcgcctgcacgccatccgcgaccgcaacgactggcgccaattccacagcccgaagaacctggccatggccgccagcgtcgagatggccgaactggtggagatcttccagtggctgacggaagaccagtcgcgcacgctgtcggccgagcagctcgaacacgctggccaggaagttggcgacatcgtcctttatctgctgctgttctgcggggaaaccggcctcgacctggaacaggtggtgcgcgccaagctggccgactgcgaacggcgcttcctgccatgagcgaccgccatttcgacgaactggcgacgcgcttcgccgaaaagatctatggcggcgccaagggtgcgatccgcctcgcggtactccaggccgacctcgccgaggccctcccggagcgacctctgcgggtcctcgacatcggcgccgggctcggccacatgtcgctctggctggccgctcgcggccaccgcgtaaccctcgccgagccagcgcaacccatgctcgacggcgcccgccagcgcttcgccgaagccgggcaggccgccgaattcatccaggcgccatggcaggaactgctcggccagttcaccgagccctacgacctggtgctctgccacgccgtgctcgagtggctggccgaaccccatgcgatcctgccggtgctgcaccaactctgcgcacccggcggctggctgtcgctggccttctacaatcgcgacgcgctgatctaccgcaacctgctcaagggccacttccgcaagctgcgcaagcaacgcttcgctggcgaggggcagagcctgaccccgcagcgcccgctcgacccgcgcgagctggaacaggcgctggcagcgcgttggcgcatcgaggcgcgcagcggcgtgcgggtgttccacgactacatgccgagcgagttccaggccaaggccgaacggctcgacctggtggaaatggaactggcctaccgccgccacccggcctttgccgggcttggccgctacctgcactggctgtgccgcccgcaatga

SEQ ID NO: 10269 - DNA, 426 bp, Pseudomonas aeruginosa
tcctgccgttactcgccagcctggccgccctcggtgcctgccagggcgacaatccctaccgcgccagctctctgccctacccgccgcagccggccaccgcggccaatcccggcctcgatcccggcgcctatccggcggcgccgcgcgactacgcccgctaccgtagctggagctgggccgccgccggggtcagcggctttccccagggcctggacgacaaccagttgcgcgacgccgtcagccagcagctcgaccagcgcggcctgcgcccggcgcggccgggcagcgcggccgacctgcaggtcagcgcgttcctgcgcagcgaactgcgcacccgccaggtcaccgactactacggcggctactacggcaactacggcggctggcgcgatccctggtacggctatggcgccagctacccggtga

SEQ ID NO: 10270 - DNA, 1020 bp, Pseudomonas aeruginosa
acatatagccggcgttcaagcgcgccagctcggccaggctcgactggccgaccgcgccggcgccctgggtcaggaccgccaggtcagcggggcgatagagcaccggatggccatcggcgctcaactgcaccgacaaccatagcgcgtcggcgccgttgtccagcgccttgcggatcgccagcagggtgttctccgggtagtccgcggtgccggcgcgatgggccaccagcagcgggcccgggccatccgccggtaccaccgagcgtgcctcgacgcagccggtcagcgacaggcccagcagcaggatcgcaatacttcgattcatttcattctcccgtcgcgccctatagggcgggtgctcgccaacgttacttgtggagacgcttcaaacccgcgtttcctcttgcctttcatccggcgctgagcttggatgtgaactctgactggagaaaaaccatgatccgccgaatcctgctgctcggcctgctcctcagcctcgcagcctgcgaaaccacccagctcgaccgcgacttcgacagctcccgcgacttcgccgcctaccgtagctggagctggtcgcaacccgccttcgaataccgccccgacgacccacgcatcaagagcgacctcaccgagcaacgcatccgcgaagccgtcgcccagcagctcgaccagcgcggcctgcgtccggcccagggcaacgccaggggcgacgtcacggtgcgcgcctacctgatcgtcgacgatcgccaggaccagatcaccaccaactacggcggcggttactggggcggctactggggaggatactggggcggcccggcgatggccgagacgcgcaccgtgaattacaaggttgccaccctccaggtcgacctgttcgacggcaaggacggcaagctggtctggcgcggcagcggcgagcagatcatgcgcaccagcccgccgagcccggccgagcgcgagcaggcgatccgcgagacggtgcagaaagtcatgtcgcaatacccgccgcgctga

SEQ ID NO: 10271 - DNA, 801 bp, Pseudomonas aeruginosa
cgccgctggcgttattcgccctaccccagctctccatcgccgccaatctcccgcatatccccggagtccgccatgtcctcaccccaaccgccccgcttcgacggccaacgctggagcaacgccgacgacgaccgcatcgaggtgctgcctgccgaccccgcctggccacaacacttcgccgccgaagccgaggccatccgcacggcgctggcgctgcccgggctgggcatcgagcatgtcggcagcaccgcggtgcccgggctcgacgccaagccgatcatcgacatcctcctgctgccgccgcccggccacgatccgcagcggctggtagccccgctggagggcctcggctaccagttctggcgcgagaacccgaacacccagcggatgttctttgtcaaaggcatgccgcccttcggccatggccgcacccaccatgtccatgtcatgcccctggcccaggccgaccgctacctgctgttccgcgactggctgcgcaaccaccccgacgacgcccgcctttacgccgaaaccaagcacgccctggcccgccggtaccccaccgaccgcgaggcctatacccgtggcaaggacgaggtcgtcgcaaggattttcggccgggcgctggcggcgacgcggcacccaatgatacagagtggcctggtaaggggagaacgcgaaatgcacgccagggaactgcgtgaaacgctggtcgccggcgcggaattgacgccaggcggccccgccgatacagcctatttcgagtcgctgcgcagccgggtaagcaagccccaggactga

SEQ ID NO: 10272 - DNA, 1665 bp, Pseudomonas aeruginosa
cgtgcttcgctcactactgcgactgtgcgagcgcggcttccaccaacctttcgatcacctcccccaccctccccggctcgccaacctccacccagcgcaaatgcgcgaaccgcggatcctcgcgcaggccggtgtatttgcggcggttgcctgcgaaggtggtccatgaccagagcaggatcgaatccctggagcagaacgccatccgcagcgattcacggttgccgtgggacaggcgggtgcgcagcaggccccgggccagggtgcggcgaaggacccgggagaacaccgtccagcgcccgaaattcagccataccacgtgggtggcgcggccccagagcaactcgcggacggcgctgtagttgccgtcggcgacccagcgcggcgccgtcgtcgcccgctccacggcgtgctcgaagcgttcgtggggcacggcttgccagccggggccccagtagagtcggtcgagttcgacatgcgtacaacccagcctggcggccagcgcggcggagaaggttgtcttcccggccccgctggtgccgaccaccaccacacgcagcggcgcgcctcgctcggcctcgacgcaggtcatgccttgaccgcgaccagcgtgtagcacatcgggatcgccagcggtccgtcctcgtagaggtcgtagagttcctcgcggttcgagtgcgggtactccttgaagtgactcaggcgcaggccggcgccgagcagcccgccgaggatgtcgccgagcgggtggacgtaccagtagctggcgatgccggtatcgctgccgctgccttcgtagacgatggcctcccgggatacgtggggcgtgtcggtgaagtagtcgttgcgcagttcgaacggtcgctccgactcgggttcgagcatctccaggaacgggtgggtctcatagatcgccaattgcccgcccggcttcagcaggccgctcaccgaggcgaagaagcgcgcgatgtcgggcatccagttgagcacaccgatggtgatcagcagcaggtcgaactgaccgttcagctcggccggcagctcgtaggcattggcttcgacgaaacgcggctgatgcggcgagcgctcggccagttgccgcgcctgggcgaggaaggcggcggactggtcgatccccaccgcccgcgcgacgccgaaggcgtacagcgaaagcacttcccggccgttgttgcagccgacctggaccgccgccttgccggccaggtccagattgcgcagcacgccagccagggtctcgtccaggcaactgaagccggtttcctgtaccgccagcgacaattcctgccagccgctgccacgcaggtgactgtcggcggacgcgtcccaggcgcgtcggttgctttccaccgcgtgttcaagatccgtcatgcgaaaacctcagaagtgttcccaggaaggccagccgagtcgcgaacccgcagcccactcaatcgcggaattgcagcccgatatgggctcggcagtcgcgtcgttccaggctgccttcctggaaagcgccgcaggcgcggtttctcagaggcagcgtctgttccaccacggtcacccgcacctcgttcgccggttggcgctgctcggcgggtcgcggcgcctgacgccggccgttcaggttgtcggccccgcctggcgggatgcgccggcgcgtag

SEQ ID NO: 10273 - DNA, 1998 bp, Pseudomonas aeruginosa
cacccgggccccccagcggaagccgaaggcgctgcgcacccagtggtagacgccgccgttggcggggaaggcggtgcccagctcggaggtcatcatggccatcggcaggaacagcaggaccagcacgtagagccaccagaacaggctcgacggaccgagggaggaagccagggcgatctggtccatgaagagcatcgccgagaccgtgtagagcaccacatcgcgcaaccgcaggaccttgttcttgttgtcgtccattggggttctcctgaatgttcgggtggggcgccggcggcgccccggcgcttaccggtgaccggcgcggacaagatcctccacggtttcctcgatgctctcgcgcagcacccggaccacggtatcgacctgttcgcgggtgaggatcagcggcggcgacatcacgttcaggtggacgatcggacgaaccagcaggccgcgcttctgcgcccgcaggtggacccactcgccgatgttcaggctttccggaaacagcgccttgctcgccttgtcggcgacgaactcgacacaggccatgaagcgcatcccgcgcacgtcgccgacgatgggcaggtcgcggagactttgcaggcgctcctcgaagtagcggccgacctcgtcggcgtgggcgagcaagccctcgcgctcgatgatctcgatgttcttcagcgccgccgcgcaggccaccgggtggccggagtaggtgaaaccatggctgaagcagcggcccttgtccggctcggcgatcacctcccagatgcgccgggagaagatgcacgcgcccagcggctggtagccggaggtgaggcccttggcggtgaggatgatgtccggctgtacgccgaacaccgcctggctggcgaagaagtggccgaggcggccgaaggaggtcaccacttcgtcggagatgtacagcacgtcgtagcgctggcacagatcccacatccgccggtggtagcccgcgggcgggacgatcacgccgccggagccgaacaccggctcggagatgaacgcccccacccggtcggcgcccagttcgaggatcttgcgttcgaactcctccaccaggccatcgaggaactcggcctcgcccactccttccggagcgcggtagtagtagggacaggcaaggtggtggatgcgctcgtcgaggaagtcgaactcggccggccggtcggcgctcttgccgcccagcgacatgccgaggaaggtcgagccgtggtaggcgttgatccgcgtgatgacgtgcttcttggcgcgcttgccgcggcagttctggtagtagtgcatgaggcggatcgcggtgtccacggcggtggaaccgccggtggtgaggaacacgtggtcgaggtcgccgggggccagctcggcgagcttgcggcagagttcgatggcgcgcgggttggccatgtcgcagaagggattggaataggccagcaggcgggtctgctcggccacggtgcgagccatttcctcgcgccccaggccgatgttggtgcaccacatgccgcccaccgcgtcgaggtagcggttgccggcggtgtcgtagatataggcgccgtcgccggcggcgatgttcagcgagccgttgacgcggtggtcgtcgaacacgtggtagccgtgcatgtagtgggcctggtcggcacggaccaggtcggcgtcgccgaggggggacgtggcgtgcattcttgcgttcatcgggctgtcgctcttctcggatggatgctccgagggtgcaagagcaccgcgcggcgggccataccccattttggggtaagcgctgggtgcggccgacgcggcttgctatcctgcggcgacaacgacaagaacgagccgtaccgtccatgcaggccatcgccccgaacgcgctcgaccgctggcacgaacacctggcgctggcgatccggcgcctgcgccaacccgacttcctcgccgcgctggtcgacgccatccaccaactggtgccgatcgagtcgagcatga

SEQ ID NO: 10274 - DNA, 549 bp, Pseudomonas aeruginosa
tcagcctggaacgcaagggccacgcgcccaccctgctctacgagcgcggcatcgccgagcgcttccgcgaggcgatcatccgccgctacttctcccgcggctacctgctcgaccctttctgcctggcggtggatgaatgccttccggaatgcttctacaccctcggcgagatcgcccccgacgacttcttccagagcgcctactaccagacctactacctcggcgccggagcggtggaggacgtctactacatcctcgacctcggccccaccgagaagctctcgatctgtctctacaacggcctttcggcgagccgctacagcgacgcccaggtcgccgtcctcgccggcctggcgccgccggtgctggagctggcccggcagttctgcgccgggcgcgccgacctctcgccgaacccgcaggccgacctcgccccgcgccttcaggaagtgctgcgcggcttcggtcgcgacgtgctcaccgaccgcgaacgcgaggcctgccacctgctgctcagcggccactcggcgaaatccagcgcgcggctga

SEQ ID NO: 10275 - DNA, 984 bp, Pseudomonas aeruginosa
agctgtgccagacgtgccggcgttcgtcggttgcgcgccggcgcggcgccgtcgagcacccgcccgccgccaagggtgcgctgcgccgactggtcgcgcagcaccaggcggtcgccatgcagggcctggatcggcgcgttcagcaccagttgggcgaaggcgcggtggccaggctccagttgttcgccttcgagcagggccaggcgcccggtgacgtcctgggtgcccaggtgcaggtgcaccggggtccagtgggtgaagtcgcggagttcgtcgggcaacaggcggaagtcgatgtcgacccgcgtggtcggcgcgtgcagcgcggcctgcagcagccagtcgccgcgctggatctgttccagcgcgaggcgctcgccggcgatgttcaaggccacgcgctggccggcccaggcctgttgcgcgggccggttctgcgcgtgcaggccgcgcacccgcaccggccgtccggcgttgccgaggagcagttcgtcgcccaccgcgacctgtccggagaaggccgtgccggtgaccacgatgccgctgccggcgacgctgaaggcccggtccaccgccaggcggaagtatccctcgcggctacgctcgcggacttcgccggcgagcccgccgagtgcttcgcgcaacgcctcgacgccctccccggtgctgctggagagcgggaagatcggcgagcgcgccagcgggccggaggccagcaggtgttcgacctgggtccgcacctgctgcacccgctgcggctcgacccggtcgatcttggtcagcgccaccagcgcccggcggataccgagcagttcgacgatcgccaggtgctcgcgggtctgcggcatcaagccgtcgtcggcggccaccaccagcagcacgcaatcgatgccgctggcgccggccagcatgttgtggacgaagcgctcgtggccgggcacgtcgatgaagccggtggggctgccgtcgccaaggtcggcgtag

SEQ ID NO: 10276 - DNA, 852 bp, Pseudomonas aeruginosa
cccacgtcgatggtgatcccgcgttggcgctcggccgggcggcggtcgccctcgatgccggtgagggcgcgcagcagcgaggtcttgccgtggtcgatgtgcccggcggtgccgacgatcacgacagctcgctccgcagtcgcggcaactgggcgaggaaccccggctcgtcgtcgagctggcgcagatcgagccagagggcgtcgtcctcgagccgaccgatcaccggcagcggcagcccgcgcagggcttcctcgaggttgcgcagggcgcgtccgcgcaggcgcctgggctgccgcggacgcaggcacagcgcggcgctgggcagccgcgccaccggctgcgcgccgctgccgatcatgcccaggggcgtcgaccacggcgacctcccagccctcgccgagcgcctcgcccagcgccggcgccagacgctcggcctgggcgcggatctccgccgccgggcggctgagcaggcgcagggtggtcaggcgttcggcgaggcggtccggatcgcggtacaggccgagcaccgcctcgagggcggcgagggtcagcttgtcgacgcgcagggcgcgcttgagcgggttcttcttgatccgcccgatcagttctcggttgccgaggatcagcccggcctggggcccgccgagcaatttgtcgccgctgaaggtaacgatgtcggcgccgtcggccagggcttcctgcaccgtcggttccttgggcaagccccagcgggtcaggtccaccagggtgccgctgccgaggtcttccagcagcggcaggccatggccatgggcgatggccgccagttgcgcggtgggcacgctggcggtgaagccctggacgctgtaa

SEQ ID NO: 10277 - DNA, 198 bp, Pseudomonas aeruginosa
cgctggtgcaggggagcggccgccgcgctgcgcagcaggcggtcgaccgaaggcaagcgaacggaactcatggagaaaccttatccacagggtagggtcaccgacacgcccatcatagacgcgtcggcgcatgcccgcagcgccttcggctattcgccgccgggggccagcaacaggttcggcgaacgccgcaggtag

SEQ ID NO: 10278 - DNA, 3384 bp, Pseudomonas aeruginosa
aacgcatcaccgtccacgagtcggccgtcaggtccatggggttgtcgtaggtgccgtggttgtggccgacctcgtcgcgcagctcgttccattccgagcaggcgacctggcaggccttgcaaccgatgcacttggacacgtcgatcagtttcgccacttcctcctggttccgcaccgagggcatcggcgtggtggtcgcggagcgggcgtggatgtcctgactactcatgtttcacctcacgccttttccacgttgaccaggaacgacttgaactccggcgtctgggtattcccgtcgcccacgaagggggtcagggtattggccaggaagccgttgcgcgccatgccggcgaagccccagtggatcgggatgccgacgtggtgcacggtcttgccgtccacctgcagcgggcggatgcgcttggtcaccaccgccaccgccttgatgtagccgcggttggaggagaccttgaccttgtcgccggcattgatgcccagctccttggccagcgcctcgccgatctcgacgaactgctcgggctgggtgatcgcattcagccggcagtgcttggtccagtagtggaagtgctcggtgagccggtaggtggtcgccgcgtaggggaactcgtcggccgtgccgaacagttccatgtcgttcttgaacacccgtgccgccgggttgctgatcgccttgcggttgtcgcggtgcaaggggttcaccccgatcggcgtctcgaacggctcgtagtgctcggggaacgggccttcggccatcttgtcgacggcgaacaggcgagccaccccttcggggttcatgatgaacgggttcatcccggcttccggcggtacgtcggccttgtagtcgggcacgtcggtgccgccccaggacttgccgttccaccacaccaggcgcttcttctccgggtcccacggcttgccgctgacgtcggccgaggcgcggttgtagagaatccgccggttcgccggccaggcccaggcccagccgagggtctggcccatgccgtaggggtcgctgttgtcgcggcggcccatctggttgccctgctgggtccaggagccggcgaagatccagcagccgctcgccgtgctgccgtcgtcgcgcagcagggcgaaacccggcaactgctcgccggccttggccaggatcatgccgttggccgggtcgaccaggtcgctcagggccttgccgttgaactcccgggccagttcgtccgggcccggttcgtcgggcttgaggtaggaccagtcgaggccgaggatcgggtcggggaaggccccgccgtccttgcggtacatctcgcgcaggcggtggaacagcccggccatgatggcgatgtccggacgcgcctggcccggcggctcggcgcccttccagtgccactgcaaccagcggccgctgttgacgatcgagccgtcttcctcggcgaagcaggaggtgggcaggcggaacaccgtggtcttgatgctggcggtgtcgacgtcgttgtactcgccgacgttgcgccagaactccgaggtctcggtcaccagcgggtccatcaccaccatccacttcaggcgcgccagcgcggcgccgaccttggccttgttggggaacgaggcgatggggttgaagccctggcagaagtaaccgttgaccttgccctggtacatcatgtcgaagtagcgcagcacgtcgtagccggcgcccggcatgtcgagcttgggcagccagtcgtagcaccagttgttttccttggtcgccgacttgccgaaccaggccttcatcaggctgacgtggaacttgccgtagttctgccagtaggacagctgtcccgggcgcagcggcttggccgtgcgcttggcgatgtaggcgtcgtagtcctgctcggcgtccatcgccagggtcaggtagcccggcagcgagttggacagcaggccgaggtcagtcaggccctggatgttggagtggccgcgcagggcgttcatgccgccgccgggcatgccgatgttgcccagcagcagctggaccatcgcgccggtgcggatcatctgcgcgcctaccgagtgctgggtccagcccagggcgtacatgatggtcatgaccttgcccggcttggaggtctcggcgatttccgcccagatcttgagcatcatgtccttcggcgtaccgcagatgttgctcaccacgtccggggtgtagcggctgtagtgctgcttgagcaggttgaacacgcagcgcgggtgggtcagggtcgggtcgaccttggcatagccgtcctcaccgatctcgtagccccaggaggacttgtccgggtaggtccgcttctcggcgtcgtagccgttgaacaggccgtcctcgaagctgaagccttccttcacgatgaacgagacatcggtgtagttgcgcacgtattcgtgctggatcttgtcgttttccagcaggtagttgatcaggccgccgaggaaggcgatgtcggtgccggtccggatcggcgcgtagtagtcggcgaccgaggcggaacgggtgaaacgcggatcgaccaccagcagccgcgccttgttgtgcgccttggcttcggtgacccatttgaatccgcacgggtgggcttcggcggcgttgccgcccatgatcagcaccagatcggcattcttgatgtcggtccagtggttggtcatggctccacggccaaacgtcggggcaagacttgccaccgtcgggccgtgtcagacacgcgcctggttgtcgaatcccaggatgccgagggagcgcatcaccttgtgggtgatgtagccggcctcgttggacgaggcggacgcggcgaggaagccggtggtcaaccagcggttgacggtctggccctgctcgttcttctcgacgaagttggcgtcgcggtcttccttcatcagcttggcgatgcgctcgagggcttcgtcccactcgatgcgcttccactcgctggagccggcctcgcgcacttccggatacttcaggcggttcgggctgtggatgtagtccagcaggccggcgcctttcgggcagagggtgccgcggttgaccggatggtcggcgtcgccctcgatatggatgatgttctgcgcgacgttcttggcgccgtcgccctggctgtacatgatcaggccgcaaccgaccgaacagtaggtacaggtgttgcgggtctcgaccgtgtgcgccagcttgaagtggcggacctggtcggcgaaggcctccgtgggggccatcccgagcgccgcaaggctcgatcctccaaggcctataccgcagaccttgaagaattgccgacggttcatatccatcgtgcatctcctgcatcaggcaaaggacacccgggacatggccggatgtctctggttaaaagatag

SEQ ID NO: 10279 - DNA, 2073 bp, Pseudomonas aeruginosa
agcgtccctggctaccggaaccgcgccatgcgcaacccctacccgccggtcgccgccgctccctatccgcacctgctggccccgctggacctgggcttcacccgtctgcgcaaccgcgtggtgatgggttcgatgcacaccgggctggaggatcgtctgtgggacttcggcaagctcgctgcctactaccgcgagcgtgcccggggcggcgtcgggctgatcgtcaccggcggcttcgcgccctgccgcgaaggttggctgctgcccttcggcagcagcctcaccagcgccctggaggtgcccgcccatcgtcgcctgacccaggcggtgcatgccgagggcggcaagatcctgctgcagatcctccacgccgggcgctatggctaccacccgatggcggtgtccgcctccccgtggaagtcgccgatcagttggttcaccccgcgcgagctctccgagcgcggcatccgcaagaccatccgcgccttcgtccgttgcgcgcggctggccaaggccgccgcctacgacggcgtggaggtgatgggcagcgaaggctacctgctcaaccagttcctctgcccgcgcaccaatcgccgcgacgaccagtggggcggcccgctggaaaaccgcatgcgcctggcgctggagatcgtccgcggcatccggcggatcgtcggccaacgcttcatcctctgctatcgcctgtcgctgctcgacctggtcgagggcggcaatacctgggacgaggtgcggcgcatcgccctggccctggaggaagccggaatcaccctgctcaacaccggcatcggctggcacgagtcgcgcgtgccgaccatcgtcacctcggtgccgcgcgcggccttcgccgaggtcagcgcacggctgcgccacgagctgaaggtgccggtgatcgccagtaaccggatcaacacccccgaggtcgccgaatccctgctcgccaccgacaaggccgacctggtgtcgatggcccggccgctgctggccgacccgcagtttgtggccaaggccggcgccggccgggccgaggagatcaacacctgcatcgcctgcaaccaggcctgcctcgatcatgccttcgccaaccgccgcgccacctgcctggtcaacccgcgggcggccttcgagaccgaattgcgctaccgcaaggcgcgcacgcagaagcgcatcgcggtgatcggcgccggccccgccgggctctccgccgcctgcgtggccgccgagcgcgggcatcgggtcagcctgttcgaggcgagcggggaaatcggcgggcagttcaacctggccaagcggattcccggcaaggaggagttccgcgaaaccctgcgctacttccgcgtgcgtctggaacgcctcggcgtcgacctgcgcctcggccaccgagtgcgccagggcgagctggacggtcagttcgacgacgtggtggtggccaccggcatccagccacgccggccaaggatcgacggcatcggcggaccgaccgtactcagctacgtggacgtgctgcgcggcgcgccggtgggcgcgcgggtcgccatcgtcggcgccggcggcatcggcttcgacgtcgccgccttcctcgtcgccgcgcccagcgacggccagccgcgggcgctcggcgaatggctcgcggaatggggcgtggacctcgacaacagccagcccggcggcctccgcgaacccgctccgacgcggccggcgcgccaggtctggctgctccagcgcaagcccggcgctcccggcgcgcagctcggcaagaccagcggctgggtacaccgcgcgcacctcaggcacaacgccgtacggatgctcggcggggtggagtacctgaagatcgacaaacgcggcctgttgatccgcgtcgacggcgaggaacgctggctggaggtggacaacgtggtgatctgcgccggccaggagccgctgcgcgagttgcagatcagccaggcggcggaaagcctgcgcttccacctgatcggtggggcgcgggtggcaggggaactggatgccaagcgggcgattcgcgagggggccatgctggcggcgcgcttgtag

SEQ ID NO: 10280 - DNA, 1437 bp, Pseudomonas aeruginosa
tcggcctcggcgttctccacgcctcccgtccgcggaaagggcagcgcccaggcgatccaccccacgcatcgcgcatgcgactccaggcctgatggcggacaaggctgcagaggagatcgtatgtccttttcccgcattctcggcgacggccggatcaatctcgaacagcaacgcaagcgcgccaaggagctgttgcgccagtggcgccgcgacccggccagccgtacagggcttccggggcaggcgccgcgcctggccgacgcccagtggcaggtggcgcgcgaactgggcttcgccagttggccgcgactcaaggcgcatgtcgacgccatcgccttcgccagccgccaccccgatctggtcggcggcgatgaggccgcgaccctgcacctgcgctgcggcaacgacatcgcccacggcctgaagctcgccggctttcgcggcggcttccggatgttcgccgacccgctgaccatgggaccggtgccgaacctgccgttgcccgagttcctcgccctgcgcagcgactacctgagccgcgccttcgacctcgacccggccgacgcccaggcccgccagcgccaggaatacgccgggctcgagcggctcggcgaatactcgcgggtggcgctctggtgcgaggcggatgcctacgaccagttgttcctggtccgggtgctggcaggaatgcagacgccgccggagcacctggaactgatcgagatcgaccgcgtgccaggcgtcgagcgcttcgtcggcatcggccaactggcgcctgagctgctcgcctggctatggacccggcgtcgcccgctggacgccgaagccctggcgctggcccgcgcggcctgggacgcctaccgcgatccggcgccactgcgctgggcgcaactggccgccgcgccgaccccggcgctaccgttgctggggccggcgctgcgtcggcaactgcatgaactgccggccctgcgcgacggcctgtcgctgagcgaacggctgaccctggagatcgtccgcgacggcgagcggccgagcgccggccaggtcttcgcccgagctgaccgcagggcgcgagccgctgccctatctcggcgacctgatgttccgcgtcctgctccgcgcgctgctggaagagcccggcgcgctgctgcgcacgccggcgccggaactgccctgggaacgccaaccgctggccctgaccgctgcgggccgcgaggtcctggccgggcggcgctaccgcctcgacctcggcgcccccgaacgctgggtcggcggcgtatgcctgcgcgccggcaccgcgcactgggcgctggacgagcaggaccggccggtatggcgggaggacccacggcactgacgctcatcgcccggacgagcgcaacgggcgcgcagccactatcatgcgcgcccgttttccccgcacccgcccgccgatga

SEQ ID NO: 10281 - DNA, 657 bp, Pseudomonas aeruginosa
tcgagcacttcaaccacaagcgcgagatcttcaccctcacccgcatggccaacggcgactgcctgtacctcgaccgcaagacccgcctgtgcaccatctatgcccgccgcccggacacctgccgcaaccacccgcgcatcggcccgcgtcccggctactgcgcctaccggccgaggtagtctcagccaggcggcgccacgccctggcatagctggtactgtcccaccggcggccggcagcgcaagcgctggcgcacctcgtcgggcaaggcgccgaacgaacgcgagcggatcgccagcagggcgtcgcgacgcaaccagccggccagctcgctgtcctccgcccgttgcgcccgcccgccgctgtagaacactgccgagtacggccgcttcggccagaacaccagcggccgctcgcgccagccggcgtcgctggccagcagcgcggcggtggacttctgctcggcgcgcgagcccagcagcagggagccgaggaacagcgcgaacagcaatggggtcagtgccaggcaagccaacccgccacgccgcagccaggcgctgcgcgccagcggcgcgcgcagcaggtcggcggcgagcaacgccagggccggcaggccgggcagcacgtaggtccagaggacgttgccggcgaaggtga

SEQ ID NO: 10282 - DNA, 534 bp, Pseudomonas aeruginosa
cgaagcgctgccaatgctcgccgagcaggaagtactcgaggaagcccggcgtcttcaactccgccagcaggtaccagggcgcggccaccaggagcatcagcaggcttccgcggatccatggcaggccccgccagagcgcgcgccagcgccactccagcaaggcccacaggccgatcggcagtccggcgaggatcagcgtcagcggccccttcgccagcagcccgaggccgaggccgaggaacatcagccagccctcgcggcgccggattccctccgcgccatgcaggcccagccagaagccgcgcatggccaggaccagcgccagggccagggccatgtcggtcattaccgccccggaggcgacgaagaacagcgccgaactgcccagcaggacgcaggcgatccgcgcctgccgacgatcttcgcgagcctgccagtcccataccagccacagcaccagcacgcccagcaaccagtgcggcaggcggctggcgaactcggtggcgccgagcagaagctggccgccggcgctga

SEQ ID NO: 10283 - DNA, 924 bp, Pseudomonas aeruginosa
tccagtcgcccagttcggccatcttccgcgccacctcgccatagcgggcctcggtggtgtccatcagcggatagctgcccaggctcagcaggcggatggcgaaggccagggcgagcaggaaccaggccagcggccagccgcgcagcgccctcacggattggccccgccgacctgcgccggcaggtagcggtcgatcaggtagagcgggcggcgccgcgcttccatggtcatccgcccgaggtattcgctgcacacgccgatggccagcagttgcaggccgccgatcaggaacagcgcggcgatcaccggccagtgttcgtggatctcctgctggccgaagatcccggcgagcagggtcgccagggccgccaacaggctgagcaggccgaggtagccggcgaccttcagcggcgcggtggaaaacccggtgatgccttccagggcgaagttccacagccgccagtagcgccacttgctgtggccggcgacgcgggcggcgcggctataggcgatatcgacctggcggaaaccgacccaggcgaacagtcccttcatgaagcgattgccttccggcagctcgcaaagggcatcgaccacccgccggtcgagcaggcggaagtcgccgacgtcgcgcgggatcggcacctcgctgaggcggttgatcaaacggtaaaaggcgctcgccgaggcgcgcttcagccagctttcgccggcccggctgcggcggcgcatgttgaccatttcggcgccgccgatccaggcgtcgagcatctgcgggatcagttccgggggatcctgcaggtcggcatcgatgacgatcaccgcggcgccgcgcgacagcttgagcccggcgctcatcgcctgttccttgccgaagttgcgggtgaagcgggccacgcccacccggcggtcggcggcctgtag

SEQ ID NO: 10284 - DNA, 1323 bp, Pseudomonas aeruginosa
caggttttcgcagggttccccgcggcaggcctggaagccgcgtcggacaaggaatacacggcaggcagaggtctgttaccggatatgaaaaacgggttttccgcaggcctcgccgccgtcgctatactgcccggccgatccggaggaccccatgagcctgttgcgcgatgcctggcgccacgccccgacccaccacagggtctgggcgctggccgggccgatgattctgtcgaacgtttccgttcccctggtgcacctggtggacagcacggtggtcggccacctgccgcacgcctaccagctcggcgcggtagccgtgggcggcagcctgtacaccctgatggtcggcgtgctcggcttcctgcgcatgggcaccaccggcttcgccgcccaggccgccggccgcgacgatggcggcgcgctgcgcctgatcctcgcccagggcctgggcatggcgctgctcctggccctgctgctcggcgcgctggccctgcccctgagcggctgggccctgcaactgatgcaaccgtcggcggaactgaccggcgaggcccgcgccttcttccatacccgcctgctcggcctgccggcggccctggccagctacgcactggtcggctggttcctcggcacgcagaacgcacgggcgccattggcgatcctgttgaccaccaacctgagcaacatcgccctggtgctctggttcgtccacggcctcgactggggcgtgcaaggcgcggcccgcgcctcggtgctggcggaatggagcggcgccctgctcggcctggccctgacccgccgcgacctggcccggcgccccgggcgggcgcagtggcaacgcctgcgccactggctgtcctggctgccgctgctgatggtcaaccgggatatcttcatccgcagcctggccctgcaactggtgtttttcctgctcaccgtacagggcacccgcctcggcgacgccacggtagccgccaacgccctgctgctcaacggcctgctcctgacgtcctacgccctcgacggtctcgcccacgcggtggaggcgctctgcggccacgccatcggcgcccgcgaccgagccgccctgcgccgcgcgctggtggtagccggtggttggtcgctgctggcaagcctggcgttcgccgcgctgttcgccttgttcggccacctgttcatcgacctgcagagcgacatcgccgacgtccgcgaagtcgcctacgcctatctgccgtacctggcctgcctgccgctgctggggatgtggagctatctgctcgacggcctgttcatcggcgccacccgcgcccgcgagatgcgtaa

SEQ ID NO: 10285 - DNA, 978 bp, Pseudomonas aeruginosa
cgcggcatgcccgggtcgtcggactgtgcctcttccggcaacaggcgcgcgagcagcgccgcaagggggccggtgaagccgatcgccagcagtgccagggccaggttgaaagcactgtggaaccagaccgccgccgcaccgccgagtgcgttggccggctgcgccagcgccgtcagccagggcagcaccagcaggcaaccgagcaggcgcaccagcaggttgcccaacggcaggcgccgcgccacccggctaccggccacccccaacgccggcaaggcgccgccgaggttggcaccgagcaccagggccagggcgatgggcagcgagaccagtccggcctgggccagggacgccaccagcagtaccaccgcgacactggaatggcaggcccaggtcagcagcgcggcgagcagcagggcgatcagcggatcgccttcgaggccgtggatcaccgcgacaaaggctggcgaggcctcgatctgctgcagggaatggccgagcaacgccagcgccagaagcatcaggccgagtccgatcaggcactggccaaggctctccaggcgcggaccgtcgcccaggcggaacagcagcaggccggacagcagggccagcggcgccagcaacgaggtgtcgaagctgagcagttgcaccaccagagtggtgccgacgttggcgccgagcatcactgccagcgccggcgccaggcccagggtgccactggcggtgaaggacgctgccatcagactggtggcggtgctgctctgcagcaggccggtgatgccgagcccggcgagcagggccagccagcggttgcccaggtggcggccgagccagttgcgcagcgcagtgccgaaaccgcgcagcacgccgctggagaccatgtgcgtgccccacaacagaagggccacggcaccggccaggttgatcaggaggatggttcccagcatggcggaactcccggttcggaatggatcgtga

SEQ ID NO: 10286 - DNA, 1194 bp, Pseudomonas aeruginosa
gtggtgatgtcgaagatcgacgaggtcgggccgatccagaccatgaagcggccgatgttcttcgagtcccacttgcgcggcttggcgaggaactccttgtccatcttgtcccacggcagcgacagctgggagatgtcgtacatcaggttctgcagcagcaggtggatcgccagcatcggcaggaaggggatgaaggcgctggccaccagtaccgagaacacgttgccgaagttggagctggcagtcatgttcaggtacttcatgatgttgccgaaggtctcgcggcccttgataacgccctcctccaggaccatcaggcttttttccaggaggatgatgtcggccgattccttggcgatgtcggtgccgctgtccaccgagatgccgacatcggcatctcgcagcgcgggggcgtcgttgatgccgtcgccgaggaagccaacggtgtgtccgttgccctgcagggccttgagcacccgcgacttctgcagcggcgtcagcttggcgaacaccgtgcgctcctcggccaggcgttgcagggtggcatcgtccatcaggtcgatgtcgcgaccgagcagcggctcgccgacgtccaggccgacctcgcggcagatcttcgcgctgaccaccgggttgtcgccggtgagcaccttcaccgccacgccgttctcgcgcaacgcggcgatggccgggccggcggtttccttcggtggatcgaggaaggtcagcaggccggcgatcaccaggtcgcgctcgtcgctggcgccgtactgggcctgggactccgtgcgcgagaggctgcgggtgccgagcaggagcacgcggaagccgtcgcggttgtattgctcggccagcgccagcagggcccggcggcgttcctcgtcgagcggcaggtcgacaccgtcctggtgcacgcgggtggcgatctcgagcatttcctcgaccgcgcccttgcacaccagcaggtgttcgccgtccttgccctcgaggatcaccgagagacgccgacggacgaaatcgaagggcagttcgtcgaccttgcgccaggcatccgacggcgtgatgcgcgggttctgttcgacgaaggcgaccaccgcgcggtccatcaggttcttcatcccggactggtggaagctgttcagccaggccatttgcaggacccggtcgcagcgccggccggcaacgtcgacgtga

SEQ ID NO: 10287 - DNA, 543 bp, Pseudomonas aeruginosa
gtgcgcgcaccggtggcgaccaccaccgcggtggccgtgccgctgaccacgttggtgcccatgaagcagatgttcggcagttcgagcaggtcctgctggtcggcggcgatccgcttggcggacttctcgcggaccgcgccgagggtgtcgtatttctccaccggcagcgcctcgccggtgagtacggcctggctgatgaacaggtcgcgcgattcgatcaggcggatgtcggcggggatcatgtcgccggcggacaggcgcacgatgtcgccgaccaccagttcgcccatggggatttcccgcagctcgccgcgcatcccgcgctcgtcgcggcgcagcacggtggcggtgttccgcaccatggccttgagcgcctcggcggccttgcccgaacggtattcctgccagaagcgcatcaggccgctgaccaggaccatgcagaggacgatgatgacgccggtgagatcggtttcctcaccgtcctgcaggggcagccagaagtcggtgaagaagctgatcgcagagagcgtcatcagcacgtag

SEQ ID NO: 10288 - DNA, 1230 bp, Pseudomonas aeruginosa
gaagcagtgggtcagcccaggatgccgctcaaccgaccgacccgttgcgggttccgtcgtgcgttggtttgggtcatcgcaccagccggcatctgctgggccgggcgacgactactgggaatactgtccatggctctcttcgtagggggaaagaaagtgcccggctctgcgggcgggggttttatagacctcttgccagacgaggtcaaccgaaaaagccgtttcgttcaggcttctatggaacatcggaaaattcccgcaggagtccggcgaaaagacaccggccaaaagcgctcaggcggagatcagtcccgccagccgtcgcgccagcgccggcacttcggaggccgggtcgaggcgcaggcgaaaacgggtctgcaggatgtccagcagttcctcgacgtcgcgcagttggcgctgcagcgtctcgccgttgccggcgcgctggccgaacagcccgtcggccagggtcaggcgcaggtcgccctcggttatggcggccttcaggccctggcggaacacgctgtgggggtgggtagaggtgtaccagttgcgcgggatgtaatcgatccacaactgcgggcgcaggtcgaagcggtacagcggcagccagccgctgcgaccgcgcacggcgctttcgtagagaccggcgtgcgggtcgaccaggcgcacgcaatgcacctgtccggcgtccgcctcgtcacccggcaaaggcagtgctcgcggcggattggccgagccgaagccgacatccaccaggaactcgccctccgccaggtacagacgcagcatcagatgcgattgctgggttcaggggggcgttctccggggagcccccagcgttcccgtgccaaccagcagttccaggtcgtagccgagggccagcagcaggcgggcgaacagcgagttgagttcgaagcaataaccgccgcggctgccctcgacgaccttggcgaaaaccttgtcggcgtcgatctcgatggggcggtcgagcagcacgtcgaggttctcgaaggcgacccggcgcagatgcgcgtcgatcagccggtcgagcttcgccaggctcggcggaccgggatcgtcgatgccgatatggtgcaggtaggcatgggtctgctcgggcgtcagcggggtcatggcgggctccggaaaatggccagctcgattctagacgcattctcggggaataccggaagcgccgtcaggcacattggcccggggtctgcttga

SEQ ID NO: 10289 - DNA, 840 bp, Pseudomonas aeruginosa
ctgtgcccatcccaccccgaggagcgccgccatggcccaggcaatcgtcgcctacctgcactacctgtcgatcttcctgctgttcgccctgctggtgttgcagcaccgcctgctgcgcctgccgctggacctggagcgcgcccgcagcctggcggcgatcgaccgcggctacggcctctgcgccctggcggtactggccagcgggctggcgcgggtgctgtggtacggcaagggcgtcgactactacctgcacaatggcctgttccacgccaaggtcgggctattcgtcctcgctgccctggtctcgctgttgccgaccgttaccttcctcggctggcgcggcaccctcaaggcccgcgaagtgccggcggtgacgccggcccggggccggcgggtggtcctggcggtgcgcctgcaactgctcctgctgctggtcattccgttgctggctacgctgatggcgcgcggcttcggcatgcgcggctgagccctcagttctgcatggcccggccatacacgtccatcgccgcctggcgcagcgcctcggagcgggtcggatgcggatggcaggtcagcgcgaggtcctccgccgaggcgctgaactccatggccacgcaggcttcgccgatcatctcgctgacgcccggcccgatcatgtgcacgccgagcacctggtcgctgcgggcatcggagaggatcttgatgaagccttcgctctcgtggttgatcttcgcccggctgttggcgctgaacgggaagcgtccgaccttgtactcgcgcctcgccgcctgcagctgctcctcgccgaggccgacgctggccacttccggctgggtgtag

SEQ ID NO: 10290 - DNA, 753 bp, Pseudomonas aeruginosa
tccgcctgcagcgattccgtagcgccgccggcggccggttgcaggtcgagttcgacgccctgctcgccactgcgcgcggcgaccacgcgggtgccgaggcgaaaccgcatgccctggcgggtcagggcgcgctgcagggtccttgcggtttccccatccagccccgggcagatccgctcgaggtactccagcaccgtgacctgtgcgcccagccggcgccagaccgaaccaagctccaggccgatcacgccggcgccgatcaccaccaggtggcgaggcacttcgaccaactccagggcgccggtggagtcgaggatgcgctggttgtccacaggcacgccgggcagcggcgccggttccgaaccggtggcgatgacgatgtcgcgcgcctccagttgcgcgtggccgccgtcggcaagggccacgccgacccggccctcgccttgcaagcgcgcccagcccttgatccactgcaccttgtgcttgcggaaaaggaattcgacgccacgggtcagggcggcgacgctctcgtccttctgcttcatcatctgcgccaggtccagttccgggctgacccggatgccgagccgggcgaactcgccgccgctcgccgcggcgtatagctccgaggcgtgcaacagggccttggacggcatgcagccgacgttcaggcaagtcccgccgagggtttcgcgaccctccacgcaggccaccttcaggcccagctggccggcgcgaatggcagcgttgtag

SEQ ID NO: 10291 - DNA, 672 bp, Pseudomonas aeruginosa
gcgacgccggcgcaaatagaggaaacgccgcgtagagggaccgaaagcgattgtatttcgctcgtcatgcaaagtttatatgatgaccgtaattttcctgcaaccctttcccaccacgacaggagcactaccatggaacagcccggccgcgaagatcgcctgaacgcctggatcgccaccgagcgggccgcccgcgcccgcctcggcgccagcggaaccctggagctggcgcaagtcgccgcgctctccccgcaggagttcttcgaccgcatcggcagcggccaactgccctgtccgccctacggcgagctggtcgacttcgttcccatcgagtggtccgaagggcgcttcctgttccagggcaccccggaccgccgccactacaatccgctgggtagcgtgcacggcggctacgccgcgtcgctgctggactcctgcatgggctgcgcgatccatacccggctccaggccggccagggctataccaccaccgacctgcggatcagctacctgcgcgcgctgaccgacaaggtcggcccggtgcgcgccgaaggccgggtggtgcacctcggccgctcgacggcggtcgccgagggccggttgtacgatgtcgacgaccgtctctacgccgtcggctcgaccacctgcctggtcctgcacatggccggatga

SEQ ID NO: 10292 - DNA, 1245 bp, Pseudomonas aeruginosa
tactcatccctcttttccgacgaccagcccagccatgcccaactccatctccaattcctcccgcctgcacagcatcgacgccctgcgcggcctggtgatgctgttcatgctgctcgaccatgtccgcgagacctttttcctgcaccgccaggtcggcgacccgatggacgtcgccagcaccgagccggcgctgttcctcagccgcaccctggcgcacctgtgcgcgccggtgttcgtcttcctcaccggcctgtcggcattcctctacggcgagaagcaccagggacgccgggcggtctcggcgttcctgttcaagcgcgggttgttcctggtggcgctggaactgaccctggtgaacttcgcctggaccttccagttgccgccgacggtgatctacctccaggtgatctgggcgatcggcctgagcatgctcgccctggccgccctgctctggttgccgcgccctctgctcgcggcgctcggcgtgctgctggtggccggccacaacctgctcgatccgctgcatttcgctcccggctcggcctggcacctgccgtgggcggtgctccacgaccgcggctggatcgaagcgggcgacgccctgcgcctgcgcacctcctaccccctgctgccgtggatcggtgtgatcgccctgggctatgccgcaggcaactggttcagcggcgccacgccggcaaccacgcgccgacgctacctcctggcgggcggtggcgggctgctgctcggcttcatcctgctgcgcctgctcaacggctatggcgagaaaccctgggccttcggcgagacgccggcgatcaccctgatgggcttcttcaacgtcaccaagtatccgccgtcgctgctgttcctcgccctcaccctgggaatcggcctgctgctcctggcctggttcgaacgcctggactggagcggtcgcggcaaggccctggtggcgttcggcggagcgccgatgttcttctacctgctgcatctctacctactgaagctgctgtacctgctggcgctggcgatctggggcgccaaccggggcgactacttcggtttctcctcggtgccggcgctatggctgtgcagcatcctgctggccgtgacgctgtacccggcggtgcactggttcgccggtttcaaggcgcggcggcgggatatcgcctggttgaaatacttctgaggcgcggagcatccaggagccgctggaaacgtccggcccttcccccccacgggtag

SEQ ID NO: 10293 - DNA, 2025 bp, Pseudomonas aeruginosa
  unsure (54),(56): Identity of nucleotide at the above locations are unknown.
agggttgcgcggaactcccagacaatggaaacgaaacggccggcgggggccgcncnccctccggccattgcgtggttcgcttcccatcgccgacgggctagccagtcaggacaggtacgccgagcgggtcagccccaggcgcagcgcatccaggtactggttgcgctcgcgggcggtgagattggccccggcgaccttgtcgcggtagagggtcatcagttcctccggcgacaggtgcacgtagcgcagcatgtcctcgatggtgtcgtgggtctcgatgccggcgtgatagatgccgccgtctgcgcgctggtagacgttcaccgagtcggtgtcgccgaacaggttgtgcatgtcgccgaggatctcctggtaggcgccgaccaggaataccccgatcaggtagtcctcgccctccttcacctcgtgcaccggcaggctggtctcgatgctctgctcgtcgacgtactgggtgatcttgccgtcggagtcgcaggtcaggtcctgcagtaccgcgcgccgatccggctcctcgcccaggcggtgcagcggcaggatcggcagcacctggccgatggcccaggtatccggcaggctctggaacaccgagaagttgcagatgtacttgtcggcgagcttgtcgttgagttcgtcgaggacctgccggtgggagcgctggcgggccttgagctggttgtgcaggcgccggcagatagcgaagtagcactgctcggcgagggctttctgcgccaggctgatcttgccgtcggcatactgcgcggcggcgtcgccgatgtagtgggtggcgcgccagtaggtctcggtgaccatctcggcatcggtcgggccgagcagttcggccagccagcggacgatctccggctgctcgtcgagatcgacgatcttcggcacgtcgtcgttgtgccgctcgacgtcggtgacctgggtgatcagcaccgcatggtgcgcggtcagcgcccggccgctctccgagaagatgtgcggatgcggcaggccctgggcgtcgcagaactccttgagcatgccgaccaccacgccggcatagtcatcgatgtcgtagttgatcgagctggcgttgcgcgaatgggtgccgtcgtagtcgacgccgaggccgccgccaacgtcgatgtgatccaccggcaggccgagcgcgcgcagctcgccgtagtagcggatggcttccttgaagccgtgctggtagtcggccaggttggcgatctgcgagcccatgtggaaatgcagcaggcgcacgccctggtcgagaccggcctggcggaagcgctcgaccaccgacagcagctgggcggcggaaaggccgaacttggccttctcgccaccggtgtctgcccacttcgacgaagccagcgaggacagccgcacgcgcaggccgacctggggctgcacgccgacgttggcggcctcctcgatcaccagctgcacctcggattccttctcgatcacgatgaacacgttgtgcccgagcttctgccccatcagcgccagcttgatgaactcgcggtccttgtagccgttgcagacgatggtgccgcccttcggggccagcgccagcaccgccatgagttccggcttggagcctgcctccaggccgatggagacgttctcggtggcgatgatgttctccaccaccgcttcctgctggttgaccttgatcggatacagcgcggtgtagcggttctggtattcgaggcgctcgatgttcgcgtcgaaggcgccggtgagcttgcgcacgcggtcctgcaggatatccgggaagcgcaccagcagcggcaggctcaggcccgcctcgcgcagttggccgaccagctcgtagagatcgatgggcgtcgagtcggcaccctgcggacgcacttcgacattgccgccatcgttgatggcgaaataacccgcaccccagtggcggatgccgtatacgccgcggctgtcggccacggtccagttgctgccatcgtctttgcgagtccgtcgagcggccatgcgcggtga

SEQ ID NO: 10294 - DNA, 2313 bp, Pseudomonas aeruginosa
gaaagccgaggaaatccgctcatgcgggtatccgcagtctcccatctagggaaagggctggcgcggcctcgcggtgccggacctgcccgctctctgcaggggagaacgcggtcagccgccggacttcttcgccttgaaaccgcgcttgaggagttcgtcgatcagcagttcgacatgctcgccctggatctccaccacgccgtccttgagactgccgccggtgccgcagcgccgcttcagcgcgctggccagctccttgagcgcatcgccggcgagcggcaggccactgatggtggtcaccgtcttgccgccgcggcccttggtctcgcggcgcacgcgcgcgatcccgtcgccgacaggcgctacggcctgcccgcagatgcaggcgtctttgggttgctggcagtccgggcaatgccggccgccatccgtggaatacaccagcccgccgagggcggacagggacgaagcttttttgaccaccgggcgtttcccccagaatggcctcgacgggccaggtcaacaacgatggccggcgggagccgaccgcgacgccccactcaggcaggggctgcgcaggggcggcatggggaccgcccgaaaaggtcgcgcaatttagcagcattgcgagcaaatgctaagagcgaaaatgcgccattgatcggtgaaatggcgacatccgcggctcaggcgtccaggtacaggcgcaacgcctgcagggaatcggggcagtacggcaggctgcgagcctcctccagcgccagttcgggacggatgaagcgggcctcggagatttcctccgcctgcaggcgcaagggcgcatcggagacggcggaaaacaccgcgcaccagagccggttgcccggttcgtcgaagaagaagcgaccatgttcgcgcaggaccgcgtcgcggattcccagctcttcctccagttcgcgggcggcggagtcggcgtatggctcgccggcctggacccatgccgccggcggcgaggtcccagtacccgggatagaccgccttgctcagggtccggcgctgcacgcacagctcgccggcggagttgaacagcaggatgaaggtgccgcgaccgatcagcccgcgctcgcgcagctccgcgcgcggcaggctaccgagcgggcggtcctgctcgtcgacccaggcgatgagttcggcgtcggaggcggcccggtgggccacctcttcggcgctgatcggcgcggccatgggtcagccctgggaaagcagctggcgcaggtcgatcaccgcggcgttggcgcgggaaatgtagttggccatcaccagcgagtggttggccaggatgccgtagccgctgccgttcagcaccatcgggctccacaacggctcctgcgcggcctccagttcgcggatgatctgccgcacgctgaccgtggcgttcttcttcgccagcacgtcggcgaagtcgacctcgatggcgcgcagcaggtgcgacagcgcccaggcctggccccgggcctcgtagaagacgttgtcgatctgcagccagggggtttcctggaccacttcctcgaccttgggcgcctcgcccggctgtacctcttcggggttcttgatgttggtgttcagcttgacccggccgacgctcgccgacaggcgctgggacagcgagcccaggcgggtggcgacgtcgcccagccagttgttcaggttgtcggcacgggcatagaactgcgcgttgggctggttcgggtcggacaggcgagccaggtagcggtccagcgacttgatgccttcctggtactccgactcggacgccggcagcgcccagctcttgttgtcgaagttgaaacgcggctcggcgcgagccagttcggcgtcctcggtggactgcgactgcgaacgggcgaaatccttgcgcagcgcccggctgatgtcgcgcacctggaccagcacgccatactcccagctgggcatgttgtccatccagatgcccggcgggaagatgtcgttggagatgtagccgcccggcttggtcagcagggtgtcgactacttccttgaggttctccaccgtggtgtagccggtgaccatctgccgcccggcgcgctcggcggcggcctgggcgtcctgctgcacggggaacaggtcgggttcctggctccagtaccagccgaccagcatcgccaccagcaggtagatgcccagcaggcctcccaccacgcgcaccagccaggggccgccgaagtaggtacgcacatcatccacggaattgtccacgcgatcgcgcatggtcccacgacgcttcttccagtccagcatggcaagggtccttaa

SEQ ID NO: 10295 - DNA, 1443 bp, Pseudomonas aeruginosa
cccgaccctggaccgcctgaagcaccacttcgcccagcgagtgatcaaccaggcgcgccaggttctggaggtctggcaacgcctgacccgcgcggagtggaacagcgacggcatggaagaactggccgacgccaccctgcgcctgcagcgctacgccgaacgcttcgagcaagccgagcatgcccagttggccggtgccatcgaccgtaccctggacgtcgtcgaggccaaccgcggccggctttccagcgagtcgatcagcgaactcaaccagttgatgcagcgcctgtcgcgcaccggcctgcggcatggcgaccagctcgagcacaccgtcctgccgccgttacgcaaaccggtctacctggcactgaaggaccgcgaacgcgccgagcgcctggcccagcaactggagttcttcggtctgcaggcgctgagctgcgagaccgccgacgccttccgcgccagcatgcgcgaacgctacccggcggcgatcgtcatggaagtcgacttcgccggccccgacatgggcctgcgactggccagcgaggcccaggccggcctcgaacacaagctgccggtgctgtttttcagcgacagcgagaccgacaccccgacccgcctggccgcagcccgcgccggcggccaggaattcttcaccggcaccctggacgcctccagcgtgctggaaaagatcgagaccctcagccgcctgagcttctacgaaccctaccgggtactgatcgtcgacgactcccgggcccaggcgctgcacaccgagatggtcctcaacagcgccgggatcatcacccgcgcgctcaccgagccgctgtcggtgatggccgagctgagcgacttccagcccgacctgatcatcctggacatgtacatgcccgagtgcctgggcaccgagttggccaaggtgatccgccagcacgaacgccacgtcagcgtgccgatcatctacctgtccgccgaggacgacctggacaagcagctggacgccatgagcgaaggcggcgacgacttcctcaccaagccgatccgcccgcgccacctgatcgccaccgtgcgcacccgcgccagccgcgcgcgcagcctgaaggcgcggatggtgcgcgacagcctgaccggcctgtacaaccacacccataccctgcaactgctcgaggacgcccgtctgcgcgcacgtcgcgatggccgtccgctgagcttcgcgatgctcgacatcgaccacttcaagcaggtcaacgaccgtttcggccaccccatgggcgaccgggtgatcaagggcctggcgctgttcctcaagcaacgcctgcgcaagaccgaccacatcggccgctatggcggcgaagagttcgccgtggtccttccggacaccgacctggacgccgcgcgcctggtgctcgacgagattcgccagcgcttcgccgagatccataa

SEQ ID NO: 10296 - DNA, 2013 bp, Pseudomonas aeruginosa
cctgcggtctcgccgttccgtagtcggacgagactcgccatgcgcctcaagcaactcaccaacctcaacaccctgctcctgctcaccgtctgcctcgccctgggaatcaccctgtggtggtcgcaacgcgccatggagcggcccttccagttgctcgaccagtacctggagctgtcgcagcgcttcgacgaacaggtcgcgcgcaacatccgccagtacctcggcagcggcgacgccgtgcgccagcaggccgcgctgcaagccctggaaagcctcgccgaggccttgccggagctaccgccggacctcgcccggaccctcgcgccaagcctcgcggagttgcgcgaattcagcgccggcgacctgctcgccgccggcaagctcgccggcgacccgcagggcctgctgctacaggccgagcgcgacctcaccggcaacctggaacaatggtccgcctacctggacgccgcggcggggcagccccaggccggcgcctaccgcaccccgctgctgctcgccagcctgcacctgacccgcctcagcctggcccgcgccaagctggtggaaagcgccaacccggccctggccggcgacgtcgagcgcgaattggccaacctgcgcgagcaggccgggcggatcgaggccttgccgctgctcggcgtgctcgacgagcaacgctcggccagcgacgacttcgccgccatgatggggctggccggcgacgccgaggctggcgccggcaatgccgaagaccgcggcgtggcgctgcggcgcgaactcgccagcctgctgcaacgctatccggacgagttgcgccgcacccgcgacctgatcgagcgtcgccagcaactgtccgccgacaccggcgccagactggacgcggtgcgccaggccctggccaccctggaaccgcaggtgcgcggcgaacgccagcgcctgcaaggccaggtacgcctgatccagggtgggatgatcgccctgatcctgctcatcgccctcgccatcgacagcctgcaaagacgcctggcgcgggtcctcgggcaactggtgccggcgctctcggcctgggccgacggcgacttctcgcgccccatatccctgcgtacccgcaccgaggacctgcgcaacctggaagattcgctgaaccgcctgcgcagcttcctcgccgagctggtcggcgcgatccaccgccgcgccgaacaggtcgccggcagcagccagaccctggccgaggtcagcagcggcctgcacgccggggtcgagcgccaggccggcgataccgggcagatccgcgacgccctcggcgacatggaagcggcgatccagcaggtcgccggagacgccagccagaccgccgacgccagtcgcagcgcaggccaggcagtggagcatggccagcgggtgatcggcgagagcctgggcggcctgcgcgagctggtcgacgaggtgcaaggcaacgcccagtcgatcgagcgcctggccgaggagtcggcgaccatcggcagcgtgctgacggtgatccgctcgatcgccgaacagaccaacctgctcgccctcaatgccgccatcgaggccgcccgcgccggcgaccagggccgcggcttcgccgtggtcgccgaggaagtccgctcgctggcccagcgcaccgccggcgccaccgaggagatccagcagctcatcggccgcctgcaacaggccgcgcggcaatcggtggaggccatgcgcagccaggtcgagcatgccgaacgcaccgccgaacaggccggcgcggcggaaggcgcgctggacgaagtggtcgccgcgatccataccatcggcgtgatggccgaacgcatcgccgaaggctcgacccagcagagccaggcggtcggcgagattcgctcgcacagcgaacgcatccacgccctgggcggggaaaacctgcggctgatcggccatagccgcgaacagggcgagcaactgcggcaactgggcggcgacctgcgcaccacggtgcaggccttccgcctgtga

SEQ ID NO: 10297 - DNA, 1707 bp, Pseudomonas aeruginosa
tccgacgagatatccatgcgccgcctgctgaccctgatcctcctgctggtcgccctgcccgccggcgcgggcctgttcgacagccgtcccggcgcctccctcggcggcggcctcgatggcggcggcttcctcaaggtcgaccaggcgttcaagcccagcgtcgagcgcagcgacgcgcagcacgtgctgctgcgcttcgtcaacgccgagggctactacctctaccgccaccgcttccagttcaaggtcgagccagcccaggtcagcctcggccaggtgcagctgccggcgggcaagcagcaccacgacgagtacttcggcgataccgaggtctactacaacatcgtcgacctggagattcccctgaacaacccggcccggcagccctataccctcgtggtgacgtaccagggctgcgccgacaagggcctctgctaccccccggaaaccaggcgcttcgacatcgacggcggtgccgcgacgccagccgcgagcgacgcggccggcaagggcccgctcgagcacaagggcaagcgcagcctgctgttcttcttcctcgccggcctgaccctgaccttcaccccctgcgtgctgccgatgctgccgatcctctccggagtggtcctgcgcggccggccgggcggtggtcgcggcttcgtcctgtcgctcgcctacgtgctgccgatggcgctctgcttcgccctgctcggcgcgctgatgggcatgttcggcgccagcctcaatctccaggcgcaattgcagtcaccctgggtactggtgccattcgcggcgtttcttcgcgctgttcgccgtggccatgttcggcttcttcgagctgcgcatgcccggcttcatccgcgaaccgctcgaccgcctggccggcgatgcgcgcggcggctcgatcctcggcgcggccaccctcggcgtgctttccagcctgctggtctcgccctgcgtctccgccccgctggccgcctcgctgctctatatcagcgccagcggcgatgcctgggggggcggcctgcaactgttcgccctcggcctgggcatgggtacgccgctggtggtgttcggcgccggcggcggcgccctgctgcccaagagcggagcctggatgaacggcgtgcgcaacgccttcggcgtgctgttgctggcggtcgccgtgtggctgctggagcgggtggtgtccggcccggtggcgctgatgctctggggcatgctcgccggcggcgccggcctggccctgggcgccctcgaattcaccccgaagagcgccgcacgccgcctgctgcaactgcttggcctgatgttcctgacctacgcggtggccgcctggatcggcgccctgcagggcgagtcggacccgatccatccgctgggccgctcggtgccgtcgatccatgccgggccgccgagcacgcccggcgaatggcagaacctgaccaccccggcgcagttggacgccgccctggccgaggcacgtcaggccggcaagccggtgctgctggactggtatgcggactggtgcatcagttgcaaggtcatcgagcgccaggttctcaccgatcccacggtgcaggcacgactgccggcctaccgcctgctgcgcttcgacatcaccgaaagcaacccggcccagcgcggcctgctggaccgctacaacctgttcggtccgccggcgatcctgttcttcgccccgggcggtga

SEQ ID NO: 10298 - DNA, 489 bp, Pseudomonas aeruginosa
tgcccgcttgccgtttgcagcctgtacaggacaatcaacaagacaatggcgaccctcctcgtattgcacgggccgaatctgaacctgctgggcacccgcgagcccggcacctacggttcgaccaccctcgggcagatcaaccaggacctcgagcgccgcgcccgcgaagccggccaccacctgctgcatctgcaaagcaacgccgaatacgaactgatcgaccggatccatgccgcgcgcgacgaaggcgtggacttcatcatcatcaatccggcggcattcacccataccagcgtcgcgttacgtgacgcgctgcttgcggtgagcatcccattcatcgaagtgcacctgtcgaacgtgcacaaacgtgaacctttccggcatcactcctacttctccgacgtggcggtaggggtgatctgcggtctcggcgccacaggctaccgcctggccctggaatccgcccttgaacaacttcaacgcccctga

SEQ ID NO: 10299 - DNA, 540 bp, Pseudomonas aeruginosa
accacatcgaagccgaagttagcggcaccatcgagtcgatcctggtggagaacggccagccggttgagttcgaccagccgctgttcaccatcgtctaagccgcggggaacctgcgatgttggaaaaagtgctgatcgccaaccgcggcgaaatcgccttgcgcatccttcgcgcatgcaaggagctggggatcaagacggtggcggtacactccaccgccgaccgcgagttgatgcacctgtcgctcgccgacgaatcggtgtgcatcggtccggccccggccacccagtcgtacctgcagatcccggcgatcatcgccgcggccgaggtcaccggcgccaccgcgatccaccccggctacggcttcctcgccgagaacgccgacttcgccgagcagatcgaacgctccggcttcaccttcgtcggcccgaccgccgaggtgatccgcctgatgggcgacaaggtctcggccaaggacgccatgaagcgcgccggcgtccccaccgtgccgggctccgacggcccgctgccggaagatga

SEQ ID NO: 10300 - DNA, 477 bp, Pseudomonas aeruginosa
agaaaccgccctggcgatcgcccgcgaggtcggctacccggtgatcatcaaggccgccggcggcggcggtggtcgcggcatgcgcgtggtctacgacgaatccgagctgatcaagtcggccaagctgacccgcaccgaggccggcgcggcgttcggcaacccgatggtctacctggagaagttcctgaccaacccgcgccacgtggaagtccaggtgctttccgacggccagggcaacgccatccacctcggcgaccgcgactgctccctgcagcgccgccaccagaaggtgatcgaagaggcgccggcccccggcatcgacgagaaggcccgtcaggaagtcttcgcccgctgcgtccaggcctgcatcgagattggctaccgcggcgccggcaccttcgagttcctctacgagaacggccgcttctacttcatcgagatgaacactcgcgtgcaggtggagcacccggtatctga

SEQ ID NO: 10301 - DNA, 1425 bp, Pseudomonas aeruginosa
gatggtcaccggtgtcgacatcgtcaaggagatgctgcgcatcgcctccggcgagaagctctcgatccgccaggaggacgtggtcatccgcggccatgcgctggaatgccggatcaacgccgaagacccgaagaccttcatgcccagcccgggcaaggtcaagcacttccacgcccccggcggcaacggcgtgcgcgtcgactcgcacctctacagcggctacagcgtgccgccgaactacgactcgctggtcggcaaggtcatcacctacggtgccgaccgcgacgaggcgctggcgcggatgcgcaatgccctggacgagttgatcgtcgacggtatcaagaccaataccgaactgcacaaggacctggtgcgcgacgccgccttctgcaagggcggggtgaacatccattacctggagaagaaactgggtatggacaagcactgatccgtcagtcgctgcgcacaagggctgcctccgggcggcccttgtcgtttccgcctgccggccgccccaacggtgctatcctcgtcgcccctccaccaccggactcctgcatggaacgcatccgccgctggtaccgccaatcgctggccgccgcgaccgaggccgcgacctgcttcgccttgggtttcagggaaagcctgcaacccgccgcactcttccgctccgcgagcctgtgcattctcgtcagcgtgctgtgcacctggctgttcgtgcatttcttcgaaccgatcatccgcctctgcggctgggccgcgctgtacacggcattcagcgtggccaacttcgccctgatccccagcggctcgctgatcgaggccggcagcggtggcccgtacttcgatccgctggcggccttcaacggcctggcgggactggcgcaactggcgttctatttcgtcggctatgccgcgctgttcttcgtcgccctgtacgccgccagcatcgtcttcggcatccgcctgggcctgcgcatcggcctgctcggacaactgaaggaacaggtccgccaacgctacccgcgactggcacctgcctccggcgaaaggatctcgctgtggcgtgccgccggcttccgcctggcaccctggctgggcgtttccggatcgatcctggtcggcctgctggttccgctctacaacggtgtactcctgctgctggcgctggcctacctgaacatccgcttcctgctgcccgccacgctggccgggctggccgatgccggcgagcagctcgccgtgcttcgtgctcgccgcggcagcctgttgctgttcggcctgctgatactgctcctggcgctggtgccgctgctcaacctgctgctgccggcggtgctcggcggcggtacctgccacctggccaatcgcggcctggcgcaactgcgcggcgaggccacggcagagagtggcagcgccggctag

SEQ ID NO: 10302 - DNA, 636 bp, Pseudomonas aeruginosa
ccttcatggacgccgaagaccagccgatcttcgagccggacctcggcaccaccccgctgtggtcgcgcacccacctgctggcgctgttcgaagcggacaccgatgagaccgccctgctcgcccacctcgccttgcttaccggcggcgacctgcccgagcaccatgtcgaggaaatcgccgaccaggattgggaacgcagctggatggacaacttccagccgatgcgtttcggccgccgcctgtggatcgtgccgagctggcacgccgcccccgagccggacgcggtcaacctgctgctcgatccgggcctggccttcggcaccggcacccacccgaccaccgcgctgtgcctggaatggctcgacggccaggaactggccggccggcaggtgctcgacttcggctgcggctcgggaatcctcgccatcgccgcgctgctgctcggcgccgaacgggcggtcggcaccgacatcgatccacaggccctggaagcctcgcgcgacaatgcctcgcgcaacggtatcgagcccgcgcggttccctgtctacctgccggcggacctgccgcagcgacaggccgacgtgctggtcgccaatatcctcgccggcccgctggtttccctcgccccgcaactga

SEQ ID NO: 10303 - DNA, 711 bp, Pseudomonas aeruginosa
agacgacgaggaaagcgccgaggaacagtccgtcgcgcccctgggcagcgcccgcaaaccggacgaggcgccggtcgagagtctcgaccagttgcgcgacgagccactgcaactggcctgggagaagccccggcgccaatggccgcggcgtctcggctggctgctgctgatcctgctggcgctgggcggtctcgccgctcagtacatcgcctaccatttcgacgaactggcgcgccaggacgcctatcgcccctggttcgcccagctctgcccggaaatcggctgcacccttccctccaaggtcgacgtggagcagatcaggagcagcaacctggtggtccgcagccatcccgaattcagcggcgcgctggtggtcgacgcgatcatctacaatcgcgccagcttctcgcagccgttcccgctgctggaactgcgcttcgccgacctcaacggccacctcatcgccaatcgccgcttcaagcccggcgagtacctcggcggcgagctggccggacgaacggaaatgccaccgcaggtaccgatccacgtgtcgctggacatcctcgacccgggtccgaaggcggtgaactacagcctgagcttccattccccggagtgaccggaaagacctcgccggtcgccgccgggccgctacgcccacccgctcgcgcggagcgccaggcgcaagtgccgctcgtcttccaactgtaa

SEQ ID NO: 10304 - DNA, 1110 bp, Pseudomonas aeruginosa
gaactaaggaatcggctgttcagaatttatccaaaacagcctttatccggtcatccagagcgggtatcatgccctcccttttttcgcagcaccgcaagacagggaagccccatgtcggtggtacgcatcggcccatatacactgcccaacagactgatcctcgcgccgatggccggggtgaccgatcgtccgttccgtcagctttgccgtcgccttggcgccgggatggtggtatcggagatggtgaccagcgacgtccgcctgtggaacagccgcaagtcgcgcctgcgcctgatccacgatggcgaggacgagccgcgctcggtgcagatcgccggcggcgatccggccatgctggccgaggccgcgcagcgcaatgtggaactcggtgcgcagatcatcgacatcaacatgggctgcccggcgaagaaggtatgcaacaaggcagcggggtccgccctgctgcgggacgaggcgctggtcgccgagatcctcgatgccgtggtcagggcggtcgacgtaccggtcaccctgaagatccggaccggctgggaccgggacaaccgtaacggcgtcaccgtcgcgaagctcgccgaacaggcggggatccaggctcttgcggtgcatggccggacccgcgccgacctgtacaccggggaggcggagtacgagaccatcgcggcgatcaagcaggccgtgtcgataccggtgttcgccaatggcgacatcgattcgccggaaaaggccaggaaagtcatcgagcagaccggggtggatgccctgctgatcggtcgggccgcccagggaagaccgtggattttccgcgagatcgaccattacctgcggaccggcgagcacctgccggcggcgccgcttcccgaagtgcagagcatcctgctcgaacacctcgcggagctgcaccttttttatggggaagaaatgggtgtgcggatcgcccgcaagcatgtggggtggtatctcgcgactctgccgggcgcaagggaattccgcgcccagttcaatcgtttgcaggacacggatgcgcagtgcgccagcgtcaggcagttcttcgccgagcgccagaacaacggaacaggggtggccgcatga

SEQ ID NO: 10305 - DNA, 1734 bp, Pseudomonas aeruginosa
accgcgggaccctgcgcaagaaactcaagcaatacgatcttctttaagagcggcggcgggctccggccaagggcgcgcgtcccggccggcacccgcggccggaagccagccctcaggacccttgcaatgaccgaccaaaccacccgcctgcccatccgccgcgcgctgatcagcgtttccgacaagaccggcgtcgtcgacttcgcccgtgagctggtcgccctcggcgtggaaatcctttccaccggcggcacctacaagctgctccgggacaacggcatctctgccgtggaagtggccgactacaccggcttcccggaaatgatggacggtcgggtgaagaccctgcacccgaaggtgcatggcggtatcctcggtcgccgcgacctggacggcgcggtcatggagcagcacggcatcaagccgatcgacctggtggcggtcaacctgtatcccttcgaggccacggtggccaggcccgactgcgacctgcctaccgccatcgagaacatcgatatcggcgggccgaccatggtccgttcggcggcgaagaaccacaaggatgtcgccatcgtggtcaatgccggcgactacgccgccgtgatcgaatccctcaaggccggcggcctgacctacgcccagcgtttcgacctggccctcaaggcgttcgagcacacctccgcctacgacggcatgatcgccaactacctgggtaccatcgaccagacccgcgataccctaggcaccgccgaccgcggcgccttcccgcgcaccttcaacagtcagttcgtcaaggcccaggaaatgcgctacggcgagaacccgcaccagagcgcggcgttctacgtcgaggcgaagaaaggcgaggccagcgtctccaccgccatccagttgcagggcaaggaactgtcgttcaacaacgtcgccgacaccgacgccgccctggaatgcgtgaagagcttcctcaagccggcctgcgtgatcgtcaagcatgccaacccctgcggcgtcgccgtggtgccggaagacgaaggcggcatccgcaaggcctacgacctggcctacgccaccgatagcgaatcggcgttcggcggcatcatcgccttcaaccgcgagctggacggcgaaaccgccaaggccatcgtcgagcgccagttcgtcgaggtgatcatcgcgccgaagatttccgccgccgcccgcgaggtggtcgccgccaaggccaacgtacgcctgctcgaatgcggcgaatggccagccgagcgcgccccgggctgggacttcaagcgggtcaacggcggcctgctggtacagagccgcgacatcggcatgatcaaggccgaggacctgaagatcgtcactcgccgcgcgcccaccgagcaggagatccacgacctgatcttcgcctggaaggtggccaagttcgtcaagtccaacgccatcgtctacgccaggaaccgccagaccgtcggcgtcggcgccggccagatgagccgggtcaactccgcacggatcgccgcgatcaaggccgagcacgccggcctggaagtgaaaggcgcggtgatggcttccgacgccttcttcccgttccgcgacggcatcgacaacgcggccaaggccggcatcaccgcggtgatccagccgggcggctcgatgcgcgacaacgaagtgatcgcggcggccgacgaggcggatatcgcgatggtgttcactggcatgcgccatttccgccattga

SEQ ID NO: 10306 - DNA, 1383 bp, Pseudomonas aeruginosa
acatgccctggcctggaaagtcgcccaggacccgcgcgtggcgaaggtcttcgtcgccccgggcaacgccggcaccgccaccgaagccaagtgcgagaacgtcgccatcgacgtgctggccctggagcaactggccgacttcgccgcgaagaacgtccagttgaccatcgtcggtcccgaggcgccgctggtggcaggcgtggtcgacctgttccgcgagcgcggcctggatatcttcggcccgaccgccggcgccgcccagctggaaggctcgaaggccttcaccaaggacttcctcgcccgccaccggatccccaccgccgcctatcgcaacttcaccgaggtcgagccggccctggcctacctgcgcgagcagggcgcgcccatcgtcatcaaggccgatggcctggccgcgggcaagggcgtgatcgtcgccatgaacctggacgaagccgaagccgccgtgcgcgacatgctcgccggcaatgccttcggcgacgccggctcgcgcgtggtgatcgaggagttcctcgatggcgaggaggccagcttcatcgtcatggtcgacggccagaacgtgctgccgatggccaccagccaggaccacaagcgcgtcggcgatggcgacagcgggccgaacaccggcggcatgggcgcctactcgccggccccggtggtcaccgccgaggtccaccagcgggtgctggacgaagtgatctacccgaccgtgcgcggcatggccgaggaaggcaacgtctataccggcttcctctatgccggcctgatgatcgacaagagcggcgcgcccaaggtcatcgaattcaactgccgcttcggcgatccggaaacccagccgatcatggtccgcctggagtcctccctggtcctgctggtcgaggccgccctggccaaggcgctggacaaggtcgaggcgacctgggacccgcgtccgaccgtgggcgtggtactggccgccggcggctatccgggcgactacgccaagggcgaggtcatcgaaggcctggccgaggccgccgcgctggacggcaaggtgttccacgccggcaccgcgctgaaggatggccaggaggtcacctccggcggccgcgtgctctgtgccaccgccatcggcgagagcgtgtccgccgcccagcaacaggcctatcgcctggccgagaagatccgctggaacggctgcttctaccgcaaggacatcggctaccgtgccatcgcccgcgagcgcggcgagtcctgaccgggcccgaagccgcgggcgccgcacggcgcttccgcggcatatgccgttgccacggccacttggctataatccggccattcaccttcgaagggacttcgccgtggtacggcttcggatcgccatag

SEQ ID NO: 10307 - DNA, 447 bp, Pseudomonas aeruginosa
gactactcgtcagcttcctgctgcttctgctcggtccgatgtcgccggcggtcgcggacgacgccggcgtttccagcgttcccctgcaaaccaccgccaccacccccagcgtcaaccagaactggcgcctgctgcgcgacgagagcgcgcaactgcggatcgccgacgtcctccagcgcaaggagcagttccgcccgctggccaagcgctccttcatcttccccgccagcccccaggcggtctggctgcaggtccagcttcccgcgcagaaggtgccgagctggctgtggatcttcgccccgcgggtgcagtacctggactactacctggtgcaggacggccaactggtgcgggaccagcacaccggcgagtcgcgaccgttccaggagcgcccgctgccctcgcgctcctacctgttctcgctgccggtcgacggcaagccgatga

SEQ ID NO: 10308 - DNA, 1002 bp, Pseudomonas aeruginosa
tcgcctactgggtcggcgaacgcgatcgccgccgccagggcgacgccctgccctcctgagggcagcgacgtgctccagcgctgcacccggcctccgccacggcggataaccgcacgcggctattcgccctacgccccggtggtcccggctcccgtagggcgcatgacgccaacggcgttatccgccgataccgccacttccgccacggcggataaccgcacgcggttattcgccctacgccccggtggtcccgcctcccgtagggcgcatgacgccaacggcgttatccgccgacatccggcctcgttgtcacatgccacgcgaaccggcatattgccaacccgccggacatcgcaccggcccgtcgcacgctatgctcatgcccacacccggaccggaagcgcctccatgcatttgctgttcagcgtctacctgaagatgctggtgctctatagccccttcttcgtgctgtcctgcttcatcagcctcagccgcggcttcggcccgcgcgaccgcaagcgcatggcctggcgggtggccctggcggcgctgatcgccagcgtcgcgctgtacctgttcggccgctacatcttcatcctcttcggtatcaccgccgacgccttccgcatcggcgccggcagcgtgctgttcatctccgcgctgggcatggcccagggccgcgcggcggtgcagagcgacaacgtgcagcaggacgtgaccatcgtcccgctgaccattcctctcaccgtcggccccggcaccatcggcgcgctgctggtgatgggcgtcggccagggctgggaggccaagctgatctccctggtggcgatcttcctcgcctgcctgaccctcggcaccacgctctatctttccgaccgcatcgaacgcctgcttggcgaccagggactacagatcgtcagtcgcctgatgggcctgttcgtctgcgcactggcggcgcagatcatcgtcaccggcctgaagggttcgctgttcccaggctga

SEQ ID NO: 10309 - DNA, 4095 bp, Pseudomonas aeruginosa
atggagaacaacaccaatgaaacgtcgcagtctgctcaaggccttcacgctgtccgcgtccatcgcttccatgggcctgtcctggtccatccaggccgccgaaaccatcaaggtcggcatcctccactcgctgtccgggaccatggcgatctccgagacctcgctgaaggacatggccctgatgaccatcgacgagatcaacgccaagggcggggtcaacggcaggaagctggaggcggtggtggtcgatcccgcgtcgaactggccgctgttcgcggaaaaggcccgccagttgctgacccaggacaaggtcgcggtggtcttcggttgctggacctcggtgtcgcgcaaatcggtgttgccggtgttcgaggaactcaacggattgctgttctacccggtccagtacgagggcgaggaactctcgccgaacgtcttctataccggcgcggcgccgaaccagcaggcgatcccggcggtggagtacctgatgagcgaggacggcggcggcgccaggcgcttcttcctgctcggcaccgactatgtctacccgcgcaccaccaacaagatcctgcgcgccttcctgcacagcaagggcgtggacgacaaggacatccaggaggtctacacgccgttcggccacagcgactaccagaccatcgtcgccgacatcaagaagttcgccgcaggcggcaagaccgcggtggtctccaccgtcaatggcgactccaacgtgcccttctacaaggaactggccaaccagggcctggaagccaccgaggtgccggtggtggccttctccgtaggcgaggaagaactgcgcggcatcgacaccaagccgctggtcggcaacctcgcggcatggaactacttcgagtcggtgagcaatccggtcaacgagaagttcgtcgccgactggaaagcctacgccaaggcaaagaacctgccgaactacggcaccgcggtgaccaacgaccccatggaagccacctacgtcggcatccacatgtgggcgcaggccgtggaaaaggccggcagcaccgaggtcgacaaggttcgcgaggcgatggccgggcaaagcttcaaggcgccatccggctacacgctggtcatggacaagagcaaccaccacctgcacaagccggtgatgatcggcgagatccaggacgacggccagttcgaagtggtttggaagacccccgagccgcttcgcgcgcaaccctggagcccgttcatcccgggcaacgagaaaaagccggagcatgcgctgaagagcaactgagttctgccgtgaagaaccctgcccccctgaccaggcgttcccctgaacggaacgggaacgccccggtcgcgcgcctaacggccccctcgtccttcagggagagggcgggggaccggccataccgcacgtcgcccaggaaccccagcatgccccttgccctcctcacccgcccgctccaggcctgtgtcctggtcctggccgcccttctcgcggtgacggcctacgccggaccggcgcaggacttcgccgctgccgacaacggcggtcgcgcccacctgctcgaacactgggcggcgacgcccgacgccggtcgcctggcctttctcgaagcgctgcgccacaaccgcattgcgctggacagccgccagcagccattcatcctcggcgccgaccagcgtttccaggccgccgaaggcgacgccctgccggacggcgagccgaagccgctgcgcctgaacaatcgcctgcgcggcctgctcaacaccgccctggccagccaccagttggtggccaacgaagtgccgctgcggcaggccgccgcgcagcagttgcagaaaaccgccaaggccgcgcaacggccgctgctcgaagcgcgcctgcggatcgagagcgacgctggcgtgaaggaagccctcggcctggccctggccaacctgcaactcggcgatcccgacccggcgctacgcctttccgccgtgcgcctgctcggcgagtccggcgatccgctggcgcgaacccgcctggagaacctgctcgacccggcggtggaaccggaggaaggcgtgcgcatcgccgccgccaccagcctggcccaggtcaagcgccgactgctggtcggcgacctgctcggccaggccttcagtggcctgtcgctgggctcgatcctgctgctcgcggcgctcggcctggcgatcacctacggcctgctcggggtgatcaacatggcccacggcgaaatgctcatgctcggcgcctattccacctacgtggtgcaactgctgttccagcgcctggcgccggaatggctggcgctctacccgttgctggcgctaccggtggcgttctgcgtcagcgccgccatcggcatggccctggagcgcacggtgatccgccatctctacggccggccgctggaaaccctgctcgccacctggggcatcagcctggtgctgatccaactggtgcggatgctgttcggcgcgcagaacgtcgaggtagccaacccggcctggctgtccggcggcatccaggtgctgccgaacctggtgctgccgtggaaccgcatcgtcatcatcggcttcgccctgttcgtgctgctcctcacctggctgctgctgaaccgcacgcggctcggcctgaacgtccgcgcggtgacccagaaccgcaacatggcggcctgctgcggggtgcccacagggcgcgtggacatgctcgccttcggtctcggctcgggcatcgccggggctcggcggggtagccctgtcgcaggtcggcaacgtcggcccggacctcggccagggctacatcatcgactccttcctggtggtggtgctcggcggcgtcggccagctcgccggcagcgtcctcgccgccttcggcctcggcgtggcgaacaagatcctcgaaccgcagatcggcgcggtgctgggcaagatcctgatcctcgcgctgatcgtcctgttcatccagaaacgcccgcagggactgttcgccctgaaagggagggtcatcgattgaaccagccactcaccgtcaccctcgcccgccgggccggcggccgcgtcaccgctatcgcgctcggcgcagccttcgccacgctgctggccatgccgctgctgcacctgctgccggcggacagcgcgctgcacctctcggcctacagcctgaccctgaccggcaagatcctctgctacgccatcgtcgccctcgccctcgacctggtctggggctacgccggcctgctgtccctcggccacgggctgttcttcgccctcggcggctacgccatgggcatgtacctgatgcgccaggcctccggcgacagcctgccggcgttcatgaccttcctttcctggaacgaactgccctggtactgggccggcacccagcacttcctctgggcgctgtgcctggtggtgctggtgcccggcgcgctggccttcgccttcggctacttcgccttccgctcgcggatccgcggcgtgtacttctcgatcatgacccaggccctgaccttcgccggcatgctgctgttcttccgcaacgagaccggtttcggaggcaacaacggcttcaccgacttccgcagcatcctcggcttcccgatcaccgcgccgggcacccgcgccgccctgttcctcgccaccgtcgcgctgctcgcggccagcctgctgctcggctggcgcctggcgcgaagcaagttcggccgggtcctcaccgcgctgcgcgacgccgagaaccgcctgatgttctgcggctacgacccgcgcggctacaagctcttcgtctggaccctgagcgcggtgctctgcggcctcgccggcgcgctgttcgtgccgcaggtggggatcatcaaccccagcgagatgtcgccgaccaactccatcgaggccgccgtctgggtcgccctcggcggacgcggcaccctgctcggcccgctgctcggcgccggcgtggtgaacggcgcgaatagctggttcaccgtggccttcccggaatactggctgttcttcctcggcgcgctgttcatcgtcgtcaccctgtacctgccgcgcggcctgctcggcctgctgcgcaaggagaaggagcaatga

SEQ ID NO: 10310 - DNA, 810 bp, Pseudomonas aeruginosa
cgcctgccaagtggcgcccgtcgcgtagggcgaatgaccgctcgcggttatccgccgagccaggttgggaatcgcagtgaagaaccatcacgggacaaatggaagagaaccatgctgcaagtcgacaagctccaccagtactacggcggtagccatatcctccgtggcctgagcttcgaggcgaaggtgggcgaggtgacctgcctgctcggtcgcaacggggtgggcaagaccaccctgctgcgctgcctgatgggcctggtcccggcccgcgagggccaggtcgcctgggaaggccgttcgctcaccggactcaggccgcaccagcgggtccgcgccgggatcgcctacgtgccgcagggacgggaaatcttcccccggctgacggtggaagagaacctgctgatgggactgtcccgtttcagcgccagggacgcccgggcggtgccggacttcatctacgagctgttcccggtcctgcgcgaaatgaaacagcgccgcggcggcgacctctccggcggccagcagcagcaactggcgatcggccgcgccctggccagccagccgcgactgctgatcctcgacgaacccacggaaggcatccagccttcggtgatcaaggagatcggcacggtcgtccgcagcctggcggcgcgcggcgacatggcgatcctgctggtcgagcagttctacgacttcgccgccgaactggccgaccaatacctggtgatggcgcgcggcgagatcgtccagcagggccgcggccgcgacatggagagcgagggcgtgcgcgggctggtggcgatttga

SEQ ID NO: 10311 - DNA, 537 bp, Pseudomonas aeruginosa
acggactgggacacactgccgctggcgcaaccggggccctgcgctggcaatctctatgccctcgtctttccgcaggaggtcgaaatgaccgtcactctgcgcccggccgtccaggccgacgcgggcttcgccgcgctctgcgtcgccgccgcctatgccccgtggatcgcggtgatcggccgcaagccctggccgatgacccaggactaccacgaggtgatcgccagcgaccgggtcctcatcgccgagcacgacggccagccggtcggcctgctggtgacgcgggaaaccgccgacggcttcctcgtcgacaacctcgccgtgcttcccgaatgcaagggccagggcatcggccgacaactgctggagcgtgccgagcgcgacgcaacgagcctcggctaccgctcgctgtacctctacaccaatgagcggatgacggaaaacatcgagctctacgccagggtcggctacctcgaatacgaacgccgccaggaagagggattccgccgcgtgttcatgcgcaaggccctggcctga

SEQ ID NO: 10312 - DNA, 672 bp, Pseudomonas aeruginosa
cgcggcgccactccggaccgctgcgggtgcagaagcacctctacgccgaaggcccggaagtctgccagcacatcctcgtgcatccgcccggcggcatcgccggcggcgacagcctggccttcgacgtgcgcctcggcgaacgcgcctgggcccagctcaccagccccggcgcggccaagtggtaccgcgccgcctgcccgtcgcggcagaccctggagatccacctggagcccggcgccaccctggaatggctgccgcaggaaagcatcgtcttcgccggcgcccaggccgaactggaaacccgtatccagctgcgcggcgacgcccgcctgttctactgggacatggtcgcgctcggccgcccggccagcggcgagcgcttcgtcagcggccacttcgtcgcggccctggacatccgtcgcgacgaccgcctgctctggcacgagcgccagcgcatcgacggcggcgaccgcctgctcgactcgccgatcggcctcgccgggcatccggtgctggcgaccctggtcgccagcggcgagatcgacaccgacctgctgcaacgctgccgcgcgctcccctgcgccggccgcggcaacctcagccagttgcccggcggcctgctggtggcgcgctgcctggccgacgaggcgctgcacgcgcgagcctggctga

SEQ ID NO: 10313 - DNA, 378 bp, Pseudomonas aeruginosa
tcgaactctggcgcctgctgcggccggcgctgctcggccgcgaggccgttcccccacgcatctggagtacctgagatggacttgtccccccgcgagaaagacaagctgctgatcttcaccgccggcctgctcgccgagcgccggctggcacgcggtctcaagctgaactacccggaggcggtggcgctgatctccgccgccctgctggagggcgcgcgcgacggccgcagcgtcgccgagctgatgcactacggcaccaccctgctgaaccgcgagcaggtgatggagggcgtgccggagatgatcccggacatccaggtggaggccaccttcgccgacggcaccaagctggtgaccgtccaccagcccatcgcctga

SEQ ID NO: 10314 - DNA, 318 bp, Pseudomonas aeruginosa
gcgcttcgatccgcgacgccggcgtcgccgacctgcccggcatcctcgccatctacaacgacgccgtgggcaataccacggcgatctggaacgaaaccccggtggacctggccaaccgccaggcctggttcgacacccgcgcccgccagggccacccgatcctggtggcgagcgacgccgccggcgaagtgctcggctacgcctcctacggcgactggcgacccttcgagggcttccgcggcaccgtcgagcactccgtctacgtgcgcgacgaccagcgcggcaaaggcctcggcgtgcaactgctgcaggcgctga

SEQ ID NO: 10315 - DNA, 414 bp, Pseudomonas aeruginosa
acctcgacccgacgcgcagcgcgccctgagccccaaggagcccccatgatccccggtgaatacgacatccagcccggcgatatcgaactcaacgccggccgccgcaccctcgccctgagcgtggcgaacaccggcgaccggccgatccaggtcggctcgcactaccacttcttcgaggtcaacgacgcgctcgccttcgaccgtccggccacccgtggcatgcgcctgaacatcgccgccggcaccgcggtgcgcttcgaaccggggcagagcccgcgaggtggagctggtggaaatcggcggcggacggcgggtatacggctttgccgggcgggtgatgggggacctctagggccccactggccaggttcgaccaaagacagcgaacaccgacgatcgccaaaggagcgttag

SEQ ID NO: 10316 - DNA, 1701 bp, Pseudomonas aeruginosa
atgaaaatcagcagacaagcgtacgccgacatgttcggccccaccgtcggcgaccgcgtgcgcctggccgacaccgacctgtggatcgaggtggaacgggacttcaccgtctatggcgaggaagtgaagttcggcggcggcaaggtcatccgcgacggcatgggccagagtcagctgggcgcggcgcaggtggtcgacacggtgatcaccaatgcgctgatcctcgaccactggggcgtggtcaaggccgacgtcggtctcaaggacgggcgcatccaggccatcggcaaggccggcaaccctgacatccagcccggggtgaacatcgccatcggcgccggcaccgaggtgatcgccggcgagggcatgatcctcaccgccggcggcatcgacacgcacatccacttcatctgcccgcagcagatcgaagaggcgctgatgagcggggtcaccaccatgatcggcggcggcaccggccccgccgccgggaccaacgccaccacctgcacctccggtccctggcacatggcgcggatgctccaggccgccgacgccttcccgatgaacatcggcttcaccggcaagggcaacgccagcctgccgctgccgctggaggagcaggtgctcgccggcgccatcggcctgaagctgcacgaggactggggcagcaccccggcggcgatcgacaactgcctggaggtcgccgagcgccacgacatccaggtggcgatccacaccgacaccctcaacgagtccggcttcgtcgagaccaccctcggcgccttcaagggccgcaccatccacacctaccacaccgagggcgccggcggcggccacgcaccggacatcatcaaggcctgcggcttcgccaacgtgctgcccagctcgaccaacccgacacggccgttcacccgcaataccatcgacgagcacctggacatgctgatggtctgccaccacctcgacccggccatcgccgaggacgtggccttcgccgagtcgcgcatccgccgcgagaccatcgccgccgaggacatcctccacgacctcggcgcgttcagcatgatcagctccgacagccaggccatgggccgggtcggcgaagtgatcacgcgcacctggcagaccgccgacaagatgaagggccagcgcggccgcctcgacggcgacggtgcgcgcaacgacaacttccgcgccaggcgctacatcgccaagtacaccatcaacccggcgatcacccacggcatcagccatgaagtgggctccgtcgaagccggcaagtgggccgacctggtgctctggcgcccggccttcttcggcgtcaagccgagcctgatcctcaagggcggggccatcgccgccagcctgatgggcgacatcaacggctcgatccccacgccgcagccggtgcactaccgaccgatgttcgccagctacgccggcagccgtcacgcgaccagcctgaccttcgtcagccaggccgccttcgccgccggcgtaccgcagcagctcggcctgcgcaaggccatcggcgtggtcagcggctgtcgcggtgtgcagaagaccgacctgatccacaacggctacctaccgaccatcgaggtcgacgcacagaactaccaggtacgcgccgacggccagttgctctggtgcgaaccggcggacgtgctgccgatggcgcagcgctatttcctgttctga

SEQ ID NO: 10317 - DNA, 1404 bp, Pseudomonas aeruginosa
ttcccacgcgacgggtcccggcgccacgccgggacgtcgaccgctccgttcggacagcttggcttgtcggcgctagcggcgacaatggcgcctacccgtagccgccggcagtccgtccatgtcctcccgccaatcgtcccgcaacgcttccaccccgtatctggccaaggccttccaggcaacggccatcgtcgtggtgagctacttcctctactggacctaccagctctaccagtacggcgagattcccatcagcaagaaggacgtgatgctgcgccaagccatcctcgcgcgctttccggcggactacgaggtggagatcaagggcgccgacctgctcggcttcggcgagaaattcctggtcgcctacggcaatcggcgcttcgtcggcaaggccttcgccatggacgaccaggtcatcgagcgcctggagcggaaccagggacggaccaacctgccgctggtgaaggtgttctacatcgccgaacccggcctcctctcctcgctgctcaacctctccccgttcctggatatccagaagaacatggtcgagctgagcctccgggaataccggaagatccagttggtccccttcgatccggacgcgaagcggaaaccgcgcgagcagttcgaaaccgattatgccttcccccagctgttcagcctcagccaaatggaagtcgccgactacgacggcgacggccgcgacgaactgcgcctgggctacctgtcctacgccggcggttcgggagggacgcgctggtcggtgatctacgacctgaaggacggcgcgctgaccgcccattccggctatccggaaatgctcgacatcgacgtcgcccggttcatccaggcggtcaacctgtacgccggcctcgacggcaccctgccacgcgaccagcgtcagctggaagacgtggtcggccgaggcagcgagcgcttcgcgctgaccgccgcggagcgccaggcactggtcgccgacccgccgcagcgggacgactacgccagggtcctgatgagcctttcgccgcgctcgccctacgcccccgatcgcttcatcgacctcggcgacggcagccgactgagcctggccccgcgccataccgacgattactcgaccttcctcgacatcggcgggaagaaaatcttcgtcgaagccttctacgtcgacgacgacgcctgccactggtgcgagcatcgctggcgagtgatggctttccattacgacgacggtcgctggatctcggaccgcaccatcaacggcgacagcttcaacgggcaatggctgcgcaacgcggagccgctgggcctcaacgacgttttcggcacctaccgcgaccagggcccggcgggcctggcctggtccttcatcgacccgcgctggaccgcctccagccagcatga

SEQ ID NO: 10318 - DNA, 738 bp, Pseudomonas aeruginosa
ctgactcctctggctgaaaccctggaacctccagatatgggcgttcgcccgcggctttgcaagggcggcgcgaccatcggcctggcgtggcacaatcgccagccaagcctggaggtacaccgcatgatgggaccgttccgccgcctcgcccacctgatcgaccagggccgccagctcgacgccgcgctcgccggcgatccgttcgccctgccggcgccggaggaccgctatagcgtccggcaactgcacggcctgtatccgcgccgtcatcccggtctctacgcaccgctgctcggcagcctggcgctgctgctcggtgccgcgccgctgggtcttgccgcgctgcgcctggcattgccggaggctcctttgcggccgctgggctggctctccgccctgccgctgctggcggcctggctgtggctgatcgccctgctctcccgtggcgccagcctcggcccgcgcctggcccgcgacgccagtctgctgctggtcgccaccgggctcctgctgcgcctggccagcggcgagacgtcgggcctggtggcgctcggcggcggcgcctgtgcctggctgctgttcaacagccgggcgatgcaacgctacatggaactggtctacgcccagcgcctgtaccgcgcccagtcggccaaccgccccggttcggcgcagcggcgcctggccaaccaggccgcctaccgcgaacgcaagcgacgcgagcgctccgggcgatcctga

SEQ ID NO: 10319 - DNA, 1695 bp, Pseudomonas aeruginosa
tcagggcgaagtccggcgccgccaggacctgcagggaagccaccgaaccgccgaggatgccgcactcgaagccgaggtcggcggcgatacgcgccgacatgggatcgaacacggaagcggtgtggtagcaacgggaggagtccaacagcgcgcgaaacatcgcacgcaactcatggtgtgaggctctatgcatggcgaaatccaggacaacacggcaagacggagtgggaaagcagcgccaacatagcaccatgcgcaggccccttggcaaatccgtatacaaaggtcggggcggcccgcacggacgtcccaggacgcttcctgccgatcgccggcggtgaaatctacgacgctctcgcatacactgcgcggccgtttttttcccggaccgtttcgcgccatgaacccgagcaccgccgcccgcgccctgggcatcgattttggcacctccaactccaccgtcggctggtggcggccggaggtcgaaccgctgatcgagctggaggacggcaagatcaccctgccctcggtggtgttcttcaacgtcgaggagcgccgcccggtctacggccgccaggcgctcggcgagtacctggagggctacgagggccggctgatgcgctcgctgaagagcctgctgggctccaagctgctgaagagcgagaccaccgtgctcggcagcgccctgccgttcaaggacctgctcggcctgttcatcggccagctcaaggcgcgcggcgaggccgccgccgggcaagccttcgacgcggtggtgctgggtcgcccggtgttcttcgtcgacgacgacccggaggccgaccgcgaggcccaggacaccctggtgcaggtggccaacaagctcggcttcaaggaggtttccttccagtacgaaccgatcgccgcggccttcgactacgagcgctgcatccagcgcgaggaactggtcctgatcgtcgacatcggcggcggcacctcggacttctccctggtgcgcctggcgccggagcggcgcaacctggccgagcgccaggacgacatcctggccaccggcggcgtacacatcggcggtaccgacttcgacaagcagctcagcctggaaggcgtgatgccgctgttcggctacggcagccggatgaagagcgacgccttcatgcccaccagctaccacctgaacctggccacctggcacaccatcaacgcggtgtacgcgcagaagtcgcaattggcgctgaagaacatgcgctacgacatcgtcgacagcaccggcatcgaccgcctcttcaggctcatcgaggaacgcgccgggcactggctggcgatgcaggtggaagacagcaagatccgcctgaccgaaaccgagcgcctgcacctctcgctggagcgcatcgaggccgggctcggcgtggagctgacccgtgggctgttcgagaacgccgtcgacggactgctggagcgcgtgcgcaacagcgtcgcgcaactgctggcctcggccggggtcgacccggaccgggtcgacacggtgttcttcaccggcggttcgagcggcattccggcgctgcgccggagcgtctcggcgatgctgcccaacgcccgtcatgtcgagggcaacctgttcggcagcatcggcagcggcctggccatcgaggcgaagaagcgctacggctgagccgccctggccgcgcccctgccctatag

SEQ ID NO: 10320 - DNA, 528 bp, Pseudomonas aeruginosa
tggcgatcgtcctggaagacggcgaggttcgccccggcgacgccatcgatatccagctgccccccttgccgcaccgggccctggagaaggtctgaggcaatccgccgcgattccgggcgaactctgcgcgagggcctgcgttccaatgttggcaagcaccgctcaaccacaaggagtcacagcatgtacaagcagtcactggcggcactgttcgtgatggcaaccctggccggctgcgcgtcgaccaaggtgcagaacccggtcaactacatcaccttccgcaacgaaccgctggtcaaggatgtcgagaaaggcatgagccagcaggaagtcctgcgcatcggcggcacgccttccggcacccagaagcgcctgatgaaaccggggagctgcaacagctacatcctcaacaaggacggccagcagcagccgttctacgtcagtttcgacggcagcggcaaggtcgacggctcgggcttcctgagctgctccgagctggaccgccacgagcgcgacgcccgcccctga

SEQ ID NO: 10321 - DNA, 843 bp, Pseudomonas aeruginosa
tctgccggtatcccgcagcaggaaccggaaatgctcaccatcggccaactggcgcgaatcttcgagatctccaccaagacgcttcgccactacgatgccatcggcctgttcgtccccgcgcgcaccggtagcgacaacggctaccgctactaccagccggaacagatcgagcagctctcgcgcatactcgcgctgcgccggctggacgttccgctggaagccatcgaccgcctgaaacgcgatggcgcgctggacgacccgcaacgcctgcggcatttcctgcaacgacaccagcacaccctgcgcgaagagatcagcgcccgccagcgcctgctggcggaactcgaccgaaccctggcgacgctcgcccactggaggatccgcaacatgcatgcacgaatcgtcgaacgtcccgccttcagcgtggtgggcatggaatacttcggcagcgcccccggcgacaccatcggccagctctgggaacgcttcatcccgcgcgagcacgagatcgccggcaagcacgatcccgaggtctcctatggcatctgcgcgcagcagcccaacggcgaattccactacgtcgccggcttcgaggtgcaggagggctggccggtgccggagggcatggtgcgcttccaggtgccggcgcagaagtacgcggtgttcacccacaagggcacggcgccgcagatcgccgagagcttccaggcgatctacagccacctgctcgccgaacgcggcctggagcccaaggcgggggtcgacttcgaatactacgaccagcgtttccgcggaccgctggatccgaactcgcaagtcgacctgtatatccccatctactga

SEQ ID NO: 10322 - DNA, 1122 bp, Pseudomonas aeruginosa
ctccaacgcaatcgacaacccactcggagtcaccgtcatgaaagcttccctgatcctcggcctcgccctcgccaccctgaccgccaacgccgccttcgccgccgacggctccagccgcaccatcgaccggctgcacaaggatatgtccagcgtcgaactgcgcatcgccgacaacggcagcgagcagaccatcgaccgcctgcacaaggacatgaccaaagccgaagcccgcctggccgacgacggcagcgagcagaccgtcgaccgcctgcacaaggacatgaccaaggccgaagcccgcctggccgacaacggcagcgaacagaccgtggaccgcctgcatcgcagcatgagccgtttcgacctgcgcaccgcctgaccgctcgctacgccgcaaggcgcgagaaaagcccggctcgatgccgggctttcctattttcccatccctgtcgcgctgggcgcatggcccgaggcaagccgcactctcccgcctcagactccgctgaaccagttgtaaccctggtcctcccagtaacctccgggattgctgttgctgacgaagatctccaccacgtgcttggcgttcttgaagccgagcttggtgggaatccgcaggcgcagcggatagccgttctcctccggcagcgcctgtccggacatctccagcgccagcagcgtctgcggatgcagcgcgctgggcatgtcgaggctggagtagtagcggtcggcgcacttgaagccaacgtacttcgccgaggtgtcggcgccgaccagctccagaaaggtgcgcagcggcactccgctccactggccgatcgcgctccagccctcgatgcagatcagttgcgtgacctggctggcctgcggcagccggcgcagttgctccaggctccaggggcgcttgtcgcggacccgcccggaaacctgcaggcggtattccggcaggtcgatctccggcacgttgtaggccgggtagaacgcgttgaaggggaacggcgaggccacctgcgacggatcgaaggtcggcgccagccgcgtacggctgaacagccaggcctggacccggtcgttccagcgcgacatggcccagagtaccttgtcgaccgaatcgccatcctgtag

SEQ ID NO: 10323 - DNA, 804 bp, Pseudomonas aeruginosa
gcctcgatggtcgccccgccggcggtacccggagatgactttcgcatgacaaaaatgtcaccgagtccgcgccgcgcgctggctagaatggcggcgaacgagggggaacgagacatgcgcatcctggtgatcgaagacgatacgaagaccggcgagtacctgaagaagggcctcggcgagtcgggctatgcggtcgactggtcgcagcacggcgccgacggtctctacctggcgctggagaaccgctacgacctggtggtcctcgacgtgatgctgcccggcctggacggttggcagatcatggaagtgctgcgcaagaagcacgatgtgccggtgctcttcctcaccgcccgcgaccagctgcaagaccgtatccgcggcctcgaactgggtgctgacgactacctggtgaaacccttctccttcaccgagttgctgctgcgtatccgtaccctgctgcgccgcggcgtggtccgcgaggcagagcaggtgcaactggccgatctgcagctggacgtgctgcggcgcaaggtcagccgccaggggcaggtaatcgccctgaccaacaaggagttcgccctcctgcacctgctgatgcgccgcgagggcgaggtgctgtcgcgcaccctgatcgcctcggaggtctgggacatgaacttcgacagcgacaccaacgtcgtcgacgtggcgatcaagcgcctgcgcgccaaggtcgacaatcccttcccgaacaagctgatccataccgtgcgcggcatcggttacgtctgcgaggagcgcccgtgcccgcccgccgctccctga

SEQ ID NO: 10324 - DNA, 339 bp, Pseudomonas aeruginosa
gcgtggagaacgcctgcgacaggctgccggccgagccgctgtcgcgcctgttcgaccgcttctaccgtggcgacgccgcgcgcagcgacgcccagtccagcggtctcggcctggccatcgtccaggcgatcatgcgcctgcacggcggccgcgccgaagcgagcgccccggctccgggacgcatccgcttcgacctggcgttcccggctcaggactgagcgggcttctcgccggcgtccggctcgccgtcggagcggccgatattcgccggcgcctccaccaccaactcctccggcacttcctcgacacgcgggtcgagggtggcggccatcgggctga

SEQ ID NO: 10325 - DNA, 1455 bp, Pseudomonas aeruginosa
cgttgtggcccagctccatgttctcgaggatcttgcccaggccgagaagcaggctgccgagcagccaggtcggcggcagccagccgaacatcagcagcgccctgccgctccagcagcagacgcgcaccgccgcgcggacccggcggatgtagcgcgcgtcgtccgcgccgagatcggccagggtacgcaggcgcagggcatcgagttcggcgccgaaggccgccagttgttccggggtcagttcgcggtcgtcgcgcatcgcagggctcgcaggtcggttcacaggtccagcgccaggtcgccgtgggcggcgctgacgcagaggcggataggctggccgggctcgctgcacagcgcgccgctgcgcaggtcgcgcacgcagccgctgagcaggacgcaggtgcaactggcgcagatgccctggcggcaaccgtgggccgggcgcaggccgtgggcctcggcctgttccagcaggctgacggcgctgtcgccggagacttcccgctgcgaccgggcgaagcgcaggcgcacttcgcgcggcgcctccccgctgcgccagcgcgggacgctgaaggattccgtctgcaagccggcgaagcgtgcccccagttgctcgcccaccgcctcgacgaaagccgccggcccgcaggccagggcctggctgcgcgccaggtcggctgcccagccgtccaggtggcgcggctggaaatgcccctccaggcagccatcggcccgcgccccgcgggtcaggctccagcgcaactccaggttcgggtggcgcgccgccagcgcctccagctcgccgagccaggcgcgctggccgggatgacggacgtagtgcagccacagcacgggaccgcgatagccgttctccagcgcctcgcggagcaggccgagcaagggcgtcaggccgctgccggcggccagcaggcagaccgcctcggcctgcatcggccagcgcagatcgccttgcgcgggttgcaactcgacacgctggccgaccgccaggtgttcgcacaaccagggcgagagcagcccgtccgggtgacgcttgacggcgatttccaggcgctcgccgaccacccgggtcaggctgtagctgcgcccgacccgcaccccgtcgcgctccgccagcagttggatgtgctggcccggccgcgccggcggccagccgggggcggtacgcagggccagggcgagcatatcgtcggccacccagtagcgtgcctcgacccgcgcatagtggcggttcaacgacgccagcggatgggcgtggcgcagcaggccgtcgacatcggcctcacgcagccagccacgggcggcgagacggcgcaggggtgcgagcaaaggggtcaggagcgcgaggggaagcaagtccatggaaaatatttcagtgaacgatcgttcacaaaactttgcccgttccgcgcaatcgagtcaacaagcgttcactga

SEQ ID NO: 10326 - DNA, 768 bp, Pseudomonas aeruginosa
tcggcggcaagcactggcacggcctgcccggctgaccccgcacctcccctgcggacctccggctcggcgttcgtccgcggactagacgcgcgcgcacctttccggtgcggcaaaaaagtcgttgcgcaccaacctggcgcgctgcaatattttgttacatccctatggccccgttttcccggtacaggcgtcccgcatcgacctggcaaggcccttgctggtgcttgttgtgatccctttcctgtcgcattgcggaaactgcccatgctggtcatccaccaacgcctgcccgcccgctcgccccgctgggacgaagaactccacctgacctacgaggcgcgcagcaagagccgcctgcgctgcttcgcggcgagcggcgaggaggtcggcctgttcctcgagcgcggccagcctccgctggccgacggcgactgcctggaggcccgcgacggtcgcctggtgcgggtcgtcgcccgctccgaacgtctgctccacgtcacctgcgccagcccgctggaactgacccgagccgcctaccacctgggcaaccgtcacgtcgccctgcaggtcggcgacggctggctgcgcctgctcgacgactacgtgctgaaagccatgctcgaacagctcggcgccacggtggaggccatcgaggcgccgttccagccggagcacggtgcctacggcggaggccaccaccactcgcaccatggcgaggcggagttcaactacgcgccgcgcctgcaccagttcggcgtgcgccggtga

SEQ ID NO: 10327 - DNA, 663 bp, Pseudomonas aeruginosa
cccacgaaacccagtacagccgtctgttccgttcctaggagaaaccccatgacatcccaacccctgcgtgtcggcatcggcggtccggtgggctccggcaagaccgccctgaccctggccctgtgtcgcgaactgcgcgagcgctacaacctcgcggtggtcaccaacgacatctatacccaggaagacgcggagttcctggtgcgcaacgaggccctcgcccccgagcggatcatcggcgtggaaaccggcggctgcccgcacacggcgatccgcgaggacgcctcgatcaacctggaggcggtggaccagctcaaccggcgcttccccggcctcgaactgatcctggtggaatccggcggcgacaacctgtcggccaccttcagccccgagctgtccgacctgaccctctacgtgatcgacgtttccgccggcgacaagatcccgcgcaagggcggccccggcatctgcaagtcggacctgctggtgatcaacaagatcgacctggcgccgctggtcggcgcctccctcgatgtgatggaccgggacgcccggcgcatgcgcggcgacaagccgttcgtgttcagcaaccagaagaccggccaggggctggacgaaatcatcgccttcatcgagcgccagggcctgctgaccgccgcctga

SEQ ID NO: 10328 - DNA, 744 bp, Pseudomonas aeruginosa
aactgcccaagctgctcgccgccctcgccctgctcgccgctccggcgctggccttcgcccaccccggccacggcgaacacggcctggtcgccggcctcgcccatccgctcaccggcctcgaccacctgctggcgatgttcgccgtcggcctctgggccgcccagcaacagggagccgcgcgtctcgccctgccctgcaccttcgtcggcaccatgctggtcggcgggctgctcggcttcgagggcctgcaactgccgttcatggataccggcatcgccgcctcggtgctcgccctcggcctctgcgtggccctcgccgtgcgcccgccgctgccgctggcgatggccgccaccgcgctgttcgccctggcccacggggtcgcccacggcctggagctgccggacctctccagcccctggctgtacgcgctcggtttcgtcgccgccaccgccgcgctgcacgccgccggctacccgctggtgcgcttcctggcgcaggcggccgcgcccctggtacgtctcgccgggctggcctcggcgggcgccggggtctggttgctggccggctgagccgccgcgcctccctcagcgcctgatcagcacccgtcggccttggtgcacgaggcgcaggccatgggtctgtgccagcatcgccagggccagcggcaggtcgtcgacgggaaaggtgccggagacacgaagcgcgtccagcgacggctcgcactcgatgctctcgccgccgtag

SEQ ID NO: 10329 - DNA, 984 bp, Pseudomonas aeruginosa
tcggcgccgaagccgtcgcgccagacctgcgcgcgacatccccaccagaccagcggtgcgccgccgagcagcagggcgaggccgcgcaggaccgcgcgccggccgctgccggacggacgctcgagcgcacgccgggccagcgccggcggcagcgaaccgatattcgccagcagacgctcggcgcgccgccaggcgcgctggtgctcggggctgcgcgagcgccaggactccagctcggcctgctgcgccggagccagcggcccctcctgcatcagcagcagccaggaggcggtctccctgagcacctgcggggcgatcgcctcggcggccggcggcccggaaagctccgtatcgcccgcctgcggcgcccggcgggaagcgcggtcattcatcgggcatcaggctcaggcaggtcacgtaggcctggtggatgaacttcttcaccgtcggcagcgcgacgcccagcgcctgggcgatgtccttctgcttcatgccgtccagcgtcgccatcaggaatgcctgtttcacccgcgggcgcagggtgtcgagcagcgcgtcgatctcgtgcagggtctcgacgatcacactctgttgttccggcgacggctgcaacggctcgggcaacgtggccagggcctccagccaggcgagttccagcgattggcgacggcgccagctgaccagcacgcagttggcgatgcgggtgaggtaggcgcgcggctgacggatcgcgtcacgctggccgccatcgcggctggcgaggatgcgcaggaaagtgtcgtgggccaggtcgtcggccacgccacgtccccaggagcgaaggcggtaggccagccagttgcgcaaccaggcatggttttcacggtagagcgtggcgacgcagtcgcggtccgcttgcaggcaggggcttggcgcattcatcggaggcgcattcatcggaatagtcagctggattcaatcgcaaatgaaaactattatcactaa

SEQ ID NO: 10330 - DNA, 483 bp, Pseudomonas aeruginosa
cccgcggccgcacggcgccggcgctcaagggtcgctacagcgtactggaaggcttgcagcgagtcctgtcgaacaccggcctgcaggtcgcggcgggaacctccggcgcctacctgctggtcgagccgcgcatgcccggagaaaccccggccgacctgtcgccggtggtggtctcggccgccgagctggccgatccgcagaaggaaacctataccgcgccacgctcgtcggtgtacctctccagcgaagacatcgaccgcttcggccgggtttccgtgggtgacctgctccagggcatcccgggcgtacaggtcggcgacagccgcaacggtggcgcgctggacgtcaacatccgcggcatccaggggcagagccgggtggcggtgcgggtcgacggcgcggagcaggcgctggacgtctaccgcggctacgccggcacccagcagcgcagctacatcgatcccgacctggtcagcagcgtga

SEQ ID NO: 10331 - DNA, 384 bp, Pseudomonas aeruginosa
ccgtcgacaagggtccctcgacccgctcgggcgcgatcggcggcagcgtggaaatgcgcaccatcggcgtcaaggacatcctggtcgacggcaaggacctcggcgtgcgcttcaccggcgacgtctggaacaacggcgtcgccccgcagcaccgcagcgccagttcgaagaccgagaatctcagcagcgtgccgcacgatgaccgcggcagcctgttcggctcccaggccaagtccggcagcgccgccttcgcctaccgcaacgagcatctggacctggtcgccgcctatgcgcagcgcaaccagggcaactacttttccggcaagaaaggccaggaccgctatcgcgtctacaaccgctacggtcgcgaggaaagcagcgtag

SEQ ID NO: 10332 - DNA, 372 bp, Pseudomonas aeruginosa
cagtccatccctcgcgggtcaccaacgtggtcaccggctacaactacagcaagaagggcagcagccgcggcggcggtttctcgccggcattcgggatcaatttcgagctggccccggataccttcgtctacgcctcctataccgaaggcctgcgtctgccgtcgctgttcgagaccagccagggcaccctccaggtcgagccgggcaaggacctcaagcccgagcgttcgcgcagctgggagatcggtgccagcgcgctgcgcgacagcctgttggccgacggcgactcggcggcgatcaagctggcctacttcaacaacaccatcaagaactacatcacccgctattacgatccgggccagatgggcctga

SEQ ID NO: 10333 - DNA, 540 bp, Pseudomonas aeruginosa
tccagtcgacgatctcctcgtggcggcggtcgaacacctccaccgccttgtacagtaccgccgcgcgtgccgagggcccgagcgcggcccatgccggctggacctcggcggccttggcgtaggcggcatcgaggtcgtcgcggtcggcctgctcgatctccagcaacaggctgccgtcgaacgggttgctcaccttcagccggcggccggcccggccgtggcgccactcgccggccaggggctggagaccgaggtcggtataacgggaatcgctcatcgctcttctcctctttcgaaaatcacaggggtttcttcgccgtcgcgtcgacggacgcttccgccggcacgcgcggccgcaggtggatgcaggcgatcgccagcgcgccgatcacgccgggcgcggcgaaggccaggaagttctgctggaacggcagctccagggccagcaggctgccgccgagcatcggcccggcgatggcgccgaggcggccgacgccggcggcccagccgaccccggtggagcgcacccaggccggatag

SEQ ID NO: 10334 - DNA, 342 bp, Pseudomonas aeruginosa
aaggccgacatcaccgtgaccagggtgctgcgccgcccggccggggcgaattcgctgatcaggttgatcgcgatgggcaccagcgcgcccagtgccaggccggtgaagaagcgtccggcgcccagttccagcgggtcgcgggcgtgcccggtgaggaaggcggcgaggctcgccagcagggtggtggcgatcaccaggcggcgccggccgaaacggtccgccagcggcgccagcagggtgccgccgaagagcatgccgaacagcgcgcaactgccgagggtgccggcctgcaccgggctcagctgccactcctgcatcaggcgtggcaccactgagccatag

SEQ ID NO: 10335 - DNA, 420 bp, Pseudomonas aeruginosa
actggttccgcaccaccatcgccgaggcgatcatcgccgcccaacgctgaaacgccggcggccctcacgcagcgtctcccagcgtcggcgagcgctcgcgacgccgcgcaccgagcagcggcaacacggcggccgcgacgacgaacaccgccgcgaacgccccatagagggacagcggctgccagccgtcgtcgagcaggagcccggccaccagcggcgagaggatcgccccgccgcgaccgacgccgatcccccagccgaccccggtggcacgcaccgaagcgtcgtagaggctcggcgccagggcatacaggccggccacgcaggcgttggcgcaaagcccgatcagcagtcccagcggcaaggccgcgccgggcagcccggcgctcagcgagaacagcgcgagcagagcggcggtaa

SEQ ID NO: 10336 - DNA, 1191 bp, Pseudomonas aeruginosa
acatcgacgccggcggcgtgcaggcccggcgtatcatcgagcgcctgctggcggacgagcgccaggccgccgcccccaaccgcgcccaggcctgacgggagccttcgccatgatcgaggtcatcgtcggcgccatccgcctggaggcgcaggatatccacagcttcgaactgttccgggccgacggggcggccctgccgtccttcgagccgggcgcacacatcgacctgcacctgcccaacggcctggtccgccagtactccctctgcggccccgccgaacggccgcgccactaccgtatcgccgtactccgctgccgcgattcgcgcggcggctcggccacgctgcacgccgaactgcgggtcggccagcggctgcacatcggcgagccgcgcaatctcttcccgctgtcgccggagcccggtccgcgcctgctgttcgccggcggcatcggcatcacgccgctgctggcgatggccgaacgcctggcccgcgatggcgccgacttccagttgcactactgcgcgcattccgccgagcgcgcggccttcgtcgactaccttggccggtgcgccttcgccgaccgcgtgcactgccacttcgaccacggcgaaagcagccggcgcgcggaccttcgcgccctgctggcgaccagtccgcgcgacgcccagctatacctttgcgggccggcgggcttcatgcagtggatcgaagaaagcgcccgcgaactgggctgggaagcaagccgcttgcatcgcgagcacttcgccgccgcgccacgagacgccagtgcggacggcaccttcgaagtgcagttggcgagcaacggggcgctgatccgggtcgccgccgggcagaccgtgctggcggccctgcgcgaagccggggtggacctgccggcctcctgcgagcagggcatctgcggcacctgcctgacccgcgtgctggacggcgagccggagcatcgcgacctctacctcagcgaagaggagcaggccgccaacgattgcttcacgccctgctgttcgcgttcgcgcagcccacggctggtgctggatctctagtcggcggcgacgtcgccgtgaagcacggtgacaccctgccgctccggatcgaagtagtcggcgtagcgcagggtcgcgttggcgtgctcgcgcatgatcgcctcggcgcgcgcccccctggccgttga

SEQ ID NO: 10337 - DNA, 531 bp, Pseudomonas aeruginosa
tggtgcggtggaaacgcatgttcatgcgctggtagcgctccagctcctccagcaggacctggccgttggcgaacaatcggtcgccctcggccaggcattcctccagggtcgcccgtgcctcggcggacagcccgcgctcggccgcctggcgtgccgccaggccttccagaacgccgcgcacctcgaccgcgccggcgatatcctcgcgggtcaccgcccgcaccctgtagccgcgcccggtcttgcacagcaggccttcctgctcgagggtacgcagggcgatgcgcaccggcatgcgcgagacctgcaggcgttcggcggtgggaatctcgacgatgcgctcgccggcggcgagttcgccggaagcgatcagcttgcgtagctcggccagcacgcgttggcccggtttgctcatggaattcgcttattcgatcgggacgtccggggcatcatagcgtgccccggccgcctccgccggtcagctttcgcggtggatggcgaagccggcccaggactggctcaccggcatga

SEQ ID NO: 10338 - DNA, 1206 bp, Pseudomonas aeruginosa
gaccgagcagtccgactcttcagattatctcctcatcaggctaatcacggtttcgacccggcactttgccgggtctttttttgcccgcgaaaacgtagcgcgatacgcggctccaggcctcgcgcccttccttcaacgtgccttcttcatctccgcgcaatagtccttgtccggctgtgccggcgtgtaccaggcgtagtcggcctcacgcgtcgttaccgcctgcccggcctcgaccagcatcagtacctgcgcgcccttctccgcaccaaggtcgcgcaggtggaccggtacgccgaggtcgcgtcgggcgtggaagcggccggcgacgagcatcgccggcagtggcgcatcgcgaagacgctcggccatgcggcggtcgcgttgctgctggacggcgagcatcgccggcaattgatcgtcgggaagcatgccgcagtgggattcgcgaatctgcgcaagcagcggcaggcgcacgctgtcacgcctggaggccgttccgggaagcggcggtcgctccctgtagatgcgcatgatctcgctccgctggaggttcgccgccagcaacggcgcgggttgcgcaaccgcccaggacaccaggggtccgtactgcgtccagtcccaacctttctgccagtccagggcctgctccaggttcgccaccggcttgccggtcccgagttgtacgcggaccgcatccacccgtggttgctggccgggatcgagcatttccagcagcaggctgccctgcgcccgatattcgcccagggcctgcgccagccacagttccacggcatgatgatcgggattgtcgtgcttctcgccgacgatcactcgcggcgcggccgccaggcgtgcgaccagttgctgcgggctcagcgtcacgccgctgcgcaattcgacgattcgtcccgtctgcggatcgtcgcgcccttccgggctctgccaatcaggcagcggcggcagttgggactggcagccgcccagcagcagacagaaagcgaacaggcgaatgcgcatggcgactccttcaacgggcgacgatcagcggatgacctcgctcgggatgacgctggaccaggacctagaggccgaacaccgcgcgcaacggctcggggcgcaggacttcctcgggcgtaccgagcaggtgcgggcgaccattctgcaacagcagcaggcggtcgcaatagcgcgcggccaggttga

SEQ ID NO: 10339 - DNA, 546 bp, Pseudomonas aeruginosa
tgtgctggtgcagcgggtcgagcgccgaggtcggttcgtcgagcagcagcacctgccccggctcgcccggccacagctgcgccagcacccgcgccaggtgcacgcgctggcgttcgccgccggacagcgccaggtagctgcgcccggccagatgcctggcgtcggccgccgccaaggcctcggcgacgatctgcacatcgcgctcgcggccgctggaatggggcagccgaccgaagccgaccaccgcctccaccggaaaggcgaagcccagcgacgaactctgcggcagcaccgccaggcgctgcgcgcgagcgacgcccggccagtcgtcgaggccgcgctcgtcgagcagcaccagcccttcggccggctccagttcgccacagagagcgccaagcaaggtgctcttgccagcgccgttggggccgagtacgccgagcatctcgccaggccgcagctccagctcgaggccttccagtacagtctttccgccacggcggatggacaggttctccacgcgcagcatcaggcccgcccccgcaatag

SEQ ID NO: 10340 - DNA, 705 bp, Pseudomonas aeruginosa
ccagcaggccaccagcagcgccaccagcagcagcggccagagtcgtgggtagctggcgccgttcaggctgcccaggttccagaaggtcagggtacgcaaggtggcgtcatcggcgagataggtaaacagtccgatcaccgcgccggacagcgcggtcaaggcgatccctgccagcaacatggtggccacgctggtctggccatcgcggcggccaagtcgatagaccagccaggtcacccccaggccgccgccgaaggcgcacagcgacagcaggtagggcgcgaggaacgccggcaagccacccagcgaggcgccgaatacgatggccagcgccgcgccgagggccgcgccgctggacaccccgaccagccctggatcggccagcgggttgcggaacaggccctgcatcgccaccccggacagcgccagcaccgcgcccacggccaggccgagcagggtccgcggcaggcggatctggccgaggatcatttccgcctgggccaggcccgttccatcgagcggcagcccggccaggcgcagcgcggcgcgcagggtatcgcccagcggcaggctgacgggaccgagggcgagggacaaccagaggaccaacacgagcgaaatccccagcgcaccgaacagtgcgcggggacgaacaaccgatttcaatgggcggcttccgtactcagcggtttcgcggaaggataa

SEQ ID NO: 10341 - DNA, 585 bp, Pseudomonas aeruginosa
tgggtgtccttcaacgcggcccagccttcgcgcaaggcggcggcatcgatctgcgcatcgacgagcgtcgcagccggtgcgcggggttcgtgcagcgccagcacggcatcctgctcggcagcccgcaggcgctcgaccagcggctcccaggcgcggacgtcgctggcctcggtaaggaacaccttgtgcaccgccacgccctgctggtcgaacacctggatgctgcgctgggtaccccgcgctgtctcctcggcaatggcgaagacagcgttccaaccccccaggaacaggcgcaggtcgatatccggcgagaccaccaggcccatctgcccattggcagagaccgtcacttcgcgatacggccccttgcgttcgtggacgcaatgctcgttgcgggtcagcgccatgatcggccccagttcgccgagcgccggcagcaaggcggcccagtccggccgcaggcgcacagcatcgatgccgacccggctggcgaccagctcgccttcgctgacctgcaacagcgcggcggcgtcgcgcgcgcgtagctgcggtcgctcggcgcgcaggtcctgccaggcgcggtaa

SEQ ID NO: 10342 - DNA, 552 bp, Pseudomonas aeruginosa
gcttgcggcacaaagataaaaaagaggaaggaacgcgccatgcgccgattcagcctgcgcttcgtcctgctgctcctgttcggcctgctgctctatgcctgccgcaatgaaccgggccccgtacggctcgcccctggcgtaacagcggcggattaccggactttcttcatccaggcggtacgcgccgaggggcaccgcatcgacttcgaggagcgtttcgatacggccgtgcgccgcgccctggaggccaagggctatcgctaccaggcggaacacggcgacctgcgggtgatctacgccctcggcctgcaacgccagccgggcctggaaatgcgcccggtgatcacccaggatggcgtcttcacccagacccaactgaccgaagacaccgaggccaggctggcgctgcgcatccttgacgaaagcaacggcagggtccttctggaaagcgtgctgagccgccaactgcacgatccggcgctgacccaggaagcgttcgaccgcggcgtcgcgcagttgctgaaggacttcccgagtcgcagtcaaccttga

SEQ ID NO: 10343 - DNA, 1230 bp, Pseudomonas aeruginosa
ggatcactccgccaggctatcgaccttcctctgcggcgacagcagcccgtcggcgcggaacatcgccttgatcccgcgcaccgcctggcgcaggcggtcgcggttctcgatcagggcgaaacgcacatgatcgtcgccgtagtcgccgaagccgatccccggcgacaccgagaccttggcgtcctgcaacagcttcttggcgaactccagcgagcccagatgcgcgtagggctcggggatcttcgcccagacgtacatcgaggccttcgggttctccaccatccagccggcctcgcgcagccccttcaccaggacgtcgcggcgctgctggtactgccgggcgatatcgcggacgcactgctggtcgccttccagagcggcgatggccgccacctgcaggggcgtgaaggtgccgtagtcgtggtagctcttgatccgcgccagggccgagaccagctcgggattgccgaccatgaagccgatccgccagccggccatgttgtagctcttcgacagggtgaagaactccacggcgatgtccttggcgcccggcacctgcatgatcgacggcgctttccagccgtcgtagacgatgtcggcataggccaggtcgtgcacgaccatcacgtcgtactgcttggccagcgccaccacgcgctcgaagaagtccagctcgacgcactgcgcggtcgggttggaggggaagccgagaatcatcatgcgtggcttgggaatcgattcacggatcgcccgttccagctcgttgaagaaatcgatgcccggcaccagcggcaccgagcgcacctgggcgccggcgatcaccgcaccgtagatatggatcggatagctcgggttgggcacgaggatggtgtcgccatggtcgagggtcgccagcatcaggtgcgccaggccttccttggagccgatggtgacgatggcttcgctttccgggtcgatctgcacgtcgtagcggtcgcggtaccagtgcgagatggcccggcgcaggcgcgggatgccgcgcgaggtggagtagccatgggtgtcttcgcgctgggcgacggtgcagagcttctcgacgatatgcggcggggtcggcccgtcgggattgcccatgctcaggtcgatgatgtcctcgccacggcgacgagcggccatcttcagttcggcggtgatattgaaaacgtaggggggaaggcggtcgatgcgcgcgaaacggcgcgcagggcgtga

SEQ ID NO: 10344 - DNA, 801 bp, Pseudomonas aeruginosa
accccacgcaggccgccgcgaggcccctggggtgcgtgggtcgtttcatgcggctcgcgcattttcgggactcagccgtctgccgggatcgttcgcgataccgcgccgacgagacagcgatgcaacgcccgccacgcggaaattcggttttccctggtcggcggccggctccacggccggccacttctgctggcgccatggggatcgttgcagagcacattcaggggaatccaacatgctggaaaagctgtttcaactaaaggcgcacaacaccacggtgcgcaccgagatcctggcggggatcaccaccttcctgaccatggcctacatcctcttcgtcaacccgagcatcctcggcgagaccggcatggacaagggcgcggtgttcgtcgccacctgcctggcagcggccatcggctcgaccatcatgggcctgatcgccaactacccgatcgccctggcccccggcatgggcctcaacgccttcttcacctacaccgtggtgctgcacatgggccacagctggcaggtcgcgctgggcgcagtgttcatttccgccaccatgttcttcctgctgtcgatctttcgcatccgcgaatggatcatcaacagcatccccctgccgctgcgctcggcgatcgccgccggcatcggcctgttcctcgcactgattgccctgcagaacgcgggcatcgtggtggacaacccggcaaccctgatcggcatgggcgacctgaccaagccggcaccgatcctcgccaccctcggcttcatcctgatcgtcgccctggaggcgcgtag

SEQ ID NO: 10345 - DNA, 1818 bp, Pseudomonas aeruginosa
cgtcaccggcgcggtgctgatcggtatcctggtggtcaccgccatcgccatcctgctcggcgtgacccagttcggcggcgtggtctcgatgccgccgtcgctggcgccgaccttcctccaactggacatcaagggcgcgctggacatcggcctggtcagcgtgatcttcgccttcctcttcgtcgacctgttcgacaactccggcaccctgatcggcgttgccaagcgcgccggactgatgggcaaggacggccacatgccgaagatgggccgcgcgctgatcgccgacagtaccgccgccatgggcggctcgctgctgggcacctcgaccaccaccagctacatcgagtccgccgcgggcgtcagcgccggcggccgcaccggcctgaccgccatcgtcgtcgccatcctgttcctcctcgcgctgttcttcgccccgctggctggcagcgtaccggccttcgccaccgccccggcgctgctcttcgtcgccgtactgatggcctcgggcctggcagaaatcgactgggaagacatcaccgtcgccgcgccggtggtcgtcaccgcgctggccatgccgttcacctattcgatcgccaccggcatcgccttcggcttcatttcctggaccgcgatcaaggtgctgtccgggcgctggcgcgaactgaacccggcgctggtgatcctctccgtcctgttcgtgatcaagctgggcttcttcaacgcatgagccgtccacagttcgaccccagcgcctacgccgcacaactggaagacaagaagtcccgcctcgccggtttgctggccccgttcgcggcacccgcgcccgagatcttcgagtcgccgcgcgagcattaccggctgcgcgccgaatttcgtctgtggcgggaaaccggcaacgagaagcgtcactacgcgatgttcgagcagggcgacaagcacacgccgatcctgatcgaggatttccccatcgccagccgccgcatcaacgaactgatgccgcgcctgaaggcggcctgggccgacccggcgctgggcttcaagctgttccaggtggagtttctcaccaccctggccggcgacgcgctgatcaccctctgctaccaccggccgatcgacgacgcctggcgacaggcagcggaaaagctggcggcggaactgggcgtgaacctggtcgggcgttcgcgcggcaagcgtatcgtcgtcggacgcgactatgtggaggaggaactgtcggtcgccggccggcgcttccgctaccgccagcccgagggggctttcacccagcccaacggcgaggtcaaccagaagatgctcggctgggcctacgaggcgctcggccagcgcgacgacgacctgctcgaactgtactgcggcaacggcaacttcaccctgcccctggccacccgggtacgcaaggtgctggccaccgagatcagcaagtcctcggtcaatgcggcgctggccaacctggccgacaacgcggtggacaacgtcagcctggtgcgcctgtcggccgaagagctgacccaggcgctgaacgaggttcgcccgttccgccgcctggccgacatcgacctgaagagctacgccttcggcagtgtcttcgtcgatccgccacgagccggcatggatccggacacctgcgagctgacccggcgcttcgagcgcatcctgtacatttcgtgcaacccggaaaccctggcgcagaacatcgctcaactgcacgacacgcaccggatcagccgctgcgcgctgttcgaccagttcccctacacccaccacatggaaagcggcgtcctgctcgaacgccgctga

SEQ ID NO: 10346 - DNA, 1089 bp, Pseudomonas aeruginosa
tcgaagacgaagagtacggctggtgcgactcctgcggcgtcgagatcggcatccgtcgcctggaggcgcgccccaccgcgaccctctgcatcgactgcaagaccctcgcggaaatccgcgagaagcaactcggctcctgagccggaccgacggggcgccaaggcgccccgtttcgtttccgccgttccccgccgcaccgctcgcgccatgacctcttcctatgtaggccgcttcgccccgacgcccagcggctacctgcacttcggttccctggtggcggccgtcgcctcctacctggacgcacgtgccgtcggcggccgctggctggtgcgcatggaggacctcgacccgccccgcgaagtcccgggcgcccagcaggcgatcctggaaaccctggagcgctacggcttcgaatgggacggcgcggtggagcggcagagcgaacgcttcccggactacgccgcagtggtcgagcaactgctgcgcagcggcctggcctacgcctgcacttgctcgcgcaagcagcttgagggattcgccgggatctacccgggcttctgccgcgacgccgggcacgcccgcgaggatgcggcgatccgcctgcgcgtgccggagctggaatatcgcttcgtcgaccgcgtgcagggcgaagtccaccagcatctcggccgcgaggtcggcgatttcgtcatccagcgccgcgatggcttctacgcctaccaactggcggtggtgctggacgacgcctggcagggcatcaccgacatcgtccgcggcgccgacctgctcgagtggaccccgcgccagctttacctccaggaattgctggggttgagccagccgcgctacctgcacgtgccgctgatcgtccagccggacgggcacaagctcggcaagtcctaccgctccccgccactgcccgccgagcaggccgccgcgccgcagacccgcgccctgcgcgcgctcggccagcggccgccggccgaactggcccaggccagcgccagcgaggcgctggcgtggggcgtcgcgcactgggacgccacgcgcatcccgcgctgcgctacccttcccgaggaacgcctgtag

SEQ ID NO: 10347 - DNA, 246 bp, Pseudomonas aeruginosa
cccgcccggcggcttgccggcacccacccgcagcctgtagcctgccggcccaagcatgagggaagcggcatgtacatctaccgactggtcctgctcctggtcgtgggcatctatctcttttcccccgccatcatggactggtggatcgaccccaacggcgcctggtaccgcccgtacctgctgtggctgatcctcatcgtggtcactttcatcctgcagagccagcgcgatgctgacgagctttag

SEQ ID NO: 10348 - DNA, 2526 bp, Pseudomonas aeruginosa
cctgacccagctgatcctgatcagcgtcgcctacctctccaccctcttcggcatcgcctggatcaccgagcgcggctacgtgccgcgccggctggtacgccacccgctggtctacaccctgtcgctgggcgtctacgccagtgcctgggcgttctacggcacggtaggcctggcctaccagtacggctacgggttcctcgccatctacctggggatttccggggccttcctgctcgccccggtgctgctctatccgatcctccgggtgacacgcgcataccagctgtcctcgctggccgacctcttcgccttccgtttccgcagtacctgggccggcgccctgaccacgctgttcatgctgatcggcgtgctgccgatgctggccctgcagatccaggcggtcaccgactcgatcagcattctcacccgcgacccggcccaggagcgggtcgcgttcgtcttctgcaccctgatcaccctgttcgcgatcctcttcggcgctcgccacatcgccacccgcgaacgccacgagggactggtgttcgccatcgccttcgagtcgctggtcaagctggtgatgctcggcagtatcggcctctacgccctgtacggcgtcttcggcgggccggaaggcctggaagtctggctgctgcagaaccagaccgcgctgaccaccctgcacacgccgctggccgaaggtccatggcgaacgctgctgctggtgttcttcgccgcggccatcgtgatgccgcacatgttccacatgatcttcaccgagaacctcaacccgcgcgcgctgatttccgccagttggggcctgccgctgttcctgctgctgatgagcctggcggtaccgccgatcctctgggccgggctgcgcctcggcgcctcgaccacaccggagtactacaccatcggcctcggcctggcggtggacagcccggccctggccctggccgccttcatcggcggcatctccgccgccagcgggctgactatcgtgatgaccctggcgctctcgggaatggtcctcaaccacctggtgctgccgctctaccagccgccggcgcagggcaacatctaccgctggctgaaatggacccggcgcctgctgatcgtcgccatcatcatggccagctacgccttctacctgctgctgggcgccgaacaggacctctccaacctgggcatagtgtccttcgtcgccaccctgcaattccttcccggcgccctctcggtgctgtactggccgaccgccaaccgccgtggcttcatctccgggctgatcgccggcatgctggtctgggcgatcaccatgctgctgcccctgatggggaacgtacagggcctgtacctgccgctgttcgacgtgatctacgtgctggacgattcgaactggcacctggcggcgctgtcctcgctggcggccaacgtgctggtattcaccctggtgtcgctgttcaccgaggccagcgacgaggaaaaaggcgccgccgaggcctgcgcggtggacaacgtacgccgtccgcaacgccgcgaactgttcgccggttcgccgcaggagttcgccagccagttggccaagccgctgggcgccaagaccgcgcagaaggaggtcgagcaggccctgcgcgatctccacctgcccttcgacgaacgtcgcccctatgccctgcgtcgcttgcgcgaccgcatcgaggcgaacctttccgggctgatgggacccagtgtcgcccaggacatcgtggagaccttccttccctacaagaccagcgaagaaagctatgtcaccgaggacatccacttcatcgagagccgcctggaggactatcactcccggctgactggcctggctgccgaactcgacaccctgcgccgctaccaccggcagaccctgcaagacctgccgatgggcgtctgctccctggccaaggaccaggaagtgctgatgtggaaccgcgccatcgaggaactcaccggggtcggcgcgcagaaggtcgtcggttcgcgcctgtcggccttgcccgaaccctggaagggcctgctggaacgtttcatcgacgcccccgacgagcacctgcacaagcagcgcctggtctacgacggccacacccgctggctgaacctgcacaaggcggccatcgaggaacccctggcgccgggcaacagcggcctggtgctactggtggaagacctcaccgaaacccaactgttggaagacaagctggtccactccgagcgcctggcttccatcggccgcctagccgccggggtggcccacgagatcggcaatccgatcaccggcatcgcctgcctggcgcagaacctgcgcgaggaacgcgaaggcgacggcgagctgaccgaaatcagcgagcagatcctcgaccagaccaagcgcgtatcgcgcatcgtccagtcgttgatgagcttcgcccactccggcagccacctgcaggccctggaaccggtgtgcctgagcgaagtcgcccaggaggccatcggactgctgtcgctgaaccggcgtag

SEQ ID NO: 10349 - DNA, 1101 bp, Pseudomonas aeruginosa
cgtcgaagtagagttcttcaacctctgcgatccggcgcactgggtcgagggagactcgcagcgcctggcccaggtgctgatcaacctgctctccaatgctcgcgacgccagcccgccgggcggcgcgatccgggtccgcagcgaagcctcggaacataccgtggacctggtcgtcgaggacgagggcagcggcattccgaaggcgatcatggaccagttgttcgaaccgttcttcaccaccaaggaccccggcaaggggaccgggctcggcctcgcactggtctattcgatcgtggaagagcattatggacagataaccatcgagagcccgacggatcaccagcgagaaggcggcactcgcttccgcgtgaccctgccgcggcaccctggcccgacggccgagctgtagacgagcacgtcgagagagctgaatacatggcacatattctgatcgtcgaagacgaaaccattatccgatctgcattgcgacgcctgctggagcgcaaccagtaccaggtcagcgaagccggctcggtgcaggaagcccaggagcgctacaccatcccctccttcgacatggtggtcagcgacctgcgcctgccgggcgcccccggcaccgaactgatcaagctcgccgaaggcattccggtgctgatcatgaccagctacgccagcctgcgttcggcggtggattcgatgaagatgggcgcggtggactacatcgccaagcctttcgaccacgacgaaatgctccaggccgtggcgcgcatcctcaaggaccgccaggagaaccgcagcgcggccccggtcctccgccaacggcggcaaggccggcggcgagcgcggcgccagcccggcggcagccgacggcgagataggcatcatcggctcctgtgcgccgatgcaagagctgtacagcaagattcgcaaggtcgcgccgaccgactccacggtactgatccagggcgagtccggcaccggcaaggaactggtcgcccgcgccctgcacaacctgtcgaagcgcgccaaggcgccgctgatctcggtgaactgtgcggcgattccggaaaccctgatcgaatccgagctgttcggccatga

SEQ ID NO: 10350 - DNA, 1419 bp, Pseudomonas aeruginosa
cttcaccatcaatgccctgtacttcgacgtcaccagcgagcggctgctggactacgccaatggcgttcacgacatccgcaatcgcctgatccgcctgatcggcgatccggagcagcgttatctggaagacccggtgcggatgctgcgggcggtacgtttcgccgccaagctcgacttcgaaatcgagaagcacagcgccgcgccgattcgccggctggccccgctgctgcgggaaatcccttcggcgcgcctgttcgacgaggtgctcaagctgttcctcgccggccgggccgagcgcactttcgaactgctggtcgagtacgaactgttcgcgccgctgttcccggccagcgccaaggcactgcaggccaaccccgactacaccggcaagctgatccgccaggccctggccaataccgatgcgcgcattcgccagggcaagccggtaaccccggccttcctcttcgccgcgctgctctggccggccctgccggcgcgcgtcgcgcagttgcaggagaaaggcatgccggccatcccggcgatgcaggaagccgcccacgaactgatcagcgaacagtgccagcggattgccattcccaagcgtttcaccctgccgatccgcgagatctgggatatgcaggaacgtctgccgcgacgccagggcaagcgcgccgacctgctcctggaaaacccgcgcttccgcgccggctacgacttcctcctgctgcgcgaaagtgccggcgaggaaaccgaaggactcggccaatggtggaccgattaccaggaagtcagcgacagcgagcggcgcaacatgatccgcgacctggtcagccaggaagacggcagcgccccgcgcaagcgtcgccgcggcggcaacagcggccgtcggcgccgcgggccgcgcaaggaaggcagcggcggaagcggcgaatgatccagcgcgtctacgtggcgctgggcagcaacctggccgaaccgcgcgagcagatccaggctgccctcgatgccttcgagcggcttcccgagacccgcctggtcgccgtctcgccgctctatatcagcgacccgctcggccccgccgaccagccgcgcttcgtcaacggcgtggcggcccttgacaccaacctggcgccgctcgacctgctcgacgccctgcaggccatcgaactggaacaagggcgcgtccgcgacctgcgctggggtccgcgcacgctcgacctggacatcctgctgttcggcgaacaattgcttgacctgccgcgcctgaaggtgccgcactaccacatgcaggcgcgcgctttcgtgctctatcccctcgccgatctcgcccccgacctgcgcctgcccgatggccgccacctgccggagctgctcgcggcctgtccgttcgagggcatcgaacgccttccgggcgcctga

SEQ ID NO: 10351 - DNA, 912 bp, Pseudomonas aeruginosa
cgccgtaacaatgcggtaacacctgcaattgacttcgagccaccccatccggactataagtggccgtttgccccgcgccggctcatcaccggcccaacgaggagcctttccatgcctgatgtaaccctgaccaccctgcaagggttgaagcagagcggcgagaagatcgccatgctgacctgctacgacgccaccttcgcccacaccgccagccaggccggcgtggacgtgcttctggtcggagattcgctcggaatggtattgcagggtcacgacagcaccctgccggtcagcaacgaggaaatggcctatcacacggcctgcgtgaaacgcggtaacaaaggttccctgatcgtcaccgacctggccttcgaatccagccattccgtggcccagacccttgccgacgcggtccgcctgatgcaggccggcgcacacatggtcaagctggagggtggggcctggctggcggagccgatcgcccgcctggcacagatgggcgtgccggtctgcgcgcatctcggcctgaccccgcaggcggtcaacctgttcggcggcttcaaggtccagggccgccaggaaacccaggcgcgccagttgcgcgccgatgccatcgccctggagcaggccggcgccgccatgctgctgctggagtgcgtgcccagcgtgctggccgaagagatcacccaggcggtgaagatcccggtgatcgggattggcgccggtgcggcgaccgatggccaggtgctggtcatgcacgacatgctcggtctctcgctgaccggccgctcgcccaagttcgtcaaggatttcatgcaaggccaggagagcatcccggccgccatcgcggcctatgtccgcgccgtcaaggacgtgtccttccccgccgccgaacacggattcaacgcatga

SEQ ID NO: 10352 - DNA, 312 bp, Pseudomonas aeruginosa
tccgcaagctggtccgcgacctcaacctgccggtgcagatcttcggcgagccgacggtgcgcgccgccgatggcctcgcgttgtcctcgcgcaacggttacctcgacgagcagcagcgcgccgccgccccggcgatctaccgcaccctgcggcagctcggcgaacgcatccgcgccggcgccgaggacttcccggcattgctcgccgacgcccgccaggccctggaacaggccgggctgcgccccgactacctggaaatccgcgagccgatcagcctgcgccccggggtacccggcgaccgccaactggtga

SEQ ID NO: 10353 - DNA, 1140 bp, Pseudomonas aeruginosa
actggccagccgcctgaacgccgagaccaccctgttcatcgtttcctccaagtccttcgggaccctggaaaccctgaagaacgcccaggccgcacgcgcctggtacctggcccagggcggcaccgaggaagagctttaccgccatttcatcgccgtctccagcaacaaggaagccgcgatcgccttcggcatccgcgaggaaaacatcttccccatgtgggactgggtcggcggccgctactcgctgtggtcggccatcggcctgccgatcgccatgtccatcggcatctccaacttcaaggaactgctgtccggcgcctacaacatggaccagcatttccagaccgcgccgttcgaacgcaacatcccggtgctgctcggcctgctcggcgtctggtacggcgacttctggggcgcgaacagccacgcgatcctgccctacgactactatctgcggaatatcaccgaccacctgcaacaactggacatggaatccaacggcaagagcgtgcgccaggacggcacgccggtcaccagcggcaccgggccggtgatctggggtggtgtcggctgcaacggccagcacgcctaccatcagttgctgcaccaaggcacccagttgatcccggcggacttcatcgtcccggtgagcagctacaacccggtggccgaccatcaccagtggctgtacgccaactgcctgtcgcagagccaggcgctgatgctcggcaagagccgcgaggaggccgaggccgaactgcgcgccaagggcctgccggaagccgaagtgcagcgcctggcgccgcacaaggtgattccgggcaaccgaccgagcaacaccctggtggtcgagcgcatcagcgcccgccgcctcggcgcgctgatcgccatgtacgagcacaaggtctacgtacagagcatcctctggggcatcaacgccttcgaccaatggggcgtggagcttggcaaggaactcggcaagggtgtctattcgcgcctggtcggcagcgaggaaaccccggccgaggacgcctcgacccaaggcctgatcgacttcttccgcggccgccatcgcggctgatccgcctctccccaaagcccggctctaggccgggctttttcattccgtccggcgattga

SEQ ID NO: 10354 - DNA, 531 bp, Pseudomonas aeruginosa
tcgacaaccgcctcaaccgctgacccgcgcaaccgtcccgccgccctgcggcgcgggacggttccagtctctccggcgcctgggttaagctcgtgcctgccctgtcgtagcgagccccccatggaaagcgtccgtcgccatatcgaaagccaggtgctgagccttaccgggctcgccgtcggcggtgtcgacttcgagtcgccgaaaggcgatccgggcctgttcggccccgatgccgcctgctggaaggtccacggcgacttcagcagcatgatgatcggcggcatcggcgcgctgctcctgcagatgctccatccgctggccctggcgggggtgtgggaccactccaatttccgcgacgacctgctcgggcgcctgcgtcgcaccggtcagttcatctcggccaccacctacggcccgctggccgatgccgagcgactgatcgagcgggtccggcgcatccacgaaagcgtcatcggccagttgcccgacggcacgcccctactccgccagcggacccggacctgctga

SEQ ID NO: 10355 - DNA, 588 bp, Pseudomonas aeruginosa
aacggaaaacgaaagagagccatgcccaaaggactgaaacgcgctgtcagcgccctgctgatcaccttcctcgtctattgcctgctgggctttctgctcatacccggcatcgggctgcgcgtcgccaaccagcaactggcgcaatacgccaccgtccccgcacgtctcgaacgtatcgaattcaaccccttcagcctggaattgaccctctggggtctgcgcctgggcgaggagaaaaaccccagctcgccttccgccggctgtacgccaacctgcagctggacagcctgtggaaacgccagctgcacctggccgacgtcgagctggaaggtccgcataccgaactgctgttcgacgagaagggccagctcaacctggccagcctgttcaggatcccgccgagcgaatcgcccgagcctgaacagccgagcgacccgttcccgctgcgcatcgaccgcatccaactggccgagggcagcctgcacttccaggacctgcgaccgagcgagccggtggacttcagcttcgatccgctgggcttcgagctgcacaacctcagcaccctgcccgacgacggcgcgaagatga

SEQ ID NO: 10356 - DNA, 516 bp, Pseudomonas aeruginosa
ccaagcaagagacgagcaaggctccgaagaccggcaaggcaaccgggcaggaaacggccaagactgcggaaatcgacaaggcagccagcgactctccgcaacagctcgccgacactgcaaagacgcctccgccggaaagtacgaaagccgccgcggagacgcccgccaagccctggcacatcgtcctgcgcgacgcccagctgcgcggctacaaggcgcacctggtggatcgccagccggccaccgaggtcccgctggaagtcggcccgctggacctcgacctgcagaacgtcgacagcctcggcaagacccccttcgacctcaagctcaagaccggcctcggcaaccgcggccaggtccaggccagcggccaggtggtgctcgacccggtcagcgccaggctcaaggtcagtacccgcgacatcgacctgcgcgtggcccaggcctacatctcgccgttcatccgcctggaactgcgcagcggcttccttggcagcgagctggcggtcgacctga

SEQ ID NO: 10357 - DNA, 369 bp, Pseudomonas aeruginosa
tcgacgtcagtttcgccgaaggcgaagacaagggtaatgtcgacacccaactgcacctggatagcgagtgataccttgcacaagcgattcgccgccctggcggcccccctgctctaccttgcctgcgcgagcgcgcaggccgacaccatgcgttgcggcagtgcgctggtcagcgtcggcgaccgggccttcgaagtacagcaaaagtgcggcgatccggatcaccgcgacgacgtcggctataccctgggcagctacgatcggcgggaattcaaggtcgaggagtgggtgtacggcccgcgcaacggcgtgacctacatcctgaccttcgaagccaacaagctgaaacgcatcgagttcaagcgttga

SEQ ID NO: 10358 - DNA, 516 bp, Pseudomonas aeruginosa
cttgtacagcggctgtccgtctttcttcagcgccgagtacatcggcggtacctgctctatgtcgccacggaagcgcggcagggcctgttcgagatcgtcccgaccgacggtcacgtcccgctcggcgagcagttcgccctcggcgtcgccggtggtggtggtgatgcccatgcgcatcaccgtctcgtaacccttgtcggcatcgagaagatactgggagaacttggtcgcctcgccgaagcacagcggcagcaccccggtggccagcgggtcgaggctgccggtgtggccggccttctcggcattgagcagccagcggactttctgcagtgcctggttggaactcatgccgcgaggcttgtcgagcaccaggatgccgctgatggagcggcggatacgcttcacctgggccacgctcagtcctcggtctcgtcgccgtggcggcggccgtcttcggccaccgcacgttcgatcagcgcggacagctcggcgccgcggcggatgctttcgtcgtag

SEQ ID NO: 10359 - DNA, 516 bp, Pseudomonas aeruginosa
ttgatgccgaccagcaccatgtcgccctggcgcagggtaccgtcctggaccagcacggtggccaccgggccgcgtcccttgtccaggcgcgactcgaccaccacgccacggcccggggccgacggagtggctttcagttcgagcacttccgcctgcagcaggaccgcttcgagcagttcatcgacgccagtaccgagcttcgccgaaaccgggacgaagggagcgtcgccgccccactcttccgggatcacgtcgagagcggccaggccgttcttgatgttgtccgggttggcctcgggcttgtcgatcttgttcaccgcgaccacgatcggcacgcccgccgctttcgcgtgctgcacggcttcctgggtctgcggcatgacgccgtcgtcggccgcgaccaccaggatcacgatatcggtcgcctgggcgccacgggcacgcatcgcggtgaacgcggcgtggccgggggtatccaggaaggtcaccatgccacgctcggtttcgacgtggtag

SEQ ID NO: 10360 - DNA, 417 bp, Pseudomonas aeruginosa
ccatcgctttcctcgtcggtgctgcgtggagccacgcgcggagcaggaaccttttccttctccttgaccgagggacggtgctgggtgtgcttgcggtcgcggcggtcatcgtcctcgtcacgcttgggcgcgcggcgcggctcttccttcttgcgttcttccacggcggcaggcttggccaccggttcggcagccgcgacatccgccaccacggcaggctcggcaccggcagtagccgctgcttcctgggcagccttggcacgcgcagcttcctcggccttgcgcgcttcctcttcggcacgctggcgggcagcggcctcttcggccttcagacgctccgcctcttccgccgcgcgctgctcctcgagttcgcgctggcgctcggcctcgatctcgtcggggctgcgcttgacatag

SEQ ID NO: 10361 - DNA, 621 bp, Pseudomonas aeruginosa
gttttcttcttgcgaacttcgacgctcaccgtcttgctgccacccactttcagcgtggtagtggtcttgcgttgcagggtgatcttgcgcggctcgctggcgcgatcgccatggctgcctttcaggtgggtcagcagggcttgcttctcgctatccgttacaacttgttcggcactggtgtgcggcagacctgcgtcacgcatctgcagcagcaggcgctccaccggtgtgtcgaccacctgggccagttctttcaccgtgacttgcgtcatgcacttctctcctcaggccgcgactgcttactcgaaccaatgggcccgggcggccatgatcaacttgccggcacgctcttcgtccatgccgtcgatgtcgagcagatcgtcgatcgattgctcggccagatcttcacgggtggttacgccacgcagcgccaggtccagggccagctccttgctcatgccatcgaggctgagcaggtcttctgccggttgtgcgtcggcgagcttctcttcggtcgcaatggccttggtcagcaggcgatccttggcacgggagcgcagctcgttgacgatgtcttcgtcgaagccatcgatgctgagcatctcttccatcggtacgtag

SEQ ID NO: 10362 - DNA, 576 bp, Pseudomonas aeruginosa
gcgatttcctcaagagtcgtgaagccctcttccaccagtacctgggccagttcctcgtcgacatccagctcgtcgacgaagcgctgcaggatatccccggtctcggcctgttgcttggcctggatatccgcctcggtcatcacattcagggtccagccggtcaactggctggccagacggacgttctggccactgcggccgatagcctgcgccagattgtcctcggcgacggcgatatccatggtatgggtatcctcgtcgacgatgatcgccgccacctcggccggagccatggcgttgatcacgaattgcgccgggttgtcgtcccacaggacgatatccacccgctctccaccgatctcgccggataccgcctggacccgcgaaccgcgcatgccgatgcaggcgccctgcgggtcgatgcgtttgtccttggaacgaacggcgatcttggcgcgcgagcccgggtcacgggcggctgccatcacgtcgatcaactgctcggcgatttccggcacttcgatgcggaacagctcgatcagcatttccggcgcggtacgcgacaggaccagttga

SEQ ID NO: 10363 - DNA, 435 bp, Pseudomonas aeruginosa
gcggtgttgcgcttctccttctcggacatgaccatggtcttgcgctcggcgcccatcatgatcttgtccttggccagctcgaactcgcgcatgtcgacgatgcgcttgttggagcgcgcggcgaacagcgaggcctcgttgaccaggttggccaggtcggcgccggagaaaccgggcgtaccgcgggcgatgacggcaggatcgacatggtcgcccagcggcaccttacgcatgtgcaccttgaggatctgttcgcgcccgcggatatccggcaagccgaccaccacctggcggtcgaagcggcccggacgcagcagcgccgggtccagaacgtccggacggttggtggcagcgatgacgatgatgccatcgttcatctcgaagccatccatctccaccagcaactggttgagggtctgctcgcgctcgtcgtga

SEQ ID NO: 10364 - DNA, 651 bp, Pseudomonas aeruginosa
ccaccgcccaggccggcgccgcgatggcggccgacggcgtcgatctcgtcgatgaagatgatgcacggcgcatgcttcttggcctggtcgaacatgtcgcggacacgggaagcgcccacgccgacgaacatctcgacgaagtcggaaccggaaatggtgaagaacggcaccttggcttcgccggcgatggccttggccagcagggtcttgccggtgccgggcgggccgaccatcagcacgccgcgcgggatacggccgcccaggcgctggaacttgcccggatcgcgaaggaactcgaccagctcgctgacctcctccttggcctcgtcgcagccggcgacgtcagcgaaggtggtcttgacctggtcctcggacagcaggcgcgccttgctcttgccgaagctcatcgggccgccgcgaccgccgccgccaccctgcatctggcgcatgaagaacatgaagacggcgatgatcaccaggatcgggaagctggcgaccagcaactgggtccagatgctctgctgttcgggctgcttgccctcgaccacgacgttgttgttgaccaggtcgccgatcaggccgttgtcctggatcgccgggcggatggtcttgaaggtatcgccgtcgctacgcttgccggtgatgacatag

SEQ ID NO: 10365 - DNA, 603 bp, Pseudomonas aeruginosa
ccctttatgaaccctcgcccgtcccggcacaacaggtcatcgaccaatagacaggctatagggtcaatcattccagtctattccccgcgaaagccgcgtgcgagcagatactgttcccgcgaacgatcacgcgacgacaggggcttgcgcatctgtaccttgtcgaacatttcccgggcctgcttgtggtactggtcgaaaccttcgccctggaagatcttgatcaggaaatcgccgcccggccgcagcacacggccggccaggtccagcgccagttcgcagagatacatggcgcgcggctggtcggaggcccgcactccactcatattgggggccatatcggaaatcacaaggtctaccggatggtcgccgatcgcctcgaggatccgcgcgaacaccgcgtcctcggtgaagtcgccctggataaaggtgacgtcggggatgctgtccatctcgaggatgtccgaagcgatcagccggccgcggtcgccgatcacccggctggtgacctgcgaccacccgcccggcgcggcgcccaggtcgaccacggtcatgcccggacgcaggatgcggtccttctcctggatctccagcagcttgtag

SEQ ID NO: 10366 - DNA, 345 bp, Pseudomonas aeruginosa
aatagacgactttttcccaggggtctgattatggcgctcactcaagagcagaagaaacagttcaaatctatcggtcaccacctgaaaccggtattgatcgtagccgagaacggcttgaccgaaggcgttctcgccgaactcgagcgcgcactcaacgatcacgaactgatcaaggtgaaactggcgctggccgagcgcgacgatcgccgcgccctgctcgacgaactctgcgcgcagtcgcgcagcgacctggtgcaaagcatcggcaagatggcgctggtctatcggaagaacccgaagccgaacaagaatctctcgaacatcagccgtttcgccggcatctga

SEQ ID NO: 10367 - DNA, 435 bp, Pseudomonas aeruginosa
tcatcaccacgccgctgtccaggtcctgcaccgggtggttggcgccgtggtgcccgtggcccatcttcagggtcttggcgccagaggccagggccagcaactgatggccgaggcagatgccgaacaccgggatctcggtatcgaggaattcgcggatcgcctggatcgcgtagtcgcacggttcggggtcgccggggccgttggaaaggaagatgccgtcagggttcagcgccagcacttcgctggccggtgtctgcgccggcaccacggacaggcggcagccgcgcgccaccagcatgcgcaggatgttcagcttcacgccgtagtcgtaggccaccacgtgatacggcagttcaccggccgggatctccggatgactgtcgctttccaggttccagacgctggagcgccactcgtagcgctcggcggtggtga

SEQ ID NO: 10368 - DNA, 1620 bp, Pseudomonas aeruginosa
gccgagcacatcctgcatgtcgtacaggccgttctccttgccctccagccacagcgccgcacgcaccgcgccacgggcgaaggtcatgcggctggaagccttgtgggtgatctccacgcgctcgccctcggcggcgaacagcacggtgtggtcgcccaccacgtcgccggcgcgcacggtggcgaagccgatggtttcccgcgcccgcgcgccggtctgcccctcgcgtccgtagaccgccacttcctggaggtcccggccgagcgcctgggctaccacctcgcccatgcgcaaggcggtgccggacggcgcatcgaccttgtgccggtgatgggcctcgatgatctcgatatccacttcgtcgcccagcacccgtgccgcagtatccagaagcttcaggcaaaggttcacgccgacgctgaagttggcagcgaagacgatcgggatatccttcgccgcttcggccagcagcagcttctcgtcggcgctgaagccggtggtgccgatgaccatcgcgcggcgcgccttgcggcactgctcgatgttcttcagggttacggagggatgggtgaagtcgatcaggacgtcgaactcctcgcagaccttgcccaggtccccggacagcggcacgccgatccggccgagaccggccagctcgccggcgtccgcccccaccagggtgctatccggacgatccaccgccgccgtcagcccggcggcaccgccggtctgctgaacggcctcgatcaggttcttgcccatgcgcccggcggcgcccactacggctatacgtcgcataaaaccactccacgcggaacccggacgcggctgtcaggccgcgcccatggctttgtttataggtcgtcgaagaaacgcttcatgccttcgaaccagccactggccttgggcgaatgcgaggtgtcgctctgcaacgacttgcggaactcctcgagcagctcgcgctggcgcttgtccaggttcaccggggtttccaccaccaccttgcacatcaggtcgccggcgccgccgccgcgcaccggggccacgcccttgccgcgcaggcggaacagcttgccggtctgggtgctttccggaatcttcagcttgacccggccatccagggtcggcacttccagctcgccgcccagcgcagcgtcggcgaaactgatcggcacttcgcagtacagatgcttgccgtcgcgctggaagatcgggtgctcgcgcacattgaccaccacgtacaggtcgcccgccggaccacccatgctgccggcctcgccttcgccggtgaggcggatgcggtcgccggtgtcgacgccggccggcaccttcaccgacagggtcttctgctcttccacgcgcccctggccatggcaggagccacagggatcggaaatcatcttgccggtgccgtggcagcgcgggcaggtctgctggaccgagaagaagccctgctgcatgcgcacctggccgataccgccgcaagtggtgcaggtgaccggtgtggtaccgggcttggcgccgctgccgttgcaggtcttgcaaccgaccagggtcggcacgcggatggtgacggtggtgccacgtaccgcctcctccaggtcgaggtccagggtgtag

SEQ ID NO: 10369 - DNA, 2106 bp, Pseudomonas aeruginosa
aagtctcgtttcgccataacctttccgtctcaattaaggaccctccagacacgccaacgcgggagcaggctcccgcgtggcggatcatgcgtaccggcctggccggcacgcggggcagaagcaagccggggcttacttgttgtccttgacctcttcgaactcggcgtccaccacgtcgtcagcggctttcgcctgctcgccctggggagcgtcttcgccctgctgggcctgttcggcgtacatcttctgcgccagcggggtggaagcctgggacagagcgttcatcttggcctcgatctcggccttgtcgtcgcccttcaccgccgcttccagctcgcccagcgccttctcgatggtcgccttgtcctcggcggtggccttgtcgcccgcctcggtgatcatcttgcgggtcgcgtggaccagcgcgtcgccctggttgcgagcggcagccagttcctcgaacttgcggtcctcctcggcgttcgcctcggcatcgcggaccatctgctggatctcatcctcggacaggccggaggatgccttgatcacgatggactgctgcttgccggtggccttgtccttcgccgagacgtgcaggatgccgttggcatcgatatcgaaggtcacctcgatctgcggcacgccgcgcggagccggcggaatgtcggccaggtcgaacttgcccagcgacttgttctgcgcggcctgcttgcgctcgccctgcagcacgtggatggtcaccgcgccctggttgtcgtcggcggtggagaacacctgcgacttcttggtcgggatggtggtgttcttctcgatcagaccggtcatcacgccgcccagggtctcgatgccgagggtcagcggggtcacgtcgagcagcagcacgtccttcacgtcgccggccaggaccgcgccctggatggcggcaccgacagccacggcttcgtccgggttgacgtccttgcgcgcttccttgccgaagaactcggcaacggtcttctgtaccagcggcatgcgggtctggccgccgaccaggatcacttcatggatatcggaaacatccaggccggcatccttcagcgcggtgcggcacggctcgatggtgcgctgcaccaggtcttcgaccagggactccagcttggcgcgggaaaccttgacgttcaggtgcttcggaccgctcgcgtcggcagtcacatacggcaggttgacgtcggtctgctgggtcgaggacagctcgatcttggctttctcggccgcttccttcagacgctgcatggccagcgggtcgcccttcaggttgatgccgctttccttcttgaactcgtcgacgaggtagtcgatcaggcggatgtcgaagtcttcgccgccgaggaaggtgtcgccgttggtggccagcacttcgaactggtgctcgccgtcgacttcggcgatctcgatcaccgacacgtcgaaggtaccgccgcccaggtcatagacgatcacggtgtggtcgcccttggccttgtccaggccgtaggccagcgccgccgcggtcggctcgttgatgatccgcttgacgtcgaggccggcgatgcggccggcgtccttggtggcctggcgctggctgtcgttgaagtaggccggaacggtgatcaccgcttcggtgaccggctcgccgaggtagtcttcggcggtcttcttcattttcttcagcacttcggcggaaatctgcggaggcgccatcttctggcccttcacttccacccaggcgtcgccgttgtcggccttgacgatgctgtacggcaccatctggatgtctttctgaaccacgttctcttcgaagcgacggccgatcaggcgcttcaccgcatacagggtgttctgcgggttggtgaccgcctggcgcttggccggctggcccaccagggtttcgccatcgttggtgtaggcgatgatcgagggggtggtacgcgcgccctcggcgttctcgatgaccttgacgttaccgttctccaggatagccacgcaggagttggtggtacccaggtcgatgccaatgattttgcccatattcactctccagaaactttgattccgtgcgacccgcccgtgggtctcgtgctcggttga

SEQ ID NO: 10370 - DNA, 414 bp, Pseudomonas aeruginosa
ccagacaaaacccacggagccgcccgccatgctggttcacctgtccgttcacaactacgccatcgtcgagcatctggatctcgaactcgctaccggcatgagcgtgatcaccggcgaaaccggtgcgggcaagtcgatcatgctcgacgccctcggccttaccctcggcgaccgcgccgacagcggcgcggtacgtcccggagcggacaaggccgacattctcgccagcttcgacgtcagcgccatcgccgaggcccgcgactggctcgccgagcgcgacctggaacaggacggtccgtgcatcctgcgccgggtgatcactgccgaaggtcgctcgcgtgcctacatcaacggcacgccctgcccgctgggcgacctgaagagcctgggcgaactgctgatcgacatccatag

SEQ ID NO: 10371 - DNA, 1314 bp, Pseudomonas aeruginosa
cggcgacgaacagcgcgcccgccaccagttgctcagctaccagctggaagaactggaaaacctgtccctcggcgaaaacgaactggaaagcctggagcaggagcagaagaccctgagcaacgccgaaagcctgctcgccgcctgccgccaagtcgtggaaatgtgcagcgagagcgatgccggcaacgtcctttccgcgctcaatgccagcctcaaccgcctgtcctcgttcagcggccagcccgccgctctcggcgaagcggtcaatctgttgtccagcgcgcagatccaggtcgaggaggcgatcggcgaactgaaccgcttcgtcgaccacttcgatgccgatcccaatcgccagcagcaggtcgaggagcgcctggacgtcatttactccctggcgcgcaagcaccgggtccagcccgccgaactggccgacctgcagcagcgcctgttcgacgagctggaggcgctgaacgccgacgacgaagcggtcggacgcctgggcgacgagctggccgcctacgcccggcattaccaggaaaaagccgacgaactgagccgcctgcgccaggccgcggccgcacctcttgccgccagcgtggagcaggaaatgcagcgcctgggcatgcccggggggcgcttcgccatcgtcctgcatcccggcgacagcgccgagccgcaggccaacggactggaaagcgtggagttcctggtcagcgccaaccccgggcagccgctgaaagggctggccaaggtcgcctcgggcggcgaactgtcgcggatcagcctggcgatccaggtgatcacggcacagacctcgcgcatccccaccctggtcttcgacgaagtcgacgtcggcatcggcggccccaccgccgaagtggtcggacagttgctgcgccgcctcggcgaacgcggccaggtcctcaccgtgacccacttgccgcaggtcgccgcccagggccaccagcacctgttcgtgcacaaggaacgcggcagcagcgaaacccgtacggcggtcgccaccctgaacaaggcccagcggatcgaggagatcgcccgcatgctcggcggcgtcgacctgaccaaggaatccctggcccacgcgaagaaactggtcaacctggccgcccagaactgaacgttccttcaatggaaaatgaaaacggcgaccccagggtcgccgttttcgcatggaaccgttgcgcgactacttcttcttgcgcacgtagagcaccagattgtgatcgaccagctcgaagccgcgctcgcggacgatttccttctggcgcttctcgatttccgcatccatga

SEQ ID NO: 10372 - DNA, 753 bp, Pseudomonas aeruginosa
aactctcacttctgctgtcgagcgggcgactccccaagcatagccggcgggacggcggcatccgccacggcggcgcgctgcgcccgtcgaccggggccagggttcggcagaaaaaacgctcagcgcagcctgacgccacttgaagacttttcttacaaaaccttggccagcggccaggaaaagagtgggcattgtccgaaattcgcctctatccctcaagcgcgacgccgccccatagcggtgaagccggcgactccctataatgcgccgcctatggctaagcagaagaaacacccttcggggaccatcgcgcagaacaagaaggctctgcacgactatttcatcgaacaacgcttcgaggcgggcgtcgccctggcgggctgggaagtgaaaagcctgcgcgccggcaaggcccagctggtcgacagctacgtgctgctcaaggatggcgaggcctggctgctcggcagccacatcacgcccctgaccaccgccagcacgcacgtgatcgccgacccggtgcgcacgcgcaagctgctgctgcacaagcgcgaactgggcaagctgttcggcgccgtgcaacagaagggctacgcctgcgtcgccctgtcgatgtactggaagaagcacctggtcaagtgcgagatcgccctggccaagggcaagaaggacttcgacaagcgccacaccgagaaggagcgcgactccgatcgggagatccagcgcgccatgcgccacggcaaggacgactga

SEQ ID NO: 10373 - DNA, 1137 bp, Pseudomonas aeruginosa
gcccggctcccttggccatttccgccgtgtcccgctccactgcgctcgatgcaaaacctttcgacacaacggaagagcccaatgatcatttccgcttccaccgactaccgcgccgccgcccaacgcaagctgccgccgttcctcttccactacatcgacggcggcgcctacgccgagtacaccctgcgccgcaacgtcgaggacctgtcggccatcgccctgcgtcagcgggtgctgaagaacatgtccgagctgagcctggaaacccgcctgttcgacgagaccctagcgatgccggtggcgctcgccccggtcggtctcaccggcatgtatgcccgccgcggcgaggtccaggcggcgcgcgcggcggcggcgaagggcgtgcccttcaccctgtcgacggtatcggtgtgcccgatcgaggaggtcgccccggccatcgaccggccgatgtggttccagctctacgtgctgaaggaccgcggcttcatgcgcaacgccctggagcgggccaaggccgccggcgtcaccaccctggtgttcaccgtcgacatgccggtccccggcgcccgctaccgcgacgcccattccggcatgagcggcccctacgccgcgccgcgccgcatcctgcaagccatgacccacccggcctgggcctgggacgtcggcctgctgggcaagccccacgacctcggcaacatttccgcctaccgcggcaacccgaccggactggaggactacatcggctggctgggcgccaacttcgacccgtcgatttcctggaaggacctggagtggatccgcgagttctgggacggcccgatggtgatcaagggcatcctcgacccggaggatgccaggggatgcggtgaagttcggcgccgacggcatcgtcgtctccaaccacggcgggcgccagctcgacggcgtgctgtccagcgcccgcggcgctgccgggcaatcgccggaggcggtgaagggcgaactggcgatccttgccgactccggcatccgcaccggtctcgacgtggtgcggatgatcgccctcggcgccgacagcgtgctgctcggccgcgccttagtatacgccctggcccgccgccggcgaggccggggtgcgcaacctgctcgaactga

SEQ ID NO: 10374 - DNA, 459 bp, Pseudomonas aeruginosa
ccttccgcgccgccggcaccagcctctccggccaggccatcagcgactcggtgctgctcgtcctcggcgacaactggaacggccgggaaatccgcgccgacggcgcgcagatccgcctgcagccgggtgtcatcggcgcccaggcgaacgcctggctggcgccgttcggccgcaagatcggtcccgacccggcctcgatcaacgcctgcaagatcggcggcatcgtcgccaacaacgccagcggcatgtgctgcggcaccgcgcagaacagctaccacaccctcgccggcctgcgcctgctgctggccgacggcacccgcctggacagcgaggacccggccagcgtcgcggccttccgcgccagccacggcgagctgctggaacggctcgccgaactcggccgcgagacccgcgccaacgccgaactggccgcgaagatccgccacaagtaccggctga

SEQ ID NO: 10375 - DNA, 600 bp, Pseudomonas aeruginosa
tccgcaagctgcgcggcgccgacgcccgccacgctggtggcgccacctggctggcgcgcaactttgccggagccatgcgcgctgcgcgcttcgccctgctcgctgccgacggcgcccggcgcctgcttggcgcgcccctgctggccagcgccagccgcggcctcagccaggccagcggcggccgcgtgccgcaatggacgccggcgctgccgcagccggtacgcttggcgccgccgcccgccccgctcgacgacgagcggccgagggtggtctatctcgccgcctgcgtctcgcgtgccatgggcccggccttcggcgactaatagcgcgagccgctgctggacaagacccgccgtctactggaaaaggccggctaccaggtggtgttcccggataacctggacaacctctgctgcggccagccgttcgcgtccaaggggtatgcgaagcaggccgacgacaagcgcgacgagctgctcgccgccctgctccaggccagccgcggcggcctcgacccgatctactgcgacaccagcccctgcaccctgcgcctggtccagggtctggacgatccgcgactgcagatccacgacccggtga

SEQ ID NO: 10376 - DNA, 519 bp, Pseudomonas aeruginosa
tggtcgatctcgaccgggagctggtggaactgtgtcgcgaacacctgttccagtggcaccagggcgccttcgacgacccacgctgcgaactgctcgccgaggacggccgggcctatctcgagcgcgacccgtcgctctatgacgtggtcatcatcgacgtcgtcgacatgctcgacaacggcccggcccaggctctctatacccgccagttctacgagctgctgcattcgcgcctgcgaccgggcggggtggtcgcggtgcaggggctggagttctcccacagcgacgacaagccccacgcggccctcgcccgcaccctgcgcagtgtcttctcccaggtccacagctaccgcgccacggtgccctcgttcctctcctcctggggcttcctgctggcttccgactggctcgacacgaaccactggcaggccgaggacatcgaccgacgcatcgaacgcaagctcggcccgctgtggctcgaccacctcgacggcgactacctcaaggcctgcttcgtga

SEQ ID NO: 10377 - DNA, 972 bp, Pseudomonas aeruginosa
tggaccgggaaacccgcttcctgctcgcccaaccgggaccggtactggaagacggcgtacccttcgtcgcaccgccggatatcgaggagatcgagttcggcccggcacaattgccggccctggcgaggacctgaagatgtccgccgctcccctggccagcgtaccgctggccgtcaacggcgcgccctgcctgctgcaccgggtacgcttccgctccgccgcggacggcggcggcctgccgctactggccaccctgcgcgatccgcagccggcgctggccgtcctggcgcaacgcatcgagctgagcgaagacgcggaactgccggagaccgccgtcgacgacgagctgctggtgatcttcgccaacgccgggctacagaccgggcacgcctggcgccagcgcctggaagcctggatggccgccggcgaggacgagcgccagccgaccctggaagcgccctcgttcggcgagcgggtgctgtggcgccccggccgcgcgctggtcatcggcaaccccgagcgctgccgggagctgctcgaaggcctggccgtcttcgcctggcacgaaggtcacctgcgccgcctggaaggcgagaccgcggcggcctgggaaccggcccaggccgatgtcgaactgacccagctaccgcgccgtgccgccctgcggcgccaggaacatgtgaaccggcaggtgcgacgcactacactctggcgcatggcctatgcccgcctggagtcgcacctggagaagccgccgctgcaactgaacggcgctgtgcgccggctctacaacgaactggccatgcaggccgaagtgcacgatcgcctggcgaccctggacgatcgcatcgaagtgctgcaggacctgtacgaactggccgccgaccgcctcggcgaataccgctacttccggggcgaactgcgggtcgaatggctgatcgtcgccatccctcctgctggaggccggcctga

SEQ ID NO: 10378 - DNA, 720 bp, Pseudomonas aeruginosa
aatccgcacgccactggccagcctgcgcacccatgcccaagtcgcgctgcgttcggaagaccccaaggcccacgcccgcggcctgctgcaagtcagtcgcagcgtcgagcggatcagcaccttgatggagcagatcctgctcctcgcccgcctcgacggcgacgccctgctggagcaattccacccggtcaacctcgccaccctggccgaagacgtactctccgaactggcgcgccaggccatcgacaaggacatcgagctgtcgttgcaccaggagaccgtgcacgtgatgggcatcgacctgtggctgaaggcgatggtcggcaacctggtgggcaacgccctgcgctacacaccggccgggggccaggtcgagatccgcgtcgagaatcgcgcccagcacgccgtgctgcgggtgcgcgacaacggccccggggtcgccctggaagagcagcaggcgatcttcacccgcttctaccgcagccccgccaccagcagcggcgagggcagcggcctgggcctgccgatcgtcaagcgcatcgtcgaactgcacttcggcagtatcggcctgggcaagggactggagggcaaagggctggaagtgcaggtgttcctgccgaagacccagccggacgcgacgcggccgccggccagaggtccggacagcgggcggtcacatatctgatagcctgcgcattggccgggaaagggataggctag

SEQ ID NO: 10379 - DNA, 618 bp, Pseudomonas aeruginosa
gcgctgaaggcgatgatcgagccgaacaggatcaggtacaccagcgccagccagccgctggtgctcggccaatgctccaggcgctcgccgctggccaggctgccgaccagcagcaccgcgccgccgaccagcatttccgcggcgctggccatcggtccggccggcagcgacaggcgccggctccacaccgagccgaaggcccaggacgcggcggcgaacaggatcaggccggcgccggcagggctggcctggaggttcgaaccgaggttgagcaggacgatgccgaacagcccgagcacgatgccgccccattccagcgtggtgttgcgctggccgaacaactggctgaacagcagggtgaacagcggcaccgtagccaccgcaagggccgccaccccggaagacacgccccagtgctcggccaccgtcaccccgccgttgccgcaactgagcaggaggattccgacgatccccgcgccgcgccactcgcgccaggtcggcaacggcgcgccgcgccagcgcaaccaggcgaacatcaggccgccggcgatgacgaagcgcaccccggccatcagcatcggaggccaggactcgacgccgaagcggatcgccaggtaa

SEQ ID NO: 10380 - DNA, 414 bp, Pseudomonas aeruginosa
ccttcgccgaactggcccggcgcatcaacctgtcgcccccggcggtggccgaccgggtggccaagctggaggccgaaaggggtgatcaccggctaccacgcctcggtgaacctggccaagctcggcctgcccatcgagtgcgtgatcgaactgcggatcaccgagaaggattgccagtcggtgctcgacgaactggcccggatcccccaactgaccctctgccaccggatcaccggcgacgcctgcgtgctgatgaaggccgccgtggcttcgatgccggagctgcaggacctgatcgaccggctgatgaagttcggcatcagcaagacctcgatgatcctctccacccccttcgccgaccgccagccggcaagcctgcgggggcaggacggcaatggcggatgtgcggcgtga

SEQ ID NO: 10381 - DNA, 1233 bp, Pseudomonas aeruginosa
  unsure (1042): Identity of nucleotide at the above locations are unknown.
tgcccgcgccggcggaactccaccgggcgtctcgccgacccagcgcttgaacgcgcgatagaaggtgttcggctcggaaaacccggtgcgttcgacgatcacttcgatgcgctcgtcggtcttcagcagcagttccttggccagtcggcagcggtagtcggtgaccaggtcgttgaagcgcaccccggccatcgccaggcgttcgcgcagacgtcgggccggcatgccgaggcgcgcggcgacctgctccagggtggcgcctccgtccaccagcaactcgccgatcagttcgcggacctggcgcaccaggtccaggcgctccacctcggccagttgccggcgcgccagcgactcgtgcatgcgcagcagttccggggcggcgtggcgcgagggtttgtccagcaccgcggcatcgaataccagcgcgtagcgcggcatgccgaggatcgtcgggcagccgtagaccgcacggtagcgctccatcggcgcgccggtttcgttcatcagttgcacttccagcggcttgaactcgccctcggtgagcgcgccgaacaggcggatcaccgcgccggcgagcatttccgggaagtggcggttgatcgccggcgattcgcccagcgacagcaccgcgcgctcgccctccacctccagttgcgcctgcagggtgtcggacagcaggcgtacgtagcgcagggaatggcgcaggccggcgccgaaggtatcgctggagaggaacaggtattccaggagcaggccgtggaacgccggcaggtgctcggccaggtgcaggccgacatgctcttcgccgcactcgtcggcggcggccttccagaacaggttctgtgcggaatgggggaaacggccggccggcaggccacccggtggcagcccgacacggaccaggacccggtccggatcgcagccgctggcgcgcagggcgtcgatcaccgggcgcatcagcgctacatcgtcggtcagatcacgcatggtgttttttctagttatccatggggcgggcccatcttatgcagctttgccaaanttccccccccccccctctcaaggagaggccatagaaataacccatcccgcatgacggaaaaaccctcagatcgactagccgccggcgtggtcgaaaatctcgatgcagacgcatcccggagccgattgaccgccctgccagcggcgtcggccaggcggccaatgcctgctgcgggtgctcgactaagctga

SEQ ID NO: 10382 - DNA, 885 bp, Pseudomonas aeruginosa
cagccacctatttcgaggagatgtccaatgcccaccgcctggctcgacctgcccgccccacccgccctgcccggcctgttcctgcgcgccgcactgcgccgcggcatccgcggcaaggccctgcccgagcgcggcctgcgcagccaggtcacggtggacccgaagcacctcgagcgctaccgccaggtctgcggcttccgcgacgacggcctgctgccgccgacctacccgcacatcctcgccttcccgctgcagatggcgctgctcaccgacaagcgcttccccttcccgctgctcggcctggtccacctggagaaccgcatcgacgtgctgcgcgcgctcggcggcctcggcccgttcaccgtgagcgtcgcggtggaaaacctgcaaccgcacgacaagggcgccaccttcagcatcgtcacccgcctggaagaccagcttggcctgctctgggtcggcgacagcaaggtgctctgccgcggcgtcaaggtgcccggcgaaattccgccgaaagccgagcaggagccgctgccgctggagccggtcgacaactggaaggcgcccgccgacatcggccggcgctatgcccgtgccgccggcgactacaacccgatccacctgtcggcgcccagcgccaagctgttcggctttccccgcgccatcgcccacggcctgtggaacaaggctcgcagcctggccgccctcggcgagcgactgccagcctcgggctatcgggtcgaggtgcgcttccagaagccggtgctgctgccggccagcctcaccctcctggccagcgcggcggcggcggacggccagttcagcctgcgcggcaaggacgacctgccgcacatggccgggcattggagccggctacagggctga

SEQ ID NO: 10383 - DNA, 366 bp, Pseudomonas aeruginosa
agcttcgggcgcaaagcccgaagctatgcggctgcttaccgccaccgcgaagaatcccccatggacctgcacgaactcaccgcgcgcctgcacgccatccgcgaccgcaacgactggcgccaattccacagcccgaagaacctggccatggccgccagcgtcgagatggccgaactggtggagatcttccagtggctgacggaagaccagtcgcgcacgctgtcggccgagcagctcgaacacgctggccaggaagttggcgacatcgtcctttatctgctgctgttctgcggggaaaccggcctcgacctggaacaggtggtgcgcgccaagctggccgactgcgaacggcgcttcctgccatga

SEQ ID NO: 10384 - DNA, 657 bp, Pseudomonas aeruginosa
attacaaggttgccaccctccaggtcgacctgttcgacggcaaggacggcaagctggtctggcgcggcagcggcgagcagatcatgcgcaccagcccgccgagcccggccgagcgcgagcaggcgatccgcgagacggtgcagaaagtcatgtcgcaatacccgccgcgctgacatgcagctcagccaccgcccggcggagaccggtgacctggagacggtcgccggcttcccccaggaccgcgacgaactcttctattgctaccccaaggcgatctggccgttcagcgtcgcccagctggccgccgccatcgccgaacgccgcggcagcaccgtggccgtgcacgacggacaggtgctcggcttcgccaacttctaccagtggcagcacggcgacttctgcgccctcggcaacatgatggtggcgcccgccgcgcgcggcctgggcgtggcccgctacctgatcggggtcatggaaaacctcgcctgcgaacagtacaaagcgcgcctgatgaagatttcctgcttcaacgccaacgccgccgggctgctgctctatacccagctcggctaccagccgcgcgccatcgccgaacgccacgatccggacggccggcgcgtggcgctgatccagatggacaagccccttgaaccctga

SEQ ID NO: 10385 - DNA, 831 bp, Pseudomonas aeruginosa
cacccacgcccagcgcgtcctcatcatcgtctccagcggcccgagcaccccggcccgctgcgccgcgcccttccacaccgccaccctgctggcctgcatggacgccgaggtgaccctgttcctcagcggcgaaggcgtgcagttggcccgccgccccgtcgccgaccagttgcgcgcgctggacggcggcgagccgctgcgccacttcatccgccaggcccgcgaggccggcgcgcgcctgctgatgtgccgccaacccggggtgaacatcgacgaaagcgaactgatcgaggaactcgacgaaatctccagcggcggcgaactggcacggctgatcctcgaatccgagcgggtgctgaccctatgagcgcgaacctgcacggcctggagttccccgacgggctgttctacgccccggactacaacctgtggttgcgcgaggaagtcgacggcagcctgaccctgggcctgagcgcctacggctgcgcgctgtatggcgaaatcttcgccttcacccccaagcgcgacggctggcacatcgaacgcgaccgcagcttcggcgtggtcgagttcgccaaggctgcctcctcggcccgcagcccgttggccgggaccctgctggcgagcaacccggcggtggtcaagcgcccggcgctgatcaaccgggattgctacggcgagggctggatggtacggctgcaaccggacgactgggcctcggcgcggagcgcgtttctccagggagacgcggcgcgggaggcattcgccgagcgcatgcgcctggatgggttcgatccgcagcatccaggggtgcaggcgctggacgtctga

SEQ ID NO: 10386 - DNA, 447 bp, Pseudomonas aeruginosa
ccagagcaggatcgaatccctggagcagaacgccatccgcagcgattcacggttgccgtgggacaggcgggtgcgcagcaggccccgggccagggtgcggcgaaggacccgggagaacaccgtccagcgcccgaaattcagccataccacgtgggtggcgcggccccagagcaactcgcggacggcgctgtagttgccgtcggcgacccagcgcggcgccgtcgtcgcccgctccacggcgtgctcgaagcgttcgtggggcacggcttgccagccggggccccagtagagtcggtcgagttcgacatgcgtacaacccagcctggcggccagcgcggcggagaaggttgtcttcccggccccgctggtgccgaccaccaccacacgcagcggcgcgcctcgctcggcctcgacgcaggtcatgccttgaccgcgaccagcgtgtag

SEQ ID NO: 10387 - DNA, 783 bp, Pseudomonas aeruginosa
agcgcgttatcttacggcttcgcggcgacgaaagcgccctccccagccaaacgtagcgcagccgctaatcgcctcttcccggaaatgctgccttcggctctactggcgaatttgtgccatccatacccgagacagccccatgacgctgatcgccgccgcccagagctgcgcccaccccgccgacctgccacgcaacctcgacgaccacctgcgcctgatgcgtatcgcccaggcacggggcgtgcgcctgctggtgtttcccgaactgtcgctcaccggctacgaacccaccgctgccgccgccctcgcccagccgacggacacgcccctgctgcaaccgctgcgccagctcgccgagcaggcacggatgaccacggtggtcggcctgccgctgcgctcgccgaagcatgccaagccgctgatcgccgccctgatcctcggcgccgacggcagcctcggcgtctatgccaagcagcacctgcacgcgggcgaggaacgccacttctcagccggcgacggcggccccctgctggagatcgacggcctgccgatggcgttggcggtctgcgccgacttcagccaacccagccacccggcccacgccgcccgtgccggcgctcgcctctacatcgccagcgcgctgatcggagaaaacggctacccggccgactcggccctactggccggttatgcccgcgagcacggaatgggcgtgctgctggccaaccatggcgggccgacgggtggctggaaggcggcgggcaggagtgcgttttggaatga

SEQ ID NO: 10388 - DNA, 405 bp, Pseudomonas aeruginosa
gggcgcgcagcagcgaggtcttgccgtggtcgatgtgcccggcggtgccgacgatcacgacagctcgctccgcagtcgcggcaactgggcgaggaaccccggctcgtcgtcgagctggcgcagatcgagccagagggcgtcgtcctcgagccgaccgatcaccggcagcggcagcccgcgcagggcttcctcgaggttgcgcagggcgcgtccgcgcaggcgcctgggctgccgcggacgcaggcacagcgcggcgctgggcagccgcgccaccggctgcgcgccgctgccgatcatgcccaggggcgtcgaccacggcgacctcccagccctcgccgagcgcctcgcccagcgccggcgccagacgctcggcctgggcgcggatctccgccgccgggcggctga

SEQ ID NO: 10389 - DNA, 498 bp, Pseudomonas aeruginosa
gcaaggcgatggcccaggccttgcgttggccttcatcggcttcgcgcaattgttcgagtgccgcgccgacggcggcgttggccggtgccgggtagcccgcgagcagggcatccagccagggcagccaggcgccttcgcgcaccagcaggtcgtaggccagcggcggcatgccgtgctcgcggctcttgcgcaggcgctcggggtcgagcggggccagggccggcgggttgtccagcagcgcctgctggagccggcagagaccggcgaccagccgcaggtagtcgcccatcgggtgcccctcggccagttgcagcagacgctcgccgcggcgggcgaacaggtcgcgcgacggctggtgcaggtgcgggggaatgttggcggcggcttcgatctgccccggctgaagaatggtgcgtgacacgggaactcctcgggtctgcgccggcgggccggtgggccgcgccgcaacgatcgggcgcccggaggggcgcggaatga

SEQ ID NO: 10390 - DNA, 1239 bp, Pseudomonas aeruginosa
atttcattttttcatttccgactcctccgagagcgccgccgctgccgccgggtcgcggaggaccggcggcaacgcccgcgcgcaggctcaacgacgctcgtgcgggtcaaaggtgtgtaccgacggatcgacctggtgcaccggtgcctcggcttgcccgtggtcttcctcgtcgtccgcgcggttgggaccgacgcgcacatagtggaagaacccggcgagcaccgtggcgcccatggccagcagcgccagcggcttggtcacgcccttccacaggctgaccagcgggctgacgctcggctggtcggccaggccggcatagagcgacggcttgtcggcgtggtgcagcacgtacatcacgtgggtgccgcccaccccttcggggtcgtacaggccggcgttctcgtaaccgcggctcttcaggtcgacgatgcgttcggcggcgtgttccttcatgtcctccttgctgccgaagacgatggcgccggtcgggcaggtcttcacgcaggccggctccatgcccaccgagacgcggtcggaacacaggctgcacttgtaggccttgtggtccttctgcgagatccgtgggatgtcgaacgggcaaccggtgatgcagtagccgcaaccgatgcacttgtcctggttgaagtcgacgatgccgttggcgtacttcacgatcgctcccgggctcgggcaggccttcaggcagcccggctcggcgcagtgcatgcagccatccttgcggatcagccactcgaggttgccggcctcgttctcgtgctcggtgaaacgcatcaccgtccacgagtcggccgtcaggtccatggggttgtcgtaggtgccgtggttgtggccgacctcgtcgcgcagctcgttccattccgagcaggcgacctggcaggccttgcaaccgatgcacttggacacgtcgatcagtttcgccacttcctcctggttccgcaccgagggcatcggcgtggtggtcgcggagcgggcgtggatgtcctgactactcatgtttcacctcacgccttttccacgttgaccaggaacgacttgaactccggcgtctgggtattcccgtcgcccacgaagggggtcagggtattggccaggaagccgttgcgcgccatgccggcgaagccccagtggatcgggatgccgacgtggtgcacggtcttgccgtccacctgcagcgggcggatgcgcttggtcaccaccgccaccgccttgatgtag

SEQ ID NO: 10391 - DNA, 654 bp, Pseudomonas aeruginosa
tcggcgccggccccgccgggctctccgccgcctgcgtggccgccgagcgcgggcatcgggtcagcctgttcgaggcgagcggggaaatcggcgggcagttcaacctggccaagcggattcccggcaaggaggagttccgcgaaaccctgcgctacttccgcgtgcgtctggaacgcctcggcgtcgacctgcgcctcggccaccgagtgcgccagggcgagctggacggtcagttcgacgacgtggtggtggccaccggcatccagccacgccggccaaggatcgacggcatcggcggaccgaccgtactcagctacgtggacgtgctgcgcggcgcgccggtgggcgcgcgggtcgccatcgtcggcgccggcggcatcggcttcgacgtcgccgccttcctcgtcgccgcgcccagcgacggccagccgcgggcgctcggcgaatggctcgcggaatggggcgtggacctcgacaacagccagcccggcggcctccgcgaacccgctccgacgcggccggcgcgccaggtctggctgctccagcgcaagcccggcgctcccggcgcgcagctcggcaagaccagcggctgggtacaccgcgcgcacctcaggcacaacgccgtacggatgctcggcggggtggagtacctga

SEQ ID NO: 10392 - DNA, 591 bp, Pseudomonas aeruginosa
ggcgaacaaccgctcgcggttacccgccgggcggaatccgagggcgtgcgatggggtctcgcgttttcctcctccgcccccgcctggtgcatactgtgcgactccccgtaccactccggcccgtccctcgccatgcgcggggcgcgctcgccgtcatcgttccaggagtcttgcatgcccactccaccctggtggctgttcgtcctgcccctgctcgccggcgcctgcctgccgctgcaagcagggatcaacggccagttggccaagcaggtgtccagcgtcctcgccgcggcactgatctcgttcttcgtcggcaccctcgggttgctcgccctgaccctctcgcagcgcgagtttcccggcctggcggcattgcgcgggctgagctggtggcactggtgcggcggtttcctcggcatgttcttcatcttcatcgccgccttcgccgcaccgcgcatcggcgcgctgatgttcatggtgctggtgcttgccggccagctgggcatggccatgaacctccaccacttcggttgggccggcttccgcgaggcaccgatcagcgcactgaaacttgggcggggttggcactga

SEQ ID NO: 10393 - DNA, 357 bp, Pseudomonas aeruginosa
ccctggagatcgtccgcgacggcgagcggccgagcgccggccaggtcttcgcccgagctgaccgcagggcgcgagccgctgccctatctcggcgacctgatgttccgcgtcctgctccgcgcgctgctggaagagcccggcgcgctgctgcgcacgccggcgccggaactgccctgggaacgccaaccgctggccctgaccgctgcgggccgcgaggtcctggccgggcggcgctaccgcctcgacctcggcgcccccgaacgctgggtcggcggcgtatgcctgcgcgccggcaccgcgcactgggcgctggacgagcaggaccggccggtatggcgggaggacccacggcactga

SEQ ID NO: 10394 - DNA, 501 bp, Pseudomonas aeruginosa
cgctcatcgcccggacgagcgcaacgggcgcgcagccactatcatgcgcgcccgttttccccgcacccgcccgccgatgaagaaaatcccgctcgccgccgccgaccccgaccgcctggatacctgggtgaaataccgcgaaggcctgtgcggcgagtgcaacgcgacctgctgcacgctgccggtggaagtgcgcatcgacgacctgatccgcatgggactggtcgacgagttcgagcgcgaggagccggccaagcgaatcgccaagcgactggaaaaggatggcgtgatcgagcacttcaaccacaagcgcgagatcttcaccctcacccgcatggccaacggcgactgcctgtacctcgaccgcaagacccgcctgtgcaccatctatgcccgccgcccggacacctgccgcaaccacccgcgcatcggcccgcgtcccggctactgcgcctaccggccgaggtagtctcagccaggcggcgccacgccctggcatag

SEQ ID NO: 10395 - DNA, 1440 bp, Pseudomonas aeruginosa
ctggtactgtcccaccggcggccggcagcgcaagcgctggcgcacctcgtcgggcaaggcgccgaacgaacgcgagcggatcgccagcagggcgtcgcgacgcaaccagccggccagctcgctgtcctccgcccgttgcgcccgcccgccgctgtagaacactgccgagtacggccgcttcggccagaacaccagcggccgctcgcgccagccggcgtcgctggccagcagcgcggcggtggacttctgctcggcgcgcgagcccagcagcagggagccgaggaacagcgcgaacagcaatggggtcagtgccaggcaagccaacccgccacgccgcagccaggcgctgcgcgccagcggcgcgcgcagcaggtcggcggcgagcaacgccagggccggcaggccgggcagcacgtaggtccagaggacgttgccggcgaaggtgaagaacaggcacggcgccagtccccagaacagccagtagcgcctgcgcgaggcgacgccatcgaccacctccccgcgctggcgccagcccagccagagcagcagcggcagccagaggctccagggaaacgcggcggccagcaggaacagccagacgctgccgtagggataggcgtgggcattgccgtagcggtcgccgtcccagccggcggtgacgaagcgctgccaatgctcgccgagcaggaagtactcgaggaagcccggcgtcttcaactccgccagcaggtaccagggcgcggccaccaggagcatcagcaggcttccgcggatccatggcaggccccgccagagcgcgcgccagcgccactccagcaaggcccacaggccgatcggcagtccggcgaggatcagcgtcagcggccccttcgccagcagcccgaggccgaggccgaggaacatcagccagccctcgcggcgccggattccctccgcgccatgcaggcccagccagaagccgcgcatggccaggaccagcgccagggccagggccatgtcggtcattaccgccccggaggcgacgaagaacagcgccgaactgcccagcaggacgcaggcgatccgcgcctgccgacgatcttcgcgagcctgccagtcccataccagccacagcaccagcacgcccagcaaccagtgcggcaggcggctggcgaactcggtggcgccgagcagaagctggccgccggcgctgagccagaaggccagcggcggcttgccccagaacggcacgccgacgtcgtaccagggcgtgatccagtcgcccagttcggccatcttccgcgccacctcgccatagcgggcctcggtggtgtccatcagcggatagctgcccaggctcagcaggcggatggcgaaggccagggcgagcaggaaccaggccagcggccagccgcgcagcgccctcacggattggccccgccgacctgcgccggcaggtag

SEQ ID NO: 10396 - DNA, 1425 bp, Pseudomonas aeruginosa
aaaacgggttttccgcaggcctcgccgccgtcgctatactgcccggccgatccggaggaccccatgagcctgttgcgcgatgcctggcgccacgccccgacccaccacagggtctgggcgctggccgggccgatgattctgtcgaacgtttccgttcccctggtgcacctggtggacagcacggtggtcggccacctgccgcacgcctaccagctcggcgcggtagccgtgggcggcagcctgtacaccctgatggtcggcgtgctcggcttcctgcgcatgggcaccaccggcttcgccgcccaggccgccggccgcgacgatggcggcgcgctgcgcctgatcctcgcccagggcctgggcatggcgctgctcctggccctgctgctcggcgcgctggccctgcccctgagcggctgggccctgcaactgatgcaaccgtcggcggaactgaccggcgaggcccgcgccttcttccatacccgcctgctcggcctgccggcggccctggccagctacgcactggtcggctggttcctcggcacgcagaacgcacgggcgccattggcgatcctgttgaccaccaacctgagcaacatcgccctggtgctctggttcgtccacggcctcgactggggcgtgcaaggcgcggcccgcgcctcggtgctggcggaatggagcggcgccctgctcggcctggccctgacccgccgcgacctggcccggcgccccgggcgggcgcagtggcaacgcctgcgccactggctgtcctggctgccgctgctgatggtcaaccgggatatcttcatccgcagcctggccctgcaactggtgtttttcctgctcaccgtacagggcacccgcctcggcgacgccacggtagccgccaacgccctgctgctcaacggcctgctcctgacgtcctacgccctcgacggtctcgcccacgcggtggaggcgctctgcggccacgccatcggcgcccgcgaccgagccgccctgcgccgcgcgctggtggtagccggtggttggtcgctgctggcaagcctggcgttcgccgcgctgttcgccttgttcggccacctgttcatcgacctgcagagcgacatcgccgacgtccgcgaagtcgcctacgcctatctgccgtacctggcctgcctgccgctgctggggatgtggagctatctgctcgacggcctgttcatcggcgccacccgcgcccgcgagatgcgtaacgcgatgctcgtcgcggtggccgccagcctgcccctcggctggctgttgcaggggctgggcaaccacgggctatggctggcgttcctcgccttcatgctgctgcgcgggctggtcctggccgcctacggctggcgcctgacccgccgcgatggctggttcgccgctcagggcgccgacagcggacgatag

SEQ ID NO: 10397 - DNA, 531 bp, Pseudomonas aeruginosa
aagcactgtggaaccagaccgccgccgcaccgccgagtgcgttggccggctgcgccagcgccgtcagccagggcagcaccagcaggcaaccgagcaggcgcaccagcaggttgcccaacggcaggcgccgcgccacccggctaccggccacccccaacgccggcaaggcgccgccgaggttggcaccgagcaccagggccagggcgatgggcagcgagaccagtccggcctgggccagggacgccaccagcagtaccaccgcgacactggaatggcaggcccaggtcagcagcgcggcgagcagcagggcgatcagcggatcgccttcgaggccgtggatcaccgcgacaaaggctggcgaggcctcgatctgctgcagggaatggccgagcaacgccagcgccagaagcatcaggccgagtccgatcaggcactggccaaggctctccaggcgcggaccgtcgcccaggcggaacagcagcaggccggacagcagggccagcggcgccagcaacgaggtgtcgaagctga

SEQ ID NO: 10398 - DNA, 417 bp, Pseudomonas aeruginosa
gcaccttcaccgccacgccgttctcgcgcaacgcggcgatggccgggccggcggtttccttcggtggatcgaggaaggtcagcaggccggcgatcaccaggtcgcgctcgtcgctggcgccgtactgggcctgggactccgtgcgcgagaggctgcgggtgccgagcaggagcacgcggaagccgtcgcggttgtattgctcggccagcgccagcagggcccggcggcgttcctcgtcgagcggcaggtcgacaccgtcctggtgcacgcgggtggcgatctcgagcatttcctcgaccgcgcccttgcacaccagcaggtgttcgccgtccttgccctcgaggatcaccgagagacgccgacggacgaaatcgaagggcagttcgtcgaccttgcgccaggcatccgacggcgtga

SEQ ID NO: 10399 - DNA, 546 bp, Pseudomonas aeruginosa
acgcattctcggggaataccggaagcgccgtcaggcacattggcccggggtctgcttgactgtgcccatcccaccccgaggagcgccgccatggcccaggcaatcgtcgcctacctgcactacctgtcgatcttcctgctgttcgccctgctggtgttgcagcaccgcctgctgcgcctgccgctggacctggagcgcgcccgcagcctggcggcgatcgaccgcggctacggcctctgcgccctggcggtactggccagcgggctggcgcgggtgctgtggtacggcaagggcgtcgactactacctgcacaatggcctgttccacgccaaggtcgggctattcgtcctcgctgccctggtctcgctgttgccgaccgttaccttcctcggctggcgcggcaccctcaaggcccgcgaagtgccggcggtgacgccggcccggggccggcgggtggtcctggcggtgcgcctgcaactgctcctgctgctggtcattccgttgctggctacgctgatggcgcgcggcttcggcatgcgcggctga

SEQ ID NO: 10400 - DNA, 360 bp, Pseudomonas aeruginosa
acgcctggatcgccaccgagcgggccgcccgcgcccgcctcggcgccagcggaaccctggagctggcgcaagtcgccgcgctctccccgcaggagttcttcgaccgcatcggcagcggccaactgccctgtccgccctacggcgagctggtcgacttcgttcccatcgagtggtccgaagggcgcttcctgttccagggcaccccggaccgccgccactacaatccgctgggtagcgtgcacggcggctacgccgcgtcgctgctggactcctgcatgggctgcgcgatccatacccggctccaggccggccagggctataccaccaccgacctgcggatcagctacctgcgcgcgctga

SEQ ID NO: 10401 - DNA, 588 bp, Pseudomonas aeruginosa
cgacctgcattccaaggtatcgaagccatgcgttatcccgaagaccacaagcagaagacccgccggcgtatcgtcgaggaggctgcccggctgttccgccaggacggcgtcggcgccaccgggctgcaaccgctgatgaaggccctgggcctgacccatggcggcttctacgcgcacttcaagtccaaggacgacctggtggaaaccgcgttgcggcatgccgcggcgcaactcgacgaaatcaccgcgcccctggcggaggcggaacgaccgctggcgctgctgatagagcagtacctgtcgccgcgtcaccgcgataaccccggcgccggctgcccgttgccgaccctgtcggcggaactcggccagcgcggcacgccgagcccgaccaccgacagcatcgtgcgcaagcgcctggcgatgatcgaagcggccctggagggcgaggacgcaggcgagcgcgccgtgctgctgctcgcttcgctggtcggcgcgctgcaactgtcgcgcagcgtgcaggatgaggcgctgtcgcaacggatactggaagcgacgcgcaagaagctgctggagcagatggagcgctag

SEQ ID NO: 10402 - DNA, 687 bp, Pseudomonas aeruginosa
aaggtcaggacccacaccaccccgacatgccctaccatggcgttgtctatcgcgggaggatcatgcgtcatgtatcacggtgaaagactcaatgcctggacccacctgatcggtgcggtcgccgcctgtaccggcgccgtctggctgacggtccaggcgagcctcaacggcagtccgtggaagatcgtcggggtcggcgtctacggcgtcaccctgacgctgctctacagcatctcgaccgcctaccacagcgtgcgcgggcgagcgaaggtggtgatgcgcaagctcgaccacctgtccatctacctgctgatcgccggcagctacacgcctttctgcctggtcacgctgcgcggtccctggggctggacgctgttcggcatcgtctggggcctggcggtactcggcatgctccaggagatcaagccacgctccgaggcgcgagtgctgtcggtggtgatctacgcggtgatgggctggatcgtgctgatcgcggtgaaaccgctgctcgccgccctcggcagcgccggcttcacctggctggcggccggcggcgtgctctataccgtagggatcgtcttctatgcctatgaccaccgcttccgccactggcatggcatctggcacctgttcgtgatcgccggcagcctcctccacttcgtggcgatctggcgctacgtactctag

SEQ ID NO: 10403 - DNA, 525 bp, Pseudomonas aeruginosa
cctggcggatctgtgccagcaccgcgcttttctgctgcaccagcgaagcgatcaggaaatgcgtggcatcgcgggaaaacgccagttccgccggcggcagcgaggaaaactgcatgcgtgcctccagcccctggcagcgagcgatctcgcgggcacagcccagggcctcctcgtcgatgtccaggcagcacaaatgtgcgccgacctcccgcgccagcaccagggccgaggtcggcagggcaccggagccgacgaacaggacccgtgcatcggcatctatccccgcgctgtcgagttcgccgcggatggattccagcaggctacccaggtagcggcccatctcgccgggttcatgcagcacgccctggcaaaggtgcttctccagttcgcagagggcctgcaccgccgcgtcgcgcaggcgcaggccgagcgcctgcaacgcaggatcgtccgaatcggcctgccactgcgcccggctgcaatcctccccgatcagtccgctcagacggtcgagcttgcgcctga

SEQ ID NO: 10404 - DNA, 2253 bp, Pseudomonas aeruginosa
gcaggcgaatctcgcattccagttcgcggagggtttccagcagcggtgtgcgtccttgcatggcatggcttcctggcggcggtagagggctcagtagttcagggtcaggctcatggtcaggttgcgcggctcgccgggggcgacccagacgttgttataggaacgctcgtagtagcgacgatcgaagaggttgttgacgttcaccccgagggtggcattgctcgccagcggatagtgcgcgagcaggtcgacggtggtgtaggccggcagttcgaagccgctgtcgctgctgtcgccggcgcgctcgccgacatagttgaccgccgcgccggcatcggcgccgtgcagccagccttcgcggaactcgtagacgcccatcaggctgccgctgtgcttcggcacgttgagcaggcggctgccgcgagcgatgttctcatccttggtcacttcggcgtcgatataggcgtaggcgccgatcagccgcaactgctcggtgagctggccgctgaactgcaggtcgaagccctggctgcgcgcctcgccggcggtctgctggtaaccgggattgctcgggtcggcggtgagcacgttcttctttttcaggtggaacgcggcgagtgtcatgcccagccggccatcgagcaggtcgagcttcacccccgcctcgtagccgcgcccctcctccgggtcgaaggccttgccggccatgtcggtaccgccattgggcttgaaggatttcgaggcgttggcgaacaggccgacctccggggtcgcctggtacagcacgccgatgcgcggggtggcggcacgctgggtctgctgcgagctggtgtcgcggaagcggccattgttcaggcgcgtggcgttcatgtcctggcggtagcggtcgaagcgcacgccgagcaggccgcgccatttctcgctgaactcgatctggtcctgcaggttgagggccatcgcgtcgacttcctcgtggttgcggtcgtcgcgtccgaagggtggtttcggctggccgtagaccggccggcggatgtcgatggcataggggttgcgcgacgggatgctacgcaggatcagttcgtcgttgtggtagcgctcgtactcgaggcccatcagcaactggtggcggatcgagccggtatggaggtcgccgagcaggtcgagctgggtgatgctgtcgtgccactcgaagtcgcggtagcggtactcccggcgcaggctgtagccgtcggcggcgaggctggagttctccgaggcgtagccgtccaggtggccatgcttgtagtggctggccaggcgcaggctccactgctcgttgaagtgatggcgcagggtggcctggagggtttcgttgttgttgtcgatcttgccgtcgtccggttcgccgaagaaccgcgagcgcggcaggctgcccaggtggttgtgcggcgccacggtgccgcggtcgaagacctggcggttgcgcaccacctcggcttccaccagcaacgaggtgtccgggtccagttgccagctgaacgatggcgccaccagcaggcgctggccgtcggcgtagtcgcggaagcccttgctgtcctccaccgccaggttcatccggtagagcaggtcgccctcttcgtccagcggcgtgttcaggtccagggtcgagcggtagcggtcccaactgccggcgctggcatgcaggcgggcgaagcgctcggcctggggcttcttggtcaccaggttcaccgtgccgccgggatcgccgcgcccgtaaaggctggaggccggtcccttgaggatttccacgcgctcgatggtggcgctgtccggggcgttcatatagccgcggttggcgctgaagccgtcgcggtagaactccgaagtggtgaagccacggacgttgtactcgaacatcgtcaggccgccgaagttgttctgccgcgagaccccgccggcgaagtccagcgcccgttcgatacgagcgctgtcaaggtcgtcgagcacctggcgcggcaccacgctgatggcttgcgggatgtcctcgatacgggtgtcggtgcgcgtcgcgctggccgtccgattggcccggtagccctgcaccgggcccgccgcgcgctccgcttcggcggtgacagtgaggacctcaagctccgcgggactttccgtttccgcccagagcgccggactgctgcaaccgaggccgacaccgaggacaagcgacacactgactctcatgggaaatcgcaccagaaaagaaatgatatactataa

SEQ ID NO: 10405 - DNA, 1260 bp, Pseudomonas aeruginosa
cgctaccagttcgattccggcctcgcaatacaatgcccggctctatctcgcgtctcgccgccaggctgtgatactcatccctcttttccgacgaccagcccagccatgcccaactccatctccaattcctcccgcctgcacagcatcgacgccctgcgcggcctggtgatgctgttcatgctgctcgaccatgtccgcgagacctttttcctgcaccgccaggtcggcgacccgatggacgtcgccagcaccgagccggcgctgttcctcagccgcaccctggcgcacctgtgcgcgccggtgttcgtcttcctcaccggcctgtcggcattcctctacggcgagaagcaccagggacgccgggcggtctcggcgttcctgttcaagcgcgggttgttcctggtggcgctggaactgaccctggtgaacttcgcctggaccttccagttgccgccgacggtgatctacctccaggtgatctgggcgatcggcctgagcatgctcgccctggccgccctgctctggttgccgcgccctctgctcgcggcgctcggcgtgctgctggtggccggccacaacctgctcgatccgctgcatttcgctcccggctcggcctggcacctgccgtgggcggtgctccacgaccgcggctggatcgaagcgggcgacgccctgcgcctgcgcacctcctaccccctgctgccgtggatcggtgtgatcgccctgggctatgccgcaggcaactggttcagcggcgccacgccggcaaccacgcgccgacgctacctcctggcgggcggtggcgggctgctgctcggcttcatcctgctgcgcctgctcaacggctatggcgagaaaccctgggccttcggcgagacgccggcgatcaccctgatgggcttcttcaacgtcaccaagtatccgccgtcgctgctgttcctcgccctcaccctgggaatcggcctgctgctcctggcctggttcgaacgcctggactggagcggtcgcggcaaggccctggtggcgttcggcggagcgccgatgttcttctacctgctgcatctctacctactgaagctgctgtacctgctggcgctggcgatctggggcgccaaccggggcgactacttcggtttctcctcggtgccggcgctatggctgtgcagcatcctgctggccgtgacgctgtacccggcggtgcactggttcgccggtttcaaggcgcggcggcgggatatcgcctggttgaaatacttctga

SEQ ID NO: 10406 - DNA, 1686 bp, Pseudomonas aeruginosa
catagagccatcattcgcagcgacgctctgccgcgaagaccacgaaagaagcgcgtcatgatgaccgagcacgatgacccgaccctggaccgcctgaagcaccacttcgcccagcgagtgatcaaccaggcgcgccaggttctggaggtctggcaacgcctgacccgcgcggagtggaacagcgacggcatggaagaactggccgacgccaccctgcgcctgcagcgctacgccgaacgcttcgagcaagccgagcatgcccagttggccggtgccatcgaccgtaccctggacgtcgtcgaggccaaccgcggccggctttccagcgagtcgatcagcgaactcaaccagttgatgcagcgcctgtcgcgcaccggcctgcggcatggcgaccagctcgagcacaccgtcctgccgccgttacgcaaaccggtctacctggcactgaaggaccgcgaacgcgccgagcgcctggcccagcaactggagttcttcggtctgcaggcgctgagctgcgagaccgccgacgccttccgcgccagcatgcgcgaacgctacccggcggcgatcgtcatggaagtcgacttcgccggccccgacatgggcctgcgactggccagcgaggcccaggccggcctcgaacacaagctgccggtgctgtttttcagcgacagcgagaccgacaccccgacccgcctggccgcagcccgcgccggcggccaggaattcttcaccggcaccctggacgcctccagcgtgctggaaaagatcgagaccctcagccgcctgagcttctacgaaccctaccgggtactgatcgtcgacgactcccgggcccaggcgctgcacaccgagatggtcctcaacagcgccgggatcatcacccgcgcgctcaccgagccgctgtcggtgatggccgagctgagcgacttccagcccgacctgatcatcctggacatgtacatgcccgagtgcctgggcaccgagttggccaaggtgatccgccagcacgaacgccacgtcagcgtgccgatcatctacctgtccgccgaggacgacctggacaagcagctggacgccatgagcgaaggcggcgacgacttcctcaccaagccgatccgcccgcgccacctgatcgccaccgtgcgcacccgcgccagccgcgcgcgcagcctgaaggcgcggatggtgcgcgacagcctgaccggcctgtacaaccacacccataccctgcaactgctcgaggacgcccgtctgcgcgcacgtcgcgatggccgtccgctgagcttcgcgatgctcgacatcgaccacttcaagcaggtcaacgaccgtttcggccaccccatgggcgaccgggtgatcaagggcctggcgctgttcctcaagcaacgcctgcgcaagaccgaccacatcggccgctatggcggcgaagagttcgccgtggtccttccggacaccgacctggacgccgcgcgcctggtgctcgacgagattcgccagcgcttcgccgagatccataacccggcgcaaccgaccgacctgcgctgcaccttcagttgcggcatcgccgagctgaccccggacctcgatatcaagagcatggccaagcaggccgacgaagcgctgtaccgggccaagcacggcgggcgcaaccggatcgaggtatatcgtcccgacgctcgataa

SEQ ID NO: 10407 - DNA, 546 bp, Pseudomonas aeruginosa
ccgaacggaaataacctgcggtctcgccgttccgtagtcggacgagactcgccatgcgcctcaagcaactcaccaacctcaacaccctgctcctgctcaccgtctgcctcgccctgggaatcaccctgtggtggtcgcaacgcgccatggagcggcccttccagttgctcgaccagtacctggagctgtcgcagcgcttcgacgaacaggtcgcgcgcaacatccgccagtacctcggcagcggcgacgccgtgcgccagcaggccgcgctgcaagccctggaaagcctcgccgaggccttgccggagctaccgccggacctcgcccggaccctcgcgccaagcctcgcggagttgcgcgaattcagcgccggcgacctgctcgccgccggcaagctcgccggcgacccgcagggcctgctgctacaggccgagcgcgacctcaccggcaacctggaacaatggtccgcctacctggacgccgcggcggggcagccccaggccggcgcctaccgcaccccgctgctgctcgccagcctgcacctga

SEQ ID NO: 10408 - DNA, 1074 bp, Pseudomonas aeruginosa
tgggcatgttcggcgccagcctcaatctccaggcgcaattgcagtcaccctgggtactggtgccattcgcggcgtttcttcgcgctgttcgccgtggccatgttcggcttcttcgagctgcgcatgcccggcttcatccgcgaaccgctcgaccgcctggccggcgatgcgcgcggcggctcgatcctcggcgcggccaccctcggcgtgctttccagcctgctggtctcgccctgcgtctccgccccgctggccgcctcgctgctctatatcagcgccagcggcgatgcctgggggggcggcctgcaactgttcgccctcggcctgggcatgggtacgccgctggtggtgttcggcgccggcggcggcgccctgctgcccaagagcggagcctggatgaacggcgtgcgcaacgccttcggcgtgctgttgctggcggtcgccgtgtggctgctggagcgggtggtgtccggcccggtggcgctgatgctctggggcatgctcgccggcggcgccggcctggccctgggcgccctcgaattcaccccgaagagcgccgcacgccgcctgctgcaactgcttggcctgatgttcctgacctacgcggtggccgcctggatcggcgccctgcagggcgagtcggacccgatccatccgctgggccgctcggtgccgtcgatccatgccgggccgccgagcacgcccggcgaatggcagaacctgaccaccccggcgcagttggacgccgccctggccgaggcacgtcaggccggcaagccggtgctgctggactggtatgcggactggtgcatcagttgcaaggtcatcgagcgccaggttctcaccgatcccacggtgcaggcacgactgccggcctaccgcctgctgcgcttcgacatcaccgaaagcaacccggcccagcgcggcctgctggaccgctacaacctgttcggtccgccggcgatcctgttcttcgccccgggcggtgacgaatggagcgacttgcgcgtcatcggagagatcgacgccgccgggctcgccgaacgactgcgccgggccgctacccggcagtga

SEQ ID NO: 10409 - DNA, 1398 bp, Pseudomonas aeruginosa
gttcgaccagccgctgttcaccatcgtctaagccgcggggaacctgcgatgttggaaaaagtgctgatcgccaaccgcggcgaaatcgccttgcgcatccttcgcgcatgcaaggagctggggatcaagacggtggcggtacactccaccgccgaccgcgagttgatgcacctgtcgctcgccgacgaatcggtgtgcatcggtccggccccggccacccagtcgtacctgcagatcccggcgatcatcgccgcggccgaggtcaccggcgccaccgcgatccaccccggctacggcttcctcgccgagaacgccgacttcgccgagcagatcgaacgctccggcttcaccttcgtcggcccgaccgccgaggtgatccgcctgatgggcgacaaggtctcggccaaggacgccatgaagcgcgccggcgtccccaccgtgccgggctccgacggcccgctgccggaagatgaagaaaccgccctggcgatcgcccgcgaggtcggctacccggtgatcatcaaggccgccggcggcggcggtggtcgcggcatgcgcgtggtctacgacgaatccgagctgatcaagtcggccaagctgacccgcaccgaggccggcgcggcgttcggcaacccgatggtctacctggagaagttcctgaccaacccgcgccacgtggaagtccaggtgctttccgacggccagggcaacgccatccacctcggcgaccgcgactgctccctgcagcgccgccaccagaaggtgatcgaagaggcgccggcccccggcatcgacgagaaggcccgtcaggaagtcttcgcccgctgcgtccaggcctgcatcgagattggctaccgcggcgccggcaccttcgagttcctctacgagaacggccgcttctacttcatcgagatgaacactcgcgtgcaggtggagcacccggtatctgagatggtcaccggtgtcgacatcgtcaaggagatgctgcgcatcgcctccggcgagaagctctcgatccgccaggaggacgtggtcatccgcggccatgcgctggaatgccggatcaacgccgaagacccgaagaccttcatgcccagcccgggcaaggtcaagcacttccacgcccccggcggcaacggcgtgcgcgtcgactcgcacctctacagcggctacagcgtgccgccgaactacgactcgctggtcggcaaggtcatcacctacggtgccgaccgcgacgaggcgctggcgcggatgcgcaatgccctggacgagttgatcgtcgacggtatcaagaccaataccgaactgcacaaggacctggtgcgcgacgccgccttctgcaagggcggggtgaacatccattacctggagaagaaactgggtatggacaagcactga

SEQ ID NO: 10410 - DNA, 750 bp, Pseudomonas aeruginosa
gaccgccctgctcgcccacctcgccttgcttaccggcggcgacctgcccgagcaccatgtcgaggaaatcgccgaccaggattgggaacgcagctggatggacaacttccagccgatgcgtttcggccgccgcctgtggatcgtgccgagctggcacgccgcccccgagccggacgcggtcaacctgctgctcgatccgggcctggccttcggcaccggcacccacccgaccaccgcgctgtgcctggaatggctcgacggccaggaactggccggccggcaggtgctcgacttcggctgcggctcgggaatcctcgccatcgccgcgctgctgctcggcgccgaacgggcggtcggcaccgacatcgatccacaggccctggaagcctcgcgcgacaatgcctcgcgcaacggtatcgagcccgcgcggttccctgtctacctgccggcggacctgccgcagcgacaggccgacgtgctggtcgccaatatcctcgccggcccgctggtttccctcgccccgcaactgaccggcctggtacgtcccggcggcctgctggcgttgtccggcatcctcgccgagcaggccgcggaggtccgcgcggcctactccgcacacttcgatctcgacccgaccgccgagcgcgaaggctggatccgcatcagcggccgccgccgcgccgattgatggcgcgccgccagccaccactgatcccgccccactgccttcgtgcaagaagcttggggtag

SEQ ID NO: 10411 - DNA, 1311 bp, Pseudomonas aeruginosa
actagccgccggattttccctacggatcgccgcatgagcgaaagcgtcatcacccaatgtccccattgcagcaccagtttccgcgtcaacgacgcgcaactgggcgccgccaatggcgcggtccgctgcggcacctgcctgaaagtcttcaacgccctgcaacaccaggtcggtggcgcgccgcgcgcgaacgctccttcggcagccgaagcgaagccggccgccgctccgccacctgcgcccagcgtcgcggccgccacctcggccgcgcccccggcagcgcgcccgcgcgacgaaaccctgtggatccatgacgacctcgacctggacagcctcaacctcgacgaggaactggccaagctcgacgaattcgagctgaaccaggaattctccagcatcgagaaggccccgcgaccggcggaaagcctgctggcgcgccgcgacgacgaacgcgatccacatgacgaacgctgggccgaggcgctgatcgccgatgccgaaccggcccagccggcgcgcggcaatccgcgccaggaaccgagcctcggcgaaccgctggcggaagagcgggtatccttcgtgccgctgcgccgcgccgaggatccgccggaacttcgcctcattctcgatgacgacgatgacgacgagcccagcctcggcaagcgccgccacggcctgagcgccctggatgaagacgacgaggaaagcgccgaggaacagtccgtcgcgcccctgggcagcgcccgcaaaccggacgaggcgccggtcgagagtctcgaccagttgcgcgacgagccactgcaactggcctgggagaagccccggcgccaatggccgcggcgtctcggctggctgctgctgatcctgctggcgctgggcggtctcgccgctcagtacatcgcctaccatttcgacgaactggcgcgccaggacgcctatcgcccctggttcgcccagctctgcccggaaatcggctgcacccttccctccaaggtcgacgtggagcagatcaggagcagcaacctggtggtccgcagccatcccgaattcagcggcgcgctggtggtcgacgcgatcatctacaatcgcgccagcttctcgcagccgttcccgctgctggaactgcgcttcgccgacctcaacggccacctcatcgccaatcgccgcttcaagcccggcgagtacctcggcggcgagctggccggacgaacggaaatgccaccgcaggtaccgatccacgtgtcgctggacatcctcgacccgggtccgaaggcggtgaactacagcctgagcttccattccccggagtga

SEQ ID NO: 10412 - DNA, 726 bp, Pseudomonas aeruginosa
tcggtcgggccgcccagggaagaccgtggattttccgcgagatcgaccattacctgcggaccggcgagcacctgccggcggcgccgcttcccgaagtgcagagcatcctgctcgaacacctcgcggagctgcaccttttttatggggaagaaatgggtgtgcggatcgcccgcaagcatgtggggtggtatctcgcgactctgccgggcgcaagggaattccgcgcccagttcaatcgtttgcaggacacggatgcgcagtgcgccagcgtcaggcagttcttcgccgagcgccagaacaacggaacaggggtggccgcatgacaacgatgacgaccgagactttagtgagtggaacaacgcccgtgagcgacaacgccaacctgaaacagcacctcaccacgccgacgcaagaagggcagaccctgcgcgacagcgtggagaaggcattgcacaactacttcgcccacctcgaagggcagccggtcacggacgtttacaacatggtgctctgcgaagtcgaagcgccgctgctggaaaccgtcatgaaccacgtcaaggggaaccagaccaaggcctccgagctactcggcctgaaccgcgggaccctgcgcaagaaactcaagcaatacgatcttctttaagagcggcggcgggctccggccaagggcgcgcgtcccggccggcacccgcggccggaagccagccctcaggacccttgcaatga

SEQ ID NO: 10413 - DNA, 1377 bp, Pseudomonas aeruginosa
gcgcgatgcggtcagccgccctacccacgaatttcacgcagggcggataacgcggcgcgttacccgccgttgcgccaggagaaccccatgaacgtactcatcatcggcagcggcggtcgtgaacatgccctggcctggaaagtcgcccaggacccgcgcgtggcgaaggtcttcgtcgccccgggcaacgccggcaccgccaccgaagccaagtgcgagaacgtcgccatcgacgtgctggccctggagcaactggccgacttcgccgcgaagaacgtccagttgaccatcgtcggtcccgaggcgccgctggtggcaggcgtggtcgacctgttccgcgagcgcggcctggatatcttcggcccgaccgccggcgccgcccagctggaaggctcgaaggccttcaccaaggacttcctcgcccgccaccggatccccaccgccgcctatcgcaacttcaccgaggtcgagccggccctggcctacctgcgcgagcagggcgcgcccatcgtcatcaaggccgatggcctggccgcgggcaagggcgtgatcgtcgccatgaacctggacgaagccgaagccgccgtgcgcgacatgctcgccggcaatgccttcggcgacgccggctcgcgcgtggtgatcgaggagttcctcgatggcgaggaggccagcttcatcgtcatggtcgacggccagaacgtgctgccgatggccaccagccaggaccacaagcgcgtcggcgatggcgacagcgggccgaacaccggcggcatgggcgcctactcgccggccccggtggtcaccgccgaggtccaccagcgggtgctggacgaagtgatctacccgaccgtgcgcggcatggccgaggaaggcaacgtctataccggcttcctctatgccggcctgatgatcgacaagagcggcgcgcccaaggtcatcgaattcaactgccgcttcggcgatccggaaacccagccgatcatggtccgcctggagtcctccctggtcctgctggtcgaggccgccctggccaaggcgctggacaaggtcgaggcgacctgggacccgcgtccgaccgtgggcgtggtactggccgccggcggctatccgggcgactacgccaagggcgaggtcatcgaaggcctggccgaggccgccgcgctggacggcaaggtgttccacgccggcaccgcgctgaaggatggccaggaggtcacctccggcggccgcgtgctctgtgccaccgccatcggcgagagcgtgtccgccgcccagcaacaggcctatcgcctggccgagaagatccgctggaacggctgcttctaccgcaaggacatcggctaccgtgccatcgcccgcgagcgcggcgagtcctga

SEQ ID NO: 10414 - DNA, 2910 bp, Pseudomonas aeruginosa
tccggccattcaccttcgaagggacttcgccgtggtacggcttcggatcgccataggactactcgtcagcttcctgctgcttctgctcggtccgatgtcgccggcggtcgcggacgacgccggcgtttccagcgttcccctgcaaaccaccgccaccacccccagcgtcaaccagaactggcgcctgctgcgcgacgagagcgcgcaactgcggatcgccgacgtcctccagcgcaaggagcagttccgcccgctggccaagcgctccttcatcttccccgccagcccccaggcggtctggctgcaggtccagcttcccgcgcagaaggtgccgagctggctgtggatcttcgccccgcgggtgcagtacctggactactacctggtgcaggacggccaactggtgcgggaccagcacaccggcgagtcgcgaccgttccaggagcgcccgctgccctcgcgctcctacctgttctcgctgccggtcgacggcaagccgatgaccctgtacgtgcggatgacctccaaccatccgctgatggcctggttcgaccagatcgacgaagccggcctggtcggcctggagaagcccgcctacgccttcggcatgctgctcggcggcatgctcctgctgctgatgtacaacctgatccgcttcgcctactcgcgcagcgccagcagcctgtggctggcggcggtgcacgcggcgctggcggtctgcgccgcggcgaacctggggctggtggcgttctggctgccgggactcaagttcaaccagtcgctgaccgccgacctcggcgccctcggcgctgcggtgagcctgctgtggttcgcctgcagcttcttccgcggcactgcggaaagccgcctgaaccgcctcctgcaaggcgaggcgctgttgatcctggcggtcggcgcgatcatcgccttcacccagcaactctggttcagctggctgatctacctgctggtgatcctcagttcgctcagcgtcccgctgatcgcggcctggcactggtatcgcggctaccagccggcgcgcctgatcgttgccgggatgatcgtgttcaacgccggcttcatggtgttcctgccggtactgttcggcaccaagcaactcgatccgggctggctggtgctcggcgtgttcagcttcgccaccctcgccgggctggtcctgagcgtctcgctcaccgaacgccagcggctgatccagcagctcaacctgcaacagcgcaccagcgaggcggcgcacaccgcggaattgcagaccaaggccgagttcctggccaagatcagccacgagatccgcacgcccatgaacggcgtgctgggcatgaccgaactgctcctcggcaccccgttgtcggcgaagcagcgcgactacgtgcagaccatccacagcgccggcaacgagctgctcacgctgatcaacgagatactcgacatctccaagctggagtccgggcagatcgagctggacgaagtgcagttcgacctcaacgcgttgatcgaggactgcctggatatcttccgggtcaaggccgagcagcagcgcatcgagctgatcagcttcacccagccgcaggtgccgcgggtcatcggcggcgatccgacgcgcctgcgccaggtggtcctgagcctgctggacaacgcgttcaagcagaccgaggaaggcgagatcctgctggtggtggccctcgacgaccagggcgagacgccacgcctgcgcatcgccgtgcaggacagcggccacccgttcgacgccaaggagcgcgaggcgctgctcaccgccgagctgcacagcggcgacttcctttccgccagcaagctcggcagccacctcggcctgatcatcgcccgccaactggtgcggctgatgggcggggagttcggcatccagtccggcagcagccagggcaccaccctgtcgctgaccctgccgctcgacccgcagcagctggagaaccccaccgccgacctggacggcccgctgcagggcgcccggctgctggtggtggacgacaacgaaacctgccgcaaggtgctggtgcagcagtgcagcggctggggcctgaacgtcagcgcggtgtcgtccggcaaggaggcgctggcccagttgcgcaccaaggcgcacctgcgcgagtacttcgacgtggtcctgctcgaccaggacatgcccggcatgaccggcatgcaactggcggcgaagatcaaggaagaccccaacctcaaccacgacatcctgctgatcatgctcaccgggatcagcaacgcgccgagcaagatcatcgcccgcaacgccgggatcaagcgcatcctggccaagccggtggccggctacacgctgaaggcgaccctcgccgacgaactcgcccagcgcggcgtcagtggcgtcaccaactacctgcaaccggccaaggaagcgcaggcgccgagcctgccgagcgacttccggatcctcgtcgccgaggacaacagcatctccaccaaggtcatccgcggcatgttgaacaagctcaacctccagccggacaccgccagcaacggccaggaggcgctcagcgcgatgaaggcgacccagtacgacctggtgctgatggactgcgagatgccggttctggacggcttctccgccaccgagcagctccgcgcctgggaagcccacgaacagcgcccgcataccccggtggtggcgctcaccgcgcacatcctcagcgaacacaaggaacgcgcgcggctggtcggcatggacgggcacatggccaagccggtggagctgtcgcaattgcgcgagctgatcgcctactgggtcggcgaacgcgatcgccgccgccagggcgacgccctgccctcctgagggcagcgacgtgctccagcgctgcacccggcctccgccacggcggataa

SEQ ID NO: 10415 - DNA, 1509 bp, Pseudomonas aeruginosa
aaacgcagccttccccggcatagccagacctgctcggcatgcttccccggcgactcgcggcgccttttcgccgaccgataccggccagcgccaagaagaggcacagcctttgctctggagcctcgacgaagagatccaggccgcagtgcgcaccccgccgtccaccggacggatgcccgacgacaagcacgacgcctcctgaaaactgccgccccgaccgctggtgaatggagaacaacaccaatgaaacgtcgcagtctgctcaaggccttcacgctgtccgcgtccatcgcttccatgggcctgtcctggtccatccaggccgccgaaaccatcaaggtcggcatcctccactcgctgtccgggaccatggcgatctccgagacctcgctgaaggacatggccctgatgaccatcgacgagatcaacgccaagggcggggtcaacggcaggaagctggaggcggtggtggtcgatcccgcgtcgaactggccgctgttcgcggaaaaggcccgccagttgctgacccaggacaaggtcgcggtggtcttcggttgctggacctcggtgtcgcgcaaatcggtgttgccggtgttcgaggaactcaacggattgctgttctacccggtccagtacgagggcgaggaactctcgccgaacgtcttctataccggcgcggcgccgaaccagcaggcgatcccggcggtggagtacctgatgagcgaggacggcggcggcgccaggcgcttcttcctgctcggcaccgactatgtctacccgcgcaccaccaacaagatcctgcgcgccttcctgcacagcaagggcgtggacgacaaggacatccaggaggtctacacgccgttcggccacagcgactaccagaccatcgtcgccgacatcaagaagttcgccgcaggcggcaagaccgcggtggtctccaccgtcaatggcgactccaacgtgcccttctacaaggaactggccaaccagggcctggaagccaccgaggtgccggtggtggccttctccgtaggcgaggaagaactgcgcggcatcgacaccaagccgctggtcggcaacctcgcggcatggaactacttcgagtcggtgagcaatccggtcaacgagaagttcgtcgccgactggaaagcctacgccaaggcaaagaacctgccgaactacggcaccgcggtgaccaacgaccccatggaagccacctacgtcggcatccacatgtgggcgcaggccgtggaaaaggccggcagcaccgaggtcgacaaggttcgcgaggcgatggccgggcaaagcttcaaggcgccatccggctacacgctggtcatggacaagagcaaccaccacctgcacaagccggtgatgatcggcgagatccaggacgacggccagttcgaagtggtttggaagacccccgagccgcttcgcgcgcaaccctggagcccgttcatcccgggcaacgagaaaaagccggagcatgcgctgaagagcaactga

SEQ ID NO: 10416 - DNA, 363 bp, Pseudomonas aeruginosa
cccagaaccgcaacatggcggcctgctgcggggtgcccacagggcgcgtggacatgctcgccttcggtctcggctcgggcatcgccggggctcggcggggtagccctgtcgcaggtcggcaacgtcggcccggacctcggccagggctacatcatcgactccttcctggtggtggtgctcggcggcgtcggccagctcgccggcagcgtcctcgccgccttcggcctcggcgtggcgaacaagatcctcgaaccgcagatcggcgcggtgctgggcaagatcctgatcctcgcgctgatcgtcctgttcatccagaaacgcccgcagggactgttcgccctgaaagggagggtcatcgattga

SEQ ID NO: 10417 - DNA, 1041 bp, Pseudomonas aeruginosa
acggcgcgaatagctggttcaccgtggccttcccggaatactggctgttcttcctcggcgcgctgttcatcgtcgtcaccctgtacctgccgcgcggcctgctcggcctgctgcgcaaggagaaggagcaatgaggaccaccccgcacctgatgctcgaaccggccttccaccccggcctcgataccgccggcagcggccgcgacgccatcggcctgggcgccgccaccagcggccggctggacgcgcgccacggcaccatcctcagcctggaagacatcaacgtcagcttcgacggcttcaaggccctgcgcgacctgaccctgtacatcggcgtcggcgaattgcgctgcatcatcggccccaacggcgccggcaagaccaccctgatggacgtgatcaccggcaagacccgcccgcagagcggtaccgcgtatttcggcgacaccctcgacctgacccgcatgagcgaggtgcagatcgcccaggccgggatcggccgcaagttccagaagcccacggtgttcgaggccctgagcgtgttcgagaacctcgaactggcgcagagggccgacaagtcggtgtgggccagcctgcgcgcgcggctcgacggcacgcagagggaacgcatcgaggaggtgctcgccaccatccgcctgctggagtcgcggcagcgtccggcgggtttgctgtcccacggccagaagcagttcctcgagatcggcatgctgctggtgcaggaaccgcagttgctgctgctcgacgagccggtggcgggcatgaccgatgccgagaccgaattcaccgccgagctgttcaagtccctggcgcgcaagcactcgctgatggtggtggagcacgacatgggtttcgtcggcagcatcgccgaccatgtcaccgtgctgcaccagggccacgtgctggccgaaggctcgctggcggaggtacaggccgacgaacaggtgatcgaggtctacctcggtcgctgacgccagccatccgctcggcgggtagcgcctgccaagtggcgcccgtcgcgtag

SEQ ID NO: 10418 - DNA, 990 bp, Pseudomonas aeruginosa
cggaaaacatcgagctctacgccagggtcggctacctcgaatacgaacgccgccaggaagagggattccgccgcgtgttcatgcgcaaggccctggcctgacccgaccgatgaccgccgccctccccgacctgagcttccaccccgcctggcacgcccaactggagctggcctacgcccgcgccggcgacgccacccgcccggtgacgcggcgccactccggaccgctgcgggtgcagaagcacctctacgccgaaggcccggaagtctgccagcacatcctcgtgcatccgcccggcggcatcgccggcggcgacagcctggccttcgacgtgcgcctcggcgaacgcgcctgggcccagctcaccagccccggcgcggccaagtggtaccgcgccgcctgcccgtcgcggcagaccctggagatccacctggagcccggcgccaccctggaatggctgccgcaggaaagcatcgtcttcgccggcgcccaggccgaactggaaacccgtatccagctgcgcggcgacgcccgcctgttctactgggacatggtcgcgctcggccgcccggccagcggcgagcgcttcgtcagcggccacttcgtcgcggccctggacatccgtcgcgacgaccgcctgctctggcacgagcgccagcgcatcgacggcggcgaccgcctgctcgactcgccgatcggcctcgccgggcatccggtgctggcgaccctggtcgccagcggcgagatcgacaccgacctgctgcaacgctgccgcgcgctcccctgcgccggccgcggcaacctcagccagttgcccggcggcctgctggtggcgcgctgcctggccgacgaggcgctgcacgcgcgagcctggctgatcgaactctggcgcctgctgcggccggcgctgctcggccgcgaggccgttcccccacgcatctggagtacctgagatggacttgtccccccgcgagaaagacaagctgctga

SEQ ID NO: 10419 - DNA, 570 bp, Pseudomonas aeruginosa
ccgtccaccagcccatcgcctgaggccggccatgagcgcttcgatccgcgacgccggcgtcgccgacctgcccggcatcctcgccatctacaacgacgccgtgggcaataccacggcgatctggaacgaaaccccggtggacctggccaaccgccaggcctggttcgacacccgcgcccgccagggccacccgatcctggtggcgagcgacgccgccggcgaagtgctcggctacgcctcctacggcgactggcgacccttcgagggcttccgcggcaccgtcgagcactccgtctacgtgcgcgacgaccagcgcggcaaaggcctcggcgtgcaactgctgcaggcgctgatcgaacgtgcgcgggcccagggcctgcacgtcatggtggccgccatcgaaagcggcaatgccgcctcgatcggcctgcaccggcgcctcggcttcgagatcagcgggcagatgccgcaggtgggccagaagttcggccgctggctcgacctgaccttcatgcaactgaacctcgacccgacgcgcagcgcgccctgagccccaaggagcccccatga

SEQ ID NO: 10420 - DNA, 1410 bp, Pseudomonas aeruginosa
cggcgacaatggcgcctacccgtagccgccggcagtccgtccatgtcctcccgccaatcgtcccgcaacgcttccaccccgtatctggccaaggccttccaggcaacggccatcgtcgtggtgagctacttcctctactggacctaccagctctaccagtacggcgagattcccatcagcaagaaggacgtgatgctgcgccaagccatcctcgcgcgctttccggcggactacgaggtggagatcaagggcgccgacctgctcggcttcggcgagaaattcctggtcgcctacggcaatcggcgcttcgtcggcaaggccttcgccatggacgaccaggtcatcgagcgcctggagcggaaccagggacggaccaacctgccgctggtgaaggtgttctacatcgccgaacccggcctcctctcctcgctgctcaacctctccccgttcctggatatccagaagaacatggtcgagctgagcctccgggaataccggaagatccagttggtccccttcgatccggacgcgaagcggaaaccgcgcgagcagttcgaaaccgattatgccttcccccagctgttcagcctcagccaaatggaagtcgccgactacgacggcgacggccgcgacgaactgcgcctgggctacctgtcctacgccggcggttcgggagggacgcgctggtcggtgatctacgacctgaaggacggcgcgctgaccgcccattccggctatccggaaatgctcgacatcgacgtcgcccggttcatccaggcggtcaacctgtacgccggcctcgacggcaccctgccacgcgaccagcgtcagctggaagacgtggtcggccgaggcagcgagcgcttcgcgctgaccgccgcggagcgccaggcactggtcgccgacccgccgcagcgggacgactacgccagggtcctgatgagcctttcgccgcgctcgccctacgcccccgatcgcttcatcgacctcggcgacggcagccgactgagcctggccccgcgccataccgacgattactcgaccttcctcgacatcggcgggaagaaaatcttcgtcgaagccttctacgtcgacgacgacgcctgccactggtgcgagcatcgctggcgagtgatggctttccattacgacgacggtcgctggatctcggaccgcaccatcaacggcgacagcttcaacgggcaatggctgcgcaacgcggagccgctgggcctcaacgacgttttcggcacctaccgcgaccagggcccggcgggcctggcctggtccttcatcgacccgcgctggaccgcctccagccagcatgacatggacgatccgctgggcgtgggaatgcgcaccctgtcgccggtggagcaatgggtgaaggaacgctatcgggaaaactga

SEQ ID NO: 10421 - DNA, 1419 bp, Pseudomonas aeruginosa
caccatgcgcaggccccttggcaaatccgtatacaaaggtcggggcggcccgcacggacgtcccaggacgcttcctgccgatcgccggcggtgaaatctacgacgctctcgcatacactgcgcggccgtttttttcccggaccgtttcgcgccatgaacccgagcaccgccgcccgcgccctgggcatcgattttggcacctccaactccaccgtcggctggtggcggccggaggtcgaaccgctgatcgagctggaggacggcaagatcaccctgccctcggtggtgttcttcaacgtcgaggagcgccgcccggtctacggccgccaggcgctcggcgagtacctggagggctacgagggccggctgatgcgctcgctgaagagcctgctgggctccaagctgctgaagagcgagaccaccgtgctcggcagcgccctgccgttcaaggacctgctcggcctgttcatcggccagctcaaggcgcgcggcgaggccgccgccgggcaagccttcgacgcggtggtgctgggtcgcccggtgttcttcgtcgacgacgacccggaggccgaccgcgaggcccaggacaccctggtgcaggtggccaacaagctcggcttcaaggaggtttccttccagtacgaaccgatcgccgcggccttcgactacgagcgctgcatccagcgcgaggaactggtcctgatcgtcgacatcggcggcggcacctcggacttctccctggtgcgcctggcgccggagcggcgcaacctggccgagcgccaggacgacatcctggccaccggcggcgtacacatcggcggtaccgacttcgacaagcagctcagcctggaaggcgtgatgccgctgttcggctacggcagccggatgaagagcgacgccttcatgcccaccagctaccacctgaacctggccacctggcacaccatcaacgcggtgtacgcgcagaagtcgcaattggcgctgaagaacatgcgctacgacatcgtcgacagcaccggcatcgaccgcctcttcaggctcatcgaggaacgcgccgggcactggctggcgatgcaggtggaagacagcaagatccgcctgaccgaaaccgagcgcctgcacctctcgctggagcgcatcgaggccgggctcggcgtggagctgacccgtgggctgttcgagaacgccgtcgacggactgctggagcgcgtgcgcaacagcgtcgcgcaactgctggcctcggccggggtcgacccggaccgggtcgacacggtgttcttcaccggcggttcgagcggcattccggcgctgcgccggagcgtctcggcgatgctgcccaacgcccgtcatgtcgagggcaacctgttcggcagcatcggcagcggcctggccatcgaggcgaagaagcgctacggctga

SEQ ID NO: 10422 - DNA, 690 bp, Pseudomonas aeruginosa
actgacgcctcgcacgaggaggagttccatgcaacaggtcatcgcggtgagcctctgcgccacccacgcgttcagcaagcaggtgcgtcccgccatccgcctcctgaaaggcctcggcgtcgagggcgacgcccaccacggcgtcaccgtgaagcaccgctcgcgggtgcggcaggacccgacccagccgaacctgcgccaggtccacctgatccacgaggaactgcacgacgagctacgcgccagcggcttcgccatcggcccggggaccatgggcgagaacatcaccacccgtggcgtcgacctgctcggcctgcccaccggcacccgcctgcgcctgggggaaagcgccctggtcgagctgaccggcctgcgcaatccctgctcgcagctggacaactaccagcccggactgaccgccgccgtgctcggccgcgacgaacagggcaacctgattcgcaaggccggggtgatggcgatcgtcctggaagacggcgaggttcgccccggcgacgccatcgatatccagctgccccccttgccgcaccgggccctggagaaggtctgaggcaatccgccgcgattccgggcgaactctgcgcgagggcctgcgttccaatgttggcaagcaccgctcaaccacaaggagtcacagcatgtacaagcagtcactggcggcactgttcgtga

SEQ ID NO: 10423 - DNA, 1926 bp, Pseudomonas aeruginosa
aacgcgatggcgcgctggacgacccgcaacgcctgcggcatttcctgcaacgacaccagcacaccctgcgcgaagagatcagcgcccgccagcgcctgctggcggaactcgaccgaaccctggcgacgctcgcccactggaggatccgcaacatgcatgcacgaatcgtcgaacgtcccgccttcagcgtggtgggcatggaatacttcggcagcgcccccggcgacaccatcggccagctctgggaacgcttcatcccgcgcgagcacgagatcgccggcaagcacgatcccgaggtctcctatggcatctgcgcgcagcagcccaacggcgaattccactacgtcgccggcttcgaggtgcaggagggctggccggtgccggagggcatggtgcgcttccaggtgccggcgcagaagtacgcggtgttcacccacaagggcacggcgccgcagatcgccgagagcttccaggcgatctacagccacctgctcgccgaacgcggcctggagcccaaggcgggggtcgacttcgaatactacgaccagcgtttccgcggaccgctggatccgaactcgcaagtcgacctgtatatccccatctactgaatcagcgcttgccggccggcaccttggccggctggcgcatgcgttgcagcagggcggtgcactggttgtcgtcgctcttgctcggcgccaccagcgccagcaggctggccgccgggcccaccgccacgccgagggcgatcattcccgcgccgcgcgccaccagcggcccggcgtggaccccggcgtcgggcttggcgaaggtgccgcgcacgtacagcggcgagcgcagcgagaagatccgcaggcccttgctgtgcggggtgacatcgaggtcgagcttctcgttggcgaagttcaccgtgccgtcgacgttgaccagcgcgttctcggtgtcgaagacgaacagccggctggtcatcaggcccttctgcaggccgaagtcggcggccgcgcagttgatcttcacctcgtcgtcgccgaacagcttggtcaccaggtagtttccgacattgaggccggcgatttcggtcaggcctttgctgatcgcaccgtcgttgatcagcatcttcaattcgccatcggcgccgccgaggatcttcgccaccgaattgccactgccgctgagactggcgtcgccgttcagctcgccgaagctggtctgcatcggcgcgaagccggggaacaactgcttcagcttgaagccccgcgcgctcatcttcactcggctctgcatcggctgcttgccgccgtccaggcggatgtccgactccagcttgccgccggccacaccgaagcgcaggggctccaggcgcagcaggccgtcgttgagcaccagatgggtatagaggtcgctgatcggcaactggtcgctgtgcacgatacgcttgccggtgaattccacgtcggcgtccatgtcgcgccagcgctcggtacggaattcctccaccggcagcaccttgtcgcccggctggcggctggtctgcccgcgcttctgtttttcggcattgctgtcggcgccgatcagcgggccgaggtcggcgaagcgcagttgctcggaggtcagcttgccggacagcttcggcctaggctggcgagcgacgaaggtcaggctgccgtgcaggtcgctggcgccgaccttgccgttgaagttctcgtagcggaacagtgcgccgccctcctccttgagccgcgccagcaggtgtccgtcggtggagtaggccggagtgtccggcagggtgatgccggtcagcggatagagattggccatgctggtcccggacagcttcaggcgcaggtcgagggcgccgaggttgagcgggtcggtcagggtgccgaccaccgcggcacgggtgctgccggcactgacctcggcctgtag

SEQ ID NO: 10424 - DNA, 987 bp, Pseudomonas aeruginosa
cgggaagggcttgctcgcatcctgcaacgccagcatcccgccgaccttgcccgagccggccagagcctggcccttgtaggtgcccttgaccttccagccgaacacatagtcctgggcgttcgccgcatcgcccgtggccagcgccttgccggccaactgaccgaacggcaccggcttgccgagcgggtcgaccagcacttccagacgggtcttcaaacgctggtcgtcgaggctgacgctacccttgtcgaaaccgatctcgcggatgtccagttgccaggcggacggctcgtcgctgtcgctggcaggcaggtcgaaatcccaattggcgcggccgtcggccaggcgcaggagctcggcgcgcggctgggtcagcttgatctgtggaatgcggatggtctgccagagcaacggcaacggcgcgaggcggaattcgatgcgttccaggctggcgaactcgctcgccttggtcttgcccgccgtccactccgggttgccgagggtgatgtcctcggcgctgaagcgcggccaggggatccaggcgcgccagccttcctcgccctcctcgcggcgccaggccacggcgaggttgccgttgatggcgaacgggcggttcagcgccgccgagaccttttcgttgagggtgggcttgatcaggttccagtcgaaggtggcgatgaacaccaccaacgccgccagcagcaggaccaggctggcgaggctccaggtcaggatctttcggccgcgcgtcatgcacaactccttttcgccgcgtcggttgtcgggcaggcgcggcagcgcgcctcgctcagcccgtcagtgtgcaggctggcccatggactcgccagcgcgaatacgccggcccgttccgttaggaccggcgaaacgccggcattgctccccgtcccacgcatttcaggcaaaaggccagttcggcggcgggtcgataaaactttttcgaccgcgtgggactcacaccttaggtaa

SEQ ID NO: 10425 - DNA, 465 bp, Pseudomonas aeruginosa
ataataagaaaacacataatcacccatgtcgatagacactatcatcgcacttcgtttttaaatcgacttatccgaactgaaaatgactccaacgcaatcgacaacccactcggagtcaccgtcatgaaagcttccctgatcctcggcctcgccctcgccaccctgaccgccaacgccgccttcgccgccgacggctccagccgcaccatcgaccggctgcacaaggatatgtccagcgtcgaactgcgcatcgccgacaacggcagcgagcagaccatcgaccgcctgcacaaggacatgaccaaagccgaagcccgcctggccgacgacggcagcgagcagaccgtcgaccgcctgcacaaggacatgaccaaggccgaagcccgcctggccgacaacggcagcgaacagaccgtggaccgcctgcatcgcagcatgagccgtttcgacctgcgcaccgcctga

SEQ ID NO: 10426 - DNA, 525 bp, Pseudomonas aeruginosa
tcatcggcagcagggtgcgcggcaccaacagcaccagcagcaggtgcacgacgacgaacccgacgaccccggccatggccaggaaatgcacccagcgcgccccctggaagccaccgaacagcgcggtcagcccgtgcagttgcaccggtttccagatcgccagcccggacagcaccagcagcgcgccgagcgccaggaccagccagtacagcaggcgctgcaccgcgttgtagcggcccggctcatggaccaggcgcaggccgagggcgaggcgcaggtcgcgccagacgccggccgcgctcaaaggcaggaagtcgcgacgaaaatgcccgctggacagtccgtgggcgaggtagcacaggccgttgccgagcagcagccacatggcggcaagatgccaggcgatggaaccgccgagccagccgccgagggtcgcccaggcgggaaaacggaaatccagcagcggcgaagcgttgtagatgccccagccgctgccgaccaggcaggccatggcataggcattga

SEQ ID NO: 10427 - DNA, 804 bp, Pseudomonas aeruginosa
tccataccgtgcgcggcatcggttacgtctgcgaggagcgcccgtgcccgcccgccgctccctgaccctctacgcggcgctgctgttcgccgcggtggcggcgctggtggtcagcgcggtcggcttctacctgtaccgctcggtggaagaggcgatgctgcggcgcagcgacgtgatggtcgccggccgggtcgagcacttccgcaacctgctgcgcgacaacctcaccctggccgagctgaaggcgcgcccgcgtctgttcgagaacatgctcggcaacgagcaggacatcctgctcctcggtcagcccggcgaggcgccgatcgtcgcggtcaacccgcgccacgaacgcctgccgtcgctacgggtggtcgccgccggccaggcgttgaatccgtccgtcgtgcacgccgcgctgacccacgacggcatcccgatgcgcgtgctcgccgccgaggtcctggtcggcggccgcgagccgttgcagatcaccgccgcacacctgctgctgggcgagacgcggatgctcgcccagtaccgcgaccgggtcatcgccgccgtgctgctggcgttccttggcaccgccctgctcggctggctggtcctgcgccacggcctgcgcccgctgcgcacgctggcggcgaaggcggcggagatccatccgaccagcctggatacccgcctcgacgtcgccgccgcgcctgccgagttgcagcaggtggcacagtcgttcaacgccatgctcgaacgcctagacgacggctaccagcgtctgcagcagttctccgccgacctcgcccatga

SEQ ID NO: 10428 - DNA, 2661 bp, Pseudomonas aeruginosa
gatccgcacgcccatcggttcgctgatgggccacggccaggtggccctgcgccagccgcgcagcaacgaggagtaccaggcgctgatcgcctccaaccaggaagagctggagcgcatcgcgcggatggtcgagagcatcctgttcctcgctcgcgccgacgacgtacgggcagcggtggagcgcagccgcctggacctgggcgaagaactgcggcgccaggcggagtatttcgaagggctggccgaggaacgtgggctgagcctcgacatccaggtcagcggccagctacgcgccgatccgcaactgttccgccgggcgctgagcaacctgctggccaacgccatccgctacgccagcgccgacagcctgatcgaagtgcgcggcctgcgccgctcgggggaattcctgctgagcgtggagaacgcctgcgacaggctgccggccgagccgctgtcgcgcctgttcgaccgcttctaccgtggcgacgccgcgcgcagcgacgcccagtccagcggtctcggcctggccatcgtccaggcgatcatgcgcctgcacggcggccgcgccgaagcgagcgccccggctccgggacgcatccgcttcgacctggcgttcccggctcaggactgagcgggcttctcgccggcgtccggctcgccgtcggagcggccgatattcgccggcgcctccaccaccaactcctccggcacttcctcgacacgcgggtcgagggtggcggccatcgggctgaccgtgtccggcatcgccacgtgttgcagcggcgcctcgtcgacccggtgttcgccggtgacgcgcttgggctgcacccagaacaccagcagcaccgcgtagccggacaccagcatgtagaacagtcccggaccgaagtggcgcatcagcgcgccggccaccagcgggccgatacaagcgccgaccccataggtggtcaggagcatcgccgacaacgcgacccggcgcggctgctcgacgtggtcgttggccagcgccaccgccagcggatagagggtgaacagcagcatgccggtaacgaacccgttggccagcagcaaccagtacggcagcgtcaccagcccccacatcgggatcgaggccaggcacagcagcaccgcattgccgcggatcagccaactgcggtcgaggcggtcggacagccagcccagcggccactgcgcacagaagccggcgacgatgcacatgccgacgaagaaactcgattgcgaggcatccaggccgttgcggttggcatagaccggcgccaggccgtagaaggcgccgaccatcaggccggcgatgaagatggtgcccagcgcctgcggcacgcgttgccagaagaaacgcacttccagcggcgcggcgaccagcttggccgggtgcacgcgacgggtcatggccagcgggatcaggcacgaggcgaagcagatggcgaccagcagcaacggcttgtagtcgagggtcgggctcagcgccagcaggccctggccgagcaccaggccaaggtcgacggcgaccatgtagccggcgaacaccttgccgcgctggtggctctcggcctgctcgttgagccagctctcgatcaccatgtactggttcatcatcaccgcaccggtgatgaagcgcagcagcagccagacttccagctgatcgaccagggcatgcagcagcacggtcacggtggcaatcccggcgcaagccacgtaggagcggatatggccgaagctggcgatcagcttgtgtccgaattttccaccgcagaccaggccgaaatagtaggacgccatcagcccgccgacccacaggtcgcctgcgccttcctgggtcaggcgcaggccgatgtaggtggtgaacaggccggagccggccagcatgagcagggtggcggtgtagagcgcgggaaaggtgacgagcgggctgaacatgacggttcctggacggacgggccccacggccggcatccgccgagcattgataggttcgggaaggatcgacgctgctggccgatcgcgggcgcaggccgtcctgcgttcggcgagactccgacgccgcacggcggccggaagccacgtcgcggcgcacagggcggcattatccccgctccggagcggccccgccacgggcgccgcgagcgttccgtcggctcagccgcgccccgccgggagcggctcgcgcggcggcagccgatatacccagatgcgccgcaagacagtgaggaattgccgtcccaggcgtccgctgttgtaggtctgcccgtagcgccgggcgatttcgcggacctcgcgggacaacgcggcgtagcgacgcgccggcaggtccgggtagaggtggtgctcgatctggtggctgaggttgccggtcaggatgtggaacagcggcccgccctccaggttgctggagccgcgcaactggcgcaggtaccagtggccacgggtctctccctccagcaccgagggcgggaagaccaccgccttctcggtgaagtggccgcagaagatcaccgtgaaggtccacaggttgcgcagcacgttggccagcaggttaccgacgaacaccgcgccgaagccgccggcgaacaggccgagaagcgggaacagcaggtagtccttggtccactggcgacccagcttggcacgcaggcggcgtag

SEQ ID NO: 10429 - DNA, 243 bp, Pseudomonas aeruginosa
acgcgcgcgcacctttccggtgcggcaaaaaagtcgttgcgcaccaacctggcgcgctgcaatattttgttacatccctatggccccgttttcccggtacaggcgtcccgcatcgacctggcaaggcccttgctggtgcttgttgtgatccctttcctgtcgcattgcggaaactgcccatgctggtcatccaccaacgcctgcccgcccgctcgccccgctgggacgaagaactccacctga

SEQ ID NO: 10430 - DNA, 639 bp, Pseudomonas aeruginosa
ccgccgcctgacgccacttcgcaacgacaaggaaccaccaatgaaactgcccaagctgctcgccgccctcgccctgctcgccgctccggcgctggccttcgcccaccccggccacggcgaacacggcctggtcgccggcctcgcccatccgctcaccggcctcgaccacctgctggcgatgttcgccgtcggcctctgggccgcccagcaacagggagccgcgcgtctcgccctgccctgcaccttcgtcggcaccatgctggtcggcgggctgctcggcttcgagggcctgcaactgccgttcatggataccggcatcgccgcctcggtgctcgccctcggcctctgcgtggccctcgccgtgcgcccgccgctgccgctggcgatggccgccaccgcgctgttcgccctggcccacggggtcgcccacggcctggagctgccggacctctccagcccctggctgtacgcgctcggtttcgtcgccgccaccgccgcgctgcacgccgccggctacccgctggtgcgcttcctggcgcaggcggccgcgcccctggtacgtctcgccgggctggcctcggcgggcgccggggtctggttgctggccggctgagccgccgcgcctccctcagcgcctga

SEQ ID NO: 10431 - DNA, 402 bp, Pseudomonas aeruginosa
cctgctccagggcatcccgggcgtacaggtcggcgacagccgcaacggtggcgcgctggacgtcaacatccgcggcatccaggggcagagccgggtggcggtgcgggtcgacggcgcggagcaggcgctggacgtctaccgcggctacgccggcacccagcagcgcagctacatcgatcccgacctggtcagcagcgtgaccgtcgacaagggtccctcgacccgctcgggcgcgatcggcggcagcgtggaaatgcgcaccatcggcgtcaaggacatcctggtcgacggcaaggacctcggcgtgcgcttcaccggcgacgtctggaacaacggcgtcgccccgcagcaccgcagcgccagttcgaagaccgagaatctcagcagcgtgccgcacgatga

SEQ ID NO: 10432 - DNA, 2169 bp, Pseudomonas aeruginosa
ccgcggcagcctgttcggctcccaggccaagtccggcagcgccgccttcgcctaccgcaacgagcatctggacctggtcgccgcctatgcgcagcgcaaccagggcaactacttttccggcaagaaaggccaggaccgctatcgcgtctacaaccgctacggtcgcgaggaaagcagcgtagccaaggtctacaacgcgggagaggaagtgctcaactcgtcgtcggagaccgagtcctacctgctcaaggcgacctggcgcatcgccgacgagcacaccctggacctcggctatcgtcgctacgacgggcgcaccggggagatcatgccgtcggacatcttccgtttcggcaccgccggcatctaccagtacccattgagcgaagtgaagatcgacacctacaccgcacgctaccgttacctgcccgagaacaatccgctggtggacctcagcaccggactgtggatgaccgacgcgaagagcgacatgctgacctcggtgctggcgccgcgctcccaggcctatcgctccgaccgcaactggacgcgccaggacaaccggcgcatcggcggcgacctgaacaacgtggcgcgcttcgaaaccgacttcggcgatttcaagctcgacctcggcggctcgttccaggtcgaagacatccagccgcagaaaagcgtggtcaccaccctccacgacatcaacgccaaccgcaccctgagggacgccacccgccaggaatacggcctcaacggcaagctcgagttcaagccggtcgagcgcctgacgctatggggcggcggccgctacagccacttcaacagcaaggacaacggcatctccgcctcgccgcggcgcgaggatcgcgacatgcgcttcatcacggtgagcaggcccggctactacggctcgatgatgtggttccccgaccagaacggccagtacaccgacgccaccgatccccgcctcaacaacggcatcgtcaccaacaacaccaacaatccgttcgaaggcattcccttcgacgagttcggcccggccaacgtgacagtccatccctcgcgggtcaccaacgtggtcaccggctacaactacagcaagaagggcagcagccgcggcggcggtttctcgccggcattcgggatcaatttcgagctggccccggataccttcgtctacgcctcctataccgaaggcctgcgtctgccgtcgctgttcgagaccagccagggcaccctccaggtcgagccgggcaaggacctcaagcccgagcgttcgcgcagctgggagatcggtgccagcgcgctgcgcgacagcctgttggccgacggcgactcggcggcgatcaagctggcctacttcaacaacaccatcaagaactacatcacccgctattacgatccgggccagatgggcctgatgaccttcagcaacaccgacagctaccgcaccagcggtctcgaactgcaatcgcactacgacgcagggcgggtgttcgccgacctgtcggcgacctactacctgaagaccgagacctgcgacgccgccttcgccgccaggctgcgcgccggcgccaaccgctaccagcgcaccgagaacacgccgaactgcacgccgggcagcttcatgggctcctataccaacacgcagaacccgccgcggctggcgaccaacctgaccgccggcctgcgcttcttcgaccaggccctgaccctgggcggacgcatgacctatacctccggccccaccgccacggcggacaagccctggcaggtcggcgccaccacaccgcagatcgagtaccgctcggtgcagctgttcgacctgttcctcaagtacaagctgttcgagcacaccgaactgaatgcctcgctgcagaacctcaccgaccgctattacctcgacccgctggcacagagtttcatgcccgcgcccgggcgtaccctgcgggtggggatgcaggcgaagttctgagccgccctctccccctccaggcgttgtcggcggagcgccgctccggtagggcgaataaccgcccagcggctatccgccgaagcaccgggcctcccgctccccgtccctccggaactgtccggaggagcggcgagacagcgtccgtcaccacgacaacggataactcaccaccagccgcgtctggtcgaagtcgctgttga

SEQ ID NO: 10433 - DNA, 2055 bp, Pseudomonas aeruginosa
agtaatagttgcgcaggaccaggtcggtcttcgcatcctccaggaagccgccctcggcagcttgcgcggcaagacaggcgagcatcggcaggaccgcccctgcattgcgcgggactgcggttttacgacggattttcattgttattgtgctccgtttttcagggacgaccgggccccggcagcctctgcgggccacctggcgacgacggtcgggtcagcggcggggcgcgggccccgccgccagggtcagaacgggtactggcgcggcgcgtgctgcacgctgatccagtggtcggtggtgaattcctcgatggcccagtcgccgttgaagcggccaagtccggagttcttctcgccgccgaagggcgcgttggcctcgtcgttcaccggaatgtcgttgacgtgggtcatccccgcgcgaagctggcgggcaaagcgcaccgcgcgttccaggtcgcggctgaacaccgcgctggacagcccgtattcgctggcgttggccaactccagcgcatgcgcctcgtcgcgcgcgcggagcaggccgaccagcgggccgaagatttcatcgcgggcgatctccatcgtcgcggtgacctcgccgaatacgtgcggagccagcaactgcccatcgacgccgccctcgtacagcggcttggcgccttcctggcgggccaggcggatcttttccagcaggccttcgagctggcgcgcgttgacgatcggcccgaccgcggtatcggcgcgctgcggatcgccgacccggaggcccttgacccgctcgacgaagcgcgcggcgaaagcgtcgtagaggctgtcctcgacgatgatgcagttgatcgccatgcagatctgcccctggtggaggaacttgccgaacaccgcggcattcaccgcctgctccaggtcggcgtcgccgagcaccacgaacggactgttgccgccaagctccagcgccacgtgcttgagatgcgcgccgccgctggcgatgcggccgatgttgcggcccaccggggtcgatccggtgaaggtcaccaggcccggcaccgggtgctcgacgaaggcgtcgccgatctcgctgccggggccgaccaccacgctgaacagcccggccggcagcccggcctcttcgaagatccgcgccagcagcagtccgccgcagaccggcgtgtcgctggccggcttgaccaccaccgcgttgcccagcgccagggccggggcgatggaacgctgggtcaggtgcagcgggaagttccacgggctgatcaccccgaccacgccgatggcgctgcggtagacccggctttccttgcccggcacgtcggactcgacgatgcgcccgtgcacccgtgccgggaacgacgccgactccagggtgatcgcgcgcgccgcgccccattcgatctcggccttcaggcgggtgctgccggactcgcggatgatccagtcgacgatctcctcgtggcggcggtcgaacacctccaccgccttgtacagtaccgccgcgcgtgccgagggcccgagcgcggcccatgccggctggacctcggcggccttggcgtaggcggcatcgaggtcgtcgcggtcggcctgctcgatctccagcaacaggctgccgtcgaacgggttgctcaccttcagccggcggccggcccggccgtggcgccactcgccggccaggggctggagaccgaggtcggtataacgggaatcgctcatcgctcttctcctctttcgaaaatcacaggggtttcttcgccgtcgcgtcgacggacgcttccgccggcacgcgcggccgcaggtggatgcaggcgatcgccagcgcgccgatcacgccgggcgcggcgaaggccaggaagttctgctggaacggcagctccagggccagcaggctgccgccgagcatcggcccggcgatggcgccgaggcggccgacgccggcggcccagccgaccccggtggagcgcacccaggccggatagaactgcgcggcgtaggcatggatcaccgccagggtgccgatggtggtggcgccggccaccaccagcaggccgttga

SEQ ID NO: 10434 - DNA, 4284 bp, Pseudomonas aeruginosa
agcgggcagcgtcgatcaccgccgcagcggattgcctgttcataccaacctctctcttgttcttgttatgggcgcacgcgggcgtcggtcggcaccgcccactctggcatggggcggcgccgtggaacatcagggttcgatggtttgcgtcggcacctcgatcaaaaccgggcgatcagcggccagggcatgcttcaaggcgctttccagctcttcgcgggtggctgcgtggagcgcctcgacgccatagccgcgggcgatcgcgcagaagtccaggccgggcacgtcgagccccggcgcatcgggcacctcgagcaccccggcgaaccagcgcagggcgccgtaggtaccgttattgaggatgatgaacaccgccggcacgcggtattgcgcggcgctccagagcgcggtgatgccgtagttggccgagccgtcgccgatgatcccgatcacctgccgccgcggttgcgccagttgcgcgccgaccgccgccggcaggccgaagccgaggccgccggcggccgggaagaaatagctgcccggctcgcgcatctccacgcgctgccagaaggcggtcacggtggaagtcgactccttgacgaaaatggcgtcgcgcggcgccagcgcatcgatcacgtcgaacacggtttccggacgcagcggtccgccctcctcggccagcgccggcggtcgcggcagcgcctcgggcaacggccgcgcactggggcggacctgttcgagcagtgcctcgagggtcagcgcgatgtcgccgaccaacgcgtcgcccatcggcgcccgtgccgcttcgccgggatcgcaggtgacctgcaccagctcggcgccggccggcaggtaatcgccgggggcgaactggtgatagcggaacaccggcgcgccgaccaccaggatcaggtcgtggccgtccagcagccggctgatcccggcgatggccgccggcagcacgccgcggaagcaggcatggcgggtggggaacggacaacgcgaggccgacggcgcgacccaggccggcatccgcagcttctccgccagttccacggccaggccgttggcattcgccccgtcgacgtccggaccgagcaccagcaccgggttgcgcgagcgcgacaggcgctcgccgagttcggccagcaatgccggcgcgggcagcgcggcgccgctgacctggcgcgcagccaggtgttcgacgccggccggcgccggttgcgcccagtcgtcgtagggaatcgacaggtacaccggcgcccgcggcggcaggctggcggtctggatcgcctggctcagcgcgcgcggtacatcctgggcgcaggccggctcgtggctccatttcaccagcggcttgggcagttgtccggcatcgacgttggcgagcatcgcctcgaccccgatcatcgagcgcacctgctgcccggcggtgatgaccagggggctatgggagtaccaggcgttggtcagggcccccataccgttgccggtgccagccgccgcatgcaggttgacgaaggccgggcggccgctggccagggcgaagccatcggccatgccgaccaccgcgccctcgtgcaggccgaggatgtagcggaaatcctcgggaaagtccttgaggaacggcagctcgttggagccggggttgccgaagacggtggtcaggccgtggcgacggaggatctcgtaagacgcggaatggacggttttcatgcaggccttcaagctcgtttcctggatttgcgctactgttgcagccgctcgataatcaatcaaatcgatactctttctataaaaaatagaactggtctatatgagtccgatcgatctcaacctgatccgcaccttcgtcaccctctacgaagccggcagcgtgaccctcgccgcggagcgcctgcgcgaactgttcgacgacgcgttgttcacccgcacccgcgacggcatccagccgaccttcgtcgccgagcagctctacggcaccttccgcgagtcgctgacgcgcatcgagggcgcggtacagagcgttcgccacttcgatccggcgaccaccgagcgacgtttccgcatcgccctcaccgatctcggcgaagtgggtttcctctcgctgatcctcgaacgcctgacccgcgacgcgccgttcgccgaagtggaagtgctgccgctgcaggtggacgaggtcggcgcctggctgagcagcgccaaggtcgacgcggcgatctgccgccagccggtgcccggcgcgcgcagccagcgggtcctgcacgagcgctacgtgtgcctgctcagcgaccgccacccgcggatcggcgacagcctgagcctggagcagtacctggccgagcggcacatcgtggtgacccgtacctccggccacggcatcgccgaggacgtgctcgaggccatgcaggtgcagcgccgcatcagcctgcgggtgccgcacttctcggtgctgccgaagatcattcccggtaccgagctgctgaccatcctgccggcgcagatcgcctatcgcttcgtcgccgaaggcggcatgcgcatgctcgaactgcccttcaccctgccgccgttcgacgtctccctgcactggcacgagagcagcgaacgctcggcggcgctgaactggttccgcaccaccatcgccgaggcgatcatcgccgcccaacgctgaaacgccggcggccctcacgcagcgtctcccagcgtcggcgagcgctcgcgacgccgcgcaccgagcagcggcaacacggcggccgcgacgacgaacaccgccgcgaacgccccatagagggacagcggctgccagccgtcgtcgagcaggagcccggccaccagcggcgagaggatcgccccgccgcgaccgacgccgatcccccagccgaccccggtggcacgcaccgaagcgtcgtagaggctcggcgccagggcatacaggccggccacgcaggcgttggcgcaaagcccgatcagcagtcccagcggcaaggccgcgccgggcagcccggcgctcagcgagaacagcgcgagcagagcggcggtaagcagcatgaacagcgccagcacccgttccaggcgaaagcgcgcggcaagcccgccgagcaaggcggcaccgaagatcccgccgatgctcagcagggtgccgccggtgatgccatgggcggtggacaggccggcggcgaccagcagcttcggcgtccagctcatgatgaagtagaagccgaacatcaccaggaaaaacagcgcccagagcagcagcgtggtacgtcgctgggcaacgcaaagcaaccgggcgaggcggctaccgtgctccgctccgccaccgggcgggctcggcagttccgcgagcgccgcgcggcccaggcgccgggccagcgcgttgacccgttgcaacgcccgcggcggccggcgcgccaggaggaagtccagcgactccggcaggcacaggcagaccagcgggatcaccgccagggtcaggccagcgccgaagacgaacaccgagcgccagccccaggcgccgatcagccataccgcgagcagtccgccaagggtcgcgccgagcgcgtagccggtggactgcaggcttaccgccaggccgcgccagcggcgcgaggcgtactcgctggcgatcacgttgctgctggcgaggatgccgccgatacccagtccggtcagcccgcgcagcaacgccagttgccaggccgcctggctcagcgccgaggcgagcatgcccaggcccgacagcgccaggcaggcgaggatcagcgggcggcgcccccagcggtcggcccagggcgcgacgaacagcgagccggcggccatgccgaagaggccggcgctgagcagcaggccgatctcggcgccgccaaggttccattcggcggccaccgaggatgcggtgaaggccatcaccagcacgtcgaagccatcgatcaggttgagcacgatgcacacagccaccgccagccactggaacggacgcatcggttcgtcgtcgagagcgcggcgcaagtcccggttcatgggcggccctcccccgagcggacaggaaagaagcgacggcaggcgggagcgaggcgcgggaatgcaggaatccatcatcgggaagaccctttttcttgttgttgtaggcacggcaagcgcaggcaccctggcaccgttgcgtcgatgccgcaatcctattggatccattttggcgacaagaaaacggatggccagcggatatcccactgtcagcgaaatccgagaaaggctctggaacgagataatttggcaatttattcctga

SEQ ID NO: 10435 - DNA, 1575 bp, Pseudomonas aeruginosa
cctgatggacctgacccacgagacctatgtccatgcgtccagcatcggccagaaggaaatcgacgaggccgcgccgaccacgcgggtggaaggcgacgaggtgatcaccagccgccacatgcagaatgtcatggccccgccgttctggcgcatggctctgcgcggcaacggcctggccgacgacgtggcggtggaccgctggcagatctgccgcttcacgccgcccagccacgtgctgatcgaggtcggcgtggcccacgccggccacggcggctaccaggcgccggcggagcgcaaggcggcgagcatcgtggtcgacttcatcaccccggagagcgccacttccatctggtacttctggggcatggcgcgcaacttccaggcccacgaccaggcgctcaccgagagcattcgcgaaggccagggaaagatcttcggcgaagacctggaaatgctcgaaagccagcagcgcaacctgctgcgccatccacggcgcgacctgctgaaactgaacatcgacgccggcggcgtgcaggcccggcgtatcatcgagcgcctgctggcggacgagcgccaggccgccgcccccaaccgcgcccaggcctgacgggagccttcgccatgatcgaggtcatcgtcggcgccatccgcctggaggcgcaggatatccacagcttcgaactgttccgggccgacggggcggccctgccgtccttcgagccgggcgcacacatcgacctgcacctgcccaacggcctggtccgccagtactccctctgcggccccgccgaacggccgcgccactaccgtatcgccgtactccgctgccgcgattcgcgcggcggctcggccacgctgcacgccgaactgcgggtcggccagcggctgcacatcggcgagccgcgcaatctcttcccgctgtcgccggagcccggtccgcgcctgctgttcgccggcggcatcggcatcacgccgctgctggcgatggccgaacgcctggcccgcgatggcgccgacttccagttgcactactgcgcgcattccgccgagcgcgcggccttcgtcgactaccttggccggtgcgccttcgccgaccgcgtgcactgccacttcgaccacggcgaaagcagccggcgcgcggaccttcgcgccctgctggcgaccagtccgcgcgacgcccagctatacctttgcgggccggcgggcttcatgcagtggatcgaagaaagcgcccgcgaactgggctgggaagcaagccgcttgcatcgcgagcacttcgccgccgcgccacgagacgccagtgcggacggcaccttcgaagtgcagttggcgagcaacggggcgctgatccgggtcgccgccgggcagaccgtgctggcggccctgcgcgaagccggggtggacctgccggcctcctgcgagcagggcatctgcggcacctgcctgacccgcgtgctggacggcgagccggagcatcgcgacctctacctcagcgaagaggagcaggccgccaacgattgcttcacgccctgctgttcgcgttcgcgcagcccacggctggtgctggatctctag

SEQ ID NO: 10436 - DNA, 456 bp, Pseudomonas aeruginosa
ctcggccagcacgcgttggcccggtttgctcatggaattcgcttattcgatcgggacgtccggggcatcatagcgtgccccggccgcctccgccggtcagctttcgcggtggatggcgaagccggcccaggactggctcaccggcatgatctcgaggctgttgatgttcaggtgggcgggctggttcctgatccagcagatggtctcggcgatgtcttccggctggatcggatgggatccggcctaggtcttgtcgtagcgcgcctggtcgccgccgaagcggaccagggagaaatcgctctcgcacaaccccggctcgaggttggtcacgcgcaccccgggtgccctgcaggtcgccacgcaggttcagggagaattgctcgacgaaagccttggtgccgccgtagacatggctacccggatagggccacttgccggccaccgaacccaggttga

SEQ ID NO: 10437 - DNA, 1023 bp, Pseudomonas aeruginosa
tcgggattgtcgtgcttctcgccgacgatcactcgcggcgcggccgccaggcgtgcgaccagttgctgcgggctcagcgtcacgccgctgcgcaattcgacgattcgtcccgtctgcggatcgtcgcgcccttccgggctctgccaatcaggcagcggcggcagttgggactggcagccgcccagcagcagacagaaagcgaacaggcgaatgcgcatggcgactccttcaacgggcgacgatcagcggatgacctcgctcgggatgacgctggaccaggacctagaggccgaacaccgcgcgcaacggctcggggcgcaggacttcctcgggcgtaccgagcaggtgcgggcgaccattctgcaacagcagcaggcggtcgcaatagcgcgcggccaggttgagatcgtggaggatcaccagcaccgaggcaccgcggcgggcgaaatcatgcaccgcctgcagggtagtgtgctggtgcagcgggtcgagcgccgaggtcggttcgtcgagcagcagcacctgccccggctcgcccggccacagctgcgccagcacccgcgccaggtgcacgcgctggcgttcgccgccggacagcgccaggtagctgcgcccggccagatgcctggcgtcggccgccgccaaggcctcggcgacgatctgcacatcgcgctcgcggccgctggaatggggcagccgaccgaagccgaccaccgcctccaccggaaaggcgaagcccagcgacgaactctgcggcagcaccgccaggcgctgcgcgcgagcgacgcccggccagtcgtcgaggccgcgctcgtcgagcagcaccagcccttcggccggctccagttcgccacagagagcgccaagcaaggtgctcttgccagcgccgttggggccgagtacgccgagcatctcgccaggccgcagctccagctcgaggccttccagtacagtctttccgccacggcggatggacaggttctccacgcgcagcatcaggcccgcccccgcaatagcagataa

SEQ ID NO: 10438 - DNA, 561 bp, Pseudomonas aeruginosa
ggcgcgaggaacgccggcaagccacccagcgaggcgccgaatacgatggccagcgccgcgccgagggccgcgccgctggacaccccgaccagccctggatcggccagcgggttgcggaacaggccctgcatcgccaccccggacagcgccagcaccgcgcccacggccaggccgagcagggtccgcggcaggcggatctggccgaggatcatttccgcctgggccaggcccgttccatcgagcggcagcccggccaggcgcagcgcggcgcgcagggtatcgcccagcggcaggctgacgggaccgagggcgagggacaaccagaggaccaacacgagcgaaatccccagcgcaccgaacagtgcgcggggacgaacaaccgatttcaatgggcggcttccgtactcagcggtttcgcggaaggataaaaggctgcggagagagccgccaggccatccggcaggcgcggaccgaggccgcccaccaggagcgtcgggtccagcaccagcagtcgtccgtcacgcgccgcgcgggttgcggcgaggccggggttctgcttga

SEQ ID NO: 10439 - DNA, 315 bp, Pseudomonas aeruginosa
tcggcaatccgctttcggccgccgcttcgaagagtttcgccaggtcgccattgtccaggcgctcggcccattcgccgccagccaggcgcagcgcctgggtgcgctgcgcgccatgcttcttcagcagggcgtggaaatgatgggtgtccttcaacgcggcccagccttcgcgcaaggcggcggcatcgatctgcgcatcgacgagcgtcgcagccggtgcgcggggttcgtgcagcgccagcacggcatcctgctcggcagcccgcaggcgctcgaccagcggctcccaggcgcggacgtcgctggcctcggtaa

SEQ ID NO: 10440 - DNA, 2370 bp, Pseudomonas aeruginosa
cgtttttctggcagtaccttgtgcgcccgacgtccccctggctattcgccaccggcccgacccaaggagtcccacatgccgctctccccgcccttcgccctgcgcccctgcctggccctgctgttgctcagcccttccctggccctggcggggaacgccatcccgctgaccccgaccaccatcaccgccacccgtaccgagcaggcagtggattcggtgccaagcaccgtcagcgtgcggacccgcgaacaactggaccggcagaacgtcaacaacatcaaggaactggtgcgctacgaaccgggagtctcggtcggcggcgccggccagcgtgccgggatcaccggctacaacatccgcggcatcgacgggaaccgcatccttacgcagatcgacggggtcgaactgcccaacgacttcttcagcggcccctacgcgcagacccaccgcaactacgtcgatccggacatcgtaaagcgcgtggaaatccttcgcggcccggcctcggcgctatacggcagcaacgccatcggcggcgcggtgagctacttcaccctcgacccgtcggacatcatcaaggacggcaaggacgtcggcgcccggctgaaggccggctacgagtcggccagccactcctggctgacctcggccaccgtcgccggccgcgccgacgacttcgacggcctgctgcattatggctaccgccagggccacgagaccgaatccaacggcggccacggcggcaccgggctctcgcgcagcgaagccaacccggaagacgccgacagctacagcctgctcggcaagctgggctggaactacgccgagggtagccgcttcgggctggtcttcgagaagtacaagagcgacgtcgataccgaccagaagagcgcctatggcggcccgtacgacaagggcaagccggccatcccgccgagcatgctgccgggcggcatgtaccagtggcgcaagggcaacgacaccctgactcgcgagcgctacggcctggagcaccatttcctgctcgacagcccggtcgccgatcgcatccagtggagcctgaactaccagttggcgaagaccgaccaggcgacccgcgagttctactacccgatcacccgcaaggtcctgcgcacccgcgacactacctacaaggaacgcctgtgggtcttcgacagccagttggacaagagcttcgccatcggcgagaccgagcacctgctgagctacgggatcaatctcaagcaccagaaggtcaccggcatgcgcagcggcaccggcaccaatctggacaccggcgcggacagtccgcgcgatgccctggagcgcagcagcgactttcccgatccgacggtgaagacctacgccctgttcgcccaggacagcatcagctggaacgactggaccttcactcccggcctgcgttacgactacacgcgcatggagccgcacatcaccgacgagttcctgcgcaccatgaagcagagccagaacaccgcggtcgacgagtcggacaagaaatggcaccgggtttcgcccaagttcggcgtgacctacgacttcgcccagcactacacctggtacggccaatacgcccagggcttccgcacgcccaccgccaaggcgctgtacggtcgattcgagaacctgcaggcgggctaccacatcgagcctaaccccaacctcaagccggaaaagagccagagcttcgagaccgggctgcgcggcaagttcgacgaaggcagcttcggcgtggcggtgttctacaacaaatatcgcgacttcatcgacgaagacgccctgaataccgatagcaccggcggcaacggccagaccttccagtccaacaacatcgagcgggcggtgatcaagggcgtcgagctcaagggccgcctggagctgggcgccttcggcgcgccgcagggactctacacccagggcagcgtggcctacgcctacggtcgcaacaaggacaacggcgagccgatcaacagcgtcaacccactcaccggagtgttcggcctgggctacgacgaagcagacggcaactacggcgggctgctcagctggaccctggtcaaacgcaaggatcgcgtcgacgacagcaccttccacaccccggatggcaccgccagccagttcaagaccccgggcttcggcgtcctcgacctcagcgcctactacaggctgagcaaggacctgaccctcaacgccggtctctacaacctgaccgacaagaaatactggctgtgggatgacgtgcgcggctacgacagcgtcggcgaggcttcggcgctggccccggccaacatcgaccgactgtcccagccaggccgcaatttcgcggtcaacctggtctgggacatctga

SEQ ID NO: 10441 - DNA, 372 bp, Pseudomonas aeruginosa
aagccgtcctccggatcagggataatgatcccggcaaacggagcgcccatgatccacctgtgtccctcttcccatctcgccgaaggcaacagccgcggcttcctcgtcgatgagcggcggctgttcgcggtgcgtcgcgacggccgcgcctacatctacctgaaccgctgcccgcatcgcggcatcccgttggagtggcagcccgatgccttcctcgacgacagcgccagcctgatccgttgcgccagccacggcgcgctgttcctcatcgagtccggcgagtgcgtcgccggcccctgcgctggcgagcgcttgcgcgccctgccctgccgggaagacgccgaaggcctctgggtggagctggacgactga

SEQ ID NO: 10442 - DNA, 1008 bp, Pseudomonas aeruginosa
cgtaagcgcccggaaccgtccgagcgacgccgaccgctgcggcggcctggaaagcgccagccaggcgctttcttgtcggcgaacataaaggccgataggctgcttgtcgagtcccccctcgcgtttttcattccatttcacaggaaaaggcccatgtcccgacgctactggcaactcgatgtgttcgccgagcgtccgctcaccggcaacggcctggccgtattcgacgacgccagcaccctcgatgacgccgccatgcaggcctggacccgcgaactgcgccagttcgaatcgatcttcctgctaccgggcgacgacccacgggccttccgcgcacggatcttcaccctggaggaagaactgccgttcgccggccacccgctgctcggcgccgccgccctgctccatcacctgcgcggcggcgacaacgaacagcactggacgctgcacctggccagcaaatcggtggccctgcgcagcgtgcgggcgggcagcggtttctacgccgagatggaccagggccgcgccgaattcggcgccaccccggacgccgggacctgccgctggttcgccgaagccttctcgctatcggccaacgacctgtccgggcatccaccgcgggtggtgagcaccggcctgccctacctgctcctgccggtaaccgccgaggcgctgggtcgagcccgtcaggtcaacgatttgcaagaagccctggataaactcggcgcggcgtttgtctatctgctcgacgtcgacgggcgcgagggccgcacctgggacagcctggggctggtggaagacgtggctaccggcagcgctgccggtccggtcgccgcctacctggtggaatacgggcttgccgcgcgcggcgaacccttcgtcctgcaccagggacgcttcctcgagcggccgagccggctcgacgtccaggtcgcgacagacggtagcgtcagggtcggcggccacgtccaactgctcgcccgcgccgagctgctgacctcggcctga

SEQ ID NO: 10443 - DNA, 1704 bp, Pseudomonas aeruginosa
ggtactgcagaaaacctgggcggagcgtccgtccggacgccaacgcctatgttaacgccgaccgcgccgggcgggcgagcaggcccttccgcgaggcgacgatcgactagactggcggaaattcacccctctcccgcgaactggtatgatgcgcgccttttcgagccgtatgaaccccacgcaggccgccgcgaggcccctggggtgcgtgggtcgtttcatgcggctcgcgcattttcgggactcagccgtctgccgggatcgttcgcgataccgcgccgacgagacagcgatgcaacgcccgccacgcggaaattcggttttccctggtcggcggccggctccacggccggccacttctgctggcgccatggggatcgttgcagagcacattcaggggaatccaacatgctggaaaagctgtttcaactaaaggcgcacaacaccacggtgcgcaccgagatcctggcggggatcaccaccttcctgaccatggcctacatcctcttcgtcaacccgagcatcctcggcgagaccggcatggacaagggcgcggtgttcgtcgccacctgcctggcagcggccatcggctcgaccatcatgggcctgatcgccaactacccgatcgccctggcccccggcatgggcctcaacgccttcttcacctacaccgtggtgctgcacatgggccacagctggcaggtcgcgctgggcgcagtgttcatttccgccaccatgttcttcctgctgtcgatctttcgcatccgcgaatggatcatcaacagcatccccctgccgctgcgctcggcgatcgccgccggcatcggcctgttcctcgcactgattgccctgcagaacgcgggcatcgtggtggacaacccggcaaccctgatcggcatgggcgacctgaccaagccggcaccgatcctcgccaccctcggcttcatcctgatcgtcgccctggaggcgcgtagcgtcaccggcgcggtgctgatcggtatcctggtggtcaccgccatcgccatcctgctcggcgtgacccagttcggcggcgtggtctcgatgccgccgtcgctggcgccgaccttcctccaactggacatcaagggcgcgctggacatcggcctggtcagcgtgatcttcgccttcctcttcgtcgacctgttcgacaactccggcaccctgatcggcgttgccaagcgcgccggactgatgggcaaggacggccacatgccgaagatgggccgcgcgctgatcgccgacagtaccgccgccatgggcggctcgctgctgggcacctcgaccaccaccagctacatcgagtccgccgcgggcgtcagcgccggcggccgcaccggcctgaccgccatcgtcgtcgccatcctgttcctcctcgcgctgttcttcgccccgctggctggcagcgtaccggccttcgccaccgccccggcgctgctcttcgtcgccgtactgatggcctcgggcctggcagaaatcgactgggaagacatcaccgtcgccgcgccggtggtcgtcaccgcgctggccatgccgttcacctattcgatcgccaccggcatcgccttcggcttcatttcctggaccgcgatcaaggtgctgtccgggcgctggcgcgaactgaacccggcgctggtgatcctctccgtcctgttcgtgatcaagctgggcttcttcaacgcatga

SEQ ID NO: 10444 - DNA, 261 bp, Pseudomonas aeruginosa
cccggcgcttcgagcgcatcctgtacatttcgtgcaacccggaaaccctggcgcagaacatcgctcaactgcacgacacgcaccggatcagccgctgcgcgctgttcgaccagttcccctacacccaccacatggaaagcggcgtcctgctcgaacgccgctgagcgagtggccgcgccccacggcgcggccatgcctcagagtcgcaccgggaggcgccgcgccaggtgcaatccttccgtcgtcacctcggcgccatag

SEQ ID NO: 10445 - DNA, 531 bp, Pseudomonas aeruginosa
gaggcggccattcatgtccaccaaagcaaaacaacagagcagccagcagatgacccgcggcttcgaaccctatcaggaaaccaagggcgaggagtacatgagcgagcgcatgcgcgcgcacttcaccgcgatcctgaacaaatggaaacaggagctgatggaagaggtcgaccgtaccgtgcatcacatgcaggacgaagcggccaacttccccgatccggccgaccgcgccagccaggaagaagaattcagcctggaactgcgcgcccgcgaccgcgagcgcaagctgatcaagaagatcgacgagaccctgcaactgatcgaagacgaagagtacggctggtgcgactcctgcggcgtcgagatcggcatccgtcgcctggaggcgcgccccaccgcgaccctctgcatcgactgcaagaccctcgcggaaatccgcgagaagcaactcggctcctgagccggaccgacggggcgccaaggcgccccgtttcgtttccgccgttccccgccgcaccgctcgcgccatga

SEQ ID NO: 10446 - DNA, 609 bp, Pseudomonas aeruginosa
gccgcttcgccccgacgcccagcggctacctgcacttcggttccctggtggcggccgtcgcctcctacctggacgcacgtgccgtcggcggccgctggctggtgcgcatggaggacctcgacccgccccgcgaagtcccgggcgcccagcaggcgatcctggaaaccctggagcgctacggcttcgaatgggacggcgcggtggagcggcagagcgaacgcttcccggactacgccgcagtggtcgagcaactgctgcgcagcggcctggcctacgcctgcacttgctcgcgcaagcagcttgagggattcgccgggatctacccgggcttctgccgcgacgccgggcacgcccgcgaggatgcggcgatccgcctgcgcgtgccggagctggaatatcgcttcgtcgaccgcgtgcagggcgaagtccaccagcatctcggccgcgaggtcggcgatttcgtcatccagcgccgcgatggcttctacgcctaccaactggcggtggtgctggacgacgcctggcagggcatcaccgacatcgtccgcggcgccgacctgctcgagtggaccccgcgccagctttacctccaggaattgctggggttga

SEQ ID NO: 10447 - DNA, 2991 bp, Pseudomonas aeruginosa
tcctcatcgtggtcactttcatcctgcagagccagcgcgatgctgacgagctttagcctgacccagctgatcctgatcagcgtcgcctacctctccaccctcttcggcatcgcctggatcaccgagcgcggctacgtgccgcgccggctggtacgccacccgctggtctacaccctgtcgctgggcgtctacgccagtgcctgggcgttctacggcacggtaggcctggcctaccagtacggctacgggttcctcgccatctacctggggatttccggggccttcctgctcgccccggtgctgctctatccgatcctccgggtgacacgcgcataccagctgtcctcgctggccgacctcttcgccttccgtttccgcagtacctgggccggcgccctgaccacgctgttcatgctgatcggcgtgctgccgatgctggccctgcagatccaggcggtcaccgactcgatcagcattctcacccgcgacccggcccaggagcgggtcgcgttcgtcttctgcaccctgatcaccctgttcgcgatcctcttcggcgctcgccacatcgccacccgcgaacgccacgagggactggtgttcgccatcgccttcgagtcgctggtcaagctggtgatgctcggcagtatcggcctctacgccctgtacggcgtcttcggcgggccggaaggcctggaagtctggctgctgcagaaccagaccgcgctgaccaccctgcacacgccgctggccgaaggtccatggcgaacgctgctgctggtgttcttcgccgcggccatcgtgatgccgcacatgttccacatgatcttcaccgagaacctcaacccgcgcgcgctgatttccgccagttggggcctgccgctgttcctgctgctgatgagcctggcggtaccgccgatcctctgggccgggctgcgcctcggcgcctcgaccacaccggagtactacaccatcggcctcggcctggcggtggacagcccggccctggccctggccgccttcatcggcggcatctccgccgccagcgggctgactatcgtgatgaccctggcgctctcgggaatggtcctcaaccacctggtgctgccgctctaccagccgccggcgcagggcaacatctaccgctggctgaaatggacccggcgcctgctgatcgtcgccatcatcatggccagctacgccttctacctgctgctgggcgccgaacaggacctctccaacctgggcatagtgtccttcgtcgccaccctgcaattccttcccggcgccctctcggtgctgtactggccgaccgccaaccgccgtggcttcatctccgggctgatcgccggcatgctggtctgggcgatcaccatgctgctgcccctgatggggaacgtacagggcctgtacctgccgctgttcgacgtgatctacgtgctggacgattcgaactggcacctggcggcgctgtcctcgctggcggccaacgtgctggtattcaccctggtgtcgctgttcaccgaggccagcgacgaggaaaaaggcgccgccgaggcctgcgcggtggacaacgtacgccgtccgcaacgccgcgaactgttcgccggttcgccgcaggagttcgccagccagttggccaagccgctgggcgccaagaccgcgcagaaggaggtcgagcaggccctgcgcgatctccacctgcccttcgacgaacgtcgcccctatgccctgcgtcgcttgcgcgaccgcatcgaggcgaacctttccgggctgatgggacccagtgtcgcccaggacatcgtggagaccttccttccctacaagaccagcgaagaaagctatgtcaccgaggacatccacttcatcgagagccgcctggaggactatcactcccggctgactggcctggctgccgaactcgacaccctgcgccgctaccaccggcagaccctgcaagacctgccgatgggcgtctgctccctggccaaggaccaggaagtgctgatgtggaaccgcgccatcgaggaactcaccggggtcggcgcgcagaaggtcgtcggttcgcgcctgtcggccttgcccgaaccctggaagggcctgctggaacgtttcatcgacgcccccgacgagcacctgcacaagcagcgcctggtctacgacggccacacccgctggctgaacctgcacaaggcggccatcgaggaacccctggcgccgggcaacagcggcctggtgctactggtggaagacctcaccgaaacccaactgttggaagacaagctggtccactccgagcgcctggcttccatcggccgcctagccgccggggtggcccacgagatcggcaatccgatcaccggcatcgcctgcctggcgcagaacctgcgcgaggaacgcgaaggcgacggcgagctgaccgaaatcagcgagcagatcctcgaccagaccaagcgcgtatcgcgcatcgtccagtcgttgatgagcttcgcccactccggcagccacctgcaggccctggaaccggtgtgcctgagcgaagtcgcccaggaggccatcggactgctgtcgctgaaccggcgtagcgtcgaagtagagttcttcaacctctgcgatccggcgcactgggtcgagggagactcgcagcgcctggcccaggtgctgatcaacctgctctccaatgctcgcgacgccagcccgccgggcggcgcgatccgggtccgcagcgaagcctcggaacataccgtggacctggtcgtcgaggacgagggcagcggcattccgaaggcgatcatggaccagttgttcgaaccgttcttcaccaccaaggaccccggcaaggggaccgggctcggcctcgcactggtctattcgatcgtggaagagcattatggacagataaccatcgagagcccgacggatcaccagcgagaaggcggcactcgcttccgcgtgaccctgccgcggcaccctggcccgacggccgagctgtag

SEQ ID NO: 10448 - DNA, 1173 bp, Pseudomonas aeruginosa
agatgggcgcggtggactacatcgccaagcctttcgaccacgacgaaatgctccaggccgtggcgcgcatcctcaaggaccgccaggagaaccgcagcgcggccccggtcctccgccaacggcggcaaggccggcggcgagcgcggcgccagcccggcggcagccgacggcgagataggcatcatcggctcctgtgcgccgatgcaagagctgtacagcaagattcgcaaggtcgcgccgaccgactccacggtactgatccagggcgagtccggcaccggcaaggaactggtcgcccgcgccctgcacaacctgtcgaagcgcgccaaggcgccgctgatctcggtgaactgtgcggcgattccggaaaccctgatcgaatccgagctgttcggccatgaaaaaggcgccttcaccggtgccagcgccgggcgcgccgggctggtcgaagcggccgacggcggcaccctgttcctcgacgagatcggcgaactgccgctggaggcccaggcccgcctgctgcgcgtattgcaggaaggcgagatccgccgggtcggctcggtgcaatcgcagaaggtcgacgtgcgcctgatcgccgccacccaccgcgacctgaaaaccctggccaagaccgggcaattccgcgaagacctctattaccgcctgcatgtgatctcgctgaagctgcccgccctgcgcgagcgtggcaacgacgtgatggagatcgcccgcgcctttctggctcgccagtgcacccggatggggcgcgcgccgctcagcttcgcccacgacgccgaacaggcgatccgccattacccatggccgggcaacgtgcgcgaactggaaaacgccatcgagcgggcggtgatcctcagcgagagccaggaaatccacgccgacctgctgggtatcgacatcgagctggacgacctcgaggacgacttcgccgccgacctctgcctcggcccggcgggcgccgcggccagcaaccacgagcccaccgaggacctttcgctggaagactacttccagcacttcgtcctcgagcaccaggaccacatgaccgagaccgagttggcccgcaagctgggcatcagccgcaaatgcctgtgggaacgccgccagcgcctgggcattccgcggcgtaaatcaggggcctcggccgactcgtaa

SEQ ID NO: 10449 - DNA, 1452 bp, Pseudomonas aeruginosa
gcaacgcaggcgtgcaatcacccacatcgtgctcccgataacacacccatgctgaaaaagctgatccagaccattcgttcccccctgcgccgtccgcgcgccgtccgtacaaccccggaagtcatcggtaacaaccagcactccctgcgccgggaccagttcagccggaacgccgtcaaggtcgtcgagatcctccagcgggccggctaccaggcctacgtggtcgggggctgcgtacgcgaccagatgctcggcatcgctcccaaggacttcgatgtcgccaccagcgccacgccggagcaggtccgcgccgaattccgcaacgcgcggatcatcggccgccgcttcaaactggtacacgtgcacttcggccgcgagatcatcgaggtcgccaccttccgcgcccatcatccggaaggccaggacgatggcgatagccgcgcgtccagcaacgaaagcggccgcatcctgcgcgacaacgtctatggcagcctggaagacgacgcccagcgccgtgacttcaccatcaatgccctgtacttcgacgtcaccagcgagcggctgctggactacgccaatggcgttcacgacatccgcaatcgcctgatccgcctgatcggcgatccggagcagcgttatctggaagacccggtgcggatgctgcgggcggtacgtttcgccgccaagctcgacttcgaaatcgagaagcacagcgccgcgccgattcgccggctggccccgctgctgcgggaaatcccttcggcgcgcctgttcgacgaggtgctcaagctgttcctcgccggccgggccgagcgcactttcgaactgctggtcgagtacgaactgttcgcgccgctgttcccggccagcgccaaggcactgcaggccaaccccgactacaccggcaagctgatccgccaggccctggccaataccgatgcgcgcattcgccagggcaagccggtaaccccggccttcctcttcgccgcgctgctctggccggccctgccggcgcgcgtcgcgcagttgcaggagaaaggcatgccggccatcccggcgatgcaggaagccgcccacgaactgatcagcgaacagtgccagcggattgccattcccaagcgtttcaccctgccgatccgcgagatctgggatatgcaggaacgtctgccgcgacgccagggcaagcgcgccgacctgctcctggaaaacccgcgcttccgcgccggctacgacttcctcctgctgcgcgaaagtgccggcgaggaaaccgaaggactcggccaatggtggaccgattaccaggaagtcagcgacagcgagcggcgcaacatgatccgcgacctggtcagccaggaagacggcagcgccccgcgcaagcgtcgccgcggcggcaacagcggccgtcggcgccgcgggccgcgcaaggaaggcagcggcggaagcggcgaatga

SEQ ID NO: 10450 - DNA, 909 bp, Pseudomonas aeruginosa
actgcgcgccgcggtggcgcgcgcccgcagcgaaggcaagcgcatcggcttcgtgccgaccatgggcaacctccacgccggccatgccgcgctggtaaagaaagccggcgaacgcgccgacttcgtggtcgtcagcatcttcgtcaacccgctgcaattcggccccagcgaagacctcgacaaatacccgcggaccctcgcagccgaccaggaacgcctgctcgaagccggctgccacctgctgttcaccccgaccgtcgaggaaatgtaccccgacggcatggacgggcagacccgcatccatgttcccggcgtctccgaaggcctttgcggcgccagtcgtcccggccatttcgaaggcgtggcgaccgtggtcagcaagctgctgaacatggtccagccggacctcgcgctgttcggcgaaaaggatttccagcagttggcggtgatccgcaagctggtccgcgacctcaacctgccggtgcagatcttcggcgagccgacggtgcgcgccgccgatggcctcgcgttgtcctcgcgcaacggttacctcgacgagcagcagcgcgccgccgccccggcgatctaccgcaccctgcggcagctcggcgaacgcatccgcgccggcgccgaggacttcccggcattgctcgccgacgcccgccaggccctggaacaggccgggctgcgccccgactacctggaaatccgcgagccgatcagcctgcgccccggggtacccggcgaccgccaactggtgatcctggccgccgcctacctgggcagtacgcggctgatcgacaacctctcagtccacctcgattgacgcatgccgagcccccggttcccgggggcttgagcgctcaccacggactcgccatactctgccgccccccgcggacccgatag

SEQ ID NO: 10451 - DNA, 1698 bp, Pseudomonas aeruginosa
gtgcgccatcgaattccaaccagaaggtcagccatgaagcaccacctcactccgctggatgccacgcaactcgacagttggcgcgccctggccgcccatcgccaggaactgcaggacttcaggatgcgccaggcgttcatcgacgatccggagcgcttcaagcggttttccttcagcgcctgtgggctgttcctcgacttttcgaagaacctgattcgccaggacaccatcgacctgctggtgaagctggccgaggaagcacggctgagcgacgcgatccgggcgatgttcgacggcgaggcgatcaatgcctccgagcgccgaccggtactgcataccgcgctgcgtcgaccgatcggcgacaaggtgctggtcgatggcgtcgacgtgatgccggaagtccaccgcgtcctgcaccagatgaccgagctggtgggctacgtgcacaacggcctgtggcgcggctataccgaaaagccgatcaccgacgtggtgaacatcggcatcggcggctccttcctcggcccgcaactggtatccgaagccttgctgccgttcgcccagaaaggcgtgcgctgccactacctggcgaacatcgacggtagcgagttccatgaactggccagccgcctgaacgccgagaccaccctgttcatcgtttcctccaagtccttcgggaccctggaaaccctgaagaacgcccaggccgcacgcgcctggtacctggcccagggcggcaccgaggaagagctttaccgccatttcatcgccgtctccagcaacaaggaagccgcgatcgccttcggcatccgcgaggaaaacatcttccccatgtgggactgggtcggcggccgctactcgctgtggtcggccatcggcctgccgatcgccatgtccatcggcatctccaacttcaaggaactgctgtccggcgcctacaacatggaccagcatttccagaccgcgccgttcgaacgcaacatcccggtgctgctcggcctgctcggcgtctggtacggcgacttctggggcgcgaacagccacgcgatcctgccctacgactactatctgcggaatatcaccgaccacctgcaacaactggacatggaatccaacggcaagagcgtgcgccaggacggcacgccggtcaccagcggcaccgggccggtgatctggggtggtgtcggctgcaacggccagcacgcctaccatcagttgctgcaccaaggcacccagttgatcccggcggacttcatcgtcccggtgagcagctacaacccggtggccgaccatcaccagtggctgtacgccaactgcctgtcgcagagccaggcgctgatgctcggcaagagccgcgaggaggccgaggccgaactgcgcgccaagggcctgccggaagccgaagtgcagcgcctggcgccgcacaaggtgattccgggcaaccgaccgagcaacaccctggtggtcgagcgcatcagcgcccgccgcctcggcgcgctgatcgccatgtacgagcacaaggtctacgtacagagcatcctctggggcatcaacgccttcgaccaatggggcgtggagcttggcaaggaactcggcaagggtgtctattcgcgcctggtcggcagcgaggaaaccccggccgaggacgcctcgacccaaggcctgatcgacttcttccgcggccgccatcgcggctga

SEQ ID NO: 10452 - DNA, 1287 bp, Pseudomonas aeruginosa
cgtgctgaagagccgcggcgtggaaaagggcgaccgggtctgcatctacatgccgatgattcccgaggccgcctacgccatgctcgcctgcgcccgtatcggggcggtgcactcggtggtgttcggcggcttctcgccggactcgctgcgcgaccgcatcctcgatgccgactgccgcaccgtgatcaccgccgacgagggcgtgcgcggcggcaagtacatcccgctgaagcagaatgtggaaaaggcactgaaggactgcccggacgtctctaccgtggtggtggtcgagcgcacccagggcgacataccctgggtcgaaggccgcgacatctggtaccacgaggcgctccacgcggcctcagccgactgcccggcggaagcgatggacgccgaggacccgctgttcatcctctatacctccggcagcaccggcaagccgaagggcgtgttgcacaccaccgggggctacctgctcggcgcggcgatgacccacaagtacgtgttcgactaccacgatggcgacgtctactggtgcaccgccgacgtcggctgggtcaccggacacagctatatcgtctacggcccgctggccaacggcgccaccaccctcatgttcgagggcgtgcccaactacccggacgcctcgcgcttctggcaggtgatcgacaagcaccaggtgaatatcttctacaccgcgccgaccgcgatccgcgcgctgatgcgcgaaggcgacgccccggtccgccagacctcgcgcagcagcctgcgcctgctcggctcggtgggcgagccgatcaacccggaggcttgggagtggtactaccaggtggtcggcgagaagcgctgccccatcgtcgatacctggtggcagaccgagaccggcagcatcctgatcaccccgttgcccggcgccactgcgctaaagccaggctcggctacccgcccgttcttcggcgtgcaacccgtgctgctcgacgagaaaggcaaggaaatcgacggcgcgggcagcggcgtactggcgatcaaggccagttggccgagtcagatccgcagcgtctacggcgaccaccagcggatgatcgacacctacttcaagccctaccccgggtattacttcagcggcgacggcgcgcgccgcgacgaggacggctactactggatcaccggccgggtcgacgacgtgatcaatgtctccggacaccggatcggcaccgccgaggtcgagagcgcgctggtcctgcacgatgcggtggccgaggcggcagtggtcggctgcccgcatga

SEQ ID NO: 10453 - DNA, 1614 bp, Pseudomonas aeruginosa
acagccgagcgacccgttcccgctgcgcatcgaccgcatccaactggccgagggcagcctgcacttccaggacctgcgaccgagcgagccggtggacttcagcttcgatccgctgggcttcgagctgcacaacctcagcaccctgcccgacgacggcgcgaagatgaccctggtcgccaccggcccgaacggcggccgcctcgactgggaaggcgacctgaccctggtgccgatcacgtccaggggccacgtgagcgtcaaggatatccagctcaaggcatggtggccctatgtccgcgacaatgccccgctggtgctggagaacggcgtggtcagcctctccagcgactatcgcctggacctgtccaaggacacccagctgctgctcgacaaggccgcgctgaaactcgccgacttcagcatcaattcgccccagggcaagccgctggccaagctcgccagcctcgacgtggccgctaccaccctggacctggccaagcaggaagtggtgctcggcgaagtccgcagccagggcctggaggcctgggccgcgcgcgagaaggacggccagctcgactggcagaaactgttcgccgacttcactccgccgccacgcaaggcgcctgcacccaagccggcggaaaacaccgatcccgccgctgccccgaccgacgcggcgaagaccacccgcgaaccggcaaccgacggtgccgccaaggcagccgtgatagcctcgggcgaagcgggcaaggacaggccggcggagaaggacgccagcgtcgccgagacggaaagggcaacggacgacaaagagtccgccaaggtcgcggaaggcgctgccgacaaggtagccaagcaagagacgagcaaggctccgaagaccggcaaggcaaccgggcaggaaacggccaagactgcggaaatcgacaaggcagccagcgactctccgcaacagctcgccgacactgcaaagacgcctccgccggaaagtacgaaagccgccgcggagacgcccgccaagccctggcacatcgtcctgcgcgacgcccagctgcgcggctacaaggcgcacctggtggatcgccagccggccaccgaggtcccgctggaagtcggcccgctggacctcgacctgcagaacgtcgacagcctcggcaagacccccttcgacctcaagctcaagaccggcctcggcaaccgcggccaggtccaggccagcggccaggtggtgctcgacccggtcagcgccaggctcaaggtcagtacccgcgacatcgacctgcgcgtggcccaggcctacatctcgccgttcatccgcctggaactgcgcagcggcttccttggcagcgagctggcggtcgacctgaagagcgtcgagccgctggccttcagcgtcgacggcagcgccgaagtcagccagttgcataccctggataccatcaaggaccgcgacttcgtcaaatggaccaagctgaccctcaacggcctcgcctatcggcacgaggacagcctgtcgatccagagcgtgtccttcgaggagccctacgcccgcttcatcatcaacgaagatcgcagcaccaacgtcagcgagctgatcatcccgcaaccgggtag

SEQ ID NO: 10454 - DNA, 462 bp, Pseudomonas aeruginosa
ggggcgactcaacctggacctgcactaccagatcgaacgcagccaactgaaggcggaaaacaaggtcctgctggaaggcctgcaactcggcgagaaggtcgacagcccggatgccgtaaacctgccggtgaagctggcggtagccctgctcaaggacaccaagggcaacatcgatatccagttgccggtggccggcgatctgaacaacccggagttcagcgtcatgccgatcgtctggcagaccctgcgcaacctggtcctgcgcgccgtgcaggcgccgttcaagttcatcgccggcctcgccgccggcggcaacgaggatctcggcacggtacccttcgccgcgggcagcgacgagctgacgccggaagcccaggccaacctcgacaagctcgccgatgcgctcaaggagcggccggcgctgcgcctggaagtggaaggcgtggcctccgccgcggctga

SEQ ID NO: 10455 - DNA, 2028 bp, Pseudomonas aeruginosa
aaaacaggtcggaagcgagacggttgcagaatgccgaattggcgatggcagggcttgcaaaatgcaaggattcacccccttcgccgagaagcgcgtcgcggaaacgaaaacagggcccgagggccctgttttcatcgatcacgactcgacttacacgccggaagcttcggcggcagccacgtccttgatcgacagcttgatgcggccacggttgtccacgtcgagcaccaggaccttcacttcctggccttcctgcagcacgtcggtgaccttgtcgatgcgcttgtcgctgatctgcgagatatgcaccaggccgtccttgcccggcaggatgttgacgaaggcaccgaagtcgacgatgcgctccaccttgccgacgtagatcttgccgatctcggcttccgcggtgatcgccaggacgcgcagcttggcagcctcggcggcttccttggtttcgccgtagatcttcacgctgccatcgtcctcgatgtcgatcgaggccttggtctcttcgcagataccacggatggtcgcgccgcccttgccgatgacgtcgcggatcttgtccgagtcgatcttcatctgcagcatggtcggggcgttctcggacagctcggcgcgcggcttggcgatgacctggttcatctggccgaggatgttcaggcgagcttccagggcctggcccagggcgatctccatgatctcttcggtgataccgttgatcttgatgtccatctgcagggcggtgacgcccttgtcggtaccggcaaccttgaagtccatgtcgcccaggtggtcttcgtcaccgaggatgtcggtcaggacggcgaacttctcgccttccttgaccaggcccatggcgataccggcgaccggcgccttgaccggcacaccggcatccatcagcgccagggaggcgccgcacacggaggccatcgagctggaaccgttggactcggtgatctcggaaaccacgcgaatggtgtaggggaactcgtcctgggtcggcagcatggcggcgacgccacgacgggccagacggccatggccgatttcacgacgacccgggctgcccatgcggccgcactcgcctaccgagaacggcgggaagttgtagtgcagcatgaaggcgtccttgcgctcgccttccagggtatccagcagctgggcatcacgcgcggtgccgagggtcgcgacgaccagggcctgggtttcgccacgggtgaacagcgcggaaccgtgggtcttgccgagcacgccgacttcgatgcgcagcggacgcacggtacgggtgtcacgaccgtcgatacgcggcttgccgttgacgatgttctcgcgaacggtacggtattccagcaggccgaatacgtccttgacctcggaagccgggaacttgccctcttcctcgccggcgaacagggccacggcctggtcgcgcagctcgcccagacggttgtagcggtcctgcttgatggtgatggtataggcctgggagatcgcttcgcccagctctgccttgatggcgttgaccagcacggtgttttccgccggggctttccagtcccaggccggcttgccagcttcggcggccagctccttgacggcacggatcaccgcctggaactcgtcgtgagcgaacagcacggcaccgagcatctggtcttcggtcagttcgtcggcctcggactccaccatcagcacggcgtcttcggtaccggccacgaccatgtcgaggctggaactctgcagttgctcgtaggtggggttgaggatgtagccgatttccggatggaaaccgacgcgggcggcgccgatcgggccggcgaacggaatgccggagatcgccagggcggcggaggtgccgatcatcgcggcgatgtccggatcggacttcttgttggtggagacgacggtgcagacgacctgcacttcattcatgaaaccttcggggaacagcggacggatcggacggtcgatcaggcgcgaggtcagggtttcccttctcggaaggacgtccttcacgcttga

SEQ ID NO: 10456 - DNA, 636 bp, Pseudomonas aeruginosa
tctcgacgcgcaggtcgacctcgtcctcgaaacgtttcttggtggcggtcgccagagccagctccagcgcctcgaaaatcacgccggccggtacgcccttttcgttggataccgactcaacaaccagcagtacttctttgctcattgtacgcctcgcctttcaatccattggatccgcggattcgcgtctcaatcaaaacggggaatgatgttggccttgtcgatcgaatcgatcggcagcaggtactcgtgatcgtccaccaggaccaccacatcctgctcctccacaccacggagaatgccttggtagttacgccgcccctcatagggcgaacgcagcctgatcttcacttgctcgccggcatgcttggcgaactgttcgagggtgaacagcggccgatccatgcccggagaggacacctccagggtgtactcgccgctgatcgggtcttcgacgtcgagaataccgctgacctgccgactgacggcttcacagtcatcgatgaggatgccttcggggcggtcgatatagacgcgcaacaccgaatgacgaccctgggaaatgaactcgacgccccagcactcatagccgagcgcctcgaccacaggggccagcaaggcctgcaactgttctag

SEQ ID NO: 10457 - DNA, 564 bp, Pseudomonas aeruginosa
gggaggctccacctaccagccccccatcgatatccggcatgccgaacaactcggctgcacttgccgcctttacactgccgccgtaaaggagtcgcacaccttttgcgacctcggcattttccgctgccagttgcgcgcggatcgccgcgtgcacttcctgggcttgcgcgggggacgcggtcaacccggtcccgatcgcccagaccggctcgtaagccacgactgcgcgagcaaaagctccaacacccaactcgtcgatcacgcttcccagctgccttgcgacaacctccagcgtcttgcccgcctcgcgctccgcccgggtctccccgacacacagcaccggcaccaggccgcacgactgagccgcggcaaacttgcgactcacaacctcgtcactctcgccgagaatcaggcgacgctccgagtggcccacgaggaccatgctacaaccgacatccgccaactgactgggagcagtctcaccggtcagcgcgccttgcatcggctcgacggcgctgttctgcgcacctacatcgatcgccttgccggccaggccctggatga

SEQ ID NO: 10458 - DNA, 1278 bp, Pseudomonas aeruginosa
cgccgcgatgatggcatcgcccgtcgtggtgttctggcagcagacgatatgtcccgaattctcccctcccagcatccagttccgagccagcagttcggccatcacatagcgatcgccgaccttcgcccgcacgaacgggatatgcagttcctgcaaagccagctccaggccgaggttgctcatcagggtgccgaccacaccgccttgcaggcgcccgctttcctgcaggtcgcgcgcgatgaggaaaagcagttcgtcgccatccacgaccgcaccggtatggtcgaccatcatcacccggtcgccgtcgccgtcgaaggcgatgccgaggtcggcatggtgctcgaccaccgcagcctgcaggccatccaggtgagtggaaccgcacttgtcgttgatgttcaggccattcgggctggccgccagcaccgtcacttccgcgcccagttcccggaagacgctgggagcgatcttgtaggtagcgccgttggcgcagtcgagcacgaccttgagaccgttgaagtcggtgctggtcggcacgctgctcttacagaattcgatgtagcgccccgccgcgtcattgatccgcgaaaccttgccgagacgggcggactccaccacggtcatcggcgcatcgagcagttcctcgatcatcagctcgacgtcgtccggcagcttggtcccctgcccggagaagaacttgatgccgttgtcgtcgtggggattgtgcgaagcgctgatcaccaccccggcctcggcgtggaaagtccgcgtcaggtaggcgatgccgggggtaggcatcggtcccagcaacagggtatcggcgccggaagcggagagcccggcctcgaaggccgactcgaacatgtaacccgagctgcgcgtgtccttgccgatcaggacccggcagttgccctgccggcggaaggccatgcccaccgcccagcccagcttgagaacgaagtccggagtaatcggaaactcgccaacacgaccacggataccgtcagtcccgaagtattttctgctcatcttttgtcttccgtgctcaatccgccatttcaacggcggagatcattcgcatcacgtcgacggtcgccgccacgtcatgcactcgaattatccgtgcgcccttggccagcgccagggccgccagagctaggctgccgtagaggcgttcgtccacctcccgccccagtaccttgccgatcatgctcttgcgcgaaacgccgaccaacaacggcaagcccaggccatggagtgcctgcagatgcctga

SEQ ID NO: 10459 - DNA, 759 bp, Pseudomonas aeruginosa
aactggcgctggccgagcgcgacgatcgccgcgccctgctcgacgaactctgcgcgcagtcgcgcagcgacctggtgcaaagcatcggcaagatggcgctggtctatcggaagaacccgaagccgaacaagaatctctcgaacatcagccgtttcgccggcatctgatgccccatccaaccaaggtcgggaaacttcccgacctggttcagacgccttcctcgtcccgccccggtaccggctgcaacaccagcagcaggccacacatcgccaccgccaggtagttgaacagcagccagcgcaccgcctcgggcgccagcccacgcaccaggaaatacaccaggcagagcagcgcgacggcgagcaacaactgaccgcgaaggtctcgccagaggctcctcggcccgtggctcgacaccaacaccagcgcctgcagcgccgcacagaatccggcgaagccgatcagcagcggcgtcaacgccgcggctacggtttccaccagcagcggcgccagtccggtcttggccaacgcaggcaggaccacgaactgcagcaaccagaggccgccgacccagaacgtctgggccagcagccaactgatcgcgcctgcgcgcaacggggcgcgcttagatatggcgaacctcgacgatctcgtactcgacgtcgccgcccggggttctcaccagcacggcatcgccttcggtcttgccgatcagcgcacgggcgatcggcgaattcaccgagatcttgccacccttga

SEQ ID NO: 10460 - DNA, 1788 bp, Pseudomonas aeruginosa
tctgcgggcgcagcacgcccttcaggtgtttcacttcttcttccagggcgcgggcgccctggacggtcatggggaacttgctcatgccttgattcctgcgtggagatcctgcagacgccgaacggtcttctcgggaccgaacttgagcgcctcacagatcgcctgcccacccgcaatggtggtggtgcagcagatcttgtgctgcagggcgtttcgacgaatggagtaggagtcagcgatggactgccggccctcggtggtgttgatgatcagggtgacctcgtcgttcttgatcatgtccaccacgtgcgggcgaccttcggtcaccttgttcacgcgacgcaccggcaggcccgcggcctcgatgacacgcgcggtaccggcggtggctaccacttcgaagcccagcgcgaccaggtcgccagccacctgggcggcgaacggcttgtcgtcttcgcggacgctgatgaaggcgcaaccggcggtcgggagaatctcgctggcccccaactgagccttggcaaaggcttcggcaaagctatcaccgacgcccatcacttcaccagtggacttcatttccgggccgaggatcggatcgacgccggggaacttggcgaacgggaacaccgcttccttgacgctgaagaacggcgggatgatttcctgggtgaagccgacctcggccagggtcttgccggccatgacgcgggcggcgaccttggccagcgactcgccgacgcacttggagacgaacggcacggtacgcgaggcgcgcggattgacctcgatgacgaagatatcctcgccctgcaccgccatctgcacgttcatcaggccgaccacgccaagctccagggccattttcttgacctgctcgcggatctcgtcctggatgtgctgcggcagcgagtacggcggcagcgaacaggcggagtcgccggagtgaacgccagcctgctcgatatgctgcatgatcgcgccgatcaccacgatctcgccgtcgcataccgcgtcgatgtcgacttcgatggcgcagttgaggaagtggtcgagcagcaccgggctgtcgttggaaacctgaaccgcctcacgcatgtagcgcttgagttcttcttcctggtagacgatttccatcgcccgcccgcccagcacgtaggacgggcgtaccaccagcggataaccgatggccttggacgcggccagggcctcgtcttcgctgcgcgcggtggcgttggccggctggcgcaggttcaggcgctggaccatctgctggaagcgctcgcggtcttcggcacggtcgatggcgtccggactggtgccgatgatcggcacgccggcctcttcgagggcgcggcagagcttcagcggggtctggccgccgtactggacgatcacgcccttgggctgctcgacgcggacgatctcaaggacgtcctcgagggtcaccggctcgaagtacaggcggtcggaggtgtcatagtcggtggagacggtttccgggttgcagttgaccatgatggtctcgtagccgtcttcgcgcatcgccagcgccgcgtgcacgcagcagtagtcgaactcgatgccctggccgatgcggttcggaccgccgccgaggatcatgatcttctcgcggctcgacgggttggcctcgcactcttcctcgtaggtcgaatacatgtaggcggtgtcggtggcgaactcggcggcgcaggtatcgacacgcttgtagaccggcagcaccttcagcttgtggcgatggctgcgcaggttcttctcggtgacgcctag

SEQ ID NO: 10461 - DNA, 1659 bp, Pseudomonas aeruginosa
cagcttggccaggcgcgcgtcggagaagcccttgcgcttgagcttgtacatcagctcgcgatcgatggaggacaggccgagggtcttgaccttctcctcgtccttgaccaggtcctcgatctgcaccaggaaccattcgtcgatgcgggtcagctcgaacacttcctcgacgctcttgccggcgcggaaggcgtcggcgacgtaccagacacgctcggcgctgggcacggtcagctcgcgcttgaggatgctgtcggcctccgggtcgttcaggtcgagcttcggatcgaagccggtggcgccgacttccaggccgcgcaaggctttctgcaccgactcctggaaggtccggccgatggccatgacttcgccgaccgacttcatctgggtggtcaggcgggcatcagctttcgggaacttctcgaaggcgaagcgcgggatcttggtcaccacgtagtcgatggccggctcgaacgacgccggggtgcggccgccggtgatgtcgttctgcagttcgtcgagggtgtagccgaccgccagcttggcggcgatcttggcgatcgggaaaccggtggccttggaggccagggccgaggagcgggaaacccgcgggttcatctcgatcaccaccatgcgcccggtgttcgggcagatgccgaactgcacgttggaaccgccggtttccacgccgatctcgcgcaataccgccagcgaggcgttgcgcatgatctggtattccttgtcggtcagggtctgcgccggcgccacggtgatcgagtcaccggtgtgcacgcccatcgggtcgaagttctcgatggagcagacgatgatgcagttgtccttcttgtcgcggaccacctccatctcgtattccttccagccgatcagcgactcgtcgatcaacagctcgttggtcggcgacaggtcgaggccacgggcgcagatctcttcgaactcttcacggttgtaggcgataccgccgccggtgccgcccatggtgaaggacggacggatgatgcaggggaagccgacctgctcgagcacgccgtaggcctcctccatgctgtgggcgatgcccgagcgcggacaggccaggccgatatccttcatcgccttgtcgaagcgcgagcggtcctcggccttgtcgatggtatcggcattggcgccgatcatctccacgccgaacttctccagcacgccgtggcgctccaggtccagggcgcagttcagcgcggtctggccgcccatggtcggcagcagcgcgtcggggcgttccttctcgatgatcttggccacggtggcccacttgatcggctcgatgtaggtcgcgtcggccatcgccggatcggtcatgatggtcgcggggttggagttcaccaggatgacgcggtagccctcctcgcgcagggccttgcaggcctgggcgccggagtagtcgaattcgcaggcctggccaatcacgatggggccggcaccgaggatcaggatgctctttatgtctgtacgttttggcatgggactctcgttgcaataatcaggacagggttgcggtggccagcttcacaccaaagccgacgaacagggcgccgacgcccgaagtggcgccggcagccaaccgttgccgccggcggaaccaggccgccagccgcacaccggtga

SEQ ID NO: 10462 - DNA, 1386 bp, Pseudomonas aeruginosa
acagcatcggctcggccttcagcagggaggccacaccgagggccgacagcagcatcagcaccgcgtctccgaggaacacgccgcaggcggcccggtagccggtcgccacgccacgctgggccgaagtcgcgaggacgaacaacgagttcggtccgggcaacaggatcacgaaaaccacacccagcacgtaggtccagaaatcggttatccccagggtcggcatggctctgctcctcagcgacgctcggccatcgccgagatgaagcggtcgaacagcggggcgacgtcatgcggaccggggctcgcctcggggtggccctggaagctgaaagcgaccttgtcggtgcgctcgataccctgcagggtaccgtcgaacagcgacttgtgagtggctcgcaggttgtccggcagggtgctctcgtcgaccgcgaaaccgtggttctggctggtgatcatcaccacgccgctgtccaggtcctgcaccgggtggttggcgccgtggtgcccgtggcccatcttcagggtcttggcgccagaggccagggccagcaactgatggccgaggcagatgccgaacaccgggatctcggtatcgaggaattcgcggatcgcctggatcgcgtagtcgcacggttcggggtcgccggggccgttggaaaggaagatgccgtcagggttcagcgccagcacttcgctggccggtgtctgcgccggcaccacggacaggcggcagccgcgcgccaccagcatgcgcaggatgttcagcttcacgccgtagtcgtaggccaccacgtgatacggcagttcaccggccgggatctccggatgactgtcgctttccaggttccagacgctggagcgccactcgtagcgctcggcggtggtgacctccttggccaggtccatgcccttcaggccggggaaggcgcgagccagctccagcgcgcgttcctcggtagcgtcggcaccagccaggatgcagccgttctgcgaacccttctcgcggaggatgcgggtcaggcgacgggtatcgatgccggcgatggcgacggtgccgttggctttcaggtagtcaggcagcgactgcttgctgcgccagttgctggcgatcagcggcaggtcgcggatgatcaggccggcggcccagacgcggttggcctcggcgtcttccggggtggtaccggtattgccgatgtgcgggtaggtcagggtgacgatctgctgggcgtaggaaggatcggtaaggatttcctggtagccggtcatggcggtgttgaacaccacctcgccaacggtctggccgtcggcaccgatggcttcaccgcgaaaaatgctgccgtcggcaagtgcaagtatggctggcttagtcaagaagacctcccgtaa

SEQ ID NO: 10463 - DNA, 1296 bp, Pseudomonas aeruginosa
ggaccctccagacacgccaacgcgggagcaggctcccgcgtggcggatcatgcgtaccggcctggccggcacgcggggcagaagcaagccggggcttacttgttgtccttgacctcttcgaactcggcgtccaccacgtcgtcagcggctttcgcctgctcgccctggggagcgtcttcgccctgctgggcctgttcggcgtacatcttctgcgccagcggggtggaagcctgggacagagcgttcatcttggcctcgatctcggccttgtcgtcgcccttcaccgccgcttccagctcgcccagcgccttctcgatggtcgccttgtcctcggcggtggccttgtcgcccgcctcggtgatcatcttgcgggtcgcgtggaccagcgcgtcgccctggttgcgagcggcagccagttcctcgaacttgcggtcctcctcggcgttcgcctcggcatcgcggaccatctgctggatctcatcctcggacaggccggaggatgccttgatcacgatggactgctgcttgccggtggccttgtccttcgccgagacgtgcaggatgccgttggcatcgatatcgaaggtcacctcgatctgcggcacgccgcgcggagccggcggaatgtcggccaggtcgaacttgcccagcgacttgttctgcgcggcctgcttgcgctcgccctgcagcacgtggatggtcaccgcgccctggttgtcgtcggcggtggagaacacctgcgacttcttggtcgggatggtggtgttcttctcgatcagaccggtcatcacgccgcccagggtctcgatgccgagggtcagcggggtcacgtcgagcagcagcacgtccttcacgtcgccggccaggaccgcgccctggatggcggcaccgacagccacggcttcgtccgggttgacgtccttgcgcgcttccttgccgaagaactcggcaacggtcttctgtaccagcggcatgcgggtctggccgccgaccaggatcacttcatggatatcggaaacatccaggccggcatccttcagcgcggtgcggcacggctcgatggtgcgctgcaccaggtcttcgaccagggactccagcttggcgcgggaaaccttgacgttcaggtgcttcggaccgctcgcgtcggcagtcacatacggcaggttgacgtcggtctgctgggtcgaggacagctcgatcttggctttctcggccgcttccttcagacgctgcatggccagcgggtcgcccttcaggttgatgccgctttccttcttgaactcgtcgacgaggtag

SEQ ID NO: 10464 - DNA, 2127 bp, Pseudomonas aeruginosa
tcgcctcgtcgttgggatcggacatctccaggccgcgctcgagggtgtcgaccaccgccagcaggtcgccggcgaatttctccagcgcgaacttgtgcgccttctcgacatcctgctccgcacgccggcgtacgttctgcagatccgcgaccatgcgcagcgcctggtcctgggcggcagccagctgctcctccagttcctgcacgcgggcggtcaggtcctcggcggcgccggtgggctgctcgggggtctgttgatccagggtctgctgttcgtcagccatgccactctccttcaaaaataagctggcaaatacaaggcgaacgcataagttcgcaacgttgccggctatatggggacggctttccacggttcaaggggcgagcggcaattgccagccggaaaaaatactgtataaataaccagacaaaacccacggagccgcccgccatgctggttcacctgtccgttcacaactacgccatcgtcgagcatctggatctcgaactcgctaccggcatgagcgtgatcaccggcgaaaccggtgcgggcaagtcgatcatgctcgacgccctcggccttaccctcggcgaccgcgccgacagcggcgcggtacgtcccggagcggacaaggccgacattctcgccagcttcgacgtcagcgccatcgccgaggcccgcgactggctcgccgagcgcgacctggaacaggacggtccgtgcatcctgcgccgggtgatcactgccgaaggtcgctcgcgtgcctacatcaacggcacgccctgcccgctgggcgacctgaagagcctgggcgaactgctgatcgacatccatagccagcacgagcaccagtcgctgctgaagagcgagacccaccggcgcctgctcgacgagtatgccggctgccaggagctggcgcgccaggtgcagctcgccgcgcaacgctggaagcagaccagccaggaactcgaacgcctgtcgcgtagcggcgacgaacagcgcgcccgccaccagttgctcagctaccagctggaagaactggaaaacctgtccctcggcgaaaacgaactggaaagcctggagcaggagcagaagaccctgagcaacgccgaaagcctgctcgccgcctgccgccaagtcgtggaaatgtgcagcgagagcgatgccggcaacgtcctttccgcgctcaatgccagcctcaaccgcctgtcctcgttcagcggccagcccgccgctctcggcgaagcggtcaatctgttgtccagcgcgcagatccaggtcgaggaggcgatcggcgaactgaaccgcttcgtcgaccacttcgatgccgatcccaatcgccagcagcaggtcgaggagcgcctggacgtcatttactccctggcgcgcaagcaccgggtccagcccgccgaactggccgacctgcagcagcgcctgttcgacgagctggaggcgctgaacgccgacgacgaagcggtcggacgcctgggcgacgagctggccgcctacgcccggcattaccaggaaaaagccgacgaactgagccgcctgcgccaggccgcggccgcacctcttgccgccagcgtggagcaggaaatgcagcgcctgggcatgcccggggggcgcttcgccatcgtcctgcatcccggcgacagcgccgagccgcaggccaacggactggaaagcgtggagttcctggtcagcgccaaccccgggcagccgctgaaagggctggccaaggtcgcctcgggcggcgaactgtcgcggatcagcctggcgatccaggtgatcacggcacagacctcgcgcatccccaccctggtcttcgacgaagtcgacgtcggcatcggcggccccaccgccgaagtggtcggacagttgctgcgccgcctcggcgaacgcggccaggtcctcaccgtgacccacttgccgcaggtcgccgcccagggccaccagcacctgttcgtgcacaaggaacgcggcagcagcgaaacccgtacggcggtcgccaccctgaacaaggcccagcggatcgaggagatcgcccgcatgctcggcggcgtcgacctgaccaaggaatccctggcccacgcgaagaaactggtcaacctggccgcccagaactga

SEQ ID NO: 10465 - DNA, 555 bp, Pseudomonas aeruginosa
acgttccttcaatggaaaatgaaaacggcgaccccagggtcgccgttttcgcatggaaccgttgcgcgactacttcttcttgcgcacgtagagcaccagattgtgatcgaccagctcgaagccgcgctcgcggacgatttccttctggcgcttctcgatttccgcatccatgaactcgatcacctcgccggtatcgacgcagaccatgtggtcgtggtggccgctatcggcgagctcgaacacggcatggccgccatcgaagttgtgacgcaccaccaggccggcggcctcgaactgggtcagcacccgatagacggttgccaggcccacgtcctcgcctgcgtccatcagcgccttgtacacgtcttcggcgctcatgtggcgttgctcggccgagtcgagcatctgcaggatcttgacccgcggcagggtcactttaaggccggcttttcgaagttcgctattttcaaccatgtctgctttctcagcgcgggatgtttcgcagtatcccggaatacgggtatgatcgggcttttatttgcccagccaagatag

SEQ ID NO: 10466 - DNA, 498 bp, Pseudomonas aeruginosa
accacctcgacggcgatctcagccatagagttgcttggcgcgctggcagaacgcgtcgaccatggtgttggcggcctgggtgaacagcggcccaagggtcgccttgaccagcggcccggcgtaatcgaaggtcaggtcgagggtgatcttgcaggccttctcgcccagcgccttgaactgccagacgccatgcagttcggtgaacggtccgttttccaggttcatctcgatggaagctcccggcaccaacacgttgcgggtggtgaagcgctggctgaggctacccttggccacggtcagctcggcgcgcatcaggctttcgctctcctccaggacctggctggccgaacaccagggcaggaactccggatagcgcttcacgtcgttcaccagatcgaacagcgcgcgggcgggataaggcaacagcgccgaacgctggatatgggtgctcatagaactctcacttctgctgtcgagcgggcgactccccaagcatag

SEQ ID NO: 10467 - DNA, 780 bp, Pseudomonas aeruginosa
gcgctggtgctgctccatcagttgcgcgcgggtttccgtgcgctgcgcgtacatcccgccgatattggtcaccacgttgcgccgcagcaagtcgaacaggcccttgatggtgtgcagcagcacggtgttgtggctggcctcggcgatcgccaggtggaagcgcgcgtcggcggcgccctcttccgcgctgacctggtcgttgcgcgcatagcaggcctggagcgcctcgaaggcctcggtcaggcgctggtgatcgagggaggtcgcacgcagcgccgcgtagtaggcacaagacccttccagcgtgtggcgaaactccagcaggtcgcgctgggcctccgggttaccttccagcaggtgcagcagcggatcgctgaaagtcgcgcccagcgattcggtcacatagttgccgccaccctggcggctgaccagcagccccttcgccaccagtttctggatcgcctcgcgcagcgacggccgggaaaccccgaactgctcggcaagcacgcgctcggcgggcagccgctcgccggacttcagcgtgccctccaggatcatcgcctccagttgcgcaacgatgtcatccgacagacggcgctgcctgacctgaccaaattccatatcccgacacccttacccgaagtttcgtcgcaaagcctctgccatgcgcccggcgcgaaaaagagaggaagcgtaccgagccgctccccgcaccacaagcgaggcgccacgagccccgcacgagcatccttagacaaaagtcgtagacgggcaaattga

SEQ ID NO: 10468 - DNA, 1707 bp, Pseudomonas aeruginosa
ggagccaacccccatgcaagcctggcaacaactctatacccccctgggcagtctcggcctgtcggccgccgcggccgtcatcccgatcgtgttcttcttcctcgccctggcggtattccgcctcaagggccacatcgccggcagcatcaccctggcgctggccatcgcggtagccatcttcgccttccacatgcccgccgacatggccttcgccgccgccggctacggcttcctctacggtctctggccgatcgcctggatcatcgtcgccgcggtcttcctctacaaactgacggtgaagagcggccagttcgaggtgatccgcagctcggtactgtcgattaccggcgaccagcgcctgcaggtactgctgatcggcttctccttcggcgccttcctcgaaggcgccgccggtttcggcgcgccggtggcgatcaccgccgccctgctcgtcggcctcggcttcaatccgctctacgccgccggcctgtgcctgatcgccaacactgcgccggtggccttcggcgcactgggcatcccgatcatcgtcgccggccaggtgaccggcatcgacgccttcaagatcggcgccatgaccggccgccaactgccgttcctgtcgatcctggtaccgttctggctggtgttcatgatggacggctggcgcggcatccgcgaaacctggccggccgccatcgtcgccggcggcagcttcgccatcacccagtacctgacgtccaacttcatcggcccggagttgccggacatcacctcagcactggtcagcctggtctccctgaccctgttcctcaaggtctggcagccgcagggcgccagcgaagcgctcgccgcaggcggcggcgcggccgtggccggtggcagcttcggcgggcaacgcagcgtcgaaccgtccgcctacagcttcggcgagatcctcaaggcctggtcgccgttcctggtgctcaccgtactggtgaccatctggaccctgaaacctttcaaggccctgttcgccccgggcggcgagctctactggctagtgttcaacttcgccatcccgcacctcgaccaactggtggtcaagggcgcgccgatcgccaccagcgccacgccgatcgcggcggtattcaagttcgacccgatctccgccaccggcacggcgatcttcctctcggcgttggtatcgatgttcattctgcgcatcggagtgaaaattggtattaccactttcaaggaagtcctggtagagctgaagtggccgatcctgtccatcggcatggtcctggccttcgccttcgtcaccaactactcgggcatgtccaccaccctggccctggtcctggccggtaccggcgcggcgttcccgttcttctcgccgttcctcggctggctgggggtattcctgaccggttcggatacgtcctccaacgccctgttcagctccctgcagtcgaccaccgcgcaccagatcggggtcagcgacaccctgctggtggccgccaataccagcggcggcgtgaccggcaagatgatctccccgcaatccatcgccgtggcctgcgccgcgaccgggatggtcggcaaggaatccgacctgttccgcttcaccctgaagcacagcctgatcttcgccgcgctggtcggactgatcaccctggcccaggcatacctattcaccggcatgctggtgcactgaccgcgccctga

SEQ ID NO: 10469 - DNA, 375 bp, Pseudomonas aeruginosa
tcaagggcatcctcgacccggaggatgccaggggatgcggtgaagttcggcgccgacggcatcgtcgtctccaaccacggcgggcgccagctcgacggcgtgctgtccagcgcccgcggcgctgccgggcaatcgccggaggcggtgaagggcgaactggcgatccttgccgactccggcatccgcaccggtctcgacgtggtgcggatgatcgccctcggcgccgacagcgtgctgctcggccgcgccttagtatacgccctggcccgccgccggcgaggccggggtgcgcaacctgctcgaactgatcgaaaaggaaatgcgcgtggccatggtcctcaccggggccaagtcgatcggcgagatcagcgctga

SEQ ID NO: 10470 - DNA, 1362 bp, Pseudomonas aeruginosa
ctcgctggtccgcgaactgggcgcctgagacgcccaccagaaaagcctgaaaacgcccggggcgtgaccgtcgtcccagggccgaggaaagccgatgagcctgccgattccctttctcgagaccgtcgagcggctgataccgcgcgaacgccgcttcgacgacccgctgtcgaccctggccttcggcaccgacgccagtttctaccggttgattcccaagctggtgctgcgcgtcgaaagcgaggacgaggtcgccgcgatcctatccgccgcctaccgcgagcaggtcccggtgaccttccgcgccgccggcaccagcctctccggccaggccatcagcgactcggtgctgctcgtcctcggcgacaactggaacggccgggaaatccgcgccgacggcgcgcagatccgcctgcagccgggtgtcatcggcgcccaggcgaacgcctggctggcgccgttcggccgcaagatcggtcccgacccggcctcgatcaacgcctgcaagatcggcggcatcgtcgccaacaacgccagcggcatgtgctgcggcaccgcgcagaacagctaccacaccctcgccggcctgcgcctgctgctggccgacggcacccgcctggacagcgaggacccggccagcgtcgcggccttccgcgccagccacggcgagctgctggaacggctcgccgaactcggccgcgagacccgcgccaacgccgaactggccgcgaagatccgccacaagtaccggctgaagaacaccaccggcctgtcgctgaacgcgctggtcgactacgacgagccgctggacatcctcacccacctgatggtcggctccgagggcaccctcggcttcatcagcgcggtgacctacgacaccgtcccggaacacccgcacaaggcctcggcgctgctggttttccccacggtggaaacctgctgcacggcggtcgcggtgctcaagcgccagccggtaatcggggggggactgttcgatcggcgcagcatgcgctcggtggagaacatgcagggcatgccggaatgggtgaagagtctttccgccggtgcatgcgccctgctcatcgagtcccgcgcggcgagccgcacgctgctgcacgaacagctcgggcggatcatggcctccatcgccgaatatccgctggagaagcaggtcgacttcagcgaagacccggcggtctacaaccagctctggcgcatccgcaaggacaccttcccggctgtcggcgcggtgcgcgagaccggcaccacggtgatcatcgaggacgtcaccttccccgtcgaacgactggccgagggagtcaaccgcctgatcgagctgttcgacaagcaccgctacgatga

SEQ ID NO: 10471 - DNA, 930 bp, Pseudomonas aeruginosa
cctggacaacctctgctgcggccagccgttcgcgtccaaggggtatgcgaagcaggccgacgacaagcgcgacgagctgctcgccgccctgctccaggccagccgcggcggcctcgacccgatctactgcgacaccagcccctgcaccctgcgcctggtccagggtctggacgatccgcgactgcagatccacgacccggtgaaattcatccgcagtcacctgctcgatcgcctggagttcatcccgcaggacaaaccggtagcggtgcacgtcacctgcagcacccagcacctcggcgagagccaggcgctgatcgacctggtcggccgctgcacccgcgaggtggtgatcccggaaggcattcactgctgcggcttcgccggcgacaagggcttcaccacgccggaactgaacgctcactccctgcgcaacctgaaggatgccgtgcagttctgcaaggaaggcgtgtccaccagccgtacctgcgacatcggcctcagcgagcacggcgggatcgactaccgcggggtggtctacctggtggaccgggtgacgcaggcgaagggcacgcctcggtagggcgaataaccgcctcgcggttattcgccgggccatgctccgcaaaagcggcggatagcgccgctggcgctattcgccctacgtcacgactctcaccggtagggcgagtatccgcctcgcggttatccgccgggccatgctccgcaaaagcggcggatagcgccgctggcgctattcgccctacctcacgacgcccaccggtagggcgaataaccgctcgcggttatccgccgggccatgctccgcaaaagcggcggatagcgccgctggcgctgttcgccctacgtcaggcgaaatggctgctccggcgtcgtcggcccgcgccgggtcgggcaaaaatccgtcgttaa

SEQ ID NO: 10472 - DNA, 900 bp, Pseudomonas aeruginosa
gcacctcttaagtcagccgcgcctatcgtgccttccaccgcgaggacatccctcgccgaaacggaagcaggaggccttcatggcaattcaaccgttgcgactcgatccgatcaccgtgctcggcaagcaactggtcatcgagctgttcgactgcgtcgaccagcgcttcgacgatatccagtggatcgaggaaagcatgctcgaggccgcccgccaggccaacgccaccatcatcacctcggcgttccacaagttcagcccgatcggcatctccggcgtggtggtgatcgccgaatcgcacctggcgatccatacctggccggagtacggctatgccgcggtcgacgtgttcacctgcggcgacgtactcgatggcgcccaggccgtgcgcgtgctcagcgaacgcctgggcagccgtcggcacctgatctcgagcatggaccgcggcctcggcggccatcgcctggggctgctcagccgcagcctggccggcaatggcccggtcgacgaagacagcccgaccctgcgctgggcgctgggccagggcacgggggtggcctgatggatacgccgatcgaacgcgccccgctggctcccgacctgagccaggcccgttacgccgtcgacctcaccggcctggtgccggcggaggtcgccgccggggctgccgccgctgccgccgaaccacttctatttctatccgccggacccgctgctggaaggcgacggcgcgatcaccgcgatcgaggacagcgaccccttcgaccagtacgtctaccgcctgcgccgggtgctctaccagggccgcacgcgctggcagaacgtgctgatcgccgacacctacaactacgaccgcgtgctgatgctcgacggcgcgatccagagcgccgagagcgatga

SEQ ID NO: 10473 - DNA, 1581 bp, Pseudomonas aeruginosa
cgtggtcatcatcgacgtcgtcgacatgctcgacaacggcccggcccaggctctctatacccgccagttctacgagctgctgcattcgcgcctgcgaccgggcggggtggtcgcggtgcaggggctggagttctcccacagcgacgacaagccccacgcggccctcgcccgcaccctgcgcagtgtcttctcccaggtccacagctaccgcgccacggtgccctcgttcctctcctcctggggcttcctgctggcttccgactggctcgacacgaaccactggcaggccgaggacatcgaccgacgcatcgaacgcaagctcggcccgctgtggctcgaccacctcgacggcgactacctcaaggcctgcttcgtgatggaccgggaaacccgcttcctgctcgcccaaccgggaccggtactggaagacggcgtacccttcgtcgcaccgccggatatcgaggagatcgagttcggcccggcacaattgccggccctggcgaggacctgaagatgtccgccgctcccctggccagcgtaccgctggccgtcaacggcgcgccctgcctgctgcaccgggtacgcttccgctccgccgcggacggcggcggcctgccgctactggccaccctgcgcgatccgcagccggcgctggccgtcctggcgcaacgcatcgagctgagcgaagacgcggaactgccggagaccgccgtcgacgacgagctgctggtgatcttcgccaacgccgggctacagaccgggcacgcctggcgccagcgcctggaagcctggatggccgccggcgaggacgagcgccagccgaccctggaagcgccctcgttcggcgagcgggtgctgtggcgccccggccgcgcgctggtcatcggcaaccccgagcgctgccgggagctgctcgaaggcctggccgtcttcgcctggcacgaaggtcacctgcgccgcctggaaggcgagaccgcggcggcctgggaaccggcccaggccgatgtcgaactgacccagctaccgcgccgtgccgccctgcggcgccaggaacatgtgaaccggcaggtgcgacgcactacactctggcgcatggcctatgcccgcctggagtcgcacctggagaagccgccgctgcaactgaacggcgctgtgcgccggctctacaacgaactggccatgcaggccgaagtgcacgatcgcctggcgaccctggacgatcgcatcgaagtgctgcaggacctgtacgaactggccgccgaccgcctcggcgaataccgctacttccggggcgaactgcgggtcgaatggctgatcgtcgccatccctcctgctggaggccggcctgagcctgtgggaattgtggaatcactgaaacgaggctgccatgagaatactgctggccgaggacgacctgctgctcggcgacggcatccgcgccgggctgcgcctggaaggcgataccgtggaatgggtgaccgacggcgtggccgcggagaacgcgctggtcaccgacgagttcgacctgctggtgctcgacatcggactgccgcgccgcagcggcctggacatcctgcgtaa

SEQ ID NO: 10474 - DNA, 1929 bp, Pseudomonas aeruginosa
cctgcgccaccagggccggctcaccccggtgctgctgctcaccgcgcgggacaaggtggccgaccgggtcgccgggctcgacagcggtgccgacgactacctgaccaagcccttcgatctcgacgaactgcaggcacgggtgcgcgccctgacccgccgcaccaccggtcgcgccctgccgcaactggtgcacggcgagctgcgcctggacccggcgacccaccaggtgaccctgtccgggcaggcggtggaactggcgccgcgcgaatacgcactgctgcgcctgctgctggagaacagcggcaaggtgctctcgcgcaaccaactggagcagagcctctacggctggagcggcgacgtcgagagcaacgccatcgaagtccacgtccaccacctgcggcgcaagctcggcaaccagttgatccgcaccgtccgcggcatcggctacggcatcgaccagccggcgccctgaaaaccgcctaccggagtcccccgatgtcccgtgccgccgtcccctccgtccgccggcgcctgctggtcaacctgctggtcggcttcgtgctgtgctggctgagcgtggcggcgctgacctaccacctctcgctgaagcaggtgaaccgcctgttcgacgacgacatggtggacttcggcgaagccgccctgcgcctgctcgaccttgccaccgaagaccaggccggcgaggacggctccatcaccgagatcatcgaacgcagccgcgaagcgatccagggtctgcccctgctgcgccgcgaaagcgccctcggctacgccctgtggcgcgacggccagccgctgctgtcgagcctcaacctgccgccggagatcacggcccagggccccggcttcagcaccgtggaagcccagggcacccactggcgggtgctccagctgaacatcgacggcttccagatctggatcagcgaaaacctgatctaccgccagcacaccatgaacctgctgctgttctactcgctgttcccactgctgctggcgctgccgttgctcggcggcctggtctggttcggcgttgcccgcggcctggcgccgctacgcgaagtgcaggccgaggtccagcagcgctccgcgcgacacctgcagccgatcgcggtggaagcggtgccgctggagatccgcggcctcatcgacgaactcaacctcctgctggagcgtctgcgcaccgccctcgaggccgaacgccgactgaccagcgacgccgcccatgaaatccgcacgccactggccagcctgcgcacccatgcccaagtcgcgctgcgttcggaagaccccaaggcccacgcccgcggcctgctgcaagtcagtcgcagcgtcgagcggatcagcaccttgatggagcagatcctgctcctcgcccgcctcgacggcgacgccctgctggagcaattccacccggtcaacctcgccaccctggccgaagacgtactctccgaactggcgcgccaggccatcgacaaggacatcgagctgtcgttgcaccaggagaccgtgcacgtgatgggcatcgacctgtggctgaaggcgatggtcggcaacctggtgggcaacgccctgcgctacacaccggccgggggccaggtcgagatccgcgtcgagaatcgcgcccagcacgccgtgctgcgggtgcgcgacaacggccccggggtcgccctggaagagcagcaggcgatcttcacccgcttctaccgcagccccgccaccagcagcggcgagggcagcggcctgggcctgccgatcgtcaagcgcatcgtcgaactgcacttcggcagtatcggcctgggcaagggactggagggcaaagggctggaagtgcaggtgttcctgccgaagacccagccggacgcgacgcggccgccggccagaggtccggacagcgggcggtcacatatctga

SEQ ID NO: 10475 - DNA, 432 bp, Pseudomonas aeruginosa
gctagcggcttcgcaacctcccaggagacccggatgaacatcggtgaagcggcgaagaaaagcggactgacgccgaagatgatccgttactacgagtccatcgagttgctccgcccagccggacgcagcgccagcggctaccgccactacaacgagaacgacctgcataccctggcgttcatccgccgttcgcgggacctcggtttctccctcgacgaagtcggcaagctgctcaccctctggcaggatcgccagcgtgccagtgccgacgtcaaggccctggcggcgcagcacgtgcgcgagctgaatcgcaagatcgaggagctcagcaccctgcgcgacaccctgcaggacctggtcgagcactgccagggcgaccaccgccccgactgcccgatcctcaaggacctggcgtctggctgctgccactga

SEQ ID NO: 10476 - DNA, 861 bp, Pseudomonas aeruginosa
tatccagcagcggccagcgcgccgtccagttcttctcccgcaggcgccgccggtagacctccggcttgccggcgaaatgcgcggtgggccgcaccttcagcgccagcaggtcgtcaacgcccagcggtgccagtagctccaggcgttcgccgacgagccgcagcgccaccgccgtgcacgtttccgcccagtggcacagcgcatcggcgcaatcccggtagggccggtcgccgttgcgcaggtgcatgcgcgcctggttcttcaccgaccagggtgcctcgcagcgacggcgcaacgcggcctcgaagtcggcgtcggcctgcgggtcgagggcccgcggggcgaaatgaaatacgtcgatgtccgccagcggcgtggcttcgccgtagccatgcagatggtcccataccgcgttgcgcacgaagccggcgccgatccaggcgccctccgggccgacctcgcgcagcacgcggagcagatgcaggcgcgaggaatcggcggcgaacagcgcgaggatgtcttccgccgttttcatcccaaccgccgcaccggccaggcgaagcgtcgcagcaggctggccggcaacagggtgatggccagcccgacgaacaccagcgcgcaggccagcaggctgtccaggtcgaggcgttcgccgagcagcagccagccggcgagcatgcccgacacaggcaccgccagggcgaacggggtcaccaggctggccgggtagtggcgcaggaggaaactccagatggcgaagcccaccgtggtcgcgccgaaggcgatgtagagcagcgcgccgaagccgccccagctcatgttcagcacggcgcgctcgatggcttgcggaccttcgaatag

SEQ ID NO: 10477 - DNA, 420 bp, Pseudomonas aeruginosa
ccgtccatgcccggcatgttcacgtcgagcaggatcaggtccgggcgcggctcttcgacggccgcccgcagcccggccgggccgctgccggcggtgcgcacgcggtactgctcctcgagcagctcgcgcatcagcagcaggttgtccggggtgtcgtccaccaccagcacgagttcctgctcgggcctgtccagcatgctctccatcgcccctccggccttcgctacggggccgcctggcggcgaccgtcattccgtattgaagacgctggagacgacttctgcacgtccggtcaggcgcccggggcgaccgttcagggcgtcaggcggaaacgcagtggcgaatcctcggcctcggcgccgttctcgctctcgccgaaggcccggcgctcgatggggtcctggccgaaatactccttga

SEQ ID NO: 10478 - DNA, 1173 bp, Pseudomonas aeruginosa
ccggtcgcgtcgcattggccgccctgccgttatcccggtcagcgcggtcaattgcggcgaacaggtggctgcgtagagttgtccacactgttacccgcgttccctcggcatcgttggccggcggaatccaccttcagccttggagcctttccaccgggagcccgttccatgaccgatcgttacatcgccttcgccaactcccccgtcggccgccgcctggttggcgccgtcggccttccctccccgctgcgcctggagcgctggcaggccggccgggtgcggccggtggacggcccgctggtgatcggcgggagcggcgcgctggccgaggccgtgctgcccttcgccggcaagctgaccgacgcggtgttcgccgccgtcgagggacagttcgagctgccgcgctggaccgccgaaacacagcccgcgggccaaggcggtgctgttcgatgccagcggcctgacccgcttcgagcagttggtggcgctgcgcgacttcttccagccggtgctcaagggcctcgacacatgcccgaaggtggtggtcctcggacgcgcccccgagtctctcaaggacccggtcgccgccagcgtgcaacgcagcctggaaggtttcacccgctccctgggcaaggaaatccgtcgcggcggcaacgtgcagttgctgtacgtcggcaagggcgccgaggaccaactggaaggcgcgctgcgcttcttcctctcgccgaagagcgcctacgtctccggccaggtgatccgtcttgccgccaacagcgcccaggtccacgactggagcaagccgctggccggccagcgcgcactggtcaccggcgccgcccgcggcattggcgcggccatcgcggaaaccctggcgcgcgacggcgcggaagtggtgctgctcgacgtgccgccggccagggaggccctcgaaggcctcgccgcgcgcctcggcggtcgtgccgtggccctcgacatctgcgccgcggacgccgggcagcaactggtggacgcgctgccggagggcgtcgatatcgtcgtgcacaacgccgggatcacacgcgacaagaccctggcgaagatgagcagcgacttctggaactcggtgatcaacgtcaacctcaatgccccgcaggtgctgacccaggccctgctcgacggcggcaagctgcatga

SEQ ID NO: 10479 - DNA, 738 bp, Pseudomonas aeruginosa
gcgtcgcggtggaaaacctgcaaccgcacgacaagggcgccaccttcagcatcgtcacccgcctggaagaccagcttggcctgctctgggtcggcgacagcaaggtgctctgccgcggcgtcaaggtgcccggcgaaattccgccgaaagccgagcaggagccgctgccgctggagccggtcgacaactggaaggcgcccgccgacatcggccggcgctatgcccgtgccgccggcgactacaacccgatccacctgtcggcgcccagcgccaagctgttcggctttccccgcgccatcgcccacggcctgtggaacaaggctcgcagcctggccgccctcggcgagcgactgccagcctcgggctatcgggtcgaggtgcgcttccagaagccggtgctgctgccggccagcctcaccctcctggccagcgcggcggcggcggacggccagttcagcctgcgcggcaaggacgacctgccgcacatggccgggcattggagccggctacagggctgacgccggtccgccatgccttgaagcttcgggcgcaaagcccgaagctatgcggctgcttaccgccaccgcgaagaatcccccatggacctgcacgaactcaccgcgcgcctgcacgccatccgcgaccgcaacgactggcgccaattccacagcccgaagaacctggccatggccgccagcgtcgagatggccgaactggtggagatcttccagtggctga

SEQ ID NO: 10480 - DNA, 642 bp, Pseudomonas aeruginosa
cgcggccacggagcgtcgagcatgcaatcgcgactgttgatcctgccgttactcgccagcctggccgccctcggtgcctgccagggcgacaatccctaccgcgccagctctctgccctacccgccgcagccggccaccgcggccaatcccggcctcgatcccggcgcctatccggcggcgccgcgcgactacgcccgctaccgtagctggagctgggccgccgccggggtcagcggctttccccagggcctggacgacaaccagttgcgcgacgccgtcagccagcagctcgaccagcgcggcctgcgcccggcgcggccgggcagcgcggccgacctgcaggtcagcgcgttcctgcgcagcgaactgcgcacccgccaggtcaccgactactacggcggctactacggcaactacggcggctggcgcgatccctggtacggctatggcgccagctacccggtgacccgcagctacaccgtgcaggtcaccgtggtccgcgtcgagctgaacgacgcccgcagcggccagccggtgtggggcaacagcgccgagttcgactccggcgactccgccagcgaacaggccaaggccctgcgcgaagcggtgaaacgggcgctgtcgagctacccgccgggctga

SEQ ID NO: 10481 - DNA, 699 bp, Pseudomonas aeruginosa
ctggagctggtcgcaacccgccttcgaataccgccccgacgacccacgcatcaagagcgacctcaccgagcaacgcatccgcgaagccgtcgcccagcagctcgaccagcgcggcctgcgtccggcccagggcaacgccaggggcgacgtcacggtgcgcgcctacctgatcgtcgacgatcgccaggaccagatcaccaccaactacggcggcggttactggggcggctactggggaggatactggggcggcccggcgatggccgagacgcgcaccgtgaattacaaggttgccaccctccaggtcgacctgttcgacggcaaggacggcaagctggtctggcgcggcagcggcgagcagatcatgcgcaccagcccgccgagcccggccgagcgcgagcaggcgatccgcgagacggtgcagaaagtcatgtcgcaatacccgccgcgctgacatgcagctcagccaccgcccggcggagaccggtgacctggagacggtcgccggcttcccccaggaccgcgacgaactcttctattgctaccccaaggcgatctggccgttcagcgtcgcccagctggccgccgccatcgccgaacgccgcggcagcaccgtggccgtgcacgacggacaggtgctcggcttcgccaacttctaccagtggcagcacggcgacttctgcgccctcggcaacatga

SEQ ID NO: 10482 - DNA, 396 bp, Pseudomonas aeruginosa
tccagatggacaagccccttgaaccctgacacccacgcccagcgcgtcctcatcatcgtctccagcggcccgagcaccccggcccgctgcgccgcgcccttccacaccgccaccctgctggcctgcatggacgccgaggtgaccctgttcctcagcggcgaaggcgtgcagttggcccgccgccccgtcgccgaccagttgcgcgcgctggacggcggcgagccgctgcgccacttcatccgccaggcccgcgaggccggcgcgcgcctgctgatgtgccgccaacccggggtgaacatcgacgaaagcgaactgatcgaggaactcgacgaaatctccagcggcggcgaactggcacggctgatcctcgaatccgagcgggtgctgaccctatga

SEQ ID NO: 10483 - DNA, 921 bp, Pseudomonas aeruginosa
tcaaccgggattgctacggcgagggctggatggtacggctgcaaccggacgactgggcctcggcgcggagcgcgtttctccagggagacgcggcgcgggaggcattcgccgagcgcatgcgcctggatgggttcgatccgcagcatccaggggtgcaggcgctggacgtctgagactcccgggttttacccgcaccccgctcgcggaaggcggataacgccgctggcgttattcgccctaccccagctctccatcgccgccaatctcccgcatatccccggagtccgccatgtcctcaccccaaccgccccgcttcgacggccaacgctggagcaacgccgacgacgaccgcatcgaggtgctgcctgccgaccccgcctggccacaacacttcgccgccgaagccgaggccatccgcacggcgctggcgctgcccgggctgggcatcgagcatgtcggcagcaccgcggtgcccgggctcgacgccaagccgatcatcgacatcctcctgctgccgccgcccggccacgatccgcagcggctggtagccccgctggagggcctcggctaccagttctggcgcgagaacccgaacacccagcggatgttctttgtcaaaggcatgccgcccttcggccatggccgcacccaccatgtccatgtcatgcccctggcccaggccgaccgctacctgctgttccgcgactggctgcgcaaccaccccgacgacgcccgcctttacgccgaaaccaagcacgccctggcccgccggtaccccaccgaccgcgaggcctatacccgtggcaaggacgaggtcgtcgcaaggattttcggccgggcgctggcggcgacgcggcacccaatgatacagagtggcctggtaaggggagaacgcgaaatgcacgccagggaactgcgtga

SEQ ID NO: 10484 - DNA, 1041 bp, Pseudomonas aeruginosa
tcggtgacggcggcgacgatctgcgccggcgtctcgtccgcggcgacgccaagcaaggcgagcccctgtgcctgcagctccgccagttgctgttgcaggtccgttgaaagcggattgatctcggccatccctgttctcccgaggcaagcgtgcgcacccgtccgtcgggcgcgccatgaagcgcgttatcttacggcttcgcggcgacgaaagcgccctccccagccaaacgtagcgcagccgctaatcgcctcttcccggaaatgctgccttcggctctactggcgaatttgtgccatccatacccgagacagccccatgacgctgatcgccgccgcccagagctgcgcccaccccgccgacctgccacgcaacctcgacgaccacctgcgcctgatgcgtatcgcccaggcacggggcgtgcgcctgctggtgtttcccgaactgtcgctcaccggctacgaacccaccgctgccgccgccctcgcccagccgacggacacgcccctgctgcaaccgctgcgccagctcgccgagcaggcacggatgaccacggtggtcggcctgccgctgcgctcgccgaagcatgccaagccgctgatcgccgccctgatcctcggcgccgacggcagcctcggcgtctatgccaagcagcacctgcacgcgggcgaggaacgccacttctcagccggcgacggcggccccctgctggagatcgacggcctgccgatggcgttggcggtctgcgccgacttcagccaacccagccacccggcccacgccgcccgtgccggcgctcgcctctacatcgccagcgcgctgatcggagaaaacggctacccggccgactcggccctactggccggttatgcccgcgagcacggaatgggcgtgctgctggccaaccatggcgggccgacgggtggctggaaggcggcgggcaggagtgcgttttggaatgagcggggagcgctggtcagggagacgacggggacgggtgagacgctgcttctgctggaacggaccgagatagacgcttga

SEQ ID NO: 10485 - DNA, 1071 bp, Pseudomonas aeruginosa
cgcggtggtcgtcgaacacgtggtagccgtgcatgtagtgggcctggtcggcacggaccaggtcggcgtcgccgaggggggacgtggcgtgcattcttgcgttcatcgggctgtcgctcttctcggatggatgctccgagggtgcaagagcaccgcgcggcgggccataccccattttggggtaagcgctgggtgcggccgacgcggcttgctatcctgcggcgacaacgacaagaacgagccgtaccgtccatgcaggccatcgccccgaacgcgctcgaccgctggcacgaacacctggcgctggcgatccggcgcctgcgccaacccgacttcctcgccgcgctggtcgacgccatccaccaactggtgccgatcgagtcgagcatgatcagcctggaacgcaagggccacgcgcccaccctgctctacgagcgcggcatcgccgagcgcttccgcgaggcgatcatccgccgctacttctcccgcggctacctgctcgaccctttctgcctggcggtggatgaatgccttccggaatgcttctacaccctcggcgagatcgcccccgacgacttcttccagagcgcctactaccagacctactacctcggcgccggagcggtggaggacgtctactacatcctcgacctcggccccaccgagaagctctcgatctgtctctacaacggcctttcggcgagccgctacagcgacgcccaggtcgccgtcctcgccggcctggcgccgccggtgctggagctggcccggcagttctgcgccgggcgcgccgacctctcgccgaacccgcaggccgacctcgccccgcgccttcaggaagtgctgcgcggcttcggtcgcgacgtgctcaccgaccgcgaacgcgaggcctgccacctgctgctcagcggccactcggcgaaatccagcgcgcggctgatggacatctccccggagaccgtgcgcatgcaccggaagaatctctacaccaagctggaagtcggctcgcagtcggaactgttcgcgctgttcatcgagtgcctgagccaggggcagcgcgtcggcccctga

SEQ ID NO: 10486 - DNA, 2778 bp, Pseudomonas aeruginosa
ctcttcgtggaagcgccgcaggccggcgagcagttgctcgaccagggcgaaccagcgctccccggcgaacaaccgggggccgaggcgggtctgcacctcgaccacctcttccggcagccgccagtgctcgcgcgggcggttgaaggattgcaccaggcgttgcgggtcgaggccgttctcggccgcgccgagcaaggtcggcagcgcctcctccaggctttcctggcgcagcgcctgaagctgtgccagacgtgccggcgttcgtcggttgcgcgccggcgcggcgccgtcgagcacccgcccgccgccaagggtgcgctgcgccgactggtcgcgcagcaccaggcggtcgccatgcagggcctggatcggcgcgttcagcaccagttgggcgaaggcgcggtggccaggctccagttgttcgccttcgagcagggccaggcgcccggtgacgtcctgggtgcccaggtgcaggtgcaccggggtccagtgggtgaagtcgcggagttcgtcgggcaacaggcggaagtcgatgtcgacccgcgtggtcggcgcgtgcagcgcggcctgcagcagccagtcgccgcgctggatctgttccagcgcgaggcgctcgccggcgatgttcaaggccacgcgctggccggcccaggcctgttgcgcgggccggttctgcgcgtgcaggccgcgcacccgcaccggccgtccggcgttgccgaggagcagttcgtcgcccaccgcgacctgtccggagaaggccgtgccggtgaccacgatgccgctgccggcgacgctgaaggcccggtccaccgccaggcggaagtatccctcgcggctacgctcgcggacttcgccggcgagcccgccgagtgcttcgcgcaacgcctcgacgccctccccggtgctgctggagagcgggaagatcggcgagcgcgccagcgggccggaggccagcaggtgttcgacctgggtccgcacctgctgcacccgctgcggctcgacccggtcgatcttggtcagcgccaccagcgcccggcggataccgagcagttcgacgatcgccaggtgctcgcgggtctgcggcatcaagccgtcgtcggcggccaccaccagcagcacgcaatcgatgccgctggcgccggccagcatgttgtggacgaagcgctcgtggccgggcacgtcgatgaagccggtggggctgccgtcgccaaggtcggcgtagagatagcccacgtcgatggtgatcccgcgttggcgctcggccgggcggcggtcgccctcgatgccggtgagggcgcgcagcagcgaggtcttgccgtggtcgatgtgcccggcggtgccgacgatcacgacagctcgctccgcagtcgcggcaactgggcgaggaaccccggctcgtcgtcgagctggcgcagatcgagccagagggcgtcgtcctcgagccgaccgatcaccggcagcggcagcccgcgcagggcttcctcgaggttgcgcagggcgcgtccgcgcaggcgcctgggctgccgcggacgcaggcacagcgcggcgctgggcagccgcgccaccggctgcgcgccgctgccgatcatgcccaggggcgtcgaccacggcgacctcccagccctcgccgagcgcctcgcccagcgccggcgccagacgctcggcctgggcgcggatctccgccgccgggcggctgagcaggcgcagggtggtcaggcgttcggcgaggcggtccggatcgcggtacaggccgagcaccgcctcgagggcggcgagggtcagcttgtcgacgcgcagggcgcgcttgagcgggttcttcttgatccgcccgatcagttctcggttgccgaggatcagcccggcctggggcccgccgagcaatttgtcgccgctgaaggtaacgatgtcggcgccgtcggccagggcttcctgcaccgtcggttccttgggcaagccccagcgggtcaggtccaccagggtgccgctgccgaggtcttccagcagcggcaggccatggccatgggcgatggccgccagttgcgcggtgggcacgctggcggtgaagccctggacgctgtaattgctggtatgcacgcgcatcagcaggccgctgcgcgggccgatggcggcttcgtaatccctggcgtgggtgcggttggtggtgcccacctcgtgcaagcgcacgccggcgcgggccatgatgtcgggaatgcggaaggcaccgccgatctcgatcagctcgccgcgcgagatgatcccttccttgcgcgcccccaggctgttcagcgccagcagcaccgccgccgcgttgttgttgaccacggtgactgcctcggcgccggtgagttcgcggatcagcccggcgatcaggtcgtcgcggtcgccgcgcttgccgctggccaggtcgaactccaggttcagcgggtagcgcgcggccagggtgatcgcctcgatggcctcgtccggcagcagggcgcggccgaggttggtatgcaacaccgtgccggtcaggttgaacacccgccgcacgcggctggcatgctgcgcggcgaggcgttcgccggcgcgcccggcgagcaccgcctcgctcagttcgatctcggcgagggcaccgcgtcgggccggctcgcgcagttcgtcgagcaggtcgcggagggtcgccagcaacgcctcgcggccgtagcgctggtgcaggggagcggccgccgcgctgcgcagcaggcggtcgaccgaaggcaagcgaacggaactcatggagaaaccttatccacagggtag

SEQ ID NO: 10487 - DNA, 981 bp, Pseudomonas aeruginosa
ggtcaccgacacgcccatcatagacgcgtcggcgcatgcccgcagcgccttcggctattcgccgccgggggccagcaacaggttcggcgaacgccgcaggtagccgtcctcggccaggcgcatgtccagcgccaggctggccaggtcgtcggcaagggcatcggcgtggcggtcgaactccaggtagaactgcttcaggtagccctggcaactggggcaggtctcggcgcgcagcacggctttttccgccggctgcccgtcatgctccagggacaggtaggccaggtgcttgctttcctcgcagtggctgcacttgatccgcacgtagtgccattcgcaggcgcacagcgagcagctcaggtagcgcagaccggtttccttgccgccctggcggatcatcccggccatcggcggcgagccgcaggcggggcacagggtccggctctcggtctcgaccaccgcgccctcctccagtcccagcagccaatggctccaggctacctgcagggcggcgccgaggaacggcaccagggccgccggcaagaggtcgaactgaccgctgagcaaggcgatggcccaggccttgcgttggccttcatcggcttcgcgcaattgttcgagtgccgcgccgacggcggcgttggccggtgccgggtagcccgcgagcagggcatccagccagggcagccaggcgccttcgcgcaccagcaggtcgtaggccagcggcggcatgccgtgctcgcggctcttgcgcaggcgctcggggtcgagcggggccagggccggcgggttgtccagcagcgcctgctggagccggcagagaccggcgaccagccgcaggtagtcgcccatcgggtgcccctcggccagttgcagcagacgctcgccgcggcgggcgaacaggtcgcgcgacggctggtgcaggtgcgggggaatgttggcggcggcttcgatctgccccggctgaagaatggtgcgtga

SEQ ID NO: 10488 - DNA, 696 bp, Pseudomonas aeruginosa
cacgggaactcctcgggtctgcgccggcgggccggtgggccgcgccgcaacgatcgggcgcccggaggggcgcggaatgaatgcaaaggccccatcgctggggcctccggtcgggcgatggcgacactatacgcgtcagtgctcctcgcccttgccgacttccttcagccagccgttatggtgcttgcgcgcccaggcgcggctgaccttgccgtagagcatcgcgcccatcgagcccttgacccagatgccggcgtagatgtgcacgatgatgctggcgatcaggacgaaggcggcgaaggcgtgcaggagcgccgacaggcggatcgcctcgatgccgaaccaggcgctgaagtactggcgccagatcacgatgccggtgaccagcagggtcagcatgctcagcagcagcacccagaacaacagcttctgcccggcgttgtagcggccgacttccgggaggttctcctcgcggttgctgaccacgtcgcgccactgcttgagccactggatatcgctcttctgcacccggttgtggtgggcgaagcgcaccaccaggccgaggaagaagacgaacatcgccagccccaggaaggggtgcaggatacgcgtccagggaccgccgccgaacaggttggtcagccagaacagcgccgggtggaacagcgccagcccggacaacccggccatgaataa

SEQ ID NO: 10489 - DNA, 1161 bp, Pseudomonas aeruginosa
ccggatcaacacccccgaggtcgccgaatccctgctcgccaccgacaaggccgacctggtgtcgatggcccggccgctgctggccgacccgcagtttgtggccaaggccggcgccggccgggccgaggagatcaacacctgcatcgcctgcaaccaggcctgcctcgatcatgccttcgccaaccgccgcgccacctgcctggtcaacccgcgggcggccttcgagaccgaattgcgctaccgcaaggcgcgcacgcagaagcgcatcgcggtgatcggcgccggccccgccgggctctccgccgcctgcgtggccgccgagcgcgggcatcgggtcagcctgttcgaggcgagcggggaaatcggcgggcagttcaacctggccaagcggattcccggcaaggaggagttccgcgaaaccctgcgctacttccgcgtgcgtctggaacgcctcggcgtcgacctgcgcctcggccaccgagtgcgccagggcgagctggacggtcagttcgacgacgtggtggtggccaccggcatccagccacgccggccaaggatcgacggcatcggcggaccgaccgtactcagctacgtggacgtgctgcgcggcgcgccggtgggcgcgcgggtcgccatcgtcggcgccggcggcatcggcttcgacgtcgccgccttcctcgtcgccgcgcccagcgacggccagccgcgggcgctcggcgaatggctcgcggaatggggcgtggacctcgacaacagccagcccggcggcctccgcgaacccgctccgacgcggccggcgcgccaggtctggctgctccagcgcaagcccggcgctcccggcgcgcagctcggcaagaccagcggctgggtacaccgcgcgcacctcaggcacaacgccgtacggatgctcggcggggtggagtacctgaagatcgacaaacgcggcctgttgatccgcgtcgacggcgaggaacgctggctggaggtggacaacgtggtgatctgcgccggccaggagccgctgcgcgagttgcagatcagccaggcggcggaaagcctgcgcttccacctgatcggtggggcgcgggtggcaggggaactggatgccaagcgggcgattcgcgagggggccatgctggcggcgcgcttgtagggggataa

SEQ ID NO: 10490 - DNA, 627 bp, Pseudomonas aeruginosa
ccgctgcgggccgcgaggtcctggccgggcggcgctaccgcctcgacctcggcgcccccgaacgctgggtcggcggcgtatgcctgcgcgccggcaccgcgcactgggcgctggacgagcaggaccggccggtatggcgggaggacccacggcactgacgctcatcgcccggacgagcgcaacgggcgcgcagccactatcatgcgcgcccgttttccccgcacccgcccgccgatgaagaaaatcccgctcgccgccgccgaccccgaccgcctggatacctgggtgaaataccgcgaaggcctgtgcggcgagtgcaacgcgacctgctgcacgctgccggtggaagtgcgcatcgacgacctgatccgcatgggactggtcgacgagttcgagcgcgaggagccggccaagcgaatcgccaagcgactggaaaaggatggcgtgatcgagcacttcaaccacaagcgcgagatcttcaccctcacccgcatggccaacggcgactgcctgtacctcgaccgcaagacccgcctgtgcaccatctatgcccgccgcccggacacctgccgcaaccacccgcgcatcggcccgcgtcccggctactgcgcctaccggccgaggtag

SEQ ID NO: 10491 - DNA, 2226 bp, Pseudomonas aeruginosa
aatggcgtccggcgcagatcaggaggcgcatgccgatccctccccttgccctggctcgtccggccgcttcgccatcggatcgatgccgctgcgttcgagcagcggataggccagggcggtgacatgatggtggatgcgtcggtagtcgcggagaatgcgctggaacacgtcaccggactccacccaggcaccgcgatcgtcgcgcaggcgacggaagcgctcgcgactggcatcggcctccagtcgctgcagcaacttcttgcgcgccaccaggcgcagcgcggcgtccaggtcttcgcgaaggaacgcgctgatcgccaggtgcaggctctcctcgatcgccgcctgcaacggcagcatgcggcccagctcgaactcgctgccggcgcggctgcgcccggcccagcgcatcgccaggggcagcaggctgttggcgacgagatcgccgatgtgctcgatgttgatggcgaacagaaggatttcctgggcacgatcggcgtcgctgtcgccgaggccgtcctggccgaggtctgccaggtaggcgcggatcgccgcactcaactggtcgagggcctggtcctggcgacggatttccgccgccaccttcgcctccggtcgctgcaacaggccgctggtggcgcgcagcatcagactggccatgtcggccagccgcaggacttcgcgagtagcgttggccaggccgatgttggccacctccagcccggcttcgtcgaggtagcgcggcatgcccgggtcgtcggactgtgcctcttccggcaacaggcgcgcgagcagcgccgcaagggggccggtgaagccgatcgccagcagtgccagggccaggttgaaagcactgtggaaccagaccgccgccgcaccgccgagtgcgttggccggctgcgccagcgccgtcagccagggcagcaccagcaggcaaccgagcaggcgcaccagcaggttgcccaacggcaggcgccgcgccacccggctaccggccacccccaacgccggcaaggcgccgccgaggttggcaccgagcaccagggccagggcgatgggcagcgagaccagtccggcctgggccagggacgccaccagcagtaccaccgcgacactggaatggcaggcccaggtcagcagcgcggcgagcagcagggcgatcagcggatcgccttcgaggccgtggatcaccgcgacaaaggctggcgaggcctcgatctgctgcagggaatggccgagcaacgccagcgccagaagcatcaggccgagtccgatcaggcactggccaaggctctccaggcgcggaccgtcgcccaggcggaacagcagcaggccggacagcagggccagcggcgccagcaacgaggtgtcgaagctgagcagttgcaccaccagagtggtgccgacgttggcgccgagcatcactgccagcgccggcgccaggcccagggtgccactggcggtgaaggacgctgccatcagactggtggcggtgctgctctgcagcaggccggtgatgccgagcccggcgagcagggccagccagcggttgcccaggtggcggccgagccagttgcgcagcgcagtgccgaaaccgcgcagcacgccgctggagaccatgtgcgtgccccacaacagaagggccacggcaccggccaggttgatcaggaggatggttcccagcatggcggaactcccggttcggaatggatcgtgaagggaacgggctcattgacccatggccagcctgagcgaggcacggttgagcgcgctcgagcagtccagcaggtatttcacttcgacctggctcaggcggccgctggcgtatgcgcgcacgctgatcaccatcagcaggtgcgcggccttcgccagcagccgtgctgccaggccacagagcgcgcggcgagacgcgcccaggcatttgcgtacgacgttcatggctgtttcctcggtggaggagcgtgccgcagcgcggcacgcccttgggctcagaaacgcaaggtcgctcccgagaccagccatcgctcgcgctcgccgcgcaggtggccgccgaccagcagatcgaggtccagccgttcgcccaggtgcagccgcggtccggcctgccagccgctgtcgccggccgactcgccgaagcgttcggcgatcagggtcaacggttggccgacccggtattccatgcccacgccccagttccagcgatgccggcgctcgccctcggcgtag

SEQ ID NO: 10492 - DNA, 3027 bp, Pseudomonas aeruginosa
gcgccgcccgcggcgcgagcctcggacagcagcgccagcagcaggacgcaggctagcgccgcggcgacgaagcccaggcgccaggacagggcgcgtcgcagcgcggccggcagcggttggaaaaggggcgcccgcgggcgccggtcgtgcagggtcatgatgcgtctctccatgcgtgggtccggtgtgcgttgcgcggcgcggcgaggcttgccgacgcgccgggaaaggccgggacgaagcccggccgatggctcagaaccactggccgaagcggcggatgtagagggtcttcatggtctgcgcggtgacgcagtagcagagcagcgtgcccaccagccaggggaagtactcccacggcagcggctgcaggccgaccatcgcccccagcggcgagaacggcacgtagatgcccagcgccatcaccagcccggtcatcagcatcaccggcagcgccgcggtgctctggatgaagggaatcttctgggtacgcagcatgtgcaccaccagggtctgcgagagcaggccctcgatgaaccagccggactggaacagcgactgcatttccgggctgttggcggcgaacacgaaccacatcagcgcgtaggtggtgatgtcgaagatcgacgaggtcgggccgatccagaccatgaagcggccgatgttcttcgagtcccacttgcgcggcttggcgaggaactccttgtccatcttgtcccacggcagcgacagctgggagatgtcgtacatcaggttctgcagcagcaggtggatcgccagcatcggcaggaaggggatgaaggcgctggccaccagtaccgagaacacgttgccgaagttggagctggcagtcatgttcaggtacttcatgatgttgccgaaggtctcgcggcccttgataacgccctcctccaggaccatcaggcttttttccaggaggatgatgtcggccgattccttggcgatgtcggtgccgctgtccaccgagatgccgacatcggcatctcgcagcgcgggggcgtcgttgatgccgtcgccgaggaagccaacggtgtgtccgttgccctgcagggccttgagcacccgcgacttctgcagcggcgtcagcttggcgaacaccgtgcgctcctcggccaggcgttgcagggtggcatcgtccatcaggtcgatgtcgcgaccgagcagcggctcgccgacgtccaggccgacctcgcggcagatcttcgcgctgaccaccgggttgtcgccggtgagcaccttcaccgccacgccgttctcgcgcaacgcggcgatggccgggccggcggtttccttcggtggatcgaggaaggtcagcaggccggcgatcaccaggtcgcgctcgtcgctggcgccgtactgggcctgggactccgtgcgcgagaggctgcgggtgccgagcaggagcacgcggaagccgtcgcggttgtattgctcggccagcgccagcagggcccggcggcgttcctcgtcgagcggcaggtcgacaccgtcctggtgcacgcgggtggcgatctcgagcatttcctcgaccgcgcccttgcacaccagcaggtgttcgccgtccttgccctcgaggatcaccgagagacgccgacggacgaaatcgaagggcagttcgtcgaccttgcgccaggcatccgacggcgtgatgcgcgggttctgttcgacgaaggcgaccaccgcgcggtccatcaggttcttcatcccggactggtggaagctgttcagccaggccatttgcaggacccggtcgcagcgccggccggcaacgtcgacgtgatgctcgaggatgatccggtcctgggtcagggtaccggtcttgtcggtgcagagcacgtccatggcgccgaagttctggatcgcgttgaggcgcttgaccaccaccttgcgccgcgacatcgccaccgcgcccttggccaggttggcgctgacgatcatcggcagcatttccggggtcaggccgaccgccacggcgagagcgaacatgaacgcctcggtccagtcgcccttggtgaaaccgttgatcagcagcacgatcggcaccatcaccagcatgaagcggatcagcagccaactgacgctgttcaccccacggtcgaaggcggtctgcgcccgcgaaccgacgatggaacgggccagcgaaccgaaataggtgcgcgcaccggtggcgaccaccaccgcggtggccgtgccgctgaccacgttggtgcccatgaagcagatgttcggcagttcgagcaggtcctgctggtcggcggcgatccgcttggcggacttctcgcggaccgcgccgagggtgtcgtatttctccaccggcagcgcctcgccggtgagtacggcctggctgatgaacaggtcgcgcgattcgatcaggcggatgtcggcggggatcatgtcgccggcggacaggcgcacgatgtcgccgaccaccagttcgcccatggggatttcccgcagctcgccgcgcatcccgcgctcgtcgcggcgcagcacggtggcggtgttccgcaccatggccttgagcgcctcggcggccttgcccgaacggtattcctgccagaagcgcatcaggccgctgaccaggaccatgcagaggacgatgatgacgccggtgagatcggtttcctcaccgtcctgcaggggcagccagaagtcggtgaagaagctgatcgcagagagcgtcatcagcacgtagatgaaggggttgttgaacgcctgcagcagttgcaccaggacgtgtggcggacggtcgtgggccacttcgttggggccgtcggcgtgcagccgggcggcggcctcggcctggtcgaggccgtcctggcgaccgcggacattggtgagggtggtttccaggctgttctgcgcttcgcgggcggcgcgcatggacagtcggtcgttgcggcgctcggtgtcgagctgggtattgcgttgggtcgctacgctcatgactcggtctcctgtcgcgagctgcgcgacggcgacacgagtcggttgccggtcaggtga

SEQ ID NO: 10493 - DNA, 1260 bp, Pseudomonas aeruginosa
tggcgcgcggcttcggcatgcgcggctgagccctcagttctgcatggcccggccatacacgtccatcgccgcctggcgcagcgcctcggagcgggtcggatgcggatggcaggtcagcgcgaggtcctccgccgaggcgctgaactccatggccacgcaggcttcgccgatcatctcgctgacgcccggcccgatcatgtgcacgccgagcacctggtcgctgcgggcatcggagaggatcttgatgaagccttcgctctcgtggttgatcttcgcccggctgttggcgctgaacgggaagcgtccgaccttgtactcgcgcctcgccgcctgcagctgctcctcgccgaggccgacgctggccacttccggctgggtgtagatgaccgacggaatcacctcggcgttcatctccgccgcatgcccggcgatccgctcgatgcagacgatcgcctcttcctcggccttgtgcgccagcatcggtcccgaggtcacgtcgccgatcacccagacgcccggcgccgcgctgcgctgtccctggttctccagcatgccgcgacgatcgctggccaggccgaccgtctccagccccagtccttcggtataggggcgccggccgatggccaccagcacgtagtccgcctgcagcgattccgtagcgccgccggcggccggttgcaggtcgagttcgacgccctgctcgccactgcgcgcggcgaccacgcgggtgccgaggcgaaaccgcatgccctggcgggtcagggcgcgctgcagggtccttgcggtttccccatccagccccgggcagatccgctcgaggtactccagcaccgtgacctgtgcgcccagccggcgccagaccgaaccaagctccaggccgatcacgccggcgccgatcaccaccaggtggcgaggcacttcgaccaactccagggcgccggtggagtcgaggatgcgctggttgtccacaggcacgccgggcagcggcgccggttccgaaccggtggcgatgacgatgtcgcgcgcctccagttgcgcgtggccgccgtcggcaagggccacgccgacccggccctcgccttgcaagcgcgcccagcccttgatccactgcaccttgtgcttgcggaaaaggaattcgacgccacgggtcagggcggcgacgctctcgtccttctgcttcatcatctgcgccaggtccagttccgggctgacccggatgccgagccgggcgaactcgccgccgctcgccgcggcgtatag

SEQ ID NO: 10494 - DNA, 993 bp, Pseudomonas aeruginosa
tcgaagcggccctggagggcgaggacgcaggcgagcgcgccgtgctgctgctcgcttcgctggtcggcgcgctgcaactgtcgcgcagcgtgcaggatgaggcgctgtcgcaacggatactggaagcgacgcgcaagaagctgctggagcagatggagcgctagggcctcagccgaggtagcgctcggccggccgctgccgcgacagattgggcgcgagcctggcccgcgccgtcatcagcgcctgccaatcggccgcatccggcaacgacgggatggtcaccgcttcacgccgatcgaaaccgaccagcgccgcctccaccaggtcctcgacctccatcaccatctccgcgggaatcccggcgattccggtgccgctgcgctcccagatctcggtacgggtgatgccgggcagcaccgcctggacgtaaacgccgctgccggccagctcgtgctgcagcgactggctcaggctcagcacgtaggccttggtcgcgctatagacggcattgaacaactccggcgccagcgccaccaccgaaccaaggttgacgatggcgccgccgccacgccggcggaacccctccgccgcgccggcagccaggcgggtcagggccactacgttgagggcgatcatccgctccgcccggtccatgtcggcatcggccagcggaccgttcatcgccacgccggcgttgttcaccagcaacgcgatcgaggcgtcgtcgcgcaaccgtcgctcgacccgcaacctatcgtcgcgctcggacaggtcggcgcgcaggatctccaccctgaccccgtgggcttggcgaagtcgatccgccagggcttccaggcgttgccggtcgcgcgccaccagcaacaggtcgtggccacggcgggccaagtgctcggcgtaggtcgcgccgattccggaagaggcgccggtgaccagggcgacgccattgccaatctgttcgttcatgtgggttctcgctggaaaaaagcctga

SEQ ID NO: 10495 - DNA, 1185 bp, Pseudomonas aeruginosa
aggcggacaccagcagcagcgtgcgcaccccgccgagtcgctcccagggcaacccgcggaccacgtccaggtaactgtcggccggcacgcagagcaccagggtctgccaatcgtcgcgaagctcagcggggtcctggtggaagacgtccagcgcggcgttgccggacagccagcgatgctgcccctgcccttccagctgcaggcaggcgccgcgcgccagggcctcggcgatccgctggctgcgccggccgggatggttcagcgcgccgaggcgaccggcaccgtggcggcgcaggtccagcgcgacctggatcgccaccgcgcccagaccgaccagcaggacgttgcccaggctctcatcagcggcattcatcgaccggccttctccaggatcagggtgtcgtacagcggctggctgacccgctccgcgcaaacccgccagccatccagttcggccggctccaccggatagttgaacagtcccttgataccgctgccgtgacgcagcaggaccttggcgtcagcgcgcatgacctggcggatctgtgccagcaccgcgcttttctgctgcaccagcgaagcgatcaggaaatgcgtggcatcgcgggaaaacgccagttccgccggcggcagcgaggaaaactgcatgcgtgcctccagcccctggcagcgagcgatctcgcgggcacagcccagggcctcctcgtcgatgtccaggcagcacaaatgtgcgccgacctcccgcgccagcaccagggccgaggtcggcagggcaccggagccgacgaacaggacccgtgcatcggcatctatccccgcgctgtcgagttcgccgcggatggattccagcaggctacccaggtagcggcccatctcgccgggttcatgcagcacgccctggcaaaggtgcttctccagttcgcagagggcctgcaccgccgcgtcgcgcaggcgcaggccgagcgcctgcaacgcaggatcgtccgaatcggcctgccactgcgcccggctgcaatcctccccgatcagtccgctcagacggtcgagcttgcgcctgaggatctcgtagcagccgcaacactcgcgggcatagacggtgagcaggcgaatctcgcattccagttcgcggagggtttccagcagcggtgtgcgtccttgcatggcatggcttcctggcggcggtag

SEQ ID NO: 10496 - DNA, 279 bp, Pseudomonas aeruginosa
gctgcgagaccgccgacgccttccgcgccagcatgcgcgaacgctacccggcggcgatcgtcatggaagtcgacttcgccggccccgacatgggcctgcgactggccagcgaggcccaggccggcctcgaacacaagctgccggtgctgtttttcagcgacagcgagaccgacaccccgacccgcctggccgcagcccgcgccggcggccaggaattcttcaccggcaccctggacgcctccagcgtgctggaaaagatcgagaccctcagccgcctga

SEQ ID NO: 10497 - DNA, 1917 bp, Pseudomonas aeruginosa
tcggacgagactcgccatgcgcctcaagcaactcaccaacctcaacaccctgctcctgctcaccgtctgcctcgccctgggaatcaccctgtggtggtcgcaacgcgccatggagcggcccttccagttgctcgaccagtacctggagctgtcgcagcgcttcgacgaacaggtcgcgcgcaacatccgccagtacctcggcagcggcgacgccgtgcgccagcaggccgcgctgcaagccctggaaagcctcgccgaggccttgccggagctaccgccggacctcgcccggaccctcgcgccaagcctcgcggagttgcgcgaattcagcgccggcgacctgctcgccgccggcaagctcgccggcgacccgcagggcctgctgctacaggccgagcgcgacctcaccggcaacctggaacaatggtccgcctacctggacgccgcggcggggcagccccaggccggcgcctaccgcaccccgctgctgctcgccagcctgcacctgacccgcctcagcctggcccgcgccaagctggtggaaagcgccaacccggccctggccggcgacgtcgagcgcgaattggccaacctgcgcgagcaggccgggcggatcgaggccttgccgctgctcggcgtgctcgacgagcaacgctcggccagcgacgacttcgccgccatgatggggctggccggcgacgccgaggctggcgccggcaatgccgaagaccgcggcgtggcgctgcggcgcgaactcgccagcctgctgcaacgctatccggacgagttgcgccgcacccgcgacctgatcgagcgtcgccagcaactgtccgccgacaccggcgccagactggacgcggtgcgccaggccctggccaccctggaaccgcaggtgcgcggcgaacgccagcgcctgcaaggccaggtacgcctgatccagggtgggatgatcgccctgatcctgctcatcgccctcgccatcgacagcctgcaaagacgcctggcgcgggtcctcgggcaactggtgccggcgctctcggcctgggccgacggcgacttctcgcgccccatatccctgcgtacccgcaccgaggacctgcgcaacctggaagattcgctgaaccgcctgcgcagcttcctcgccgagctggtcggcgcgatccaccgccgcgccgaacaggtcgccggcagcagccagaccctggccgaggtcagcagcggcctgcacgccggggtcgagcgccaggccggcgataccgggcagatccgcgacgccctcggcgacatggaagcggcgatccagcaggtcgccggagacgccagccagaccgccgacgccagtcgcagcgcaggccaggcagtggagcatggccagcgggtgatcggcgagagcctgggcggcctgcgcgagctggtcgacgaggtgcaaggcaacgcccagtcgatcgagcgcctggccgaggagtcggcgaccatcggcagcgtgctgacggtgatccgctcgatcgccgaacagaccaacctgctcgccctcaatgccgccatcgaggccgcccgcgccggcgaccagggccgcggcttcgccgtggtcgccgaggaagtccgctcgctggcccagcgcaccgccggcgccaccgaggagatccagcagctcatcggccgcctgcaacaggccgcgcggcaatcggtggaggccatgcgcagccaggtcgagcatgccgaacgcaccgccgaacaggccggcgcggcggaaggcgcgctggacgaagtggtcgccgcgatccataccatcggcgtgatggccgaacgcatcgccgaaggctcgacccagcagagccaggcggtcggcgagattcgctcgcacagcgaacgcatccacgccctgggcggggaaaacctgcggctgatcggccatag

SEQ ID NO: 10498 - DNA, 513 bp, Pseudomonas aeruginosa
acaacttcaacgcccctgacctcactgggagtgctagcgctaatggacattcgtaaagtcaagaaactgatcgagctgctggaagagtccggtatcgacgagctggaaatccgcgaaggcgaagagtcggtacgcatcagccgccacagcaagaccgccgcccagccggtgtacgcacaggctccggccttcgccgctccggtcgccgctccggcgccggcagccgccgctccggccgccgctgccgcggaaagcgccccggccgcgccgaagctgaacggcaacgtggttcgctcgccgatggtcggcaccttctaccgcgccgcctcgccgacctcggccaacttcgtcgaagtcggccagagcgtgaagaaaggcgacatcctgtgcatcgtcgaagccatgaagatgatgaaccacatcgaagccgaagttagcggcaccatcgagtcgatcctggtggagaacggccagccggttgagttcgaccagccgctgttcaccatcgtctaa

SEQ ID NO: 10499 - DNA, 1986 bp, Pseudomonas aeruginosa
acatccattacctggagaagaaactgggtatggacaagcactgatccgtcagtcgctgcgcacaagggctgcctccgggcggcccttgtcgtttccgcctgccggccgccccaacggtgctatcctcgtcgcccctccaccaccggactcctgcatggaacgcatccgccgctggtaccgccaatcgctggccgccgcgaccgaggccgcgacctgcttcgccttgggtttcagggaaagcctgcaacccgccgcactcttccgctccgcgagcctgtgcattctcgtcagcgtgctgtgcacctggctgttcgtgcatttcttcgaaccgatcatccgcctctgcggctgggccgcgctgtacacggcattcagcgtggccaacttcgccctgatccccagcggctcgctgatcgaggccggcagcggtggcccgtacttcgatccgctggcggccttcaacggcctggcgggactggcgcaactggcgttctatttcgtcggctatgccgcgctgttcttcgtcgccctgtacgccgccagcatcgtcttcggcatccgcctgggcctgcgcatcggcctgctcggacaactgaaggaacaggtccgccaacgctacccgcgactggcacctgcctccggcgaaaggatctcgctgtggcgtgccgccggcttccgcctggcaccctggctgggcgtttccggatcgatcctggtcggcctgctggttccgctctacaacggtgtactcctgctgctggcgctggcctacctgaacatccgcttcctgctgcccgccacgctggccgggctggccgatgccggcgagcagctcgccgtgcttcgtgctcgccgcggcagcctgttgctgttcggcctgctgatactgctcctggcgctggtgccgctgctcaacctgctgctgccggcggtgctcggcggcggtacctgccacctggccaatcgcggcctggcgcaactgcgcggcgaggccacggcagagagtggcagcgccggctagcctcaagtaagcttgcgcggtggaaaacgggtcgcccctgggcggcccgtttcgtttacagccgcaacagaggtcgccccatgccctggttacaagttcgcctggctatcaccccggaacaggccgaaacctacgaagacgccctgctcgaagtcggcgccgtctccgtgaccttcatggacgccgaagaccagccgatcttcgagccggacctcggcaccaccccgctgtggtcgcgcacccacctgctggcgctgttcgaagcggacaccgatgagaccgccctgctcgcccacctcgccttgcttaccggcggcgacctgcccgagcaccatgtcgaggaaatcgccgaccaggattgggaacgcagctggatggacaacttccagccgatgcgtttcggccgccgcctgtggatcgtgccgagctggcacgccgcccccgagccggacgcggtcaacctgctgctcgatccgggcctggccttcggcaccggcacccacccgaccaccgcgctgtgcctggaatggctcgacggccaggaactggccggccggcaggtgctcgacttcggctgcggctcgggaatcctcgccatcgccgcgctgctgctcggcgccgaacgggcggtcggcaccgacatcgatccacaggccctggaagcctcgcgcgacaatgcctcgcgcaacggtatcgagcccgcgcggttccctgtctacctgccggcggacctgccgcagcgacaggccgacgtgctggtcgccaatatcctcgccggcccgctggtttccctcgccccgcaactgaccggcctggtacgtcccggcggcctgctggcgttgtccggcatcctcgccgagcaggccgcggaggtccgcgcggcctactccgcacacttcgatctcgacccgaccgccgagcgcgaaggctggatccgcatcagcggccgccgccgcgccgattga

SEQ ID NO: 10500 - DNA, 417 bp, Pseudomonas aeruginosa
tcctgctggcgctgggcggtctcgccgctcagtacatcgcctaccatttcgacgaactggcgcgccaggacgcctatcgcccctggttcgcccagctctgcccggaaatcggctgcacccttccctccaaggtcgacgtggagcagatcaggagcagcaacctggtggtccgcagccatcccgaattcagcggcgcgctggtggtcgacgcgatcatctacaatcgcgccagcttctcgcagccgttcccgctgctggaactgcgcttcgccgacctcaacggccacctcatcgccaatcgccgcttcaagcccggcgagtacctcggcggcgagctggccggacgaacggaaatgccaccgcaggtaccgatccacgtgtcgctggacatcctcgacccgggtccgaaggcggtga

SEQ ID NO: 10501 - DNA, 861 bp, Pseudomonas aeruginosa
cggcgtcaccgtcgcgaagctcgccgaacaggcggggatccaggctcttgcggtgcatggccggacccgcgccgacctgtacaccggggaggcggagtacgagaccatcgcggcgatcaagcaggccgtgtcgataccggtgttcgccaatggcgacatcgattcgccggaaaaggccaggaaagtcatcgagcagaccggggtggatgccctgctgatcggtcgggccgcccagggaagaccgtggattttccgcgagatcgaccattacctgcggaccggcgagcacctgccggcggcgccgcttcccgaagtgcagagcatcctgctcgaacacctcgcggagctgcaccttttttatggggaagaaatgggtgtgcggatcgcccgcaagcatgtggggtggtatctcgcgactctgccgggcgcaagggaattccgcgcccagttcaatcgtttgcaggacacggatgcgcagtgcgccagcgtcaggcagttcttcgccgagcgccagaacaacggaacaggggtggccgcatgacaacgatgacgaccgagactttagtgagtggaacaacgcccgtgagcgacaacgccaacctgaaacagcacctcaccacgccgacgcaagaagggcagaccctgcgcgacagcgtggagaaggcattgcacaactacttcgcccacctcgaagggcagccggtcacggacgtttacaacatggtgctctgcgaagtcgaagcgccgctgctggaaaccgtcatgaaccacgtcaaggggaaccagaccaaggcctccgagctactcggcctgaaccgcgggaccctgcgcaagaaactcaagcaatacgatcttctttaa

SEQ ID NO: 10502 - DNA, 864 bp, Pseudomonas aeruginosa
gctggtcgccctcggcgtggaaatcctttccaccggcggcacctacaagctgctccgggacaacggcatctctgccgtggaagtggccgactacaccggcttcccggaaatgatggacggtcgggtgaagaccctgcacccgaaggtgcatggcggtatcctcggtcgccgcgacctggacggcgcggtcatggagcagcacggcatcaagccgatcgacctggtggcggtcaacctgtatcccttcgaggccacggtggccaggcccgactgcgacctgcctaccgccatcgagaacatcgatatcggcgggccgaccatggtccgttcggcggcgaagaaccacaaggatgtcgccatcgtggtcaatgccggcgactacgccgccgtgatcgaatccctcaaggccggcggcctgacctacgcccagcgtttcgacctggccctcaaggcgttcgagcacacctccgcctacgacggcatgatcgccaactacctgggtaccatcgaccagacccgcgataccctaggcaccgccgaccgcggcgccttcccgcgcaccttcaacagtcagttcgtcaaggcccaggaaatgcgctacggcgagaacccgcaccagagcgcggcgttctacgtcgaggcgaagaaaggcgaggccagcgtctccaccgccatccagttgcagggcaaggaactgtcgttcaacaacgtcgccgacaccgacgccgccctggaatgcgtgaagagcttcctcaagccggcctgcgtgatcgtcaagcatgccaacccctgcggcgtcgccgtggtgccggaagacgaaggcggcatccgcaaggcctacgacctggcctacgccaccgatag

SEQ ID NO: 10503 - DNA, 765 bp, Pseudomonas aeruginosa
cgaatcggcgttcggcggcatcatcgccttcaaccgcgagctggacggcgaaaccgccaaggccatcgtcgagcgccagttcgtcgaggtgatcatcgcgccgaagatttccgccgccgcccgcgaggtggtcgccgccaaggccaacgtacgcctgctcgaatgcggcgaatggccagccgagcgcgccccgggctgggacttcaagcgggtcaacggcggcctgctggtacagagccgcgacatcggcatgatcaaggccgaggacctgaagatcgtcactcgccgcgcgcccaccgagcaggagatccacgacctgatcttcgcctggaaggtggccaagttcgtcaagtccaacgccatcgtctacgccaggaaccgccagaccgtcggcgtcggcgccggccagatgagccgggtcaactccgcacggatcgccgcgatcaaggccgagcacgccggcctggaagtgaaaggcgcggtgatggcttccgacgccttcttcccgttccgcgacggcatcgacaacgcggccaaggccggcatcaccgcggtgatccagccgggcggctcgatgcgcgacaacgaagtgatcgcggcggccgacgaggcggatatcgcgatggtgttcactggcatgcgccatttccgccattgagtatcacggcggctgagcgcgatgcggtcagccgccctacccacgaatttcacgcagggcggataacgcggcgcgttacccgccgttgcgccaggagaaccccatga

SEQ ID NO: 10504 - DNA, 3111 bp, Pseudomonas aeruginosa
aggatggccaggaggtcacctccggcggccgcgtgctctgtgccaccgccatcggcgagagcgtgtccgccgcccagcaacaggcctatcgcctggccgagaagatccgctggaacggctgcttctaccgcaaggacatcggctaccgtgccatcgcccgcgagcgcggcgagtcctgaccgggcccgaagccgcgggcgccgcacggcgcttccgcggcatatgccgttgccacggccacttggctataatccggccattcaccttcgaagggacttcgccgtggtacggcttcggatcgccataggactactcgtcagcttcctgctgcttctgctcggtccgatgtcgccggcggtcgcggacgacgccggcgtttccagcgttcccctgcaaaccaccgccaccacccccagcgtcaaccagaactggcgcctgctgcgcgacgagagcgcgcaactgcggatcgccgacgtcctccagcgcaaggagcagttccgcccgctggccaagcgctccttcatcttccccgccagcccccaggcggtctggctgcaggtccagcttcccgcgcagaaggtgccgagctggctgtggatcttcgccccgcgggtgcagtacctggactactacctggtgcaggacggccaactggtgcgggaccagcacaccggcgagtcgcgaccgttccaggagcgcccgctgccctcgcgctcctacctgttctcgctgccggtcgacggcaagccgatgaccctgtacgtgcggatgacctccaaccatccgctgatggcctggttcgaccagatcgacgaagccggcctggtcggcctggagaagcccgcctacgccttcggcatgctgctcggcggcatgctcctgctgctgatgtacaacctgatccgcttcgcctactcgcgcagcgccagcagcctgtggctggcggcggtgcacgcggcgctggcggtctgcgccgcggcgaacctggggctggtggcgttctggctgccgggactcaagttcaaccagtcgctgaccgccgacctcggcgccctcggcgctgcggtgagcctgctgtggttcgcctgcagcttcttccgcggcactgcggaaagccgcctgaaccgcctcctgcaaggcgaggcgctgttgatcctggcggtcggcgcgatcatcgccttcacccagcaactctggttcagctggctgatctacctgctggtgatcctcagttcgctcagcgtcccgctgatcgcggcctggcactggtatcgcggctaccagccggcgcgcctgatcgttgccgggatgatcgtgttcaacgccggcttcatggtgttcctgccggtactgttcggcaccaagcaactcgatccgggctggctggtgctcggcgtgttcagcttcgccaccctcgccgggctggtcctgagcgtctcgctcaccgaacgccagcggctgatccagcagctcaacctgcaacagcgcaccagcgaggcggcgcacaccgcggaattgcagaccaaggccgagttcctggccaagatcagccacgagatccgcacgcccatgaacggcgtgctgggcatgaccgaactgctcctcggcaccccgttgtcggcgaagcagcgcgactacgtgcagaccatccacagcgccggcaacgagctgctcacgctgatcaacgagatactcgacatctccaagctggagtccgggcagatcgagctggacgaagtgcagttcgacctcaacgcgttgatcgaggactgcctggatatcttccgggtcaaggccgagcagcagcgcatcgagctgatcagcttcacccagccgcaggtgccgcgggtcatcggcggcgatccgacgcgcctgcgccaggtggtcctgagcctgctggacaacgcgttcaagcagaccgaggaaggcgagatcctgctggtggtggccctcgacgaccagggcgagacgccacgcctgcgcatcgccgtgcaggacagcggccacccgttcgacgccaaggagcgcgaggcgctgctcaccgccgagctgcacagcggcgacttcctttccgccagcaagctcggcagccacctcggcctgatcatcgcccgccaactggtgcggctgatgggcggggagttcggcatccagtccggcagcagccagggcaccaccctgtcgctgaccctgccgctcgacccgcagcagctggagaaccccaccgccgacctggacggcccgctgcagggcgcccggctgctggtggtggacgacaacgaaacctgccgcaaggtgctggtgcagcagtgcagcggctggggcctgaacgtcagcgcggtgtcgtccggcaaggaggcgctggcccagttgcgcaccaaggcgcacctgcgcgagtacttcgacgtggtcctgctcgaccaggacatgcccggcatgaccggcatgcaactggcggcgaagatcaaggaagaccccaacctcaaccacgacatcctgctgatcatgctcaccgggatcagcaacgcgccgagcaagatcatcgcccgcaacgccgggatcaagcgcatcctggccaagccggtggccggctacacgctgaaggcgaccctcgccgacgaactcgcccagcgcggcgtcagtggcgtcaccaactacctgcaaccggccaaggaagcgcaggcgccgagcctgccgagcgacttccggatcctcgtcgccgaggacaacagcatctccaccaaggtcatccgcggcatgttgaacaagctcaacctccagccggacaccgccagcaacggccaggaggcgctcagcgcgatgaaggcgacccagtacgacctggtgctgatggactgcgagatgccggttctggacggcttctccgccaccgagcagctccgcgcctgggaagcccacgaacagcgcccgcataccccggtggtggcgctcaccgcgcacatcctcagcgaacacaaggaacgcgcgcggctggtcggcatggacgggcacatggccaagccggtggagctgtcgcaattgcgcgagctgatcgcctactgggtcggcgaacgcgatcgccgccgccagggcgacgccctgccctcctga

SEQ ID NO: 10505 - DNA, 561 bp, Pseudomonas aeruginosa
ccccttcttcgtgctgtcctgcttcatcagcctcagccgcggcttcggcccgcgcgaccgcaagcgcatggcctggcgggtggccctggcggcgctgatcgccagcgtcgcgctgtacctgttcggccgctacatcttcatcctcttcggtatcaccgccgacgccttccgcatcggcgccggcagcgtgctgttcatctccgcgctgggcatggcccagggccgcgcggcggtgcagagcgacaacgtgcagcaggacgtgaccatcgtcccgctgaccattcctctcaccgtcggccccggcaccatcggcgcgctgctggtgatgggcgtcggccagggctgggaggccaagctgatctccctggtggcgatcttcctcgcctgcctgaccctcggcaccacgctctatctttccgaccgcatcgaacgcctgcttggcgaccagggactacagatcgtcagtcgcctgatgggcctgttcgtctgcgcactggcggcgcagatcatcgtcaccggcctgaagggttcgctgttcccaggctgagcgcaccagcctga

SEQ ID NO: 10506 - DNA, 369 bp, Pseudomonas aeruginosa
ggcggacgccctggatgccgcgccctgacgcaccgcggtggtgccaggacggagcgacggcgtacccatggacgcgccgccggcggcaaggagggaggtcagcgcgacgcctccccttccggagcccacggcgccttctccgtcgatatccggcgaaaacccgttgaaaacgcagccttccccggcatagccagacctgctcggcatgcttccccggcgactcgcggcgccttttcgccgaccgataccggccagcgccaagaagaggcacagcctttgctctggagcctcgacgaagagatccaggccgcagtgcgcaccccgccgtccaccggacggatgcccgacgacaagcacgacgcctcctga

SEQ ID NO: 10507 - DNA, 1431 bp, Pseudomonas aeruginosa
acggaacgggaacgccccggtcgcgcgcctaacggccccctcgtccttcagggagagggcgggggaccggccataccgcacgtcgcccaggaaccccagcatgccccttgccctcctcacccgcccgctccaggcctgtgtcctggtcctggccgcccttctcgcggtgacggcctacgccggaccggcgcaggacttcgccgctgccgacaacggcggtcgcgcccacctgctcgaacactgggcggcgacgcccgacgccggtcgcctggcctttctcgaagcgctgcgccacaaccgcattgcgctggacagccgccagcagccattcatcctcggcgccgaccagcgtttccaggccgccgaaggcgacgccctgccggacggcgagccgaagccgctgcgcctgaacaatcgcctgcgcggcctgctcaacaccgccctggccagccaccagttggtggccaacgaagtgccgctgcggcaggccgccgcgcagcagttgcagaaaaccgccaaggccgcgcaacggccgctgctcgaagcgcgcctgcggatcgagagcgacgctggcgtgaaggaagccctcggcctggccctggccaacctgcaactcggcgatcccgacccggcgctacgcctttccgccgtgcgcctgctcggcgagtccggcgatccgctggcgcgaacccgcctggagaacctgctcgacccggcggtggaaccggaggaaggcgtgcgcatcgccgccgccaccagcctggcccaggtcaagcgccgactgctggtcggcgacctgctcggccaggccttcagtggcctgtcgctgggctcgatcctgctgctcgcggcgctcggcctggcgatcacctacggcctgctcggggtgatcaacatggcccacggcgaaatgctcatgctcggcgcctattccacctacgtggtgcaactgctgttccagcgcctggcgccggaatggctggcgctctacccgttgctggcgctaccggtggcgttctgcgtcagcgccgccatcggcatggccctggagcgcacggtgatccgccatctctacggccggccgctggaaaccctgctcgccacctggggcatcagcctggtgctgatccaactggtgcggatgctgttcggcgcgcagaacgtcgaggtagccaacccggcctggctgtccggcggcatccaggtgctgccgaacctggtgctgccgtggaaccgcatcgtcatcatcggcttcgccctgttcgtgctgctcctcacctggctgctgctgaaccgcacgcggctcggcctgaacgtccgcgcggtgacccagaaccgcaacatggcggcctgctgcggggtgcccacagggcgcgtggacatgctcgccttcggtctcggctcgggcatcgccggggctcggcggggtag

SEQ ID NO: 10508 - DNA, 975 bp, Pseudomonas aeruginosa
aagggagggtcatcgattgaaccagccactcaccgtcaccctcgcccgccgggccggcggccgcgtcaccgctatcgcgctcggcgcagccttcgccacgctgctggccatgccgctgctgcacctgctgccggcggacagcgcgctgcacctctcggcctacagcctgaccctgaccggcaagatcctctgctacgccatcgtcgccctcgccctcgacctggtctggggctacgccggcctgctgtccctcggccacgggctgttcttcgccctcggcggctacgccatgggcatgtacctgatgcgccaggcctccggcgacagcctgccggcgttcatgaccttcctttcctggaacgaactgccctggtactgggccggcacccagcacttcctctgggcgctgtgcctggtggtgctggtgcccggcgcgctggccttcgccttcggctacttcgccttccgctcgcggatccgcggcgtgtacttctcgatcatgacccaggccctgaccttcgccggcatgctgctgttcttccgcaacgagaccggtttcggaggcaacaacggcttcaccgacttccgcagcatcctcggcttcccgatcaccgcgccgggcacccgcgccgccctgttcctcgccaccgtcgcgctgctcgcggccagcctgctgctcggctggcgcctggcgcgaagcaagttcggccgggtcctcaccgcgctgcgcgacgccgagaaccgcctgatgttctgcggctacgacccgcgcggctacaagctcttcgtctggaccctgagcgcggtgctctgcggcctcgccggcgcgctgttcgtgccgcaggtggggatcatcaaccccagcgagatgtcgccgaccaactccatcgaggccgccgtctgggtcgccctcggcggacgcggcaccctgctcggcccgctgctcggcgccggcgtggtgaacggcgcgaatag

SEQ ID NO: 10509 - DNA, 975 bp, Pseudomonas aeruginosa
ctggttcaccgtggccttcccggaatactggctgttcttcctcggcgcgctgttcatcgtcgtcaccctgtacctgccgcgcggcctgctcggcctgctgcgcaaggagaaggagcaatgaggaccaccccgcacctgatgctcgaaccggccttccaccccggcctcgataccgccggcagcggccgcgacgccatcggcctgggcgccgccaccagcggccggctggacgcgcgccacggcaccatcctcagcctggaagacatcaacgtcagcttcgacggcttcaaggccctgcgcgacctgaccctgtacatcggcgtcggcgaattgcgctgcatcatcggccccaacggcgccggcaagaccaccctgatggacgtgatcaccggcaagacccgcccgcagagcggtaccgcgtatttcggcgacaccctcgacctgacccgcatgagcgaggtgcagatcgcccaggccgggatcggccgcaagttccagaagcccacggtgttcgaggccctgagcgtgttcgagaacctcgaactggcgcagagggccgacaagtcggtgtgggccagcctgcgcgcgcggctcgacggcacgcagagggaacgcatcgaggaggtgctcgccaccatccgcctgctggagtcgcggcagcgtccggcgggtttgctgtcccacggccagaagcagttcctcgagatcggcatgctgctggtgcaggaaccgcagttgctgctgctcgacgagccggtggcgggcatgaccgatgccgagaccgaattcaccgccgagctgttcaagtccctggcgcgcaagcactcgctgatggtggtggagcacgacatgggtttcgtcggcagcatcgccgaccatgtcaccgtgctgcaccagggccacgtgctggccgaaggctcgctggcggaggtacaggccgacgaacaggtgatcgaggtctacctcggtcgctga

SEQ ID NO: 10510 - DNA, 1086 bp, Pseudomonas aeruginosa
ccatatcctccgtggcctgagcttcgaggcgaaggtgggcgaggtgacctgcctgctcggtcgcaacggggtgggcaagaccaccctgctgcgctgcctgatgggcctggtcccggcccgcgagggccaggtcgcctgggaaggccgttcgctcaccggactcaggccgcaccagcgggtccgcgccgggatcgcctacgtgccgcagggacgggaaatcttcccccggctgacggtggaagagaacctgctgatgggactgtcccgtttcagcgccagggacgcccgggcggtgccggacttcatctacgagctgttcccggtcctgcgcgaaatgaaacagcgccgcggcggcgacctctccggcggccagcagcagcaactggcgatcggccgcgccctggccagccagccgcgactgctgatcctcgacgaacccacggaaggcatccagccttcggtgatcaaggagatcggcacggtcgtccgcagcctggcggcgcgcggcgacatggcgatcctgctggtcgagcagttctacgacttcgccgccgaactggccgaccaatacctggtgatggcgcgcggcgagatcgtccagcagggccgcggccgcgacatggagagcgagggcgtgcgcgggctggtggcgatttgaacggactgggacacactgccgctggcgcaaccggggccctgcgctggcaatctctatgccctcgtctttccgcaggaggtcgaaatgaccgtcactctgcgcccggccgtccaggccgacgcgggcttcgccgcgctctgcgtcgccgccgcctatgccccgtggatcgcggtgatcggccgcaagccctggccgatgacccaggactaccacgaggtgatcgccagcgaccgggtcctcatcgccgagcacgacggccagccggtcggcctgctggtgacgcgggaaaccgccgacggcttcctcgtcgacaacctcgccgtgcttcccgaatgcaagggccagggcatcggccgacaactgctggagcgtgccgagcgcgacgcaacgagcctcggctaccgctcgctgtacctctacaccaatga

SEQ ID NO: 10511 - DNA, 960 bp, Pseudomonas aeruginosa
gcggatgacggaaaacatcgagctctacgccagggtcggctacctcgaatacgaacgccgccaggaagagggattccgccgcgtgttcatgcgcaaggccctggcctgacccgaccgatgaccgccgccctccccgacctgagcttccaccccgcctggcacgcccaactggagctggcctacgcccgcgccggcgacgccacccgcccggtgacgcggcgccactccggaccgctgcgggtgcagaagcacctctacgccgaaggcccggaagtctgccagcacatcctcgtgcatccgcccggcggcatcgccggcggcgacagcctggccttcgacgtgcgcctcggcgaacgcgcctgggcccagctcaccagccccggcgcggccaagtggtaccgcgccgcctgcccgtcgcggcagaccctggagatccacctggagcccggcgccaccctggaatggctgccgcaggaaagcatcgtcttcgccggcgcccaggccgaactggaaacccgtatccagctgcgcggcgacgcccgcctgttctactgggacatggtcgcgctcggccgcccggccagcggcgagcgcttcgtcagcggccacttcgtcgcggccctggacatccgtcgcgacgaccgcctgctctggcacgagcgccagcgcatcgacggcggcgaccgcctgctcgactcgccgatcggcctcgccgggcatccggtgctggcgaccctggtcgccagcggcgagatcgacaccgacctgctgcaacgctgccgcgcgctcccctgcgccggccgcggcaacctcagccagttgcccggcggcctgctggtggcgcgctgcctggccgacgaggcgctgcacgcgcgagcctggctgatcgaactctggcgcctgctgcggccggcgctgctcggccgcgaggccgttcccccacgcatctggagtacctga

SEQ ID NO: 10512 - DNA, 831 bp, Pseudomonas aeruginosa
gatggacttgtccccccgcgagaaagacaagctgctgatcttcaccgccggcctgctcgccgagcgccggctggcacgcggtctcaagctgaactacccggaggcggtggcgctgatctccgccgccctgctggagggcgcgcgcgacggccgcagcgtcgccgagctgatgcactacggcaccaccctgctgaaccgcgagcaggtgatggagggcgtgccggagatgatcccggacatccaggtggaggccaccttcgccgacggcaccaagctggtgaccgtccaccagcccatcgcctgaggccggccatgagcgcttcgatccgcgacgccggcgtcgccgacctgcccggcatcctcgccatctacaacgacgccgtgggcaataccacggcgatctggaacgaaaccccggtggacctggccaaccgccaggcctggttcgacacccgcgcccgccagggccacccgatcctggtggcgagcgacgccgccggcgaagtgctcggctacgcctcctacggcgactggcgacccttcgagggcttccgcggcaccgtcgagcactccgtctacgtgcgcgacgaccagcgcggcaaaggcctcggcgtgcaactgctgcaggcgctgatcgaacgtgcgcgggcccagggcctgcacgtcatggtggccgccatcgaaagcggcaatgccgcctcgatcggcctgcaccggcgcctcggcttcgagatcagcgggcagatgccgcaggtgggccagaagttcggccgctggctcgacctgaccttcatgcaactgaacctcgacccgacgcgcagcgcgccctga

SEQ ID NO: 10513 - DNA, 951 bp, Pseudomonas aeruginosa
catccagcccggggtgaacatcgccatcggcgccggcaccgaggtgatcgccggcgagggcatgatcctcaccgccggcggcatcgacacgcacatccacttcatctgcccgcagcagatcgaagaggcgctgatgagcggggtcaccaccatgatcggcggcggcaccggccccgccgccgggaccaacgccaccacctgcacctccggtccctggcacatggcgcggatgctccaggccgccgacgccttcccgatgaacatcggcttcaccggcaagggcaacgccagcctgccgctgccgctggaggagcaggtgctcgccggcgccatcggcctgaagctgcacgaggactggggcagcaccccggcggcgatcgacaactgcctggaggtcgccgagcgccacgacatccaggtggcgatccacaccgacaccctcaacgagtccggcttcgtcgagaccaccctcggcgccttcaagggccgcaccatccacacctaccacaccgagggcgccggcggcggccacgcaccggacatcatcaaggcctgcggcttcgccaacgtgctgcccagctcgaccaacccgacacggccgttcacccgcaataccatcgacgagcacctggacatgctgatggtctgccaccacctcgacccggccatcgccgaggacgtggccttcgccgagtcgcgcatccgccgcgagaccatcgccgccgaggacatcctccacgacctcggcgcgttcagcatgatcagctccgacagccaggccatgggccgggtcggcgaagtgatcacgcgcacctggcagaccgccgacaagatgaagggccagcgcggccgcctcgacggcgacggtgcgcgcaacgacaacttccgcgccaggcgctacatcgccaagtacaccatcaacccggcgatcacccacggcatcagccatga

SEQ ID NO: 10514 - DNA, 585 bp, Pseudomonas aeruginosa
cgtccggcaactgcacggcctgtatccgcgccgtcatcccggtctctacgcaccgctgctcggcagcctggcgctgctgctcggtgccgcgccgctgggtcttgccgcgctgcgcctggcattgccggaggctcctttgcggccgctgggctggctctccgccctgccgctgctggcggcctggctgtggctgatcgccctgctctcccgtggcgccagcctcggcccgcgcctggcccgcgacgccagtctgctgctggtcgccaccgggctcctgctgcgcctggccagcggcgagacgtcgggcctggtggcgctcggcggcggcgcctgtgcctggctgctgttcaacagccgggcgatgcaacgctacatggaactggtctacgcccagcgcctgtaccgcgcccagtcggccaaccgccccggttcggcgcagcggcgcctggccaaccaggccgcctaccgcgaacgcaagcgacgcgagcgctccgggcgatcctgagccagactgtcgccctgcgaccttctgcgcattggcgggcgtcgccgacctgcaggcgcggcagcgcaacatgggcctag

SEQ ID NO: 10515 - DNA, 642 bp, Pseudomonas aeruginosa
cgactgcggcgggctttgcaggggctgggaacgcgtcctgtgcgcttgcgacaagcgtcatgtttcgcggctagactgacgcctcgcacgaggaggagttccatgcaacaggtcatcgcggtgagcctctgcgccacccacgcgttcagcaagcaggtgcgtcccgccatccgcctcctgaaaggcctcggcgtcgagggcgacgcccaccacggcgtcaccgtgaagcaccgctcgcgggtgcggcaggacccgacccagccgaacctgcgccaggtccacctgatccacgaggaactgcacgacgagctacgcgccagcggcttcgccatcggcccggggaccatgggcgagaacatcaccacccgtggcgtcgacctgctcggcctgcccaccggcacccgcctgcgcctgggggaaagcgccctggtcgagctgaccggcctgcgcaatccctgctcgcagctggacaactaccagcccggactgaccgccgccgtgctcggccgcgacgaacagggcaacctgattcgcaaggccggggtgatggcgatcgtcctggaagacggcgaggttcgccccggcgacgccatcgatatccagctgccccccttgccgcaccgggccctggagaaggtctga

SEQ ID NO: 10516 - DNA, 1152 bp, Pseudomonas aeruginosa
cgacaacggctaccgctactaccagccggaacagatcgagcagctctcgcgcatactcgcgctgcgccggctggacgttccgctggaagccatcgaccgcctgaaacgcgatggcgcgctggacgacccgcaacgcctgcggcatttcctgcaacgacaccagcacaccctgcgcgaagagatcagcgcccgccagcgcctgctggcggaactcgaccgaaccctggcgacgctcgcccactggaggatccgcaacatgcatgcacgaatcgtcgaacgtcccgccttcagcgtggtgggcatggaatacttcggcagcgcccccggcgacaccatcggccagctctgggaacgcttcatcccgcgcgagcacgagatcgccggcaagcacgatcccgaggtctcctatggcatctgcgcgcagcagcccaacggcgaattccactacgtcgccggcttcgaggtgcaggagggctggccggtgccggagggcatggtgcgcttccaggtgccggcgcagaagtacgcggtgttcacccacaagggcacggcgccgcagatcgccgagagcttccaggcgatctacagccacctgctcgccgaacgcggcctggagcccaaggcgggggtcgacttcgaatactacgaccagcgtttccgcggaccgctggatccgaactcgcaagtcgacctgtatatccccatctactgaatcagcgcttgccggccggcaccttggccggctggcgcatgcgttgcagcagggcggtgcactggttgtcgtcgctcttgctcggcgccaccagcgccagcaggctggccgccgggcccaccgccacgccgagggcgatcattcccgcgccgcgcgccaccagcggcccggcgtggaccccggcgtcgggcttggcgaaggtgccgcgcacgtacagcggcgagcgcagcgagaagatccgcaggcccttgctgtgcggggtgacatcgaggtcgagcttctcgttggcgaagttcaccgtgccgtcgacgttgaccagcgcgttctcggtgtcgaagacgaacagccggctggtcatcaggcccttctgcaggccgaagtcggcggccgcgcagttgatcttcacctcgtcgtcgccgaacagcttggtcaccaggtag

SEQ ID NO: 10517 - DNA, 1422 bp, Pseudomonas aeruginosa
ccgaacggcaccggcttgccgagcgggtcgaccagcacttccagacgggtcttcaaacgctggtcgtcgaggctgacgctacccttgtcgaaaccgatctcgcggatgtccagttgccaggcggacggctcgtcgctgtcgctggcaggcaggtcgaaatcccaattggcgcggccgtcggccaggcgcaggagctcggcgcgcggctgggtcagcttgatctgtggaatgcggatggtctgccagagcaacggcaacggcgcgaggcggaattcgatgcgttccaggctggcgaactcgctcgccttggtcttgcccgccgtccactccgggttgccgagggtgatgtcctcggcgctgaagcgcggccaggggatccaggcgcgccagccttcctcgccctcctcgcggcgccaggccacggcgaggttgccgttgatggcgaacgggcggttcagcgccgccgagaccttttcgttgagggtgggcttgatcaggttccagtcgaaggtggcgatgaacaccaccaacgccgccagcagcaggaccaggctggcgaggctccaggtcaggatctttcggccgcgcgtcatgcacaactccttttcgccgcgtcggttgtcgggcaggcgcggcagcgcgcctcgctcagcccgtcagtgtgcaggctggcccatggactcgccagcgcgaatacgccggcccgttccgttaggaccggcgaaacgccggcattgctccccgtcccacgcatttcaggcaaaaggccagttcggcggcgggtcgataaaactttttcgaccgcgtgggactcacaccttaggtaagcagaaaaagccggccgcagagccggcccttttcaccggatcagcctcaaggagaaaaccgatgaccaccgttcaactgacggacgtccagacccttcgcgaccgtgcccgcaagaacatccaggaaggcgcggtcaccgaaggctattcggccgatcgccagaccgtcctgcgcctgctcaacgaagcgctcgccaccgagttggtctgcttcctgcgctacaagcgccactacttcatggccaccggccttaaggcgagcatcgccgccgccgagttcctcgagcacgccaaccaggaaatgcagcatgccgaccagttggccgagcgcatcatgcaactgggcggcgagccggacttcaatccgcgcggcctggaggagcgctcccatgccgaatacgtcgaaggcaagaccctgaaggacatggtcaccgagaacctgatcgccgagcgcatcgccatcgacagctatcgcgagatcatcacctacctcggtaacgacgaccccaccacccgacgcattttcgaggaaatcctggcccaggaagaagaacacgcagacgacatggccgacatcctcgacgacctcgcctga

SEQ ID NO: 10518 - DNA, 1563 bp, Pseudomonas aeruginosa
acagccaggcctggacccggtcgttccagcgcgacatggcccagagtaccttgtcgaccgaatcgccatcctgtagccggcaccccgagagcatcgccagggcgcccagggacaggccgccgcgcaacagcaggcggcgttgcaaatcgaccatctgccgctcgctggacgggtcgaccgcgatcttcgcgcgcttcttctccggccccttcatccttcgctcctccgtccgcgccgccactcgcgtccgatgatcatcggcagcagggtgcgcggcaccaacagcaccagcagcaggtgcacgacgacgaacccgacgaccccggccatggccaggaaatgcacccagcgcgccccctggaagccaccgaacagcgcggtcagcccgtgcagttgcaccggtttccagatcgccagcccggacagcaccagcagcgcgccgagcgccaggaccagccagtacagcaggcgctgcaccgcgttgtagcggcccggctcatggaccaggcgcaggccgagggcgaggcgcaggtcgcgccagacgccggccgcgctcaaaggcaggaagtcgcgacgaaaatgcccgctggacagtccgtgggcgaggtagcacaggccgttgccgagcagcagccacatggcggcaagatgccaggcgatggaaccgccgagccagccgccgagggtcgcccaggcgggaaaacggaaatccagcagcggcgaagcgttgtagatgccccagccgctgccgaccaggcaggccatggcataggcattgagccagtggcagagtctcaccggccaggcgtgcaacgcacggttcatggcttttctcccaggaaacccggccgggacggacgcgccgtcccggcgaaacctcacatcggcggggtcacgccgtccttgccgaccgagatggccagggcggtgaggctgccgtcggcgcccttctgcgggaacagcacgaccttggcgccaggcttgagcaggctgcgctcgcccggctccaggctgacgatgggcacgtcgtccggcaccaccacggtcttctcgccatcgccgtatttcaccgtcatgcgccggccctggctgaccaccaggttgccgaccgtaccgttggtcatggtcgaggcgctgccatcggcgttctcccagggccggtggccttcgccgctgccgcgcaggctgggggcgaagacatgcacctcgagggccttcagggtgccgtcgggctgcggcacggcggcggtgccgatgaagctgtcgggctggatgtcctccggcttcgccagcgacacggcgcgaatcgcggtcttgtcggtgagtctgaccgtcagttgctggccgttgcgggccttcagttgcaggtggtcgtcggcggcctgctggatggtgccgcgcagcggctgcagcatgcccgcaggcggttgcgcggcgaagctggcggcactggccaggagcaggccgaagaacagcgcgggggaagccttgagtcgaagcatcggtcgatcctcggtggggttgagcctcgatggtcgccccgccggcggtacccggagatga

SEQ ID NO: 10519 - DNA, 1776 bp, Pseudomonas aeruginosa
cgactacctggtgaaacccttctccttcaccgagttgctgctgcgtatccgtaccctgctgcgccgcggcgtggtccgcgaggcagagcaggtgcaactggccgatctgcagctggacgtgctgcggcgcaaggtcagccgccaggggcaggtaatcgccctgaccaacaaggagttcgccctcctgcacctgctgatgcgccgcgagggcgaggtgctgtcgcgcaccctgatcgcctcggaggtctgggacatgaacttcgacagcgacaccaacgtcgtcgacgtggcgatcaagcgcctgcgcgccaaggtcgacaatcccttcccgaacaagctgatccataccgtgcgcggcatcggttacgtctgcgaggagcgcccgtgcccgcccgccgctccctgaccctctacgcggcgctgctgttcgccgcggtggcggcgctggtggtcagcgcggtcggcttctacctgtaccgctcggtggaagaggcgatgctgcggcgcagcgacgtgatggtcgccggccgggtcgagcacttccgcaacctgctgcgcgacaacctcaccctggccgagctgaaggcgcgcccgcgtctgttcgagaacatgctcggcaacgagcaggacatcctgctcctcggtcagcccggcgaggcgccgatcgtcgcggtcaacccgcgccacgaacgcctgccgtcgctacgggtggtcgccgccggccaggcgttgaatccgtccgtcgtgcacgccgcgctgacccacgacggcatcccgatgcgcgtgctcgccgccgaggtcctggtcggcggccgcgagccgttgcagatcaccgccgcacacctgctgctgggcgagacgcggatgctcgcccagtaccgcgaccgggtcatcgccgccgtgctgctggcgttccttggcaccgccctgctcggctggctggtcctgcgccacggcctgcgcccgctgcgcacgctggcggcgaaggcggcggagatccatccgaccagcctggatacccgcctcgacgtcgccgccgcgcctgccgagttgcagcaggtggcacagtcgttcaacgccatgctcgaacgcctagacgacggctaccagcgtctgcagcagttctccgccgacctcgcccatgagatccgcacgcccatcggttcgctgatgggccacggccaggtggccctgcgccagccgcgcagcaacgaggagtaccaggcgctgatcgcctccaaccaggaagagctggagcgcatcgcgcggatggtcgagagcatcctgttcctcgctcgcgccgacgacgtacgggcagcggtggagcgcagccgcctggacctgggcgaagaactgcggcgccaggcggagtatttcgaagggctggccgaggaacgtgggctgagcctcgacatccaggtcagcggccagctacgcgccgatccgcaactgttccgccgggcgctgagcaacctgctggccaacgccatccgctacgccagcgccgacagcctgatcgaagtgcgcggcctgcgccgctcgggggaattcctgctgagcgtggagaacgcctgcgacaggctgccggccgagccgctgtcgcgcctgttcgaccgcttctaccgtggcgacgccgcgcgcagcgacgcccagtccagcggtctcggcctggccatcgtccaggcgatcatgcgcctgcacggcggccgcgccgaagcgagcgccccggctccgggacgcatccgcttcgacctggcgttcccggctcaggactga

SEQ ID NO: 10520 - DNA, 483 bp, Pseudomonas aeruginosa
aggattccgtctgcaagccggcgaagcgtgcccccagttgctcgcccaccgcctcgacgaaagccgccggcccgcaggccagggcctggctgcgcgccaggtcggctgcccagccgtccaggtggcgcggctggaaatgcccctccaggcagccatcggcccgcgccccgcgggtcaggctccagcgcaactccaggttcgggtggcgcgccgccagcgcctccagctcgccgagccaggcgcgctggccgggatgacggacgtagtgcagccacagcacgggaccgcgatagccgttctccagcgcctcgcggagcaggccgagcaagggcgtcaggccgctgccggcggccagcaggcagaccgcctcggcctgcatcggccagcgcagatcgccttgcgcgggttgcaactcgacacgctggccgaccgccaggtgttcgcacaaccagggcgagagcagcccgtccgggtgacgcttga

SEQ ID NO: 10521 - DNA, 771 bp, Pseudomonas aeruginosa
acgatcgttcacaaaactttgcccgttccgcgcaatcgagtcaacaagcgttcactgatgtatccttcgaccgctgccgtccccggttcgaccgggtcgcagggcttttgctacagtcgccggtccgccaaaggaagccgtatgtcctcaccccgcgccgaacagaaacagcagacccgccacgcgctgatgagcgccgcgcgccacctgatggaaagcgggcgcggcttcggcagcctcagcctgcgcgaagtgacgcgcgccgccggcatcgtcccggccggcttctaccggcacttcagcgacatggaccagctcggcctggcgctggtcgccgaagtcgacgagaccttccgcgccaccctgcgcgcggtgcgccgcaacgagttcgaactgggcgggctgatcgacgcctcggtgcgcatcttcctcgacgcggtcggcgccaaccgctcgcagttcctcttcctcgcccgcgagcaatacggcggctcgttgccgatccgccaggccatcgccagcctgcgccagcgcatcaccgacgatctggccgccgacctggcgctgctgaacaagatgccgcacctcgacggcgcggccctcgacgtgttcgccgacctggtggtgaagaccgtcttcgccacccttccggagctgatcgacccacccgccgccgatctgccgccgcacctgatgccggccgcgaagatcacccaccagctgcgtttcatcatgatcggcggcaagcactggcacggcctgcccggctga

SEQ ID NO: 10522 - DNA, 1203 bp, Pseudomonas aeruginosa
tccctttcctgtcgcattgcggaaactgcccatgctggtcatccaccaacgcctgcccgcccgctcgccccgctgggacgaagaactccacctgacctacgaggcgcgcagcaagagccgcctgcgctgcttcgcggcgagcggcgaggaggtcggcctgttcctcgagcgcggccagcctccgctggccgacggcgactgcctggaggcccgcgacggtcgcctggtgcgggtcgtcgcccgctccgaacgtctgctccacgtcacctgcgccagcccgctggaactgacccgagccgcctaccacctgggcaaccgtcacgtcgccctgcaggtcggcgacggctggctgcgcctgctcgacgactacgtgctgaaagccatgctcgaacagctcggcgccacggtggaggccatcgaggcgccgttccagccggagcacggtgcctacggcggaggccaccaccactcgcaccatggcgaggcggagttcaactacgcgccgcgcctgcaccagttcggcgtgcgccggtgaacagcatctgggcgcgcctgcgcctggccagctcgcagttgccgatcggcggatacagctattcccagggcctggaggcggccctcgacaatggctgggtgcgcgacgccgagagcgcgcggacctggctggtcgaccagctgcaactgaacctggcgcgcttcgaggcgccgctgctggccggcctgctgcgcgccgcgctgatcggcgactgggccgcctgcgatgcggccagcgaacgccatagggccagccgcgagacccgcgagctggcccaggagagccggcagatgggcttttccctgcaccaattgctggaagccctgcccgagctcgacgctcccggccgcgcctggctggcgcgccaggacccgcccaatctcgccgccgcctgggcgatggccgcgcgcgcctggcgcctggacgccgaggaggcgctgagtgcctggttctggagctggctggaaaaccagttggcggtgctgatgaaaaccctgccgctcggccaactggccgcgcagaaacttgcttccagcctactgccggaactcgaccgcgcctgcgccgaggcgctgcggcggcccgccgtcgagggcagcgccgcgttcggtctggcgctggccagcatgacccacgaaacccagtacagccgtctgttccgttcctag

SEQ ID NO: 10523 - DNA, 1227 bp, Pseudomonas aeruginosa
gagaaaccccatgacatcccaacccctgcgtgtcggcatcggcggtccggtgggctccggcaagaccgccctgaccctggccctgtgtcgcgaactgcgcgagcgctacaacctcgcggtggtcaccaacgacatctatacccaggaagacgcggagttcctggtgcgcaacgaggccctcgcccccgagcggatcatcggcgtggaaaccggcggctgcccgcacacggcgatccgcgaggacgcctcgatcaacctggaggcggtggaccagctcaaccggcgcttccccggcctcgaactgatcctggtggaatccggcggcgacaacctgtcggccaccttcagccccgagctgtccgacctgaccctctacgtgatcgacgtttccgccggcgacaagatcccgcgcaagggcggccccggcatctgcaagtcggacctgctggtgatcaacaagatcgacctggcgccgctggtcggcgcctccctcgatgtgatggaccgggacgcccggcgcatgcgcggcgacaagccgttcgtgttcagcaaccagaagaccggccaggggctggacgaaatcatcgccttcatcgagcgccagggcctgctgaccgccgcctgacgccacttcgcaacgacaaggaaccaccaatgaaactgcccaagctgctcgccgccctcgccctgctcgccgctccggcgctggccttcgcccaccccggccacggcgaacacggcctggtcgccggcctcgcccatccgctcaccggcctcgaccacctgctggcgatgttcgccgtcggcctctgggccgcccagcaacagggagccgcgcgtctcgccctgccctgcaccttcgtcggcaccatgctggtcggcgggctgctcggcttcgagggcctgcaactgccgttcatggataccggcatcgccgcctcggtgctcgccctcggcctctgcgtggccctcgccgtgcgcccgccgctgccgctggcgatggccgccaccgcgctgttcgccctggcccacggggtcgcccacggcctggagctgccggacctctccagcccctggctgtacgcgctcggtttcgtcgccgccaccgccgcgctgcacgccgccggctacccgctggtgcgcttcctggcgcaggcggccgcgcccctggtacgtctcgccgggctggcctcggcgggcgccggggtctggttgctggccggctga

SEQ ID NO: 10524 - DNA, 2979 bp, Pseudomonas aeruginosa
gagcccgcaatgccgggcgccaaccctgcgagcgaagaagtcatgtccctacaacgccctatccccagcctggcgcgccccttgtcgcgcctctccccgctcacccttgccctgcgctgggccctgctcggcctgtcggcggccggcgccggcctgctcggcggcggcctggcccacgcgcagagcgtcggccagcacagcgcggctacccgcctggacgacgccacgccgcgcagctacgacattccggcgggttcgctgggcgcctccctgggcgccttcgccagccagtcgggcctgctgctgtccttcgaccccgagctgacccgcggccgcacggcgccggcgctcaagggtcgctacagcgtactggaaggcttgcagcgagtcctgtcgaacaccggcctgcaggtcgcggcgggaacctccggcgcctacctgctggtcgagccgcgcatgcccggagaaaccccggccgacctgtcgccggtggtggtctcggccgccgagctggccgatccgcagaaggaaacctataccgcgccacgctcgtcggtgtacctctccagcgaagacatcgaccgcttcggccgggtttccgtgggtgacctgctccagggcatcccgggcgtacaggtcggcgacagccgcaacggtggcgcgctggacgtcaacatccgcggcatccaggggcagagccgggtggcggtgcgggtcgacggcgcggagcaggcgctggacgtctaccgcggctacgccggcacccagcagcgcagctacatcgatcccgacctggtcagcagcgtgaccgtcgacaagggtccctcgacccgctcgggcgcgatcggcggcagcgtggaaatgcgcaccatcggcgtcaaggacatcctggtcgacggcaaggacctcggcgtgcgcttcaccggcgacgtctggaacaacggcgtcgccccgcagcaccgcagcgccagttcgaagaccgagaatctcagcagcgtgccgcacgatgaccgcggcagcctgttcggctcccaggccaagtccggcagcgccgccttcgcctaccgcaacgagcatctggacctggtcgccgcctatgcgcagcgcaaccagggcaactacttttccggcaagaaaggccaggaccgctatcgcgtctacaaccgctacggtcgcgaggaaagcagcgtagccaaggtctacaacgcgggagaggaagtgctcaactcgtcgtcggagaccgagtcctacctgctcaaggcgacctggcgcatcgccgacgagcacaccctggacctcggctatcgtcgctacgacgggcgcaccggggagatcatgccgtcggacatcttccgtttcggcaccgccggcatctaccagtacccattgagcgaagtgaagatcgacacctacaccgcacgctaccgttacctgcccgagaacaatccgctggtggacctcagcaccggactgtggatgaccgacgcgaagagcgacatgctgacctcggtgctggcgccgcgctcccaggcctatcgctccgaccgcaactggacgcgccaggacaaccggcgcatcggcggcgacctgaacaacgtggcgcgcttcgaaaccgacttcggcgatttcaagctcgacctcggcggctcgttccaggtcgaagacatccagccgcagaaaagcgtggtcaccaccctccacgacatcaacgccaaccgcaccctgagggacgccacccgccaggaatacggcctcaacggcaagctcgagttcaagccggtcgagcgcctgacgctatggggcggcggccgctacagccacttcaacagcaaggacaacggcatctccgcctcgccgcggcgcgaggatcgcgacatgcgcttcatcacggtgagcaggcccggctactacggctcgatgatgtggttccccgaccagaacggccagtacaccgacgccaccgatccccgcctcaacaacggcatcgtcaccaacaacaccaacaatccgttcgaaggcattcccttcgacgagttcggcccggccaacgtgacagtccatccctcgcgggtcaccaacgtggtcaccggctacaactacagcaagaagggcagcagccgcggcggcggtttctcgccggcattcgggatcaatttcgagctggccccggataccttcgtctacgcctcctataccgaaggcctgcgtctgccgtcgctgttcgagaccagccagggcaccctccaggtcgagccgggcaaggacctcaagcccgagcgttcgcgcagctgggagatcggtgccagcgcgctgcgcgacagcctgttggccgacggcgactcggcggcgatcaagctggcctacttcaacaacaccatcaagaactacatcacccgctattacgatccgggccagatgggcctgatgaccttcagcaacaccgacagctaccgcaccagcggtctcgaactgcaatcgcactacgacgcagggcgggtgttcgccgacctgtcggcgacctactacctgaagaccgagacctgcgacgccgccttcgccgccaggctgcgcgccggcgccaaccgctaccagcgcaccgagaacacgccgaactgcacgccgggcagcttcatgggctcctataccaacacgcagaacccgccgcggctggcgaccaacctgaccgccggcctgcgcttcttcgaccaggccctgaccctgggcggacgcatgacctatacctccggccccaccgccacggcggacaagccctggcaggtcggcgccaccacaccgcagatcgagtaccgctcggtgcagctgttcgacctgttcctcaagtacaagctgttcgagcacaccgaactgaatgcctcgctgcagaacctcaccgaccgctattacctcgacccgctggcacagagtttcatgcccgcgcccgggcgtaccctgcgggtggggatgcaggcgaagttctga

SEQ ID NO: 10525 - DNA, 2067 bp, Pseudomonas aeruginosa
gccgccctctccccctccaggcgttgtcggcggagcgccgctccggtagggcgaataaccgcccagcggctatccgccgaagcaccgggcctcccgctccccgtccctccggaactgtccggaggagcggcgagacagcgtccgtcaccacgacaacggataactcaccaccagccgcgtctggtcgaagtcgctgttgaagctgcgtcggttgctggcgtggttgaggcgcacgttgagccgcgccagcggaccgctctgcacggtgtagccgagctcgacatcgcgctcccattccttgccgccgctaccggccttggtggtggcgttcgagccatggccgtagcggaccatgccgatcaggccgggccagccgaggccgacgaaatcgtagtcgtagcgcacctgccaggagcgttcgtcggcgttggtgaagttgccgttgaacatgtcgttgcccatgctccgcccactgctgccgtagaccgattgccagccgctgtcgccgccgaccttctgcaggccaaggtagaaggtgtgcaggccgatgccggcggaaaacaggccgtagacggtatggctgtcgatctctccggcgcgcgcggcgccgtcgtcgcggtcgacgaacaggccgaggttggcgcccagggtccagtcgccgacacgctgcttgtgcagcaggttggcgtagctctgccggtagacgtcctccagttgcccgtgccacaggcccagttgggtgcgctcgcggttgaagcggtactcggcgccggcgtagttgaaaccgtccgatttctgcgtcggcgcgctccaggccgacaggtcctgcatgtccgccgaattgcgcaggctcaccgcgtcgaagcgtccggcctgcagagccaggcccggcagctcgcgggaaaccacggcgaagccgcggaacgtctgcggcagcaggcgtccgtcgtcgtagcgcaacagcggaatgtccgggagcatctcgccgatcttcagttcgctggccgaaacgcgcagcttggcggccacgccgacacgcccatagttgtccgccgcgcgaccgtcatcgtgcaacggaagaagctcggaattgctggtgccacgtccgctgttcagcttcacgccgaacaggccgatggcgtcgaggccgacgccgaccgtgcccggggtatagccggaactgaacttgaggatgaagccctgcgcccactcgtccaccaggctcttgccggcatcgtggtcgcggaaatcgcggttgaagtaatagttgcgcaggaccaggtcggtcttcgcatcctccaggaagccgccctcggcagcttgcgcggcaagacaggcgagcatcggcaggaccgcccctgcattgcgcgggactgcggttttacgacggattttcattgttattgtgctccgtttttcagggacgaccgggccccggcagcctctgcgggccacctggcgacgacggtcgggtcagcggcggggcgcgggccccgccgccagggtcagaacgggtactggcgcggcgcgtgctgcacgctgatccagtggtcggtggtgaattcctcgatggcccagtcgccgttgaagcggccaagtccggagttcttctcgccgccgaagggcgcgttggcctcgtcgttcaccggaatgtcgttgacgtgggtcatccccgcgcgaagctggcgggcaaagcgcaccgcgcgttccaggtcgcggctgaacaccgcgctggacagcccgtattcgctggcgttggccaactccagcgcatgcgcctcgtcgcgcgcgcggagcaggccgaccagcgggccgaagatttcatcgcgggcgatctccatcgtcgcggtgacctcgccgaatacgtgcggagccagcaactgcccatcgacgccgccctcgtacagcggcttggcgccttcctggcgggccaggcggatcttttccagcaggccttcgagctggcgcgcgttgacgatcggcccgaccgcggtatcggcgcgctgcggatcgccgacccggaggcccttgacccgctcgacgaagcgcgcggcgaaagcgtcgtag

SEQ ID NO: 10526 - DNA, 486 bp, Pseudomonas aeruginosa
aggctgtcctcgacgatgatgcagttgatcgccatgcagatctgcccctggtggaggaacttgccgaacaccgcggcattcaccgcctgctccaggtcggcgtcgccgagcaccacgaacggactgttgccgccaagctccagcgccacgtgcttgagatgcgcgccgccgctggcgatgcggccgatgttgcggcccaccggggtcgatccggtgaaggtcaccaggcccggcaccgggtgctcgacgaaggcgtcgccgatctcgctgccggggccgaccaccacgctgaacagcccggccggcagcccggcctcttcgaagatccgcgccagcagcagtccgccgcagaccggcgtgtcgctggccggcttgaccaccaccgcgttgcccagcgccagggccggggcgatggaacgctgggtcaggtgcagcgggaagttccacgggctgatcaccccgaccacgccgatggcgctgcggtag

SEQ ID NO: 10527 - DNA, 891 bp, Pseudomonas aeruginosa
cgggaatcgctcatcgctcttctcctctttcgaaaatcacaggggtttcttcgccgtcgcgtcgacggacgcttccgccggcacgcgcggccgcaggtggatgcaggcgatcgccagcgcgccgatcacgccgggcgcggcgaaggccaggaagttctgctggaacggcagctccagggccagcaggctgccgccgagcatcggcccggcgatggcgccgaggcggccgacgccggcggcccagccgaccccggtggagcgcacccaggccggatagaactgcgcggcgtaggcatggatcaccgccagggtgccgatggtggtggcgccggccaccaccagcaggccgttgagcagccaggggcctggccccaggccgagggccgcgagggaggccgcggccagggcgaagaacagcaccagggtgcggccggcgccaaggcggtcggccagccagccgccgaacaacgcaccgagggtcgccccgacattcagggtgacgaggaacgccaggctcgaaccgagagcgtagccgccgccggccatcagtttcggcaaccaagtgttgagcccgtagctcatcagcatgcacatggcgaaggccacccacagcagcagggtgcccactgcctggcgcccctcgaacaactgggcgacccgtccgctcggcgcttcggccgcgacagcgttcgcccgctcggcgccgggccggtagtcgggatcgaccttgcgcagcagcgcgtccagttcggcgcggcggcccttgagttcgaggaacgccgccgactccggcaaccagcgcaacatcagcggcaccgccagcaccggcagcaccgccacgtagaacaccgattgccagccccaggcggggatcatggcgatcgccagtag

SEQ ID NO: 10528 - DNA, 873 bp, Pseudomonas aeruginosa
aaaatagaactggtctatatgagtccgatcgatctcaacctgatccgcaccttcgtcaccctctacgaagccggcagcgtgaccctcgccgcggagcgcctgcgcgaactgttcgacgacgcgttgttcacccgcacccgcgacggcatccagccgaccttcgtcgccgagcagctctacggcaccttccgcgagtcgctgacgcgcatcgagggcgcggtacagagcgttcgccacttcgatccggcgaccaccgagcgacgtttccgcatcgccctcaccgatctcggcgaagtgggtttcctctcgctgatcctcgaacgcctgacccgcgacgcgccgttcgccgaagtggaagtgctgccgctgcaggtggacgaggtcggcgcctggctgagcagcgccaaggtcgacgcggcgatctgccgccagccggtgcccggcgcgcgcagccagcgggtcctgcacgagcgctacgtgtgcctgctcagcgaccgccacccgcggatcggcgacagcctgagcctggagcagtacctggccgagcggcacatcgtggtgacccgtacctccggccacggcatcgccgaggacgtgctcgaggccatgcaggtgcagcgccgcatcagcctgcgggtgccgcacttctcggtgctgccgaagatcattcccggtaccgagctgctgaccatcctgccggcgcagatcgcctatcgcttcgtcgccgaaggcggcatgcgcatgctcgaactgcccttcaccctgccgccgttcgacgtctccctgcactggcacgagagcagcgaacgctcggcggcgctgaactggttccgcaccaccatcgccgaggcgatcatcgccgcccaacgctga

SEQ ID NO: 10529 - DNA, 1890 bp, Pseudomonas aeruginosa
ccggtggactgcaggcttaccgccaggccgcgccagcggcgcgaggcgtactcgctggcgatcacgttgctgctggcgaggatgccgccgatacccagtccggtcagcccgcgcagcaacgccagttgccaggccgcctggctcagcgccgaggcgagcatgcccaggcccgacagcgccaggcaggcgaggatcagcgggcggcgcccccagcggtcggcccagggcgcgacgaacagcgagccggcggccatgccgaagaggccggcgctgagcagcaggccgatctcggcgccgccaaggttccattcggcggccaccgaggatgcggtgaaggccatcaccagcacgtcgaagccatcgatcaggttgagcacgatgcacacagccaccgccagccactggaacggacgcatcggttcgtcgtcgagagcgcggcgcaagtcccggttcatgggcggccctcccccgagcggacaggaaagaagcgacggcaggcgggagcgaggcgcgggaatgcaggaatccatcatcgggaagaccctttttcttgttgttgtaggcacggcaagcgcaggcaccctggcaccgttgcgtcgatgccgcaatcctattggatccattttggcgacaagaaaacggatggccagcggatatcccactgtcagcgaaatccgagaaaggctctggaacgagataatttggcaatttattcctgaagttttttatgtgcgactatcgaacagattattttttgtacagaagcggttgacttggaaaagttgcctcgcgaatcattggatccaattacaaaaacaacgagaggatccgacgatgtttccgaagaacgcctggtacgtggcctgcacccccgacgaactggccggcaagccgctcggccgacgcatctgcgacgagccgatggttttctaccgaggcgaggacggccgcgtggcggccctcgaggatttctgcccgcaccgtggcgcgccgctgtcgctgggcttcgtcgaggacggcgtgctggtctgcggctaccacggcctggcaatgggcgaggacggtcgcacccgcgcgatgcccggccagcgggtccgcggcttcccctgcatccgtcgcttcccggtgcaggaacggcacggcttcgtctgggtctggccgggcgcggaagaacaggccgacgccgcgctgataccccgcctggaatgggcggaaagccccgattgggcctatggcggcgggctgtaccacatccactgcgactatcgcctgatgatcgataacctgatggacctgacccacgagacctatgtccatgcgtccagcatcggccagaaggaaatcgacgaggccgcgccgaccacgcgggtggaaggcgacgaggtgatcaccagccgccacatgcagaatgtcatggccccgccgttctggcgcatggctctgcgcggcaacggcctggccgacgacgtggcggtggaccgctggcagatctgccgcttcacgccgcccagccacgtgctgatcgaggtcggcgtggcccacgccggccacggcggctaccaggcgccggcggagcgcaaggcggcgagcatcgtggtcgacttcatcaccccggagagcgccacttccatctggtacttctggggcatggcgcgcaacttccaggcccacgaccaggcgctcaccgagagcattcgcgaaggccagggaaagatcttcggcgaagacctggaaatgctcgaaagccagcagcgcaacctgctgcgccatccacggcgcgacctgctgaaactgaacatcgacgccggcggcgtgcaggcccggcgtatcatcgagcgcctgctggcggacgagcgccaggccgccgcccccaaccgcgcccaggcctga

SEQ ID NO: 10530 - DNA, 723 bp, Pseudomonas aeruginosa
tcgaggtcatcgtcggcgccatccgcctggaggcgcaggatatccacagcttcgaactgttccgggccgacggggcggccctgccgtccttcgagccgggcgcacacatcgacctgcacctgcccaacggcctggtccgccagtactccctctgcggccccgccgaacggccgcgccactaccgtatcgccgtactccgctgccgcgattcgcgcggcggctcggccacgctgcacgccgaactgcgggtcggccagcggctgcacatcggcgagccgcgcaatctcttcccgctgtcgccggagcccggtccgcgcctgctgttcgccggcggcatcggcatcacgccgctgctggcgatggccgaacgcctggcccgcgatggcgccgacttccagttgcactactgcgcgcattccgccgagcgcgcggccttcgtcgactaccttggccggtgcgccttcgccgaccgcgtgcactgccacttcgaccacggcgaaagcagccggcgcgcggaccttcgcgccctgctggcgaccagtccgcgcgacgcccagctatacctttgcgggccggcgggcttcatgcagtggatcgaagaaagcgcccgcgaactgggctgggaagcaagccgcttgcatcgcgagcacttcgccgccgcgccacgagacgccagtgcggacggcaccttcgaagtgcagttggcgagcaacggggcgctga

SEQ ID NO: 10531 - DNA, 567 bp, Pseudomonas aeruginosa
cgcgcctggtcgccgccgaagcggaccagggagaaatcgctctcgcacaaccccggctcgaggttggtcacgcgcaccccgggtgccctgcaggtcgccacgcaggttcagggagaattgctcgacgaaagccttggtgccgccgtagacatggctacccggatagggccacttgccggccaccgaacccaggttgacgatgctcgccccggcgccgtgggcgatcagccgcggcagcagcaggcgcgtgctgtagagcaggcccttgaagttggtgtcgaccatggtgtcccagtcgtccaggtcgcaggactgcgccgggtcggagcccagcgccaggccggcgttgttgatcaggccgcgcagggtggcgaactcttccggcaggttgtccacggccgcgctcatcgccgcgcggtcgcgcacgtccagggtcagcggcaacacccgggtcttcgccgaaagctcaccggccagggcttgcagacgctcctcgcgacggccggtgagcaccagcgaccagccggcctcggcgaaacgacgggcgcaggcttcgccgaagcctga

SEQ ID NO: 10532 - DNA, 312 bp, Pseudomonas aeruginosa
gctttcggcgaagacccgggtgttgccgctgaccctggacgtgcgcgaccgcgcggcgatgagcgcggccgtggacaacctgccggaagagttcgccaccctgcgcggcctgatcaacaacgccggcctggcgctgggctccgacccggcgcagtcctgcgacctggacgactgggacaccatggtcgacaccaacttcaagggcctgctctacagcacgcgcctgctgctgccgcggctgatcgcccacggcgccggggcgagcatcgtcaacctgggttcggtggccggcaagtggccctatccgggtag

SEQ ID NO: 10533 - DNA, 417 bp, Pseudomonas aeruginosa
aggtcgcgatgctccggctcgccgtccagcacgcgggtcaggcaggtgccgcagatgccctgctcgcaggaggccggcaggtccaccccggcttcgcgcagggccgccagcacggtctgcccggcggcgacccggatcagcgccccgttgctcgccaactgcacttcgaaggtgccgtccgcactggcgtctcgtggcgcggcggcgaagtgctcgcgatgcaagcggcttgcttcccagcccagttcgcgggcgctttcttcgatccactgcatgaagcccgccggcccgcaaaggtatagctgggcgtcgcgcggactggtcgccagcagggcgcgaaggtccgcgcgccggctgctttcgccgtggtcgaagtggcagtgcacgcggtcggcgaaggcgcaccggccaaggtag

SEQ ID NO: 10534 - DNA, 678 bp, Pseudomonas aeruginosa
tcacctcgtcgccttccacccgcgtggtcggcgcggcctcgtcgatttccttctggccgatgctggacgcatggacataggtctcgtgggtcaggtccatcaggttatcgatcatcaggcgatagtcgcagtggatgtggtacagcccgccgccataggcccaatcggggctttccgcccattccaggcggggtatcagcgcggcgtcggcctgttcttccgcgcccggccagacccagacgaagccgtgccgttcctgcaccgggaagcgacggatgcaggggaagccgcggacccgctggccgggcatcgcgcgggtgcgaccgtcctcgcccattgccaggccgtggtagccgcagaccagcacgccgtcctcgacgaagcccagcgacagcggcgcgccacggtgcgggcagaaatcctcgagggccgccacgcggccgtcctcgcctcggtagaaaaccatcggctcgtcgcagatgcgtcggccgagcggcttgccggccagttcgtcgggggtgcaggccacgtaccaggcgttcttcggaaacatcgtcggatcctctcgttgtttttgtaattggatccaatgattcgcgaggcaacttttccaagtcaaccgcttctgtacaaaaaataatctgttcgatagtcgcacataaaaaacttcaggaataa

SEQ ID NO: 10535 - DNA, 1320 bp, Pseudomonas aeruginosa
ccgtactcactggctgatcctcggctgggggtgtttcatcatgctgttcgacggctacgacatggtcatctatggctcagtggtgccacgcctgatgcaggagtggcagctgagcccggtgcaggccggcaccctcggcagttgcgcgctgttcggcatgctcttcggcggcaccctgctggcgccgctggcggaccgtttcggccggcgccgcctggtgatcgccaccaccctgctggcgagcctcgccgccttcctcaccgggcacgcccgcgacccgctggaactgggcgccggacgcttcttcaccggcctggcactgggcgcgctggtgcccatcgcgatcaacctgatcagcgaattcgccccggccgggcggcgcagcaccctggtcacggtgatgtcggccttctactcggtgggcgcggtgctctcggcgctactggcgatcgccatgatccccgcctggggctggcaatcggtgttctacgtggcggtgctgccggtgctggcggtgccgctgatgttgcgctggttgccggagtcggcggcgttcctcgaactcaagggccgccgcgccgaactggacgcgctgctgcgcaaggtcgatcccgactaccggcccggcgccgagcgggcgaacgctgtcgcggccgaagcgccgagcggacgggtcgcccagttgttcgaggggcgccaggcagtgggcaccctgctgctgtgggtggccttcgccatgtgcatgctgatgagctacgggctcaacacttggttgccgaaactgatggccggcggcggctacgctctcggttcgagcctggcgttcctcgtcaccctgaatgtcggggcgaccctcggtgcgttgttcggcggctggctggccgaccgccttggcgccggccgcaccctggtgctgttcttcgccctggccgcggcctccctcgcggccctcggcctggggccaggcccctggctgctcaacggcctgctggtggtggccggcgccaccaccatcggcaccctggcggtgatccatgcctacgccgcgcagttctatccggcctgggtgcgctccaccggggtcggctgggccgccggcgtcggccgcctcggcgccatcgccgggccgatgctcggcggcagcctgctggccctggagctgccgttccagcagaacttcctggccttcgccgcgcccggcgtgatcggcgcgctggcgatcgcctgcatccacctgcggccgcgcgtgccggcggaagcgtccgtcgacgcgacggcgaagaaacccctgtgattttcgaaagaggagaagagcgatga

SEQ ID NO: 10536 - DNA, 480 bp, Pseudomonas aeruginosa
atgccgcggtgttcggcaagttcctccaccaggggcagatctgcatggcgatcaactgcatcatcgtcgaggacagcctctacgacgctttcgccgcgcgcttcgtcgagcgggtcaagggcctccgggtcggcgatccgcagcgcgccgataccgcggtcgggccgatcgtcaacgcgcgccagctcgaaggcctgctggaaaagatccgcctggcccgccaggaaggcgccaagccgctgtacgagggcggcgtcgatgggcagttgctggctccgcacgtattcggcgaggtcaccgcgacgatggagatcgcccgcgatgaaatcttcggcccgctggtcggcctgctccgcgcgcgcgacgaggcgcatgcgctggagttggccaacgccagcgaatacgggctgtccagcgcggtgttcagccgcgacctggaacgcgcggtgcgctttgcccgccagcttcgcgcggggatga

SEQ ID NO: 10537 - DNA, 756 bp, Pseudomonas aeruginosa
cggtcgcgcggcggacaactatgggcgtgtcggcgtggccgccaagctgcgcgtttcggccagcgaactgaagatcggcgagatgctcccggacattccgctgttgcgctacgacgacggacgcctgctgccgcagacgttccgcggcttcgccgtggtttcccgcgagctgccgggcctggctctgcaggccggacgcttcgacgcggtgagcctgcgcaattcggcggacatgcaggacctgtcggcctggagcgcgccgacgcagaaatcggacggtttcaactacgccggcgccgagtaccgcttcaaccgcgagcgcacccaactgggcctgtggcacgggcaactggaggacgtctaccggcagagctacgccaacctgctgcacaagcagcgtgtcggcgactggaccctgggcgccaacctcggcctgttcgtcgaccgcgacgacggcgccgcgcgcgccggagagatcgacagccataccgtctacggcctgttttccgccggcatcggcctgcacaccttctaccttggcctgcagaaggtcggcggcgacagcggctggcaatcggtctacggcagcagtgggcggagcatgggcaacgacatgttcaacggcaacttcaccaacgccgacgaacgctcctggcaggtgcgctacgactacgatttcgtcggcctcggctggcccggcctgatcggcatggtccgctacggccatggctcgaacgccaccaccaaggccggtag

SEQ ID NO: 10538 - DNA, 570 bp, Pseudomonas aeruginosa
atccagctgactattccgatgaatgcgcctccgatgaatgcgccaagcccctgcctgcaagcggaccgcgactgcgtcgccacgctctaccgtgaaaaccatgcctggttgcgcaactggctggcctaccgccttcgctcctggggacgtggcgtggccgacgacctggcccacgacactttcctgcgcatcctcgccagccgcgatggcggccagcgtgacgcgatccgtcagccgcgcgcctacctcacccgcatcgccaactgcgtgctggtcagctggcgccgtcgccaatcgctggaactcgcctggctggaggccctggccacgttgcccgagccgttgcagccgtcgccggaacaacagagtgtgatcgtcgagaccctgcacgagatcgacgcgctgctcgacaccctgcgcccgcgggtgaaacaggcattcctgatggcgacgctggacggcatgaagcagaaggacatcgcccaggcgctgggcgtcgcgctgccgacggtgaagaagttcatccaccaggcctacgtgacctgcctgagcctgatgcccgatgaatga

SEQ ID NO: 10539 - DNA, 1341 bp, Pseudomonas aeruginosa
ccgcgcttcccgccgggcgccgcaggcgggcgatacggagctttccgggccgccggccgccgaggcgatcgccccgcaggtgctcagggagaccgcctcctggctgctgctgatgcaggaggggccgctggctccggcgcagcaggccgagctggagtcctggcgctcgcgcagccccgagcaccagcgcgcctggcggcgcgccgagcgtctgctggcgaatatcggttcgctgccgccggcgctggcccggcgtgcgctcgagcgtccgtccggcagcggccggcgcgcggtcctgcgcggcctcgccctgctgctcggcggcgcaccgctggtctggtggggatgtcgcgcgcaggtctggcgcgacggcttcggcgccgactacctcactgccgtcggcgagcggcgcgacctggtgctggaggacggcagccaggtcgagatgaacaccgacagcgcgctggacgtgcgctacgatgccggccagcgcctgctgcgcctgtatcgcggagagatctacctccgcaccgcggcggatcggcgagagccgccgcggccgttcctggtgcgcaccgaacagggcctgatgcgcgcgctgggtaccgccttcagcgtccgacgcgagggcgcagagacagtgctggcggtgtacgaaggcgcggtccaggtgcgtccggagggcgccgcgagcgcggcggatggccgggtgatcgaagctggccagcgggtgcgcttcgatcgccagcggatcggccccgtcgagtccgccagcgaggccgcgctggcctggcgccagggcctgctggtggccgacgacatgccgctgcggcagtgggcgggagaactgatgcgctacggcggcgagagcatcgagtgcgagccgtcgctggacgcgcttcgtgtctccggcacctttcccgtcgacgacctgccgctggccctggcgatgctggcacagacccatggcctgcgcctcgtgcaccaaggccgacgggtgctgatcaggcgctgagggaggcgcggcggctcagccggccagcaaccagaccccggcgcccgccgaggccagcccggcgagacgtaccaggggcgcggccgcctgcgccaggaagcgcaccagcgggtagccggcggcgtgcagcgcggcggtggcggcgacgaaaccgagcgcgtacagccaggggctggagaggtccggcagctccaggccgtgggcgaccccgtgggccagggcgaacagcgcggtggcggccatcgccagcggcagcggcgggcgcacggcgagggccacgcagaggccgagggcgagcaccgaggcggcgatgccggtatccatga

SEQ ID NO: 10540 - DNA, 2040 bp, Pseudomonas aeruginosa
gcggatgggcgaggccggcgaccaggccgtgttcgccgtggccggggtgggcgaaggccagcgccggagcggcgagcagggcgagggcggcgagcagcttgggcagtttcattggtggttccttgtcgttgcgaagtggcgtcaggcggcggtcagcaggccctggcgctcgatgaaggcgatgatttcgtccagcccctggccggtcttctggttgctgaacacgaacggcttgtcgccgcgcatgcgccgggcgtcccggtccatcacatcgagggaggcgccgaccagcggcgccaggtcgatcttgttgatcaccagcaggtccgacttgcagatgccggggccgcccttgcgcgggatcttgtcgccggcggaaacgtcgatcacgtagagggtcaggtcggacagctcggggctgaaggtggccgacaggttgtcgccgccggattccaccaggatcagttcgaggccggggaagcgccggttgagctggtccaccgcctccaggttgatcgaggcgtcctcgcggatcgccgtgtgcgggcagccgccggtttccacgccgatgatccgctcgggggcgagggcctcgttgcgcaccaggaactccgcgtcttcctgggtatagatgtcgttggtgaccaccgcgaggttgtagcgctcgcgcagttcgcgacacagggccagggtcagggcggtcttgccggagcccaccggaccgccgatgccgacacgcaggggttgggatgtcatggggtttctcctaggaacggaacagacggctgtactgggtttcgtgggtcatgctggccagcgccagaccgaacgcggcgctgccctcgacggcgggccgccgcagcgcctcggcgcaggcgcggtcgagttccggcagtaggctggaagcaagtttctgcgcggccagttggccgagcggcagggttttcatcagcaccgccaactggttttccagccagctccagaaccaggcactcagcgcctcctcggcgtccaggcgccaggcgcgcgcggccatcgcccaggcggcggcgagattgggcgggtcctggcgcgccagccaggcgcggccgggagcgtcgagctcgggcagggcttccagcaattggtgcagggaaaagcccatctgccggctctcctgggccagctcgcgggtctcgcggctggccctatggcgttcgctggccgcatcgcaggcggcccagtcgccgatcagcgcggcgcgcagcaggccggccagcagcggcgcctcgaagcgcgccaggttcagttgcagctggtcgaccagccaggtccgcgcgctctcggcgtcgcgcacccagccattgtcgagggccgcctccaggccctgggaatagctgtatccgccgatcggcaactgcgagctggccaggcgcaggcgcgcccagatgctgttcaccggcgcacgccgaactggtgcaggcgcggcgcgtagttgaactccgcctcgccatggtgcgagtggtggtggcctccgccgtaggcaccgtgctccggctggaacggcgcctcgatggcctccaccgtggcgccgagctgttcgagcatggctttcagcacgtagtcgtcgagcaggcgcagccagccgtcgccgacctgcagggcgacgtgacggttgcccaggtggtaggcggctcgggtcagttccagcgggctggcgcaggtgacgtggagcagacgttcggagcgggcgacgacccgcaccaggcgaccgtcgcgggcctccaggcagtcgccgtcggccagcggaggctggccgcgctcgaggaacaggccgacctcctcgccgctcgccgcgaagcagcgcaggcggctcttgctgcgcgcctcgtaggtcaggtggagttcttcgtcccagcggggcgagcgggcgggcaggcgttggtggatgaccagcatgggcagtttccgcaatgcgacaggaaagggatcacaacaagcaccagcaagggccttgccaggtcgatgcgggacgcctgtaccgggaaaacggggccatag

SEQ ID NO: 10541 - DNA, 1158 bp, Pseudomonas aeruginosa
ctcgattgcgcggaacgggcaaagttttgtgaacgatcgttcactgaaatattttccatggacttgcttcccctcgcgctcctgacccctttgctcgcacccctgcgccgtctcgccgcccgtggctggctgcgtgaggccgatgtcgacggcctgctgcgccacgcccatccgctggcgtcgttgaaccgccactatgcgcgggtcgaggcacgctactgggtggccgacgatatgctcgccctggccctgcgtaccgcccccggctggccgccggcgcggccgggccagcacatccaactgctggcggagcgcgacggggtgcgggtcgggcgcagctacagcctgacccgggtggtcggcgagcgcctggaaatcgccgtcaagcgtcacccggacgggctgctctcgccctggttgtgcgaacacctggcggtcggccagcgtgtcgagttgcaacccgcgcaaggcgatctgcgctggccgatgcaggccgaggcggtctgcctgctggccgccggcagcggcctgacgcccttgctcggcctgctccgcgaggcgctggagaacggctatcgcggtcccgtgctgtggctgcactacgtccgtcatcccggccagcgcgcctggctcggcgagctggaggcgctggcggcgcgccacccgaacctggagttgcgctggagcctgacccgcggggcgcgggccgatggctgcctggaggggcatttccagccgcgccacctggacggctgggcagccgacctggcgcgcagccaggccctggcctgcgggccggcggctttcgtcgaggcggtgggcgagcaactgggggcacgcttcgccggcttgcagacggaatccttcagcgtcccgcgctggcgcagcggggaggcgccgcgcgaagtgcgcctgcgcttcgcccggtcgcagcgggaagtctccggcgacagcgccgtcagcctgctggaacaggccgaggcccacggcctgcgcccggcccacggttgccgccagggcatctgcgccagttgcacctgcgtcctgctcagcggctgcgtgcgcgacctgcgcagcggcgcgctgtgcagcgagcccggccagcctatccgcctctgcgtcagcgccgcccacggcgacctggcgctggacctgtga

SEQ ID NO: 10542 - DNA, 252 bp, Pseudomonas aeruginosa
cgctgcaggcgctgctgttccagtacgcggtggcgatccagcatctgcgcctggacaagtacgccaaggggcgcctggacaaggccgaactcatgccgctgctacgccgcctgcgtgccaagctgggtcgccagtggaccaaggactacctgctgttcccgcttctcggcctgttcgccggcggcttcggcgcggtgttcgtcggtaacctgctggccaacgtgctgcgcaacctgtggaccttcacggtga

SEQ ID NO: 10543 - DNA, 792 bp, Pseudomonas aeruginosa
ccaccagcgccgccaccgcggcgaacagcagcgccgcgtagagggtcagggagcggcgggcgggcacgggcgctcctcgcagacgtaaccgatgccgcgcacggtatggatcagcttgttcgggaagggattgtcgaccttggcgcgcaggcgcttgatcgccacgtcgacgacgttggtgtcgctgtcgaagttcatgtcccagacctccgaggcgatcagggtgcgcgacagcacctcgccctcgcggcgcatcagcaggtgcaggagggcgaactccttgttggtcagggcgattacctgcccctggcggctgaccttgcgccgcagcacgtccagctgcagatcggccagttgcacctgctctgcctcgcggaccacgccgcggcgcagcagggtacggatacgcagcagcaactcggtgaaggagaagggtttcaccaggtagtcgtcagcacccagttcgaggccgcggatacggtcttgcagctggtcgcgggcggtgaggaagagcaccggcacatcgtgcttcttgcgcagcacttccatgatctgccaaccgtccaggccgggcagcatcacgtcgaggaccaccaggtcgtagcggttctccagcgccaggtagagaccgtcggcgccgtgctgcgaccagtcgaccgcatagcccgactcgccgaggcccttcttcaggtactcgccggtcttcgtatcgtcttcgatcaccaggatgcgcatgtctcgttccccctcgttcgccgccattctagccagcgcgcggcgcggactcggtga

SEQ ID NO: 10544 - DNA, 1050 bp, Pseudomonas aeruginosa
gccgggccgctacaacgcggtgcagcgcctgctgtactggctggtcctggcgctcggcgcgctgctggtgctgtccgggctggcgatctggaaaccggtgcaactgcacgggctgaccgcgctgttcggtggcttccagggggcgcgctgggtgcatttcctggccatggccggggtcgtcgggttcgtcgtcgtgcacctgctgctggtgctgttggtgccgcgcaccctgctgccgatgatcatcggacgcgagtggcggcgcggacggaggagcgaaggatgaaggggccggagaagaagcgcgcgaagatcgcggtcgacccgtccagcgagcggcagatggtcgatttgcaacgccgcctgctgttgcgcggcggcctgtccctgggcgccctggcgatgctctcggggtgccggctacaggatggcgattcggtcgacaaggtactctgggccatgtcgcgctggaacgaccgggtccaggcctggctgttcagccgtacgcggctggcgccgaccttcgatccgtcgcaggtggcctcgccgttccccttcaacgcgttctacccggcctacaacgtgccggagatcgacctgccggaataccgcctgcaggtttccgggcgggtccgcgacaagcgcccctggagcctggagcaactgcgccggctgccgcaggccagccaggtcacgcaactgatctgcatcgagggctggagcgcgatcggccagtggagcggagtgccgctgcgcacctttctggagctggtcggcgccgacacctcggcgaagtacgttggcttcaagtgcgccgaccgctactactccagcctcgacatgcccagcgcgctgcatccgcagacgctgctggcgctggagatgtccggacaggcgctgccggaggagaacggctatccgctgcgcctgcggattcccaccaagctcggcttcaagaacgccaagcacgtggtggagatcttcgtcagcaacagcaatcccggaggttactgggaggaccagggttacaactggttcagcggagtctga

SEQ ID NO: 10545 - DNA, 1023 bp, Pseudomonas aeruginosa
ccgcctcggagctgtcgaagaagtacaccttccccgaggaataccaggcctgggcccgcgactacatggaagtcaaagagtaggcgatttcaggctaggcccatgttgcgctgccgcgcctgcaggtcggcgacgcccgccaatgcgcagaaggtcgcagggcgacagtctggctcaggatcgcccggagcgctcgcgtcgcttgcgttcgcggtaggcggcctggttggccaggcgccgctgcgccgaaccggggcggttggccgactgggcgcggtacaggcgctgggcgtagaccagttccatgtagcgttgcatcgcccggctgttgaacagcagccaggcacaggcgccgccgccgagcgccaccaggcccgacgtctcgccgctggccaggcgcagcaggagcccggtggcgaccagcagcagactggcgtcgcgggccaggcgcgggccgaggctggcgccacgggagagcagggcgatcagccacagccaggccgccagcagcggcagggcggagagccagcccagcggccgcaaaggagcctccggcaatgccaggcgcagcgcggcaagacccagcggcgcggcaccgagcagcagcgccaggctgccgagcagcggtgcgtagagaccgggatgacggcgcggatacaggccgtgcagttgccggacgctatagcggtcctccggcgccggcagggcgaacggatcgccggcgagcgcggcgtcgagctggcggccctggtcgatcaggtgggcgaggcggcggaacggtcccatcatgcggtgtacctccaggcttggctggcgattgtgccacgccaggccgatggtcgcgccgcccttgcaaagccgcgggcgaacgcccatatctggaggttccagggtttcagccagaggagtcagtcatggccagcgggtgggcgaacgacggtgcggtgcaggaacagatcgacagcacgatcgaggatgccatcgctcgtgcgcgcagccagttgcctcgtggcgagagcctga

SEQ ID NO: 10546 - DNA, 1653 bp, Pseudomonas aeruginosa
gtagccgttgtggatcaggtcggtcttctgcacaccgcgacagccgctgaccacgccgatggccttgcgcaggccgagctgctgcggtacgccggcggcgaaggcggcctggctgacgaaggtcaggctggtcgcgtgacggctgccggcgtagctggcgaacatcggtcggtagtgcaccggctgcggcgtggggatcgagccgttgatgtcgcccatcaggctggcggcgatggccccgcccttgaggatcaggctcggcttgacgccgaagaaggccgggcgccagagcaccaggtcggcccacttgccggcttcgacggagcccacttcatggctgatgccgtgggtgatcgccgggttgatggtgtacttggcgatgtagcgcctggcgcggaagttgtcgttgcgcgcaccgtcgccgtcgaggcggccgcgctggcccttcatcttgtcggcggtctgccaggtgcgcgtgatcacttcgccgacccggcccatggcctggctgtcggagctgatcatgctgaacgcgccgaggtcgtggaggatgtcctcggcggcgatggtctcgcggcggatgcgcgactcggcgaaggccacgtcctcggcgatggccgggtcgaggtggtggcagaccatcagcatgtccaggtgctcgtcgatggtattgcgggtgaacggccgtgtcgggttggtcgagctgggcagcacgttggcgaagccgcaggccttgatgatgtccggtgcgtggccgccgccggcgccctcggtgtggtaggtgtggatggtgcggcccttgaaggcgccgagggtggtctcgacgaagccggactcgttgagggtgtcggtgtggatcgccacctggatgtcgtggcgctcggcgacctccaggcagttgtcgatcgccgccggggtgctgccccagtcctcgtgcagcttcaggccgatggcgccggcgagcacctgctcctccagcggcagcggcaggctggcgttgcccttgccggtgaagccgatgttcatcgggaaggcgtcggcggcctggagcatccgcgccatgtgccagggaccggaggtgcaggtggtggcgttggtcccggcggcggggccggtgccgccgccgatcatggtggtgaccccgctcatcagcgcctcttcgatctgctgcgggcagatgaagtggatgtgcgtgtcgatgccgccggcggtgaggatcatgccctcgccggcgatcacctcggtgccggcgccgatggcgatgttcaccccgggctggatgtcagggttgccggccttgccgatggcctggatgcgcccgtccttgagaccgacgtcggccttgaccacgccccagtggtcgaggatcagcgcattggtgatcaccgtgtcgaccacctgcgccgcgcccagctgactctggcccatgccgtcgcggatgaccttgccgccgccgaacttcacttcctcgccatagacggtgaagtcccgttccacctcgatccacaggtcggtgtcggccaggcgcacgcggtcgccgacggtggggccgaacatgtcggcgtacgcttgtctgctgattttcatctaacgctcctttggcgatcgtcggtgttcgctgtctttggtcgaacctggccagtggggccctag

SEQ ID NO: 10547 - DNA, 813 bp, Pseudomonas aeruginosa
cgtgcaggccctgggcccgcgcacgttcgatcagcgcctgcagcagttgcacgccgaggcctttgccgcgctggtcgtcgcgcacgtagacggagtgctcgacggtgccgcggaagccctcgaagggtcgccagtcgccgtaggaggcgtagccgagcacttcgccggcggcgtcgctcgccaccaggatcgggtggccctggcgggcgcgggtgtcgaaccaggcctggcggttggccaggtccaccggggtttcgttccagatcgccgtggtattgcccacggcgtcgttgtagatggcgaggatgccgggcaggtcggcgacgccggcgtcgcggatcgaagcgctcatggccggcctcaggcgatgggctggtggacggtcaccagcttggtgccgtcggcgaaggtggcctccacctggatgtccgggatcatctccggcacgccctccatcacctgctcgcggttcagcagggtggtgccgtagtgcatcagctcggcgacgctgcggccgtcgcgcgcgccctccagcagggcggcggagatcagcgccaccgcctccgggtagttcagcttgagaccgcgtgccagccggcgctcggcgagcaggccggcggtgaagatcagcagcttgtctttctcgcggggggacaagtccatctcaggtactccagatgcgtgggggaacggcctcgcggccgagcagcgccggccgcagcaggcgccagagttcgatcagccaggctcgcgcgtgcagcgcctcgtcggccaggcagcgcgccaccagcaggccgccgggcaactggctga

SEQ ID NO: 10548 - DNA, 1521 bp, Pseudomonas aeruginosa
gctgggcccaggcgcgttcgccgaggcgcacgtcgaaggccaggctgtcgccgccggcgatgccgccgggcggatgcacgaggatgtgctggcagacttccgggccttcggcgtagaggtgcttctgcacccgcagcggtccggagtggcgccgcgtcaccgggcgggtggcgtcgccggcgcgggcgtaggccagctccagttgggcgtgccaggcggggtggaagctcaggtcggggagggcggcggtcatcggtcgggtcaggccagggccttgcgcatgaacacgcggcggaatccctcttcctggcggcgttcgtattcgaggtagccgaccctggcgtagagctcgatgttttccgtcatccgctcattggtgtagaggtacagcgagcggtagccgaggctcgttgcgtcgcgctcggcacgctccagcagttgtcggccgatgccctggcccttgcattcgggaagcacggcgaggttgtcgacgaggaagccgtcggcggtttcccgcgtcaccagcaggccgaccggctggccgtcgtgctcggcgatgaggacccggtcgctggcgatcacctcgtggtagtcctgggtcatcggccagggcttgcggccgatcaccgcgatccacggggcataggcggcggcgacgcagagcgcggcgaagcccgcgtcggcctggacggccgggcgcagagtgacggtcatttcgacctcctgcggaaagacgagggcatagagattgccagcgcagggccccggttgcgccagcggcagtgtgtcccagtccgttcaaatcgccaccagcccgcgcacgccctcgctctccatgtcgcggccgcggccctgctggacgatctcgccgcgcgccatcaccaggtattggtcggccagttcggcggcgaagtcgtagaactgctcgaccagcaggatcgccatgtcgccgcgcgccgccaggctgcggacgaccgtgccgatctccttgatcaccgaaggctggatgccttccgtgggttcgtcgaggatcagcagtcgcggctggctggccagggcgcggccgatcgccagttgctgctgctggccgccggagaggtcgccgccgcggcgctgtttcatttcgcgcaggaccgggaacagctcgtagatgaagtccggcaccgcccgggcgtccctggcgctgaaacgggacagtcccatcagcaggttctcttccaccgtcagccgggggaagatttcccgtccctgcggcacgtaggcgatcccggcgcggacccgctggtgcggcctgagtccggtgagcgaacggccttcccaggcgacctggccctcgcgggccgggaccaggcccatcaggcagcgcagcagggtggtcttgcccaccccgttgcgaccgagcaggcaggtcacctcgcccaccttcgcctcgaagctcaggccacggaggatatggctaccgccgtagtactggtggagcttgtcgacttgcagcatggttctcttccatttgtcccgtga

SEQ ID NO: 10549 - DNA, 402 bp, Pseudomonas aeruginosa
attcggtctcggcatcggtcatgcccgccaccggctcgtcgagcagcagcaactgcggttcctgcaccagcagcatgccgatctcgaggaactgcttctggccgtgggacagcaaacccgccggacgctgccgcgactccagcaggcggatggtggcgagcacctcctcgatgcgttccctctgcgtgccgtcgagccgcgcgcgcaggctggcccacaccgacttgtcggccctctgcgccagttcgaggttctcgaacacgctcagggcctcgaacaccgtgggcttctggaacttgcggccgatcccggcctgggcgatctgcacctcgctcatgcgggtcaggtcgagggtgtcgccgaaatacgcggtaccgctctgcgggcgggtcttgccggtga

SEQ ID NO: 10550 - DNA, 1422 bp, Pseudomonas aeruginosa
ggatggtgccgtggcgcgcgtccagccggccgctggtggcggcgcccaggccgatggcgtcgcggccgctgccggcggtatcgaggccggggtggaaggccggttcgagcatcaggtgcggggtggtcctcattgctccttctccttgcgcagcaggccgagcaggccgcgcggcaggtacagggtgacgacgatgaacagcgcgccgaggaagaacagccagtattccgggaaggccacggtgaaccagctattcgcgccgttcaccacgccggcgccgagcagcgggccgagcagggtgccgcgtccgccgagggcgacccagacggcggcctcgatggagttggtcggcgacatctcgctggggttgatgatccccacctgcggcacgaacagcgcgccggcgaggccgcagagcaccgcgctcagggtccagacgaagagcttgtagccgcgcgggtcgtagccgcagaacatcaggcggttctcggcgtcgcgcagcgcggtgaggacccggccgaacttgcttcgcgccaggcgccagccgagcagcaggctggccgcgagcagcgcgacggtggcgaggaacagggcggcgcgggtgcccggcgcggtgatcgggaagccgaggatgctgcggaagtcggtgaagccgttgttgcctccgaaaccggtctcgttgcggaagaacagcagcatgccggcgaaggtcagggcctgggtcatgatcgagaagtacacgccgcggatccgcgagcggaaggcgaagtagccgaaggcgaaggccagcgcgccgggcaccagcaccaccaggcacagcgcccagaggaagtgctgggtgccggcccagtaccagggcagttcgttccaggaaaggaaggtcatgaacgccggcaggctgtcgccggaggcctggcgcatcaggtacatgcccatggcgtagccgccgagggcgaagaacagcccgtggccgagggacagcaggccggcgtagccccagaccaggtcgagggcgagggcgacgatggcgtagcagaggatcttgccggtcagggtcaggctgtaggccgagaggtgcagcgcgctgtccgccggcagcaggtgcagcagcggcatggccagcagcgtggcgaaggctgcgccgagcgcgatagcggtgacgcggccgccggcccggcgggcgagggtgacggtgagtggctggttcaatcgatgaccctccctttcagggcgaacagtccctgcgggcgtttctggatgaacaggacgatcagcgcgaggatcaggatcttgcccagcaccgcgccgatctgcggttcgaggatcttgttcgccacgccgaggccgaaggcggcgaggacgctgccggcgagctggccgacgccgccgagcaccaccaccaggaaggagtcgatgatgtag

SEQ ID NO: 10551 - DNA, 471 bp, Pseudomonas aeruginosa
ccctggccgaggtccgggccgacgttgccgacctgcgacagggctaccccgccgagccccggcgatgcccgagccgagaccgaaggcgagcatgtccacgcgccctgtgggcaccccgcagcaggccgccatgttgcggttctgggtcaccgcgcggacgttcaggccgagccgcgtgcggttcagcagcagccaggtgaggagcagcacgaacagggcgaagccgatgatgacgatgcggttccacggcagcaccaggttcggcagcacctggatgccgccggacagccaggccgggttggctacctcgacgttctgcgcgccgaacagcatccgcaccagttggatcagcaccaggctgatgccccaggtggcgagcagggtttccagcggccggccgtagagatggcggatcaccgtgcgctccagggccatgccgatggcggcgctgacgcagaacgccaccggtag

SEQ ID NO: 10552 - DNA, 897 bp, Pseudomonas aeruginosa
aacagcaatccgttgagttcctcgaacaccggcaacaccgatttgcgcgacaccgaggtccagcaaccgaagaccaccgcgaccttgtcctgggtcagcaactggcgggccttttccgcgaacagcggccagttcgacgcgggatcgaccaccaccgcctccagcttcctgccgttgaccccgcccttggcgttgatctcgtcgatggtcatcagggccatgtccttcagcgaggtctcggagatcgccatggtcccggacagcgagtggaggatgccgaccttgatggtttcggcggcctggatggaccaggacaggcccatggaagcgatggacgcggacagcgtgaaggccttgagcagactgcgacgtttcattggtgttgttctccattcaccagcggtcggggcggcagttttcaggaggcgtcgtgcttgtcgtcgggcatccgtccggtggacggcggggtgcgcactgcggcctggatctcttcgtcgaggctccagagcaaaggctgtgcctcttcttggcgctggccggtatcggtcggcgaaaaggcgccgcgagtcgccggggaagcatgccgagcaggtctggctatgccggggaaggctgcgttttcaacgggttttcgccggatatcgacggagaaggcgccgtgggctccggaaggggaggcgtcgcgctgacctccctccttgccgccggcggcgcgtccatgggtacgccgtcgctccgtcctggcaccaccgcggtgcgtcagggcgcggcatccagggcgtccgcctcaggctggtgcgctcagcctgggaacagcgaacccttcaggccggtgacgatgatctgcgccgccagtgcgcagacgaacaggcccatcaggcgactgacgatctgtag

SEQ ID NO: 10553 - DNA, 495 bp, Pseudomonas aeruginosa
gtcccggcagccagaacgccaccagccccaggttcgccgcggcgcagaccgccagcgccgcgtgcaccgccgccagccacaggctgctggcgctgcgcgagtaggcgaagcggatcaggttgtacatcagcagcaggagcatgccgccgagcagcatgccgaaggcgtaggcgggcttctccaggccgaccaggccggcttcgtcgatctggtcgaaccaggccatcagcggatggttggaggtcatccgcacgtacagggtcatcggcttgccgtcgaccggcagcgagaacaggtaggagcgcgagggcagcgggcgctcctggaacggtcgcgactcgccggtgtgctggtcccgcaccagttggccgtcctgcaccaggtagtagtccaggtactgcacccgcggggcgaagatccacagccagctcggcaccttctgcgcgggaagctggacctgcagccagaccgcctgggggctggcggggaagatga

SEQ ID NO: 10554 - DNA, 999 bp, Pseudomonas aeruginosa
tactcaatggcggaaatggcgcatgccagtgaacaccatcgcgatatccgcctcgtcggccgccgcgatcacttcgttgtcgcgcatcgagccgcccggctggatcaccgcggtgatgccggccttggccgcgttgtcgatgccgtcgcggaacgggaagaaggcgtcggaagccatcaccgcgcctttcacttccaggccggcgtgctcggccttgatcgcggcgatccgtgcggagttgacccggctcatctggccggcgccgacgccgacggtctggcggttcctggcgtagacgatggcgttggacttgacgaacttggccaccttccaggcgaagatcaggtcgtggatctcctgctcggtgggcgcgcggcgagtgacgatcttcaggtcctcggccttgatcatgccgatgtcgcggctctgtaccagcaggccgccgttgacccgcttgaagtcccagcccggggcgcgctcggctggccattcgccgcattcgagcaggcgtacgttggccttggcggcgaccacctcgcgggcggcggcggaaatcttcggcgcgatgatcacctcgacgaactggcgctcgacgatggccttggcggtttcgccgtccagctcgcggttgaaggcgatgatgccgccgaacgccgattcgctatcggtggcgtaggccaggtcgtaggccttgcggatgccgccttcgtcttccggcaccacggcgacgccgcaggggttggcatgcttgacgatcacgcaggccggcttgaggaagctcttcacgcattccagggcggcgtcggtgtcggcgacgttgttgaacgacagttccttgccctgcaactggatggcggtggagacgctggcctcgcctttcttcgcctcgacgtagaacgccgcgctctggtgcgggttctcgccgtagcgcatttcctgggccttgacgaactgactgttgaaggtgcgcgggaaggcgccgcggtcggcggtgcctag

SEQ ID NO: 10555 - DNA, 714 bp, Pseudomonas aeruginosa
ggtatcgcgggtctggtcgatggtacccaggtagttggcgatcatgccgtcgtaggcggaggtgtgctcgaacgccttgagggccaggtcgaaacgctgggcgtaggtcaggccgccggccttgagggattcgatcacggcggcgtagtcgccggcattgaccacgatggcgacatccttgtggttcttcgccgccgaacggaccatggtcggcccgccgatatcgatgttctcgatggcggtaggcaggtcgcagtcgggcctggccaccgtggcctcgaagggatacaggttgaccgccaccaggtcgatcggcttgatgccgtgctgctccatgaccgcgccgtccaggtcgcggcgaccgaggataccgccatgcaccttcgggtgcagggtcttcacccgaccgtccatcatttccgggaagccggtgtagtcggccacttccacggcagagatgccgttgtcccggagcagcttgtaggtgccgccggtggaaaggatttccacgccgagggcgaccagctcacgggcgaagtcgacgacgccggtcttgtcggaaacgctgatcagcgcgcggcggatgggcaggcgggtggtttggtcggtcattgcaagggtcctgagggctggcttccggccgcgggtgccggccgggacgcgcgcccttggccggagcccgccgccgctcttaaagaagatcgtattgcttga

SEQ ID NO: 10556 - DNA, 1116 bp, Pseudomonas aeruginosa
ggtgctgtttcaggttggcgttgtcgctcacgggcgttgttccactcactaaagtctcggtcgtcatcgttgtcatgcggccacccctgttccgttgttctggcgctcggcgaagaactgcctgacgctggcgcactgcgcatccgtgtcctgcaaacgattgaactgggcgcggaattcccttgcgcccggcagagtcgcgagataccaccccacatgcttgcgggcgatccgcacacccatttcttccccataaaaaaggtgcagctccgcgaggtgttcgagcaggatgctctgcacttcgggaagcggcgccgccggcaggtgctcgccggtccgcaggtaatggtcgatctcgcggaaaatccacggtcttccctgggcggcccgaccgatcagcagggcatccaccccggtctgctcgatgactttcctggccttttccggcgaatcgatgtcgccattggcgaacaccggtatcgacacggcctgcttgatcgccgcgatggtctcgtactccgcctccccggtgtacaggtcggcgcgggtccggccatgcaccgcaagagcctggatccccgcctgttcggcgagcttcgcgacggtgacgccgttacggttgtcccggtcccagccggtccggatcttcagggtgaccggtacgtcgaccgccctgaccacggcatcgaggatctcggcgaccagcgcctcgtcccgcagcagggcggaccccgctgccttgttgcataccttcttcgccgggcagcccatgttgatgtcgatgatctgcgcaccgagttccacattgcgctgcgcggcctcggccagcatggccggatcgccgccggcgatctgcaccgagcgcggctcgtcctcgccatcgtggatcaggcgcaggcgcgacttgcggctgttccacaggcggacgtcgctggtcaccatctccgataccaccatcccggcgccaaggcgacggcaaagctgacggaacggacgatcggtcaccccggccatcggcgcgaggatcagtctgttgggcagtgtatatgggccgatgcgtaccaccgacatggggcttccctgtcttgcggtgctgcgaaaaaagggagggcatga

SEQ ID NO: 10557 - DNA, 978 bp, Pseudomonas aeruginosa
gcggcgagaccgcccagcgccagcaggatcagcagcagccagccgagacgccgcggccattggcgccggggcttctcccaggccagttgcagtggctcgtcgcgcaactggtcgagactctcgaccggcgcctcgtccggtttgcgggcgctgcccaggggcgcgacggactgttcctcggcgctttcctcgtcgtcttcatccagggcgctcaggccgtggcggcgcttgccgaggctgggctcgtcgtcatcgtcgtcatcgagaatgaggcgaagttccggcggatcctcggcgcggcgcagcggcacgaaggatacccgctcttccgccagcggttcgccgaggctcggttcctggcgcggattgccgcgcgccggctgggccggttcggcatcggcgatcagcgcctcggcccagcgttcgtcatgtggatcgcgttcgtcgtcgcggcgcgccagcaggctttccgccggtcgcggggccttctcgatgctggagaattcctggttcagctcgaattcgtcgagcttggccagttcctcgtcgaggttgaggctgtccaggtcgaggtcgtcatggatccacagggtttcgtcgcgcgggcgcgctgccgggggcgcggccgaggtggcggccgcgacgctgggcgcaggtggcggagcggcggccggcttcgcttcggctgccgaaggagcgttcgcgcgcggcgcgccaccgacctggtgttgcagggcgttgaagactttcaggcaggtgccgcagcggaccgcgccattggcggcgcccagttgcgcgtcgttgacgcggaaactggtgctgcaatggggacattgggtgatgacgctttcgctcatgcggcgatccgtagggaaaatccggcggctagtctaccccaagcttcttgcacgaaggcagtggggcgggatcagtggtggctggcggcgcgccatcaatcggcgcggcggcggccgctga

SEQ ID NO: 10558 - DNA, 483 bp, Pseudomonas aeruginosa
tgcggatccagccttcgcgctcggcggtcgggtcgagatcgaagtgtgcggagtaggccgcgcggacctccgcggcctgctcggcgaggatgccggacaacgccagcaggccgccgggacgtaccaggccggtcagttgcggggcgagggaaaccagcgggccggcgaggatattggcgaccagcacgtcggcctgtcgctgcggcaggtccgccggcaggtagacagggaaccgcgcgggctcgataccgttgcgcgaggcattgtcgcgcgaggcttccagggcctgtggatcgatgtcggtgccgaccgcccgttcggcgccgagcagcagcgcggcgatggcgaggattcccgagccgcagccgaagtcgagcacctgccggccggccagttcctggccgtcgagccattccaggcacagcgcggtggtcgggtgggtgccggtgccgaaggccaggcccggatcgagcagcaggttga

SEQ ID NO: 10559 - DNA, 1119 bp, Pseudomonas aeruginosa
ccaggcgaacttgtaaccagggcatggggcgacctctgttgcggctgtaaacgaaacgggccgcccaggggcgacccgttttccaccgcgcaagcttacttgaggctagccggcgctgccactctctgccgtggcctcgccgcgcagttgcgccaggccgcgattggccaggtggcaggtaccgccgccgagcaccgccggcagcagcaggttgagcagcggcaccagcgccaggagcagtatcagcaggccgaacagcaacaggctgccgcggcgagcacgaagcacggcgagctgctcgccggcatcggccagcccggccagcgtggcgggcagcaggaagcggatgttcaggtaggccagcgccagcagcaggagtacaccgttgtagagcggaaccagcaggccgaccaggatcgatccggaaacgcccagccagggtgccaggcggaagccggcggcacgccacagcgagatcctttcgccggaggcaggtgccagtcgcgggtagcgttggcggacctgttccttcagttgtccgagcaggccgatgcgcaggcccaggcggatgccgaagacgatgctggcggcgtacagggcgacgaagaacagcgcggcatagccgacgaaatagaacgccagttgcgccagtcccgccaggccgttgaaggccgccagcggatcgaagtacgggccaccgctgccggcctcgatcagcgagccgctggggatcagggcgaagttggccacgctgaatgccgtgtacagcgcggcccagccgcagaggcggatgatcggttcgaagaaatgcacgaacagccaggtgcacagcacgctgacgagaatgcacaggctcgcggagcggaagagtgcggcgggttgcaggctttccctgaaacccaaggcgaagcaggtcgcggcctcggtcgcggcggccagcgattggcggtaccagcggcggatgcgttccatgcaggagtccggtggtggaggggcgacgaggatagcaccgttggggcggccggcaggcggaaacgacaagggccgcccggaggcagcccttgtgcgcagcgactgacggatcagtgcttgtccatacccagtttcttctccaggtaa

SEQ ID NO: 10560 - DNA, 2511 bp, Pseudomonas aeruginosa
ctgcaattgcgcctggagattgaggctggcgccgaacatgcccatcagcgcgccgagcagggcgaagcagagcgccatcggcagcacgtaggcgagcgacaggacgaagccgcgaccaccgcccggccggccgcgcaggaccactccggagaggatcggcagcatcggcagcacgcagggggtgaaggtcagggtcaggccggcgaggaagaagaacagcaggctgcgcttgcccttgtgctcgagcgggcccttgccggccgcgtcgctcgcggctggcgtcgcggcaccgccgtcgatgtcgaagcgcctggtttccggggggtagcagaggcccttgtcggcgcagccctggtacgtcaccacgagggtatagggctgccgggccgggttgttcaggggaatctccaggtcgacgatgttgtagtagacctcggtatcgccgaagtactcgtcgtggtgctgcttgcccgccggcagctgcacctggccgaggctgacctgggctggctcgaccttgaactggaagcggtggcggtagaggtagtagccctcggcgttgacgaagcgcagcagcacgtgctgcgcgtcgctgcgctcgacgctgggcttgaacgcctggtcgaccttgaggaagccgccgccatcgaggccgccgccgagggaggcgccgggacggctgtcgaacaggcccgcgccggcgggcagggcgaccagcaggaggatcagggtcagcaggcggcgcatggatatctcgtcggatcaaaagccggaatgatagcggaaagccgggcccgatcgagccccgtgcggctgatcaggtcctgccccggttccgctgagcggtatccgaccggtccgaagccagacggttcctctggcgccttgcggcacgtcgccgcagggtcacaggcggaaggcctgcaccgtggtgcgcaggtcgccgcccagttgccgcagttgctcgccctgttcgcggctatggccgatcagccgcaggttttccccgcccagggcgtggatgcgttcgctgtgcgagcgaatctcgccgaccgcctggctctgctgggtcgagccttcggcgatgcgttcggccatcacgccgatggtatggatcgcggcgaccacttcgtccagcgcgccttccgccgcgccggcctgttcggcggtgcgttcggcatgctcgacctggctgcgcatggcctccaccgattgccgcgcggcctgttgcaggcggccgatgagctgctggatctcctcggtggcgccggcggtgcgctgggccagcgagcggacttcctcggcgaccacggcgaagccgcggccctggtcgccggcgcgggcggcctcgatggcggcattgagggcgagcaggttggtctgttcggcgatcgagcggatcaccgtcagcacgctgccgatggtcgccgactcctcggccaggcgctcgatcgactgggcgttgccttgcacctcgtcgaccagctcgcgcaggccgcccaggctctcgccgatcacccgctggccatgctccactgcctggcctgcgctgcgactggcgtcggcggtctggctggcgtctccggcgacctgctggatcgccgcttccatgtcgccgagggcgtcgcggatctgcccggtatcgccggcctggcgctcgaccccggcgtgcaggccgctgctgacctcggccagggtctggctgctgccggcgacctgttcggcgcggcggtggatcgcgccgaccagctcggcgaggaagctgcgcaggcggttcagcgaatcttccaggttgcgcaggtcctcggtgcgggtacgcagggatatggggcgcgagaagtcgccgtcggcccaggccgagagcgccggcaccagttgcccgaggacccgcgccaggcgtctttgcaggctgtcgatggcgagggcgatgagcaggatcagggcgatcatcccaccctggatcaggcgtacctggccttgcaggcgctggcgttcgccgcgcacctgcggttccagggtggccagggcctggcgcaccgcgtccagtctggcgccggtgtcggcggacagttgctggcgacgctcgatcaggtcgcgggtgcggcgcaactcgtccggatagcgttgcagcaggctggcgagttcgcgccgcagcgccacgccgcggtcttcggcattgccggcgccagcctcggcgtcgccggccagccccatcatggcggcgaagtcgtcgctggccgagcgttgctcgtcgagcacgccgagcagcggcaaggcctcgatccgcccggcctgctcgcgcaggttggccaattcgcgctcgacgtcgccggccagggccgggttggcgctttccaccagcttggcgcgggccaggctgaggcgggtcaggtgcaggctggcgagcagcagcggggtgcggtaggcgccggcctggggctgccccgccgcggcgtccaggtaggcggaccattgttccaggttgccggtgaggtcgcgctcggcctgtag

SEQ ID NO: 10561 - DNA, 1182 bp, Pseudomonas aeruginosa
aagccgacgatgccgaggttttcggcgtcctggaagggttggcgcttggcacggaacgcgttcgccatggtccaatcccccatctatcgagctgttttaaggacccttgccatgctggactggaagaagcgtcgtgggaccatgcgcgatcgcgtggacaattccgtggatgatgtgcgtacctacttcggcggcccctggctggtgcgcgtggtgggaggcctgctgggcatctacctgctggtggcgatgctggtcggctggtactggagccaggaacccgacctgttccccgtgcagcaggacgcccaggccgccgccgagcgcgccgggcggcagatggtcaccggctacaccacggtggagaacctcaaggaagtagtcgacaccctgctgaccaagccgggcggctacatctccaacgacatcttcccgccgggcatctggatggacaacatgcccagctgggagtatggcgtgctggtccaggtgcgcgacatcagccgggcgctgcgcaaggatttcgcccgttcgcagtcgcagtccaccgaggacgccgaactggctcgcgccgagccgcgtttcaacttcgacaacaagagctgggcgctgccggcgtccgagtcggagtaccaggaaggcatcaagtcgctggaccgctacctggctcgcctgtccgacccgaaccagcccaacgcgcagttctatgcccgtgccgacaacctgaacaactggctgggcgacgtcgccacccgcctgggctcgctgtcccagcgcctgtcggcgagcgtcggccgggtcaagctgaacaccaacatcaagaaccccgaagaggtacagccgggcgaggcgcccaaggtcgaggaagtggtccaggaaaccccctggctgcagatcgacaacgtcttctacgaggcccggggccaggcctgggcgctgtcgcacctgctgcgcgccatcgaggtcgacttcgccgacgtgctggcgaagaagaacgccacggtcagcgtgcggcagatcatccgcgaactggaggccgcgcaggagccgttgtggagcccgatggtgctgaacggcagcggctacggcatcctggccaaccactcgctggtgatggccaactacatttcccgcgccaacgccgcggtgatcgacctgcgccagctgctttcccagggctga

SEQ ID NO: 10562 - DNA, 612 bp, Pseudomonas aeruginosa
cccatggccgcgccgatcagcgccgaagaggtggcccaccgggccgcctccgacgccgaactcatcgcctgggtcgacgagcaggaccgcccgctcggtagcctgccgcgcgcggagctgcgcgagcgcgggctgatcggtcgcggcaccttcatcctgctgttcaactccgccggcgagctgtgcgtgcagcgccggaccctgagcaaggcggtctatcccgggtactgggacctcgccgccggcggcatgggtccaggccggcgagccatacgccgactccgccgcccgcgaactggaggaagagctgggaatccgcgacgcggtcctgcgcgaacatggtcgcttcttcttcgacgaaccgggcaaccggctctggtgcgcggtgttttccgccgtctccgatgcgcccttgcgcctgcaggcggaggaaatctccgaggcccgcttcatccgtcccgaactggcgctggaggaggctcgcagcctgccgtactgccccgattccctgcaggcgttgcgcctgtacctggacgcctgagccgcggatgtcgccatttcaccgatcaatggcgcattttcgctcttagcatttgctcgcaatgctgctaa

SEQ ID NO: 10563 - DNA, 408 bp, Pseudomonas aeruginosa
cctggcccgtcgaggccattctgggggaaacgcccggtggtcaaaaaagcttcgtccctgtccgccctcggcgggctggtgtattccacggatggcggccggcattgcccggactgccagcaacccaaagacgcctgcatctgcgggcaggccgtagcgcctgtcggcgacgggatcgcgcgcgtgcgccgcgagaccaagggccgcggcggcaagacggtgaccaccatcagtggcctgccgctcgccggcgatgcgctcaaggagctggccagcgcgctgaagcggcgctgcggcaccggcggcagtctcaaggacggcgtggtggagatccagggcgagcatgtcgaactgctgatcgacgaactcctcaagcgcggtttcaaggcgaagaagtccggcggctga

SEQ ID NO: 10564 - DNA, 2094 bp, Pseudomonas aeruginosa
atgggagactgcggatacccgcatgagcggatttcctcggctttcctaaactaccgcccagtgtggcggtcaacacggcaacgtcacatcctccggctagcctccaccacaggcgtgccggcccagggccatccggagatcccggcgcccgcccgaccccgaacattgaggagatcaccgcgcatggccgctcgacggactcgcaaagacgatggcagcaactggaccgtggccgacagccgcggcgtatacggcatccgccactggggtgcgggttatttcgccatcaacgatggcggcaatgtcgaagtgcgtccgcagggtgccgactcgacgcccatcgatctctacgagctggtcggccaactgcgcgaggcgggcctgagcctgccgctgctggtgcgcttcccggatatcctgcaggaccgcgtgcgcaagctcaccggcgccttcgacgcgaacatcgagcgcctcgaataccagaaccgctacaccgcgctgtatccgatcaaggtcaaccagcaggaagcggtggtggagaacatcatcgccaccgagaacgtctccatcggcctggaggcaggctccaagccggaactcatggcggtgctggcgctggccccgaagggcggcaccatcgtctgcaacggctacaaggaccgcgagttcatcaagctggcgctgatggggcagaagctcgggcacaacgtgttcatcgtgatcgagaaggaatccgaggtgcagctggtgatcgaggaggccgccaacgtcggcgtgcagccccaggtcggcctgcgcgtgcggctgtcctcgctggcttcgtcgaagtgggcagacaccggtggcgagaaggccaagttcggcctttccgccgcccagctgctgtcggtggtcgagcgcttccgccaggccggtctcgaccagggcgtgcgcctgctgcatttccacatgggctcgcagatcgccaacctggccgactaccagcacggcttcaaggaagccatccgctactacggcgagctgcgcgcgctcggcctgccggtggatcacatcgacgttggcggcggcctcggcgtcgactacgacggcacccattcgcgcaacgccagctcgatcaactacgacatcgatgactatgccggcgtggtggtcggcatgctcaaggagttctgcgacgcccagggcctgccgcatccgcacatcttctcggagagcggccgggcgctgaccgcgcaccatgcggtgctgatcacccaggtcaccgacgtcgagcggcacaacgacgacgtgccgaagatcgtcgatctcgacgagcagccggagatcgtccgctggctggccgaactgctcggcccgaccgatgccgagatggtcaccgagacctactggcgcgccacccactacatcggcgacgccgccgcgcagtatgccgacggcaagatcagcctggcgcagaaagccctcgccgagcagtgctacttcgctatctgccggcgcctgcacaaccagctcaaggcccgccagcgctcccaccggcaggtcctcgacgaactcaacgacaagctcgccgacaagtacatctgcaacttctcggtgttccagagcctgccggatacctgggccatcggccaggtgctgccgatcctgccgctgcaccgcctgggcgaggagccggatcggcgcgcggtactgcaggacctgacctgcgactccgacggcaagatcacccagtacgtcgacgagcagagcatcgagaccagcctgccggtgcacgaggtgaaggagggcgaggactacctgatcggggtattcctggtcggcgcctaccaggagatcctcggcgacatgcacaacctgttcggcgacaccgactcggtgaacgtctaccagcgcgcagacggcggcatctatcacgccggcatcgagacccacgacaccatcgaggacatgctgcgctacgtgcacctgtcgccggaggaactgatgaccctctaccgcgacaaggtcgccggggccaatctcaccgcccgcgagcgcaaccagtacctggatgcgctgcgcctggggctgacccgctcggcgtacctgtcctga

SEQ ID NO: 10565 - DNA, 477 bp, Pseudomonas aeruginosa
acctggcggtggaggacagcaagggcttccgcgactacgccgacggccagcgcctgctggtggcgccatcgttcagctggcaactggacccggacacctcgttgctggtggaagccgaggtggtgcgcaaccgccaggtcttcgaccgcggcaccgtggcgccgcacaaccacctgggcagcctgccgcgctcgcggttcttcggcgaaccggacgacggcaagatcgacaacaacaacgaaaccctccaggccaccctgcgccatcacttcaacgagcagtggagcctgcgcctggccagccactacaagcatggccacctggacggctacgcctcggagaactccagcctcgccgccgacggctacagcctgcgccgggagtaccgctaccgcgacttcgagtggcacgacagcatcacccagctcgacctgctcggcgacctccataccggctcgatccgccaccagttgctga

SEQ ID NO: 10566 - DNA, 2286 bp, Pseudomonas aeruginosa
cgccaaggtcctgctgcgtcacggcagcggtatcaagggactgttcaactatccggtggagccggccgaactggatggctggcgggtttgcgcggagcgggtcagccagccgctgtacgacaccctgatcctggagaaggccggtcgatgaatgccgctgatgagagcctgggcaacgtcctgctggtcggtctgggcgcggtggcgatccaggtcgcgctggacctgcgccgccacggtgccggtcgcctcggcgcgctgaaccatcccggccggcgcagccagcggatcgccgaggccctggcgcgcggcgcctgcctgcagctggaagggcaggggcagcatcgctggctgtccggcaacgccgcgctggacgtcttccaccaggaccccgctgagcttcgcgacgattggcagaccctggtgctctgcgtgccggccgacagttacctggacgtggtccgcgggttgccctgggagcgactcggcggggtgcgcacgctgctgctggtgtccgccttcatcggcgccaacctgctggtgcgcagcgccctgccggcggggtgccaggcgaccgtgctgagccctgtccagctactacgcggcgaccaaggtgatcgacgagacacaaccgctgcgggccctgaccaaggcggtcaagcgcagggtctacctgggttccagccggccggactgcccggcgcgggagacctggcggcgagtcctggccggcagcggggtggaggtggtacccctggcgacgccggaagcggcggagggccgcaacgtcaccacctacgtgcacagtccgttctttctcggcgagttcgccctcgcccggatactttccgagcaggggccacccggtttcatgtacaagctctacccggagggacctatcacccccggggccatcggcgccatgcggcggctgtggtgcgagctgagcgaactgttgcggcggatgggcgccgagccgttgaacctgctgcggttcctcaacgacgacaactacccggtgcacgagacgatgctgccgcgcgcggccatcgacggtttcgccgaggccggcgccgagcgccaggaatacctgctgttcgtgcgctacgcggcgttgctggtcgatccgttctctccggccgacgagcagggtcgccacttcgacttttccgccgtgccgttccgccgcgtcagtcgcgacgaagacggactctggcggctcccgcgggtgccgctggaggactatcgcaagctggcgctgatcgtcgcgctggccgcccacttcgacctggccatgccgcaggcgcgcagcctgttggcgagctacgagaacgccgtgtcccgattcatcgattgccaaggagcgagccagtgccatccaagcctgtatccgatcgacagccgtccggcggcggacgccatctatcgccaatggtgctcgacctgctgaagagcggggtgctgctggcggtgctggcgtccttcaccttcagcgtgatgaacgccctggtcaaggaagccagcgccaccctgccggctgccgagatcgtgttcttccgcagcgccatcggtaccctgctgatctacctgctgatgcgccaggccggtgtcgccctgtcgcgccagggcgtgccgatgctgctggtgcgcggggtgatgggggcgctgtacctggtctgctatttctacgccatcgcccatatcccgctggcggacgcgagcatcctggcgcacatgtcgccgttcttcgtcatcctcttctccgcgctgttcctcggcgagcggattccccgggcggtctattggctgttgctggtggtggtgctcggcgcgctgatgatcgtcaagccgttcagctattccagctactcggtatacgccgtggtcggcctgctcagtgcggtgttcgccgccggtgcctcggtggcgatccgccaactgagcgcgcggcaccatacctacgagatcgtcttctacttcctggcggtggccaccctggtggccatcccgctgatgtggaacgacttcgtggtgccggcgacgctgcgcgagtgggggctgctgctggccatcggggtggtatcgctactcggccaggtgttcctaacccgcgccttcagtcacgagagcgcgaccatcgttgcggtgacccgctatatcggcatcgtcttcaacgccggctggggctggctgttctggagcgaggtgccggacgcgctgaccatcgccggcggcgtgctgatcgtggtggcgtgcatcgcgctgtcgcggacgaagaagggctga

SEQ ID NO: 10567 - DNA, 1635 bp, Pseudomonas aeruginosa
cgtgatcgtgatcggcgccggtccggggggctacaacgctgccattcgcgccggccagctgggcctgaaggtggcctgcgtggagggtcgcgaaaccctcggcgggacttgcctgaacgtcggctgcatgccgtccaaggccctgttgcacgcctcggagctatacgccgcggcgagcggcggcgagttcgcccggctcggcatccgggtcagcccggaactggacctggcgcagatgatgaagcagaaggacgagagcgtcgccgccctgacccgtggcgtcgaattccttttccgcaagcacaaggtgcagtggatcaagggctgggcgcgcttgcaaggcgagggccgggtcggcgtggcccttgccgacggcggccacgcgcaactggaggcgcgcgacatcgtcatcgccaccggttcggaaccggcgccgctgcccggcgtgcctgtggacaaccagcgcatcctcgactccaccggcgccctggagttggtcgaagtgcctcgccacctggtggtgatcggcgccggcgtgatcggcctggagcttggttcggtctggcgccggctgggcgcacaggtcacggtgctggagtacctcgagcggatctgcccggggctggatggggaaaccgcaaggaccctgcagcgcgccctgacccgccagggcatgcggtttcgcctcggcacccgcgtggtcgccgcgcgcagtggcgagcagggcgtcgaactcgacctgcaaccggccgccggcggcgctacggaatcgctgcaggcggactacgtgctggtggccatcggccggcgcccctataccgaaggactggggctggagacggtcggcctggccagcgatcgtcgcggcatgctggagaaccagggacagcgcagcgcggcgccgggcgtctgggtgatcggcgacgtgacctcgggaccgatgctggcgcacaaggccgaggaagaggcgatcgtctgcatcgagcggatcgccgggcatgcggcggagatgaacgccgaggtgattccgtcggtcatctacacccagccggaagtggccagcgtcggcctcggcgaggagcagctgcaggcggcgaggcgcgagtacaaggtcggacgcttcccgttcagcgccaacagccgggcgaagatcaaccacgagagcgaaggcttcatcaagatcctctccgatgcccgcagcgaccaggtgctcggcgtgcacatgatcgggccgggcgtcagcgagatgatcggcgaagcctgcgtggccatggagttcagcgcctcggcggaggacctcgcgctgacctgccatccgcatccgacccgctccgaggcgctgcgccaggcggcgatggacgtgtatggccgggccatgcagaactgagggctcagccgcgcatgccgaagccgcgcgccatcagcgtagccagcaacggaatgaccagcagcaggagcagttgcaggcgcaccgccaggaccacccgccggccccgggccggcgtcaccgccggcacttcgcgggccttgagggtgccgcgccagccgaggaaggtaacggtcggcaacagcgagaccagggcagcgaggacgaatagcccgaccttggcgtggaacaggccattgtgcaggtag

SEQ ID NO: 10568 - DNA, 357 bp, Pseudomonas aeruginosa
aatcgagctggccattttccggagcccgccatgaccccgctgacgcccgagcagacccatgcctacctgcaccatatcggcatcgacgatcccggtccgccgagcctggcgaagctcgaccggctgatcgacgcgcatctgcgccgggtcgccttcgagaacctcgacgtgctgctcgaccgccccatcgagatcgacgccgacaaggttttcgccaaggtcgtcgagggcagccgcggcggttattgcttcgaactcaactcgctgttcgcccgcctgctgctggccctcggctacgacctggaactgctggttggcacgggaacgctgggggctccccggagaacgcccccctga

SEQ ID NO: 10569 - DNA, 516 bp, Pseudomonas aeruginosa
acccagcaatcgcatctgatgctgcgtctgtacctggcggagggcgagttcctggtggatgtcggcttcggctcggccaatccgccgcgagcactgcctttgccgggtgacgaggcggacgccggacaggtgcattgcgtgcgcctggtcgacccgcacgccggtctctacgaaagcgccgtgcgcggtcgcagcggctggctgccgctgtaccgcttcgacctgcgcccgcagttgtggatcgattacatcccgcgcaactggtacacctctacccacccccacagcgtgttccgccagggcctgaaggccgccataaccgagggcgacctgcgcctgaccctggccgacgggctgttcggccagcgcgccggcaacggcgagacgctgcagcgccaactgcgcgacgtcgaggaactgctggacatcctgcagacccgttttcgcctgcgcctcgacccggcctccgaagtgccggcgctggcgcgacggctggcgggactgatctccgcctga

SEQ ID NO: 10570 - DNA, 183 bp, Pseudomonas aeruginosa
gcgcttttggccggtgtcttttcgccggactcctgcgggaattttccgatgttccatagaagcctgaacgaaacggctttttcggttgacctcgtctggcaagaggtctataaaacccccgcccgcagagccgggcactttctttccccctacgaagagagccatggacagtattcccagtag

SEQ ID NO: 10571 - DNA, 2493 bp, Pseudomonas aeruginosa
ggaaaccgatctcaccggcgtcatcatcgtcctctgcatggtcctggtcagcggcctgatgcgcttctggcaggaataccgttcgggcaaggccgccgaggcgctcaaggccatggtgcggaacaccgccaccgtgctgcgccgcgacgagcgcgggatgcgcggcgagctgcgggaaatccccatgggcgaactggtggtcggcgacatcgtgcgcctgtccgccggcgacatgatccccgccgacatccgcctgatcgaatcgcgcgacctgttcatcagccaggccgtactcaccggcgaggcgctgccggtggagaaatacgacaccctcggcgcggtccgcgagaagtccgccaagcggatcgccgccgaccagcaggacctgctcgaactgccgaacatctgcttcatgggcaccaacgtggtcagcggcacggccaccgcggtggtggtcgccaccggtgcgcgcacctatttcggttcgctggcccgttccatcgtcggttcgcgggcgcagaccgccttcgaccgtggggtgaacagcgtcagttggctgctgatccgcttcatgctggtgatggtgccgatcgtgctgctgatcaacggtttcaccaagggcgactggaccgaggcgttcatgttcgctctcgccgtggcggtcggcctgaccccggaaatgctgccgatgatcgtcagcgccaacctggccaagggcgcggtggcgatgtcgcggcgcaaggtggtggtcaagcgcctcaacgcgatccagaacttcggcgccatggacgtgctctgcaccgacaagaccggtaccctgacccaggaccggatcatcctcgagcatcacgtcgacgttgccggccggcgctgcgaccgggtcctgcaaatggcctggctgaacagcttccaccagtccgggatgaagaacctgatggaccgcgcggtggtcgccttcgtcgaacagaacccgcgcatcacgccgtcggatgcctggcgcaaggtcgacgaactgcccttcgatttcgtccgtcggcgtctctcggtgatcctcgagggcaaggacggcgaacacctgctggtgtgcaagggcgcggtcgaggaaatgctcgagatcgccacccgcgtgcaccaggacggtgtcgacctgccgctcgacgaggaacgccgccgggccctgctggcgctggccgagcaatacaaccgcgacggcttccgcgtgctcctgctcggcacccgcagcctctcgcgcacggagtcccaggcccagtacggcgccagcgacgagcgcgacctggtgatcgccggcctgctgaccttcctcgatccaccgaaggaaaccgccggcccggccatcgccgcgttgcgcgagaacggcgtggcggtgaaggtgctcaccggcgacaacccggtggtcagcgcgaagatctgccgcgaggtcggcctggacgtcggcgagccgctgctcggtcgcgacatcgacctgatggacgatgccaccctgcaacgcctggccgaggagcgcacggtgttcgccaagctgacgccgctgcagaagtcgcgggtgctcaaggccctgcagggcaacggacacaccgttggcttcctcggcgacggcatcaacgacgcccccgcgctgcgagatgccgatgtcggcatctcggtggacagcggcaccgacatcgccaaggaatcggccgacatcatcctcctggaaaaaagcctgatggtcctggaggagggcgttatcaagggccgcgagaccttcggcaacatcatgaagtacctgaacatgactgccagctccaacttcggcaacgtgttctcggtactggtggccagcgccttcatccccttcctgccgatgctggcgatccacctgctgctgcagaacctgatgtacgacatctcccagctgtcgctgccgtgggacaagatggacaaggagttcctcgccaagccgcgcaagtgggactcgaagaacatcggccgcttcatggtctggatcggcccgacctcgtcgatcttcgacatcaccacctacgcgctgatgtggttcgtgttcgccgccaacagcccggaaatgcagtcgctgttccagtccggctggttcatcgagggcctgctctcgcagaccctggtggtgcacatgctgcgtacccagaagattcccttcatccagagcaccgcggcgctgccggtgatgctgatgaccgggctggtgatggcgctgggcatctacgtgccgttctcgccgctgggggcgatggtcggcctgcagccgctgccgtgggagtacttcccctggctggtgggcacgctgctctgctactgcgtcaccgcgcagaccatgaagaccctctacatccgccgcttcggccagtggttctgagccatcggccgggcttcgtcccggcctttcccggcgcgtcggcaagcctcgccgcgccgcgcaacgcacaccggacccacgcatggagagacgcatcatga

SEQ ID NO: 10572 - DNA, 819 bp, Pseudomonas aeruginosa
ccgggtggcgcggcgcctgccgttgggcaacctgctggtgcgcctgctcggttgcctgctggtgctgccctggctgacggcgctggcgcagccggccaacgcactcggcggtgcggcggcggtctggttccacagtgctttcaacctggccctggcactgctggcgatcggcttcaccggcccccttgcggcgctgctcgcgcgcctgttgccggaagaggcacagtccgacgacccgggcatgccgcgctacctcgacgaagccgggctggaggtggccaacatcggcctggccaacgctactcgcgaagtcctgcggctggccgacatggccagtctgatgctgcgcgccaccagcggcctgttgcagcgaccggaggcgaaggtggcggcggaaatccgtcgccaggaccaggccctcgaccagttgagtgcggcgatccgcgcctacctggcagacctcggccaggacggcctcggcgacagcgacgccgatcgtgcccaggaaatccttctgttcgccatcaacatcgagcacatcggcgatctcgtcgccaacagcctgctgcccctggcgatgcgctgggccgggcgcagccgcgccggcagcgagttcgagctgggccgcatgctgccgttgcaggcggcgatcgaggagagcctgcacctggcgatcagcgcgttccttcgcgaagacctggacgccgcgctgcgcctggtggcgcgcaagaagttgctgcagcgactggaggccgatgccagtcgcgagcgcttccgtcgcctgcgcgacgatcgcggtgcctgggtggagtccggtga

SEQ ID NO: 10573 - DNA, 507 bp, Pseudomonas aeruginosa
cgtgttccagcgcattctccgcgactaccgacgcatccaccatcatgtcaccgccctggcctatccgctgctcgaacgcagcggcatcgatccgatggcgaagcggccggacgagccagggcaaggggagggatcggcatgcgcctcctgatctgcgccggacgccatttcaaggacgccgaacgcctgcgcctggcgctcgaccagtgccacggcctgcaaccggtggcgctgctcggccacctgctgcatgccggcagcggcctgccggacgaggccgagcgctggtgccgcgagcgtggcgcggattcgcgcgcctacgattatccggagcgcagtggcagcgacaacgccctgcgcgagtatggcgaggccgtcctcggcgatgccgcgccggacctggtgctggtgtttcccggcgggcgcctggccagcgaactgatacaggtcgcgcacgctgccgacgtcccgctgatgctcgcctatcgtccgctgtcggcgccctga

SEQ ID NO: 10574 - DNA, 408 bp, Pseudomonas aeruginosa
gacgtcaggagcaggccgttgagcagcagggcgttggcggctaccgtggcgtcgccgaggcgggtgccctgtacggtgagcaggaaaaacaccagttgcagggccaggctgcggatgaagatatcccggttgaccatcagcagcggcagccaggacagccagtggcgcaggcgttgccactgcgcccgcccggggcgccgggccaggtcgcggcgggtcagggccaggccgagcagggcgccgctccattccgccagcaccgaggcgcgggccgcgccttgcacgccccagtcgaggccgtggacgaaccagagcaccagggcgatgttgctcaggttggtggtcaacaggatcgccaatggcgcccgtgcgttctgcgtgccgaggaaccagccgaccagtgcgtag

SEQ ID NO: 10575 - DNA, 1494 bp, Pseudomonas aeruginosa
cagacctctgcctgccgtgtattccttgtccgacgcggcttccaggcctgccgcggggaaccctgcgaaaacctgtcaggaagcttgcgcagcgctaaccgcggggctttgcgcaccttcctagaatgccggcgtcggttgtttccagaggaagccatgcatgctcctggggcgtttcgtctcggtcggcgccggtgccaccgccgttcattacctggtgctgaccctcctggtcgagggcttcgccgtcggcgccgccgtggccgccgcgacgggagcaggctgcggggctctggctgcctacctggggcatcgccggaagactttccgccaccgtggcccggtgttccgttcgctgccgcgcttcttcgccgtcagcctgctttgcgtactcggcaacgccgtcctggtgttgctgctcggcgacctcgccggactcgactaccgcctggcccagctcgccgcgaccggcgcactgctgttggcgacctatcaccttcatcgactctggaccttctcatgatgatcgaaccttccctggcgtcgaagctcgaggccccctgcctgctcagtgtggtagtgccggtgttcaacgaggaggcggtgctgccggccttccaccagcgcctgggcgccgtgctcggcgaccttggcgacgattgcgaggtgctctatgtcgacgacggcagcaccgaccgcagcgcgacgatcctcgcccagctacaggccgccgaccgccgggtgggcgtggcccgcttcacccgcaacttcggcaaggaacaggcgatgagcgccgggctcaagctgtcgcgcggcgccgcggtgatcgtcatcgatgccgacctgcaggatcccccggaactgatcccgcagatgctcgacgcctggatcggcggcgccgaaatggtcaacatgcgccgccgcagccgggccggcgaaagctggctgaagcgcgcctcggcgagcgccttttaccgtttgatcaaccgcctcagcgaggtgccgatcccgcgcgacgtcggcgacttccgcctgctcgaccggcgggtggtcgatgccctttgcgagctgccggaaggcaatcgcttcatgaagggactgttcgcctgggtcggtttccgccaggtcgatatcgcctatagccgcgccgcccgcgtcgccggccacagcaagtggcgctactggcggctgtggaacttcgccctggaaggcatcaccgggttttccaccgcgccgctgaaggtcgccggctacctcggcctgctcagcctgttggcggccctggcgaccctgctcgccgggatcttcggccagcaggagatccacgaacactggccggtgatcgccgcgctgttcctgatcggcggcctgcaactgctggccatcggcgtgtgcagcgaatacctcgggcggatgaccatggaagcgcggcgccgcccgctctacctgatcgaccgctacctgccggcgcaggtcggcggggccaatccgtga

SEQ ID NO: 10576 - DNA, 312 bp, Pseudomonas aeruginosa
tggacaccaccgaggcccgctatggcgaggtggcgcggaagatggccgaactgggcgactggatcacgccctggtacgacgtcggcgtgccgttctggggcaagccgccgctggccttctggctcagcgccggcggccagcttctgctcggcgccaccgagttcgccagccgcctgccgcactggttgctgggcgtgctggtgctgtggctggtatgggactggcaggctcgcgaagatcgtcggcaggcgcggatcgcctgcgtcctgctgggcagttcggcgctgttcttcgtcgcctccggggcggtaa

SEQ ID NO: 10577 - DNA, 2772 bp, Pseudomonas aeruginosa
gccggccgacgcgtccgcggcaagacgcactcagcccttgcggatcatccagatgccggcgccgatcagtgccaaccccgcccaagtttcagtgcgctgatcggtgcctcgcggaagccggcccaaccgaagtggtggaggttcatggccatgcccagctggccggcaagcaccagcaccatgaacatcagcgcgccgatgcgcggtgcggcgaaggcggcgatgaagatgaagaacatgccgaggaaaccgccgcaccagtgccaccagctcagcccgcgcaatgccgccaggccgggaaactcgcgctgcgagagggtcagggcgagcaacccgagggtgccgacgaagaacgagatcagtgccgcggcgaggacgctggacacctgcttggccaactggccgttgatccctgcttgcagcggcaggcaggcgccggcgagcaggggcaggacgaacagccaccagggtggagtgggcatgcaagactcctggaacgatgacggcgagcgcgccccgcgcatggcgagggacgggccggagtggtacggggagtcgcacagtatgcaccaggcgggggcggaggaggaaaacgcgagaccccatcgcacgccctcggattccgcccggcgggtaaccgcgagcggttgttcgccctacggcagccataccgccagcggcgttatccccctacaagcgcgccgccagcatggccccctcgcgaatcgcccgcttggcatccagttcccctgccacccgcgccccaccgatcaggtggaagcgcaggctttccgccgcctggctgatctgcaactcgcgcagcggctcctggccggcgcagatcaccacgttgtccacctccagccagcgttcctcgccgtcgacgcggatcaacaggccgcgtttgtcgatcttcaggtactccaccccgccgagcatccgtacggcgttgtgcctgaggtgcgcgcggtgtacccagccgctggtcttgccgagctgcgcgccgggagcgccgggcttgcgctggagcagccagacctggcgcgccggccgcgtcggagcgggttcgcggaggccgccgggctggctgttgtcgaggtccacgccccattccgcgagccattcgccgagcgcccgcggctggccgtcgctgggcgcggcgacgaggaaggcggcgacgtcgaagccgatgccgccggcgccgacgatggcgacccgcgcgcccaccggcgcgccgcgcagcacgtccacgtagctgagtacggtcggtccgccgatgccgtcgatccttggccggcgtggctggatgccggtggccaccaccacgtcgtcgaactgaccgtccagctcgccctggcgcactcggtggccgaggcgcaggtcgacgccgaggcgttccagacgcacgcggaagtagcgcagggtttcgcggaactcctccttgccgggaatccgcttggccaggttgaactgcccgccgatttccccgctcgcctcgaacaggctgacccgatgcccgcgctcggcggccacgcaggcggcggagagcccggcggggccggcgccgatcaccgcgatgcgcttctgcgtgcgcgccttgcggtagcgcaattcggtctcgaaggccgcccgcgggttgaccaggcaggtggcgcggcggttggcgaaggcatgatcgaggcaggcctggttgcaggcgatgcaggtgttgatctcctcggcccggccggcgccggccttggccacaaactgcgggtcggccagcagcggccgggccatcgacaccaggtcggccttgtcggtggcgagcagggattcggcgacctcgggggtgttgatccggttactggcgatcaccggcaccttcagctcgtggcgcagccgtgcgctgacctcggcgaaggccgcgcgcggcaccgaggtgacgatggtcggcacgcgcgactcgtgccagccgatgccggtgttgagcagggtgattccggcttcctccagggccagggcgatgcgccgcacctcgtcccaggtattgccgccctcgaccaggtcgagcagcgacaggcgatagcagaggatgaagcgttggccgacgatccgccggatgccgcggacgatctccagcgccaggcgcatgcggttttccagcgggccgccccactggtcgtcgcggcgattggtgcgcgggcagaggaactggttgagcaggtagccttcgctgcccatcacctccacgccgtcgtaggcggcggccttggccagccgcgcgcaacggacgaaggcgcggatggtcttgcggatgccgcgctcggagagctcgcgcggggtgaaccaactgatcggcgacttccacggggaggcggacaccgccatcgggtggtagccatagcgcccggcgtggaggatctgcagcaggatcttgccgccctcggcatgcaccgcctgggtcaggcgacgatgggcgggcacctccagggcgctggtgaggctgctgccgaagggcagcagccaaccttcgcggcagggcgcgaagccgccggtgacgatcagcccgacgccgccccgggcacgctcgcggtagtaggcagcgagcttgccgaagtcccacagacgatcctccagcccggtgtgcatcgaacccatcaccacgcggttgcgcagacgggtgaagcccaggtccagcggggccagcaggtgcggatagggagcggcggcgaccggcgggtaggggttgcgcatggcgcggttccggtagccagggacgcttcaccatag

SEQ ID NO: 10578 - DNA, 606 bp, Pseudomonas aeruginosa
tgcaggagatgcacgatggatatgaaccgtcggcaattcttcaaggtctgcggtataggccttggaggatcgagccttgcggcgctcgggatggcccccacggaggccttcgccgaccaggtccgccacttcaagctggcgcacacggtcgagacccgcaacacctgtacctactgttcggtcggttgcggcctgatcatgtacagccagggcgacggcgccaagaacgtcgcgcagaacatcatccatatcgagggcgacgccgaccatccggtcaaccgcggcaccctctgcccgaaaggcgccggcctgctggactacatccacagcccgaaccgcctgaagtatccggaagtgcgcgaggccggctccagcgagtggaagcgcatcgagtgggacgaagccctcgagcgcatcgccaagctgatgaaggaagaccgcgacgccaacttcgtcgagaagaacgagcagggccagaccgtcaaccgctggttgaccaccggcttcctcgccgcgtccgcctcgtccaacgaggccggctacatcacccacaaggtgatgcgctccctcggcatcctgggattcgacaaccaggcgcgtgtctga

SEQ ID NO: 10579 - DNA, 2490 bp, Pseudomonas aeruginosa
cacggcccgacggtggcaagtcttgccccgacgtttggccgtggagccatgaccaaccactggaccgacatcaagaatgccgatctggtgctgatcatgggcggcaacgccgccgaagcccacccgtgcggattcaaatgggtcaccgaagccaaggcgcacaacaaggcgcggctgctggtggtcgatccgcgtttcacccgttccgcctcggtcgccgactactacgcgccgatccggaccggcaccgacatcgccttcctcggcggcctgatcaactacctgctggaaaacgacaagatccagcacgaatacgtgcgcaactacaccgatgtctcgttcatcgtgaaggaaggcttcagcttcgaggacggcctgttcaacggctacgacgccgagaagcggacctacccggacaagtcctcctggggctacgagatcggtgaggacggctatgccaaggtcgacccgaccctgacccacccgcgctgcgtgttcaacctgctcaagcagcactacagccgctacaccccggacgtggtgagcaacatctgcggtacgccgaaggacatgatgctcaagatctgggcggaaatcgccgagacctccaagccgggcaaggtcatgaccatcatgtacgccctgggctggacccagcactcggtaggcgcgcagatgatccgcaccggcgcgatggtccagctgctgctgggcaacatcggcatgcccggcggcggcatgaacgccctgcgcggccactccaacatccagggcctgactgacctcggcctgctgtccaactcgctgccgggctacctgaccctggcgatggacgccgagcaggactacgacgcctacatcgccaagcgcacggccaagccgctgcgcccgggacagctgtcctactggcagaactacggcaagttccacgtcagcctgatgaaggcctggttcggcaagtcggcgaccaaggaaaacaactggtgctacgactggctgcccaagctcgacatgccgggcgccggctacgacgtgctgcgctacttcgacatgatgtaccagggcaaggtcaacggttacttctgccagggcttcaaccccatcgcctcgttccccaacaaggccaaggtcggcgccgcgctggcgcgcctgaagtggatggtggtgatggacccgctggtgaccgagacctcggagttctggcgcaacgtcggcgagtacaacgacgtcgacaccgccagcatcaagaccacggtgttccgcctgcccacctcctgcttcgccgaggaagacggctcgatcgtcaacagcggccgctggttgcagtggcactggaagggcgccgagccgccgggccaggcgcgtccggacatcgccatcatggccgggctgttccaccgcctgcgcgagatgtaccgcaaggacggcggggccttccccgacccgatcctcggcctcgactggtcctacctcaagcccgacgaaccgggcccggacgaactggcccgggagttcaacggcaaggccctgagcgacctggtcgacccggccaacggcatgatcctggccaaggccggcgagcagttgccgggtttcgccctgctgcgcgacgacggcagcacggcgagcggctgctggatcttcgccggctcctggacccagcagggcaaccagatgggccgccgcgacaacagcgacccctacggcatgggccagaccctcggctgggcctgggcctggccggcgaaccggcggattctctacaaccgcgcctcggccgacgtcagcggcaagccgtgggacccggagaagaagcgcctggtgtggtggaacggcaagtcctggggcggcaccgacgtgcccgactacaaggccgacgtaccgccggaagccgggatgaacccgttcatcatgaaccccgaaggggtggctcgcctgttcgccgtcgacaagatggccgaaggcccgttccccgagcactacgagccgttcgagacgccgatcggggtgaaccccttgcaccgcgacaaccgcaaggcgatcagcaacccggcggcacgggtgttcaagaacgacatggaactgttcggcacggccgacgagttcccctacgcggcgaccacctaccggctcaccgagcacttccactactggaccaagcactgccggctgaatgcgatcacccagcccgagcagttcgtcgagatcggcgaggcgctggccaaggagctgggcatcaatgccggcgacaaggtcaaggtctcctccaaccgcggctacatcaaggcggtggcggtggtgaccaagcgcatccgcccgctgcaggtggacggcaagaccgtgcaccacgtcggcatcccgatccactggggcttcgccggcatggcgcgcaacggcttcctggccaataccctgacccccttcgtgggcgacgggaatacccagacgccggagttcaagtcgttcctggtcaacgtggaaaaggcgtga

SEQ ID NO: 10580 - DNA, 561 bp, Pseudomonas aeruginosa
cggctggctgaaggaagtcggcaagggcgaggagcactgacgcgtatagtgtcgccatcgcccgaccggaggccccagcgatggggcctttgcattcattccgcgcccctccgggcgcccgatcgttgcggcgcggcccaccggcccgccggcgcagacccgaggagttcccgtgtcacgcaccattcttcagccggggcagatcgaagccgccgccaacattcccccgcacctgcaccagccgtcgcgcgacctgttcgcccgccgcggcgagcgtctgctgcaactggccgaggggcacccgatgggcgactacctgcggctggtcgccggtctctgccggctccagcaggcgctgctggacaacccgccggccctggccccgctcgaccccgagcgcctgcgcaagagccgcgagcacggcatgccgccgctggcctacgacctgctggtgcgcgaaggcgcctggctgccctggctggatgccctgctcgcgggctacccggcaccggccaacgccgccgtcggcgcggcactcgaacaattgcgcgaagccgatga

SEQ ID NO: 10581 - DNA, 1452 bp, Pseudomonas aeruginosa
cgggcagccggcggaaaaagccgtgctgcgcgccgagacctgccccagttgccagggctacctgaagcagttctacctggagttcgaccgccacgccgatgcccttgccgacgacctggccagcctggcgctggacatgcgcctggccgaggacggctacctgcggcgttcgccgaacctgttgctggcccccggcggcgaatagccgaaggcgctgcgggcatgcgccgacgcgtctatgatgggcgtgtcggtgaccctaccctgtggataaggtttctccatgagttccgttcgcttgccttcggtcgaccgcctgctgcgcagcgcggcggccgctcccctgcaccagcgctacggccgcgaggcgttgctggcgaccctccgcgacctgctcgacgaactgcgcgagccggcccgacgcggtgccctcgccgagatcgaactgagcgaggcggtgctcgccgggcgcgccggcgaacgcctcgccgcgcagcatgccagccgcgtgcggcgggtgttcaacctgaccggcacggtgttgcataccaacctcggccgcgccctgctgccggacgaggccatcgaggcgatcaccctggccgcgcgctacccgctgaacctggagttcgacctggccagcggcaagcgcggcgaccgcgacgacctgatcgccgggctgatccgcgaactcaccggcgccgaggcagtcaccgtggtcaacaacaacgcggcggcggtgctgctggcgctgaacagcctgggggcgcgcaaggaagggatcatctcgcgcggcgagctgatcgagatcggcggtgccttccgcattcccgacatcatggcccgcgccggcgtgcgcttgcacgaggtgggcaccaccaaccgcacccacgccagggattacgaagccgccatcggcccgcgcagcggcctgctgatgcgcgtgcataccagcaattacagcgtccagggcttcaccgccagcgtgcccaccgcgcaactggcggccatcgcccatggccatggcctgccgctgctggaagacctcggcagcggcaccctggtggacctgacccgctggggcttgcccaaggaaccgacggtgcaggaagccctggccgacggcgccgacatcgttaccttcagcggcgacaaattgctcggcgggccccaggccgggctgatcctcggcaaccgagaactgatcgggcggatcaagaagaacccgctcaagcgcgccctgcgcgtcgacaagctgaccctcgccgccctcgaggcggtgctcggcctgtaccgcgatccggaccgcctcgccgaacgcctgaccaccctgcgcctgctcagccgcccggcggcggagatccgcgcccaggccgagcgtctggcgccggcgctgggcgaggcgctcggcgagggctgggaggtcgccgtggtcgacgcccctgggcatga

SEQ ID NO: 10582 - DNA, 615 bp, Pseudomonas aeruginosa
tcggtcggctcgaggacgacgccctctggctcgatctgcgccagctcgacgacgagccggggttcctcgcccagttgccgcgactgcggagcgagctgtcgtgatcgtcggcaccgccgggcacatcgaccacggcaagacctcgctgctgcgcgccctcaccggcatcgagggcgaccgccgcccggccgagcgccaacgcgggatcaccatcgacgtgggctatctctacgccgaccttggcgacggcagccccaccggcttcatcgacgtgcccggccacgagcgcttcgtccacaacatgctggccggcgccagcggcatcgattgcgtgctgctggtggtggccgccgacgacggcttgatgccgcagacccgcgagcacctggcgatcgtcgaactgctcggtatccgccgggcgctggtggcgctgaccaagatcgaccgggtcgagccgcagcgggtgcagcaggtgcggacccaggtcgaacacctgctggcctccggcccgctggcgcgctcgccgatcttcccgctctccagcagcaccggggagggcgtcgaggcgttgcgcgaagcactcggcgggctcgccggcgaagtccgcgagcgtag

SEQ ID NO: 10583 - DNA, 1005 bp, Pseudomonas aeruginosa
ccgcgagggatacttccgcctggcggtggaccgggccttcagcgtcgccggcagcggcatcgtggtcaccggcacggccttctccggacaggtcgcggtgggcgacgaactgctcctcggcaacgccggacggccggtgcgggtgcgcggcctgcacgcgcagaaccggcccgcgcaacaggcctgggccggccagcgcgtggccttgaacatcgccggcgagcgcctcgcgctggaacagatccagcgcggcgactggctgctgcaggccgcgctgcacgcgccgaccacgcgggtcgacatcgacttccgcctgttgcccgacgaactccgcgacttcacccactggaccccggtgcacctgcacctgggcacccaggacgtcaccgggcgcctggccctgctcgaaggcgaacaactggagcctggccaccgcgccttcgcccaactggtgctgaacgcgccgatccaggccctgcatggcgaccgcctggtgctgcgcgaccagtcggcgcagcgcacccttggcggcgggcgggtgctcgacggcgccgcgccggcgcgcaaccgacgaacgccggcacgtctggcacagcttcaggcgctgcgccaggaaagcctggaggaggcgctgccgaccttgctcggcgcggccgagaacggcctcgacccgcaacgcctggtgcaatccttcaaccgcccgcgcgagcactggcggctgccggaagaggtggtcgaggtgcagacccgcctcggcccccggttgttcgccggggagcgctggttcgccctggtcgagcaactgctcgccggcctgcggcgcttccacgaagagctaccggacgaactcggtcccgaccgcgaccgcctgcgtcgctacgccctgccgcagctggagcggccggtgttcatcgccctgctcgacgccgccctggccggcggcgatgtgcacagcagcgggccctggctgcacctgcccggccacgaagtgcgcctgagcgatag

SEQ ID NO: 10584 - DNA, 402 bp, Pseudomonas aeruginosa
gcacgtcgcgaccgaagccgcgcagcacttcctgaaggcgcggggcgaggtcggcctgcgggttcggcgagaggtcggcgcgcccggcgcagaactgccgggccagctccagcaccggcggcgccaggccggcgaggacggcgacctgggcgtcgctgtagcggctcgccgaaaggccgttgtagagacagatcgagagcttctcggtggggccgaggtcgaggatgtagtagacgtcctccaccgctccggcgccgaggtagtaggtctggtagtaggcgctctggaagaagtcgtcgggggcgatctcgccgagggtgtagaagcattccggaaggcattcatccaccgccaggcagaaagggtcgagcaggtagccgcgggagaagtagcggcggatga

SEQ ID NO: 10585 - DNA, 1512 bp, Pseudomonas aeruginosa
caagccgcgtcggccgcacccagcgcttaccccaaaatggggtatggcccgccgcgcggtgctcttgcaccctcggagcatccatccgagaagagcgacagcccgatgaacgcaagaatgcacgccacgtcccccctcggcgacgccgacctggtccgtgccgaccaggcccactacatgcacggctaccacgtgttcgacgaccaccgcgtcaacggctcgctgaacatcgccgccggcgacggcgcctatatctacgacaccgccggcaaccgctacctcgacgcggtgggcggcatgtggtgcaccaacatcggcctggggcgcgaggaaatggctcgcaccgtggccgagcagacccgcctgctggcctattccaatcccttctgcgacatggccaacccgcgcgccatcgaactctgccgcaagctcgccgagctggcccccggcgacctcgaccacgtgttcctcaccaccggcggttccaccgccgtggacaccgcgatccgcctcatgcactactaccagaactgccgcggcaagcgcgccaagaagcacgtcatcacgcggatcaacgcctaccacggctcgaccttcctcggcatgtcgctgggcggcaagagcgccgaccggccggccgagttcgacttcctcgacgagcgcatccaccaccttgcctgtccctactactaccgcgctccggaaggagtgggcgaggccgagttcctcgatggcctggtggaggagttcgaacgcaagatcctcgaactgggcgccgaccgggtgggggcgttcatctccgagccggtgttcggctccggcggcgtgatcgtcccgcccgcgggctaccaccggcggatgtgggatctgtgccagcgctacgacgtgctgtacatctccgacgaagtggtgacctccttcggccgcctcggccacttcttcgccagccaggcggtgttcggcgtacagccggacatcatcctcaccgccaagggcctcacctccggctaccagccgctgggcgcgtgcatcttctcccggcgcatctgggaggtgatcgccgagccggacaagggccgctgcttcagccatggtttcacctactccggccacccggtggcctgcgcggcggcgctgaagaacatcgagatcatcgagcgcgagggcttgctcgcccacgccgacgaggtcggccgctacttcgaggagcgcctgcaaagtctccgcgacctgcccatcgtcggcgacgtgcgcgggatgcgcttcatggcctgtgtcgagttcgtcgccgacaaggcgagcaaggcgctgtttccggaaagcctgaacatcggcgagtgggtccacctgcgggcgcagaagcgcggcctgctggttcgtccgatcgtccacctgaacgtgatgtcgccgccgctgatcctcacccgcgaacaggtcgataccgtggtccgggtgctgcgcgagagcatcgaggaaaccgtggaggatcttgtccgcgccggtcaccggtaa

SEQ ID NO: 10586 - DNA, 1446 bp, Pseudomonas aeruginosa
  unsure (680): Identity of nucleotide at the above locations are unknown.
gcgccggggcgccgccggcgccccacccgaacattcaggagaaccccaatggacgacaacaagaacaaggtcctgcggttgcgcgatgtggtgctctacacggtctcggcgatgctcttcatggaccagatcgccctggcttcctccctcggtccgtcgagcctgttctggtggctctacgtgctggtcctgctgttcctgccgatggccatgatgacctccgagctgggcaccgccttccccgccaacggcggcgtctaccactgggtgcgcagcgccttcggcttccgctggggggcccgggtgtcatggatgtactgggtcaacaacgcactgtggatgccttcggtctacaccctgttcggcagcatgctcggcgccttctatttccccgagctgagcctctggggcaagatcgccatcggcatagccctggcgctgctcaccgcggcgttcaacgtggtcgcgctgcgcctgggcaagtggctgccgaacctcggcgcgctgctcaagctgctcgcggtgctcgccctgggcgtcggcggcctgcacttcggctggaaccatggcttcgccaacgacttcagcctggactccatcgtcccgtcctcgccgggccagatggccgcgctgggagtgatggtctatggcatcatggggaccgagctggcctgttgcancgccgcggatatgcgcaacgcgcgccgcgacatcccgcgcgcggtggtgatctccgggctgatcgtcggcgccttcaacatcttcggcaccctcggcgtgctggccgcggtaccggccgaggaaaccgacgtcacccggatcttcgcccataccctctacaacatctacggccacgacggcgccggcgggatgctcgccgacctggtcggcgccttcgtcctgttcaccctcttcaccaacatggtcacctggagcatgggcaccaaccgtgccgcggtggaagcggccaaggccggcgagctgccggcgctgttcggcgtggtccattcgcgccacggcacgccgatcggctcggcggtgctggcctcggcggtgagcatcgtcctgctgctgctctacggcctggtggcgcacactgccgaggaactgttctggaccctgctgtcgatcttcgccatggttttcatgatgccctatgtgctgatgtgcctggccttcgtccgcctgcgccgcgccgacccgcgtccacggccctaccggatgccgctgggcgaccgcctggccagtctctgggcgctgttcgtcgcgctgcatgtgctggccggcatctgcctgttcgtcgtcacccccggcgcgccgatggactgggcctacgccggcaagatcgtcggcggcgtggcgctggccctggccgtgggcgaactgctgatccgccaggcggcgcgaaggcgcggcgtgatgtcactgcgcggtgcctacggttga

SEQ ID NO: 10587 - DNA, 981 bp, Pseudomonas aeruginosa
tgggtcgcagcgcaacacggagaaggtcgtcatgtccgaacgagagcactggcaacgggtatacgagagcaagccgtccgacgcggtgagctggttccaggccgaggccacgctgtctctcgacctgatccgacgcatcggcgcgccccgcgaggcggcgatcatcgatgtcggcggcggcgcctcgaccctggtcgacggcctgctcgccgaaggcttcggcgacctgacggtgctcgacctttccgacgccgccctgcgtgtcgcccgcaaccgcctcggcgcgcgcggcgaagaggtgcgctggatcgccggcgacattaccggcgtcgacctgccggaagccacctacgatgtctggcacgaccgcgccgtgttccacttccttaccactgccgaagcccgccgcgcctacgtgcgccaggtgatgaaggcggtccgccacggcggccacgtgatcgtcgccaccttcgccgccgacggcccgaccgaatgcagcggcctgccagtcatgcgctacgacgccgacgaactgcacgccgagttcggctccgccttccagctcaccgagcaccgcgacgaacaccacgtcactcccgccggccgggtccagcacttcgtctactgccattgcctgaaacgcctgtgaagtgctccgaggctgggctacgctctgctcgcccggccatgcgaacgactttccatgacatccggcatttcttcttcggaccccggcctgataagctcccgtctcgaggaaaacctcttgcaaatcaaagaggaaggcaatcacgcccggtggcgtggccggacttcaaatccggtgggggacggcagccgttcctgggtgggttcgactcccactgccttccgccaattctccgctcgctttcggcggccatcgtgtctcacaggatcaagcgtctatctcggtccgttccagcagaagcagcgtctcacccgtccccgtcgtctccctga

SEQ ID NO: 10588 - DNA, 810 bp, Pseudomonas aeruginosa
ggttttcgcatgacggatcttgaacacgcggtggaaagcaaccgacgcgcctgggacgcgtccgccgacagtcacctgcgtggcagcggctggcaggaattgtcgctggcggtacaggaaaccggcttcagttgcctggacgagaccctggctggcgtgctgcgcaatctggacctggccggcaaggcggcggtccaggtcggctgcaacaacggccgggaagtgctttcgctgtacgccttcggcgtcgcgcgggcggtggggatcgaccagtccgccgccttcctcgcccaggcgcggcaactggccgagcgctcgccgcatcagccgcgtttcgtcgaagccaatgcctacgagctgccggccgagctgaacggtcagttcgacctgctgctgatcaccatcggtgtgctcaactggatgcccgacatcgcgcgcttcttcgcctcggtgagcggcctgctgaagccgggcgggcaattggcgatctatgagacccacccgttcctggagatgctcgaacccgagtcggagcgaccgttcgaactgcgcaacgactacttcaccgacacgccccacgtatcccgggaggccatcgtctacgaaggcagcggcagcgataccggcatcgccagctactggtacgtccacccgctcggcgacatcctcggcgggctgctcggcgccggcctgcgcctgagtcacttcaaggagtacccgcactcgaaccgcgaggaactctacgacctctacgaggacggaccgctggcgatcccgatgtgctacacgctggtcgcggtcaaggcatga

SEQ ID NO: 10589 - DNA, 1452 bp, Pseudomonas aeruginosa
ggcctgtccgaaagggggctaccgggtcggcgtcctgttgccggggagtcaggggccgcctcaggcccccagcaggctctgcccgcacaccctcagcacctggccgctgaccgcgccggacgacggctgggcgaaccaggccaccgtttcggcgacgtcctgcggcaggccgccctggctcatggagttcatccgccggccggcctcgcggatggtcagcggaatggcggcggtcatctgcgtctcgatgaagcccggcgccaccgcgttgatggtgatgccgcgcttgcccagcgccggcgcccaggcctgggccaggccgatcaggccggccttgctcaccgcgtagttgctctgcccgaggttgccggcgatgccgctgatcgacgccagcaacaccacccggccgttgtcatgcagcttgccgccgtcgagcagggcctgggtcagcacctgcggggcattgaggttgacgttgatcaccgagttccagaagtcgctgctcatcttcgccagggtcttgtcgcgtgtgatcccggcgttgtgcacgacgatatcgacgccctccggcagcgcgtccaccagttgctgcccggcgtccgcggcgcagatgtcgagggccacggcacgaccgccgaggcgcgcggcgaggccttcgagggcctccctggccggcggcacgtcgagcagcaccacttccgcgccgtcgcgcgccagggtttccgcgatggccgcgccaatgccgcgggcggcgccggtgaccagtgcgcgctggccggccagcggcttgctccagtcgtggacctgggcgctgttggcggcaagacggatcacctggccggagacgtaggcgctcttcggcgagaggaagaagcgcagcgcgccttccagttggtcctcggcgcccttgccgacgtacagcaactgcacgttgccgccgcgacggatttccttgcccagggagcgggtgaaaccttccaggctgcgttgcacgctggcggcgaccgggtccttgagagactcgggggcgcgtccgaggaccaccaccttcgggcatgtgtcgaggcccttgagcaccggctggaagaagtcgcgcagcgccaccaactgctcgaagcgggtcaggccgctggcatcgaacagcaccgccttggcccgcgggctgtgtttcggcggtccagcgcggcagctcgaactgtccctcgacggcggcgaacaccgcgtcggtcagcttgccggcgaagggcagcacggcctcggccagcgcgccgctcccgccgatcaccagcgggccgtccaccggccgcacccggccggcctgccagcgctccaggcgcagcggggagggaaggccgacggcgccaaccaggcggcggccgacgggggagttggcgaaggcgatgtaacgatcggtcatggaacgggctcccggtggaaaggctccaaggctga

SEQ ID NO: 10590 - DNA, 195 bp, Pseudomonas aeruginosa
aggtggattccgccggccaacgatgccgagggaacgcgggtaacagtgtggacaactctacgcagccacctgttcgccgcaattgaccgcgctgaccgggataacggcagggcggccaatgcgacgcgaccggctaaggttagcctgtgcgccactgaccgctcagttaacgggtcgagcctcggctcggcgtaa

SEQ ID NO: 10591 - DNA, 1302 bp, Pseudomonas aeruginosa
acgattccagcaaggagttcttccatgacccagctgcgccgggtcgccattgtcggcggcaaccgtattcccttcgcccgctcgaacaccgtgtacgccacggcgagcaaccaggagatgctcacttccgccctggaaggcctggtggagcgctacaacctgcacggagagcgccttggcgaggtggtggccggcgccgtgctgaagcattcgcgcgacttcaacctgacccgcgaatgcgtgctcggttcgcgcctggccccggaaaccccggcctacgatatccagcaggcctgcggtaccggcctggaggcggcgatcctggtggccaacaagatcgccctcgggcagatcgacagcggcatcgccggcggcgtcgataccacttccgacgcgccgatcggggtcaacgagggcctgcgcaagattctcctcgaggccaaccgcggcaagagcaacctggacaagctcaagagcctgctgaagatccgcccgcgccacgtggtcccggccatcccgcgcaacggcgagccgcgcaccgggctgtcgatgggggagtcctgcgaactgatggcgcagacctggcagatcccccgcgacgagcaggacaggctggccttcgagagccaccacaagctggccgcggcctatgaggagggctggcagaacgacttgatgacgccgttccgcggcctgacccgcgaccagaaactgcgcccggatatcgacctggagaagatcggcaccctcaagccggtgttcgagcgcggttcgcgcggcaccctcacggcggccaactcgacgccgctgaccgacggcgcctcggtggtactgctggccagcgaggagtgggcgaaggcgcgcggcctgccgatcctggcctatttcaaggacggcgaggcggcggcggtgaacttcgtcgatcgccaggagggcctgctgatggcgccggtctacgcggtgccgcggctgctggcacgcaacggcctgagcctgcaggacttcgactactacgagatccacgaggccttcgccgcccaggtgctctgcaccctgaaggcctgggaagaccccgagtactgcaagacccgcctcggcctcgaccagccgctgggctccatcgaccgcagcaagctcaacgtcaagggcagctcactggccgccggccacccgttcgccgccacgggaggacggatcgtcgccaacctggccaagctgctctcgctggcggagcagggacgcgggctgatttccatctgcgccgccggtgggcagggtgtgaccgcgatcatcgagcggtaa

SEQ ID NO: 10592 - DNA, 942 bp, Pseudomonas aeruginosa
cgacctcataaaatgaagtctttctcccgcctgccctgtcgagtgctttccatgcctgcccgtcgccttccgctgttgcttttcggtgcgttcttcgccctgtacttcatctggggctccacttacctggcgatccgcttcggcgtcgagtcctggcctccgatgctgatggccggggtgcgcttcgtcatcgccggcggcctgatgttcgcctggttgcgctggcgcggcgcgccgttgccgacctggcgcgagtggcgcggcgcggggatcgtcggaatcctcctgctcagttgcggcaacggcggggtgacggtggccgagcactggggcgtgtcttccggggtggcggcccttgcggtggctacggtgccgctgttcaccctgctgttcagccagttgttcggccagcgcaacaccacgctggaatggggcggcatcgtgctcgggctgttcggcatcgtcctgctcaacctcggttcgaacctccaggccagccctgccggcgccggcctgatcctgttcgccgccgcgtcctgggccttcggctcggtgtggagccggcgcctgtcgctgccggccggaccgatggccagcgccgcggaaatgctggtcggcggcgcggtgctgctggtcggcagcctggccagcggcgagcgcctggagcattggccgagcaccagcggctggctggcgctggtgtacctgatcctgttcggctcgatcatcgccttcagcgcctaccagtacctgctgcgcaacgtacggccggcggcggccaccagctatgcctacgtcaatccggcggtggcggtgttgctcggcaccctgttcgccggcgagcggatcggcggtatcgaggggctggcgatgctggtgatcatcagcgccgtggtgctcatcggcctgccccagtggcgcgccagccgcgccgctgcctga

SEQ ID NO: 10593 - DNA, 270 bp, Pseudomonas aeruginosa
gcgatccctaaggcgggctgcgccatgctgcggcgcagcgcccggatgggccgggctgacgggggtacgaagatgaaagcgctggtcatcggtgtggtcctggtgttccttggcggttgcgccagtcacgtgagccccggcggcaaggccatcgagtcgccgatcaaggagtatttcggccaggaccccatcgagcgccgggccttcggcgagagcgagaacggcgccgaggccgaggattcgccactgcgtttccgcctgacgccctga

SEQ ID NO: 10594 - DNA, 1485 bp, Pseudomonas aeruginosa
cgtggcctgaagttttccggaggccgccatgcctgttgcacatatcctgctcgccctgctggtgaccctgatctggggtctgaacttcgtcgtgatcaaggtcggcctcggcgacttcccgccgctgctgttctgcgccctgcgcttcgccctggcggcgctgccgctgctggtcctgcgcgggccgatgccggcgccgttcggacgcatcctactgatcggcgtgctcctcggggtggtcaagttcggcctgctgttcgtcggcatggcccagggcatgccggccgggctgtcgtcgctggtgctgcagagccaggtattcttcaccatcctcatcgccgccctatggctgggcgagcggccgtcgccgcgcgggttgttcggcctctcgctggcggcggcggggctggtcctgatcggcctggaacggccgctgggagacagcctgctggcattcctgctggtggtcgccgcagcgctggcctggtccttcgccaatatcgccaccaagcgttccggggccaccgacatgctgcgcctgatctgctgggtcagcctggtcccgccgttgccgctgctggcgctttcctatctattcgaaggtccgcaagccatcgagcgcgccgtgctgaacatgagctggggcggcttcggcgcgctgctctacatcgccttcggcgcgaccacggtgggcttcgccatctggagtttcctcctgcgccactacccggccagcctggtgaccccgttcgccctggcggtgcctgtgtcgggcatgctcgccggctggctgctgctcggcgaacgcctcgacctggacagcctgctggcctgcgcgctggtgttcgtcgggctggccatcaccctgttgccggccagcctgctgcgacgcttcgcctggccggtgcggcggttgggatgaaaacggcggaagacatcctcgcgctgttcgccgccgattcctcgcgcctgcatctgctccgcgtgctgcgcgaggtcggcccggagggcgcctggatcggcgccggcttcgtgcgcaacgcggtatgggaccatctgcatggctacggcgaagccacgccgctggcggacatcgacgtatttcatttcgccccgcgggccctcgacccgcaggccgacgccgacttcgaggccgcgttgcgccgtcgctgcgaggcaccctggtcggtgaagaaccaggcgcgcatgcacctgcgcaacggcgaccggccctaccgggattgcgccgatgcgctgtgccactgggcggaaacgtgcacggcggtggcgctgcggctcgtcggcgaacgcctggagctactggcaccgctgggcgttgacgacctgctggcgctgaaggtgcggcccaccgcgcatttcgccggcaagccggaggtctaccggcggcgcctgcgggagaagaactggacggcgcgctggccgctgctggatatcagtggcagcagccagacgccaggtccttga

SEQ ID NO: 10595 - DNA, 276 bp, Pseudomonas aeruginosa
agatcgcctgctgctcttccagggcgaccccggggccgttgtcgcgcacccgcagcacggcgtgctgggcgcgattctcgacgcggatctcgacctggcccccggccggtgtgtagcgcagggcgttgcccaccaggttgccgaccatcgccttcagccacaggtcgatgcccatcacgtgcacggtctcctggtgcaacgacagctcgatgtccttgtcgatggcctggcgcgccagttcggagagtacgtcttcggccagggtggcgaggttga

SEQ ID NO: 10596 - DNA, 1041 bp, Pseudomonas aeruginosa
ccagcaggcgccggcggacggaggggacggcggcacgggacatcgggggactccggtaggcggttttcagggcgccggctggtcgatgccgtagccgatgccgcggacggtgcggatcaactggttgccgagcttgcgccgcaggtggtggacgtggacttcgatggcgttgctctcgacgtcgccgctccagccgtagaggctctgctccagttggttgcgcgagagcaccttgccgctgttctccagcagcaggcgcagcagtgcgtattcgcgcggcgccagttccaccgcctgcccggacagggtcacctggtgggtcgccgggtccaggcgcagctcgccgtgcaccagttgcggcagggcgcgaccggtggtgcggcgggtcagggcgcgcacccgtgcctgcagttcgtcgagatcgaagggcttggtcaggtagtcgtcggcaccgctgtcgagcccggcgacccggtcggccaccttgtcccgcgcggtgagcagcagcaccggggtgagccggccctggtggcgcaggttacgcaggatgtccaggccgctgcggcgcggcagtccgatgtcgagcaccagcaggtcgaactcgtcggtgaccagcgcgttctccgcggccacgccgtcggtcacccattccacggtatcgccttccaggcgcagcccggcgcggatgccgtcgccgagcagcaggtcgtcctcggccagcagtattctcatggcagcctcgtttcagtgattccacaattcccacaggctcaggccggcctccagcaggagggatggcgacgatcagccattcgacccgcagttcgccccggaagtagcggtattcgccgaggcggtcggcggccagttcgtacaggtcctgcagcacttcgatgcgatcgtccagggtcgccaggcgatcgtgcacttcggcctgcatggccagttcgttgtagagccggcgcacagcgccgttcagttgcagcggcggcttctccaggtgcgactccaggcgggcataggccatgcgccagagtgtag

SEQ ID NO: 10597 - DNA, 1101 bp, Pseudomonas aeruginosa
cggccagcggtacgctggccaggggagcggcggacatcttcaggtcctcgccagggccggcaattgtgccgggccgaactcgatctcctcgatatccggcggtgcgacgaagggtacgccgtcttccagtaccggtcccggttgggcgagcaggaagcgggtttcccggtccatcacgaagcaggccttgaggtagtcgccgtcgaggtggtcgagccacagcgggccgagcttgcgttcgatgcgtcggtcgatgtcctcggcctgccagtggttcgtgtcgagccagtcggaagccagcaggaagccccaggaggagaggaacgagggcaccgtggcgcggtagctgtggacctgggagaagacactgcgcagggtgcgggcgagggccgcgtggggcttgtcgtcgctgtgggagaactccagcccctgcaccgcgaccaccccgcccggtcgcaggcgcgaatgcagcagctcgtagaactggcgggtatagagagcctgggccgggccgttgtcgagcatgtcgacgacgtcgatgatgaccacgtcatagagcgacgggtcgcgctcgagataggcccggccgtcctcggcgagcagttcgcagcgtgggtcgtcgaaggcgccctggtgccactggaacaggtgttcgcgacacagttccaccagctcccggtcgagatcgaccatcaccgcccgccgcacgctggcatgggacagcacctcgcgcagggtggcgccttcgccgccgccgatgatcagtacgtcgcgcggctcgtcgtgggcgagcatggccggctgcaccagcagctcgtggtacagcgactcatcgctctcggcgctctggatcgcgccgtcgagcatcagcacgcggtcgtagttgtaggtgtcggcgatcagcacgttctgccagcgcgtgcggccctggtagagcacccggcgcaggcggtagacgtactggtcgaaggggtcgctgtcctcgatcgcggtgatcgcgccgtcgccttccagcagcgggtccggcggatagaaatagaagtggttcggcggcagcggcggcagccccggcggcgacctccgccggcaccaggccggtga

SEQ ID NO: 10598 - DNA, 1626 bp, Pseudomonas aeruginosa
gccggtggcggcgcaggtgtcgatgccctggtagcggtagtcgcgctccagcgccgtggtgtcgacgccggcgcgcttcttcgcctggatgtcgcgccacaggacgatgcgctggcgtggcgtgagggtcagtccgcgcgacgggcagaccggttcgcagaaaccgcactcgatgcacttgtcgacgatctcgtcggcggccggcagcggcttgaggttcttcaggtgactctgcgggtcgtcgctgaggaccacgcccgggttgaggatgccgcgcgggtcgagcaggcgcttgagctgccacatcaagcgataggcgtcctcgccccactccagttcgacgaacggcgccatgttgcgcccggtgccatgctcggccttcagcgagccgccgtactccaccgccaccaggtgcgccacgtcgtccatgaacgccgagtagcgggcgatctgctcgggcgagtcgaagccctgggtgaagacgaagtgcaggttgccctccagcgcgtggccgaagaggatcgcctcatcgtagcggtgcttgtcgaacagctcgatcaggcggttgactccctcggccagtcgttcgacggggaaggtgacgtcctcgatgatcaccgtggtgccggtctcgcgcaccgcgccgacagccgggaaggtgtccttgcggatgcgccagagctggttgtagaccgccgggtcttcgctgaagtcgacctgcttctccagcggatattcggcgatggaggccatgatccgcccgagctgttcgtgcagcagcgtgcggctcgccgcgcgggactcgatgagcagggcgcatgcaccggcggaaagactcttcacccattccggcatgccctgcatgttctccaccgagcgcatgctgcgccgatcgaacagtccccccccgattaccggctggcgcttgagcaccgcgaccgccgtgcagcaggtttccaccgtggggaaaaccagcagcgccgaggccttgtgcgggtgttccgggacggtgtcgtaggtcaccgcgctgatgaagccgagggtgccctcggagccgaccatcaggtgggtgaggatgtccagcggctcgtcgtagtcgaccagcgcgttcagcgacaggccggtggtgttcttcagccggtacttgtggcggatcttcgcggccagttcggcgttggcgcgggtctcgcggccgagttcggcgagccgttccagcagctcgccgtggctggcgcggaaggccgcgacgctggccgggtcctcgctgtccaggcgggtgccgtcggccagcagcaggcgcaggccggcgagggtgtggtagctgttctgcgcggtgccgcagcacatgccgctggcgttgttggcgacgatgccgccgatcttgcaggcgttgatcgaggccgggtcgggaccgatcttgcggccgaacggcgccagccaggcgttcgcctgggcgccgatgacacccggctgcaggcggatctgcgcgccgtcggcgcggatttcccggccgttccagttgtcgccgaggacgagcagcaccgagtcgctgatggcctggccggagaggctggtgccggcggcgcggaaggtcaccgggacctgctcgcggtaggcggcggatag

SEQ ID NO: 10599 - DNA, 729 bp, Pseudomonas aeruginosa
gatcgcggcgacctcgtcctcgctttcgacgcgcagcaccagcttgggaatcaaccggtagaaactggcgtcggtgccgaaggccagggtcgacagcgggtcgtcgaagcggcgttcgcgcggtatcagccgctcgacggtctcgagaaagggaatcggcaggctcatcggctttcctcggccctgggacgacggtcacgccccgggcgttttcaggcttttctggtgggcgtctcaggcgcccagttcgcggaccagcgagtcagcgctgatctcgccgatcgacttggccccggtgaggaccatggccacgcgcatttccttttcgatcagttcgagcaggttgcgcaccccggcctcgccggcggcgggccagggcgtatactaaggcgcggccgagcagcacgctgtcggcgccgagggcgatcatccgcaccacgtcgagaccggtgcggatgccggagtcggcaaggatcgccagttcgcccttcaccgcctccggcgattgcccggcagcgccgcgggcgctggacagcacgccgtcgagctggcgcccgccgtggttggagacgacgatgccgtcggcgccgaacttcaccgcatcccctggcatcctccgggtcgaggatgcccttgatcaccatcgggccgtcccagaactcgcggatccactccaggtccttccaggaaatcgacgggtcgaagttggcgcccagccagccgatgtag

SEQ ID NO: 10600 - DNA, 633 bp, Pseudomonas aeruginosa
gtatgcctgggccagggtgatcagtccgaccagcgcggcgaagatcaggctgtgcttcagggtgaagcggaacaggtcggattccttgccgaccatcccggtcgcggcgcaggccacggcgatggattgcggggagatcatcttgccggtcacgccgccgctggtattggcggccaccagcagggtgtcgctgaccccgatctggtgcgcggtggtcgactgcagggagctgaacagggcgttggaggacgtatccgaaccggtcaggaatacccccagccagccgaggaacggcgagaagaacgggaacgccgcgccggtaccggccaggaccagggccagggtggtggacatgcccgagtagttggtgacgaaggcgaaggccaggaccatgccgatggacaggatcggccacttcagctctaccaggacttccttgaaagtggtaataccaattttcactccgatgcgcagaatgaacatcgataccaacgccgagaggaagatcgccgtgccggtggcggagatcgggtcgaacttgaataccgccgcgatcggcgtggcgctggtggcgatcggcgcgcccttgaccaccagttggtcgaggtgcgggatggcgaagttgaacactag

SEQ ID NO: 10601 - DNA, 798 bp, Pseudomonas aeruginosa
ggtgatgtccggcaactccgggccgatgaagttggacgtcaggtactgggtgatggcgaagctgccgccggcgacgatggcggccggccaggtttcgcggatgccgcgccagccgtccatcatgaacaccagccagaacggtaccaggatcgacaggaacggcagttggcggccggtcatggcgccgatcttgaaggcgtcgatgccggtcacctggccggcgacgatgatcgggatgcccagtgcgccgaaggccaccggcgcagtgttggcgatcaggcacaggccggcggcgtagagcggattgaagccgaggccgacgagcagggcggcggtgatcgccaccggcgcgccgaaaccggcggcgccttcgaggaaggcgccgaaggagaagccgatcagcagtacctgcaggcgctggtcgccggtaatcgacagtaccgagctgcggatcacctcgaactggccgctcttcaccgtcagtttgtagaggaagaccgcggcgacgatgatccaggcgatcggccagagaccgtagaggaagccgtagccggcggcggcgaaggccatgtcggcgggcatgtggaaggcgaagatggctaccgcgatggccagcgccagggtgatgctgccggcgatgtggcccttgaggcggaataccgccagggcgaggaagaagaacacgatcgggatgacggccgcggcggccgacaggccgagactgcccaggggggtatagagttgttgccaggcttgcatgggggttggctccctaattgttgttgggtttgcctgtga

SEQ ID NO: 10602 - DNA, 651 bp, Pseudomonas aeruginosa
accgtggaaagccgtccccatatagccggcaacgttgcgaacttatgcgttcgccttgtatttgccagcttatttttgaaggagagtggcatggctgacgaacagcagaccctggatcaacagacccccgagcagcccaccggcgccgccgaggacctgaccgcccgcgtgcaggaactggaggagcagctggctgccgcccaggaccaggcgctgcgcatggtcgcggatctgcagaacgtacgccggcgtgcggagcaggatgtcgagaaggcgcacaagttcgcgctggagaaattcgccggcgacctgctggcggtggtcgacaccctcgagcgcggcctggagatgtccgatcccaacgacgaggcgatcaagccgatgcgcgaagggatggaactgaccctgaagatgttcgacgacaccctgcgccgctaccaggtggaggcgctgaacccggaaggcgagcctttcaaccccgagcagcaccaggcgatggccatgcaggaaagcgcttcggccgagccgggcagtgtcctcaaggtgttccagaaaggctacctgctcaacggccgcctgctgcgtccggcgatggtggtagtcagcaaggcgccggcggaaaccccgccgtccatcgacgagcaggcttga

SEQ ID NO: 10603 - DNA, 1146 bp, Pseudomonas aeruginosa
gacggaaaggttatggcgaaacgagacttttacgaggttctgggggttgagcgtggcgccagcgaggcggacctgaagaaggcctaccgccgcctggcgatgaaatatcacccggaccgcaatcctggcgacaaggaagccgaggacaagttcaaggaggccaacgaggcctacgaggtcctctccgatgccagcaagcgggcggcctacgaccagtacggccatgccggcgtcgatccgaatatgggtgggggcgctggcgccggtttcggcggggcgagcttctccgacatcttcggcgatgtgttcagcgatttcttcggtggcggcggtgcccgcggtggctcgcgcggcggcgcgcagcgcggcgcggacctgcgctacaccctggacctcgacctggaggaggcggtacgtggcaccaccgtcaccatccgcgtgccgaccctggtcggttgcaagacctgcaacggcagcggcgccaagcccggtaccacaccggtcacctgcaccacttgcggcggtatcggccaggtgcgcatgcagcagggcttcttctcggtccagcagacctgcccgcgctgccacggcaccggcaagatgatttccgatccctgtggctcctgccatggccaggggcgcgtggaagagcagaagaccctgtcggtgaaggtgccggccggcgtcgacaccggcgaccgcatccgcctcaccggcgaaggcgaggccggcagcatgggtggtccggcgggcgacctgtacgtggtggtcaatgtgcgcgagcacccgatcttccagcgcgacggcaagcatctgtactgcgaagtgccgatcagtttcgccgacgctgcgctgggcggcgagctggaagtgccgaccctggatggccgggtcaagctgaagattccggaaagcacccagaccggcaagctgttccgcctgcgcggcaagggcgtggccccggtgcgcggcggcggcgccggcgacctgatgtgcaaggtggtggtggaaaccccggtgaacctggacaagcgccagcgcgagctgctcgaggagttccgcaagtcgttgcagagcgacacctcgcattcgcccaaggccagtggctggttcgaaggcatgaagcgtttcttcgacgacctataa

SEQ ID NO: 10604 - DNA, 714 bp, Pseudomonas aeruginosa
cgtcgccccgctgttcgaccgcttcatctcggcgatggccgagcgtcgctgaggagcagagccatgccgaccctggggataaccgatttctggacctacgtgctgggtgtggttttcgtgatcctgttgcccggaccgaactcgttgttcgtcctcgcgacttcggcccagcgtggcgtggcgaccggctaccgggccgcctgcggcgtgttcctcggagacgcggtgctgatgctgctgtcggccctcggtgtggcctccctgctgaaggccgagccgatgctgttcatcggcctgaagtacctcggtgcggcctacctgttctatctcggcgtcggcatgctgcggggcgcctggcgcaagctgcgcaatcccgaggcgacggcggcgcaggccgaaaaggtggatgtccaccagccgttccgcaaggcgctgctgctcagcctgtcgaatcccaaggcgatcctgttcttcatctccttcttcatccagttcgtcgatcccggctatgcctatccggggctgtcgttcctggtgctggcggtgatcctggaactggtcagcgccctttacctgagcttcctgattttcaccggtgtgcggctggcggcctggttccgccggcggcaacggttggctgccggcgccacttcgggcgtcggcgccctgttcgtcggctttggtgtgaagctggccaccgcaaccctgtcctga

SEQ ID NO: 10605 - DNA, 576 bp, Pseudomonas aeruginosa
ttattgcaacgagagtcccatgccaaaacgtacagacataaagagcatcctgatcctcggtgccggccccatcgtgattggccaggcctgcgaattcgactactccggcgcccaggcctgcaaggccctgcgcgaggagggctaccgcgtcatcctggtgaactccaaccccgcgaccatcatgaccgatccggcgatggccgacgcgacctacatcgagccgatcaagtgggccaccgtggccaagatcatcgagaaggaacgccccgacgcgctgctgccgaccatgggcggccagaccgcgctgaactgcgccctggacctggagcgccacggcgtgctggagaagttcggcgtggagatgatcggcgccaatgccgataccatcgacaaggccgaggaccgctcgcgcttcgacaaggcgatgaaggatatcggcctggcctgtccgcgctcgggcatcgcccacagcatggaggaggcctacggcgtgctcgagcaggtcggcttcccctgcatcatccgtccgtccttcaccatgggcggcaccggcggcggtatcgcctacaaccgtga

SEQ ID NO: 10606 - DNA, 717 bp, Pseudomonas aeruginosa
tgcccgcctgaccacccagatgaagtcggtcggcgaagtcatggccatcggccggaccttccaggagtcggtgcagaaagccttgcgcggcctggaagtcggcgccaccggcttcgatccgaagctcgacctgaacgacccggaggccgacagcatcctcaagcgcgagctgaccgtgcccagcgccgagcgtgtctggtacgtcgccgacgccttccgcgccggcaagagcgtcgaggaagtgttcgagctgacccgcatcgacgaatggttcctggtgcagatcgaggacctggtcaaggacgaggagaaggtcaagaccctcggcctgtcctccatcgatcgcgagctgatgtacaagctcaagcgcaagggcttctccgacgcgcgcctggccaagctgctaggcgtcaccgagaagaacctgcgcagccatcgccacaagctgaaggtgctgccggtctacaagcgtgtcgatacctgcgccgccgagttcgccaccgacaccgcctacatgtattcgacctacgaggaagagtgcgaggccaacccgtcgagccgcgagaagatcatgatcctcggcggcggtccgaaccgcatcggccagggcatcgagttcgactactgctgcgtgcacgcggcgctggcgatgcgcgaagacggctacgagaccatcatggtcaactgcaacccggaaaccgtctccaccgactatga

SEQ ID NO: 10607 - DNA, 543 bp, Pseudomonas aeruginosa
ggcgctcaagttcggtcccgagaagaccgttcggcgtctgcaggatctccacgcaggaatcaaggcatgagcaagttccccatgaccgtccagggcgcccgcgccctggaagaagaagtgaaacacctgaagggcgtgctgcgcccgcagatcagccaggccatcgccgaagcgcgtgaactgggcgacctcaaggaaaacgccgagtaccatgcggcgcgcgaacagcagggcatggtcgaggcgcgtatccgcgacatcgaggccaagctgtccaacgcccaggtcatcgatgtcaccgccatcccgcacagcggcaaggtgatcttcggcaccaccgtcgacatcgccaatgtcgagaccgacgagaccgtgacctaccagatcgtcggcgacgacgaggcggatatcaagggtggcaagatctcggtgaattcgccgatcgcccgtgcgctgatcggcaagaccgaaggcgatgccgtgctggtgagaaccccgggcggcgacgtcgagtacgagatcgtcgaggttcgccatatctaa

SEQ ID NO: 10608 - DNA, 729 bp, Pseudomonas aeruginosa
gtgagcgccataatcagacccctgggaaaaagtcgtctattttaccccagttttagtccaagtgatgctgcccccgccgaccgggggtgcccgaagaggtattccgtggcccgctccaaaaccagccagcgttggctgaaagaacatttcgacgatccctacgtgaagatggcccagcgcgatggctatcgctcgcgcgccagctacaagctgctggagatccaggagaaggaccgcatcctgcgtccgggcatgaccgtggtcgacctgggcgccgcgccgggcgggtggtcgcaggtcaccagccgggtgatcggcgaccgcggccggctgatcgcttcggacatcctcgagatggacagcatccccgacgtcacctttatccagggcgacttcaccgaggacgcggtgttcgcgcggatcctcgaggcgatcggcgaccatccggtagaccttgtgatttccgatatggcccccaatatgagtggagtgcgggcctccgaccagccgcgcgccatgtatctctgcgaactggcgctggacctggccggccgtgtgctgcggccgggcggcgatttcctgatcaagatcttccagggcgaaggtttcgaccagtaccacaagcaggcccgggaaatgttcgacaaggtacagatgcgcaagcccctgtcgtcgcgtgatcgttcgcgggaacagtatctgctcgcacgcggctttcgcggggaatag

SEQ ID NO: 10609 - DNA, 2004 bp, Pseudomonas aeruginosa
tacttttggccggaaggagtctggccgtcgtgtgaagcggtttccaggacggagccggcttcagagggtagtcaattgaacgacatggcaaagaatctgattctgtggctgatcatcgcggcggtactggtgaccgtgatgaacaatttctcgagcccgagcgagccacagacgctgaactactcggacttcatccagcaggtcaaggatggcaaggtcgagcgagtgaccgtggatggctatgtcatcaccggcaagcgtagcgacggcgataccttcaagaccatccgcccggcgatccaggacaacggcctgatcggcgacctggtcaacaacaacgtcgtggtcgagggcaagcagcccgaacagcagagcatctggacccagttgctggtcgccagcttcccgatcctggtgatcatcgccgtcttcatgttcttcatgcgccagatgcagggtggcggcggcggtcgcggcggcccgatgagcttcggcaagagcaaggcgcgcctgctgtccgaggaccaggtcaagaccaccttcgctgacgtcgccggctgcgacgaggccaaggaggaggtcagcgagctggtcgagttccttcgcgatccgggcaagttccagcgcctgggcggccgtatcccgcgcggcgtgctgatggtcggcccgcccggcaccggcaagaccctgctggccaaggccatcgccggcgaagccaaggtgccgttcttcaccatttccggttccgacttcgtcgagatgttcgtcggcgtgggcgcttcccgtgtccgcgacatgttcgaccaggccaagaagcatgcgccgtgcatcatcttcatcgacgagatcgacgccgtcggccgccatcgcggcgccggcctgggcggtggtcacgacgagcgcgagcagaccctcaaccagttgctggtggagatggatggcttcgagatgaacgatggcatcatcgtcatcgctgccaccaaccgtccggacgttctggacccggcgctgctgcgtccgggccgcttcgaccgccaggtggtggtcggcttgccggatatccgcgggcgcgaacagatcctcaaggtgcacatgcgtaaggtgccgctgggcgaccatgtcgatcctgccgtcatcgcccgcggtacgcccggtttctccggcgccgacctggccaacctggtcaacgaggcctcgctgttcgccgcgcgctccaacaagcgcatcgtcgacatgcgcgagttcgagctggccaaggacaagatcatgatgggcgccgagcgcaagaccatggtcatgtccgagaaggagaagcgcaacaccgcctaccacgaagccggccacgccatcgtcggtcgcctggtgccggagcatgacccggtctacaaggtgtccatcattccgcgcggacgcgccctgggcgtgaccatgttcctccccgaggaagatcgctacagcctgtccaagcgcgcgctggaaagccagatctgctcgctgttcggcggccgtatcgcggaagagatgaccctcggcttcgaaggcgtcaccactggcgcttccaacgacatcatgcgtgctacccagttggcgcggaacatggtgaccaagtggggtctgtccgagaagctcggcccgctgatgtacgcggaggaggagggcgaggtgttcctcggccgtagcgccggcagccagcacgccaatgtgtcgggcgagaccgccaagatgatcgaccaggaagtccggcgcatcatcgacgactgctacggtaccgccaagcgactgctcgacgagaaccgcgacaagctggagatgatggccgacgcactgatgaagtacgaaaccatcgactccgaccagatcgacgacatcatggccggtcgcgtgccgcgcgagccgcgtgactggcagggtggttcgggtaccggcaccccgccggccaacctggaagagtcgggccgccgcgagaatacccctcccatcggtgggccggccggcgagcactga

SEQ ID NO: 10610 - DNA, 852 bp, Pseudomonas aeruginosa
atgagcaatccgcaatacccgacccgactgccttgcggcagtcgggttcttgatttggcccgcccacatgtcatgggcatcctcaatgtcacccccgattccttttccgatggcggccgttacgaccggctggacgatgccctgcggcatgccgagcgcatggtgcgggaaggcgcaacgctcatcgacgtcggcggcgagtcgacccgtcccggtgcgcgcagcgtttctccgacggaggagctggagcgggtcgctccggtagtcgaacgcatcgctcgcgagctggacgtcgtgatttcggtggatacctccacgcccgcggtcatgcgcgaaactgcgcgtctcggagcgggtctgatcaacgacgtccgttcgctgcagcgcgacggtgcgctggatgctgcggtggatagcggcctggcggtctgcctcatgcacatgcgtggagaaccgcagaccatgcaggatgcgcctgcctaccaggatgtggtggcggaagtcggcgcgttcctgcaggagcgtgtgaatgcctgcgtggcggccggaatcgaccgcgagcggctgttgctggatccgggtttcggttttgccaagacactggagcacaacctggtgctgttcaggcatctgcaggcactccatggcctgggcttgccgttgttggtcggcgtttcgcgcaagagcatgatcggcaaggtactggggcgggaggtggacgaacgcctctacggcagcctagctctggcggccctggcgctggccaagggcgcacggataattcgagtgcatgacgtggcggcgaccgtcgacgtgatgcgaatgatctccgccgttgaaatggcggattga

SEQ ID NO: 10611 - DNA, 789 bp, Pseudomonas aeruginosa
catctgcgcccactttgccccgcgaggtacagcatgcgtcgacccttggtggccggtaactggaaaatgcacggtacgcattccagtgtggccgagttgatcaaaggcttgcgtcagctggcgttgccgagcggagtcgatgtagctgtgatgccgccttgcttgttcatcagccaggtcatccagggcctggccggcaaggcgatcgatgtaggtgcgcagaacagcgccgtcgagccgatgcaaggcgcgctgaccggtgagactgctcccagtcagttggcggatgtcggttgtagcatggtcctcgtgggccactcggagcgtcgcctgattctcggcgagagtgacgaggttgtgagtcgcaagtttgccgcggctcagtcgtgcggcctggtgccggtgctgtgtgtcggggagacccgggcggagcgcgaggcgggcaagacgctggaggttgtcgcaaggcagctgggaagcgtgatcgacgagttgggtgttggagcttttgctcgcgcagtcgtggcttacgagccggtctgggcgatcgggaccgggttgaccgcgtcccccgcgcaagcccaggaagtgcacgcggcgatccgcgcgcaactggcagcggaaaatgccgaggtcgcaaaaggtgtgcgactcctttacggcggcagtgtaaaggcggcaagtgcagccgagttgttcggcatgccggatatcgatggggggctggtaggtggagcctccctcaatgcggatgagttcggcgcgatctgtcgtgccgcgggaagctga

SEQ ID NO: 10612 - DNA, 1497 bp, Pseudomonas aeruginosa
aaggcgaggcgtacaatgagcaaagaagtactgctggttgttgagtcggtatccaacgaaaagggcgtaccggccggcgtgattttcgaggcgctggagctggctctggcgaccgccaccaagaaacgtttcgaggacgaggtcgacctgcgcgtcgagatcaatcgtcataacggcagctacgagactttccgtcgttggcacgtcgtcgccgacgaggactaccaggaccccgccaccgagatcaccgtcgaggacgtccaggagcagaagccgggcgcgaaggttggcgaggtcatcgaagaaaagatcgaatccatcgagttcggccgcatcgctgcgcagactgccaagcaggtcatcgtgcaaaaggtccgcgaggccgagcgcgcccaggtggtcgatgcctaccgcgagaaggtcggcgagatcatttccggtaccgtgaagaaggtcacccgcgacaacgtcatcgtcgatctcggcaacaacgccgaggcgctgctggcccgcgaccagatcattccgcgcgagaccttccgcgttggcacccgcgtgcgtgccctgctgaaggagatccggaccgagaaccgcggtcctcaactggtcctgtcgcgtaccgcgccggaaatgctgatcgagctgttccgcatcgaagtgccggaaatcgccgagcagttgatcgacgtgatggcagccgcccgtgacccgggctcgcgcgccaagatcgccgttcgttccaaggacaaacgcatcgacccgcagggcgcctgcatcggcatgcgcggttcgcgggtccaggcggtatccggcgagatcggtggagagcgggtggatatcgtcctgtgggacgacaacccggcgcaattcgtgatcaacgccatggctccggccgaggtggcggcgatcatcgtcgacgaggatacccataccatggatatcgccgtcgccgaggacaatctggcgcaggctatcggccgcagtggccagaacgtccgtctggccagccagttgaccggctggaccctgaatgtgatgaccgaggcggatatccaggccaagcaacaggccgagaccggggatatcctgcagcgcttcgtcgacgagctggatgtcgacgaggaactggcccaggtactggtggaagagggcttcacgactcttgaggaaatcgcctacgtaccgatggaagagatgctcagcatcgatggcttcgacgaagacatcgtcaacgagctgcgctcccgtgccaaggatcgcctgctgaccaaggccattgcgaccgaagagaagctcgccgacgcacaaccggcagaagacctgctcagcctcgatggcatgagcaaggagctggccctggacctggcgctgcgtggcgtaaccacccgtgaagatctggccgagcaatcgatcgacgatctgctcgacatcgacggcatggacgaagagcgtgccggcaagttgatcatggccgcccgggcccattggttcgagtaa

SEQ ID NO: 10613 - DNA, 2535 bp, Pseudomonas aeruginosa
ggagagaagtgcatgacgcaagtcacggtgaaagaactggcccaggtggtcgacacaccggtggagcgcctgctgctgcagatgcgtgacgcaggtctgccgcacaccagtgccgaacaagttgtaacggatagcgagaagcaagccctgctgacccacctgaaaggcagccatggcgatcgcgccagcgagccgcgcaagatcaccctgcaacgcaagaccactaccacgctgaaagtgggtggcagcaagacggtgagcgtcgaagttcgcaagaagaaaacctatgtcaagcgcagccccgacgagatcgaggccgagcgccagcgcgaactcgaggagcagcgcgcggcggaagaggcggagcgtctgaaggccgaagaggccgctgcccgccagcgtgccgaagaggaagcgcgcaaggccgaggaagctgcgcgtgccaaggctgcccaggaagcagcggctactgccggtgccgagcctgccgtggtggcggatgtcgcggctgccgaaccggtggccaagcctgccgccgtggaagaacgcaagaaggaagagccgcgccgcgcgcccaagcgtgacgaggacgatgaccgccgcgaccgcaagcacacccagcaccgtccctcggtcaaggagaaggaaaaggttcctgctccgcgcgtggctccacgcagcaccgacgaggaaagcgatggttaccgtcgcggcggtcgtggtggcaagtcgaagctgaagaagcgcaaccagcacgggttccagaacccgacaggaccgatcgtgcgtgaagtgaacatcggtgagaccatcaccgtagccgagttggccgcccagatgtcggtcaagggcgccgaagtcgtcaagttcatgttcaagatgggctccccggtgaccatcaaccaggtcctggaccaggagaccgcccaactggtcgccgaagagctgggccacaaggtcaagctggtcagcgagaacgcgctggaagaacaactggccgagtccctgaagttcgaaggcgaggcggtcacccgcgcgccggtcgtcaccgtcatgggccacgtcgaccacggcaagacctcgctgctcgactacatccgtcgcgccaaggtcgccgcgggcgaggccggtggcatcacccagcatatcggtgcctaccacgtcgaaaccgagcgtggcatggtgaccttcctggatacccccggccacgccgcgttcaccgcgatgcgtgcccgtggcgcccaggcgaccgatatcgtgatcctggtggtcgcggccgacgacggcgtcatgccgcagacccaggaagccgtgcagcacgcgaaagcggcgggcgtgccgatcgtggtcgcggtgaacaagatcgacaagcccgaggccaacccggacaacatcaagaacggcctggccgctctcgacgtgatcccggaagagtggggcggcgacgctcccttcgtcccggtttcggcgaagctcggtactggcgtcgatgaactgctcgaagcggtcctgctgcaggcggaagtgctcgaactgaaagccactccgtcggccccgggccgtggcgtggtggtcgagtcgcgcctggacaagggacgcggcccggtggccaccgtgctggtccaggacggtaccctgcgccagggcgacatggtgctggtcggcatcaactacggtcgtgtccgcgccatgctcgacgagaacggcaagccgatcaaggaagccggcccgtcgatcccggtcgagatcctcggcctggacggtacgccggatgccggtgacgagatgaccgtggtcgccgacgagaagaaggcccgcgaagtcgccctgttccgtcaaggcaagttccgtgaggtgaaactggcgcgtgcccatgccggcaagctggaaaacatcttcgagaacatgggccaggaagagaagaagaccctgaacatcgtcctcaaggccgatgtgcgcggttcgctcgaggctctgcaaggctcgctcagcggcctgggcaacgacgaagtgcaggtccgcgtggtcggtggcggcgtcggtggcatcaccgagtccgacgccaacctggcgctggcttccaacgcggtgctgttcggcttcaacgtgcgcgccgacgccggcgcgcgcaagatcgtcgaagccgaaggtctggatatgcgttactacaacgtgatctacgacatcatcgaggacgtcaagaaggccctgaccggcatgctcggcagcgatctgcgggagaacatcctgggcatcgccgaggtgcgcgacgtgttccgctcgccgaagttcggcgcgatcgccggctgcatggtcaccgagggcatggtgcaccgcaaccgtccgatccgcgtgctgcgcgacgatgtggtcatcttcgaaggcgagctggagtctctccgtcgcttcaaggacgacgtcgccgaagtgcgtgccggcatggagtgcggcatcggcgtgaagagctacaacgacgtcaaggtcggcgacaagatcgaagtgttcgagaaggtcgaagtcgcacgcagcctttga

SEQ ID NO: 10614 - DNA, 393 bp, Pseudomonas aeruginosa
aaaatggcaaaagactacagccgtacccagcgtatcggcgatcagatgcaacgcgaactggctcaactgatccagcgcgagatcaaggacccgcgcctgggcctggtcaccatcaccggtgtcgaggtcagccgcgacgtggcgcacgccaaggtgttcatcaccgtcatgggccaggacgatgccggcaagatcgccctgaacatggaaatcctcaacgacgccgccggctacctgcgcatgttgctgggcaagtcgatgaagctgcgcagcgtgccgcaactgcatttccactacgacgaaagcatccgccgcggcgccgagctgtccgcgctgatcgaacgtgcggtggccgaagacggccgccgccacggcgacgagaccgaggactga

SEQ ID NO: 10615 - DNA, 576 bp, Pseudomonas aeruginosa
gctgctggactacctgaagggcaaagacgtgtctcgctacactgccctgatcggccgtctgggtctgcgtcgctaagcgacgccggtcggcagcttgaagcaaggagctggaagtctggcgtcgatacccgcacacgaggcgggtatcggcgtcgggcttccagcttcgcgctttctaggaatcgattcgggtccgactcccggcattccaccgatttcccccaaggcaacatagaaggtaaagacaccgtgaacccggtaaccaagcaattccagttcggtcagtcgaccgtcactctcgagaccggccgtattgctcgccaggccaccggcgccgtactggtcaccatggacgacgtcagcgtgctggtcaccgtggtcggcgccaagtcgccggccgaaggccgcgacttcttcccgctgtccgtgcactaccaggaaaagacctacgccgcaggccgtatccccggcggtttcttcaagcgtgaaggacgtccttccgagaagggaaaccctgacctcgcgcctgatcgaccgtccgatccgtccgctgttccccgaaggtttcatgaatga

SEQ ID NO: 10616 - DNA, 1269 bp, Pseudomonas aeruginosa
cgaagaccacctgggcgacatggacttcaaggttgccggtaccgacaagggcgtcaccgccctgcagatggacatcaagatcaacggtatcaccgaagagatcatggagatcgccctgggccaggccctggaagctcgcctgaacatcctcggccagatgaaccaggtcatcgccaagccgcgcgccgagctgtccgagaacgccccgaccatgctgcagatgaagatcgactcggacaagatccgcgacgtcatcggcaagggcggcgcgaccatccgtggtatctgcgaagagaccaaggcctcgatcgacatcgaggacgatggcagcgtgaagatctacggcgaaaccaaggaagccgccgaggctgccaagctgcgcgtcctggcgatcaccgcggaagccgagatcggcaagatctacgtcggcaaggtggagcgcatcgtcgacttcggtgccttcgtcaacatcctgccgggcaaggacggcctggtgcatatctcgcagatcagcgacaagcgcatcgacaaggtcaccgacgtgctgcaggaaggccaggaagtgaaggtcctggtgctcgacgtggacaaccgtggccgcatcaagctgtcgatcaaggacgtggctgccgccgaagcttccggcgtgtaagtcgagtcgtgatcgatgaaaacagggccctcgggccctgttttcgtttccgcgacgcgcttctcggcgaagggggtgaatccttgcattttgcaagccctgccatcgccaattcggcattctgcaaccgtctcgcttccgacctgttttttaacctattgtttttaaaggattttattttagaggaaaactggcacagcgcttgcgatatctactatgcaactgacgccaggaatggctgcagtttttcgaaatccataggagaaaccgcaatgaaattcagcaaactcgctattgccgctgctactgccactgctctgagcttctcgatggccaatgcgttcgctgcccagcccatcagcctggcggccaacgacactatgcagaaaaccgaagaagcggtttccgatacctggatcaccagcaaggtgaaatcaagcctgatcgccaacaagaatgtcagtggcgtcgatatcaaggtcgagaccaacaaaggtgtggtttccctttccggcaacgtgaagagcgatgccgagcgtgacctggcgatcgagaccgccaagggcatcaagggcgtgaaagccgtttccgccgatggcctgaaatcggtcgagtaa

SEQ ID NO: 10617 - DNA, 3255 bp, Pseudomonas aeruginosa
agcaggggggccgccagggcggcgaatcgcttgtgcaaggtatcactcgctatccaggtgcagttgggtgtcgacattacccttgtcttcgccttcggcgaaactgacgtcgatcaagtagatgcgatcgtccggcaactggcctttctccaccaggtaatccttgatccgggtggcccgggcctggccgatctggcgcagcagcacctggctcttggcccaggaagcgatcaccgcttcgcgcatcttcgcggtgcgttcgtcgctgtccagttccttccactcggctggtggctgctgcttcaggcgggtccggtagatgccttcgagcagcggcgcctgcatgttctccggtacctcgagttgcttggcgtcgctcgggaccttgtcgccgcgacgttggagcatgcggtagtaggtgttctggtattccagttcgagacgcttggcgccgatcgagggaccgtcagccgcggcggaggccacgccttccacttccaggcgcagcgccggccgctccttgagcgcatcggcgagcttgtcgaggttggcctgggcttccggcgtcagctcgtcgctgcccgcggcgaagggtaccgtgccgagatcctcgttgccgccggcggcgaggccggcgatgaacttgaacggcgcctgcacggcgcgcaggaccaggttgcgcagggtctgccagacgatcggcatgacgctgaactccgggttgttcagatcgccggccaccggcaactggatatcgatgttgcccttggtgtccttgagcagggctaccgccagcttcaccggcaggtttacggcatccgggctgtcgaccttctcgccgagttgcaggccttccagcaggaccttgttttccgccttcagttggctgcgttcgatctggtagtgcaggtccaggttgagtcgccccttacggatgcggtagccggcgaacttgccggaatagggcgtcagggtggtcagctcgacgcgcttgaagctggtggtgatgtcgagtttcttcagcgggtcgaatgggtccagttcgccggcgatggtcaccggtgcgtacttgtcgaccttgcccttgatgtccaccttggccggctgcgagttgcgcgtgtcgagggtgccgacttcgccgctgagctgctggatggcggtaccgaacggcggcatcagggtcaggtcggcgaagttcgccgagccgttgttgatccgtacgccgccgatgtggatgcccagcggcttgctcgccggcgcgttcttgctttcggcggcggccttgccggacgaactacccggttgcgggatgatcagctcgctgacgttggtgctgcgatcttcgttgatgatgaagcgggcgtagggctcctcgaaggacacgctctggatcgacaggctgtcctcgtgccgataggcgaggccgttgagggtcagcttggtccatttgacgaagtcgcggtccttgatggtatccagggtatgcaactggctgacttcggcgctgccgtcgacgctgaaggccagcggctcgacgctcttcaggtcgaccgccagctcgctgccaaggaagccgctgcgcagttccaggcggatgaacggcgagatgtaggcctgggccacgcgcaggtcgatgtcgcgggtactgaccttgagcctggcgctgaccgggtcgagcaccacctggccgctggcctggacctggccgcggttgccgaggccggtcttgagcttgaggtcgaagggggtcttgccgaggctgtcgacgttctgcaggtcgaggtccagcgggccgacttccagcgggacctcggtggccggctggcgatccaccaggtgcgccttgtagccgcgcagctgggcgtcgcgcaggacgatgtgccagggcttggcgggcgtctccgcggcggctttcgtactttccggcggaggcgtctttgcagtgtcggcgagctgttgcggagagtcgctggctgccttgtcgatttccgcagtcttggccgtttcctgcccggttgccttgccggtcttcggagccttgctcgtctcttgcttggctaccttgtcggcagcgccttccgcgaccttggcggactctttgtcgtccgttgccctttccgtctcggcgacgctggcgtccttctccgccggcctgtccttgcccgcttcgcccgaggctatcacggctgccttggcggcaccgtcggttgccggttcgcgggtggtcttcgccgcgtcggtcggggcagcggcgggatcggtgttttccgccggcttgggtgcaggcgccttgcgtggcggcggagtgaagtcggcgaacagtttctgccagtcgagctggccgtccttctcgcgcgcggcccaggcctccaggccctggctgcggacttcgccgagcaccacttcctgcttggccaggtccagggtggtagcggccacgtcgaggctggcgagcttggccagcggcttgccctggggcgaattgatgctgaagtcggcgagtttcagcgcggccttgtcgagcagcagctgggtgtccttggacaggtccaggcgatagtcgctggagaggctgaccacgccgttctccagcaccagcggggcattgtcgcggacatagggccaccatgccttgagctggatatccttgacgctcacgtggcccctggacgtgatcggcaccagggtcaggtcgccttcccagtcgaggcggccgccgttcgggccggtggcgaccagggtcatcttcgcgccgtcgtcgggcagggtgctgaggttgtgcagctcgaagcccagcggatcgaagctgaagtccaccggctcgctcggtcgcaggtcctggaagtgcaggctgccctcggccagttggatgcggtcgatgcgcagcgggaacgggtcgctcggctgttcaggctcgggcgattcgctcggcgggatcctgaacaggctggccaggttgagctggcccttctcgtcgaacagcagttcggtatgcggaccttccagctcgacgtcggccaggtgcagctggcgtttccacaggctgtccagctgcaggttggcgtacagccggcggaaggcgagctggggtttttctcctcgcccaggcgcagaccccagagggtcaattccaggctgaaggggttgaattcgatacgttcgagacgtgcggggacggtggcgtattgcgccagttgctggttggcgacgcgcagcccgatgccgggtatgagcagaaagcccagcaggcaatag

SEQ ID NO: 10618 - DNA, 471 bp, Pseudomonas aeruginosa
cggactgaacgggaggtcgagcatcgatccggcccattccggcaacagctcggcgcctgcgcgcagcatcagcgcgccgaacggcctggccagggtgctgggcgctggtgcgttgaagagaatccgcaccacttcgcgggtgcgttcgtcgcaacgcaggcgtggacgcatcgcctccaggtaggcggcgatctgctggcggtcgcgcggtaccgcgcgggcgccgaggcgttcggcgaccagggcgatttccgagtagtaacggtcctgctcgctgcccggcaggtcgggattgagatagcgcaggtaggacttgagaaagctgctgacctcggcgacatgcacccaggtcagcaggtccgggtccgctggcggagtaggggcgtgccgtcgggcaactggccgatgacgctttcgtggatgcgccggacccgctcgatcagtcgctcggcatcggccagcgggccgtag

SEQ ID NO: 10619 - DNA, 591 bp, Pseudomonas aeruginosa
ccggtgcgacgcaggcgcccgagcaggtcgtcgcggaaattggagtggtcccacacccccgccagggccagcggatggagcatctgcaggagcagcgcgccgatgccgccgatcatcatgctgctgaagtcgccgtggaccttccagcaggcggcatcggggccgaacaggcccggatcgcctttcggcgactcgaagtcgacaccgccgacggcgagcccggtaaggctcagcacctggctttcgatatggcgacggacgctttccatggggggctcgctacgacagggcaggcacgagcttaacccaggcgccggagagactggaaccgtcccgcgccgcagggcggcgggacggttgcgcgggtcagcggttgaggcggttgtcgatcaacccctgcaccactcccggatcggccagggtcgaggtatcgccgagactgtccagctcgttgcaggcgatcttgcgcaggatacgccgcatgatcttgccggagcgggtcttcggcaggctgggcgcccattgcaggtgatccggcttggcgaagctgccgatctccttgccgaccagggccagcaattcctgttgtag

SEQ ID NO: 10620 - DNA, 429 bp, Pseudomonas aeruginosa
cgcctcgctgggctgactgccggccatcagggtgacgaacgcgtagatggcctggcccttcacgtcatgcgggcagccgaccactgccgcctcggccaccgcatcgtgcaggaccagcgcgctctcgacctcggcggtgccgatccggtgtccggagacattgatcacgtcgtcgacccggccggtgatccagtagtagccgtcctcgtcgcggcgcgcgccgtcgccgctgaagtaatacccggggtagggcttgaagtaggtgtcgatcatccgctggtggtcgccgtagacgctgcggatctgactcggccaactggccttgatcgccagtacgccgctgcccgcgccgtcgatttccttgcctttctcgtcgagcagcacgggttgcacgccgaagaacgggcgggtagccgagcctggctttag

SEQ ID NO: 10621 - DNA, 561 bp, Pseudomonas aeruginosa
cgcagtggcgccgggcaacggggtgatcaggatgctgccggtctcggtctgccaccaggtatcgacgatggggcagcgcttctcgccgaccacctggtagtaccactcccaagcctccgggttgatcggctcgcccaccgagccgagcaggcgcaggctgctgcgcgaggtctggcggaccggggcgtcgccttcgcgcatcagcgcgcggatcgcggtcggcgcggtgtagaagatattcacctggtgcttgtcgatcacctgccagaagcgcgaggcgtccgggtagttgggcacgccctcgaacatgagggtggtggcgccgttggccagcgggccgtagacgatatagctgtgtccggtgacccagccgacgtcggcggtgcaccagtagacgtcgccatcgtggtagtcgaacacgtacttgtgggtcatcgccgcgccgagcaggtagcccccggtggtgtgcaacacgcccttcggcttgccggtgctgccggaggtatagaggatgaacagcgggtcctcggcgtccatcgcttccgccgggcagtcggctga

SEQ ID NO: 10622 - DNA, 1065 bp, Pseudomonas aeruginosa
ggccgcgtggagcgcctcgtggtaccagatgtcgcggccttcgacccagggtatgtcgccctgggtgcgctcgaccaccaccacggtagagacgtccgggcagtccttcagtgccttttccacattctgcttcagcgggatgtacttgccgccgcgcacgccctcgtcggcggtgatcacggtgcggcagtcggcatcgaggatgcggtcgcgcagcgagtccggcgagaagccgccgaacaccaccgagtgcaccgccccgatacgggcgcaggcgagcatggcgtaggcggcctcgggaatcatcggcatgtagatgcagacccggtcgcccttttccacgccgcggctcttcagcacgttagccaggcggcagacgttgtggtgcagcttgcggtaggtgatgtgcgcggattcgctggggttgtcgccttcccagacgatcgcgatctgttcgccgcggcgttccaggtggcgatcgatgcagttgtaggcgacgttcaactggccgcccttgaaccaggtggcctggcctttcctcaggtcgccgtggtggacgctgtgccagggcttgaaccaatcgaggaaggccttggcctgctcgccccagaactcgtcggggttctcgacggattggcggtacaggcgctggtagtcgtcgtcgttcaggtaggcacgctggcggacggcgtccggcaccgggtggacgctgatctcgaacatggcggtttcctttgtttttctgctccgcaaggtgtcgagagaccgcacgcggcccctctccaggttcgaccaagggtgggccaggcgagagccatgttcaagtgccaaaggcgcgagcggggaaggcgccggggtcaatcgccggacggaatgaaaaagcccggcctagagccgggctttggggagaggcggatcagccgcgatggcggccgcggaagaagtcgatcaggccttgggtcgaggcgtcctcggccggggtttcctcgctgccgaccaggcgcgaatagacacccttgccgagttccttgccaagctccacgccccattggtcgaaggcgttga

SEQ ID NO: 10623 - DNA, 534 bp, Pseudomonas aeruginosa
aaaagcccggatgaaaccgggctttatccagagagggcgaggtcaggcgacctgtatcggaatcgcctcgctggtatggctgagctggttgcccggcgccatgtacagcatgcgcggcttgtggctggccagttcggcttcgctgtagtgtgcgtaggcgcagatgatcacgcggtcgccgaccttggccttgtgtgccgcggcgccgttcaccgagatcatcttcgagccgttctcggcgcggatcgcataggtggtgaagcgctcgccgttgtcgacgttgtagatctggatctgttcgtactcgcggatttcggagaggtccagccaatcgccgtcgatggcgcaggagccttcgtagtcgaggacggcatgggtgacttcggcgcgatgcaacttggctttgagcattatggcgtgcatggggcgactcctatcgggtccgcggggggcggcagagtatggcgagtccgtggtgagcgctcaagcccccgggaaccgggggctcggcatgcgtcaatcgaggtggactga

SEQ ID NO: 10624 - DNA, 891 bp, Pseudomonas aeruginosa
gaggttgtcgatcagccgcgtactgcccaggtaggcggcggccaggatcaccagttggcggtcgccgggtaccccggggcgcaggctgatcggctcgcggatttccaggtagtcggggcgcagcccggcctgttccagggcctggcgggcgtcggcgagcaatgccgggaagtcctcggcgccggcgcggatgcgttcgccgagctgccgcagggtgcggtagatcgccggggcggcggcgcgctgctgctcgtcgaggtaaccgttgcgcgaggacaacgcgaggccatcggcggcgcgcaccgtcggctcgccgaagatctgcaccggcaggttgaggtcgcggaccagcttgcggatcaccgccaactgctggaaatccttttcgccgaacagcgcgaggtccggctggaccatgttcagcagcttgctgaccacggtcgccacgccttcgaaatggccgggacgactggcgccgcaaaggccttcggagacgccgggaacatggatgcgggtctgcccgtccatgccgtcggggtacatttcctcgacggtcggggtgaacagcaggtggcagccggcttcgagcaggcgttcctggtcggctgcgagggtccgcgggtatttgtcgaggtcttcgctggggccgaattgcagcgggttgacgaagatgctgacgaccacgaagtcggcgcgttcgccggctttctttaccagcgcggcatggccggcgtggaggttgcccatggtcggcacgaagccgatgcgcttgccttcgctgcgggcgcgcgccaccgcggcgcgcagttcacggacggtcttgacggtgttcatgcgttgaatccgtgttcggcggcggggaaggacacgtccttgacggcgcggacatag

SEQ ID NO: 10625 - DNA, 540 bp, Pseudomonas aeruginosa
gccgcgatggcggccgggatgctctcctggccttgcatgaaatccttgacgaacttgggcgagcggccggtcagcgagagaccgagcatgtcgtgcatgaccagcacctggccatcggtcgccgcaccggcgccaatcccgatcaccgggatcttcaccgcctgggtgatctcttcggccagcacgctgggcacgcactccagcagcagcatggcggcgccggcctgctccagggcgatggcatcggcgcgcaactggcgcgcctgggtttcctggcggccctggaccttgaagccgccgaacaggttgaccgcctgcggggtcaggccgagatgcgcgcagaccggcacgcccatctgtgccaggcgggcgatcggctccgccagccaggccccaccctccagcttgaccatgtgtgcgccggcctgcatcaggcggaccgcgtcggcaagggtctgggccacggaatggctggattcgaaggccaggtcggtgacgatcagggaacctttgttaccgcgtttcacgcaggccgtgtga

SEQ ID NO: 10626 - DNA, 627 bp, Pseudomonas aeruginosa
gaagaggtcatggcgcgagcggtgcggcggggaacggcggaaacgaaacggggcgccttggcgccccgtcggtccggctcaggagccgagttgcttctcgcggatttccgcgagggtcttgcagtcgatgcagagggtcgcggtggggcgcgcctccaggcgacggatgccgatctcgacgccgcaggagtcgcaccagccgtactcttcgtcttcgatcagttgcagggtctcgtcgatcttcttgatcagcttgcgctcgcggtcgcgggcgcgcagttccaggctgaattcttcttcctggctggcgcggtcggccggatcggggaagttggccgcttcgtcctgcatgtgatgcacggtacggtcgacctcttccatcagctcctgtttccatttgttcaggatcgcggtgaagtgcgcgcgcatgcgctcgctcatgtactcctcgcccttggtttcctgatagggttcgaagccgcgggtcatctgctggctgctctgttgttttgctttggtggacatgaatggccgcctctcactttcgctaatcctgtccgcggcagggttccctcgccggctctccggccccgcggtcgcaagcgggcgaacttaccagaacgataa

SEQ ID NO: 10627 - DNA, 1206 bp, Pseudomonas aeruginosa
aatcggtttttcctcgcaaagttcggaatatccatggctacctcctatagcgcgcgcagtcgggccatcgagcctttccatgtcatggccctgctggcgcgggccaacgagttgcaggccgccggccacgatgtgatccacctggagatcggcgagccggacttcaccacggccgagccgatcgtcgaggccgggcgcgccgccctggccgccgggcatacccgctacaccgccgcccgcggcctgccggcgctgcgcgaggcgatcgcgaaattctacggcgaacgctacggggtcgacctcgacccacagcgcgtgctggtcactccgggcggttccggagccctgctgctggccagcagcttgctggtcgaccccggccgccactggttgctcgccgacccgggctacccgtgcaacaggcatttcctgcgcctggtggaaggcgccgcgcaactggtgccggtggggccggacagccgttaccaactgacaccggatctcatcgagcggcactgggactcagacagtgtaggcgctctggtggcgacgccggcgaatccgaccgggaccctgctcgatcgcgacgaactggccggcctgtcgggcgccttgaaggcccgcggcgggcacctggtggtggacgagatctatcacgggctgacctatggcgtggacgccgcgtcggtgctggaagtcgacgacgacgctttcgtcctgaatagtttttccaagtatttcggcatgaccggctggcgcctgggctggctggtggcgccggcagcggcggtgcctgagctggagaagctggctcagaacctctacatcagcgcgccgagcatggcccagcaggccgcgctggcctgtttcgcgccgaccaccatcgccattctcgaagagcgtcgcgaagagttcgcccgccgtcgcgacttcctcctgccggccctgcgcgagctgggtttcggaatcgccgtggagccggaaggcgccttctatctctacgccgatatcagtgcgttcggcggcgatgcctacgccttctgcaagcacttcatcgagaccgagcacgtggccttcactccggggctggatttcggccgccaccaggccggccaccacgtgcgtttcgcctatacccagaacctgccgcgcctgcaggaagcggtggagcggatcgcccgcggcctgcaggactggcggccctga

SEQ ID NO: 10628 - DNA, 528 bp, Pseudomonas aeruginosa
gcgttggcgtccggacggacgctccgcccaggttttctgcagtacctcatcatgaaacgctcgaaactcgcactccttccgctgggcctggcgctgctgctggccgcctgcgccagcgatccgctgccgatcccgcagcacagcttcggggtctatgccaccgccagcacgccttccgcggcgttccgcaccctggccgacccgcagggcaaggccatgctggtggcgctgaagcccagcctgacccaggctgacgtactccgcgccgaggtcctgtacgaccagaacggtcgacccggcgtcgaagtcaccttcaccgaaccggccgcccgccgcctggccgcgctgaccggcgaggcccgggggcgcactctcgcggtactggtggacgggcgcctgcgcctggcgccgcgggtgcgcgagccgatccgcaacggtaaggtctatctcgacgggttggcttcggcctacgaggccagggaactggccgatcagttgaatgcgctgggaagccagccggggcgctaa

SEQ ID NO: 10629 - DNA, 1041 bp, Pseudomonas aeruginosa
gcgcccggctggcggcgaggctcagagcgtctgggccttgaaggtatcgcaactggccggcgagccgctctcgaagccggtcttgaaccagcgcatgcgttgcgccgaggagccatgggtgaaggagtccggcaccaccatgccgcggccctggcgttgcaggcgatcgtcgccgatggcgttggcggcgttcagggcttcctcgatgtcgcccggctccagccagttcagccgctgctgtgcacggttggcccaaaccccggcgaagcagtccgcctgcagttcctggcgtaccgacaggccgttggcgccctccatgcgcgcgccgcgctggcgggctgcgttgatcttggccgagatgcccatcaggttctgcacgtggtggccgacctcgtgggcgatcacataggcctgggcgaagtcgccggcggcggagaagcgctgttccatctcgcggaagaactccaggtcgaggtagacccggcggtcggccggacagtagaacggcccagtggccgacgaggcgaagccgcaggcggaattcaccccattgctgaacagcaccagcttgggctgttggtattgtgcctggccgctggcgaagatctgttcccaggtgtcctcggtgtcgccgaggatcgagcggacgaactcgctctgctcgtcattggccgccggggcccgaccgccggcctgctgctgggtggccggcgccgggctgtccatctggccgagcagcgacccgaggatctgcatcgggtcctggcccatcagcaggccgaccaccaccacgatggccaccccacccaggctgaggcccttgccgccgatgcgcatgccgccaccgccgcctgcgcctccttcgccccgggcatcaatcacgttgtcactgcgtcgtcctttgcgccagagcatggcggttctcctgtacgtttcgcttcttcagtgttgtcgtcgtccgccgccagcgccaccccgaccgtcaggccgaggtcagcagctcggcgcgggcgagcagttggacgtggccgccgaccctga

SEQ ID NO: 10630 - DNA, 540 bp, Pseudomonas aeruginosa
tcgggtagtagaactcgcgggtcgcctggtcggtcttcgccaactggtagttcaggctccactggatgcgatcggcgaccgggctgtcgagcaggaaatggtgctccaggccgtagcgctcgcgagtcagggtgtcgttgcccttgcgccactggtacatgccgcccggcagcatgctcggcgggatggccggcttgcccttgtcgtacgggccgccataggcgctcttctggtcggtatcgacgtcgctcttgtacttctcgaagaccagcccgaagcggctaccctcggcgtagttccagcccagcttgccgagcaggctgtagctgtcggcgtcttccgggttggcttcgctgcgcgagagcccggtgccgccgtggccgccgttggattcggtctcgtggccctggcggtagccataatgcagcaggccgtcgaagtcgtcggcgcggccggcgacggtggccgaggtcagccaggagtggctggccgactcgtagccggccttcagccgggcgccgacgtccttgccgtccttga

SEQ ID NO: 10631 - DNA, 1296 bp, Pseudomonas aeruginosa
gcaacagcagggccaggcaggggcgcagggcgaagggcggggagagcggcatgtgggactccttgggtcgggccggtggcgaatagccagggggacgtcgggcgcacaaggtactgccagaaaaacgttaatgcaaataattatcaaatggattcagatatgcgttttgtggcaaagttcacctgttttgcgcgtagcgcgaccgaaccggatatgcccgaggaaccgtcgatgagcagcactcccagcctttcccattcccctgccgagctttaccgcgcctggcaggacctgcgcgccgagcgaccgcagctacgcgcgcgcgacgccgccgcgctgttgcaggtcagcgaaggcgagctggtcgccagccgggtcggcatcgatgctgtgcgcctgcggccggactgggccgccttgctgccggcgctcggcgaactggggccgatcatggcgctgacccgcaacgagcattgcgtccacgaacgcaaggggccgtatcgcgaagtgacggtctctgccaatgggcagatgggcctggtggtctcgccggatatcgacctgcgcctgttcctggggggttggaacgctgtcttcgccattgccgaggagacagcgcggggtacccagcgcagcatccaggtgttcgaccagcagggcgtggcggtgcacaaggtgttccttaccgaggccagcgacgtccgcgcctgggagccgctggtcgagcgcctgcgggctgccgagcaggatgccgtgctggcgctgcacgaaccccgcgcaccggctgcgacgctcgtcgatgcgcagatcgatgccgccgccttgcgcgaaggctgggccgcgttgaaggacacccatcatttccacgccctgctgaagaagcatggcgcgcagcgcacccaggcgctgcgcctggctggcggcgaatgggccgagcgcctggacaatggcgacctggcgaaactcttcgaagcggcggccgaaagcggattgccgatcatggtgttcgtcggcaacgcccactgcatccagatccataccgggccagtgtgcaacctgaagtggctggacgactggttcaacgtgctcgatccggaattcaacctgcacttgaagaccaccggcatcgccgaactttggcgggtgcgcaagccgagcaccgatggcatcgtaaccagctgggaggccttcgacgccgacggcgaactgatcgtgcaactgttcggcgcgcgcaagcccggcgagcccgagcgcgacgactggcgcgaactggccgaatccttcaaggcgctctga

SEQ ID NO: 10632 - DNA, 903 bp, Pseudomonas aeruginosa
ggagagatcatgcgtatcgatcgactattcaacgggttggcgctgggcatcctgctcggcaccggcatggcccaggccgccgagctgccgcaacgctgggtgagcgcgggcggctcgctgagcgaatgggtggtggcgttgggcggcgagagcaagttggtcggggtggacaccaccagccagcatccgcaggcgctgaaacagttgccgagcgtcggctaccagcgccaactggctgccgagggcgtgctggcgttgcgtccggatatcctcatcggcaccgaggaaatggggcctccgccggtactcaagcagctcgaaggcgccggcgtgcgagtcgagaccctctccgccaagccggatctggaggcactggaaagcaatctgaagaagctcggcgactggctcggcgtgccccagcgcgccgaggccgccgaacttgactatcgtcagcggctgcggcgccaggcggactggatcgcggccgcgcagaagagccagccggccccgggcgtcctgctggtgatcggcaacgccggcggtcagttgctggtagccgggcgcaataccggcggcgattgggtcctgaaccgggccggagcacgcaacctggctacccatgagggttacaagccgatctcggtggaagccctggcagcgctcgatccggtcgcggtggtgatcgccgaccgcagcctcgaaggtgatgcggcgcgtgccgcgctgctcaagcagaaccccggcctcgccgcaacccgcgcggcgcgtgacggacgactgctggtgctggacccgacgctcctggtgggcggcctcggtccgcgcctgccggatggcctggcggctctctccgcagccttttatccttccgcgaaaccgctgagtacggaagccgcccattga

SEQ ID NO: 10633 - DNA, 594 bp, Pseudomonas aeruginosa
tcggcgcgccgttcttcctttatctgctattgcgggggcgggcctgatgctgcgcgtggagaacctgtccatccgccgtggcggaaagactgtactggaaggcctcgagctggagctgcggcctggcgagatgctcggcgtactcggccccaacggcgctggcaagagcaccttgcttggcgctctctgtggcgaactggagccggccgaagggctggtgctgctcgacgagcgcggcctcgacgactggccgggcgtcgctcgcgcgcagcgcctggcggtgctgccgcagagttcgtcgctgggcttcgcctttccggtggaggcggtggtcggcttcggtcggctgccccattccagcggccgcgagcgcgatgtgcagatcgtcgccgaggccttggcggcggccgacgccaggcatctggccgggcgcagctacctggcgctgtccggcggcgaacgccagcgcgtgcacctggcgcgggtgctggcgcagctgtggccgggcgagccggggcaggtgctgctgctcgacgaaccgacctcggcgctcgacccgctgcaccagcacactaccctgcaggcggtgcatga

SEQ ID NO: 10634 - DNA, 759 bp, Pseudomonas aeruginosa
tcaggcttcggcgaagcctgcgcccgtcgtttcgccgaggccggctggtcgctggtgctcaccggccgtcgcgaggagcgtctgcaagccctggccggtgagctttcggcgaagacccgggtgttgccgctgaccctggacgtgcgcgaccgcgcggcgatgagcgcggccgtggacaacctgccggaagagttcgccaccctgcgcggcctgatcaacaacgccggcctggcgctgggctccgacccggcgcagtcctgcgacctggacgactgggacaccatggtcgacaccaacttcaagggcctgctctacagcacgcgcctgctgctgccgcggctgatcgcccacggcgccggggcgagcatcgtcaacctgggttcggtggccggcaagtggccctatccgggtagccatgtctacggcggcaccaaggctttcgtcgagcaattctccctgaacctgcgtggcgacctgcagggcacccggggtgcgcgtgaccaacctcgagccggggttgtgcgagagcgatttctccctggtccgcttcggcggcgaccaggcgcgctacgacaagacctaggccggatcccatccgatccagccggaagacatcgccgagaccatctgctggatcaggaaccagcccgcccacctgaacatcaacagcctcgagatcatgccggtgagccagtcctgggccggcttcgccatccaccgcgaaagctgaccggcggaggcggccggggcacgctatga

SEQ ID NO: 10635 - DNA, 798 bp, Pseudomonas aeruginosa
tgccccggacgtcccgatcgaataagcgaattccatgagcaaaccgggccaacgcgtgctggccgagctacgcaagctgatcgcttccggcgaactcgccgccggcgagcgcatcgtcgagattcccaccgccgaacgcctgcaggtctcgcgcatgccggtgcgcatcgccctgcgtaccctcgagcaggaaggcctgctgtgcaagaccgggcgcggctacagggtgcgggcggtgacccgcgaggatatcgccggcgcggtcgaggtgcgcggcgttctggaaggcctggcggcacgccaggcggccgagcgcgggctgtccgccgaggcacgggcgaccctggaggaatgcctggccgagggcgaccgattgttcgccaacggccaggtcctgctggaggagctggagcgctaccagcgcatgaacatgcgtttccaccgcaccatcatcgaggccagcggcaacccggcgatcgccgtggcgctggcgcgcaacgaccacctgccgttcgcctcggtgagcgccctggcggtggatcgcgacaatctcgagcaggaattccgccgtttcaacttcgcccacatgcagcaccacgcggtggtcgacgcgctggtcaacggccaggggggcgcgcgccgaggcgatcatgcgcgagcacgccaacgcgaccctgcgctacgccgactacttcgatccggagcggcagggtgtcaccgtgcttcacggcgacgtcgccgccgactagagatccagcaccagccgtgggctgcgcgaacgcgaacagcagggcgtga

SEQ ID NO: 10636 - DNA, 240 bp, Pseudomonas aeruginosa
agcccgccggcccgcaaaggtatagctgggcgtcgcgcggactggtcgccagcagggcgcgaaggtccgcgcgccggctgctttcgccgtggtcgaagtggcagtgcacgcggtcggcgaaggcgcaccggccaaggtagtcgacgaaggccgcgcgctcggcggaatgcgcgcagtagtgcaactggaagtcggcgccatcgcgggccaggcgttcggccatcgccagcagcggcgtga

SEQ ID NO: 10637 - DNA, 1506 bp, Pseudomonas aeruginosa
ccgcctcgcccggttgctttgcgttgcccagcgacgtaccacgctgctgctctgggcgctgtttttcctggtgatgttcggcttctacttcatcatgagctggacgccgaagctgctggtcgccgccggcctgtccaccgcccatggcatcaccggcggcaccctgctgagcatcggcgggatcttcggtgccgccttgctcggcgggcttgccgcgcgctttcgcctggaacgggtgctggcgctgttcatgctgcttaccgccgctctgctcgcgctgttctcgctgagcgccgggctgcccggcgcggccttgccgctgggactgctgatcgggctttgcgccaacgcctgcgtggccggcctgtatgccctggcgccgagcctctacgacgcttcggtgcgtgccaccggggtcggctgggggatcggcgtcggtcgcggcggggcgatcctctcgccgctggtggccgggctcctgctcgacgacggctggcagccgctgtccctctatggggcgttcgcggcggtgttcgtcgtcgcggccgccgtgttgccgctgctcggtgcgcggcgtcgcgagcgctcgccgacgctgggagacgctgcgtgagggccgccggcgtttcagcgttgggcggcgatgatcgcctcggcgatggtggtgcggaaccagttcagcgccgccgagcgttcgctgctctcgtgccagtgcagggagacgtcgaacggcggcagggtgaagggcagttcgagcatgcgcatgccgccttcggcgacgaagcgataggcgatctgcgccggcaggatggtcagcagctcggtaccgggaatgatcttcggcagcaccgagaagtgcggcacccgcaggctgatgcggcgctgcacctgcatggcctcgagcacgtcctcggcgatgccgtggccggaggtacgggtcaccacgatgtgccgctcggccaggtactgctccaggctcaggctgtcgccgatccgcgggtggcggtcgctgagcaggcacacgtagcgctcgtgcaggacccgctggctgcgcgcgccgggcaccggctggcggcagatcgccgcgtcgaccttggcgctgctcagccaggcgccgacctcgtccacctgcagcggcagcacttccacttcggcgaacggcgcgtcgcgggtcaggcgttcgaggatcagcgagaggaaacccacttcgccgagatcggtgagggcgatgcggaaacgtcgctcggtggtcgccggatcgaagtggcgaacgctctgtaccgcgccctcgatgcgcgtcagcgactcgcggaaggtgccgtagagctgctcggcgacgaaggtcggctggatgccgtcgcgggtgcgggtgaacaacgcgtcgtcgaacagttcgcgcaggcgctccgcggcgagggtcacgctgccggcttcgtagagggtgacgaaggtgcggatcaggttgagatcgatcggactcatatagaccagttctattttttatag

SEQ ID NO: 10638 - DNA, 1095 bp, Pseudomonas aeruginosa
ccccctggtcatcaccgccgggcagcaggtgcgctcgatgatcggggtcgaggcgatgctcgccaacgtcgatgccggacaactgcccaagccgctggtgaaatggagccacgagccggcctgcgcccaggatgtaccgcgcgcgctgagccaggcgatccagaccgccagcctgccgccgcgggcgccggtgtacctgtcgattccctacgacgactgggcgcaaccggcgccggccggcgtcgaacacctggctgcgcgccaggtcagcggcgccgcgctgcccgcgccggcattgctggccgaactcggcgagcgcctgtcgcgctcgcgcaacccggtgctggtgctcggtccggacgtcgacggggcgaatgccaacggcctggccgtggaactggcggagaagctgcggatgccggcctgggtcgcgccgtcggcctcgcgttgtccgttccccacccgccatgcctgcttccgcggcgtgctgccggcggccatcgccgggatcagccggctgctggacggccacgacctgatcctggtggtcggcgcgccggtgttccgctatcaccagttcgcccccggcgattacctgccggccggcgccgagctggtgcaggtcacctgcgatcccggcgaagcggcacgggcgccgatgggcgacgcgttggtcggcgacatcgcgctgaccctcgaggcactgctcgaacaggtccgccccagtgcgcggccgttgcccgaggcgctgccgcgaccgccggcgctggccgaggagggcggaccgctgcgtccggaaaccgtgttcgacgtgatcgatgcgctggcgccgcgcgacgccattttcgtcaaggagtcgacttccaccgtgaccgccttctggcagcgcgtggagatgcgcgagccgggcagctatttcttcccggccgccggcggcctcggcttcggcctgccggcggcggtcggcgcgcaactggcgcaaccgcggcggcaggtgatcgggatcatcggcgacggctcggccaactacggcatcaccgcgctctggagcgccgcgcaataccgcgtgccggcggtgttcatcatcctcaataa

SEQ ID NO: 10639 - DNA, 1473 bp, Pseudomonas aeruginosa
tcgcccggttttgatcgaggtgccgacgcaaaccatcgaaccctgatgttccacggcgccgccccatgccagagtgggcggtgccgaccgacgcccgcgtgcgcccataacaagaacaagagagaggttggtatgaacaggcaatccgctgcggcggtgatcgacgctgcccgctttaaccgtactcactggctgatcctcggctgggggtgtttcatcatgctgttcgacggctacgacatggtcatctatggctcagtggtgccacgcctgatgcaggagtggcagctgagcccggtgcaggccggcaccctcggcagttgcgcgctgttcggcatgctcttcggcggcaccctgctggcgccgctggcggaccgtttcggccggcgccgcctggtgatcgccaccaccctgctggcgagcctcgccgccttcctcaccgggcacgcccgcgacccgctggaactgggcgccggacgcttcttcaccggcctggcactgggcgcgctggtgcccatcgcgatcaacctgatcagcgaattcgccccggccgggcggcgcagcaccctggtcacggtgatgtcggccttctactcggtgggcgcggtgctctcggcgctactggcgatcgccatgatccccgcctggggctggcaatcggtgttctacgtggcggtgctgccggtgctggcggtgccgctgatgttgcgctggttgccggagtcggcggcgttcctcgaactcaagggccgccgcgccgaactggacgcgctgctgcgcaaggtcgatcccgactaccggcccggcgccgagcgggcgaacgctgtcgcggccgaagcgccgagcggacgggtcgcccagttgttcgaggggcgccaggcagtgggcaccctgctgctgtgggtggccttcgccatgtgcatgctgatgagctacgggctcaacacttggttgccgaaactgatggccggcggcggctacgctctcggttcgagcctggcgttcctcgtcaccctgaatgtcggggcgaccctcggtgcgttgttcggcggctggctggccgaccgccttggcgccggccgcaccctggtgctgttcttcgccctggccgcggcctccctcgcggccctcggcctggggccaggcccctggctgctcaacggcctgctggtggtggccggcgccaccaccatcggcaccctggcggtgatccatgcctacgccgcgcagttctatccggcctgggtgcgctccaccggggtcggctgggccgccggcgtcggccgcctcggcgccatcgccgggccgatgctcggcggcagcctgctggccctggagctgccgttccagcagaacttcctggccttcgccgcgcccggcgtgatcggcgcgctggcgatcgcctgcatccacctgcggccgcgcgtgccggcggaagcgtccgtcgacgcgacggcgaagaaacccctgtga

SEQ ID NO: 10640 - DNA, 1176 bp, Pseudomonas aeruginosa
ttttcgaaagaggagaagagcgatgagcgattcccgttataccgacctcggtctccagcccctggccggcgagtggcgccacggccgggccggccgccggctgaaggtgagcaacccgttcgacggcagcctgttgctggagatcgagcaggccgaccgcgacgacctcgatgccgcctacgccaaggccgccgaggtccagccggcatgggccgcgctcgggccctcggcacgcgcggcggtactgtacaaggcggtggaggtgttcgaccgccgccacgaggagatcgtcgactggatcatccgcgagtccggcagcacccgcctgaaggccgagatcgaatggggcgcggcgcgcgcgatcaccctggagtcggcgtcgttcccggcacgggtgcacgggcgcatcgtcgagtccgacgtgccgggcaaggaaagccgggtctaccgcagcgccatcggcgtggtcggggtgatcagcccgtggaacttcccgctgcacctgacccagcgttccatcgccccggccctggcgctgggcaacgcggtggtggtcaagccggccagcgacacgccggtctgcggcggactgctgctggcgcggatcttcgaagaggccgggctgccggccgggctgttcagcgtggtggtcggccccggcagcgagatcggcgacgccttcgtcgagcacccggtgccgggcctggtgaccttcaccggatcgaccccggtgggccgcaacatcggccgcatcgccagcggcggcgcgcatctcaagcacgtggcgctggagcttggcggcaacagtccgttcgtggtgctcggcgacgccgacctggagcaggcggtgaatgccgcggtgttcggcaagttcctccaccaggggcagatctgcatggcgatcaactgcatcatcgtcgaggacagcctctacgacgctttcgccgcgcgcttcgtcgagcgggtcaagggcctccgggtcggcgatccgcagcgcgccgataccgcggtcgggccgatcgtcaacgcgcgccagctcgaaggcctgctggaaaagatccgcctggcccgccaggaaggcgccaagccgctgtacgagggcggcgtcgatgggcagttgctggctccgcacgtattcggcgaggtcaccgcgacgatggagatcgcccgcgatga

SEQ ID NO: 10641 - DNA, 1329 bp, Pseudomonas aeruginosa
cccgaccgtcgtcgccaggtggcccgcagaggctgccggggcccggtcgtccctgaaaaacggagcacaataacaatgaaaatccgtcgtaaaaccgcagtcccgcgcaatgcaggggcggtcctgccgatgctcgcctgtcttgccgcgcaagctgccgagggcggcttcctggaggatgcgaagaccgacctggtcctgcgcaactattacttcaaccgcgatttccgcgaccacgatgccggcaagagcctggtggacgagtgggcgcagggcttcatcctcaagttcagttccggctataccccgggcacggtcggcgtcggcctcgacgccatcggcctgttcggcgtgaagctgaacagcggacgtggcaccagcaattccgagcttcttccgttgcacgatgacggtcgcgcggcggacaactatgggcgtgtcggcgtggccgccaagctgcgcgtttcggccagcgaactgaagatcggcgagatgctcccggacattccgctgttgcgctacgacgacggacgcctgctgccgcagacgttccgcggcttcgccgtggtttcccgcgagctgccgggcctggctctgcaggccggacgcttcgacgcggtgagcctgcgcaattcggcggacatgcaggacctgtcggcctggagcgcgccgacgcagaaatcggacggtttcaactacgccggcgccgagtaccgcttcaaccgcgagcgcacccaactgggcctgtggcacgggcaactggaggacgtctaccggcagagctacgccaacctgctgcacaagcagcgtgtcggcgactggaccctgggcgccaacctcggcctgttcgtcgaccgcgacgacggcgccgcgcgcgccggagagatcgacagccataccgtctacggcctgttttccgccggcatcggcctgcacaccttctaccttggcctgcagaaggtcggcggcgacagcggctggcaatcggtctacggcagcagtgggcggagcatgggcaacgacatgttcaacggcaacttcaccaacgccgacgaacgctcctggcaggtgcgctacgactacgatttcgtcggcctcggctggcccggcctgatcggcatggtccgctacggccatggctcgaacgccaccaccaaggccggtagcggcggcaaggaatgggagcgcgatgtcgagctcggctacaccgtgcagagcggtccgctggcgcggctcaacgtgcgcctcaaccacgccagcaaccgacgcagcttcaacagcgacttcgaccagacgcggctggtggtgagttatccgttgtcgtggtga

SEQ ID NO: 10642 - DNA, 1254 bp, Pseudomonas aeruginosa
ccgctgggcggttattcgccctaccggagcggcgctccgccgacaacgcctggagggggagagggcggctcagaacttcgcctgcatccccacccgcagggtacgcccgggcgcgggcatgaaactctgtgccagcgggtcgaggtaatagcggtcggtgaggttctgcagcgaggcattcagttcggtgtgctcgaacagcttgtacttgaggaacaggtcgaacagctgcaccgagcggtactcgatctgcggtgtggtggcgccgacctgccagggcttgtccgccgtggcggtggggccggaggtataggtcatgcgtccgcccagggtcagggcctggtcgaagaagcgcaggccggcggtcaggttggtcgccagccgcggcgggttctgcgtgttggtataggagcccatgaagctgcccggcgtgcagttcggcgtgttctcggtgcgctggtagcggttggcgccggcgcgcagcctggcggcgaaggcggcgtcgcaggtctcggtcttcaggtagtaggtcgccgacaggtcggcgaacacccgccctgcgtcgtagtgcgattgcagttcgagaccgctggtgcggtagctgtcggtgttgctgaaggtcatcaggcccatctggcccggatcgtaatagcgggtgatgtagttcttgatggtgttgttgaagtaggccagcttgatcgccgccgagtcgccgtcggccaacaggctgtcgcgcagcgcgctggcaccgatctcccagctgcgcgaacgctcgggcttgaggtccttgcccggctcgacctggagggtgccctggctggtctcgaacagcgacggcagacgcaggccttcggtataggaggcgtagacgaaggtatccggggccagctcgaaattgatcccgaatgccggcgagaaaccgccgccgcggctgctgcccttcttgctgtagttgtagccggtgaccacgttggtgacccgcgagggatggactgtcacgttggccgggccgaactcgtcgaagggaatgccttcgaacggattgttggtgttgttggtgacgatgccgttgttgaggcggggatcggtggcgtcggtgtactggccgttctggtcggggaaccacatcatcgagccgtagtagccgggcctgctcaccgtgatgaagcgcatgtcgcgatcctcgcgccgcggcgaggcggagatgccgttgtccttgctgttgaagtggctgtagcggccgccgccccatag

SEQ ID NO: 10643 - DNA, 1746 bp, Pseudomonas aeruginosa
cgtcaggcgctcgaccggcttgaactcgagcttgccgttgaggccgtattcctggcgggtggcgtccctcagggtgcggttggcgttgatgtcgtggagggtggtgaccacgcttttctgcggctggatgtcttcgacctggaacgagccgccgaggtcgagcttgaaatcgccgaagtcggtttcgaagcgcgccacgttgttcaggtcgccgccgatgcgccggttgtcctggcgcgtccagttgcggtcggagcgataggcctgggagcgcggcgccagcaccgaggtcagcatgtcgctcttcgcgtcggtcatccacagtccggtgctgaggtccaccagcggattgttctcgggcaggtaacggtagcgtgcggtgtaggtgtcgatcttcacttcgctcaatgggtactggtagatgccggcggtgccgaaacggaagatgtccgacggcatgatctccccggtgcgcccgtcgtagcgacgatagccgaggtccagggtgtgctcgtcggcgatgcgccaggtcgccttgagcaggtaggactcggtctccgacgacgagttgagcacttcctctcccgcgttgtagaccttggctacgctgctttcctcgcgaccgtagcggttgtagacgcgatagcggtcctggcctttcttgccggaaaagtagttgccctggttgcgctgcgcataggcggcgaccaggtccagatgctcgttgcggtaggcgaaggcggcgctgccggacttggcctgggagccgaacaggctgccgcggtcatcgtgcggcacgctgctgagattctcggtcttcgaactggcgctgcggtgctgcggggcgacgccgttgttccagacgtcgccggtgaagcgcacgccgaggtccttgccgtcgaccaggatgtccttgacgccgatggtgcgcatttccacgctgccgccgatcgcgcccgagcgggtcgagggacccttgtcgacggtcacgctgctgaccaggtcgggatcgatgtagctgcgctgctgggtgccggcgtagccgcggtagacgtccagcgcctgctccgcgccgtcgacccgcaccgccacccggctctgcccctggatgccgcggatgttgacgtccagcgcgccaccgttgcggctgtcgccgacctgtacgcccgggatgccctggagcaggtcacccacggaaacccggccgaagcggtcgatgtcttcgctggagaggtacaccgacgagcgtggcgcggtataggtttccttctgcggatcggccagctcggcggccgagaccaccaccggcgacaggtcggccggggtttctccgggcatgcgcggctcgaccagcaggtaggcgccggaggttcccgccgcgacctgcaggccggtgttcgacaggactcgctgcaagccttccagtacgctgtagcgacccttgagcgccggcgccgtgcggccgcgggtcagctcggggtcgaaggacagcagcaggcccgactggctggcgaaggcgcccagggaggcgcccagcgaacccgccggaatgtcgtagctgcgcggcgtggcgtcgtccaggcgggtagccgcgctgtgctggccgacgctctgcgcgtgggccaggccgccgccgagcaggccggcgccggccgccgacaggccgagcagggcccagcgcagggcaagggtgagcggggagaggcgcgacaaggggcgcgccaggctggggatagggcgttgtag

SEQ ID NO: 10644 - DNA, 1029 bp, Pseudomonas aeruginosa
tgcccgatgaatgaccgcgcttcccgccgggcgccgcaggcgggcgatacggagctttccgggccgccggccgccgaggcgatcgccccgcaggtgctcagggagaccgcctcctggctgctgctgatgcaggaggggccgctggctccggcgcagcaggccgagctggagtcctggcgctcgcgcagccccgagcaccagcgcgcctggcggcgcgccgagcgtctgctggcgaatatcggttcgctgccgccggcgctggcccggcgtgcgctcgagcgtccgtccggcagcggccggcgcgcggtcctgcgcggcctcgccctgctgctcggcggcgcaccgctggtctggtggggatgtcgcgcgcaggtctggcgcgacggcttcggcgccgactacctcactgccgtcggcgagcggcgcgacctggtgctggaggacggcagccaggtcgagatgaacaccgacagcgcgctggacgtgcgctacgatgccggccagcgcctgctgcgcctgtatcgcggagagatctacctccgcaccgcggcggatcggcgagagccgccgcggccgttcctggtgcgcaccgaacagggcctgatgcgcgcgctgggtaccgccttcagcgtccgacgcgagggcgcagagacagtgctggcggtgtacgaaggcgcggtccaggtgcgtccggagggcgccgcgagcgcggcggatggccgggtgatcgaagctggccagcgggtgcgcttcgatcgccagcggatcggccccgtcgagtccgccagcgaggccgcgctggcctggcgccagggcctgctggtggccgacgacatgccgctgcggcagtgggcgggagaactgatgcgctacggcggcgagagcatcgagtgcgagccgtcgctggacgcgcttcgtgtctccggcacctttcccgtcgacgacctgccgctggccctggcgatgctggcacagacccatggcctgcgcctcgtgcaccaaggccgacgggtgctgatcaggcgctga

SEQ ID NO: 10645 - DNA, 870 bp, Pseudomonas aeruginosa
gggaggcgcggcggctcagccggccagcaaccagaccccggcgcccgccgaggccagcccggcgagacgtaccaggggcgcggccgcctgcgccaggaagcgcaccagcgggtagccggcggcgtgcagcgcggcggtggcggcgacgaaaccgagcgcgtacagccaggggctggagaggtccggcagctccaggccgtgggcgaccccgtgggccagggcgaacagcgcggtggcggccatcgccagcggcagcggcgggcgcacggcgagggccacgcagaggccgagggcgagcaccgaggcggcgatgccggtatccatgaacggcagttgcaggccctcgaagccgagcagcccgccgaccagcatggtgccgacgaaggtgcagggcagggcgagacgcgcggctccctgttgctgggcggcccagaggccgacggcgaacatcgccagcaggtggtcgaggccggtgagcggatgggcgaggccggcgaccaggccgtgttcgccgtggccggggtgggcgaaggccagcgccggagcggcgagcagggcgagggcggcgagcagcttgggcagtttcattggtggttccttgtcgttgcgaagtggcgtcaggcggcggtcagcaggccctggcgctcgatgaaggcgatgatttcgtccagcccctggccggtcttctggttgctgaacacgaacggcttgtcgccgcgcatgcgccgggcgtcccggtccatcacatcgagggaggcgccgaccagcggcgccaggtcgatcttgttgatcaccagcaggtccgacttgcagatgccggggccgcccttgcgcgggatcttgtcgccggcggaaacgtcgatcacgtag

SEQ ID NO: 10646 - DNA, 576 bp, Pseudomonas aeruginosa
gctggaagcaagtttctgcgcggccagttggccgagcggcagggttttcatcagcaccgccaactggttttccagccagctccagaaccaggcactcagcgcctcctcggcgtccaggcgccaggcgcgcgcggccatcgcccaggcggcggcgagattgggcgggtcctggcgcgccagccaggcgcggccgggagcgtcgagctcgggcagggcttccagcaattggtgcagggaaaagcccatctgccggctctcctgggccagctcgcgggtctcgcggctggccctatggcgttcgctggccgcatcgcaggcggcccagtcgccgatcagcgcggcgcgcagcaggccggccagcagcggcgcctcgaagcgcgccaggttcagttgcagctggtcgaccagccaggtccgcgcgctctcggcgtcgcgcacccagccattgtcgagggccgcctccaggccctgggaatagctgtatccgccgatcggcaactgcgagctggccaggcgcaggcgcgcccagatgctgttcaccggcgcacgccgaactggtgcaggcgcggcgcgtag

SEQ ID NO: 10647 - DNA, 918 bp, Pseudomonas aeruginosa
gtcaggtggagttcttcgtcccagcggggcgagcgggcgggcaggcgttggtggatgaccagcatgggcagtttccgcaatgcgacaggaaagggatcacaacaagcaccagcaagggccttgccaggtcgatgcgggacgcctgtaccgggaaaacggggccatagggatgtaacaaaatattgcagcgcgccaggttggtgcgcaacgacttttttgccgcaccggaaaggtgcgcgcgcgtctagtccgcggacgaacgccgagccggaggtccgcaggggaggtgcggggtcagccgggcaggccgtgccagtgcttgccgccgatcatgatgaaacgcagctggtgggtgatcttcgcggccggcatcaggtgcggcggcagatcggcggcgggtgggtcgatcagctccggaagggtggcgaagacggtcttcaccaccaggtcggcgaacacgtcgagggccgcgccgtcgaggtgcggcatcttgttcagcagcgccaggtcggcggccagatcgtcggtgatgcgctggcgcaggctggcgatggcctggcggatcggcaacgagccgccgtattgctcgcgggcgaggaagaggaactgcgagcggttggcgccgaccgcgtcgaggaagatgcgcaccgaggcgtcgatcagcccgcccagttcgaactcgttgcggcgcaccgcgcgcagggtggcgcggaaggtctcgtcgacttcggcgaccagcgccaggccgagctggtccatgtcgctgaagtgccggtagaagccggccgggacgatgccggcggcgcgcgtcacttcgcgcaggctgaggctgccgaagccgcgcccgctttccatcaggtggcgcgcggcgctcatcagcgcgtggcgggtctgctgtttctgttcggcgcggggtga

SEQ ID NO: 10648 - DNA, 1179 bp, Pseudomonas aeruginosa
cccgcggggcgcgggccgatggctgcctggaggggcatttccagccgcgccacctggacggctgggcagccgacctggcgcgcagccaggccctggcctgcgggccggcggctttcgtcgaggcggtgggcgagcaactgggggcacgcttcgccggcttgcagacggaatccttcagcgtcccgcgctggcgcagcggggaggcgccgcgcgaagtgcgcctgcgcttcgcccggtcgcagcgggaagtctccggcgacagcgccgtcagcctgctggaacaggccgaggcccacggcctgcgcccggcccacggttgccgccagggcatctgcgccagttgcacctgcgtcctgctcagcggctgcgtgcgcgacctgcgcagcggcgcgctgtgcagcgagcccggccagcctatccgcctctgcgtcagcgccgcccacggcgacctggcgctggacctgtgaaccgacctgcgagccctgcgatgcgcgacgaccgcgaactgaccccggaacaactggcggccttcggcgccgaactcgatgccctgcgcctgcgtaccctggccgatctcggcgcggacgacgcgcgctacatccgccgggtccgcgcggcggtgcgcgtctgctgctggagcggcagggcgctgctgatgttcggctggctgccgccgacctggctgctcggcagcctgcttctcggcctgggcaagatcctcgagaacatggagctgggccacaacgtcatgcacggccagtacgactggatgaacgatccggaattcgccggccgcgcctacgagtgggacatcgccgggccgtccgacttctggcggcacacccacaaccatatccaccacacttacaccaacgtgctgggcaaggacgacgacgtcggctacggggttgtgcgcctgttcccggagcagcgctggaagccgttttaccgctggcaaccgctgtgggtgacgctgcaggcgctgctgttccagtacgcggtggcgatccagcatctgcgcctggacaagtacgccaaggggcgcctggacaaggccgaactcatgccgctgctacgccgcctgcgtgccaagctgggtcgccagtggaccaaggactacctgctgttcccgcttctcggcctgttcgccggcggcttcggcgcggtgttcgtcggtaa

SEQ ID NO: 10649 - DNA, 1818 bp, Pseudomonas aeruginosa
tgccgccctgtgcgccgcgacgtggcttccggccgccgtgcggcgtcggagtctcgccgaacgcaggacggcctgcgcccgcgatcggccagcagcgtcgatccttcccgaacctatcaatgctcggcggatgccggccgtggggcccgtccgtccaggaaccgtcatgttcagcccgctcgtcacctttcccgcgctctacaccgccaccctgctcatgctggccggctccggcctgttcaccacctacatcggcctgcgcctgacccaggaaggcgcaggcgacctgtgggtcggcgggctgatggcgtcctactatttcggcctggtctgcggtggaaaattcggacacaagctgatcgccagcttcggccatatccgctcctacgtggcttgcgccgggattgccaccgtgaccgtgctgctgcatgccctggtcgatcagctggaagtctggctgctgctgcgcttcatcaccggtgcggtgatgatgaaccagtacatggtgatcgagagctggctcaacgagcaggccgagagccaccagcgcggcaaggtgttcgccggctacatggtcgccgtcgaccttggcctggtgctcggccagggcctgctggcgctgagcccgaccctcgactacaagccgttgctgctggtcgccatctgcttcgcctcgtgcctgatcccgctggccatgacccgtcgcgtgcacccggccaagctggtcgccgcgccgctggaagtgcgtttcttctggcaacgcgtgccgcaggcgctgggcaccatcttcatcgccggcctgatggtcggcgccttctacggcctggcgccggtctatgccaaccgcaacggcctggatgcctcgcaatcgagtttcttcgtcggcatgtgcatcgtcgccggcttctgtgcgcagtggccgctgggctggctgtccgaccgcctcgaccgcagttggctgatccgcggcaatgcggtgctgctgtgcctggcctcgatcccgatgtgggggctggtgacgctgccgtactggttgctgctggccaacgggttcgttaccggcatgctgctgttcaccctctatccgctggcggtggcgctggccaacgaccacgtcgagcagccgcgccgggtcgcgttgtcggcgatgctcctgaccacctatggggtcggcgcttgtatcggcccgctggtggccggcgcgctgatgcgccacttcggtccgggactgttctacatgctggtgtccggctacgcggtgctgctggtgttctgggtgcagcccaagcgcgtcaccggcgaacaccgggtcgacgaggcgccgctgcaacacgtggcgatgccggacacggtcagcccgatggccgccaccctcgacccgcgtgtcgaggaagtgccggaggagttggtggtggaggcgccggcgaatatcggccgctccgacggcgagccggacgccggcgagaagcccgctcagtcctgagccgggaacgccaggtcgaagcggatgcgtcccggagccggggcgctcgcttcggcgcggccgccgtgcaggcgcatgatcgcctggacgatggccaggccgagaccgctggactgggcgtcgctgcgcgcggcgtcgccacggtagaagcggtcgaacaggcgcgacagcggctcggccggcagcctgtcgcaggcgttctccacgctcagcaggaattcccccgagcggcgcaggccgcgcacttcgatcaggctgtcggcgctggcgtagcggatggcgttggccagcaggttgctcagcgcccggcggaacagttgcggatcggcgcgtag

SEQ ID NO: 10650 - DNA, 1500 bp, Pseudomonas aeruginosa
cccgactcgccgaggcccttcttcaggtactcgccggtcttcgtatcgtcttcgatcaccaggatgcgcatgtctcgttccccctcgttcgccgccattctagccagcgcgcggcgcggactcggtgacatttttgtcatgcgaaagtcatctccgggtaccgccggcggggcgaccatcgaggctcaaccccaccgaggatcgaccgatgcttcgactcaaggcttcccccgcgctgttcttcggcctgctcctggccagtgccgccagcttcgccgcgcaaccgcctgcgggcatgctgcagccgctgcgcggcaccatccagcaggccgccgacgaccacctgcaactgaaggcccgcaacggccagcaactgacggtcagactcaccgacaagaccgcgattcgcgccgtgtcgctggcgaagccggaggacatccagcccgacagcttcatcggcaccgccgccgtgccgcagcccgacggcaccctgaaggccctcgaggtgcatgtcttcgcccccagcctgcgcggcagcggcgaaggccaccggccctgggagaacgccgatggcagcgcctcgaccatgaccaacggtacggtcggcaacctggtggtcagccagggccggcgcatgacggtgaaatacggcgatggcgagaagaccgtggtggtgccggacgacgtgcccatcgtcagcctggagccgggcgagcgcagcctgctcaagcctggcgccaaggtcgtgctgttcccgcagaagggcgccgacggcagcctcaccgccctggccatctcggtcggcaaggacggcgtgaccccgccgatgtgaggtttcgccgggacggcgcgtccgtcccggccgggtttcctgggagaaaagccatgaaccgtgcgttgcacgcctggccggtgagactctgccactggctcaatgcctatgccatggcctgcctggtcggcagcggctggggcatctacaacgcttcgccgctgctggatttccgttttcccgcctgggcgaccctcggcggctggctcggcggttccatcgcctggcatcttgccgccatgtggctgctgctcggcaacggcctgtgctacctcgcccacggactgtccagcgggcattttcgtcgcgacttcctgcctttgagcgcggccggcgtctggcgcgacctgcgcctcgccctcggcctgcgcctggtccatgagccgggccgctacaacgcggtgcagcgcctgctgtactggctggtcctggcgctcggcgcgctgctggtgctgtccgggctggcgatctggaaaccggtgcaactgcacgggctgaccgcgctgttcggtggcttccagggggcgcgctgggtgcatttcctggccatggccggggtcgtcgggttcgtcgtcgtgcacctgctgctggtgctgttggtgccgcgcaccctgctgccgatgatcatcggacgcgagtggcggcgcggacggaggagcgaaggatga

SEQ ID NO: 10651 - DNA, 534 bp, Pseudomonas aeruginosa
cgtcagcctcgacgaccagcgtttgaagacccgtctggaagtgctggtcgacccgctcggcaagccggtgccgttcggtcagttggccggcaaggcgctggccacgggcgatgcggcgaacgcccaggactatgtgttcggctggaaggtcaagggcacctacaagggccaggctctggccggctcgggcaaggtcggcgggatgctggcgttgcaggatgcgagcaagcccttcccgctacaggccgaggtcagtgccggcagcacccgtgccgcggtggtcggcaccctgaccgacccgctcaacctcggcgccctcgacctgcgcctgaagctgtccgggaccagcatggccaatctctatccgctgaccggcatcaccctgccggacactccggcctactccaccgacggacacctgctggcgcggctcaaggaggagggcggcgcactgttccgctacgagaacttcaacggcaaggtcggcgccagcgacctgcacggcagcctgaccttcgtcgctcgccagcctag

SEQ ID NO: 10652 - DNA, 1029 bp, Pseudomonas aeruginosa
gccgaagctgtccggcaagctgacctccgagcaactgcgcttcgccgacctcggcccgctgatcggcgccgacagcaatgccgaaaaacagaagcgcgggcagaccagccgccagccgggcgacaaggtgctgccggtggaggaattccgtaccgagcgctggcgcgacatggacgccgacgtggaattcaccggcaagcgtatcgtgcacagcgaccagttgccgatcagcgacctctatacccatctggtgctcaacgacggcctgctgcgcctggagcccctgcgcttcggtgtggccggcggcaagctggagtcggacatccgcctggacggcggcaagcagccgatgcagagccgagtgaagatgagcgcgcggggcttcaagctgaagcagttgttccccggcttcgcgccgatgcagaccagcttcggcgagctgaacggcgacgccagtctcagcggcagtggcaattcggtggcgaagatcctcggcggcgccgatggcgaattgaagatgctgatcaacgacggtgcgatcagcaaaggcctgaccgaaatcgccggcctcaatgtcggaaactacctggtgaccaagctgttcggcgacgacgaggtgaagatcaactgcgcggccgccgacttcggcctgcagaagggcctgatgaccagccggctgttcgtcttcgacaccgagaacgcgctggtcaacgtcgacggcacggtgaacttcgccaacgagaagctcgacctcgatgtcaccccgcacagcaagggcctgcggatcttctcgctgcgctcgccgctgtacgtgcgcggcaccttcgccaagcccgacgccggggtccacgccgggccgctggtggcgcgcggcgcgggaatgatcgccctcggcgtggcggtgggcccggcggccagcctgctggcgctggtggcgccgagcaagagcgacgacaaccagtgcaccgccctgctgcaacgcatgcgccagccggccaaggtgccggccggcaagcgctgattcagtag

SEQ ID NO: 10653 - DNA, 636 bp, Pseudomonas aeruginosa
gtgtggatggtgcggcccttgaaggcgccgagggtggtctcgacgaagccggactcgttgagggtgtcggtgtggatcgccacctggatgtcgtggcgctcggcgacctccaggcagttgtcgatcgccgccggggtgctgccccagtcctcgtgcagcttcaggccgatggcgccggcgagcacctgctcctccagcggcagcggcaggctggcgttgcccttgccggtgaagccgatgttcatcgggaaggcgtcggcggcctggagcatccgcgccatgtgccagggaccggaggtgcaggtggtggcgttggtcccggcggcggggccggtgccgccgccgatcatggtggtgaccccgctcatcagcgcctcttcgatctgctgcgggcagatgaagtggatgtgcgtgtcgatgccgccggcggtgaggatcatgccctcgccggcgatcacctcggtgccggcgccgatggcgatgttcaccccgggctggatgtcagggttgccggccttgccgatggcctggatgcgcccgtccttgagaccgacgtcggccttgaccacgccccagtggtcgaggatcagcgcattggtgatcaccgtgtcgaccacctgcgccgcgcccagctga

SEQ ID NO: 10654 - DNA, 789 bp, Pseudomonas aeruginosa
tgcgagccgacctggatcggccggtcgccggtgttcgccacgctcagggcgagggtgcggcggccggcgttgagttcgatatcgccgggctggatgtcgtattcaccggggatcatgggggctccttggggctcagggcgcgctgcgcgtcgggtcgaggttcagttgcatgaaggtcaggtcgagccagcggccgaacttctggcccacctgcggcatctgcccgctgatctcgaagccgaggcgccggtgcaggccgatcgaggcggcattgccgctttcgatggcggccaccatgacgtgcaggccctgggcccgcgcacgttcgatcagcgcctgcagcagttgcacgccgaggcctttgccgcgctggtcgtcgcgcacgtagacggagtgctcgacggtgccgcggaagccctcgaagggtcgccagtcgccgtaggaggcgtagccgagcacttcgccggcggcgtcgctcgccaccaggatcgggtggccctggcgggcgcgggtgtcgaaccaggcctggcggttggccaggtccaccggggtttcgttccagatcgccgtggtattgcccacggcgtcgttgtagatggcgaggatgccgggcaggtcggcgacgccggcgtcgcggatcgaagcgctcatggccggcctcaggcgatgggctggtggacggtcaccagcttggtgccgtcggcgaaggtggcctccacctggatgtccgggatcatctccggcacgccctccatcacctgctcgcggttcagcagggtggtgccgtag

SEQ ID NO: 10655 - DNA, 1014 bp, Pseudomonas aeruginosa
ttcagcttgagaccgcgtgccagccggcgctcggcgagcaggccggcggtgaagatcagcagcttgtctttctcgcggggggacaagtccatctcaggtactccagatgcgtgggggaacggcctcgcggccgagcagcgccggccgcagcaggcgccagagttcgatcagccaggctcgcgcgtgcagcgcctcgtcggccaggcagcgcgccaccagcaggccgccgggcaactggctgaggttgccgcggccggcgcaggggagcgcgcggcagcgttgcagcaggtcggtgtcgatctcgccgctggcgaccagggtcgccagcaccggatgcccggcgaggccgatcggcgagtcgagcaggcggtcgccgccgtcgatgcgctggcgctcgtgccagagcaggcggtcgtcgcgacggatgtccagggccgcgacgaagtggccgctgacgaagcgctcgccgctggccgggcggccgagcgcgaccatgtcccagtagaacaggcgggcgtcgccgcgcagctggatacgggtttccagttcggcctgggcgccggcgaagacgatgctttcctgcggcagccattccagggtggcgccgggctccaggtggatctccagggtctgccgcgacgggcaggcggcgcggtaccacttggccgcgccggggctggtgagctgggcccaggcgcgttcgccgaggcgcacgtcgaaggccaggctgtcgccgccggcgatgccgccgggcggatgcacgaggatgtgctggcagacttccgggccttcggcgtagaggtgcttctgcacccgcagcggtccggagtggcgccgcgtcaccgggcgggtggcgtcgccggcgcgggcgtaggccagctccagttgggcgtgccaggcggggtggaagctcaggtcggggagggcggcggtcatcggtcgggtcaggccagggccttgcgcatgaacacgcggcggaatccctcttcctggcggcgttcgtattcgaggtag

SEQ ID NO: 10656 - DNA, 1248 bp, Pseudomonas aeruginosa
ccgcgagcggtcattcgccctacgcgacgggcgccacttggcaggcgctacccgccgagcggatggctggcgtcagcgaccgaggtagacctcgatcacctgttcgtcggcctgtacctccgccagcgagccttcggccagcacgtggccctggtgcagcacggtgacatggtcggcgatgctgccgacgaaacccatgtcgtgctccaccaccatcagcgagtgcttgcgcgccagggacttgaacagctcggcggtgaattcggtctcggcatcggtcatgcccgccaccggctcgtcgagcagcagcaactgcggttcctgcaccagcagcatgccgatctcgaggaactgcttctggccgtgggacagcaaacccgccggacgctgccgcgactccagcaggcggatggtggcgagcacctcctcgatgcgttccctctgcgtgccgtcgagccgcgcgcgcaggctggcccacaccgacttgtcggccctctgcgccagttcgaggttctcgaacacgctcagggcctcgaacaccgtgggcttctggaacttgcggccgatcccggcctgggcgatctgcacctcgctcatgcgggtcaggtcgagggtgtcgccgaaatacgcggtaccgctctgcgggcgggtcttgccggtgatcacgtccatcagggtggtcttgccggcgccgttggggccgatgatgcagcgcaattcgccgacgccgatgtacagggtcaggtcgcgcagggccttgaagccgtcgaagctgacgttgatgtcttccaggctgaggatggtgccgtggcgcgcgtccagccggccgctggtggcggcgcccaggccgatggcgtcgcggccgctgccggcggtatcgaggccggggtggaaggccggttcgagcatcaggtgcggggtggtcctcattgctccttctccttgcgcagcaggccgagcaggccgcgcggcaggtacagggtgacgacgatgaacagcgcgccgaggaagaacagccagtattccgggaaggccacggtgaaccagctattcgcgccgttcaccacgccggcgccgagcagcgggccgagcagggtgccgcgtccgccgagggcgacccagacggcggcctcgatggagttggtcggcgacatctcgctggggttgatgatccccacctgcggcacgaacagcgcgccggcgaggccgcagagcaccgcgctcagggtccagacgaagagcttgtag

SEQ ID NO: 10657 - DNA, 408 bp, Pseudomonas aeruginosa
tgtagccctggccgaggtccgggccgacgttgccgacctgcgacagggctaccccgccgagccccggcgatgcccgagccgagaccgaaggcgagcatgtccacgcgccctgtgggcaccccgcagcaggccgccatgttgcggttctgggtcaccgcgcggacgttcaggccgagccgcgtgcggttcagcagcagccaggtgaggagcagcacgaacagggcgaagccgatgatgacgatgcggttccacggcagcaccaggttcggcagcacctggatgccgccggacagccaggccgggttggctacctcgacgttctgcgcgccgaacagcatccgcaccagttggatcagcaccaggctgatgccccaggtggcgagcagggtttccagcggccggccgtag

SEQ ID NO: 10658 - DNA, 696 bp, Pseudomonas aeruginosa
gtgatcgccaggccgagcgccgcgagcagcaggatcgagcccagcgacaggccactgaaggcctggccgagcaggtcgccgaccagcagtcggcgcttgacctgggccaggctggtggcggcggcgatgcgcacgccttcctccggttccaccgccgggtcgagcaggttctccaggcgggttcgcgccagcggatcgccggactcgccgagcaggcgcacggcggaaaggcgtagcgccgggtcgggatcgccgagttgcaggttggccagggccaggccgagggcttccttcacgccagcgtcgctctcgatccgcaggcgcgcttcgagcagcggccgttgcgcggccttggcggttttctgcaactgctgcgcggcggcctgccgcagcggcacttcgttggccaccaactggtggctggccagggcggtgttgagcaggccgcgcaggcgattgttcaggcgcagcggcttcggctcgccgtccggcagggcgtcgccttcggcggcctggaaacgctggtcggcgccgaggatgaatggctgctggcggctgtccagcgcaatgcggttgtggcgcagcgcttcgagaaaggccaggcgaccggcgtcgggcgtcgccgcccagtgttcgagcaggtgggcgcgaccgccgttgtcggcagcggcgaagtcctgcgccggtccggcgtag

SEQ ID NO: 10659 - DNA, 2862 bp, Pseudomonas aeruginosa
ccgcgtgcggttatccgccgtggcggaggccgggtgcagcgctggagcacgtcgctgccctcaggagggcagggcgtcgccctggcggcggcgatcgcgttcgccgacccagtaggcgatcagctcgcgcaattgcgacagctccaccggcttggccatgtgcccgtccatgccgaccagccgcgcgcgttccttgtgttcgctgaggatgtgcgcggtgagcgccaccaccggggtatgcgggcgctgttcgtgggcttcccaggcgcggagctgctcggtggcggagaagccgtccagaaccggcatctcgcagtccatcagcaccaggtcgtactgggtcgccttcatcgcgctgagcgcctcctggccgttgctggcggtgtccggctggaggttgagcttgttcaacatgccgcggatgaccttggtggagatgctgttgtcctcggcgacgaggatccggaagtcgctcggcaggctcggcgcctgcgcttccttggccggttgcaggtagttggtgacgccactgacgccgcgctgggcgagttcgtcggcgagggtcgccttcagcgtgtagccggccaccggcttggccaggatgcgcttgatcccggcgttgcgggcgatgatcttgctcggcgcgttgctgatcccggtgagcatgatcagcaggatgtcgtggttgaggttggggtcttccttgatcttcgccgccagttgcatgccggtcatgccgggcatgtcctggtcgagcaggaccacgtcgaagtactcgcgcaggtgcgccttggtgcgcaactgggccagcgcctccttgccggacgacaccgcgctgacgttcaggccccagccgctgcactgctgcaccagcaccttgcggcaggtttcgttgtcgtccaccaccagcagccgggcgccctgcagcgggccgtccaggtcggcggtggggttctccagctgctgcgggtcgagcggcagggtcagcgacagggtggtgccctggctgctgccggactggatgccgaactccccgcccatcagccgcaccagttggcgggcgatgatcaggccgaggtggctgccgagcttgctggcggaaaggaagtcgccgctgtgcagctcggcggtgagcagcgcctcgcgctccttggcgtcgaacgggtggccgctgtcctgcacggcgatgcgcaggcgtggcgtctcgccctggtcgtcgagggccaccaccagcaggatctcgccttcctcggtctgcttgaacgcgttgtccagcaggctcaggaccacctggcgcaggcgcgtcggatcgccgccgatgacccgcggcacctgcggctgggtgaagctgatcagctcgatgcgctgctgctcggccttgacccggaagatatccaggcagtcctcgatcaacgcgttgaggtcgaactgcacttcgtccagctcgatctgcccggactccagcttggagatgtcgagtatctcgttgatcagcgtgagcagctcgttgccggcgctgtggatggtctgcacgtagtcgcgctgcttcgccgacaacggggtgccgaggagcagttcggtcatgcccagcacgccgttcatgggcgtgcggatctcgtggctgatcttggccaggaactcggccttggtctgcaattccgcggtgtgcgccgcctcgctggtgcgctgttgcaggttgagctgctggatcagccgctggcgttcggtgagcgagacgctcaggaccagcccggcgagggtggcgaagctgaacacgccgagcaccagccagcccggatcgagttgcttggtgccgaacagtaccggcaggaacaccatgaagccggcgttgaacacgatcatcccggcaacgatcaggcgcgccggctggtagccgcgataccagtgccaggccgcgatcagcgggacgctgagcgaactgaggatcaccagcaggtagatcagccagctgaaccagagttgctgggtgaaggcgatgatcgcgccgaccgccaggatcaacagcgcctcgccttgcaggaggcggttcaggcggctttccgcagtgccgcggaagaagctgcaggcgaaccacagcaggctcaccgcagcgccgagggcgccgaggtcggcggtcagcgactggttgaacttgagtcccggcagccagaacgccaccagccccaggttcgccgcggcgcagaccgccagcgccgcgtgcaccgccgccagccacaggctgctggcgctgcgcgagtaggcgaagcggatcaggttgtacatcagcagcaggagcatgccgccgagcagcatgccgaaggcgtaggcgggcttctccaggccgaccaggccggcttcgtcgatctggtcgaaccaggccatcagcggatggttggaggtcatccgcacgtacagggtcatcggcttgccgtcgaccggcagcgagaacaggtaggagcgcgagggcagcgggcgctcctggaacggtcgcgactcgccggtgtgctggtcccgcaccagttggccgtcctgcaccaggtagtagtccaggtactgcacccgcggggcgaagatccacagccagctcggcaccttctgcgcgggaagctggacctgcagccagaccgcctgggggctggcggggaagatgaaggagcgcttggccagcgggcggaactgctccttgcgctggaggacgtcggcgatccgcagttgcgcgctctcgtcgcgcagcaggcgccagttctggttgacgctgggggtggtggcggtggtttgcaggggaacgctggaaacgccggcgtcgtccgcgaccgccggcgacatcggaccgagcagaagcagcaggaagctgacgagtag

SEQ ID NO: 10660 - DNA, 405 bp, Pseudomonas aeruginosa
gtacgttcatggggttctcctggcgcaacggcgggtaacgcgccgcgttatccgccctgcgtgaaattcgtgggtagggcggctgaccgcatcgcgctcagccgccgtgatactcaatggcggaaatggcgcatgccagtgaacaccatcgcgatatccgcctcgtcggccgccgcgatcacttcgttgtcgcgcatcgagccgcccggctggatcaccgcggtgatgccggccttggccgcgttgtcgatgccgtcgcggaacgggaagaaggcgtcggaagccatcaccgcgcctttcacttccaggccggcgtgctcggccttgatcgcggcgatccgtgcggagttgacccggctcatctggccggcgccgacgccgacggtctggcggttcctggcgtag

SEQ ID NO: 10661 - DNA, 240 bp, Pseudomonas aeruginosa
ctcggaggccttggtctggttccccttgacgtggttcatgacggtttccagcagcggcgcttcgacttcgcagagcaccatgttgtaaacgtccgtgaccggctgcccttcgaggtgggcgaagtagttgtgcaatgccttctccacgctgtcgcgcagggtctgcccttcttgcgtcggcgtggtgaggtgctgtttcaggttggcgttgtcgctcacgggcgttgttccactcactaa

SEQ ID NO: 10662 - DNA, 639 bp, Pseudomonas aeruginosa
tggtcgatctcgcggaaaatccacggtcttccctgggcggcccgaccgatcagcagggcatccaccccggtctgctcgatgactttcctggccttttccggcgaatcgatgtcgccattggcgaacaccggtatcgacacggcctgcttgatcgccgcgatggtctcgtactccgcctccccggtgtacaggtcggcgcgggtccggccatgcaccgcaagagcctggatccccgcctgttcggcgagcttcgcgacggtgacgccgttacggttgtcccggtcccagccggtccggatcttcagggtgaccggtacgtcgaccgccctgaccacggcatcgaggatctcggcgaccagcgcctcgtcccgcagcagggcggaccccgctgccttgttgcataccttcttcgccgggcagcccatgttgatgtcgatgatctgcgcaccgagttccacattgcgctgcgcggcctcggccagcatggccggatcgccgccggcgatctgcaccgagcgcggctcgtcctcgccatcgtggatcaggcgcaggcgcgacttgcggctgttccacaggcggacgtcgctggtcaccatctccgataccaccatcccggcgccaaggcgacggcaaagctga

SEQ ID NO: 10663 - DNA, 939 bp, Pseudomonas aeruginosa
tctaccccaagcttcttgcacgaaggcagtggggcgggatcagtggtggctggcggcgcgccatcaatcggcgcggcggcggccgctgatgcggatccagccttcgcgctcggcggtcgggtcgagatcgaagtgtgcggagtaggccgcgcggacctccgcggcctgctcggcgaggatgccggacaacgccagcaggccgccgggacgtaccaggccggtcagttgcggggcgagggaaaccagcgggccggcgaggatattggcgaccagcacgtcggcctgtcgctgcggcaggtccgccggcaggtagacagggaaccgcgcgggctcgataccgttgcgcgaggcattgtcgcgcgaggcttccagggcctgtggatcgatgtcggtgccgaccgcccgttcggcgccgagcagcagcgcggcgatggcgaggattcccgagccgcagccgaagtcgagcacctgccggccggccagttcctggccgtcgagccattccaggcacagcgcggtggtcgggtgggtgccggtgccgaaggccaggcccggatcgagcagcaggttgaccgcgtccggctcgggggcggcgtgccagctcggcacgatccacaggcggcggccgaaacgcatcggctggaagttgtccatccagctgcgttcccaatcctggtcggcgatttcctcgacatggtgctcgggcaggtcgccgccggtaagcaaggcgaggtgggcgagcagggcggtctcatcggtgtccgcttcgaacagcgccagcaggtgggtgcgcgaccacagcggggtggtgccgaggtccggctcgaagatcggctggtcttcggcgtccatgaaggtcacggagacggcgccgacttcgagcagggcgtcttcgtaggtttcggcctgttccggggtgatagccaggcgaacttgtaa

SEQ ID NO: 10664 - DNA, 1305 bp, Pseudomonas aeruginosa
tcaggtcctgccccggttccgctgagcggtatccgaccggtccgaagccagacggttcctctggcgccttgcggcacgtcgccgcagggtcacaggcggaaggcctgcaccgtggtgcgcaggtcgccgcccagttgccgcagttgctcgccctgttcgcggctatggccgatcagccgcaggttttccccgcccagggcgtggatgcgttcgctgtgcgagcgaatctcgccgaccgcctggctctgctgggtcgagccttcggcgatgcgttcggccatcacgccgatggtatggatcgcggcgaccacttcgtccagcgcgccttccgccgcgccggcctgttcggcggtgcgttcggcatgctcgacctggctgcgcatggcctccaccgattgccgcgcggcctgttgcaggcggccgatgagctgctggatctcctcggtggcgccggcggtgcgctgggccagcgagcggacttcctcggcgaccacggcgaagccgcggccctggtcgccggcgcgggcggcctcgatggcggcattgagggcgagcaggttggtctgttcggcgatcgagcggatcaccgtcagcacgctgccgatggtcgccgactcctcggccaggcgctcgatcgactgggcgttgccttgcacctcgtcgaccagctcgcgcaggccgcccaggctctcgccgatcacccgctggccatgctccactgcctggcctgcgctgcgactggcgtcggcggtctggctggcgtctccggcgacctgctggatcgccgcttccatgtcgccgagggcgtcgcggatctgcccggtatcgccggcctggcgctcgaccccggcgtgcaggccgctgctgacctcggccagggtctggctgctgccggcgacctgttcggcgcggcggtggatcgcgccgaccagctcggcgaggaagctgcgcaggcggttcagcgaatcttccaggttgcgcaggtcctcggtgcgggtacgcagggatatggggcgcgagaagtcgccgtcggcccaggccgagagcgccggcaccagttgcccgaggacccgcgccaggcgtctttgcaggctgtcgatggcgagggcgatgagcaggatcagggcgatcatcccaccctggatcaggcgtacctggccttgcaggcgctggcgttcgccgcgcacctgcggttccagggtggccagggcctggcgcaccgcgtccagtctggcgccggtgtcggcggacagttgctggcgacgctcgatcaggtcgcgggtgcggcgcaactcgtccggatag

SEQ ID NO: 10665 - DNA, 330 bp, Pseudomonas aeruginosa
ccaagccgggcggctacatctccaacgacatcttcccgccgggcatctggatggacaacatgcccagctgggagtatggcgtgctggtccaggtgcgcgacatcagccgggcgctgcgcaaggatttcgcccgttcgcagtcgcagtccaccgaggacgccgaactggctcgcgccgagccgcgtttcaacttcgacaacaagagctgggcgctgccggcgtccgagtcggagtaccaggaaggcatcaagtcgctggaccgctacctggctcgcctgtccgacccgaaccagcccaacgcgcagttctatgcccgtgccgacaacctga

SEQ ID NO: 10666 - DNA, 264 bp, Pseudomonas aeruginosa
acaccaacatcaagaaccccgaagaggtacagccgggcgaggcgcccaaggtcgaggaagtggtccaggaaaccccctggctgcagatcgacaacgtcttctacgaggcccggggccaggcctgggcgctgtcgcacctgctgcgcgccatcgaggtcgacttcgccgacgtgctggcgaagaagaacgccacggtcagcgtgcggcagatcatccgcgaactggaggccgcgcaggagccgttgtggagcccgatggtgctga

SEQ ID NO: 10667 - DNA, 336 bp, Pseudomonas aeruginosa
gcaaggcggtctatcccgggtactgggacctcgccgccggcggcatgggtccaggccggcgagccatacgccgactccgccgcccgcgaactggaggaagagctgggaatccgcgacgcggtcctgcgcgaacatggtcgcttcttcttcgacgaaccgggcaaccggctctggtgcgcggtgttttccgccgtctccgatgcgcccttgcgcctgcaggcggaggaaatctccgaggcccgcttcatccgtcccgaactggcgctggaggaggctcgcagcctgccgtactgccccgattccctgcaggcgttgcgcctgtacctggacgcctga

SEQ ID NO: 10668 - DNA, 477 bp, Pseudomonas aeruginosa
tcgaggaggccgccaacgtcggcgtgcagccccaggtcggcctgcgcgtgcggctgtcctcgctggcttcgtcgaagtgggcagacaccggtggcgagaaggccaagttcggcctttccgccgcccagctgctgtcggtggtcgagcgcttccgccaggccggtctcgaccagggcgtgcgcctgctgcatttccacatgggctcgcagatcgccaacctggccgactaccagcacggcttcaaggaagccatccgctactacggcgagctgcgcgcgctcggcctgccggtggatcacatcgacgttggcggcggcctcggcgtcgactacgacggcacccattcgcgcaacgccagctcgatcaactacgacatcgatgactatgccggcgtggtggtcggcatgctcaaggagttctgcgacgcccagggcctgccgcatccgcacatcttctcggagagcggccgggcgctga

SEQ ID NO: 10669 - DNA, 453 bp, Pseudomonas aeruginosa
tcacccaggtcaccgacgtcgagcggcacaacgacgacgtgccgaagatcgtcgatctcgacgagcagccggagatcgtccgctggctggccgaactgctcggcccgaccgatgccgagatggtcaccgagacctactggcgcgccacccactacatcggcgacgccgccgcgcagtatgccgacggcaagatcagcctggcgcagaaagccctcgccgagcagtgctacttcgctatctgccggcgcctgcacaaccagctcaaggcccgccagcgctcccaccggcaggtcctcgacgaactcaacgacaagctcgccgacaagtacatctgcaacttctcggtgttccagagcctgccggatacctgggccatcggccaggtgctgccgatcctgccgctgcaccgcctgggcgaggagccggatcggcgcgcggtactgcaggacctga

SEQ ID NO: 10670 - DNA, 906 bp, Pseudomonas aeruginosa
cagcgctcgtatcgaacgggcgctggacttcgccggcggggtctcgcggcagaacaacttcggcggcctgacgatgttcgagtacaacgtccgtggcttcaccacttcggagttctaccgcgacggcttcagcgccaaccgcggctatatgaacgccccggacagcgccaccatcgagcgcgtggaaatcctcaagggaccggcctccagcctttacgggcgcggcgatcccggcggcacggtgaacctggtgaccaagaagccccaggccgagcgcttcgcccgcctgcatgccagcgccggcagttgggaccgctaccgctcgaccctggacctgaacacgccgctggacgaagagggcgacctgctctaccggatgaacctggcggtggaggacagcaagggcttccgcgactacgccgacggccagcgcctgctggtggcgccatcgttcagctggcaactggacccggacacctcgttgctggtggaagccgaggtggtgcgcaaccgccaggtcttcgaccgcggcaccgtggcgccgcacaaccacctgggcagcctgccgcgctcgcggttcttcggcgaaccggacgacggcaagatcgacaacaacaacgaaaccctccaggccaccctgcgccatcacttcaacgagcagtggagcctgcgcctggccagccactacaagcatggccacctggacggctacgcctcggagaactccagcctcgccgccgacggctacagcctgcgccgggagtaccgctaccgcgacttcgagtggcacgacagcatcacccagctcgacctgctcggcgacctccataccggctcgatccgccaccagttgctgatgggcctcgagtacgagcgctaccacaacgacgaactgatcctgcgtag

SEQ ID NO: 10671 - DNA, 885 bp, Pseudomonas aeruginosa
caacgtctgggtcgcccccggcgagccgcgcaacctgaccatgagcctgaccctgaactactgagccctctaccgccgccaggaagccatgccatgcaaggacgcacaccgctgctggaaaccctccgcgaactggaatgcgagattcgcctgctcaccgtctatgcccgcgagtgttgcggctgctacgagatcctcaggcgcaagctcgaccgtctgagcggactgatcggggaggattgcagccgggcgcagtggcaggccgattcggacgatcctgcgttgcaggcgctcggcctgcgcctgcgcgacgcggcggtgcaggccctctgcgaactggagaagcacctttgccagggcgtgctgcatgaacccggcgagatgggccgctacctgggtagcctgctggaatccatccgcggcgaactcgacagcgcggggatagatgccgatgcacgggtcctgttcgtcggctccggtgccctgccgacctcggccctggtgctggcgcgggaggtcggcgcacatttgtgctgcctggacatcgacgaggaggccctgggctgtgcccgcgagatcgctcgctgccaggggctggaggcacgcatgcagttttcctcgctgccgccggcggaactggcgttttcccgcgatgccacgcatttcctgatcgcttcgctggtgcagcagaaaagcgcggtgctggcacagatccgccaggtcatgcgcgctgacgccaaggtcctgctgcgtcacggcagcggtatcaagggactgttcaactatccggtggagccggccgaactggatggctggcgggtttgcgcggagcgggtcagccagccgctgtacgacaccctgatcctggagaaggccggtcgatga

SEQ ID NO: 10672 - DNA, 867 bp, Pseudomonas aeruginosa
gccctgtccagctactacgcggcgaccaaggtgatcgacgagacacaaccgctgcgggccctgaccaaggcggtcaagcgcagggtctacctgggttccagccggccggactgcccggcgcgggagacctggcggcgagtcctggccggcagcggggtggaggtggtacccctggcgacgccggaagcggcggagggccgcaacgtcaccacctacgtgcacagtccgttctttctcggcgagttcgccctcgcccggatactttccgagcaggggccacccggtttcatgtacaagctctacccggagggacctatcacccccggggccatcggcgccatgcggcggctgtggtgcgagctgagcgaactgttgcggcggatgggcgccgagccgttgaacctgctgcggttcctcaacgacgacaactacccggtgcacgagacgatgctgccgcgcgcggccatcgacggtttcgccgaggccggcgccgagcgccaggaatacctgctgttcgtgcgctacgcggcgttgctggtcgatccgttctctccggccgacgagcagggtcgccacttcgacttttccgccgtgccgttccgccgcgtcagtcgcgacgaagacggactctggcggctcccgcgggtgccgctggaggactatcgcaagctggcgctgatcgtcgcgctggccgcccacttcgacctggccatgccgcaggcgcgcagcctgttggcgagctacgagaacgccgtgtcccgattcatcgattgccaaggagcgagccagtgccatccaagcctgtatccgatcgacagccgtccggcggcggacgccatctatcgccaatggtgctcgacctgctga

SEQ ID NO: 10673 - DNA, 855 bp, Pseudomonas aeruginosa
gtgtgtaatataaacagccgctgtcagcggtcaggcttttttccagcgagaacccacatgaacgaacagattggcaatggcgtcgccctggtcaccggcgcctcttccggaatcggcgcgacctacgccgagcacttggcccgccgtggccacgacctgttgctggtggcgcgcgaccggcaacgcctggaagccctggcggatcgacttcgccaagcccacggggtcagggtggagatcctgcgcgccgacctgtccgagcgcgacgataggttgcgggtcgagcgacggttgcgcgacgacgcctcgatcgcgttgctggtgaacaacgccggcgtggcgatgaacggtccgctggccgatgccgacatggaccgggcggagcggatgatcgccctcaacgtagtggccctgacccgcctggctgccggcgcggcggaggggttccgccggcgtggcggcggcgccatcgtcaaccttggttcggtggtggcgctggcgccggagttgttcaatgccgtctatagcgcgaccaaggcctacgtgctgagcctgagccagtcgctgcagcacgagctggccggcagcggcgtttacgtccaggcggtgctgcccggcatcacccgtaccgagatctgggagcgcagcggcaccggaatcgccgggattcccgcggagatggtgatggaggtcgaggacctggtggaggcggcgctggtcggtttcgatcggcgtgaagcggtgaccatcccgtcgttgccggatgcggccgattggcaggcgctgatgacggcgcgggccaggctcgcgcccaatctgtcgcggcagcggccggccgagcgctacctcggctga

SEQ ID NO: 10674 - DNA, 1743 bp, Pseudomonas aeruginosa
ggcggacagggcagttggccgctgccgatgcggtcgaagaactcctgcggggagagcgcggcgacttgcgccagctccagggttccgctggcgccgaggcgggcgcgggcggcccgctcggtggcgatccaggcgttcaggcgatcttcgcggccgggctgttccatggtagtgctcctgtcgtggtgggaaagggttgcaggaaaattacggtcatcatataaactttgcatgacgagcgaaatacaatcgctttcggtccctctacgcggcgtttcctctatttgcgccggcgtcgcctacgctgagggggccgtggcgggacaaccgaggagcaggatgatggaaagctatgacgtgatcgtgatcggcgccggtccggggggctacaacgctgccattcgcgccggccagctgggcctgaaggtggcctgcgtggagggtcgcgaaaccctcggcgggacttgcctgaacgtcggctgcatgccgtccaaggccctgttgcacgcctcggagctatacgccgcggcgagcggcggcgagttcgcccggctcggcatccgggtcagcccggaactggacctggcgcagatgatgaagcagaaggacgagagcgtcgccgccctgacccgtggcgtcgaattccttttccgcaagcacaaggtgcagtggatcaagggctgggcgcgcttgcaaggcgagggccgggtcggcgtggcccttgccgacggcggccacgcgcaactggaggcgcgcgacatcgtcatcgccaccggttcggaaccggcgccgctgcccggcgtgcctgtggacaaccagcgcatcctcgactccaccggcgccctggagttggtcgaagtgcctcgccacctggtggtgatcggcgccggcgtgatcggcctggagcttggttcggtctggcgccggctgggcgcacaggtcacggtgctggagtacctcgagcggatctgcccggggctggatggggaaaccgcaaggaccctgcagcgcgccctgacccgccagggcatgcggtttcgcctcggcacccgcgtggtcgccgcgcgcagtggcgagcagggcgtcgaactcgacctgcaaccggccgccggcggcgctacggaatcgctgcaggcggactacgtgctggtggccatcggccggcgcccctataccgaaggactggggctggagacggtcggcctggccagcgatcgtcgcggcatgctggagaaccagggacagcgcagcgcggcgccgggcgtctgggtgatcggcgacgtgacctcgggaccgatgctggcgcacaaggccgaggaagaggcgatcgtctgcatcgagcggatcgccgggcatgcggcggagatgaacgccgaggtgattccgtcggtcatctacacccagccggaagtggccagcgtcggcctcggcgaggagcagctgcaggcggcgaggcgcgagtacaaggtcggacgcttcccgttcagcgccaacagccgggcgaagatcaaccacgagagcgaaggcttcatcaagatcctctccgatgcccgcagcgaccaggtgctcggcgtgcacatgatcgggccgggcgtcagcgagatgatcggcgaagcctgcgtggccatggagttcagcgcctcggcggaggacctcgcgctgacctgccatccgcatccgacccgctccgaggcgctgcgccaggcggcgatggacgtgtatggccgggccatgcagaactga

SEQ ID NO: 10675 - DNA, 2967 bp, Pseudomonas aeruginosa
gagcggtcgccgcccgatgcgcggctgacgctttctcctgcccaacccttcgcacaaggagcctgccatggacgaaccaccaagtcggcctgctgcgtgccgcctgagcggccgcgcgcagtgggcctcacccggacaagccgaacattcttcccaccgatcgcgaacatcgccgacccggcacgcctttgcctgtcacctgaccggcaaccgactcgtgtcgccgtcgcgcagctcgcgacaggagaccgagtcatgagcgtagcgacccaacgcaatacccagctcgacaccgagcgccgcaacgaccgactgtccatgcgcgccgcccgcgaagcgcagaacagcctggaaaccaccctcaccaatgtccgcggtcgccaggacggcctcgaccaggccgaggccgccgcccggctgcacgccgacggccccaacgaagtggcccacgaccgtccgccacacgtcctggtgcaactgctgcaggcgttcaacaaccccttcatctacgtgctgatgacgctctctgcgatcagcttcttcaccgacttctggctgcccctgcaggacggtgaggaaaccgatctcaccggcgtcatcatcgtcctctgcatggtcctggtcagcggcctgatgcgcttctggcaggaataccgttcgggcaaggccgccgaggcgctcaaggccatggtgcggaacaccgccaccgtgctgcgccgcgacgagcgcgggatgcgcggcgagctgcgggaaatccccatgggcgaactggtggtcggcgacatcgtgcgcctgtccgccggcgacatgatccccgccgacatccgcctgatcgaatcgcgcgacctgttcatcagccaggccgtactcaccggcgaggcgctgccggtggagaaatacgacaccctcggcgcggtccgcgagaagtccgccaagcggatcgccgccgaccagcaggacctgctcgaactgccgaacatctgcttcatgggcaccaacgtggtcagcggcacggccaccgcggtggtggtcgccaccggtgcgcgcacctatttcggttcgctggcccgttccatcgtcggttcgcgggcgcagaccgccttcgaccgtggggtgaacagcgtcagttggctgctgatccgcttcatgctggtgatggtgccgatcgtgctgctgatcaacggtttcaccaagggcgactggaccgaggcgttcatgttcgctctcgccgtggcggtcggcctgaccccggaaatgctgccgatgatcgtcagcgccaacctggccaagggcgcggtggcgatgtcgcggcgcaaggtggtggtcaagcgcctcaacgcgatccagaacttcggcgccatggacgtgctctgcaccgacaagaccggtaccctgacccaggaccggatcatcctcgagcatcacgtcgacgttgccggccggcgctgcgaccgggtcctgcaaatggcctggctgaacagcttccaccagtccgggatgaagaacctgatggaccgcgcggtggtcgccttcgtcgaacagaacccgcgcatcacgccgtcggatgcctggcgcaaggtcgacgaactgcccttcgatttcgtccgtcggcgtctctcggtgatcctcgagggcaaggacggcgaacacctgctggtgtgcaagggcgcggtcgaggaaatgctcgagatcgccacccgcgtgcaccaggacggtgtcgacctgccgctcgacgaggaacgccgccgggccctgctggcgctggccgagcaatacaaccgcgacggcttccgcgtgctcctgctcggcacccgcagcctctcgcgcacggagtcccaggcccagtacggcgccagcgacgagcgcgacctggtgatcgccggcctgctgaccttcctcgatccaccgaaggaaaccgccggcccggccatcgccgcgttgcgcgagaacggcgtggcggtgaaggtgctcaccggcgacaacccggtggtcagcgcgaagatctgccgcgaggtcggcctggacgtcggcgagccgctgctcggtcgcgacatcgacctgatggacgatgccaccctgcaacgcctggccgaggagcgcacggtgttcgccaagctgacgccgctgcagaagtcgcgggtgctcaaggccctgcagggcaacggacacaccgttggcttcctcggcgacggcatcaacgacgcccccgcgctgcgagatgccgatgtcggcatctcggtggacagcggcaccgacatcgccaaggaatcggccgacatcatcctcctggaaaaaagcctgatggtcctggaggagggcgttatcaagggccgcgagaccttcggcaacatcatgaagtacctgaacatgactgccagctccaacttcggcaacgtgttctcggtactggtggccagcgccttcatccccttcctgccgatgctggcgatccacctgctgctgcagaacctgatgtacgacatctcccagctgtcgctgccgtgggacaagatggacaaggagttcctcgccaagccgcgcaagtgggactcgaagaacatcggccgcttcatggtctggatcggcccgacctcgtcgatcttcgacatcaccacctacgcgctgatgtggttcgtgttcgccgccaacagcccggaaatgcagtcgctgttccagtccggctggttcatcgagggcctgctctcgcagaccctggtggtgcacatgctgcgtacccagaagattcccttcatccagagcaccgcggcgctgccggtgatgctgatgaccgggctggtgatggcgctgggcatctacgtgccgttctcgccgctgggggcgatggtcggcctgcagccgctgccgtgggagtacttcccctggctggtgggcacgctgctctgctactgcgtcaccgcgcagaccatgaagaccctctacatccgccgcttcggccagtggttctga

SEQ ID NO: 10676 - DNA, 1134 bp, Pseudomonas aeruginosa
gccatcggccgggcttcgtcccggcctttcccggcgcgtcggcaagcctcgccgcgccgcgcaacgcacaccggacccacgcatggagagacgcatcatgaccctgcacgaccggcgcccgcgggcgccccttttccaaccgctgccggccgcgctgcgacgcgccctgtcctggcgcctgggcttcgtcgccgcggcgctagcctgcgtcctgctgctggcgctgctgtccgaggctcgcgccgcgggcggcgcctaccgggtcgacgacggcgagatcgaccccgtcggcgaatgcaacctggacgcctggcaccagcgcgaacgccaccacggcaaccgctaccagtcggtgctgtcccccgcctgcaccttctccgccctaccatcggtgcagctcggcgcggcgctggtgcgcgagggcgacgcaggcgatcggcacagccgcctcagccccgagctgaacacaccgatgatggcccgcgacgacctcggcctggcgttggccttcgcgctctcggcggatctctacctggaccgccggcacgccttcgaatgcgccggcttcaacctgccgctgagctaccagccgttcgaggccctgcgcctgaacgccggggtcggcctggggcatgcctacgccgagggcgagcgccggcatcgctggaactggggcgtgggcatggaataccgggtcggccaaccgttgaccctgatcgccgaacgcttcggcgagtcggccggcgacagcggctggcaggccggaccgcggctgcacctgggcgaacggctggacctcgatctgctggtcggcggccacctgcgcggcgagcgcgagcgatggctggtctcgggagcgaccttgcgtttctgagcccaagggcgtgccgcgctgcggcacgctcctccaccgaggaaacagccatgaacgtcgtacgcaaatgcctgggcgcgtctcgccgcgcgctctgtggcctggcagcacggctgctggcgaaggccgcgcacctgctgatggtgatcagcgtgcgcgcatacgccagcggccgcctgagccaggtcgaagtgaaatacctgctggactgctcgagcgcgctcaaccgtgcctcgctcaggctggccatgggtcaatga

SEQ ID NO: 10677 - DNA, 1710 bp, Pseudomonas aeruginosa
gcccgttcccttcacgatccattccgaaccgggagttccgccatgctgggaaccatcctcctgatcaacctggccggtgccgtggcccttctgttgtggggcacgcacatggtctccagcggcgtgctgcgcggtttcggcactgcgctgcgcaactggctcggccgccacctgggcaaccgctggctggccctgctcgccgggctcggcatcaccggcctgctgcagagcagcaccgccaccagtctgatggcagcgtccttcaccgccagtggcaccctgggcctggcgccggcgctggcagtgatgctcggcgccaacgtcggcaccactctggtggtgcaactgctcagcttcgacacctcgttgctggcgccgctggccctgctgtccggcctgctgctgttccgcctgggcgacggtccgcgcctggagagccttggccagtgcctgatcggactcggcctgatgcttctggcgctggcgttgctcggccattccctgcagcagatcgaggcctcgccagcctttgtcgcggtgatccacggcctcgaaggcgatccgctgatcgccctgctgctcgccgcgctgctgacctgggcctgccattccagtgtcgcggtggtactgctggtggcgtccctggcccaggccggactggtctcgctgcccatcgccctggccctggtgctcggtgccaacctcggcggcgccttgccggcgttgggggtggccggtagccgggtggcgcggcgcctgccgttgggcaacctgctggtgcgcctgctcggttgcctgctggtgctgccctggctgacggcgctggcgcagccggccaacgcactcggcggtgcggcggcggtctggttccacagtgctttcaacctggccctggcactgctggcgatcggcttcaccggcccccttgcggcgctgctcgcgcgcctgttgccggaagaggcacagtccgacgacccgggcatgccgcgctacctcgacgaagccgggctggaggtggccaacatcggcctggccaacgctactcgcgaagtcctgcggctggccgacatggccagtctgatgctgcgcgccaccagcggcctgttgcagcgaccggaggcgaaggtggcggcggaaatccgtcgccaggaccaggccctcgaccagttgagtgcggcgatccgcgcctacctggcagacctcggccaggacggcctcggcgacagcgacgccgatcgtgcccaggaaatccttctgttcgccatcaacatcgagcacatcggcgatctcgtcgccaacagcctgctgcccctggcgatgcgctgggccgggcgcagccgcgccggcagcgagttcgagctgggccgcatgctgccgttgcaggcggcgatcgaggagagcctgcacctggcgatcagcgcgttccttcgcgaagacctggacgccgcgctgcgcctggtggcgcgcaagaagttgctgcagcgactggaggccgatgccagtcgcgagcgcttccgtcgcctgcgcgacgatcgcggtgcctgggtggagtccggtgacgtgttccagcgcattctccgcgactaccgacgcatccaccatcatgtcaccgccctggcctatccgctgctcgaacgcagcggcatcgatccgatggcgaagcggccggacgagccagggcaaggggagggatcggcatgcgcctcctga

SEQ ID NO: 10678 - DNA, 927 bp, Pseudomonas aeruginosa
ccatcagcagcggcagccaggacagccagtggcgcaggcgttgccactgcgcccgcccggggcgccgggccaggtcgcggcgggtcagggccaggccgagcagggcgccgctccattccgccagcaccgaggcgcgggccgcgccttgcacgccccagtcgaggccgtggacgaaccagagcaccagggcgatgttgctcaggttggtggtcaacaggatcgccaatggcgcccgtgcgttctgcgtgccgaggaaccagccgaccagtgcgtagctggccagggccgccggcaggccgagcaggcgggtatggaagaaggcgcgggcctcgccggtcagttccgccgacggttgcatcagttgcagggcccagccgctcaggggcagggccagcgcgccgagcagcagggccaggagcagcgccatgcccaggccctgggcgaggatcaggcgcagcgcgccgccatcgtcgcggccggcggcctgggcggcgaagccggtggtgcccatgcgcaggaagccgagcacgccgaccatcagggtgtacaggctgccgcccacggctaccgcgccgagctggtaggcgtgcggcaggtggccgaccaccgtgctgtccaccaggtgcaccaggggaacggaaacgttcgacagaatcatcggcccggccagcgcccagaccctgtggtgggtcggggcgtggcgccaggcatcgcgcaacaggctcatggggtcctccggatcggccgggcagtatagcgacggcggcgaggcctgcggaaaacccgtttttcatatccggtaacagacctctgcctgccgtgtattccttgtccgacgcggcttccaggcctgccgcggggaaccctgcgaaaacctgtcaggaagcttgcgcagcgctaaccgcggggctttgcgcaccttcctag

SEQ ID NO: 10679 - DNA, 399 bp, Pseudomonas aeruginosa
aatgccggcgtcggttgtttccagaggaagccatgcatgctcctggggcgtttcgtctcggtcggcgccggtgccaccgccgttcattacctggtgctgaccctcctggtcgagggcttcgccgtcggcgccgccgtggccgccgcgacgggagcaggctgcggggctctggctgcctacctggggcatcgccggaagactttccgccaccgtggcccggtgttccgttcgctgccgcgcttcttcgccgtcagcctgctttgcgtactcggcaacgccgtcctggtgttgctgctcggcgacctcgccggactcgactaccgcctggcccagctcgccgcgaccggcgcactgctgttggcgacctatcaccttcatcgactctggaccttctcatga

SEQ ID NO: 10680 - DNA, 2448 bp, Pseudomonas aeruginosa
tcgaccgctacctgccggcgcaggtcggcggggccaatccgtgagggcgctgcgcggctggccgctggcctggttcctgctcgccctggccttcgccatccgcctgctgagcctgggcagctatccgctgatggacaccaccgaggcccgctatggcgaggtggcgcggaagatggccgaactgggcgactggatcacgccctggtacgacgtcggcgtgccgttctggggcaagccgccgctggccttctggctcagcgccggcggccagcttctgctcggcgccaccgagttcgccagccgcctgccgcactggttgctgggcgtgctggtgctgtggctggtatgggactggcaggctcgcgaagatcgtcggcaggcgcggatcgcctgcgtcctgctgggcagttcggcgctgttcttcgtcgcctccggggcggtaatgaccgacatggccctggccctggcgctggtcctggccatgcgcggcttctggctgggcctgcatggcgcggagggaatccggcgccgcgagggctggctgatgttcctcggcctcggcctcgggctgctggcgaaggggccgctgacgctgatcctcgccggactgccgatcggcctgtgggccttgctggagtggcgctggcgcgcgctctggcggggcctgccatggatccgcggaagcctgctgatgctcctggtggccgcgccctggtacctgctggcggagttgaagacgccgggcttcctcgagtacttcctgctcggcgagcattggcagcgcttcgtcaccgccggctgggacggcgaccgctacggcaatgcccacgcctatccctacggcagcgtctggctgttcctgctggccgccgcgtttccctggagcctctggctgccgctgctgctctggctgggctggcgccagcgcggggaggtggtcgatggcgtcgcctcgcgcaggcgctactggctgttctggggactggcgccgtgcctgttcttcaccttcgccggcaacgtcctctggacctacgtgctgcccggcctgccggccctggcgttgctcgccgccgacctgctgcgcgcgccgctggcgcgcagcgcctggctgcggcgtggcgggttggcttgcctggcactgaccccattgctgttcgcgctgttcctcggctccctgctgctgggctcgcgcgccgagcagaagtccaccgccgcgctgctggccagcgacgccggctggcgcgagcggccgctggtgttctggccgaagcggccgtactcggcagtgttctacagcggcgggcgggcgcaacgggcggaggacagcgagctggccggctggttgcgtcgcgacgccctgctggcgatccgctcgcgttcgttcggcgccttgcccgacgaggtgcgccagcgcttgcgctgccggccgccggtgggacagtaccagctatgccagggcgtggcgccgcctggctgagactacctcggccggtaggcgcagtagccgggacgcgggccgatgcgcgggtggttgcggcaggtgtccgggcggcgggcatagatggtgcacaggcgggtcttgcggtcgaggtacaggcagtcgccgttggccatgcgggtgagggtgaagatctcgcgcttgtggttgaagtgctcgatcacgccatccttttccagtcgcttggcgattcgcttggccggctcctcgcgctcgaactcgtcgaccagtcccatgcggatcaggtcgtcgatgcgcacttccaccggcagcgtgcagcaggtcgcgttgcactcgccgcacaggccttcgcggtatttcacccaggtatccaggcggtcggggtcggcggcggcgagcgggattttcttcatcggcgggcgggtgcggggaaaacgggcgcgcatgatagtggctgcgcgcccgttgcgctcgtccgggcgatgagcgtcagtgccgtgggtcctcccgccataccggccggtcctgctcgtccagcgcccagtgcgcggtgccggcgcgcaggcatacgccgccgacccagcgttcgggggcgccgaggtcgaggcggtagcgccgcccggccaggacctcgcggcccgcagcggtcagggccagcggttggcgttcccagggcagttccggcgccggcgtgcgcagcagcgcgccgggctcttccagcagcgcgcggagcaggacgcggaacatcaggtcgccgagatagggcagcggctcgcgccctgcggtcagctcgggcgaagacctggccggcgctcggccgctcgccgtcgcggacgatctccagggtcagccgttcgctcagcgacaggccgtcgcgcagggccggcagttcatgcagttgccgacgcagcgccggccccagcaacggtagcgccggggtcggcgcggcggccagttgcgcccagcgcagtggcgccggatcgcggtag

SEQ ID NO: 10681 - DNA, 1239 bp, Pseudomonas aeruginosa
gcacggctcgacgcctttggcggcgctgtcaggctggggttccggcccgcccagcacgtgccttgccaactgcctgtccaatccgaacggagtctcgacgatgaacaagaacaagacgttcctcgcggcggcgctggtaacgctggccgccagccttcccgtgcacgctgcgaccgactacacccgcacgcgctatcccatcgtgctgtcccacggtctgttcggcttcaagagcgtcggcccggtggactactggcacgctatcgtgccggccctggagaaggacggcgcgaaggtcttcgccacctcgcagtcgccggtgaacagcaacgaggtgcgcggcgaacagctactggcgcaggtggaggaagtcctggccctgaccggcgcggagaaagtcaacctgatcggccacagccagggcggcatgaccgtgcgctacgtcgccggggtggcgccgcaactggtggcctcggtcaccaccatgggcacgccgcacaagggcacgccggtagccgacgcggtgaccggcttcagcgagttcctcgggccgatcggcaccgaggtgatcgcctcggcggtggaggcgctgttctcggtggtcgacatcgtcgacggcggcgagtgggtcaagggcgacgcgctggctgccctgaacagtctcaacactcccggcaccgcgcggttcaaccagcgcttcccgcaggcgatcccggccagcgcctgtggccagggcgcggagacggtagccggggtgcgctactactcgatgagcggcaccggctccctgaccaatgcgctcgacccgagctccgccggcctggcggtgaccgggctgctgttcggcgaggccaacgacggtctggtcggccaatgctccagccacctgggcagcgtggtgaaggacaactaccggatggaccatctggacgaagtcaaccagttgctcggcctggtcagcctgttcgagagcgacccgacccaggtctatcggcagcatgccaatcgcctcaggaacgtcggactctgatccgctcgccgggtcgccgcagccctaggcgacccggcattagtctttggtctaatggcacctggatatcacctcctgttcgcgcgcctcgcggcgttcggacctgtcccgattccgcgcaccttgctggacaaggtttgcgccgccgtgtaatgactccggtcaaggcagaaaaacccagcgttcgtgtagggttcgctgccccgtag

SEQ ID NO: 10682 - DNA, 903 bp, Pseudomonas aeruginosa
tcaggacatccacgcccgctccgcgaccaccacgccgatgccctcggtgcggaaccaggaggaagtggcgaaactgatcgacgtgtccaagtgcatcggttgcaaggcctgccaggtcgcctgctcggaatggaacgagctgcgcgacgaggtcggccacaaccacggcacctacgacaaccccatggacctgacggccgactcgtggacggtgatgcgtttcaccgagcacgagaacgaggccggcaacctcgagtggctgatccgcaaggatggctgcatgcactgcgccgagccgggctgcctgaaggcctgcccgagcccgggagcgatcgtgaagtacgccaacggcatcgtcgacttcaaccaggacaagtgcatcggttgcggctactgcatcaccggttgcccgttcgacatcccacggatctcgcagaaggaccacaaggcctacaagtgcagcctgtgttccgaccgcgtctcggtgggcatggagccggcctgcgtgaagacctgcccgaccggcgccatcgtcttcggcagcaaggaggacatgaaggaacacgccgccgaacgcatcgtcgacctgaagagccgcggttacgagaacgccggcctgtacgaccccgaaggggtgggcggcacccacgtgatgtacgtgctgcaccacgccgacaagccgtcgctctatgccggcctggccgaccagccgagcgtcagcccgctggtcagcctgtggaagggcgtgaccaagccgctggcgctgctggccatgggcgccacggtgctcgccgggttcttccactatgtgcgcgtcggtcccaaccgcgcggacgacgaggaagaccacgggcaagccgaggcaccggtgcaccaggtcgatccgtcggtacacacctttga

SEQ ID NO: 10683 - DNA, 723 bp, Pseudomonas aeruginosa
cccgcacgagcgtcgttgagcctgcgcgcgggcgttgccgccggtcctccgcgacccggcggcagcggcggcgctctcggaggagtcggaaatgaaaaaatgaaattcaaggggaaaacaacgccaacgagcgcagcaaccattgggcccgtggcgatcctgttattcatggccgggttgtccgggctggcgctgttccacccggcgctgttctggctgaccaacctgttcggcggcggtccctggacgcgtatcctgcaccccttcctggggctggcgatgttcgtcttcttcctcggcctggtggtgcgcttcgcccaccacaaccgggtgcagaagagcgatatccagtggctcaagcagtggcgcgacgtggtcagcaaccgcgaggagaacctcccggaagtcggccgctacaacgccgggcagaagctgttgttctgggtgctgctgctgagcatgctgaccctgctggtcaccggcatcgtgatctggcgccagtacttcagcgcctggttcggcatcgaggcgatccgcctgtcggcgctcctgcacgccttcgccgccttcgtcctgatcgccagcatcatcgtgcacatctacgccggcatctgggtcaagggctcgatgggcgcgatgctctacggcaaggtcagccgcgcctgggcgcgcaagcaccataacggctggctgaaggaagtcggcaagggcgaggagcactga

SEQ ID NO: 10684 - DNA, 1053 bp, Pseudomonas aeruginosa
tgtcgccatcgcccgaccggaggccccagcgatggggcctttgcattcattccgcgcccctccgggcgcccgatcgttgcggcgcggcccaccggcccgccggcgcagacccgaggagttcccgtgtcacgcaccattcttcagccggggcagatcgaagccgccgccaacattcccccgcacctgcaccagccgtcgcgcgacctgttcgcccgccgcggcgagcgtctgctgcaactggccgaggggcacccgatgggcgactacctgcggctggtcgccggtctctgccggctccagcaggcgctgctggacaacccgccggccctggccccgctcgaccccgagcgcctgcgcaagagccgcgagcacggcatgccgccgctggcctacgacctgctggtgcgcgaaggcgcctggctgccctggctggatgccctgctcgcgggctacccggcaccggccaacgccgccgtcggcgcggcactcgaacaattgcgcgaagccgatgaaggccaacgcaaggcctgggccatcgccttgctcagcggtcagttcgacctcttgccggcggccctggtgccgttcctcggcgccgccctgcaggtagcctggagccattggctgctgggactggaggagggcgcggtggtcgagaccgagagccggaccctgtgccccgcctgcggctcgccgccgatggccgggatgatccgccagggcggcaaggaaaccggtctgcgctacctgagctgctcgctgtgcgcctgcgaatggcactacgtgcggatcaagtgcagccactgcgaggaaagcaagcacctggcctacctgtccctggagcatgacgggcagccggcggaaaaagccgtgctgcgcgccgagacctgccccagttgccagggctacctgaagcagttctacctggagttcgaccgccacgccgatgcccttgccgacgacctggccagcctggcgctggacatgcgcctggccgaggacggctacctgcggcgttcgccgaacctgttgctggcccccggcggcgaatag

SEQ ID NO: 10685 - DNA, 3339 bp, Pseudomonas aeruginosa
ggtttctccatgagttccgttcgcttgccttcggtcgaccgcctgctgcgcagcgcggcggccgctcccctgcaccagcgctacggccgcgaggcgttgctggcgaccctccgcgacctgctcgacgaactgcgcgagccggcccgacgcggtgccctcgccgagatcgaactgagcgaggcggtgctcgccgggcgcgccggcgaacgcctcgccgcgcagcatgccagccgcgtgcggcgggtgttcaacctgaccggcacggtgttgcataccaacctcggccgcgccctgctgccggacgaggccatcgaggcgatcaccctggccgcgcgctacccgctgaacctggagttcgacctggccagcggcaagcgcggcgaccgcgacgacctgatcgccgggctgatccgcgaactcaccggcgccgaggcagtcaccgtggtcaacaacaacgcggcggcggtgctgctggcgctgaacagcctgggggcgcgcaaggaagggatcatctcgcgcggcgagctgatcgagatcggcggtgccttccgcattcccgacatcatggcccgcgccggcgtgcgcttgcacgaggtgggcaccaccaaccgcacccacgccagggattacgaagccgccatcggcccgcgcagcggcctgctgatgcgcgtgcataccagcaattacagcgtccagggcttcaccgccagcgtgcccaccgcgcaactggcggccatcgcccatggccatggcctgccgctgctggaagacctcggcagcggcaccctggtggacctgacccgctggggcttgcccaaggaaccgacggtgcaggaagccctggccgacggcgccgacatcgttaccttcagcggcgacaaattgctcggcgggccccaggccgggctgatcctcggcaaccgagaactgatcgggcggatcaagaagaacccgctcaagcgcgccctgcgcgtcgacaagctgaccctcgccgccctcgaggcggtgctcggcctgtaccgcgatccggaccgcctcgccgaacgcctgaccaccctgcgcctgctcagccgcccggcggcggagatccgcgcccaggccgagcgtctggcgccggcgctgggcgaggcgctcggcgagggctgggaggtcgccgtggtcgacgcccctgggcatgatcggcagcggcgcgcagccggtggcgcggctgcccagcgccgcgctgtgcctgcgtccgcggcagcccaggcgcctgcgcggacgcgccctgcgcaacctcgaggaagccctgcgcgggctgccgctgccggtgatcggtcggctcgaggacgacgccctctggctcgatctgcgccagctcgacgacgagccggggttcctcgcccagttgccgcgactgcggagcgagctgtcgtgatcgtcggcaccgccgggcacatcgaccacggcaagacctcgctgctgcgcgccctcaccggcatcgagggcgaccgccgcccggccgagcgccaacgcgggatcaccatcgacgtgggctatctctacgccgaccttggcgacggcagccccaccggcttcatcgacgtgcccggccacgagcgcttcgtccacaacatgctggccggcgccagcggcatcgattgcgtgctgctggtggtggccgccgacgacggcttgatgccgcagacccgcgagcacctggcgatcgtcgaactgctcggtatccgccgggcgctggtggcgctgaccaagatcgaccgggtcgagccgcagcgggtgcagcaggtgcggacccaggtcgaacacctgctggcctccggcccgctggcgcgctcgccgatcttcccgctctccagcagcaccggggagggcgtcgaggcgttgcgcgaagcactcggcgggctcgccggcgaagtccgcgagcgtagccgcgagggatacttccgcctggcggtggaccgggccttcagcgtcgccggcagcggcatcgtggtcaccggcacggccttctccggacaggtcgcggtgggcgacgaactgctcctcggcaacgccggacggccggtgcgggtgcgcggcctgcacgcgcagaaccggcccgcgcaacaggcctgggccggccagcgcgtggccttgaacatcgccggcgagcgcctcgcgctggaacagatccagcgcggcgactggctgctgcaggccgcgctgcacgcgccgaccacgcgggtcgacatcgacttccgcctgttgcccgacgaactccgcgacttcacccactggaccccggtgcacctgcacctgggcacccaggacgtcaccgggcgcctggccctgctcgaaggcgaacaactggagcctggccaccgcgccttcgcccaactggtgctgaacgcgccgatccaggccctgcatggcgaccgcctggtgctgcgcgaccagtcggcgcagcgcacccttggcggcgggcgggtgctcgacggcgccgcgccggcgcgcaaccgacgaacgccggcacgtctggcacagcttcaggcgctgcgccaggaaagcctggaggaggcgctgccgaccttgctcggcgcggccgagaacggcctcgacccgcaacgcctggtgcaatccttcaaccgcccgcgcgagcactggcggctgccggaagaggtggtcgaggtgcagacccgcctcggcccccggttgttcgccggggagcgctggttcgccctggtcgagcaactgctcgccggcctgcggcgcttccacgaagagctaccggacgaactcggtcccgaccgcgaccgcctgcgtcgctacgccctgccgcagctggagcggccggtgttcatcgccctgctcgacgccgccctggccggcggcgatgtgcacagcagcgggccctggctgcacctgcccggccacgaagtgcgcctgagcgatagcgaggagcaactgcgcgcgcgcctctggccgctgctcgaagccggccgctacgacccgccctgggtccgcgacctggcccgcgagctgcgccaggatgaagccgtcatgcgcaacctgctgcgcaagctggcacgcctgggccagttgcagcaggtggtgcgcgacctgttctacccggaagccaccctgcgtcaattggccgagatcgccgtgcaggtgcgcgaccccgccgggctgatccgcccggcggaattccgcgaccgcctgggcatcggccgcaagcgcagcatccagatcctcgagcacttcgaccgcatcggcctgacccgccgcatcggcaacgaccgtcgcctgcgcgagggttcggcgctggccgaacagttgctcggcggcgtctcgccctga

SEQ ID NO: 10686 - DNA, 603 bp, Pseudomonas aeruginosa
acatcgccgccggcgacggcgcctatatctacgacaccgccggcaaccgctacctcgacgcggtgggcggcatgtggtgcaccaacatcggcctggggcgcgaggaaatggctcgcaccgtggccgagcagacccgcctgctggcctattccaatcccttctgcgacatggccaacccgcgcgccatcgaactctgccgcaagctcgccgagctggcccccggcgacctcgaccacgtgttcctcaccaccggcggttccaccgccgtggacaccgcgatccgcctcatgcactactaccagaactgccgcggcaagcgcgccaagaagcacgtcatcacgcggatcaacgcctaccacggctcgaccttcctcggcatgtcgctgggcggcaagagcgccgaccggccggccgagttcgacttcctcgacgagcgcatccaccaccttgcctgtccctactactaccgcgctccggaaggagtgggcgaggccgagttcctcgatggcctggtggaggagttcgaacgcaagatcctcgaactgggcgccgaccgggtgggggcgttcatctccgagccggtgttcggctccggcggcgtga

SEQ ID NO: 10687 - DNA, 738 bp, Pseudomonas aeruginosa
tgtcactgcgcggtgcctacggttgaggagcggccctgtcgcaacaccgcctatggcgttaatgtgccgttaacgcccttggtgggtaatgggtcgcagcgcaacacggagaaggtcgtcatgtccgaacgagagcactggcaacgggtatacgagagcaagccgtccgacgcggtgagctggttccaggccgaggccacgctgtctctcgacctgatccgacgcatcggcgcgccccgcgaggcggcgatcatcgatgtcggcggcggcgcctcgaccctggtcgacggcctgctcgccgaaggcttcggcgacctgacggtgctcgacctttccgacgccgccctgcgtgtcgcccgcaaccgcctcggcgcgcgcggcgaagaggtgcgctggatcgccggcgacattaccggcgtcgacctgccggaagccacctacgatgtctggcacgaccgcgccgtgttccacttccttaccactgccgaagcccgccgcgcctacgtgcgccaggtgatgaaggcggtccgccacggcggccacgtgatcgtcgccaccttcgccgccgacggcccgaccgaatgcagcggcctgccagtcatgcgctacgacgccgacgaactgcacgccgagttcggctccgccttccagctcaccgagcaccgcgacgaacaccacgtcactcccgccggccgggtccagcacttcgtctactgccattgcctgaaacgcctgtga

SEQ ID NO: 10688 - DNA, 855 bp, Pseudomonas aeruginosa
cggctgcgctacgtttggctggggagggcgctttcgtcgccgcgaagccgtaagataacgcgcttcatggcgcgcccgacggacgggtgcgcacgcttgcctcgggagaacagggatggccgagatcaatccgctttcaacggacctgcaacagcaactggcggagctgcaggcacaggggctcgccttgcttggcgtcgccgcggacgagacgccggcgcagatcgtcgccgccgtcaccgactacgtgcgcgatgcgagggagcaggggcgcagcctcgacgacgaggcggtcttcgccctcggcgcgctgatcggcgcgcagtacgtgcgtggcctcggctggcactggggcgacgtgacctgggacggcgacccggacagcgccgccgtcggcgtgctcagccccgacgaatcgctgttcaacaaccccatcggctgggtaagccagatcgccgaaagcggcggcggggtgccgttcatgctcagctacaacatgatcctggccaaccaggtgccgctgttcgagcggggcagcgccaccggtctctattgagcatgcaggcggatcgccgctacgcgccggcgcatcccgccaggcggggccgacaacctgaacggccggcgtcaggcgccgcgacccgccgagcagcgccaaccggcgaacgaggtgcgggtgaccgtggtggaacagacgctgcctctgagaaaccgcgcctgcggcgctttccaggaaggcagcctggaacgacgcgactgccgagcccatatcgggctgcaattccgcgattgagtgggctgcgggttcgcgactcggctggccttcctgggaacacttctgaggttttcgcatga

SEQ ID NO: 10689 - DNA, 492 bp, Pseudomonas aeruginosa
ggtcagcacccgctcggattcgaggatcagccgtgccagttcgccgccgctggagatttcgtcgagttcctcgatcagttcgctttcgtcgatgttcaccccgggttggcggcacatcagcaggcgcgcgccggcctcgcgggcctggcggatgaagtggcgcagcggctcgccgccgtccagcgcgcgcaactggtcggcgacggggcggcgggccaactgcacgccttcgccgctgaggaacagggtcacctcggcgtccatgcaggccagcagggtggcggtgtggaagggcgcggcgcagcgggccggggtgctcgggccgctggagacgatgatgaggacgcgctgggcgtgggtgtcagggttcaaggggcttgtccatctggatcagcgccacgcgccggccgtccggatcgtggcgttcggcgatggcgcgcggctggtagccgagctgggtatagagcagcagcccggcggcgttggcgttga

SEQ ID NO: 10690 - DNA, 1272 bp, Pseudomonas aeruginosa
cctggcggtcctgacccagggcgccggcgcggtcggccagtcgagcctggccgagctggcgcgcttgaacgccggctatatgttcaaggccgaggacggcagctatccctaccgccagaagccgctgcggattcctacgctgcgccaggcgctgcgggcgatcccgccgcaggtgccggtgttcctcgacatgaagtcgctgccggtggagccgctggtcgatgccgtggccggcgagctggagcggcagaaggcctggtcgcgggtgcgtttctattccaccgagaaggccgccaacgactacctgacgcagcgctacgcggaccgcgcgcgacagttcgaaagccgcgatgcgacgcgcaaccgcctggtcggcctggccttcggcgagcgctgcgaggcaccgccggccggcggcacctggatgggcatcgagctgcgccgcgaactgacggtgaccgagcgcttcacccttggcgagtcttcctacaaggtgccggcggcgcagttgtggacgcgcaaagcgatggactgcgtgcgccgcgagccggtgaaggtggtgatgttcggcatcgagaccgccgaggactaccgcaccgcgcgcgccctgggcgccgacgcggtgatgagcaactcgcccaggaagatggaggcgatccgccgccgggtgctcgccgatcagcccggcgggtagctcgacagcgcccgtttcaccgcttcgcgcagggccttggcctgttcgctggcggagtcgccggagtcgaactcggcgctgttgccccacaccggctggccgctgcgggcgtcgttcagctcgacgcggaccacggtgacctgcacggtgtagctgcgggtcaccgggtagctggcgccatagccgtaccagggatcgcgccagccgccgtagttgccgtagtagccgccgtagtagtcggtgacctggcgggtgcgcagttcgctgcgcaggaacgcgctgacctgcaggtcggccgcgctgcccggccgcgccgggcgcaggccgcgctggtcgagctgctggctgacggcgtcgcgcaactggttgtcgtccaggccctggggaaagccgctgaccccggcggcggcccagctccagctacggtagcgggcgtagtcgcgcggcgccgccggataggcgccgggatcgaggccgggattggccgcggtggccggctgcggcgggtagggcagagagctggcgcggtagggattgtcgccctggcaggcaccgagggcggccaggctggcgagtaa

SEQ ID NO: 10691 - DNA, 1344 bp, Pseudomonas aeruginosa
tctgaccgacgatgtagcgctgatgcgcccggtgatcgacgccctgcgcgccagcggctgcgatccggaccgggtcctggtccgtgtcgggctgccaccgggtggcctgccggccggccgtttcccccattccgcacagaacctgttctggaaggccgccgccgacgagtgcggcgaagagcatgtcggcctgcacctggccgagcacctgccggcgttccacggcctgctcctggaatacctgttcctctccagcgataccttcggcgccggcctgcgccattccctgcgctacgtacgcctgctgtccgacaccctgcaggcgcaactggaggtggagggcgagcgcgcggtgctgtcgctgggcgaatcgccggcgatcaaccgccacttcccggaaatgctcgccggcgcggtgatccgcctgttcggcgcgctcaccgagggcgagttcaagccgctggaagtgcaactgatgaacgaaaccggcgcgccgatggagcgctaccgtgcggtctacggctgcccgacgatcctcggcatgccgcgctacgcgctggtattcgatgccgcggtgctggacaaaccctcgcgccacgccgccccggaactgctgcgcatgcacgagtcgctggcgcgccggcaactggccgaggtggagcgcctggacctggtgcgccaggtccgcgaactgatcggcgagttgctggtggacggaggcgccaccctggagcaggtcgccgcgcgcctcggcatgccggcccgacgtctgcgcgaacgcctggcgatggccggggtgcgcttcaacgacctggtcaccgactaccgctgccgactggccaaggaactgctgctgaagaccgacgagcgcatcgaagtgatcgtcgaacgcaccgggttttccgagccgaacaccttctatcgcgcgttcaagcgctgggtcggcgagacgcccggtggagttccgccggcgcgggcatcaggggcgcgggtagggcctgtccgaaagggggctaccgggtcggcgtcctgttgccggggagtcaggggccgcctcaggcccccagcaggctctgcccgcacaccctcagcacctggccgctgaccgcgccggacgacggctgggcgaaccaggccaccgtttcggcgacgtcctgcggcaggccgccctggctcatggagttcatccgccggccggcctcgcggatggtcagcggaatggcggcggtcatctgcgtctcgatgaagcccggcgccaccgcgttgatggtgatgccgcgcttgcccagcgccggcgcccaggcctgggccaggccgatcaggccggccttgctcaccgcgtag

SEQ ID NO: 10692 - DNA, 501 bp, Pseudomonas aeruginosa
ttgctctgcccgaggttgccggcgatgccgctgatcgacgccagcaacaccacccggccgttgtcatgcagcttgccgccgtcgagcagggcctgggtcagcacctgcggggcattgaggttgacgttgatcaccgagttccagaagtcgctgctcatcttcgccagggtcttgtcgcgtgtgatcccggcgttgtgcacgacgatatcgacgccctccggcagcgcgtccaccagttgctgcccggcgtccgcggcgcagatgtcgagggccacggcacgaccgccgaggcgcgcggcgaggccttcgagggcctccctggccggcggcacgtcgagcagcaccacttccgcgccgtcgcgcgccagggtttccgcgatggccgcgccaatgccgcgggcggcgccggtgaccagtgcgcgctggccggccagcggcttgctccagtcgtggacctgggcgctgttggcggcaagacggatcacctggccggagacgtag

SEQ ID NO: 10693 - DNA, 777 bp, Pseudomonas aeruginosa
cgccctgaacggtcgccccgggcgcctgaccggacgtgcagaagtcgtctccagcgtcttcaatacggaatgacggtcgccgccaggcggccccgtagcgaaggccggaggggcgatggagagcatgctggacaggcccgagcaggaactcgtgctggtggtggacgacaccccggacaacctgctgctgatgcgcgagctgctcgaggagcagtaccgcgtgcgcaccgccggcagcggcccggccgggctgcgggcggccgtcgaagagccgcgcccggacctgatcctgctcgacgtgaacatgccgggcatggacggctacgaggtctgccgacggctcaaggccgatccgctgacccgcgacatcccgttgatgttcctcactgcccgcgccgatcgcgacgacgagcaacagggcctggccctgggcgcggtggattacctgggcaagccggtgagcccgccgatcgtcctggcgcgggtgcgtacccatctgcaattgaaggccaatgccgatttcctgcgcgacaagagcgaatacctggaactcgaagtgcgccgtcgcacgcgccagctgcaacagttgcaggacgccgtcatcgaagccctggcgacccttggcgatcttcgcgacaacccgcgcagccgccatcttccgcgtatcgagcgctatgtcaggctgctcgccgagcacctggcggcgcagcgggcgttcgccgacgagctgactccggaggctgtcgacctgctgagcaagtcggcgctgttgcatga

SEQ ID NO: 10694 - DNA, 621 bp, Pseudomonas aeruginosa
attcgacccacggctggtggaggccttcgtcgccgtggccgacgctttcgccgaggttgcccggcgctacgccgacagcgccgaggcgctggacgtggagatgcagcggctggaacaggcggtggcggaaagcatcgaactcaccgcgccaccggcctagtacgccgatcggtgcgcagtccggcggaaagccggcgcgtccggctgtgctcggcacggcgtttgccgtataacgtcagaccctttgccttacacattggccccgaggaaccgcgtagcaccgatgaagacacccagacgcctggaaccgttgatcgaagacggtctgatcgacgaggtcgtgcgcccgctgatgagcggcaaggaagcctcggtctatgtggtgcgttgcggcgacagcctgcgttgcgccaaggtctacaaggaagccaacaagcgcagcttccgccaggccgccgagtaccaggagggccgcaaggtccgcaacagccgccaggcgcgggccatggccaagggctcgaagtatggccgccgcgaacaggaggaagcctggcagaatgccgaagtggcggccctgttccgtctcgccggggccggtgtgcgggtgccgaagccctatga

SEQ ID NO: 10695 - DNA, 912 bp, Pseudomonas aeruginosa
agttttccggaggccgccatgcctgttgcacatatcctgctcgccctgctggtgaccctgatctggggtctgaacttcgtcgtgatcaaggtcggcctcggcgacttcccgccgctgctgttctgcgccctgcgcttcgccctggcggcgctgccgctgctggtcctgcgcgggccgatgccggcgccgttcggacgcatcctactgatcggcgtgctcctcggggtggtcaagttcggcctgctgttcgtcggcatggcccagggcatgccggccgggctgtcgtcgctggtgctgcagagccaggtattcttcaccatcctcatcgccgccctatggctgggcgagcggccgtcgccgcgcgggttgttcggcctctcgctggcggcggcggggctggtcctgatcggcctggaacggccgctgggagacagcctgctggcattcctgctggtggtcgccgcagcgctggcctggtccttcgccaatatcgccaccaagcgttccggggccaccgacatgctgcgcctgatctgctgggtcagcctggtcccgccgttgccgctgctggcgctttcctatctattcgaaggtccgcaagccatcgagcgcgccgtgctgaacatgagctggggcggcttcggcgcgctgctctacatcgccttcggcgcgaccacggtgggcttcgccatctggagtttcctcctgcgccactacccggccagcctggtgaccccgttcgccctggcggtgcctgtgtcgggcatgctcgccggctggctgctgctcggcgaacgcctcgacctggacagcctgctggcctgcgcgctggtgttcgtcgggctggccatcaccctgttgccggccagcctgctgcgacgcttcgcctggccggtgcggcggttgggatga

SEQ ID NO: 10696 - DNA, 570 bp, Pseudomonas aeruginosa
aggtgcggcccaccgcgcatttcgccggcaagccggaggtctaccggcggcgcctgcgggagaagaactggacggcgcgctggccgctgctggatatcagtggcagcagccagacgccaggtccttgaggatcgggcagtcggggcggtggtcgccctggcagtgctcgaccaggtcctgcagggtgtcgcgcagggtgctgagctcctcgatcttgcgattcagctcgcgcacgtgctgcgccgccagggccttgacgtcggcactggcacgctggcgatcctgccagagggtgagcagcttgccgacttcgtcgagggagaaaccgaggtcccgcgaacggcggatgaacgccagggtatgcaggtcgttctcgttgtagtggcggtagccgctggcgctgcgtccggctgggcggagcaactcgatggactcgtagtaacggatcatcttcggcgtcagtccgcttttcttcgccgcttcaccgatgttcatccgggtctcctgggaggttgcgaagccgctagcctatccctttcccggccaatgcgcaggctatcagatatgtga

SEQ ID NO: 10697 - DNA, 249 bp, Pseudomonas aeruginosa
ggcgcggccgagcagcacgctgtcggcgccgagggcgatcatccgcaccacgtcgagaccggtgcggatgccggagtcggcaaggatcgccagttcgcccttcaccgcctccggcgattgcccggcagcgccgcgggcgctggacagcacgccgtcgagctggcgcccgccgtggttggagacgacgatgccgtcggcgccgaacttcaccgcatcccctggcatcctccgggtcgaggatgcccttga

SEQ ID NO: 10698 - DNA, 441 bp, Pseudomonas aeruginosa
gcggacggttcgacgctgcgttgcccgccgaagctgccaccggccacggccgcgccgccgcctgcggcgagcgcttcgctggcgccctgcggctgccagaccttgaggaacagggtcagggagaccaggctgaccagtgctgaggtgatgtccggcaactccgggccgatgaagttggacgtcaggtactgggtgatggcgaagctgccgccggcgacgatggcggccggccaggtttcgcggatgccgcgccagccgtccatcatgaacaccagccagaacggtaccaggatcgacaggaacggcagttggcggccggtcatggcgccgatcttgaaggcgtcgatgccggtcacctggccggcgacgatgatcgggatgcccagtgcgccgaaggccaccggcgcagtgttggcgatcaggcacaggccggcggcgtag

SEQ ID NO: 10699 - DNA, 786 bp, Pseudomonas aeruginosa
gggtgtcgggatatggaatttggtcaggtcaggcagcgccgtctgtcggatgacatcgttgcgcaactggaggcgatgatcctggagggcacgctgaagtccggcgagcggctgcccgccgagcgcgtgcttgccgagcagttcggggtttcccggccgtcgctgcgcgaggcgatccagaaactggtggcgaaggggctgctggtcagccgccagggtggcggcaactatgtgaccgaatcgctgggcgcgactttcagcgatccgctgctgcacctgctggaaggtaacccggaggcccagcgcgacctgctggagtttcgccacacgctggaagggtcttgtgcctactacgcggcgctgcgtgcgacctccctcgatcaccagcgcctgaccgaggccttcgaggcgctccaggcctgctatgcgcgcaacgaccaggtcagcgcggaagagggcgccgccgacgcgcgcttccacctggcgatcgccgaggccagccacaacaccgtgctgctgcacaccatcaagggcctgttcgacttgctgcggcgcaacgtggtgaccaatatcggcgggatgtacgcgcagcgcacggaaacccgcgcgcaactgatggagcagcaccagcgcctatacgacgcgatcatcagcggtcaggcggagctggctcgggaggtgtccaaccagcacatccactatgtgcaggaggtcctggcggaggtccaggaagaggcgcgcaggatgaagcgctcgcagcgccgtcgcagcgtgcaggaagactag

SEQ ID NO: 10700 - DNA, 645 bp, Pseudomonas aeruginosa
aggcgaatttcggacaatgcccactcttttcctggccgctggccaaggttttgtaagaaaagtcttcaagtggcgtcaggctgcgctgagcgttttttctgccgaaccctggccccggtcgacgggcgcagcgcgccgccgtggcggatgccgccgtcccgccggctatgcttggggagtcgcccgctcgacagcagaagtgagagttctatgagcacccatatccagcgttcggcgctgttgccttatcccgcccgcgcgctgttcgatctggtgaacgacgtgaagcgctatccggagttcctgccctggtgttcggccagccaggtcctggaggagagcgaaagcctgatgcgcgccgagctgaccgtggccaagggtagcctcagccagcgcttcaccacccgcaacgtgttggtgccgggagcttccatcgagatgaacctggaaaacggaccgttcaccgaactgcatggcgtctggcagttcaaggcgctgggcgagaaggcctgcaagatcaccctcgacctgaccttcgattacgccgggccgctggtcaaggcgacccttgggccgctgttcacccaggccgccaacaccatggtcgacgcgttctgccagcgcgccaagcaactctatggctga

SEQ ID NO: 10701 - DNA, 465 bp, Pseudomonas aeruginosa
aagcccgatcatacccgtattccgggatactgcgaaacatcccgcgctgagaaagcagacatggttgaaaatagcgaacttcgaaaagccggccttaaagtgaccctgccgcgggtcaagatcctgcagatgctcgactcggccgagcaacgccacatgagcgccgaagacgtgtacaaggcgctgatggacgcaggcgaggacgtgggcctggcaaccgtctatcgggtgctgacccagttcgaggccgccggcctggtggtgcgtcacaacttcgatggcggccatgccgtgttcgagctcgccgatagcggccaccacgaccacatggtctgcgtcgataccggcgaggtgatcgagttcatggatgcggaaatcgagaagcgccagaaggaaatcgtccgcgagcgcggcttcgagctggtcgatcacaatctggtgctctacgtgcgcaagaagaagtag

SEQ ID NO: 10702 - DNA, 1848 bp, Pseudomonas aeruginosa
tcgcgcaacggttccatgcgaaaacggcgaccctggggtcgccgttttcattttccattgaaggaacgttcagttctgggcggccaggttgaccagtttcttcgcgtgggccagggattccttggtcaggtcgacgccgccgagcatgcgggcgatctcctcgatccgctgggccttgttcagggtggcgaccgccgtacgggtttcgctgctgccgcgttccttgtgcacgaacaggtgctggtggccctgggcggcgacctgcggcaagtgggtcacggtgaggacctggccgcgttcgccgaggcggcgcagcaactgtccgaccacttcggcggtggggccgccgatgccgacgtcgacttcgtcgaagaccagggtggggatgcgcgaggtctgtgccgtgatcacctggatcgccaggctgatccgcgacagttcgccgcccgaggcgaccttggccagccctttcagcggctgcccggggttggcgctgaccaggaactccacgctttccagtccgttggcctgcggctcggcgctgtcgccgggatgcaggacgatggcgaagcgccccccgggcatgcccaggcgctgcatttcctgctccacgctggcggcaagaggtgcggccgcggcctggcgcaggcggctcagttcgtcggctttttcctggtaatgccgggcgtaggcggccagctcgtcgcccaggcgtccgaccgcttcgtcgtcggcgttcagcgcctccagctcgtcgaacaggcgctgctgcaggtcggccagttcggcgggctggacccggtgcttgcgcgccagggagtaaatgacgtccaggcgctcctcgacctgctgctggcgattgggatcggcatcgaagtggtcgacgaagcggttcagttcgccgatcgcctcctcgacctggatctgcgcgctggacaacagattgaccgcttcgccgagagcggcgggctggccgctgaacgaggacaggcggttgaggctggcattgagcgcggaaaggacgttgccggcatcgctctcgctgcacatttccacgacttggcggcaggcggcgagcaggctttcggcgttgctcagggtcttctgctcctgctccaggctttccagttcgttttcgccgagggacaggttttccagttcttccagctggtagctgagcaactggtggcgggcgcgctgttcgtcgccgctacgcgacaggcgttcgagttcctggctggtctgcttccagcgttgcgcggcgagctgcacctggcgcgccagctcctggcagccggcatactcgtcgagcaggcgccggtgggtctcgctcttcagcagcgactggtgctcgtgctggctatggatgtcgatcagcagttcgcccaggctcttcaggtcgcccagcgggcagggcgtgccgttgatgtaggcacgcgagcgaccttcggcagtgatcacccggcgcaggatgcacggaccgtcctgttccaggtcgcgctcggcgagccagtcgcgggcctcggcgatggcgctgacgtcgaagctggcgagaatgtcggccttgtccgctccgggacgtaccgcgccgctgtcggcgcggtcgccgagggtaaggccgagggcgtcgagcatgatcgacttgcccgcaccggtttcgccggtgatcacgctcatgccggtagcgagttcgagatccagatgctcgacgatggcgtagttgtgaacggacaggtgaaccagcatggcgggcggctccgtgggttttgtctggttatttatacagtattttttccggctggcaattgccgctcgccccttgaaccgtggaaagccgtccccatatag

SEQ ID NO: 10703 - DNA, 513 bp, Pseudomonas aeruginosa
cgtcaaggtcatcgagaacgccgagggcgcgcgtaccaccccctcgatcatcgcctacaccaacgatggcgaaaccctggtgggccagccggccaagcgccaggcggtcaccaacccgcagaacaccctgtatgcggtgaagcgcctgatcggccgtcgcttcgaagagaacgtggttcagaaagacatccagatggtgccgtacagcatcgtcaaggccgacaacggcgacgcctgggtggaagtgaagggccagaagatggcgcctccgcagatttccgccgaagtgctgaagaaaatgaagaagaccgccgaagactacctcggcgagccggtcaccgaagcggtgatcaccgttccggcctacttcaacgacagccagcgccaggccaccaaggacgccggccgcatcgccggcctcgacgtcaagcggatcatcaacgagccgaccgcggcggcgctggcctacggcctggacaaggccaagggcgaccacaccgtgatcgtctatga

SEQ ID NO: 10704 - DNA, 525 bp, Pseudomonas aeruginosa
agtgatcctggtcggcggccagacccgcatgccgctggtacagaagaccgttgccgagttcttcggcaaggaagcgcgcaaggacgtcaacccggacgaagccgtggctgtcggtgccgccatccagggcgcggtcctggccggcgacgtgaaggacgtgctgctgctcgacgtgaccccgctgaccctcggcatcgagaccctgggcggcgtgatgaccggtctgatcgagaagaacaccaccatcccgaccaagaagtcgcaggtgttctccaccgccgacgacaaccagggcgcggtgaccatccacgtgctgcagggcgagcgcaagcaggccgcgcagaacaagtcgctgggcaagttcgacctggccgacattccgccggctccgcgcggcgtgccgcagatcgaggtgaccttcgatatcgatgccaacggcatcctgcacgtctcggcgaaggacaaggccaccggcaagcagcagtccatcgtgatcaaggcatcctccggcctgtccgaggatga

SEQ ID NO: 10705 - DNA, 501 bp, Pseudomonas aeruginosa
aatatcacccggaccgcaatcctggcgacaaggaagccgaggacaagttcaaggaggccaacgaggcctacgaggtcctctccgatgccagcaagcgggcggcctacgaccagtacggccatgccggcgtcgatccgaatatgggtgggggcgctggcgccggtttcggcggggcgagcttctccgacatcttcggcgatgtgttcagcgatttcttcggtggcggcggtgcccgcggtggctcgcgcggcggcgcgcagcgcggcgcggacctgcgctacaccctggacctcgacctggaggaggcggtacgtggcaccaccgtcaccatccgcgtgccgaccctggtcggttgcaagacctgcaacggcagcggcgccaagcccggtaccacaccggtcacctgcaccacttgcggcggtatcggccaggtgcgcatgcagcagggcttcttctcggtccagcagacctgcccgcgctgccacggcaccggcaagatga

SEQ ID NO: 10706 - DNA, 1206 bp, Pseudomonas aeruginosa
ctcttcacggtgtcatcccgcttttttacacctgcgcgaccagtcaggcttgatttacgggaggtcttcttgactaagccagccatacttgcacttgccgacggcagcatttttcgcggtgaagccatcggtgccgacggccagaccgttggcgaggtggtgttcaacaccgccatgaccggctaccaggaaatccttaccgatccttcctacgcccagcagatcgtcaccctgacctacccgcacatcggcaataccggtaccaccccggaagacgccgaggccaaccgcgtctgggccgccggcctgatcatccgcgacctgccgctgatcgccagcaactggcgcagcaagcagtcgctgcctgactacctgaaagccaacggcaccgtcgccatcgccggcatcgatacccgtcgcctgacccgcatcctccgcgagaagggttcgcagaacggctgcatcctggctggtgccgacgctaccgaggaacgcgcgctggagctggctcgcgccttccccggcctgaagggcatggacctggccaaggaggtcaccaccgccgagcgctacgagtggcgctccagcgtctggaacctggaaagcgacagtcatccggagatcccggccggtgaactgccgtatcacgtggtggcctacgactacggcgtgaagctgaacatcctgcgcatgctggtggcgcgcggctgccgcctgtccgtggtgccggcgcagacaccggccagcgaagtgctggcgctgaaccctgacggcatcttcctttccaacggccccggcgaccccgaaccgtgcgactacgcgatccaggcgatccgcgaattcctcgataccgagatcccggtgttcggcatctgcctcggccatcagttgctggccctggcctctggcgccaagaccctgaagatgggccacgggcaccacggcgccaaccacccggtgcaggacctggacagcggcgtggtgatgatcaccagccagaaccacggtttcgcggtcgacgagagcaccctgccggacaacctgcgagccactcacaagtcgctgttcgacggtaccctgcagggtatcgagcgcaccgacaaggtcgctttcagcttccagggccaccccgaggcgagccccggtccgcatgacgtcgccccgctgttcgaccgcttcatctcggcgatggccgagcgtcgctga

SEQ ID NO: 10707 - DNA, 3267 bp, Pseudomonas aeruginosa
agctggccaccgcaaccctgtcctgattattgcaacgagagtcccatgccaaaacgtacagacataaagagcatcctgatcctcggtgccggccccatcgtgattggccaggcctgcgaattcgactactccggcgcccaggcctgcaaggccctgcgcgaggagggctaccgcgtcatcctggtgaactccaaccccgcgaccatcatgaccgatccggcgatggccgacgcgacctacatcgagccgatcaagtgggccaccgtggccaagatcatcgagaaggaacgccccgacgcgctgctgccgaccatgggcggccagaccgcgctgaactgcgccctggacctggagcgccacggcgtgctggagaagttcggcgtggagatgatcggcgccaatgccgataccatcgacaaggccgaggaccgctcgcgcttcgacaaggcgatgaaggatatcggcctggcctgtccgcgctcgggcatcgcccacagcatggaggaggcctacggcgtgctcgagcaggtcggcttcccctgcatcatccgtccgtccttcaccatgggcggcaccggcggcggtatcgcctacaaccgtgaagagttcgaagagatctgcgcccgtggcctcgacctgtcgccgaccaacgagctgttgatcgacgagtcgctgatcggctggaaggaatacgagatggaggtggtccgcgacaagaaggacaactgcatcatcgtctgctccatcgagaacttcgacccgatgggcgtgcacaccggtgactcgatcaccgtggcgccggcgcagaccctgaccgacaaggaataccagatcatgcgcaacgcctcgctggcggtattgcgcgagatcggcgtggaaaccggcggttccaacgtgcagttcggcatctgcccgaacaccgggcgcatggtggtgatcgagatgaacccgcgggtttcccgctcctcggccctggcctccaaggccaccggtttcccgatcgccaagatcgccgccaagctggcggtcggctacaccctcgacgaactgcagaacgacatcaccggcggccgcaccccggcgtcgttcgagccggccatcgactacgtggtgaccaagatcccgcgcttcgccttcgagaagttcccgaaagctgatgcccgcctgaccacccagatgaagtcggtcggcgaagtcatggccatcggccggaccttccaggagtcggtgcagaaagccttgcgcggcctggaagtcggcgccaccggcttcgatccgaagctcgacctgaacgacccggaggccgacagcatcctcaagcgcgagctgaccgtgcccagcgccgagcgtgtctggtacgtcgccgacgccttccgcgccggcaagagcgtcgaggaagtgttcgagctgacccgcatcgacgaatggttcctggtgcagatcgaggacctggtcaaggacgaggagaaggtcaagaccctcggcctgtcctccatcgatcgcgagctgatgtacaagctcaagcgcaagggcttctccgacgcgcgcctggccaagctgctaggcgtcaccgagaagaacctgcgcagccatcgccacaagctgaaggtgctgccggtctacaagcgtgtcgatacctgcgccgccgagttcgccaccgacaccgcctacatgtattcgacctacgaggaagagtgcgaggccaacccgtcgagccgcgagaagatcatgatcctcggcggcggtccgaaccgcatcggccagggcatcgagttcgactactgctgcgtgcacgcggcgctggcgatgcgcgaagacggctacgagaccatcatggtcaactgcaacccggaaaccgtctccaccgactatgacacctccgaccgcctgtacttcgagccggtgaccctcgaggacgtccttgagatcgtccgcgtcgagcagcccaagggcgtgatcgtccagtacggcggccagaccccgctgaagctctgccgcgccctcgaagaggccggcgtgccgatcatcggcaccagtccggacgccatcgaccgtgccgaagaccgcgagcgcttccagcagatggtccagcgcctgaacctgcgccagccggccaacgccaccgcgcgcagcgaagacgaggccctggccgcgtccaaggccatcggttatccgctggtggtacgcccgtcctacgtgctgggcgggcgggcgatggaaatcgtctaccaggaagaagaactcaagcgctacatgcgtgaggcggttcaggtttccaacgacagcccggtgctgctcgaccacttcctcaactgcgccatcgaagtcgacatcgacgcggtatgcgacggcgagatcgtggtgatcggcgcgatcatgcagcatatcgagcaggctggcgttcactccggcgactccgcctgttcgctgccgccgtactcgctgccgcagcacatccaggacgagatccgcgagcaggtcaagaaaatggccctggagcttggcgtggtcggcctgatgaacgtgcagatggcggtgcagggcgaggatatcttcgtcatcgaggtcaatccgcgcgcctcgcgtaccgtgccgttcgtctccaagtgcgtcggcgagtcgctggccaaggtcgccgcccgcgtcatggccggcaagaccctggccgaggtcggcttcacccaggaaatcatcccgccgttcttcagcgtcaaggaagcggtgttcccgttcgccaagttccccggcgtcgatccgatcctcggcccggaaatgaagtccactggtgaagtgatgggcgtcggtgatagctttgccgaagcctttgccaaggctcagttgggggccagcgagattctcccgaccgccggttgcgccttcatcagcgtccgcgaagacgacaagccgttcgccgcccaggtggctggcgacctggtcgcgctgggcttcgaagtggtagccaccgccggtaccgcgcgtgtcatcgaggccgcgggcctgccggtgcgtcgcgtgaacaaggtgaccgaaggtcgcccgcacgtggtggacatgatcaagaacgacgaggtcaccctgatcatcaacaccaccgagggccggcagtccatcgctgactcctactccattcgtcgaaacgccctgcagcacaagatctgctgcaccaccaccattgcgggtgggcaggcgatctgtgaggcgctcaagttcggtcccgagaagaccgttcggcgtctgcaggatctccacgcaggaatcaaggcatga

SEQ ID NO: 10708 - DNA, 471 bp, Pseudomonas aeruginosa
gaaccccgggcggcgacgtcgagtacgagatcgtcgaggttcgccatatctaagcgcgccccgttgcgcgcaggcgcgatcagttggctgctggcccagacgttctgggtcggcggcctctggttgctgcagttcgtggtcctgcctgcgttggccaagaccggactggcgccgctgctggtggaaaccgtagccgcggcgttgacgccgctgctgatcggcttcgccggattctgtgcggcgctgcaggcgctggtgttggtgtcgagccacgggccgaggagcctctggcgagaccttcgcggtcagttgttgctcgccgtcgcgctgctctgcctggtgtatttcctggtgcgtgggctggcgcccgaggcggtgcgctggctgctgttcaactacctggcggtggcgatgtgtggcctgctgctggtgttgcagccggtaccggggcgggacgaggaaggcgtctga

SEQ ID NO: 10709 - DNA, 1380 bp, Pseudomonas aeruginosa
tctccgccgttgaaatggcggattgagcacggaagacaaaagatgagcagaaaatacttcgggactgacggtatccgtggtcgtgttggcgagtttccgattactccggacttcgttctcaagctgggctgggcggtgggcatggccttccgccggcagggcaactgccgggtcctgatcggcaaggacacgcgcagctcgggttacatgttcgagtcggccttcgaggccgggctctccgcttccggcgccgataccctgttgctgggaccgatgcctacccccggcatcgcctacctgacgcggactttccacgccgaggccggggtggtgatcagcgcttcgcacaatccccacgacgacaacggcatcaagttcttctccgggcaggggaccaagctgccggacgacgtcgagctgatgatcgaggaactgctcgatgcgccgatgaccgtggtggagtccgcccgtctcggcaaggtttcgcggatcaatgacgcggcggggcgctacatcgaattctgtaagagcagcgtgccgaccagcaccgacttcaacggtctcaaggtcgtgctcgactgcgccaacggcgctacctacaagatcgctcccagcgtcttccgggaactgggcgcggaagtgacggtgctggcggccagcccgaatggcctgaacatcaacgacaagtgcggttccactcacctggatggcctgcaggctgcggtggtcgagcaccatgccgacctcggcatcgccttcgacggcgacggcgaccgggtgatgatggtcgaccataccggtgcggtcgtggatggcgacgaactgcttttcctcatcgcgcgcgacctgcaggaaagcgggcgcctgcaaggcggtgtggtcggcaccctgatgagcaacctcggcctggagctggctttgcaggaactgcatatcccgttcgtgcgggcgaaggtcggcgatcgctatgtgatggccgaactgctggctcggaactggatgctgggaggggagaattcgggacatatcgtctgctgccagaacaccacgacgggcgatgccatcatcgcggcgctacaggtgctgatggcgctcaagcatcgcggccagaccctggccgaggcgcgccaggggattcgcaagtgcccccaggtgctgatcaatgtgcgcttcaagggcgaaaacgatccgctcgagcacccctcggtgaaggaggccagcgtccgcgtcaccgagcaaatgggcgggcgcggtcgtgtcctgctgcgcaaatccggcacagagccgttggtccgggtgatggtcgagggtgacgaggaagctagcgttcgtgcccacgccgaacagctggcaaaaattgtttctgaggtatgtgcttga

SEQ ID NO: 10710 - DNA, 549 bp, Pseudomonas aeruginosa
ctggacagtccatgccacggttccgagtggcaatttagggatgggcgtttcgcccattttttgtttctacgacatacgcgaggcgatcaggtgtcgagcaagctagaacagttgcaggccttgctggcccctgtggtcgaggcgctcggctatgagtgctggggcgtcgagttcatttcccagggtcgtcattcggtgttgcgcgtctatatcgaccgccccgaaggcatcctcatcgatgactgtgaagccgtcagtcggcaggtcagcggtattctcgacgtcgaagacccgatcagcggcgagtacaccctggaggtgtcctctccgggcatggatcggccgctgttcaccctcgaacagttcgccaagcatgccggcgagcaagtgaagatcaggctgcgttcgccctatgaggggcggcgtaactaccaaggcattctccgtggtgtggaggagcaggatgtggtggtcctggtggacgatcacgagtacctgctgccgatcgattcgatcgacaaggccaacatcattccccgttttgattga

SEQ ID NO: 10711 - DNA, 414 bp, Pseudomonas aeruginosa
agtgaccgacgatgggcgtatcgccccgcgtcgactgattcggtcataagaccgatacgagggtggctgtcagcaggcacggtcattcctccttttaaaacacgggaagcgattcccggcctgttcactcagaggaagcccatcatggcactgagcgttgaagaaaaagcgcagatcgttaacgaatacaagcaagctgaaggcgacaccggttccccggaagtgcaggtagccctgctgtccgccaacatcaacaagctgcaggatcacttcaaggccaacggcaaggatcaccattcccgccgtggtctgatccgtatggttaaccagcgccgtaagctgctggactacctgaagggcaaagacgtgtctcgctacactgccctgatcggccgtctgggtctgcgtcgctaa

SEQ ID NO: 10712 - DNA, 2094 bp, Pseudomonas aeruginosa
ccaagcaattccagttcggtcagtcgaccgtcactctcgagaccggccgtattgctcgccaggccaccggcgccgtactggtcaccatggacgacgtcagcgtgctggtcaccgtggtcggcgccaagtcgccggccgaaggccgcgacttcttcccgctgtccgtgcactaccaggaaaagacctacgccgcaggccgtatccccggcggtttcttcaagcgtgaaggacgtccttccgagaagggaaaccctgacctcgcgcctgatcgaccgtccgatccgtccgctgttccccgaaggtttcatgaatgaagtgcaggtcgtctgcaccgtcgtctccaccaacaagaagtccgatccggacatcgccgcgatgatcggcacctccgccgccctggcgatctccggcattccgttcgccggcccgatcggcgccgcccgcgtcggtttccatccggaaatcggctacatcctcaaccccacctacgagcaactgcagagttccagcctcgacatggtcgtggccggtaccgaagacgccgtgctgatggtggagtccgaggccgacgaactgaccgaagaccagatgctcggtgccgtgctgttcgctcacgacgagttccaggcggtgatccgtgccgtcaaggagctggccgccgaagctggcaagccggcctgggactggaaagccccggcggaaaacaccgtgctggtcaacgccatcaaggcagagctgggcgaagcgatctcccaggcctataccatcaccatcaagcaggaccgctacaaccgtctgggcgagctgcgcgaccaggccgtggccctgttcgccggcgaggaagagggcaagttcccggcttccgaggtcaaggacgtattcggcctgctggaataccgtaccgttcgcgagaacatcgtcaacggcaagccgcgtatcgacggtcgtgacacccgtaccgtgcgtccgctgcgcatcgaagtcggcgtgctcggcaagacccacggttccgcgctgttcacccgtggcgaaacccaggccctggtcgtcgcgaccctcggcaccgcgcgtgatgcccagctgctggataccctggaaggcgagcgcaaggacgccttcatgctgcactacaacttcccgccgttctcggtaggcgagtgcggccgcatgggcagcccgggtcgtcgtgaaatcggccatggccgtctggcccgtcgtggcgtcgccgccatgctgccgacccaggacgagttcccctacaccattcgcgtggtttccgagatcaccgagtccaacggttccagctcgatggcctccgtgtgcggcgcctccctggcgctgatggatgccggtgtgccggtcaaggcgccggtcgccggtatcgccatgggcctggtcaaggaaggcgagaagttcgccgtcctgaccgacatcctcggtgacgaagaccacctgggcgacatggacttcaaggttgccggtaccgacaagggcgtcaccgccctgcagatggacatcaagatcaacggtatcaccgaagagatcatggagatcgccctgggccaggccctggaagctcgcctgaacatcctcggccagatgaaccaggtcatcgccaagccgcgcgccgagctgtccgagaacgccccgaccatgctgcagatgaagatcgactcggacaagatccgcgacgtcatcggcaagggcggcgcgaccatccgtggtatctgcgaagagaccaaggcctcgatcgacatcgaggacgatggcagcgtgaagatctacggcgaaaccaaggaagccgccgaggctgccaagctgcgcgtcctggcgatcaccgcggaagccgagatcggcaagatctacgtcggcaaggtggagcgcatcgtcgacttcggtgccttcgtcaacatcctgccgggcaaggacggcctggtgcatatctcgcagatcagcgacaagcgcatcgacaaggtcaccgacgtgctgcaggaaggccaggaagtgaaggtcctggtgctcgacgtggacaaccgtggccgcatcaagctgtcgatcaaggacgtggctgccgccgaagcttccggcgtgtaa

SEQ ID NO: 10713 - DNA, 261 bp, Pseudomonas aeruginosa
aatcggtcgagtaagcgcccgggccgaacgatcccttttccctcgtcaccaggaggaagaccgatgaattccgatgtgatcaaaggtaagtggaagcaactcaccggcaagatcaaggagcgttggggcgatctgaccgacgacgatctccaggctgccgacggacatgccgaatacctggtcggcaagctgcaggaacgctatggctggtccaaggaaagggccgaacaggaagttcgcgacttcagcgaccgcctgtga

SEQ ID NO: 10714 - DNA, 711 bp, Pseudomonas aeruginosa
ccgcgcagctgggcgtcgcgcaggacgatgtgccagggcttggcgggcgtctccgcggcggctttcgtactttccggcggaggcgtctttgcagtgtcggcgagctgttgcggagagtcgctggctgccttgtcgatttccgcagtcttggccgtttcctgcccggttgccttgccggtcttcggagccttgctcgtctcttgcttggctaccttgtcggcagcgccttccgcgaccttggcggactctttgtcgtccgttgccctttccgtctcggcgacgctggcgtccttctccgccggcctgtccttgcccgcttcgcccgaggctatcacggctgccttggcggcaccgtcggttgccggttcgcgggtggtcttcgccgcgtcggtcggggcagcggcgggatcggtgttttccgccggcttgggtgcaggcgccttgcgtggcggcggagtgaagtcggcgaacagtttctgccagtcgagctggccgtccttctcgcgcgcggcccaggcctccaggccctggctgcggacttcgccgagcaccacttcctgcttggccaggtccagggtggtagcggccacgtcgaggctggcgagcttggccagcggcttgccctggggcgaattgatgctgaagtcggcgagtttcagcgcggccttgtcgagcagcagctgggtgtccttggacaggtccaggcgatag

SEQ ID NO: 10715 - DNA, 1695 bp, Pseudomonas aeruginosa
agccgggctttggggagaggcggatcagccgcgatggcggccgcggaagaagtcgatcaggccttgggtcgaggcgtcctcggccggggtttcctcgctgccgaccaggcgcgaatagacacccttgccgagttccttgccaagctccacgccccattggtcgaaggcgttgatgccccagaggatgctctgtacgtagaccttgtgctcgtacatggcgatcagcgcgccgaggcggcgggcgctgatgcgctcgaccaccagggtgttgctcggtcggttgcccggaatcaccttgtgcggcgccaggcgctgcacttcggcttccggcaggcccttggcgcgcagttcggcctcggcctcctcgcggctcttgccgagcatcagcgcctggctctgcgacaggcagttggcgtacagccactggtgatggtcggccaccgggttgtagctgctcaccgggacgatgaagtccgccgggatcaactgggtgccttggtgcagcaactgatggtaggcgtgctggccgttgcagccgacaccaccccagatcaccggcccggtgccgctggtgaccggcgtgccgtcctggcgcacgctcttgccgttggattccatgtccagttgttgcaggtggtcggtgatattccgcagatagtagtcgtagggcaggatcgcgtggctgttcgcgccccagaagtcgccgtaccagacgccgagcaggccgagcagcaccgggatgttgcgttcgaacggcgcggtctggaaatgctggtccatgttgtaggcgccggacagcagttccttgaagttggagatgccgatggacatggcgatcggcaggccgatggccgaccacagcgagtagcggccgccgacccagtcccacatggggaagatgttttcctcgcggatgccgaaggcgatcgcggcttccttgttgctggagacggcgatgaaatggcggtaaagctcttcctcggtgccgccctgggccaggtaccaggcgcgtgcggcctgggcgttcttcagggtttccagggtcccgaaggacttggaggaaacgatgaacagggtggtctcggcgttcaggcggctggccagttcatggaactcgctaccgtcgatgttcgccaggtagtggcagcgcacgcctttctgggcgaacggcagcaaggcttcggataccagttgcgggccgaggaaggagccgccgatgccgatgttcaccacgtcggtgatcggcttttcggtatagccgcgccacaggccgttgtgcacgtagcccaccagctcggtcatctggtgcaggacgcggtggacttccggcatcacgtcgacgccatcgaccagcaccttgtcgccgatcggtcgacgcagcgcggtatgcagtaccggtcggcgctcggaggcattgatcgcctcgccgtcgaacatcgcccggatcgcgtcgctcagccgtgcttcctcggccagcttcaccagcaggtcgatggtgtcctggcgaatcaggttcttcgaaaagtcgaggaacagcccacaggcgctgaaggaaaaccgcttgaagcgctccggatcgtcgatgaacgcctggcgcatcctgaagtcctgcagttcctggcgatgggcggccagggcgcgccaactgtcgagttgcgtggcatccagcggagtgaggtggtgcttcatggctga

SEQ ID NO: 10716 - DNA, 579 bp, Pseudomonas aeruginosa
ccgttgcgcgaggacaacgcgaggccatcggcggcgcgcaccgtcggctcgccgaagatctgcaccggcaggttgaggtcgcggaccagcttgcggatcaccgccaactgctggaaatccttttcgccgaacagcgcgaggtccggctggaccatgttcagcagcttgctgaccacggtcgccacgccttcgaaatggccgggacgactggcgccgcaaaggccttcggagacgccgggaacatggatgcgggtctgcccgtccatgccgtcggggtacatttcctcgacggtcggggtgaacagcaggtggcagccggcttcgagcaggcgttcctggtcggctgcgagggtccgcgggtatttgtcgaggtcttcgctggggccgaattgcagcgggttgacgaagatgctgacgaccacgaagtcggcgcgttcgccggctttctttaccagcgcggcatggccggcgtggaggttgcccatggtcggcacgaagccgatgcgcttgccttcgctgcgggcgcgcgccaccgcggcgcgcagttcacggacggtcttgacggtgttcatgcgttga

SEQ ID NO: 10717 - DNA, 1599 bp, Pseudomonas aeruginosa
tatagagcggcgagacggcgaccaggcgggtctcgggaagccgctcgaaggcatcgagggcagcctggatctgctcgcgcggttcggccaggttgctgcccagcgccacgtagacgcgctggatcattcgccgcttccgccgctgccttccttgcgcggcccgcggcgccgacggccgctgttgccgccgcggcgacgcttgcgcggggcgctgccgtcttcctggctgaccaggtcgcggatcatgttgcgccgctcgctgtcgctgacttcctggtaatcggtccaccattggccgagtccttcggtttcctcgccggcactttcgcgcagcaggaggaagtcgtagccggcgcggaagcgcgggttttccaggagcaggtcggcgcgcttgccctggcgtcgcggcagacgttcctgcatatcccagatctcgcggatcggcagggtgaaacgcttgggaatggcaatccgctggcactgttcgctgatcagttcgtgggcggcttcctgcatcgccgggatggccggcatgcctttctcctgcaactgcgcgacgcgcgccggcagggccggccagagcagcgcggcgaagaggaaggccggggttaccggcttgccctggcgaatgcgcgcatcggtattggccagggcctggcggatcagcttgccggtgtagtcggggttggcctgcagtgccttggcgctggccgggaacagcggcgcgaacagttcgtactcgaccagcagttcgaaagtgcgctcggcccggccggcgaggaacagcttgagcacctcgtcgaacaggcgcgccgaagggatttcccgcagcagcggggccagccggcgaatcggcgcggcgctgtgcttctcgatttcgaagtcgagcttggcggcgaaacgtaccgcccgcagcatccgcaccgggtcttccagataacgctgctccggatcgccgatcaggcggatcaggcgattgcggatgtcgtgaacgccattggcgtagtccagcagccgctcgctggtgacgtcgaagtacagggcattgatggtgaagtcacggcgctgggcgtcgtcttccaggctgccatagacgttgtcgcgcaggatgcggccgctttcgttgctggacgcgcggctatcgccatcgtcctggccttccggatgatgggcgcggaaggtggcgacctcgatgatctcgcggccgaagtgcacgtgtaccagtttgaagcggcggccgatgatccgcgcgttgcggaattcggcgcggacctgctccggcgtggcgctggtggcgacatcgaagtccttgggagcgatgccgagcatctggtcgcgtacgcagcccccgaccacgtaggcctggtagccggcccgctggaggatctcgacgaccttgacggcgttccggctgaactggtcccggcgcagggagtgctggttgttaccgatgacttccggggttgtacggacggcgcgcggacggcgcaggggggaacgaatggtctggatcagctttttcagcatgggtgtgttatcgggagcacgatgtgggtgattgcacgcctgcgttgctcaaacaggacggacgtcgggtaa

SEQ ID NO: 10718 - DNA, 183 bp, Pseudomonas aeruginosa
tgctgcggcattatcaggacctctcgggcgaggcgtgttctgtacccgttgaatgtttggccccgcgacgcacagggcgtcccgggcgccggaaccgactgcgccatgcatcctgacagaaacgaacaggggccgtacatcctgttcccgcgaagcgggagagggccgggaaggctgcggtga

SEQ ID NO: 10719 - DNA, 1077 bp, Pseudomonas aeruginosa
tttacgccgcggaatgcccaggcgctggcggcgttcccacaggcatttgcggctgatgcccagcttgcgggccaactcggtctcggtcatgtggtcctggtgctcgaggacgaagtgctggaagtagtcttccagcgaaaggtcctcggtgggctcgtggttgctggccgcggcgcccgccgggccgaggcagaggtcggcggcgaagtcgtcctcgaggtcgtccagctcgatgtcgatacccagcaggtcggcgtggatttcctggctctcgctgaggatcaccgcccgctcgatggcgttttccagttcgcgcacgttgcccggccatgggtaatggcggatcgcctgttcggcgtcgtgggcgaagctgagcggcgcgcgccccatccgggtgcactggcgagccagaaaggcgcgggcgatctccatcacgtcgttgccacgctcgcgcagggcgggcagcttcagcgagatcacatgcaggcggtaatagaggtcttcgcggaattgcccggtcttggccagggttttcaggtcgcggtgggtggcggcgatcaggcgcacgtcgaccttctgcgattgcaccgagccgacccggcggatctcgccttcctgcaatacgcgcagcaggcgggcctgggcctccagcggcagttcgccgatctcgtcgaggaacagggtgccgccgtcggccgcttcgaccagcccggcgcgcccggcgctggcaccggtgaaggcgcctttttcatggccgaacagctcggattcgatcagggtttccggaatcgccgcacagttcaccgagatcagcggcgccttggcgcgcttcgacaggttgtgcagggcgcgggcgaccagttccttgccggtgccggactcgccctggatcagtaccgtggagtcggtcggcgcgaccttgcgaatcttgctgtacagctcttgcatcggcgcacaggagccgatgatgcctatctcgccgtcggctgccgccgggctggcgccgcgctcgccgccggccttgccgccgttggcggaggaccggggccgcgctgcggttctcctggcggtccttga

SEQ ID NO: 10720 - DNA, 2217 bp, Pseudomonas aeruginosa
caccaggccgctgttgcccggcgccaggggttcctcgatggccgccttgtgcaggttcagccagcgggtgtggccgtcgtagaccaggcgctgcttgtgcaggtgctcgtcgggggcgtcgatgaaacgttccagcaggcccttccagggttcgggcaaggccgacaggcgcgaaccgacgaccttctgcgcgccgaccccggtgagttcctcgatggcgcggttccacatcagcacttcctggtccttggccagggagcagacgcccatcggcaggtcttgcagggtctgccggtggtagcggcgcagggtgtcgagttcggcagccaggccagtcagccgggagtgatagtcctccaggcggctctcgatgaagtggatgtcctcggtgacatagctttcttcgctggtcttgtagggaaggaaggtctccacgatgtcctgggcgacactgggtcccatcagcccggaaaggttcgcctcgatgcggtcgcgcaagcgacgcagggcataggggcgacgttcgtcgaagggcaggtggagatcgcgcagggcctgctcgacctccttctgcgcggtcttggcgcccagcggcttggccaactggctggcgaactcctgcggcgaaccggcgaacagttcgcggcgttgcggacggcgtacgttgtccaccgcgcaggcctcggcggcgcctttttcctcgtcgctggcctcggtgaacagcgacaccagggtgaataccagcacgttggccgccagcgaggacagcgccgccaggtgccagttcgaatcgtccagcacgtagatcacgtcgaacagcggcaggtacaggccctgtacgttccccatcaggggcagcagcatggtgatcgcccagaccagcatgccggcgatcagcccggagatgaagccacggcggttggcggtcggccagtacagcaccgagagggcgccgggaaggaattgcagggtggcgacgaaggacactatgcccaggttggagaggtcctgttcggcgcccagcagcaggtagaaggcgtagctggccatgatgatggcgacgatcagcaggcgccgggtccatttcagccagcggtagatgttgccctgcgccggcggctggtagagcggcagcaccaggtggttgaggaccattcccgagagcgccagggtcatcacgatagtcagcccgctggcggcggagatgccgccgatgaaggcggccagggccagggccgggctgtccaccgccaggccgaggccgatggtgtagtactccggtgtggtcgaggcgccgaggcgcagcccggcccagaggatcggcggtaccgccaggctcatcagcagcaggaacagcggcaggccccaactggcggaaatcagcgcgcgcgggttgaggttctcggtgaagatcatgtggaacatgtgcggcatcacgatggccgcggcgaagaacaccagcagcagcgttcgccatggaccttcggccagcggcgtgtgcagggtggtcagcgcggtctggttctgcagcagccagacttccaggccttccggcccgccgaagacgccgtacagggcgtagaggccgatactgccgagcatcaccagcttgaccagcgactcgaaggcgatggcgaacaccagtccctcgtggcgttcgcgggtggcgatgtggcgagcgccgaagaggatcgcgaacagggtgatcagggtgcagaagacgaacgcgacccgctcctgggccgggtcgcgggtgagaatgctgatcgagtcggtgaccgcctggatctgcagggccagcatcggcagcacgccgatcagcatgaacagcgtggtcagggcgccggcccaggtactgcggaaacggaaggcgaagaggtcggccagcgaggacagctggtatgcgcgtgtcacccggaggatcggatagagcagcaccggggcgagcaggaaggccccggaaatccccaggtagatggcgaggaacccgtagccgtactggtaggccaggcctaccgtgccgtagaacgcccaggcactggcgtagacgcccagcgacagggtgtagaccagcgggtggcgtaccagccggcgcggcacgtagccgcgctcggtgatccaggcgatgccgaagagggtggagaggtaggcgacgctgatcaggatcagctgggtcaggctaaagctcgtcagcatcgcgctggctctgcaggatga

SEQ ID NO: 10721 - DNA, 825 bp, Pseudomonas aeruginosa
cgaaatcgccgacctcgcggccgagatgctggtggacttcgccctgcacgcggtcgacgaagcgatattccagctccggcacgcgcaggcggatcgccgcatcctcgcgggcgtgcccggcgtcgcggcagaagcccgggtagatcccggcgaatccctcaagctgcttgcgcgagcaagtgcaggcgtaggccaggccgctgcgcagcagttgctcgaccactgcggcgtagtccgggaagcgttcgctctgccgctccaccgcgccgtcccattcgaagccgtagcgctccagggtttccaggatcgcctgctgggcgcccgggacttcgcggggcgggtcgaggtcctccatgcgcaccagccagcggccgccgacggcacgtgcgtccaggtaggaggcgacggccgccaccagggaaccgaagtgcaggtagccgctgggcgtcggggcgaagcggcctacataggaagaggtcatggcgcgagcggtgcggcggggaacggcggaaacgaaacggggcgccttggcgccccgtcggtccggctcaggagccgagttgcttctcgcggatttccgcgagggtcttgcagtcgatgcagagggtcgcggtggggcgcgcctccaggcgacggatgccgatctcgacgccgcaggagtcgcaccagccgtactcttcgtcttcgatcagttgcagggtctcgtcgatcttcttgatcagcttgcgctcgcggtcgcgggcgcgcagttccaggctgaattcttcttcctggctggcgcggtcggccggatcggggaagttggccgcttcgtcctgcatgtga

SEQ ID NO: 10722 - DNA, 1275 bp, Pseudomonas aeruginosa
ccggctggcgcctgggctggctggtggcgccggcagcggcggtgcctgagctggagaagctggctcagaacctctacatcagcgcgccgagcatggcccagcaggccgcgctggcctgtttcgcgccgaccaccatcgccattctcgaagagcgtcgcgaagagttcgcccgccgtcgcgacttcctcctgccggccctgcgcgagctgggtttcggaatcgccgtggagccggaaggcgccttctatctctacgccgatatcagtgcgttcggcggcgatgcctacgccttctgcaagcacttcatcgagaccgagcacgtggccttcactccggggctggatttcggccgccaccaggccggccaccacgtgcgtttcgcctatacccagaacctgccgcgcctgcaggaagcggtggagcggatcgcccgcggcctgcaggactggcggccctgatgcgtttcgagcagccactggaagaaggccgcctgctgcgtcgctacaagcgtttcctcgccgatatcgagagcgccggcggcgagcgcctgactatccactgtccgaataccggttcgatgctcaattgcatgagcgaaggttgccgggtctggttcagccgctccaacgaccccaagcgcaagctgccggggacctgggagctgagcgagactccgcagggccgcctggcctgcgtcaacacggcgcgggccaaccgcctggtagaggaggcgctgctggccggggacatcgcggagcttgccggtttcaccgctctgcgccgggaagtggcctacggcgtggagaacagtcgcgccgactttcgcctggaataccccacgggcgcactgttcatcgaggtgaagagcgtcaccctgggcttcgacgaaaccgccgtggcggcctttcccgacgcggtgacgctgcgcggcgccaagcacctgcgcgaactggcggcgctggcgcgggaggggatccgcgcggtgcagctgtactgcgtgaacctttccggggtcgaggcggtgcgccccgccgacgagatcgatccagcctatggcaaggcgttgcgcgaggcggcgcaagcgggcgtcgaggtgctggcctatggcgccgaggtgacgacggaaggattgcacctggcgcggcgcctcccggtgcgactctgaggcatggccgcgccgtggggcgcggccactcgctcagcggcgttcgagcaggacgccgctttccatgtggtgggtgtaggggaactggtcgaacagcgcgcagcggctga

SEQ ID NO: 10723 - DNA, 1530 bp, Pseudomonas aeruginosa
tgcggcggctggcgatggggaaatcctcgatcaggatcggcgtgtgcttgtcgccctgctcgaacatcgcgtagtgacgcttctcgttgccggtttcccgccacagacgaaattcggcgcgcagccggtaatgctcgcgcggcgactcgaagatctcgggcgcgggtgccgcgaacggggccagcaaaccggcgaggcgggacttcttgtcttccagttgtgcggcgtaggcgctggggtcgaactgtggacggctcatgcgttgaagaagcccagcttgatcacgaacaggacggagaggatcaccagcgccgggttcagttcgcgccagcgcccggacagcaccttgatcgcggtccaggaaatgaagccgaaggcgatgccggtggcgatcgaataggtgaacggcatggccagcgcggtgacgaccaccggcgcggcgacggtgatgtcttcccagtcgatttctgccaggcccgaggccatcagtacggcgacgaagagcagcgccggggcggtggcgaaggccggtacgctgccagccagcggggcgaagaacagcgcgaggaggaacaggatggcgacgacgatggcggtcaggccggtgcggccgccggcgctgacgcccgcggcggactcgatgtagctggtggtggtcgaggtgcccagcagcgagccgcccatggcggcggtactgtcggcgatcagcgcgcggcccatcttcggcatgtggccgtccttgcccatcagtccggcgcgcttggcaacgccgatcagggtgccggagttgtcgaacaggtcgacgaagaggaaggcgaagatcacgctgaccaggccgatgtccagcgcgcccttgatgtccagttggaggaaggtcggcgccagcgacggcggcatcgagaccacgccgccgaactgggtcacgccgagcaggatggcgatggcggtgaccaccaggataccgatcagcaccgcgccggtgacgctacgcgcctccagggcgacgatcaggatgaagccgagggtggcgaggatcggtgccggcttggtcaggtcgcccatgccgatcagggttgccgggttgtccaccacgatgcccgcgttctgcagggcaatcagtgcgaggaacaggccgatgccggcggcgatcgccgagcgcagcggcagggggatgctgttgatgatccattcgcggatgcgaaagatcgacagcaggaagaacatggtggcggaaatgaacactgcgcccagcgcgacctgccagctgtggcccatgtgcagcaccacggtgtaggtgaagaaggcgttgaggcccatgccgggggccagggcgatcgggtagttggcgatcaggcccatgatggtcgagccgatggccgctgccaggcaggtggcgacgaacaccgcgcccttgtccatgccggtctcgccgaggatgctcgggttgacgaagaggatgtaggccatggtcaggaaggtggtgatccccgccaggatctcggtgcgcaccgtggtgttgtgcgcctttag

SEQ ID NO: 10724 - DNA, 903 bp, Pseudomonas aeruginosa
aacggcccagtggccgacgaggcgaagccgcaggcggaattcaccccattgctgaacagcaccagcttgggctgttggtattgtgcctggccgctggcgaagatctgttcccaggtgtcctcggtgtcgccgaggatcgagcggacgaactcgctctgctcgtcattggccgccggggcccgaccgccggcctgctgctgggtggccggcgccgggctgtccatctggccgagcagcgacccgaggatctgcatcgggtcctggcccatcagcaggccgaccaccaccacgatggccaccccacccaggctgaggcccttgccgccgatgcgcatgccgccaccgccgcctgcgcctccttcgccccgggcatcaatcacgttgtcactgcgtcgtcctttgcgccagagcatggcggttctcctgtacgtttcgcttcttcagtgttgtcgtcgtccgccgccagcgccaccccgaccgtcaggccgaggtcagcagctcggcgcgggcgagcagttggacgtggccgccgaccctgacgctaccgtctgtcgcgacctggacgtcgagccggctcggccgctcgaggaagcgtccctggtgcaggacgaagggttcgccgcgcgcggcaagcccgtattccaccaggtaggcggcgaccggaccggcagcgctgccggtagccacgtcttccaccagccccaggctgtcccaggtgcggccctcgcgcccgtcgacgtcgagcagatagacaaacgccgcgccgagtttatccagggcttcttgcaaatcgttgacctgacgggctcgacccagcgcctcggcggttaccggcaggagcaggtagggcaggccggtgctcaccacccgcggtggatgcccggacaggtcgttggccgatag

SEQ ID NO: 10725 - DNA, 1953 bp, Pseudomonas aeruginosa
tccggaggacggctttcacctgtggcatggaaagcgcccggcatggccaggcgctgggtatgggggcacttccgtgtgcgaaggggtaacgggtcagatgtcccagaccaggttgaccgcgaaattgcggcctggctgggacagtcggtcgatgttggccggggccagcgccgaagcctcgccgacgctgtcgtagccgcgcacgtcatcccacagccagtatttcttgtcggtcaggttgtagagaccggcgttgagggtcaggtccttgctcagcctgtagtaggcgctgaggtcgaggacgccgaagcccggggtcttgaactggctggcggtgccatccggggtgtggaaggtgctgtcgtcgacgcgatccttgcgtttgaccagggtccagctgagcagcccgccgtagttgccgtctgcttcgtcgtagcccaggccgaacactccggtgagtgggttgacgctgttgatcggctcgccgttgtccttgttgcgaccgtaggcgtaggccacgctgccctgggtgtagagtccctgcggcgcgccgaaggcgcccagctccaggcggcccttgagctcgacgcccttgatcaccgcccgctcgatgttgttggactggaaggtctggccgttgccgccggtgctatcggtattcagggcgtcttcgtcgatgaagtcgcgatatttgttgtagaacaccgccacgccgaagctgccttcgtcgaacttgccgcgcagcccggtctcgaagctctggctcttttccggcttgaggttggggttaggctcgatgtggtagcccgcctgcaggttctcgaatcgaccgtacagcgccttggcggtgggcgtgcggaagccctgggcgtattggccgtaccaggtgtagtgctgggcgaagtcgtaggtcacgccgaacttgggcgaaacccggtgccatttcttgtccgactcgtcgaccgcggtgttctggctctgcttcatggtgcgcaggaactcgtcggtgatgtgcggctccatgcgcgtgtagtcgtaacgcaggccgggagtgaaggtccagtcgttccagctgatgctgtcctgggcgaacagggcgtaggtcttcaccgtcggatcgggaaagtcgctgctgcgctccagggcatcgcgcggactgtccgcgccggtgtccagattggtgccggtgccgctgcgcatgccggtgaccttctggtgcttgagattgatcccgtagctcagcaggtgctcggtctcgccgatggcgaagctcttgtccaactggctgtcgaagacccacaggcgttccttgtaggtagtgtcgcgggtgcgcaggaccttgcgggtgatcgggtagtagaactcgcgggtcgcctggtcggtcttcgccaactggtagttcaggctccactggatgcgatcggcgaccgggctgtcgagcaggaaatggtgctccaggccgtagcgctcgcgagtcagggtgtcgttgcccttgcgccactggtacatgccgcccggcagcatgctcggcgggatggccggcttgcccttgtcgtacgggccgccataggcgctcttctggtcggtatcgacgtcgctcttgtacttctcgaagaccagcccgaagcggctaccctcggcgtagttccagcccagcttgccgagcaggctgtagctgtcggcgtcttccgggttggcttcgctgcgcgagagcccggtgccgccgtggccgccgttggattcggtctcgtggccctggcggtagccataatgcagcaggccgtcgaagtcgtcggcgcggccggcgacggtggccgaggtcagccaggagtggctggccgactcgtagccggccttcagccgggcgccgacgtccttgccgtccttgatgatgtccgacgggtcgagggtgaagtagctcaccgcgccgccgatggcgttgctgccgtatag

SEQ ID NO: 10726 - DNA, 618 bp, Pseudomonas aeruginosa
cgccgaggccgggccgcgaaggatttccacgcgctttacgatgtccggatcgacgtagttgcggtgggtctgcgcgtaggggccgctgaagaagtcgttgggcagttcgaccccgtcgatctgcgtaaggatgcggttcccgtcgatgccgcggatgttgtagccggtgatcccggcacgctggccggcgccgccgaccgagactcccggttcgtagcgcaccagttccttgatgttgttgacgttctgccggtccagttgttcgcgggtccgcacgctgacggtgcttggcaccgaatccactgcctgctcggtacgggtggcggtgatggtggtcggggtcagcgggatggcgttccccgccagggccagggaagggctgagcaacagcagggccaggcaggggcgcagggcgaagggcggggagagcggcatgtgggactccttgggtcgggccggtggcgaatagccagggggacgtcgggcgcacaaggtactgccagaaaaacgttaatgcaaataattatcaaatggattcagatatgcgttttgtggcaaagttcacctgttttgcgcgtagcgcgaccgaaccggatatgcccgaggaaccgtcgatga

SEQ ID NO: 10727 - DNA, 1191 bp, Pseudomonas aeruginosa
cgccaccttgcgtaccctgaccttctggaacctgggcagcctgaacggcgccagctacccacgactctggccgctgctgctggtggcgctgctggtggcctgctggctaccgcgccgggcagatgcgctgaacgcactgctgctcggcgagtccgaggcccgtcacctgggcttcgacgtcgagcgattgaaggccgaactggtgctttgcactgccctcggcgtcggcgccgcagtggcggcggcggggatgatcggcttcatcggcctggtggtgccgcacctgatccgtctggttgccggtccggatcatcggacgttgctgccggcctcgatgatggccggcgccattctcctgctgcttgccgacctgctggcgcgcctggcgctggctccggcggagttgccgatcggcatcgtcacggcactgatcggcgcgccgttcttcctttatctgctattgcgggggcgggcctgatgctgcgcgtggagaacctgtccatccgccgtggcggaaagactgtactggaaggcctcgagctggagctgcggcctggcgagatgctcggcgtactcggccccaacggcgctggcaagagcaccttgcttggcgctctctgtggcgaactggagccggccgaagggctggtgctgctcgacgagcgcggcctcgacgactggccgggcgtcgctcgcgcgcagcgcctggcggtgctgccgcagagttcgtcgctgggcttcgcctttccggtggaggcggtggtcggcttcggtcggctgccccattccagcggccgcgagcgcgatgtgcagatcgtcgccgaggccttggcggcggccgacgccaggcatctggccgggcgcagctacctggcgctgtccggcggcgaacgccagcgcgtgcacctggcgcgggtgctggcgcagctgtggccgggcgagccggggcaggtgctgctgctcgacgaaccgacctcggcgctcgacccgctgcaccagcacactaccctgcaggcggtgcatgatttcgcccgccgcggtgcctcggtgctggtgatcctccacgatctcaacctggccgcgcgctattgcgaccgcctgctgctgttgcagaatggtcgcccgcacctgctcggtacgcccgaggaagtcctgcgccccgagccgttgcgcgcggtgttcggcctctag

SEQ ID NO: 10728 - DNA, 1113 bp, Pseudomonas aeruginosa
gcgaattccatgagcaaaccgggccaacgcgtgctggccgagctacgcaagctgatcgcttccggcgaactcgccgccggcgagcgcatcgtcgagattcccaccgccgaacgcctgcaggtctcgcgcatgccggtgcgcatcgccctgcgtaccctcgagcaggaaggcctgctgtgcaagaccgggcgcggctacagggtgcgggcggtgacccgcgaggatatcgccggcgcggtcgaggtgcgcggcgttctggaaggcctggcggcacgccaggcggccgagcgcgggctgtccgccgaggcacgggcgaccctggaggaatgcctggccgagggcgaccgattgttcgccaacggccaggtcctgctggaggagctggagcgctaccagcgcatgaacatgcgtttccaccgcaccatcatcgaggccagcggcaacccggcgatcgccgtggcgctggcgcgcaacgaccacctgccgttcgcctcggtgagcgccctggcggtggatcgcgacaatctcgagcaggaattccgccgtttcaacttcgcccacatgcagcaccacgcggtggtcgacgcgctggtcaacggccaggggggcgcgcgccgaggcgatcatgcgcgagcacgccaacgcgaccctgcgctacgccgactacttcgatccggagcggcagggtgtcaccgtgcttcacggcgacgtcgccgccgactagagatccagcaccagccgtgggctgcgcgaacgcgaacagcagggcgtgaagcaatcgttggcggcctgctcctcttcgctgaggtagaggtcgcgatgctccggctcgccgtccagcacgcgggtcaggcaggtgccgcagatgccctgctcgcaggaggccggcaggtccaccccggcttcgcgcagggccgccagcacggtctgcccggcggcgacccggatcagcgccccgttgctcgccaactgcacttcgaaggtgccgtccgcactggcgtctcgtggcgcggcggcgaagtgctcgcgatgcaagcggcttgcttcccagcccagttcgcgggcgctttcttcgatccactgcatgaagcccgccggcccgcaaaggtatag

SEQ ID NO: 10729 - DNA, 1605 bp, Pseudomonas aeruginosa
aaaacttcaggaataaattgccaaattatctcgttccagagcctttctcggatttcgctgacagtgggatatccgctggccatccgttttcttgtcgccaaaatggatccaataggattgcggcatcgacgcaacggtgccagggtgcctgcgcttgccgtgcctacaacaacaagaaaaagggtcttcccgatgatggattcctgcattcccgcgcctcgctcccgcctgccgtcgcttctttcctgtccgctcgggggagggccgcccatgaaccgggacttgcgccgcgctctcgacgacgaaccgatgcgtccgttccagtggctggcggtggctgtgtgcatcgtgctcaacctgatcgatggcttcgacgtgctggtgatggccttcaccgcatcctcggtggccgccgaatggaaccttggcggcgccgagatcggcctgctgctcagcgccggcctcttcggcatggccgccggctcgctgttcgtcgcgccctgggccgaccgctgggggcgccgcccgctgatcctcgcctgcctggcgctgtcgggcctgggcatgctcgcctcggcgctgagccaggcggcctggcaactggcgttgctgcgcgggctgaccggactgggtatcggcggcatcctcgccagcagcaacgtgatcgccagcgagtacgcctcgcgccgctggcgcggcctggcggtaagcctgcagtccaccggctacgcgctcggcgcgacccttggcggactgctcgcggtatggctgatcggcgcctggggctggcgctcggtgttcgtcttcggcgctggcctgaccctggcggtgatcccgctggtctgcctgtgcctgccggagtcgctggacttcctcctggcgcgccggccgccgcgggcgttgcaacgggtcaacgcgctggcccggcgcctgggccgcgcggcgctcgcggaactgccgagcccgcccggtggcggagcggagcacggtagccgcctcgcccggttgctttgcgttgcccagcgacgtaccacgctgctgctctgggcgctgtttttcctggtgatgttcggcttctacttcatcatgagctggacgccgaagctgctggtcgccgccggcctgtccaccgcccatggcatcaccggcggcaccctgctgagcatcggcgggatcttcggtgccgccttgctcggcgggcttgccgcgcgctttcgcctggaacgggtgctggcgctgttcatgctgcttaccgccgctctgctcgcgctgttctcgctgagcgccgggctgcccggcgcggccttgccgctgggactgctgatcgggctttgcgccaacgcctgcgtggccggcctgtatgccctggcgccgagcctctacgacgcttcggtgcgtgccaccggggtcggctgggggatcggcgtcggtcgcggcggggcgatcctctcgccgctggtggccgggctcctgctcgacgacggctggcagccgctgtccctctatggggcgttcgcggcggtgttcgtcgtcgcggccgccgtgttgccgctgctcggtgcgcggcgtcgcgagcgctcgccgacgctgggagacgctgcgtga

SEQ ID NO: 10730 - DNA, 1683 bp, Pseudomonas aeruginosa
accagttctattttttatagaaagagtatcgatttgattgattatcgagcggctgcaacagtagcgcaaatccaggaaacgagcttgaaggcctgcatgaaaaccgtccattccgcgtcttacgagatcctccgtcgccacggcctgaccaccgtcttcggcaaccccggctccaacgagctgccgttcctcaaggactttcccgaggatttccgctacatcctcggcctgcacgagggcgcggtggtcggcatggccgatggcttcgccctggccagcggccgcccggccttcgtcaacctgcatgcggcggctggcaccggcaacggtatgggggccctgaccaacgcctggtactcccatagccccctggtcatcaccgccgggcagcaggtgcgctcgatgatcggggtcgaggcgatgctcgccaacgtcgatgccggacaactgcccaagccgctggtgaaatggagccacgagccggcctgcgcccaggatgtaccgcgcgcgctgagccaggcgatccagaccgccagcctgccgccgcgggcgccggtgtacctgtcgattccctacgacgactgggcgcaaccggcgccggccggcgtcgaacacctggctgcgcgccaggtcagcggcgccgcgctgcccgcgccggcattgctggccgaactcggcgagcgcctgtcgcgctcgcgcaacccggtgctggtgctcggtccggacgtcgacggggcgaatgccaacggcctggccgtggaactggcggagaagctgcggatgccggcctgggtcgcgccgtcggcctcgcgttgtccgttccccacccgccatgcctgcttccgcggcgtgctgccggcggccatcgccgggatcagccggctgctggacggccacgacctgatcctggtggtcggcgcgccggtgttccgctatcaccagttcgcccccggcgattacctgccggccggcgccgagctggtgcaggtcacctgcgatcccggcgaagcggcacgggcgccgatgggcgacgcgttggtcggcgacatcgcgctgaccctcgaggcactgctcgaacaggtccgccccagtgcgcggccgttgcccgaggcgctgccgcgaccgccggcgctggccgaggagggcggaccgctgcgtccggaaaccgtgttcgacgtgatcgatgcgctggcgccgcgcgacgccattttcgtcaaggagtcgacttccaccgtgaccgccttctggcagcgcgtggagatgcgcgagccgggcagctatttcttcccggccgccggcggcctcggcttcggcctgccggcggcggtcggcgcgcaactggcgcaaccgcggcggcaggtgatcgggatcatcggcgacggctcggccaactacggcatcaccgcgctctggagcgccgcgcaataccgcgtgccggcggtgttcatcatcctcaataacggtacctacggcgccctgcgctggttcgccggggtgctcgaggtgcccgatgcgccggggctcgacgtgcccggcctggacttctgcgcgatcgcccgcggctatggcgtcgaggcgctccacgcagccacccgcgaagagctggaaagcgccttgaagcatgccctggccgctgatcgcccggttttgatcgaggtgccgacgcaaaccatcgaaccctga

SEQ ID NO: 10731 - DNA, 1581 bp, Pseudomonas aeruginosa
tcggcgcgctggcgatcgcctgcatccacctgcggccgcgcgtgccggcggaagcgtccgtcgacgcgacggcgaagaaacccctgtgattttcgaaagaggagaagagcgatgagcgattcccgttataccgacctcggtctccagcccctggccggcgagtggcgccacggccgggccggccgccggctgaaggtgagcaacccgttcgacggcagcctgttgctggagatcgagcaggccgaccgcgacgacctcgatgccgcctacgccaaggccgccgaggtccagccggcatgggccgcgctcgggccctcggcacgcgcggcggtactgtacaaggcggtggaggtgttcgaccgccgccacgaggagatcgtcgactggatcatccgcgagtccggcagcacccgcctgaaggccgagatcgaatggggcgcggcgcgcgcgatcaccctggagtcggcgtcgttcccggcacgggtgcacgggcgcatcgtcgagtccgacgtgccgggcaaggaaagccgggtctaccgcagcgccatcggcgtggtcggggtgatcagcccgtggaacttcccgctgcacctgacccagcgttccatcgccccggccctggcgctgggcaacgcggtggtggtcaagccggccagcgacacgccggtctgcggcggactgctgctggcgcggatcttcgaagaggccgggctgccggccgggctgttcagcgtggtggtcggccccggcagcgagatcggcgacgccttcgtcgagcacccggtgccgggcctggtgaccttcaccggatcgaccccggtgggccgcaacatcggccgcatcgccagcggcggcgcgcatctcaagcacgtggcgctggagcttggcggcaacagtccgttcgtggtgctcggcgacgccgacctggagcaggcggtgaatgccgcggtgttcggcaagttcctccaccaggggcagatctgcatggcgatcaactgcatcatcgtcgaggacagcctctacgacgctttcgccgcgcgcttcgtcgagcgggtcaagggcctccgggtcggcgatccgcagcgcgccgataccgcggtcgggccgatcgtcaacgcgcgccagctcgaaggcctgctggaaaagatccgcctggcccgccaggaaggcgccaagccgctgtacgagggcggcgtcgatgggcagttgctggctccgcacgtattcggcgaggtcaccgcgacgatggagatcgcccgcgatgaaatcttcggcccgctggtcggcctgctccgcgcgcgcgacgaggcgcatgcgctggagttggccaacgccagcgaatacgggctgtccagcgcggtgttcagccgcgacctggaacgcgcggtgcgctttgcccgccagcttcgcgcggggatgacccacgtcaacgacattccggtgaacgacgaggccaacgcgcccttcggcggcgagaagaactccggacttggccgcttcaacggcgactgggccatcgaggaattcaccaccgaccactggatcagcgtgcagcacgcgccgcgccagtacccgttctga

SEQ ID NO: 10732 - DNA, 492 bp, Pseudomonas aeruginosa
gcctgcgcaattcggcggacatgcaggacctgtcggcctggagcgcgccgacgcagaaatcggacggtttcaactacgccggcgccgagtaccgcttcaaccgcgagcgcacccaactgggcctgtggcacgggcaactggaggacgtctaccggcagagctacgccaacctgctgcacaagcagcgtgtcggcgactggaccctgggcgccaacctcggcctgttcgtcgaccgcgacgacggcgccgcgcgcgccggagagatcgacagccataccgtctacggcctgttttccgccggcatcggcctgcacaccttctaccttggcctgcagaaggtcggcggcgacagcggctggcaatcggtctacggcagcagtgggcggagcatgggcaacgacatgttcaacggcaacttcaccaacgccgacgaacgctcctggcaggtgcgctacgactacgatttcgtcggcctcggctggcccggcctga

SEQ ID NO: 10733 - DNA, 606 bp, Pseudomonas aeruginosa
gaacggaacagacggctgtactgggtttcgtgggtcatgctggccagcgccagaccgaacgcggcgctgccctcgacggcgggccgccgcagcgcctcggcgcaggcgcggtcgagttccggcagtaggctggaagcaagtttctgcgcggccagttggccgagcggcagggttttcatcagcaccgccaactggttttccagccagctccagaaccaggcactcagcgcctcctcggcgtccaggcgccaggcgcgcgcggccatcgcccaggcggcggcgagattgggcgggtcctggcgcgccagccaggcgcggccgggagcgtcgagctcgggcagggcttccagcaattggtgcagggaaaagcccatctgccggctctcctgggccagctcgcgggtctcgcggctggccctatggcgttcgctggccgcatcgcaggcggcccagtcgccgatcagcgcggcgcgcagcaggccggccagcagcggcgcctcgaagcgcgccaggttcagttgcagctggtcgaccagccaggtccgcgcgctctcggcgtcgcgcacccagccattgtcgagggccgcctccaggccctgggaatag

SEQ ID NO: 10734 - DNA, 2130 bp, Pseudomonas aeruginosa
ggccgatgtcgacggcctgctgcgccacgcccatccgctggcgtcgttgaaccgccactatgcgcgggtcgaggcacgctactgggtggccgacgatatgctcgccctggccctgcgtaccgcccccggctggccgccggcgcggccgggccagcacatccaactgctggcggagcgcgacggggtgcgggtcgggcgcagctacagcctgacccgggtggtcggcgagcgcctggaaatcgccgtcaagcgtcacccggacgggctgctctcgccctggttgtgcgaacacctggcggtcggccagcgtgtcgagttgcaacccgcgcaaggcgatctgcgctggccgatgcaggccgaggcggtctgcctgctggccgccggcagcggcctgacgcccttgctcggcctgctccgcgaggcgctggagaacggctatcgcggtcccgtgctgtggctgcactacgtccgtcatcccggccagcgcgcctggctcggcgagctggaggcgctggcggcgcgccacccgaacctggagttgcgctggagcctgacccgcggggcgcgggccgatggctgcctggaggggcatttccagccgcgccacctggacggctgggcagccgacctggcgcgcagccaggccctggcctgcgggccggcggctttcgtcgaggcggtgggcgagcaactgggggcacgcttcgccggcttgcagacggaatccttcagcgtcccgcgctggcgcagcggggaggcgccgcgcgaagtgcgcctgcgcttcgcccggtcgcagcgggaagtctccggcgacagcgccgtcagcctgctggaacaggccgaggcccacggcctgcgcccggcccacggttgccgccagggcatctgcgccagttgcacctgcgtcctgctcagcggctgcgtgcgcgacctgcgcagcggcgcgctgtgcagcgagcccggccagcctatccgcctctgcgtcagcgccgcccacggcgacctggcgctggacctgtgaaccgacctgcgagccctgcgatgcgcgacgaccgcgaactgaccccggaacaactggcggccttcggcgccgaactcgatgccctgcgcctgcgtaccctggccgatctcggcgcggacgacgcgcgctacatccgccgggtccgcgcggcggtgcgcgtctgctgctggagcggcagggcgctgctgatgttcggctggctgccgccgacctggctgctcggcagcctgcttctcggcctgggcaagatcctcgagaacatggagctgggccacaacgtcatgcacggccagtacgactggatgaacgatccggaattcgccggccgcgcctacgagtgggacatcgccgggccgtccgacttctggcggcacacccacaaccatatccaccacacttacaccaacgtgctgggcaaggacgacgacgtcggctacggggttgtgcgcctgttcccggagcagcgctggaagccgttttaccgctggcaaccgctgtgggtgacgctgcaggcgctgctgttccagtacgcggtggcgatccagcatctgcgcctggacaagtacgccaaggggcgcctggacaaggccgaactcatgccgctgctacgccgcctgcgtgccaagctgggtcgccagtggaccaaggactacctgctgttcccgcttctcggcctgttcgccggcggcttcggcgcggtgttcgtcggtaacctgctggccaacgtgctgcgcaacctgtggaccttcacggtgatcttctgcggccacttcaccgagaaggcggtggtcttcccgccctcggtgctggagggagagacccgtggccactggtacctgcgccagttgcgcggctccagcaacctggagggcgggccgctgttccacatcctgaccggcaacctcagccaccagatcgagcaccacctctacccggacctgccggcgcgtcgctacgccgcgttgtcccgcgaggtccgcgaaatcgcccggcgctacgggcagacctacaacagcggacgcctgggacggcaattcctcactgtcttgcggcgcatctgggtatatcggctgccgccgcgcgagccgctcccggcggggcgcggctga

SEQ ID NO: 10735 - DNA, 1536 bp, Pseudomonas aeruginosa
gccgacggaacgctcgcggcgcccgtggcggggccgctccggagcggggataatgccgccctgtgcgccgcgacgtggcttccggccgccgtgcggcgtcggagtctcgccgaacgcaggacggcctgcgcccgcgatcggccagcagcgtcgatccttcccgaacctatcaatgctcggcggatgccggccgtggggcccgtccgtccaggaaccgtcatgttcagcccgctcgtcacctttcccgcgctctacaccgccaccctgctcatgctggccggctccggcctgttcaccacctacatcggcctgcgcctgacccaggaaggcgcaggcgacctgtgggtcggcgggctgatggcgtcctactatttcggcctggtctgcggtggaaaattcggacacaagctgatcgccagcttcggccatatccgctcctacgtggcttgcgccgggattgccaccgtgaccgtgctgctgcatgccctggtcgatcagctggaagtctggctgctgctgcgcttcatcaccggtgcggtgatgatgaaccagtacatggtgatcgagagctggctcaacgagcaggccgagagccaccagcgcggcaaggtgttcgccggctacatggtcgccgtcgaccttggcctggtgctcggccagggcctgctggcgctgagcccgaccctcgactacaagccgttgctgctggtcgccatctgcttcgcctcgtgcctgatcccgctggccatgacccgtcgcgtgcacccggccaagctggtcgccgcgccgctggaagtgcgtttcttctggcaacgcgtgccgcaggcgctgggcaccatcttcatcgccggcctgatggtcggcgccttctacggcctggcgccggtctatgccaaccgcaacggcctggatgcctcgcaatcgagtttcttcgtcggcatgtgcatcgtcgccggcttctgtgcgcagtggccgctgggctggctgtccgaccgcctcgaccgcagttggctgatccgcggcaatgcggtgctgctgtgcctggcctcgatcccgatgtgggggctggtgacgctgccgtactggttgctgctggccaacgggttcgttaccggcatgctgctgttcaccctctatccgctggcggtggcgctggccaacgaccacgtcgagcagccgcgccgggtcgcgttgtcggcgatgctcctgaccacctatggggtcggcgcttgtatcggcccgctggtggccggcgcgctgatgcgccacttcggtccgggactgttctacatgctggtgtccggctacgcggtgctgctggtgttctgggtgcagcccaagcgcgtcaccggcgaacaccgggtcgacgaggcgccgctgcaacacgtggcgatgccggacacggtcagcccgatggccgccaccctcgacccgcgtgtcgaggaagtgccggaggagttggtggtggaggcgccggcgaatatcggccgctccgacggcgagccggacgccggcgagaagcccgctcagtcctga

SEQ ID NO: 10736 - DNA, 729 bp, Pseudomonas aeruginosa
ccagcgcgcggcgcggactcggtgacatttttgtcatgcgaaagtcatctccgggtaccgccggcggggcgaccatcgaggctcaaccccaccgaggatcgaccgatgcttcgactcaaggcttcccccgcgctgttcttcggcctgctcctggccagtgccgccagcttcgccgcgcaaccgcctgcgggcatgctgcagccgctgcgcggcaccatccagcaggccgccgacgaccacctgcaactgaaggcccgcaacggccagcaactgacggtcagactcaccgacaagaccgcgattcgcgccgtgtcgctggcgaagccggaggacatccagcccgacagcttcatcggcaccgccgccgtgccgcagcccgacggcaccctgaaggccctcgaggtgcatgtcttcgcccccagcctgcgcggcagcggcgaaggccaccggccctgggagaacgccgatggcagcgcctcgaccatgaccaacggtacggtcggcaacctggtggtcagccagggccggcgcatgacggtgaaatacggcgatggcgagaagaccgtggtggtgccggacgacgtgcccatcgtcagcctggagccgggcgagcgcagcctgctcaagcctggcgccaaggtcgtgctgttcccgcagaagggcgccgacggcagcctcaccgccctggccatctcggtcggcaaggacggcgtgaccccgccgatgtga

SEQ ID NO: 10737 - DNA, 1329 bp, Pseudomonas aeruginosa
tcatcggacgcgagtggcggcgcggacggaggagcgaaggatgaaggggccggagaagaagcgcgcgaagatcgcggtcgacccgtccagcgagcggcagatggtcgatttgcaacgccgcctgctgttgcgcggcggcctgtccctgggcgccctggcgatgctctcggggtgccggctacaggatggcgattcggtcgacaaggtactctgggccatgtcgcgctggaacgaccgggtccaggcctggctgttcagccgtacgcggctggcgccgaccttcgatccgtcgcaggtggcctcgccgttccccttcaacgcgttctacccggcctacaacgtgccggagatcgacctgccggaataccgcctgcaggtttccgggcgggtccgcgacaagcgcccctggagcctggagcaactgcgccggctgccgcaggccagccaggtcacgcaactgatctgcatcgagggctggagcgcgatcggccagtggagcggagtgccgctgcgcacctttctggagctggtcggcgccgacacctcggcgaagtacgttggcttcaagtgcgccgaccgctactactccagcctcgacatgcccagcgcgctgcatccgcagacgctgctggcgctggagatgtccggacaggcgctgccggaggagaacggctatccgctgcgcctgcggattcccaccaagctcggcttcaagaacgccaagcacgtggtggagatcttcgtcagcaacagcaatcccggaggttactgggaggaccagggttacaactggttcagcggagtctgaggcgggagagtgcggcttgcctcgggccatgcgcccagcgcgacagggatgggaaaataggaaagcccggcatcgagccgggcttttctcgcgccttgcggcgtagcgagcggtcaggcggtgcgcaggtcgaaacggctcatgctgcgatgcaggcggtccacggtctgttcgctgccgttgtcggccaggcgggcttcggccttggtcatgtccttgtgcaggcggtcgacggtctgctcgctgccgtcgtcggccaggcgggcttcggctttggtcatgtccttgtgcaggcggtcgatggtctgctcgctgccgttgtcggcgatgcgcagttcgacgctggacatatccttgtgcagccggtcgatggtgcggctggagccgtcggcggcgaaggcggcgttggcggtcagggtggcgagggcgaggccgaggatcagggaagctttcatgacggtgactccgagtgggttgtcgattgcgttggagtcattttcagttcggataagtcgatttaa

SEQ ID NO: 10738 - DNA, 2133 bp, Pseudomonas aeruginosa
cgggctgagcgaggcgcgctgccgcgcctgcccgacaaccgacgcggcgaaaaggagttgtgcatgacgcgcggccgaaagatcctgacctggagcctcgccagcctggtcctgctgctggcggcgttggtggtgttcatcgccaccttcgactggaacctgatcaagcccaccctcaacgaaaaggtctcggcggcgctgaaccgcccgttcgccatcaacggcaacctcgccgtggcctggcgccgcgaggagggcgaggaaggctggcgcgcctggatcccctggccgcgcttcagcgccgaggacatcaccctcggcaacccggagtggacggcgggcaagaccaaggcgagcgagttcgccagcctggaacgcatcgaattccgcctcgcgccgttgccgttgctctggcagaccatccgcattccacagatcaagctgacccagccgcgcgccgagctcctgcgcctggccgacggccgcgccaattgggatttcgacctgcctgccagcgacagcgacgagccgtccgcctggcaactggacatccgcgagatcggtttcgacaagggtagcgtcagcctcgacgaccagcgtttgaagacccgtctggaagtgctggtcgacccgctcggcaagccggtgccgttcggtcagttggccggcaaggcgctggccacgggcgatgcggcgaacgcccaggactatgtgttcggctggaaggtcaagggcacctacaagggccaggctctggccggctcgggcaaggtcggcgggatgctggcgttgcaggatgcgagcaagcccttcccgctacaggccgaggtcagtgccggcagcacccgtgccgcggtggtcggcaccctgaccgacccgctcaacctcggcgccctcgacctgcgcctgaagctgtccgggaccagcatggccaatctctatccgctgaccggcatcaccctgccggacactccggcctactccaccgacggacacctgctggcgcggctcaaggaggagggcggcgcactgttccgctacgagaacttcaacggcaaggtcggcgccagcgacctgcacggcagcctgaccttcgtcgctcgccagcctaggccgaagctgtccggcaagctgacctccgagcaactgcgcttcgccgacctcggcccgctgatcggcgccgacagcaatgccgaaaaacagaagcgcgggcagaccagccgccagccgggcgacaaggtgctgccggtggaggaattccgtaccgagcgctggcgcgacatggacgccgacgtggaattcaccggcaagcgtatcgtgcacagcgaccagttgccgatcagcgacctctatacccatctggtgctcaacgacggcctgctgcgcctggagcccctgcgcttcggtgtggccggcggcaagctggagtcggacatccgcctggacggcggcaagcagccgatgcagagccgagtgaagatgagcgcgcggggcttcaagctgaagcagttgttccccggcttcgcgccgatgcagaccagcttcggcgagctgaacggcgacgccagtctcagcggcagtggcaattcggtggcgaagatcctcggcggcgccgatggcgaattgaagatgctgatcaacgacggtgcgatcagcaaaggcctgaccgaaatcgccggcctcaatgtcggaaactacctggtgaccaagctgttcggcgacgacgaggtgaagatcaactgcgcggccgccgacttcggcctgcagaagggcctgatgaccagccggctgttcgtcttcgacaccgagaacgcgctggtcaacgtcgacggcacggtgaacttcgccaacgagaagctcgacctcgatgtcaccccgcacagcaagggcctgcggatcttctcgctgcgctcgccgctgtacgtgcgcggcaccttcgccaagcccgacgccggggtccacgccgggccgctggtggcgcgcggcgcgggaatgatcgccctcggcgtggcggtgggcccggcggccagcctgctggcgctggtggcgccgagcaagagcgacgacaaccagtgcaccgccctgctgcaacgcatgcgccagccggccaaggtgccggccggcaagcgctga

SEQ ID NO: 10739 - DNA, 558 bp, Pseudomonas aeruginosa
gcatttccggttcctgctgcgggataccggcagactacggattgcccctggggcaaggtcaaggggtttgtgccggtgcgcactttctctgaacgtccgccgtcgcctcccggtcccaacagtgaacccatcgcaaagggagatatccccatgccccgtggcgacaagagcaagtacagcgacaagcagcagcgcaaggccgagcacatcgaggagagctacaaggccaagggtgtgagcgaatcggaagccgaggcgcgcgcctgggcgacggtgaacaagcagtccggcggcggcgagcgcaagggcggttccggccgcgccaagagcgagacggccaagcgcgccgaccgcaaggactcggcccatcgcgccgcccaggcccgctcagggagaccggccaaccgcggctcggcgagccgtggcaaacgtcaaggcagcacctcggtgagcgagatgacccgcgaggaattgatgcagctggcgcgcaagcgcgacatccgcggtcgttcgacgatgcgcaaggccgaactgatcgaggccctgtcccgggcctga

SEQ ID NO: 10740 - DNA, 465 bp, Pseudomonas aeruginosa
acttcagcgcacctgcatgcgaacgtgcagcccttcaaggagagttcgatgaatatcctgcgtatcccgatgttcgtattggccatggccgtctcggcccatggtttcgctgccaccgcgcagcaggagaagatgaccgcctgcaacgccgaggccaccaccaaggcgctcaagggcgacgaacgcaaggcgttcatgagcggctgcctgaaggccggcgcgcctgccggcggcaaggccaccgcccagcaggagaagatgaagagctgcaacgccgacgccagtgccaagtcgctcaagggcgacgaacgcaaggcgttcatgagcagttgcctgaaggccggcggcagcgccaaggcggcgacccagcaggagaagatgaagacctgcaacgccgacgccaccgccaaggcgctcaagggcgacgaacgcaaggcgttcatgagcacctgcctgaagaagtga

SEQ ID NO: 10741 - DNA, 2376 bp, Pseudomonas aeruginosa
ccttatccccctatagggcaggggcgcggccagggcggctcagccgtagcgcttcttcgcctcgatggccaggccgctgccgatgctgccgaacaggttgccctcgacatgacgggcgttgggcagcatcgccgagacgctccggcgcagcgccggaatgccgctcgaaccgccggtgaagaacaccgtgtcgacccggtccgggtcgaccccggccgaggccagcagttgcgcgacgctgttgcgcacgcgctccagcagtccgtcgacggcgttctcgaacagcccacgggtcagctccacgccgagcccggcctcgatgcgctccagcgagaggtgcaggcgctcggtttcggtcaggcggatcttgctgtcttccacctgcatcgccagccagtgcccggcgcgttcctcgatgagcctgaagaggcggtcgatgccggtgctgtcgacgatgtcgtagcgcatgttcttcagcgccaattgcgacttctgcgcgtacaccgcgttgatggtgtgccaggtggccaggttcaggtggtagctggtgggcatgaaggcgtcgctcttcatccggctgccgtagccgaacagcggcatcacgccttccaggctgagctgcttgtcgaagtcggtaccgccgatgtgtacgccgccggtggccaggatgtcgtcctggcgctcggccaggttgcgccgctccggcgccaggcgcaccagggagaagtccgaggtgccgccgccgatgtcgacgatcaggaccagttcctcgcgctggatgcagcgctcgtagtcgaaggccgcggcgatcggttcgtactggaaggaaacctccttgaagccgagcttgttggccacctgcaccagggtgtcctgggcctcgcggtcggcctccgggtcgtcgtcgacgaagaacaccgggcgacccagcaccaccgcgtcgaaggcttgcccggcggcggcctcgccgcgcgccttgagctggccgatgaacaggccgagcaggtccttgaacggcagggcgctgccgagcacggtggtctcgctcttcagcagcttggagcccagcaggctcttcagcgagcgcatcagccggccctcgtagccctccaggtactcgccgagcgcctggcggccgtagaccgggcggcgctcctcgacgttgaagaacaccaccgagggcagggtgatcttgccgtcctccagctcgatcagcggttcgacctccggccgccaccagccgacggtggagttggaggtgccaaaatcgatgcccagggcgcgggcggcggtgctcgggttcatggcgcgaaacggtccgggaaaaaaacggccgcgcagtgtatgcgagagcgtcgtagatttcaccgccggcgatcggcaggaagcgtcctgggacgtccgtgcgggccgccccgacctttgtatacggatttgccaaggggcctgcgcatggtgctatgttggcgctgctttcccactccgtcttgccgtgttgtcctggatttcgccatgcatagagcctcacaccatgagttgcgtgcgatgtttcgcgcgctgttggactcctcccgttgctaccacaccgcttccgtgttcgatcccatgtcggcgcgtatcgccgccgacctcggcttcgagtgcggcatcctcggcggttcggtggcttccctgcaggtcctggcggcgccggacttcgccctgatcaccctcagcgaattcgtcgagcaggccacccgcatcggccgggtggcgcgcctgccggtgatcgccgacgccgaccacggctacggcaacgcgctgaacgtgatgcgtacggtggtcgaactggagcgcgccggaatcgccgcgctgaccatcgaggacaccctgctgccggcgcagttcgggcgcaagtccaccgacctgatctgcgtcgaggaaggcgtcggcaagatccgcgcggccctggaggcgagggtcgacccggcgttgaccatcattgcccggaccaacgccgaactgatcgacgtcgatgcggtgatccagcgcaccctggcctaccaggaagccggcgccgatggcatctgcctggtcggcgtgcgcgacttcgcccacctcgaggcgatcgccgagcacctgcacatcccgctgatgctggtcacctacggtaatccgcaactgcgcgacgacgcccgcctggcgcggctcggcgtgcgtgtcgtggtcaacggccacgccgcctatttcgccgcgatcaaggcgacctacgactgcctgcgcgaggagcgcggtgcggtggcctcggacctgaccgcctcggagctgtcgaagaagtacaccttccccgaggaataccaggcctgggcccgcgactacatggaagtcaaagagtag

SEQ ID NO: 10742 - DNA, 849 bp, Pseudomonas aeruginosa
acagcagccaggcacaggcgccgccgccgagcgccaccaggcccgacgtctcgccgctggccaggcgcagcaggagcccggtggcgaccagcagcagactggcgtcgcgggccaggcgcgggccgaggctggcgccacgggagagcagggcgatcagccacagccaggccgccagcagcggcagggcggagagccagcccagcggccgcaaaggagcctccggcaatgccaggcgcagcgcggcaagacccagcggcgcggcaccgagcagcagcgccaggctgccgagcagcggtgcgtagagaccgggatgacggcgcggatacaggccgtgcagttgccggacgctatagcggtcctccggcgccggcagggcgaacggatcgccggcgagcgcggcgtcgagctggcggccctggtcgatcaggtgggcgaggcggcggaacggtcccatcatgcggtgtacctccaggcttggctggcgattgtgccacgccaggccgatggtcgcgccgcccttgcaaagccgcgggcgaacgcccatatctggaggttccagggtttcagccagaggagtcagtcatggccagcgggtgggcgaacgacggtgcggtgcaggaacagatcgacagcacgatcgaggatgccatcgctcgtgcgcgcagccagttgcctcgtggcgagagcctgacccattgcgaagagtgcgacgcgactatccccgaggcgcggcgccgggcgattcccggcgtgcgcctgtgcgtcaactgccaggccgagcacgacagggaacaggcgaagttcagcggctacaaccgccgcggcagcaaggacagccagttgcgctga

SEQ ID NO: 10743 - DNA, 1404 bp, Pseudomonas aeruginosa
aggcctgcctcagttttcccgatagcgttccttcacccattgctccaccggcgacagggtgcgcattcccacgcccagcggatcgtccatgtcatgctggctggaggcggtccagcgcgggtcgatgaaggaccaggccaggcccgccgggccctggtcgcggtaggtgccgaaaacgtcgttgaggcccagcggctccgcgttgcgcagccattgcccgttgaagctgtcgccgttgatggtgcggtccgagatccagcgaccgtcgtcgtaatggaaagccatcactcgccagcgatgctcgcaccagtggcaggcgtcgtcgtcgacgtagaaggcttcgacgaagattttcttcccgccgatgtcgaggaaggtcgagtaatcgtcggtatggcgcggggccaggctcagtcggctgccgtcgccgaggtcgatgaagcgatcgggggcgtagggcgagcgcggcgaaaggctcatcaggaccctggcgtagtcgtcccgctgcggcgggtcggcgaccagtgcctggcgctccgcggcggtcagcgcgaagcgctcgctgcctcggccgaccacgtcttccagctgacgctggtcgcgtggcagggtgccgtcgaggccggcgtacaggttgaccgcctggatgaaccgggcgacgtcgatgtcgagcatttccggatagccggaatgggcggtcagcgcgccgtccttcaggtcgtagatcaccgaccagcgcgtccctcccgaaccgccggcgtaggacaggtagcccaggcgcagttcgtcgcggccgtcgccgtcgtagtcggcgacttccatttggctgaggctgaacagctgggggaaggcataatcggtttcgaactgctcgcgcggtttccgcttcgcgtccggatcgaaggggaccaactggatcttccggtattcccggaggctcagctcgaccatgttcttctggatatccaggaacggggagaggttgagcagcgaggagaggaggccgggttcggcgatgtagaacaccttcaccagcggcaggttggtccgtccctggttccgctccaggcgctcgatgacctggtcgtccatggcgaaggccttgccgacgaagcgccgattgccgtaggcgaccaggaatttctcgccgaagccgagcaggtcggcgcccttgatctccacctcgtagtccgccggaaagcgcgcgaggatggcttggcgcagcatcacgtccttcttgctgatgggaatctcgccgtactggtagagctggtaggtccagtagaggaagtagctcaccacgacgatggccgttgcctggaaggccttggccagatacggggtggaagcgttgcgggacgattggcgggaggacatggacggactgccggcggctacgggtag

SEQ ID NO: 10744 - DNA, 453 bp, Pseudomonas aeruginosa
agatcagcagcttgtctttctcgcggggggacaagtccatctcaggtactccagatgcgtgggggaacggcctcgcggccgagcagcgccggccgcagcaggcgccagagttcgatcagccaggctcgcgcgtgcagcgcctcgtcggccaggcagcgcgccaccagcaggccgccgggcaactggctgaggttgccgcggccggcgcaggggagcgcgcggcagcgttgcagcaggtcggtgtcgatctcgccgctggcgaccagggtcgccagcaccggatgcccggcgaggccgatcggcgagtcgagcaggcggtcgccgccgtcgatgcgctggcgctcgtgccagagcaggcggtcgtcgcgacggatgtccagggccgcgacgaagtggccgctgacgaagcgctcgccgctggccgggcggccgagcgcgaccatgtcccagtag

SEQ ID NO: 10745 - DNA, 897 bp, Pseudomonas aeruginosa
acctcgatcacctgttcgtcggcctgtacctccgccagcgagccttcggccagcacgtggccctggtgcagcacggtgacatggtcggcgatgctgccgacgaaacccatgtcgtgctccaccaccatcagcgagtgcttgcgcgccagggacttgaacagctcggcggtgaattcggtctcggcatcggtcatgcccgccaccggctcgtcgagcagcagcaactgcggttcctgcaccagcagcatgccgatctcgaggaactgcttctggccgtgggacagcaaacccgccggacgctgccgcgactccagcaggcggatggtggcgagcacctcctcgatgcgttccctctgcgtgccgtcgagccgcgcgcgcaggctggcccacaccgacttgtcggccctctgcgccagttcgaggttctcgaacacgctcagggcctcgaacaccgtgggcttctggaacttgcggccgatcccggcctgggcgatctgcacctcgctcatgcgggtcaggtcgagggtgtcgccgaaatacgcggtaccgctctgcgggcgggtcttgccggtgatcacgtccatcagggtggtcttgccggcgccgttggggccgatgatgcagcgcaattcgccgacgccgatgtacagggtcaggtcgcgcagggccttgaagccgtcgaagctgacgttgatgtcttccaggctgaggatggtgccgtggcgcgcgtccagccggccgctggtggcggcgcccaggccgatggcgtcgcggccgctgccggcggtatcgaggccggggtggaaggccggttcgagcatcaggtgcggggtggtcctcattgctccttctccttgcgcagcaggccgagcaggccgcgcggcaggtacagggtga

SEQ ID NO: 10746 - DNA, 426 bp, Pseudomonas aeruginosa
gtggctggttcaatcgatgaccctccctttcagggcgaacagtccctgcgggcgtttctggatgaacaggacgatcagcgcgaggatcaggatcttgcccagcaccgcgccgatctgcggttcgaggatcttgttcgccacgccgaggccgaaggcggcgaggacgctgccggcgagctggccgacgccgccgagcaccaccaccaggaaggagtcgatgatgtagccctggccgaggtccgggccgacgttgccgacctgcgacagggctaccccgccgagccccggcgatgcccgagccgagaccgaaggcgagcatgtccacgcgccctgtgggcaccccgcagcaggccgccatgttgcggttctgggtcaccgcgcggacgttcaggccgagccgcgtgcggttcagcagcagccaggtga

SEQ ID NO: 10747 - DNA, 1671 bp, Pseudomonas aeruginosa
aggacgagggggccgttaggcgcgcgaccggggcgttcccgttccgttcaggggaacgcctggtcaggggggcagggttcttcacggcagaactcagttgctcttcagcgcatgctccggctttttctcgttgcccgggatgaacgggctccagggttgcgcgcgaagcggctcgggggtcttccaaaccacttcgaactggccgtcgtcctggatctcgccgatcatcaccggcttgtgcaggtggtggttgctcttgtccatgaccagcgtgtagccggatggcgccttgaagctttgcccggccatcgcctcgcgaaccttgtcgacctcggtgctgccggccttttccacggcctgcgcccacatgtggatgccgacgtaggtggcttccatggggtcgttggtcaccgcggtgccgtagttcggcaggttctttgccttggcgtaggctttccagtcggcgacgaacttctcgttgaccggattgctcaccgactcgaagtagttccatgccgcgaggttgccgaccagcggcttggtgtcgatgccgcgcagttcttcctcgcctacggagaaggccaccaccggcacctcggtggcttccaggccctggttggccagttccttgtagaagggcacgttggagtcgccattgacggtggagaccaccgcggtcttgccgcctgcggcgaacttcttgatgtcggcgacgatggtctggtagtcgctgtggccgaacggcgtgtagacctcctggatgtccttgtcgtccacgcccttgctgtgcaggaaggcgcgcaggatcttgttggtggtgcgcgggtagacatagtcggtgccgagcaggaagaagcgcctggcgccgccgccgtcctcgctcatcaggtactccaccgccgggatcgcctgctggttcggcgccgcgccggtatagaagacgttcggcgagagttcctcgccctcgtactggaccgggtagaacagcaatccgttgagttcctcgaacaccggcaacaccgatttgcgcgacaccgaggtccagcaaccgaagaccaccgcgaccttgtcctgggtcagcaactggcgggccttttccgcgaacagcggccagttcgacgcgggatcgaccaccaccgcctccagcttcctgccgttgaccccgcccttggcgttgatctcgtcgatggtcatcagggccatgtccttcagcgaggtctcggagatcgccatggtcccggacagcgagtggaggatgccgaccttgatggtttcggcggcctggatggaccaggacaggcccatggaagcgatggacgcggacagcgtgaaggccttgagcagactgcgacgtttcattggtgttgttctccattcaccagcggtcggggcggcagttttcaggaggcgtcgtgcttgtcgtcgggcatccgtccggtggacggcggggtgcgcactgcggcctggatctcttcgtcgaggctccagagcaaaggctgtgcctcttcttggcgctggccggtatcggtcggcgaaaaggcgccgcgagtcgccggggaagcatgccgagcaggtctggctatgccggggaaggctgcgttttcaacgggttttcgccggatatcgacggagaaggcgccgtgggctccggaaggggaggcgtcgcgctga

SEQ ID NO: 10748 - DNA, 957 bp, Pseudomonas aeruginosa
ccggccaccggcttggccaggatgcgcttgatcccggcgttgcgggcgatgatcttgctcggcgcgttgctgatcccggtgagcatgatcagcaggatgtcgtggttgaggttggggtcttccttgatcttcgccgccagttgcatgccggtcatgccgggcatgtcctggtcgagcaggaccacgtcgaagtactcgcgcaggtgcgccttggtgcgcaactgggccagcgcctccttgccggacgacaccgcgctgacgttcaggccccagccgctgcactgctgcaccagcaccttgcggcaggtttcgttgtcgtccaccaccagcagccgggcgccctgcagcgggccgtccaggtcggcggtggggttctccagctgctgcgggtcgagcggcagggtcagcgacagggtggtgccctggctgctgccggactggatgccgaactccccgcccatcagccgcaccagttggcgggcgatgatcaggccgaggtggctgccgagcttgctggcggaaaggaagtcgccgctgtgcagctcggcggtgagcagcgcctcgcgctccttggcgtcgaacgggtggccgctgtcctgcacggcgatgcgcaggcgtggcgtctcgccctggtcgtcgagggccaccaccagcaggatctcgccttcctcggtctgcttgaacgcgttgtccagcaggctcaggaccacctggcgcaggcgcgtcggatcgccgccgatgacccgcggcacctgcggctgggtgaagctgatcagctcgatgcgctgctgctcggccttgacccggaagatatccaggcagtcctcgatcaacgcgttgaggtcgaactgcacttcgtccagctcgatctgcccggactccagcttggagatgtcgagtatctcgttgatcagcgtgagcagctcgttgccggcgctgtggatggtctgcacgtag

SEQ ID NO: 10749 - DNA, 1410 bp, Pseudomonas aeruginosa
ccaagtggccgtggcaacggcatatgccgcggaagcgccgtgcggcgcccgcggcttcgggcccggtcaggactcgccgcgctcgcgggcgatggcacggtagccgatgtccttgcggtagaagcagccgttccagcggatcttctcggccaggcgataggcctgttgctgggcggcggacacgctctcgccgatggcggtggcacagagcacgcggccgccggaggtgacctcctggccatccttcagcgcggtgccggcgtggaacaccttgccgtccagcgcggcggcctcggccaggccttcgatgacctcgcccttggcgtagtcgcccggatagccgccggcggccagtaccacgcccacggtcggacgcgggtcccaggtcgcctcgaccttgtccagcgccttggccagggcggcctcgaccagcaggaccagggaggactccaggcggaccatgatcggctgggtttccggatcgccgaagcggcagttgaattcgatgaccttgggcgcgccgctcttgtcgatcatcaggccggcatagaggaagccggtatagacgttgccttcctcggccatgccgcgcacggtcgggtagatcacttcgtccagcacccgctggtggacctcggcggtgaccaccggggccggcgagtaggcgcccatgccgccggtgttcggcccgctgtcgccatcgccgacgcgcttgtggtcctggctggtggccatcggcagcacgttctggccgtcgaccatgacgatgaagctggcctcctcgccatcgaggaactcctcgatcaccacgcgcgagccggcgtcgccgaaggcattgccggcgagcatgtcgcgcacggcggcttcggcttcgtccaggttcatggcgacgatcacgcccttgcccgcggccaggccatcggccttgatgacgatgggcgcgccctgctcgcgcaggtaggccagggccggctcgacctcggtgaagttgcgataggcggcggtggggatccggtggcgggcgaggaagtccttggtgaaggccttcgagccttccagctgggcggcgccggcggtcgggccgaagatatccaggccgcgctcgcggaacaggtcgaccacgcctgccaccagcggcgcctcgggaccgacgatggtcaactggacgttcttcgcggcgaagtcggccagttgctccagggccagcacgtcgatggcgacgttctcgcacttggcttcggtggcggtgccggcgttgcccggggcgacgaagaccttcgccacgcgcgggtcctgggcgactttccaggccagggcatgttcacgaccgccgctgccgatgatgagtacgttcatggggttctcctggcgcaacggcgggtaacgcgccgcgttatccgccctgcgtga

SEQ ID NO: 10750 - DNA, 1566 bp, Pseudomonas aeruginosa
acagccgattccttagttcttacagttggaagacgagcggcacttgcgcctggcgctccgcgcgagcgggtgggcgtagcggcccggcggcgaccggcgaggtctttccggtcactccggggaatggaagctcaggctgtagttcaccgccttcggacccgggtcgaggatgtccagcgacacgtggatcggtacctgcggtggcatttccgttcgtccggccagctcgccgccgaggtactcgccgggcttgaagcggcgattggcgatgaggtggccgttgaggtcggcgaagcgcagttccagcagcgggaacggctgcgagaagctggcgcgattgtagatgatcgcgtcgaccaccagcgcgccgctgaattcgggatggctgcggaccaccaggttgctgctcctgatctgctccacgtcgaccttggagggaagggtgcagccgatttccgggcagagctgggcgaaccaggggcgataggcgtcctggcgcgccagttcgtcgaaatggtaggcgatgtactgagcggcgagaccgcccagcgccagcaggatcagcagcagccagccgagacgccgcggccattggcgccggggcttctcccaggccagttgcagtggctcgtcgcgcaactggtcgagactctcgaccggcgcctcgtccggtttgcgggcgctgcccaggggcgcgacggactgttcctcggcgctttcctcgtcgtcttcatccagggcgctcaggccgtggcggcgcttgccgaggctgggctcgtcgtcatcgtcgtcatcgagaatgaggcgaagttccggcggatcctcggcgcggcgcagcggcacgaaggatacccgctcttccgccagcggttcgccgaggctcggttcctggcgcggattgccgcgcgccggctgggccggttcggcatcggcgatcagcgcctcggcccagcgttcgtcatgtggatcgcgttcgtcgtcgcggcgcgccagcaggctttccgccggtcgcggggccttctcgatgctggagaattcctggttcagctcgaattcgtcgagcttggccagttcctcgtcgaggttgaggctgtccaggtcgaggtcgtcatggatccacagggtttcgtcgcgcgggcgcgctgccgggggcgcggccgaggtggcggccgcgacgctgggcgcaggtggcggagcggcggccggcttcgcttcggctgccgaaggagcgttcgcgcgcggcgcgccaccgacctggtgttgcagggcgttgaagactttcaggcaggtgccgcagcggaccgcgccattggcggcgcccagttgcgcgtcgttgacgcggaaactggtgctgcaatggggacattgggtgatgacgctttcgctcatgcggcgatccgtagggaaaatccggcggctagtctaccccaagcttcttgcacgaaggcagtggggcgggatcagtggtggctggcggcgcgccatcaatcggcgcggcggcggccgctgatgcggatccagccttcgcgctcggcggtcgggtcgagatcgaagtgtgcggagtag

SEQ ID NO: 10751 - DNA, 585 bp, Pseudomonas aeruginosa
acagggaaccgcgcgggctcgataccgttgcgcgaggcattgtcgcgcgaggcttccagggcctgtggatcgatgtcggtgccgaccgcccgttcggcgccgagcagcagcgcggcgatggcgaggattcccgagccgcagccgaagtcgagcacctgccggccggccagttcctggccgtcgagccattccaggcacagcgcggtggtcgggtgggtgccggtgccgaaggccaggcccggatcgagcagcaggttgaccgcgtccggctcgggggcggcgtgccagctcggcacgatccacaggcggcggccgaaacgcatcggctggaagttgtccatccagctgcgttcccaatcctggtcggcgatttcctcgacatggtgctcgggcaggtcgccgccggtaagcaaggcgaggtgggcgagcagggcggtctcatcggtgtccgcttcgaacagcgccagcaggtgggtgcgcgaccacagcggggtggtgccgaggtccggctcgaagatcggctggtcttcggcgtccatgaaggtcacggagacggcgccgacttcgagcagggcgtcttcgtag

SEQ ID NO: 10752 - DNA, 1446 bp, Pseudomonas aeruginosa
caccgttggggcggccggcaggcggaaacgacaagggccgcccggaggcagcccttgtgcgcagcgactgacggatcagtgcttgtccatacccagtttcttctccaggtaatggatgttcaccccgcccttgcagaaggcggcgtcgcgcaccaggtccttgtgcagttcggtattggtcttgataccgtcgacgatcaactcgtccagggcattgcgcatccgcgccagcgcctcgtcgcggtcggcaccgtaggtgatgaccttgccgaccagcgagtcgtagttcggcggcacgctgtagccgctgtagaggtgcgagtcgacgcgcacgccgttgccgccgggggcgtggaagtgcttgaccttgcccgggctgggcatgaaggtcttcgggtcttcggcgttgatccggcattccagcgcatggccgcggatgaccacgtcctcctggcggatcgagagcttctcgccggaggcgatgcgcagcatctccttgacgatgtcgacaccggtgaccatctcagataccgggtgctccacctgcacgcgagtgttcatctcgatgaagtagaagcggccgttctcgtagaggaactcgaaggtgccggcgccgcggtagccaatctcgatgcaggcctggacgcagcgggcgaagacttcctgacgggccttctcgtcgatgccgggggccggcgcctcttcgatcaccttctggtggcggcgctgcagggagcagtcgcggtcgccgaggtggatggcgttgccctggccgtcggaaagcacctggacttccacgtggcgcgggttggtcaggaacttctccaggtagaccatcgggttgccgaacgccgcgccggcctcggtgcgggtcagcttggccgacttgatcagctcggattcgtcgtagaccacgcgcatgccgcgaccaccgccgccgccggcggccttgatgatcaccgggtagccgacctcgcgggcgatcgccagggcggtttcttcatcttccggcagcgggccgtcggagcccggcacggtggggacgccggcgcgcttcatggcgtccttggccgagaccttgtcgcccatcaggcggatcacctcggcggtcgggccgacgaaggtgaagccggagcgttcgatctgctcggcgaagtcggcgttctcggcgaggaagccgtagccggggtggatcgcggtggcgccggtgacctcggccgcggcgatgatcgccgggatctgcaggtacgactgggtggccggggccggaccgatgcacaccgattcgtcggcgagcgacaggtgcatcaactcgcggtcggcggtggagtgtaccgccaccgtcttgatccccagctccttgcatgcgcgaaggatgcgcaaggcgatttcgccgcggttggcgatcagcactttttccaacatcgcaggttccccgcggcttag

SEQ ID NO: 10753 - DNA, 1086 bp, Pseudomonas aeruginosa
ccggcaattgcggcagaagtatgtcagcgcatgtcactgccgggtagcggcccggcgcagtcgttcggcgagcccggcggcgtcgatctctccgatgacgcgcaagtcgctccattcgtcaccgcccggggcgaagaacaggatcgccggcggaccgaacaggttgtagcggtccagcaggccgcgctgggccgggttgctttcggtgatgtcgaagcgcagcaggcggtaggccggcagtcgtgcctgcaccgtgggatcggtgagaacctggcgctcgatgaccttgcaactgatgcaccagtccgcataccagtccagcagcaccggcttgccggcctgacgtgcctcggccagggcggcgtccaactgcgccggggtggtcaggttctgccattcgccgggcgtgctcggcggcccggcatggatcgacggcaccgagcggcccagcggatggatcgggtccgactcgccctgcagggcgccgatccaggcggccaccgcgtaggtcaggaacatcaggccaagcagttgcagcaggcggcgtgcggcgctcttcggggtgaattcgagggcgcccagggccaggccggcgccgccggcgagcatgccccagagcatcagcgccaccgggccggacaccacccgctccagcagccacacggcgaccgccagcaacagcacgccgaaggcgttgcgcacgccgttcatccaggctccgctcttgggcagcagggcgccgccgccggcgccgaacaccaccagcggcgtacccatgcccaggccgagggcgaacagttgcaggccgcccccccaggcatcgccgctggcgctgatatagagcagcgaggcggccagcggggcggagacgcagggcgagaccagcaggctggaaagcacgccgagggtggccgcgccgaggatcgagccgccgcgcgcatcgccggccaggcggtcgagcggttcgcggatgaagccgggcatgcgcagctcgaagaagccgaacatggccacggcgaacagcgcgaagaaacgccgcgaatggcaccagtacccagggtgactgcaattgcgcctggagattga

SEQ ID NO: 10754 - DNA, 1350 bp, Pseudomonas aeruginosa
ggcgcatggcgagtctcgtccgactacggaacggcgagaccgcaggttatttccgttcggttaccggctgatgacaaaaggccattatcgagcgtcgggacgatatacctcgatccggttgcgcccgccgtgcttggcccggtacagcgcttcgtcggcctgcttggccatgctcttgatatcgaggtccggggtcagctcggcgatgccgcaactgaaggtgcagcgcaggtcggtcggttgcgccgggttatggatctcggcgaagcgctggcgaatctcgtcgagcaccaggcgcgcggcgtccaggtcggtgtccggaaggaccacggcgaactcttcgccgccatagcggccgatgtggtcggtcttgcgcaggcgttgcttgaggaacagcgccaggcccttgatcacccggtcgcccatggggtggccgaaacggtcgttgacctgcttgaagtggtcgatgtcgagcatcgcgaagctcagcggacggccatcgcgacgtgcgcgcagacgggcgtcctcgagcagttgcagggtatgggtgtggttgtacaggccggtcaggctgtcgcgcaccatccgcgccttcaggctgcgcgcgcggctggcgcgggtgcgcacggtggcgatcaggtggcgcgggcggatcggcttggtgaggaagtcgtcgccgccttcgctcatggcgtccagctgcttgtccaggtcgtcctcggcggacaggtagatgatcggcacgctgacgtggcgttcgtgctggcggatcaccttggccaactcggtgcccaggcactcgggcatgtacatgtccaggatgatcaggtcgggctggaagtcgctcagctcggccatcaccgacagcggctcggtgagcgcgcgggtgatgatcccggcgctgttgaggaccatctcggtgtgcagcgcctgggcccgggagtcgtcgacgatcagtacccggtagggttcgtagaagctcaggcggctgagggtctcgatcttttccagcacgctggaggcgtccagggtgccggtgaagaattcctggccgccggcgcgggctgcggccaggcgggtcggggtgtcggtctcgctgtcgctgaaaaacagcaccggcagcttgtgttcgaggccggcctgggcctcgctggccagtcgcaggcccatgtcggggccggcgaagtcgacttccatgacgatcgccgccgggtagcgttcgcgcatgctggcgcggaaggcgtcggcggtctcgcagctcagcgcctgcagaccgaagaactccagttgctgggccaggcgctcggcgcgttcgcggtccttcagtgccaggtagaccggtttgcgtaa

SEQ ID NO: 10755 - DNA, 969 bp, Pseudomonas aeruginosa
ctatgccggcgtggtggtcggcatgctcaaggagttctgcgacgcccagggcctgccgcatccgcacatcttctcggagagcggccgggcgctgaccgcgcaccatgcggtgctgatcacccaggtcaccgacgtcgagcggcacaacgacgacgtgccgaagatcgtcgatctcgacgagcagccggagatcgtccgctggctggccgaactgctcggcccgaccgatgccgagatggtcaccgagacctactggcgcgccacccactacatcggcgacgccgccgcgcagtatgccgacggcaagatcagcctggcgcagaaagccctcgccgagcagtgctacttcgctatctgccggcgcctgcacaaccagctcaaggcccgccagcgctcccaccggcaggtcctcgacgaactcaacgacaagctcgccgacaagtacatctgcaacttctcggtgttccagagcctgccggatacctgggccatcggccaggtgctgccgatcctgccgctgcaccgcctgggcgaggagccggatcggcgcgcggtactgcaggacctgacctgcgactccgacggcaagatcacccagtacgtcgacgagcagagcatcgagaccagcctgccggtgcacgaggtgaaggagggcgaggactacctgatcggggtattcctggtcggcgcctaccaggagatcctcggcgacatgcacaacctgttcggcgacaccgactcggtgaacgtctaccagcgcgcagacggcggcatctatcacgccggcatcgagacccacgacaccatcgaggacatgctgcgctacgtgcacctgtcgccggaggaactgatgaccctctaccgcgacaaggtcgccggggccaatctcaccgcccgcgagcgcaaccagtacctggatgcgctgcgcctggggctgacccgctcggcgtacctgtcctgactggctag

SEQ ID NO: 10756 - DNA, 1026 bp, Pseudomonas aeruginosa
gtagagatgcagcaggtagaagaacatcggcgctccgccgaacgccaccagggccttgccgcgaccgctccagtccaggcgttcgaaccaggccaggagcagcaggccgattcccagggtgagggcgaggaacagcagcgacggcggatacttggtgacgttgaagaagcccatcagggtgatcgccggcgtctcgccgaaggcccagggtttctcgccatagccgttgagcaggcgcagcaggatgaagccgagcagcagcccgccaccgcccgccaggaggtagcgtcggcgcgtggttgccggcgtggcgccgctgaaccagttgcctgcggcatagcccagggcgatcacaccgatccacggcagcagggggtaggaggtgcgcaggcgcagggcgtcgcccgcttcgatccagccgcggtcgtggagcaccgcccacggcaggtgccaggccgagccgggagcgaaatgcagcggatcgagcaggttgtggccggccaccagcagcacgccgagcgccgcgagcagagggcgcggcaaccagagcagggcggccagggcgagcatgctcaggccgatcgcccagatcacctggaggtagatcaccgtcggcggcaactggaaggtccaggcgaagttcaccagggtcagttccagcgccaccaggaacaacccgcgcttgaacaggaacgccgagaccgcccggcgtccctggtgcttctcgccgtagaggaatgccgacaggccggtgaggaagacgaacaccggcgcgcacaggtgcgccagggtgcggctgaggaacagcgccggctcggtgctggcgacgtccatcgggtcgccgacctggcggtgcaggaaaaaggtctcgcggacatggtcgagcagcatgaacagcatcaccaggccgcgcagggcgtcgatgctgtgcaggcgggaggaattggagatggagttgggcatggctgggctggtcgtcggaaaagagggatgagtatcacagcctggcggcgagacgcgagatag

SEQ ID NO: 10757 - DNA, 2157 bp, Pseudomonas aeruginosa
tatatcatttcttttctggtgcgatttcccatgagagtcagtgtgtcgcttgtcctcggtgtcggcctcggttgcagcagtccggcgctctgggcggaaacggaaagtcccgcggagcttgaggtcctcactgtcaccgccgaagcggagcgcgcggcgggcccggtgcagggctaccgggccaatcggacggccagcgcgacgcgcaccgacacccgtatcgaggacatcccgcaagccatcagcgtggtgccgcgccaggtgctcgacgaccttgacagcgctcgtatcgaacgggcgctggacttcgccggcggggtctcgcggcagaacaacttcggcggcctgacgatgttcgagtacaacgtccgtggcttcaccacttcggagttctaccgcgacggcttcagcgccaaccgcggctatatgaacgccccggacagcgccaccatcgagcgcgtggaaatcctcaagggaccggcctccagcctttacgggcgcggcgatcccggcggcacggtgaacctggtgaccaagaagccccaggccgagcgcttcgcccgcctgcatgccagcgccggcagttgggaccgctaccgctcgaccctggacctgaacacgccgctggacgaagagggcgacctgctctaccggatgaacctggcggtggaggacagcaagggcttccgcgactacgccgacggccagcgcctgctggtggcgccatcgttcagctggcaactggacccggacacctcgttgctggtggaagccgaggtggtgcgcaaccgccaggtcttcgaccgcggcaccgtggcgccgcacaaccacctgggcagcctgccgcgctcgcggttcttcggcgaaccggacgacggcaagatcgacaacaacaacgaaaccctccaggccaccctgcgccatcacttcaacgagcagtggagcctgcgcctggccagccactacaagcatggccacctggacggctacgcctcggagaactccagcctcgccgccgacggctacagcctgcgccgggagtaccgctaccgcgacttcgagtggcacgacagcatcacccagctcgacctgctcggcgacctccataccggctcgatccgccaccagttgctgatgggcctcgagtacgagcgctaccacaacgacgaactgatcctgcgtagcatcccgtcgcgcaacccctatgccatcgacatccgccggccggtctacggccagccgaaaccacccttcggacgcgacgaccgcaaccacgaggaagtcgacgcgatggccctcaacctgcaggaccagatcgagttcagcgagaaatggcgcggcctgctcggcgtgcgcttcgaccgctaccgccaggacatgaacgccacgcgcctgaacaatggccgcttccgcgacaccagctcgcagcagacccagcgtgccgccaccccgcgcatcggcgtgctgtaccaggcgaccccggaggtcggcctgttcgccaacgcctcgaaatccttcaagcccaatggcggtaccgacatggccggcaaggccttcgacccggaggaggggcgcggctacgaggcgggggtgaagctcgacctgctcgatggccggctgggcatgacactcgccgcgttccacctgaaaaagaagaacgtgctcaccgccgacccgagcaatcccggttaccagcagaccgccggcgaggcgcgcagccagggcttcgacctgcagttcagcggccagctcaccgagcagttgcggctgatcggcgcctacgcctatatcgacgccgaagtgaccaaggatgagaacatcgctcgcggcagccgcctgctcaacgtgccgaagcacagcggcagcctgatgggcgtctacgagttccgcgaaggctggctgcacggcgccgatgccggcgcggcggtcaactatgtcggcgagcgcgccggcgacagcagcgacagcggcttcgaactgccggcctacaccaccgtcgacctgctcgcgcactatccgctggcgagcaatgccaccctcggggtgaacgtcaacaacctcttcgatcgtcgctactacgagcgttcctataacaacgtctgggtcgcccccggcgagccgcgcaacctgaccatgagcctgaccctgaactactga

SEQ ID NO: 10758 - DNA, 1695 bp, Pseudomonas aeruginosa
tcgtcgcgctggccgcccacttcgacctggccatgccgcaggcgcgcagcctgttggcgagctacgagaacgccgtgtcccgattcatcgattgccaaggagcgagccagtgccatccaagcctgtatccgatcgacagccgtccggcggcggacgccatctatcgccaatggtgctcgacctgctgaagagcggggtgctgctggcggtgctggcgtccttcaccttcagcgtgatgaacgccctggtcaaggaagccagcgccaccctgccggctgccgagatcgtgttcttccgcagcgccatcggtaccctgctgatctacctgctgatgcgccaggccggtgtcgccctgtcgcgccagggcgtgccgatgctgctggtgcgcggggtgatgggggcgctgtacctggtctgctatttctacgccatcgcccatatcccgctggcggacgcgagcatcctggcgcacatgtcgccgttcttcgtcatcctcttctccgcgctgttcctcggcgagcggattccccgggcggtctattggctgttgctggtggtggtgctcggcgcgctgatgatcgtcaagccgttcagctattccagctactcggtatacgccgtggtcggcctgctcagtgcggtgttcgccgccggtgcctcggtggcgatccgccaactgagcgcgcggcaccatacctacgagatcgtcttctacttcctggcggtggccaccctggtggccatcccgctgatgtggaacgacttcgtggtgccggcgacgctgcgcgagtgggggctgctgctggccatcggggtggtatcgctactcggccaggtgttcctaacccgcgccttcagtcacgagagcgcgaccatcgttgcggtgacccgctatatcggcatcgtcttcaacgccggctggggctggctgttctggagcgaggtgccggacgcgctgaccatcgccggcggcgtgctgatcgtggtggcgtgcatcgcgctgtcgcggacgaagaagggctgagcctccggcgcgaccagctcccgctgcttcgcgccggaccgcgcctagagtacgtagcgccagatcgccacgaagtggaggaggctgccggcgatcacgaacaggtgccagatgccatgccagtggcggaagcggtggtcataggcatagaagacgatccctacggtatagagcacgccgccggccgccagccaggtgaagccggcgctgccgagggcggcgagcagcggtttcaccgcgatcagcacgatccagcccatcaccgcgtagatcaccaccgacagcactcgcgcctcggagcgtggcttgatctcctggagcatgccgagtaccgccaggccccagacgatgccgaacagcgtccagccccagggaccgcgcagcgtgaccaggcagaaaggcgtgtagctgccggcgatcagcaggtagatggacaggtggtcgagcttgcgcatcaccaccttcgctcgcccgcgcacgctgtggtaggcggtcgagatgctgtagagcagcgtcagggtgacgccgtagacgccgaccccgacgatcttccacggactgccgttgaggctcgcctggaccgtcagccagacggcgccggtacaggcggcgaccgcaccgatcaggtgggtccaggcattgagtctttcaccgtgatacatgacgcatga

SEQ ID NO: 10759 - DNA, 222 bp, Pseudomonas aeruginosa
gtcatgaacttcgagaattcggtatcccctggcgtatccgccttcgtggcgaaaatgcgcgtgcgcgccgcgcagtcccccggcgcgatccttcccggccacggccatcctgcgagcctcgcctggcgtgtcgacccggccggcggtcgcctggagtatcgccgcctggagacgcaggtcgaagagaaccctgagagcggtcgccgcccgatgcgcggctga

SEQ ID NO: 10760 - DNA, 912 bp, Pseudomonas aeruginosa
agaccctctacatccgccgcttcggccagtggttctgagccatcggccgggcttcgtcccggcctttcccggcgcgtcggcaagcctcgccgcgccgcgcaacgcacaccggacccacgcatggagagacgcatcatgaccctgcacgaccggcgcccgcgggcgccccttttccaaccgctgccggccgcgctgcgacgcgccctgtcctggcgcctgggcttcgtcgccgcggcgctagcctgcgtcctgctgctggcgctgctgtccgaggctcgcgccgcgggcggcgcctaccgggtcgacgacggcgagatcgaccccgtcggcgaatgcaacctggacgcctggcaccagcgcgaacgccaccacggcaaccgctaccagtcggtgctgtcccccgcctgcaccttctccgccctaccatcggtgcagctcggcgcggcgctggtgcgcgagggcgacgcaggcgatcggcacagccgcctcagccccgagctgaacacaccgatgatggcccgcgacgacctcggcctggcgttggccttcgcgctctcggcggatctctacctggaccgccggcacgccttcgaatgcgccggcttcaacctgccgctgagctaccagccgttcgaggccctgcgcctgaacgccggggtcggcctggggcatgcctacgccgagggcgagcgccggcatcgctggaactggggcgtgggcatggaataccgggtcggccaaccgttgaccctgatcgccgaacgcttcggcgagtcggccggcgacagcggctggcaggccggaccgcggctgcacctgggcgaacggctggacctcgatctgctggtcggcggccacctgcgcggcgagcgcgagcgatggctggtctcgggagcgaccttgcgtttctga

SEQ ID NO: 10761 - DNA, 990 bp, Pseudomonas aeruginosa
gtgcggcgatccgcgcctacctggcagacctcggccaggacggcctcggcgacagcgacgccgatcgtgcccaggaaatccttctgttcgccatcaacatcgagcacatcggcgatctcgtcgccaacagcctgctgcccctggcgatgcgctgggccgggcgcagccgcgccggcagcgagttcgagctgggccgcatgctgccgttgcaggcggcgatcgaggagagcctgcacctggcgatcagcgcgttccttcgcgaagacctggacgccgcgctgcgcctggtggcgcgcaagaagttgctgcagcgactggaggccgatgccagtcgcgagcgcttccgtcgcctgcgcgacgatcgcggtgcctgggtggagtccggtgacgtgttccagcgcattctccgcgactaccgacgcatccaccatcatgtcaccgccctggcctatccgctgctcgaacgcagcggcatcgatccgatggcgaagcggccggacgagccagggcaaggggagggatcggcatgcgcctcctgatctgcgccggacgccatttcaaggacgccgaacgcctgcgcctggcgctcgaccagtgccacggcctgcaaccggtggcgctgctcggccacctgctgcatgccggcagcggcctgccggacgaggccgagcgctggtgccgcgagcgtggcgcggattcgcgcgcctacgattatccggagcgcagtggcagcgacaacgccctgcgcgagtatggcgaggccgtcctcggcgatgccgcgccggacctggtgctggtgtttcccggcgggcgcctggccagcgaactgatacaggtcgcgcacgctgccgacgtcccgctgatgctcgcctatcgtccgctgtcggcgccctgagcggcgaaccagccatcgcggcgggtcaggcgccagccgtaggcggccaggaccagcccgcgcagcagcatgaaggcgaggaacgccagccatag

SEQ ID NO: 10762 - DNA, 1272 bp, Pseudomonas aeruginosa
cccgtggttgcccagcccctgcaacagccagccgaggggcaggctggcggccaccgcgacgagcatcgcgttacgcatctcgcgggcgcgggtggcgccgatgaacaggccgtcgagcagatagctccacatccccagcagcggcaggcaggccaggtacggcagataggcgtaggcgacttcgcggacgtcggcgatgtcgctctgcaggtcgatgaacaggtggccgaacaaggcgaacagcgcggcgaacgccaggcttgccagcagcgaccaaccaccggctaccaccagcgcgcggcgcagggcggctcggtcgcgggcgccgatggcgtggccgcagagcgcctccaccgcgtgggcgagaccgtcgagggcgtaggacgtcaggagcaggccgttgagcagcagggcgttggcggctaccgtggcgtcgccgaggcgggtgccctgtacggtgagcaggaaaaacaccagttgcagggccaggctgcggatgaagatatcccggttgaccatcagcagcggcagccaggacagccagtggcgcaggcgttgccactgcgcccgcccggggcgccgggccaggtcgcggcgggtcagggccaggccgagcagggcgccgctccattccgccagcaccgaggcgcgggccgcgccttgcacgccccagtcgaggccgtggacgaaccagagcaccagggcgatgttgctcaggttggtggtcaacaggatcgccaatggcgcccgtgcgttctgcgtgccgaggaaccagccgaccagtgcgtagctggccagggccgccggcaggccgagcaggcgggtatggaagaaggcgcgggcctcgccggtcagttccgccgacggttgcatcagttgcagggcccagccgctcaggggcagggccagcgcgccgagcagcagggccaggagcagcgccatgcccaggccctgggcgaggatcaggcgcagcgcgccgccatcgtcgcggccggcggcctgggcggcgaagccggtggtgcccatgcgcaggaagccgagcacgccgaccatcagggtgtacaggctgccgcccacggctaccgcgccgagctggtaggcgtgcggcaggtggccgaccaccgtgctgtccaccaggtgcaccaggggaacggaaacgttcgacagaatcatcggcccggccagcgcccagaccctgtggtgggtcggggcgtggcgccaggcatcgcgcaacaggctcatggggtcctccggatcggccgggcagtatag

SEQ ID NO: 10763 - DNA, 918 bp, Pseudomonas aeruginosa
ccctcctggtcgagggcttcgccgtcggcgccgccgtggccgccgcgacgggagcaggctgcggggctctggctgcctacctggggcatcgccggaagactttccgccaccgtggcccggtgttccgttcgctgccgcgcttcttcgccgtcagcctgctttgcgtactcggcaacgccgtcctggtgttgctgctcggcgacctcgccggactcgactaccgcctggcccagctcgccgcgaccggcgcactgctgttggcgacctatcaccttcatcgactctggaccttctcatgatgatcgaaccttccctggcgtcgaagctcgaggccccctgcctgctcagtgtggtagtgccggtgttcaacgaggaggcggtgctgccggccttccaccagcgcctgggcgccgtgctcggcgaccttggcgacgattgcgaggtgctctatgtcgacgacggcagcaccgaccgcagcgcgacgatcctcgcccagctacaggccgccgaccgccgggtgggcgtggcccgcttcacccgcaacttcggcaaggaacaggcgatgagcgccgggctcaagctgtcgcgcggcgccgcggtgatcgtcatcgatgccgacctgcaggatcccccggaactgatcccgcagatgctcgacgcctggatcggcggcgccgaaatggtcaacatgcgccgccgcagccgggccggcgaaagctggctgaagcgcgcctcggcgagcgccttttaccgtttgatcaaccgcctcagcgaggtgccgatcccgcgcgacgtcggcgacttccgcctgctcgaccggcgggtggtcgatgccctttgcgagctgccggaaggcaatcgcttcatgaagggactgttcgcctgggtcggtttccgccaggtcgatatcgcctatag

SEQ ID NO: 10764 - DNA, 1785 bp, Pseudomonas aeruginosa
ccgcgccgcccgcgtcgccggccacagcaagtggcgctactggcggctgtggaacttcgccctggaaggcatcaccgggttttccaccgcgccgctgaaggtcgccggctacctcggcctgctcagcctgttggcggccctggcgaccctgctcgccgggatcttcggccagcaggagatccacgaacactggccggtgatcgccgcgctgttcctgatcggcggcctgcaactgctggccatcggcgtgtgcagcgaatacctcgggcggatgaccatggaagcgcggcgccgcccgctctacctgatcgaccgctacctgccggcgcaggtcggcggggccaatccgtgagggcgctgcgcggctggccgctggcctggttcctgctcgccctggccttcgccatccgcctgctgagcctgggcagctatccgctgatggacaccaccgaggcccgctatggcgaggtggcgcggaagatggccgaactgggcgactggatcacgccctggtacgacgtcggcgtgccgttctggggcaagccgccgctggccttctggctcagcgccggcggccagcttctgctcggcgccaccgagttcgccagccgcctgccgcactggttgctgggcgtgctggtgctgtggctggtatgggactggcaggctcgcgaagatcgtcggcaggcgcggatcgcctgcgtcctgctgggcagttcggcgctgttcttcgtcgcctccggggcggtaatgaccgacatggccctggccctggcgctggtcctggccatgcgcggcttctggctgggcctgcatggcgcggagggaatccggcgccgcgagggctggctgatgttcctcggcctcggcctcgggctgctggcgaaggggccgctgacgctgatcctcgccggactgccgatcggcctgtgggccttgctggagtggcgctggcgcgcgctctggcggggcctgccatggatccgcggaagcctgctgatgctcctggtggccgcgccctggtacctgctggcggagttgaagacgccgggcttcctcgagtacttcctgctcggcgagcattggcagcgcttcgtcaccgccggctgggacggcgaccgctacggcaatgcccacgcctatccctacggcagcgtctggctgttcctgctggccgccgcgtttccctggagcctctggctgccgctgctgctctggctgggctggcgccagcgcggggaggtggtcgatggcgtcgcctcgcgcaggcgctactggctgttctggggactggcgccgtgcctgttcttcaccttcgccggcaacgtcctctggacctacgtgctgcccggcctgccggccctggcgttgctcgccgccgacctgctgcgcgcgccgctggcgcgcagcgcctggctgcggcgtggcgggttggcttgcctggcactgaccccattgctgttcgcgctgttcctcggctccctgctgctgggctcgcgcgccgagcagaagtccaccgccgcgctgctggccagcgacgccggctggcgcgagcggccgctggtgttctggccgaagcggccgtactcggcagtgttctacagcggcgggcgggcgcaacgggcggaggacagcgagctggccggctggttgcgtcgcgacgccctgctggcgatccgctcgcgttcgttcggcgccttgcccgacgaggtgcgccagcgcttgcgctgccggccgccggtgggacagtaccagctatgccagggcgtggcgccgcctggctga

SEQ ID NO: 10765 - DNA, 1050 bp, Pseudomonas aeruginosa
gcgtcagtgccgtgggtcctcccgccataccggccggtcctgctcgtccagcgcccagtgcgcggtgccggcgcgcaggcatacgccgccgacccagcgttcgggggcgccgaggtcgaggcggtagcgccgcccggccaggacctcgcggcccgcagcggtcagggccagcggttggcgttcccagggcagttccggcgccggcgtgcgcagcagcgcgccgggctcttccagcagcgcgcggagcaggacgcggaacatcaggtcgccgagatagggcagcggctcgcgccctgcggtcagctcgggcgaagacctggccggcgctcggccgctcgccgtcgcggacgatctccagggtcagccgttcgctcagcgacaggccgtcgcgcagggccggcagttcatgcagttgccgacgcagcgccggccccagcaacggtagcgccggggtcggcgcggcggccagttgcgcccagcgcagtggcgccggatcgcggtaggcgtcccaggccgcgcgggccagcgccagggcttcggcgtccagcgggcgacgccgggtccatagccaggcgagcagctcaggcgccagttggccgatgccgacgaagcgctcgacgcctggcacgcggtcgatctcgatcagttccaggtgctccggcggcgtctgcattcctgccagcacccggaccaggaacaactggtcgtaggcatccgcctcgcaccagagcgccacccgcgagtattcgccgagccgctcgagcccggcgtattcctggcgctggcgggcctgggcgtcggccgggtcgaggtcgaaggcgcggctcaggtagtcgctgcgcagggcgaggaactcgggcaacggcaggttcggcaccggtcccatggtcagcgggtcggcgaacatccggaagccgccgcgaaagccggcgagcttcaggccgtgggcgatgtcgttgccgcagcgcaggtgcagggtcgcggcctcatcgccgccgaccagatcggggtggcggctggcgaaggcgatggcgtcgacatgcgccttga

SEQ ID NO: 10766 - DNA, 1056 bp, Pseudomonas aeruginosa
tggcgtgcgccgggagcccaacttaagcacggctcgacgcctttggcggcgctgtcaggctggggttccggcccgcccagcacgtgccttgccaactgcctgtccaatccgaacggagtctcgacgatgaacaagaacaagacgttcctcgcggcggcgctggtaacgctggccgccagccttcccgtgcacgctgcgaccgactacacccgcacgcgctatcccatcgtgctgtcccacggtctgttcggcttcaagagcgtcggcccggtggactactggcacgctatcgtgccggccctggagaaggacggcgcgaaggtcttcgccacctcgcagtcgccggtgaacagcaacgaggtgcgcggcgaacagctactggcgcaggtggaggaagtcctggccctgaccggcgcggagaaagtcaacctgatcggccacagccagggcggcatgaccgtgcgctacgtcgccggggtggcgccgcaactggtggcctcggtcaccaccatgggcacgccgcacaagggcacgccggtagccgacgcggtgaccggcttcagcgagttcctcgggccgatcggcaccgaggtgatcgcctcggcggtggaggcgctgttctcggtggtcgacatcgtcgacggcggcgagtgggtcaagggcgacgcgctggctgccctgaacagtctcaacactcccggcaccgcgcggttcaaccagcgcttcccgcaggcgatcccggccagcgcctgtggccagggcgcggagacggtagccggggtgcgctactactcgatgagcggcaccggctccctgaccaatgcgctcgacccgagctccgccggcctggcggtgaccgggctgctgttcggcgaggccaacgacggtctggtcggccaatgctccagccacctgggcagcgtggtgaaggacaactaccggatggaccatctggacgaagtcaaccagttgctcggcctggtcagcctgttcgagagcgacccgacccaggtctatcggcagcatgccaatcgcctcaggaacgtcggactctga

SEQ ID NO: 10767 - DNA, 1713 bp, Pseudomonas aeruginosa
cctcggcctgctgtccaactcgctgccgggctacctgaccctggcgatggacgccgagcaggactacgacgcctacatcgccaagcgcacggccaagccgctgcgcccgggacagctgtcctactggcagaactacggcaagttccacgtcagcctgatgaaggcctggttcggcaagtcggcgaccaaggaaaacaactggtgctacgactggctgcccaagctcgacatgccgggcgccggctacgacgtgctgcgctacttcgacatgatgtaccagggcaaggtcaacggttacttctgccagggcttcaaccccatcgcctcgttccccaacaaggccaaggtcggcgccgcgctggcgcgcctgaagtggatggtggtgatggacccgctggtgaccgagacctcggagttctggcgcaacgtcggcgagtacaacgacgtcgacaccgccagcatcaagaccacggtgttccgcctgcccacctcctgcttcgccgaggaagacggctcgatcgtcaacagcggccgctggttgcagtggcactggaagggcgccgagccgccgggccaggcgcgtccggacatcgccatcatggccgggctgttccaccgcctgcgcgagatgtaccgcaaggacggcggggccttccccgacccgatcctcggcctcgactggtcctacctcaagcccgacgaaccgggcccggacgaactggcccgggagttcaacggcaaggccctgagcgacctggtcgacccggccaacggcatgatcctggccaaggccggcgagcagttgccgggtttcgccctgctgcgcgacgacggcagcacggcgagcggctgctggatcttcgccggctcctggacccagcagggcaaccagatgggccgccgcgacaacagcgacccctacggcatgggccagaccctcggctgggcctgggcctggccggcgaaccggcggattctctacaaccgcgcctcggccgacgtcagcggcaagccgtgggacccggagaagaagcgcctggtgtggtggaacggcaagtcctggggcggcaccgacgtgcccgactacaaggccgacgtaccgccggaagccgggatgaacccgttcatcatgaaccccgaaggggtggctcgcctgttcgccgtcgacaagatggccgaaggcccgttccccgagcactacgagccgttcgagacgccgatcggggtgaaccccttgcaccgcgacaaccgcaaggcgatcagcaacccggcggcacgggtgttcaagaacgacatggaactgttcggcacggccgacgagttcccctacgcggcgaccacctaccggctcaccgagcacttccactactggaccaagcactgccggctgaatgcgatcacccagcccgagcagttcgtcgagatcggcgaggcgctggccaaggagctgggcatcaatgccggcgacaaggtcaaggtctcctccaaccgcggctacatcaaggcggtggcggtggtgaccaagcgcatccgcccgctgcaggtggacggcaagaccgtgcaccacgtcggcatcccgatccactggggcttcgccggcatggcgcgcaacggcttcctggccaataccctgacccccttcgtgggcgacgggaatacccagacgccggagttcaagtcgttcctggtcaacgtggaaaaggcgtgaggtga

SEQ ID NO: 10768 - DNA, 933 bp, Pseudomonas aeruginosa
aacatgagtagtcaggacatccacgcccgctccgcgaccaccacgccgatgccctcggtgcggaaccaggaggaagtggcgaaactgatcgacgtgtccaagtgcatcggttgcaaggcctgccaggtcgcctgctcggaatggaacgagctgcgcgacgaggtcggccacaaccacggcacctacgacaaccccatggacctgacggccgactcgtggacggtgatgcgtttcaccgagcacgagaacgaggccggcaacctcgagtggctgatccgcaaggatggctgcatgcactgcgccgagccgggctgcctgaaggcctgcccgagcccgggagcgatcgtgaagtacgccaacggcatcgtcgacttcaaccaggacaagtgcatcggttgcggctactgcatcaccggttgcccgttcgacatcccacggatctcgcagaaggaccacaaggcctacaagtgcagcctgtgttccgaccgcgtctcggtgggcatggagccggcctgcgtgaagacctgcccgaccggcgccatcgtcttcggcagcaaggaggacatgaaggaacacgccgccgaacgcatcgtcgacctgaagagccgcggttacgagaacgccggcctgtacgaccccgaaggggtgggcggcacccacgtgatgtacgtgctgcaccacgccgacaagccgtcgctctatgccggcctggccgaccagccgagcgtcagcccgctggtcagcctgtggaagggcgtgaccaagccgctggcgctgctggccatgggcgccacggtgctcgccgggttcttccactatgtgcgcgtcggtcccaaccgcgcggacgacgaggaagaccacgggcaagccgaggcaccggtgcaccaggtcgatccgtcggtacacacctttgacccgcacgagcgtcgttga

SEQ ID NO: 10769 - DNA, 366 bp, Pseudomonas aeruginosa
ccaccctgcgcctgctcagccgcccggcggcggagatccgcgcccaggccgagcgtctggcgccggcgctgggcgaggcgctcggcgagggctgggaggtcgccgtggtcgacgcccctgggcatgatcggcagcggcgcgcagccggtggcgcggctgcccagcgccgcgctgtgcctgcgtccgcggcagcccaggcgcctgcgcggacgcgccctgcgcaacctcgaggaagccctgcgcgggctgccgctgccggtgatcggtcggctcgaggacgacgccctctggctcgatctgcgccagctcgacgacgagccggggttcctcgcccagttgccgcgactgcggagcgagctgtcgtga

SEQ ID NO: 10770 - DNA, 3222 bp, Pseudomonas aeruginosa
  unsure (2409): Identity of nucleotide at the above locations are unknown.
agcagggtgggcgcgtggcccttgcgttccaggctgatcatgctcgactcgatcggcaccagttggtggatggcgtcgaccagcgcggcgaggaagtcgggttggcgcaggcgccggatcgccagcgccaggtgttcgtgccagcggtcgagcgcgttcggggcgatggcctgcatggacggtacggctcgttcttgtcgttgtcgccgcaggatagcaagccgcgtcggccgcacccagcgcttaccccaaaatggggtatggcccgccgcgcggtgctcttgcaccctcggagcatccatccgagaagagcgacagcccgatgaacgcaagaatgcacgccacgtcccccctcggcgacgccgacctggtccgtgccgaccaggcccactacatgcacggctaccacgtgttcgacgaccaccgcgtcaacggctcgctgaacatcgccgccggcgacggcgcctatatctacgacaccgccggcaaccgctacctcgacgcggtgggcggcatgtggtgcaccaacatcggcctggggcgcgaggaaatggctcgcaccgtggccgagcagacccgcctgctggcctattccaatcccttctgcgacatggccaacccgcgcgccatcgaactctgccgcaagctcgccgagctggcccccggcgacctcgaccacgtgttcctcaccaccggcggttccaccgccgtggacaccgcgatccgcctcatgcactactaccagaactgccgcggcaagcgcgccaagaagcacgtcatcacgcggatcaacgcctaccacggctcgaccttcctcggcatgtcgctgggcggcaagagcgccgaccggccggccgagttcgacttcctcgacgagcgcatccaccaccttgcctgtccctactactaccgcgctccggaaggagtgggcgaggccgagttcctcgatggcctggtggaggagttcgaacgcaagatcctcgaactgggcgccgaccgggtgggggcgttcatctccgagccggtgttcggctccggcggcgtgatcgtcccgcccgcgggctaccaccggcggatgtgggatctgtgccagcgctacgacgtgctgtacatctccgacgaagtggtgacctccttcggccgcctcggccacttcttcgccagccaggcggtgttcggcgtacagccggacatcatcctcaccgccaagggcctcacctccggctaccagccgctgggcgcgtgcatcttctcccggcgcatctgggaggtgatcgccgagccggacaagggccgctgcttcagccatggtttcacctactccggccacccggtggcctgcgcggcggcgctgaagaacatcgagatcatcgagcgcgagggcttgctcgcccacgccgacgaggtcggccgctacttcgaggagcgcctgcaaagtctccgcgacctgcccatcgtcggcgacgtgcgcgggatgcgcttcatggcctgtgtcgagttcgtcgccgacaaggcgagcaaggcgctgtttccggaaagcctgaacatcggcgagtgggtccacctgcgggcgcagaagcgcggcctgctggttcgtccgatcgtccacctgaacgtgatgtcgccgccgctgatcctcacccgcgaacaggtcgataccgtggtccgggtgctgcgcgagagcatcgaggaaaccgtggaggatcttgtccgcgccggtcaccggtaagcgccggggcgccgccggcgccccacccgaacattcaggagaaccccaatggacgacaacaagaacaaggtcctgcggttgcgcgatgtggtgctctacacggtctcggcgatgctcttcatggaccagatcgccctggcttcctccctcggtccgtcgagcctgttctggtggctctacgtgctggtcctgctgttcctgccgatggccatgatgacctccgagctgggcaccgccttccccgccaacggcggcgtctaccactgggtgcgcagcgccttcggcttccgctggggggcccgggtgtcatggatgtactgggtcaacaacgcactgtggatgccttcggtctacaccctgttcggcagcatgctcggcgccttctatttccccgagctgagcctctggggcaagatcgccatcggcatagccctggcgctgctcaccgcggcgttcaacgtggtcgcgctgcgcctgggcaagtggctgccgaacctcggcgcgctgctcaagctgctcgcggtgctcgccctgggcgtcggcggcctgcacttcggctggaaccatggcttcgccaacgacttcagcctggactccatcgtcccgtcctcgccgggccagatggccgcgctgggagtgatggtctatggcatcatggggaccgagctggcctgttgcancgccgcggatatgcgcaacgcgcgccgcgacatcccgcgcgcggtggtgatctccgggctgatcgtcggcgccttcaacatcttcggcaccctcggcgtgctggccgcggtaccggccgaggaaaccgacgtcacccggatcttcgcccataccctctacaacatctacggccacgacggcgccggcgggatgctcgccgacctggtcggcgccttcgtcctgttcaccctcttcaccaacatggtcacctggagcatgggcaccaaccgtgccgcggtggaagcggccaaggccggcgagctgccggcgctgttcggcgtggtccattcgcgccacggcacgccgatcggctcggcggtgctggcctcggcggtgagcatcgtcctgctgctgctctacggcctggtggcgcacactgccgaggaactgttctggaccctgctgtcgatcttcgccatggttttcatgatgccctatgtgctgatgtgcctggccttcgtccgcctgcgccgcgccgacccgcgtccacggccctaccggatgccgctgggcgaccgcctggccagtctctgggcgctgttcgtcgcgctgcatgtgctggccggcatctgcctgttcgtcgtcacccccggcgcgccgatggactgggcctacgccggcaagatcgtcggcggcgtggcgctggccctggccgtgggcgaactgctgatccgccaggcggcgcgaaggcgcggcgtgatgtcactgcgcggtgcctacggttgaggagcggccctgtcgcaacaccgcctatggcgttaatgtgccgttaa

SEQ ID NO: 10771 - DNA, 498 bp, Pseudomonas aeruginosa
cgcgcttcatggcgcgcccgacggacgggtgcgcacgcttgcctcgggagaacagggatggccgagatcaatccgctttcaacggacctgcaacagcaactggcggagctgcaggcacaggggctcgccttgcttggcgtcgccgcggacgagacgccggcgcagatcgtcgccgccgtcaccgactacgtgcgcgatgcgagggagcaggggcgcagcctcgacgacgaggcggtcttcgccctcggcgcgctgatcggcgcgcagtacgtgcgtggcctcggctggcactggggcgacgtgacctgggacggcgacccggacagcgccgccgtcggcgtgctcagccccgacgaatcgctgttcaacaaccccatcggctgggtaagccagatcgccgaaagcggcggcggggtgccgttcatgctcagctacaacatgatcctggccaaccaggtgccgctgttcgagcggggcagcgccaccggtctctattga

SEQ ID NO: 10772 - DNA, 237 bp, Pseudomonas aeruginosa
gcatgcaggcggatcgccgctacgcgccggcgcatcccgccaggcggggccgacaacctgaacggccggcgtcaggcgccgcgacccgccgagcagcgccaaccggcgaacgaggtgcgggtgaccgtggtggaacagacgctgcctctgagaaaccgcgcctgcggcgctttccaggaaggcagcctggaacgacgcgactgccgagcccatatcgggctgcaattccgcgattga

SEQ ID NO: 10773 - DNA, 891 bp, Pseudomonas aeruginosa
gacccacccgttcctggagatgctcgaacccgagtcggagcgaccgttcgaactgcgcaacgactacttcaccgacacgccccacgtatcccgggaggccatcgtctacgaaggcagcggcagcgataccggcatcgccagctactggtacgtccacccgctcggcgacatcctcggcgggctgctcggcgccggcctgcgcctgagtcacttcaaggagtacccgcactcgaaccgcgaggaactctacgacctctacgaggacggaccgctggcgatcccgatgtgctacacgctggtcgcggtcaaggcatgacctgcgtcgaggccgagcgaggcgcgccgctgcgtgtggtggtggtcggcaccagcggggccgggaagacaaccttctccgccgcgctggccgccaggctgggttgtacgcatgtcgaactcgaccgactctactggggccccggctggcaagccgtgccccacgaacgcttcgagcacgccgtggagcgggcgacgacggcgccgcgctgggtcgccgacggcaactacagcgccgtccgcgagttgctctggggccgcgccacccacgtggtatggctgaatttcgggcgctggacggtgttctcccgggtccttcgccgcaccctggcccggggcctgctgcgcacccgcctgtcccacggcaaccgtgaatcgctgcggatggcgttctgctccagggattcgatcctgctctggtcatggaccaccttcgcaggcaaccgccgcaaatacaccggcctgcgcgaggatccgcggttcgcgcatttgcgctgggtggaggttggcgagccggggagggtgggggaggtgatcgaaaggttggtggaagccgcgctcgcacagtcgcagtag

SEQ ID NO: 10774 - DNA, 1353 bp, Pseudomonas aeruginosa
aacccgggagtctcagacgtccagcgcctgcacccctggatgctgcggatcgaacccatccaggcgcatgcgctcggcgaatgcctcccgcgccgcgtctccctggagaaacgcgctccgcgccgaggcccagtcgtccggttgcagccgtaccatccagccctcgccgtagcaatcccggttgatcagcgccgggcgcttgaccaccgccgggttgctcgccagcagggtcccggccaacgggctgcgggccgaggaggcagccttggcgaactcgaccacgccgaagctgcggtcgcgttcgatgtgccagccgtcgcgcttgggggtgaaggcgaagatttcgccatacagcgcgcagccgtaggcgctcaggcccagggtcaggctgccgtcgacttcctcgcgcaaccacaggttgtagtccggggcgtagaacagcccgtcggggaactccaggccgtgcaggttcgcgctcatagggtcagcacccgctcggattcgaggatcagccgtgccagttcgccgccgctggagatttcgtcgagttcctcgatcagttcgctttcgtcgatgttcaccccgggttggcggcacatcagcaggcgcgcgccggcctcgcgggcctggcggatgaagtggcgcagcggctcgccgccgtccagcgcgcgcaactggtcggcgacggggcggcgggccaactgcacgccttcgccgctgaggaacagggtcacctcggcgtccatgcaggccagcagggtggcggtgtggaagggcgcggcgcagcgggccggggtgctcgggccgctggagacgatgatgaggacgcgctgggcgtgggtgtcagggttcaaggggcttgtccatctggatcagcgccacgcgccggccgtccggatcgtggcgttcggcgatggcgcgcggctggtagccgagctgggtatagagcagcagcccggcggcgttggcgttgaagcaggaaatcttcatcaggcgcgctttgtactgttcgcaggcgaggttttccatgaccccgatcaggtagcgggccacgcccaggccgcgcgcggcgggcgccaccatcatgttgccgagggcgcagaagtcgccgtgctgccactggtagaagttggcgaagccgagcacctgtccgtcgtgcacggccacggtgctgccgcggcgttcggcgatggcggcggccagctgggcgacgctgaacggccagatcgccttggggtagcaatagaagagttcgtcgcggtcctgggggaagccggcgaccgtctccaggtcaccggtctccgccgggcggtggctgagctgcatgtcagcgcggcgggtattgcgacatga

SEQ ID NO: 10775 - DNA, 996 bp, Pseudomonas aeruginosa
agcgtctccacaagtaacgttggcgagcacccgccctatagggcgcgacgggagaatgaaatgaatcgaagtattgcgatcctgctgctgggcctgtcgctgaccggctgcgtcgaggcacgctcggtggtaccggcggatggcccgggcccgctgctggtggcccatcgcgccggcaccgcggactacccggagaacaccctgctggcgatccgcaaggcgctggacaacggcgccgacgcgctatggttgtcggtgcagttgagcgccgatggccatccggtgctctatcgccccgctgacctggcggtcctgacccagggcgccggcgcggtcggccagtcgagcctggccgagctggcgcgcttgaacgccggctatatgttcaaggccgaggacggcagctatccctaccgccagaagccgctgcggattcctacgctgcgccaggcgctgcgggcgatcccgccgcaggtgccggtgttcctcgacatgaagtcgctgccggtggagccgctggtcgatgccgtggccggcgagctggagcggcagaaggcctggtcgcgggtgcgtttctattccaccgagaaggccgccaacgactacctgacgcagcgctacgcggaccgcgcgcgacagttcgaaagccgcgatgcgacgcgcaaccgcctggtcggcctggccttcggcgagcgctgcgaggcaccgccggccggcggcacctggatgggcatcgagctgcgccgcgaactgacggtgaccgagcgcttcacccttggcgagtcttcctacaaggtgccggcggcgcagttgtggacgcgcaaagcgatggactgcgtgcgccgcgagccggtgaaggtggtgatgttcggcatcgagaccgccgaggactaccgcaccgcgcgcgccctgggcgccgacgcggtgatgagcaactcgcccaggaagatggaggcgatccgccgccgggtgctcgccgatcagcccggcgggtag

SEQ ID NO: 10776 - DNA, 1149 bp, Pseudomonas aeruginosa
gatgggcccgccccatggataactagaaaaaacaccatgcgtgatctgaccgacgatgtagcgctgatgcgcccggtgatcgacgccctgcgcgccagcggctgcgatccggaccgggtcctggtccgtgtcgggctgccaccgggtggcctgccggccggccgtttcccccattccgcacagaacctgttctggaaggccgccgccgacgagtgcggcgaagagcatgtcggcctgcacctggccgagcacctgccggcgttccacggcctgctcctggaatacctgttcctctccagcgataccttcggcgccggcctgcgccattccctgcgctacgtacgcctgctgtccgacaccctgcaggcgcaactggaggtggagggcgagcgcgcggtgctgtcgctgggcgaatcgccggcgatcaaccgccacttcccggaaatgctcgccggcgcggtgatccgcctgttcggcgcgctcaccgagggcgagttcaagccgctggaagtgcaactgatgaacgaaaccggcgcgccgatggagcgctaccgtgcggtctacggctgcccgacgatcctcggcatgccgcgctacgcgctggtattcgatgccgcggtgctggacaaaccctcgcgccacgccgccccggaactgctgcgcatgcacgagtcgctggcgcgccggcaactggccgaggtggagcgcctggacctggtgcgccaggtccgcgaactgatcggcgagttgctggtggacggaggcgccaccctggagcaggtcgccgcgcgcctcggcatgccggcccgacgtctgcgcgaacgcctggcgatggccggggtgcgcttcaacgacctggtcaccgactaccgctgccgactggccaaggaactgctgctgaagaccgacgagcgcatcgaagtgatcgtcgaacgcaccgggttttccgagccgaacaccttctatcgcgcgttcaagcgctgggtcggcgagacgcccggtggagttccgccggcgcgggcatcaggggcgcgggtagggcctgtccgaaagggggctaccgggtcggcgtcctgttgccggggagtcaggggccgcctcaggcccccagcaggctctgcccgcacaccctcagcacctggccgctga

SEQ ID NO: 10777 - DNA, 678 bp, Pseudomonas aeruginosa
cgggtcgagcctcggctcggcgtaaacgattccagcaaggagttcttccatgacccagctgcgccgggtcgccattgtcggcggcaaccgtattcccttcgcccgctcgaacaccgtgtacgccacggcgagcaaccaggagatgctcacttccgccctggaaggcctggtggagcgctacaacctgcacggagagcgccttggcgaggtggtggccggcgccgtgctgaagcattcgcgcgacttcaacctgacccgcgaatgcgtgctcggttcgcgcctggccccggaaaccccggcctacgatatccagcaggcctgcggtaccggcctggaggcggcgatcctggtggccaacaagatcgccctcgggcagatcgacagcggcatcgccggcggcgtcgataccacttccgacgcgccgatcggggtcaacgagggcctgcgcaagattctcctcgaggccaaccgcggcaagagcaacctggacaagctcaagagcctgctgaagatccgcccgcgccacgtggtcccggccatcccgcgcaacggcgagccgcgcaccgggctgtcgatgggggagtcctgcgaactgatggcgcagacctggcagatcccccgcgacgagcaggacaggctggccttcgagagccaccacaagctggccgcggcctatga

SEQ ID NO: 10778 - DNA, 1224 bp, Pseudomonas aeruginosa
cggtcgccgccaggcggccccgtagcgaaggccggaggggcgatggagagcatgctggacaggcccgagcaggaactcgtgctggtggtggacgacaccccggacaacctgctgctgatgcgcgagctgctcgaggagcagtaccgcgtgcgcaccgccggcagcggcccggccgggctgcgggcggccgtcgaagagccgcgcccggacctgatcctgctcgacgtgaacatgccgggcatggacggctacgaggtctgccgacggctcaaggccgatccgctgacccgcgacatcccgttgatgttcctcactgcccgcgccgatcgcgacgacgagcaacagggcctggccctgggcgcggtggattacctgggcaagccggtgagcccgccgatcgtcctggcgcgggtgcgtacccatctgcaattgaaggccaatgccgatttcctgcgcgacaagagcgaatacctggaactcgaagtgcgccgtcgcacgcgccagctgcaacagttgcaggacgccgtcatcgaagccctggcgacccttggcgatcttcgcgacaacccgcgcagccgccatcttccgcgtatcgagcgctatgtcaggctgctcgccgagcacctggcggcgcagcgggcgttcgccgacgagctgactccggaggctgtcgacctgctgagcaagtcggcgctgttgcatgacatcggcaaggtcgcggtgcccgaccgggtcctgctcaaccccgggcaactggacgccgccgacaccgccctgctacagggccatacccgcgccgggcgcgacgccctggccagcgccgagcggcggctcggccagccttccggattcctccgcttcgcccggcagatcgcctacagtcatcacgaacgctgggatggccggggctttccggaaggccttgcgggcgagcggattcccctggcggcgcggatcgtcgccctggccgaccgctacgatgaactgaccagccggcacgcctaccggccgccgctggcgcatgccgaggcggtgctgctgatccaggccggcgccggcagtgaattcgacccacggctggtggaggccttcgtcgccgtggccgacgctttcgccgaggttgcccggcgctacgccgacagcgccgaggcgctggacgtggagatgcagcggctggaacaggcggtggcggaaagcatcgaactcaccgcgccaccggcctag

SEQ ID NO: 10779 - DNA, 1017 bp, Pseudomonas aeruginosa
tacgccgatcggtgcgcagtccggcggaaagccggcgcgtccggctgtgctcggcacggcgtttgccgtataacgtcagaccctttgccttacacattggccccgaggaaccgcgtagcaccgatgaagacacccagacgcctggaaccgttgatcgaagacggtctgatcgacgaggtcgtgcgcccgctgatgagcggcaaggaagcctcggtctatgtggtgcgttgcggcgacagcctgcgttgcgccaaggtctacaaggaagccaacaagcgcagcttccgccaggccgccgagtaccaggagggccgcaaggtccgcaacagccgccaggcgcgggccatggccaagggctcgaagtatggccgccgcgaacaggaggaagcctggcagaatgccgaagtggcggccctgttccgtctcgccggggccggtgtgcgggtgccgaagccctatgatttcctcgatggcgtgttgctgatggaactggtggcggacgccgacggcgatgctgcgccgcgtctcaacgacgtgacgctggagcccgacgaggcacggcgccaccacgctttcctgatccgccagatcgtcgccatgctctgcgccggcctggtgcacggcgacctctccgagttcaacgtcctgctcggtccggatggcccggtgatcatcgacttgccgcaggcggtcgacgcggccggcaacaaccatgcgttcagcatgctcgaacgcgacgtcggcaacatggccgcctacttcggccgcttcgccccggaactcaggcagacccgctatgccaaggaaatgtgggcgctctacgaagccggcgagctgacagcggaaaccccgctcagcggcaccttcgtcgaagccgaagaggccgccgacgtgcgcgcggtgctccgcgagatcgaggccgcgcagcgcgaggaggcgcgtcgccaggcgctgcgccaggccgacgacgcgccgcgtggcgagcgcgaggaaccgccgccgccctggttgcagtga

SEQ ID NO: 10780 - DNA, 606 bp, Pseudomonas aeruginosa
cgcagggcgttgcccaccaggttgccgaccatcgccttcagccacaggtcgatgcccatcacgtgcacggtctcctggtgcaacgacagctcgatgtccttgtcgatggcctggcgcgccagttcggagagtacgtcttcggccagggtggcgaggttgaccgggtggaattgctccagcagggcgtcgccgtcgaggcgggcgaggagcaggatctgctccatcaaggtgctgatccgctcgacgctgcgactgacttgcagcaggccgcgggcgtgggccttggggtcttccgaacgcagcgcgacttgggcatgggtgcgcaggctggccagtggcgtgcggatttcatgggcggcgtcgctggtcagtcggcgttcggcctcgagggcggtgcgcagacgctccagcaggaggttgagttcgtcgatgaggccgcggatctccagcggcaccgcttccaccgcgatcggctgcaggtgtcgcgcggagcgctgctggacctcggcctgcacttcgcgtagcggcgccaggccgcgggcaacgccgaaccagaccaggccgccgagcaacggcagcgccagcagcagtgggaacagcgagtag

SEQ ID NO: 10781 - DNA, 441 bp, Pseudomonas aeruginosa
gcggttttcagggcgccggctggtcgatgccgtagccgatgccgcggacggtgcggatcaactggttgccgagcttgcgccgcaggtggtggacgtggacttcgatggcgttgctctcgacgtcgccgctccagccgtagaggctctgctccagttggttgcgcgagagcaccttgccgctgttctccagcagcaggcgcagcagtgcgtattcgcgcggcgccagttccaccgcctgcccggacagggtcacctggtgggtcgccgggtccaggcgcagctcgccgtgcaccagttgcggcagggcgcgaccggtggtgcggcgggtcagggcgcgcacccgtgcctgcagttcgtcgagatcgaagggcttggtcaggtagtcgtcggcaccgctgtcgagcccggcgacccggtcggccaccttgtcccgcgcggtga

SEQ ID NO: 10782 - DNA, 588 bp, Pseudomonas aeruginosa
ccttcgtgccaggcgaagacggccaggccttcgagcagctcccggcagcgctcggggttgccgatgaccagcgcgcggccggggcgccacagcacccgctcgccgaacgagggcgcttccagggtcggctggcgctcgtcctcgccggcggccatccaggcttccaggcgctggcgccaggcgtgcccggtctgtagcccggcgttggcgaagatcaccagcagctcgtcgtcgacggcggtctccggcagttccgcgtcttcgctcagctcgatgcgttgcgccaggacggccagcgccggctgcggatcgcgcagggtggccagtagcggcaggccgccgccgtccgcggcggagcggaagcgtacccggtgcagcaggcagggcgcgccgttgacggccagcggtacgctggccaggggagcggcggacatcttcaggtcctcgccagggccggcaattgtgccgggccgaactcgatctcctcgatatccggcggtgcgacgaagggtacgccgtcttccagtaccggtcccggttgggcgagcaggaagcgggtttcccggtccatcacgaagcaggccttga

SEQ ID NO: 10783 - DNA, 882 bp, Pseudomonas aeruginosa
ggaccatggccacgcgcatttccttttcgatcagttcgagcaggttgcgcaccccggcctcgccggcggcgggccagggcgtatactaaggcgcggccgagcagcacgctgtcggcgccgagggcgatcatccgcaccacgtcgagaccggtgcggatgccggagtcggcaaggatcgccagttcgcccttcaccgcctccggcgattgcccggcagcgccgcgggcgctggacagcacgccgtcgagctggcgcccgccgtggttggagacgacgatgccgtcggcgccgaacttcaccgcatcccctggcatcctccgggtcgaggatgcccttgatcaccatcgggccgtcccagaactcgcggatccactccaggtccttccaggaaatcgacgggtcgaagttggcgcccagccagccgatgtagtcctccagtccggtcgggttgccgcggtaggcggaaatgttgccgaggtcgtggggcttgcccagcaggccgacgtcccaggcccaggccgggtgggtcatggcttgcaggatgcggcgcggcgcggcgtaggggccgctcatgccggaatgggcgtcgcggtagcgggcgccggggaccggcatgtcgacggtgaacaccagggtggtgacgccggcggccttggcccgctccagggcgttgcgcatgaagccgcggtccttcagcacgtagagctggaaccacatcggccggtcgatggccggggcgacctcctcgatcgggcacaccgataccgtcgacagggtgaagggcacgcccttcgccgccgccgcgcgcgccgcctggacctcgccgcggcgggcatacatgccggtgagaccgaccggggcgagcgccaccggcatcgctag

SEQ ID NO: 10784 - DNA, 819 bp, Pseudomonas aeruginosa
agcgctcgcagcgccgtcgcagcgtgcaggaagactagcgaggcgcgggcagggacgcgttcagtcgtccttgccgtggcgcatggcgcgctggatctcccgatcggagtcgcgctccttctcggtgtggcgcttgtcgaagtccttcttgcccttggccagggcgatctcgcacttgaccaggtgcttcttccagtacatcgacagggcgacgcaggcgtagcccttctgttgcacggcgccgaacagcttgcccagttcgcgcttgtgcagcagcagcttgcgcgtgcgcaccgggtcggcgatcacgtgcgtgctggcggtggtcaggggcgtgatgtggctgccgagcagccaggcctcgccatccttgagcagcacgtagctgtcgaccagctgggccttgccggcgcgcaggcttttcacttcccagcccgccagggcgacgcccgcctcgaagcgttgttcgatgaaatagtcgtgcagagccttcttgttctgcgcgatggtccccgaagggtgtttcttctgcttagccataggcggcgcattatagggagtcgccggcttcaccgctatggggcggcgtcgcgcttgagggatagaggcgaatttcggacaatgcccactcttttcctggccgctggccaaggttttgtaagaaaagtcttcaagtggcgtcaggctgcgctgagcgttttttctgccgaaccctggccccggtcgacgggcgcagcgcgccgccgtggcggatgccgccgtcccgccggctatgcttggggagtcgcccgctcgacagcagaagtgagagttctatga

SEQ ID NO: 10785 - DNA, 411 bp, Pseudomonas aeruginosa
ccttcgattacgccgggccgctggtcaaggcgacccttgggccgctgttcacccaggccgccaacaccatggtcgacgcgttctgccagcgcgccaagcaactctatggctgagatcgccgtcgaggtggtctacgcgctgccggagcgacaggcgttactgcgcctgagcgtgccggcaggtaccagcgcacgcgaggccgtgctgctctccggcatcggcgaggcctttccagggctggatgtgcaaggttgtccgctgggtatcttcggcaagctcctggcacgcccggaggagcggatgctggaggctggcgagcgggtggagatctaccgtccgctgatcgccgatcccaaggaggtgcgcaagcagcgtgccgcacgtgcccggagcgagcgcgaaggcggttag

SEQ ID NO: 10786 - DNA, 582 bp, Pseudomonas aeruginosa
cgaacagcagaccctggatcaacagacccccgagcagcccaccggcgccgccgaggacctgaccgcccgcgtgcaggaactggaggagcagctggctgccgcccaggaccaggcgctgcgcatggtcgcggatctgcagaacgtacgccggcgtgcggagcaggatgtcgagaaggcgcacaagttcgcgctggagaaattcgccggcgacctgctggcggtggtcgacaccctcgagcgcggcctggagatgtccgatcccaacgacgaggcgatcaagccgatgcgcgaagggatggaactgaccctgaagatgttcgacgacaccctgcgccgctaccaggtggaggcgctgaacccggaaggcgagcctttcaaccccgagcagcaccaggcgatggccatgcaggaaagcgcttcggccgagccgggcagtgtcctcaaggtgttccagaaaggctacctgctcaacggccgcctgctgcgtccggcgatggtggtagtcagcaaggcgccggcggaaaccccgccgtccatcgacgagcaggcttgaaattcgacgcgacgaccccatctgggtag

SEQ ID NO: 10787 - DNA, 1974 bp, Pseudomonas aeruginosa
tcaaccgagcacgagacccacgggcgggtcgcacggaatcaaagtttctggagagtgaatatgggcaaaatcattggcatcgacctgggtaccaccaactcctgcgtggctatcctggagaacggtaacgtcaaggtcatcgagaacgccgagggcgcgcgtaccaccccctcgatcatcgcctacaccaacgatggcgaaaccctggtgggccagccggccaagcgccaggcggtcaccaacccgcagaacaccctgtatgcggtgaagcgcctgatcggccgtcgcttcgaagagaacgtggttcagaaagacatccagatggtgccgtacagcatcgtcaaggccgacaacggcgacgcctgggtggaagtgaagggccagaagatggcgcctccgcagatttccgccgaagtgctgaagaaaatgaagaagaccgccgaagactacctcggcgagccggtcaccgaagcggtgatcaccgttccggcctacttcaacgacagccagcgccaggccaccaaggacgccggccgcatcgccggcctcgacgtcaagcggatcatcaacgagccgaccgcggcggcgctggcctacggcctggacaaggccaagggcgaccacaccgtgatcgtctatgacctgggcggcggtaccttcgacgtgtcggtgatcgagatcgccgaagtcgacggcgagcaccagttcgaagtgctggccaccaacggcgacaccttcctcggcggcgaagacttcgacatccgcctgatcgactacctcgtcgacgagttcaagaaggaaagcggcatcaacctgaagggcgacccgctggccatgcagcgtctgaaggaagcggccgagaaagccaagatcgagctgtcctcgacccagcagaccgacgtcaacctgccgtatgtgactgccgacgcgagcggtccgaagcacctgaacgtcaaggtttcccgcgccaagctggagtccctggtcgaagacctggtgcagcgcaccatcgagccgtgccgcaccgcgctgaaggatgccggcctggatgtttccgatatccatgaagtgatcctggtcggcggccagacccgcatgccgctggtacagaagaccgttgccgagttcttcggcaaggaagcgcgcaaggacgtcaacccggacgaagccgtggctgtcggtgccgccatccagggcgcggtcctggccggcgacgtgaaggacgtgctgctgctcgacgtgaccccgctgaccctcggcatcgagaccctgggcggcgtgatgaccggtctgatcgagaagaacaccaccatcccgaccaagaagtcgcaggtgttctccaccgccgacgacaaccagggcgcggtgaccatccacgtgctgcagggcgagcgcaagcaggccgcgcagaacaagtcgctgggcaagttcgacctggccgacattccgccggctccgcgcggcgtgccgcagatcgaggtgaccttcgatatcgatgccaacggcatcctgcacgtctcggcgaaggacaaggccaccggcaagcagcagtccatcgtgatcaaggcatcctccggcctgtccgaggatgagatccagcagatggtccgcgatgccgaggcgaacgccgaggaggaccgcaagttcgaggaactggctgccgctcgcaaccagggcgacgcgctggtccacgcgacccgcaagatgatcaccgaggcgggcgacaaggccaccgccgaggacaaggcgaccatcgagaaggcgctgggcgagctggaagcggcggtgaagggcgacgacaaggccgagatcgaggccaagatgaacgctctgtcccaggcttccaccccgctggcgcagaagatgtacgccgaacaggcccagcagggcgaagacgctccccagggcgagcaggcgaaagccgctgacgacgtggtggacgccgagttcgaagaggtcaaggacaacaagtaa

SEQ ID NO: 10788 - DNA, 1119 bp, Pseudomonas aeruginosa
gcgtggcgccagcgaggcggacctgaagaaggcctaccgccgcctggcgatgaaatatcacccggaccgcaatcctggcgacaaggaagccgaggacaagttcaaggaggccaacgaggcctacgaggtcctctccgatgccagcaagcgggcggcctacgaccagtacggccatgccggcgtcgatccgaatatgggtgggggcgctggcgccggtttcggcggggcgagcttctccgacatcttcggcgatgtgttcagcgatttcttcggtggcggcggtgcccgcggtggctcgcgcggcggcgcgcagcgcggcgcggacctgcgctacaccctggacctcgacctggaggaggcggtacgtggcaccaccgtcaccatccgcgtgccgaccctggtcggttgcaagacctgcaacggcagcggcgccaagcccggtaccacaccggtcacctgcaccacttgcggcggtatcggccaggtgcgcatgcagcagggcttcttctcggtccagcagacctgcccgcgctgccacggcaccggcaagatgatttccgatccctgtggctcctgccatggccaggggcgcgtggaagagcagaagaccctgtcggtgaaggtgccggccggcgtcgacaccggcgaccgcatccgcctcaccggcgaaggcgaggccggcagcatgggtggtccggcgggcgacctgtacgtggtggtcaatgtgcgcgagcacccgatcttccagcgcgacggcaagcatctgtactgcgaagtgccgatcagtttcgccgacgctgcgctgggcggcgagctggaagtgccgaccctggatggccgggtcaagctgaagattccggaaagcacccagaccggcaagctgttccgcctgcgcggcaagggcgtggccccggtgcgcggcggcggcgccggcgacctgatgtgcaaggtggtggtggaaaccccggtgaacctggacaagcgccagcgcgagctgctcgaggagttccgcaagtcgttgcagagcgacacctcgcattcgcccaaggccagtggctggttcgaaggcatgaagcgtttcttcgacgacctataaacaaagccatgggcgcggcctga

SEQ ID NO: 10789 - DNA, 840 bp, Pseudomonas aeruginosa
cagccgcgtccgggttccgcgtggagtggttttatgcgacgtatagccgtagtgggcgccgccgggcgcatgggcaagaacctgatcgaggccgttcagcagaccggcggtgccgccgggctgacggcggcggtggatcgtccggatagcaccctggtgggggcggacgccggcgagctggccggtctcggccggatcggcgtgccgctgtccggggacctgggcaaggtctgcgaggagttcgacgtcctgatcgacttcacccatccctccgtaaccctgaagaacatcgagcagtgccgcaaggcgcgccgcgcgatggtcatcggcaccaccggcttcagcgccgacgagaagctgctgctggccgaagcggcgaaggatatcccgatcgtcttcgctgccaacttcagcgtcggcgtgaacctttgcctgaagcttctggatactgcggcacgggtgctgggcgacgaagtggatatcgagatcatcgaggcccatcaccggcacaaggtcgatgcgccgtccggcaccgccttgcgcatgggcgaggtggtagcccaggcgctcggccgggacctccaggaagtggcggtctacggacgcgaggggcagaccggcgcgcgggcgcgggaaaccatcggcttcgccaccgtgcgcgccggcgacgtggtgggcgaccacaccgtgctgttcgccgccgagggcgagcgcgtggagatcacccacaaggcttccagccgcatgaccttcgcccgtggcgcggtgcgtgcggcgctgtggctggagggcaaggagaacggcctgtacgacatgcaggatgtgctcggcctacgctga

SEQ ID NO: 10790 - DNA, 654 bp, Pseudomonas aeruginosa
tcggcttcgccggattctgtgcggcgctgcaggcgctggtgttggtgtcgagccacgggccgaggagcctctggcgagaccttcgcggtcagttgttgctcgccgtcgcgctgctctgcctggtgtatttcctggtgcgtgggctggcgcccgaggcggtgcgctggctgctgttcaactacctggcggtggcgatgtgtggcctgctgctggtgttgcagccggtaccggggcgggacgaggaaggcgtctgaaccaggtcgggaagtttcccgaccttggttggatggggcatcagatgccggcgaaacggctgatgttcgagagattcttgttcggcttcgggttcttccgatagaccagcgccatcttgccgatgctttgcaccaggtcgctgcgcgactgcgcgcagagttcgtcgagcagggcgcggcgatcgtcgcgctcggccagcgccagtttcaccttgatcagttcgtgatcgttgagtgcgcgctcgagttcggcgagaacgccttcggtcaagccgttctcggctacgatcaataccggtttcaggtggtgaccgatagatttgaactgtttcttctgctcttgagtgagcgccataatcagacccctgggaaaaagtcgtctattttaccccagttttag

SEQ ID NO: 10791 - DNA, 426 bp, Pseudomonas aeruginosa
gttcggcgcgatctgtcgtgccgcgggaagctgaagatgctggaaaaggtcgtaattgtcgtgcacctgctgatggcattgggtcttgttggcctgatcctcgttcagcatggcaagggtgcggatgcaggggcttctttcggtgcaggtgcttcggcaactgttttcggaagccaaggttccgctacctttttgagtcggattactggtatactggcagcggtttttttcttgaccagccttggcttagcgtacttcgctaaagaaaagtctgatgctctgcaacacatcgggctgccggatccggcagttctggagcagaagcaagagaaagcaccggccgctgacgatgtgccggttcttcaggagcagtccaagcctgcggaaagtgcaggcgatgtaccggcggctcctgaacagaagtaa

SEQ ID NO: 10792 - DNA, 534 bp, Pseudomonas aeruginosa
cggcagctacgagactttccgtcgttggcacgtcgtcgccgacgaggactaccaggaccccgccaccgagatcaccgtcgaggacgtccaggagcagaagccgggcgcgaaggttggcgaggtcatcgaagaaaagatcgaatccatcgagttcggccgcatcgctgcgcagactgccaagcaggtcatcgtgcaaaaggtccgcgaggccgagcgcgcccaggtggtcgatgcctaccgcgagaaggtcggcgagatcatttccggtaccgtgaagaaggtcacccgcgacaacgtcatcgtcgatctcggcaacaacgccgaggcgctgctggcccgcgaccagatcattccgcgcgagaccttccgcgttggcacccgcgtgcgtgccctgctgaaggagatccggaccgagaaccgcggtcctcaactggtcctgtcgcgtaccgcgccggaaatgctgatcgagctgttccgcatcgaagtgccggaaatcgccgagcagttgatcgacgtgatggcagccgcccgtga

SEQ ID NO: 10793 - DNA, 687 bp, Pseudomonas aeruginosa
gaccatcaccgtagccgagttggccgcccagatgtcggtcaagggcgccgaagtcgtcaagttcatgttcaagatgggctccccggtgaccatcaaccaggtcctggaccaggagaccgcccaactggtcgccgaagagctgggccacaaggtcaagctggtcagcgagaacgcgctggaagaacaactggccgagtccctgaagttcgaaggcgaggcggtcacccgcgcgccggtcgtcaccgtcatgggccacgtcgaccacggcaagacctcgctgctcgactacatccgtcgcgccaaggtcgccgcgggcgaggccggtggcatcacccagcatatcggtgcctaccacgtcgaaaccgagcgtggcatggtgaccttcctggatacccccggccacgccgcgttcaccgcgatgcgtgcccgtggcgcccaggcgaccgatatcgtgatcctggtggtcgcggccgacgacggcgtcatgccgcagacccaggaagccgtgcagcacgcgaaagcggcgggcgtgccgatcgtggtcgcggtgaacaagatcgacaagcccgaggccaacccggacaacatcaagaacggcctggccgctctcgacgtgatcccggaagagtggggcggcgacgctcccttcgtcccggtttcggcgaagctcggtactggcgtcgatga

SEQ ID NO: 10794 - DNA, 288 bp, Pseudomonas aeruginosa
actgctcgaagcggtcctgctgcaggcggaagtgctcgaactgaaagccactccgtcggccccgggccgtggcgtggtggtcgagtcgcgcctggacaagggacgcggcccggtggccaccgtgctggtccaggacggtaccctgcgccagggcgacatggtgctggtcggcatcaactacggtcgtgtccgcgccatgctcgacgagaacggcaagccgatcaaggaagccggcccgtcgatcccggtcgagatcctcggcctggacggtacgccggatgccggtga

SEQ ID NO: 10795 - DNA, 696 bp, Pseudomonas aeruginosa
ggtgaaactggcgcgtgcccatgccggcaagctggaaaacatcttcgagaacatgggccaggaagagaagaagaccctgaacatcgtcctcaaggccgatgtgcgcggttcgctcgaggctctgcaaggctcgctcagcggcctgggcaacgacgaagtgcaggtccgcgtggtcggtggcggcgtcggtggcatcaccgagtccgacgccaacctggcgctggcttccaacgcggtgctgttcggcttcaacgtgcgcgccgacgccggcgcgcgcaagatcgtcgaagccgaaggtctggatatgcgttactacaacgtgatctacgacatcatcgaggacgtcaagaaggccctgaccggcatgctcggcagcgatctgcgggagaacatcctgggcatcgccgaggtgcgcgacgtgttccgctcgccgaagttcggcgcgatcgccggctgcatggtcaccgagggcatggtgcaccgcaaccgtccgatccgcgtgctgcgcgacgatgtggtcatcttcgaaggcgagctggagtctctccgtcgcttcaaggacgacgtcgccgaagtgcgtgccggcatggagtgcggcatcggcgtgaagagctacaacgacgtcaaggtcggcgacaagatcgaagtgttcgagaaggtcgaagtcgcacgcagcctttgatggcgagtgcgtaa

SEQ ID NO: 10796 - DNA, 1395 bp, Pseudomonas aeruginosa
ccacagcgcccgggccggcttccagctgtcccgggcgtttgtcgcttttttttccagtggccgggtgtcgctggaggcaggttgaaaaatggcaaaagactacagccgtacccagcgtatcggcgatcagatgcaacgcgaactggctcaactgatccagcgcgagatcaaggacccgcgcctgggcctggtcaccatcaccggtgtcgaggtcagccgcgacgtggcgcacgccaaggtgttcatcaccgtcatgggccaggacgatgccggcaagatcgccctgaacatggaaatcctcaacgacgccgccggctacctgcgcatgttgctgggcaagtcgatgaagctgcgcagcgtgccgcaactgcatttccactacgacgaaagcatccgccgcggcgccgagctgtccgcgctgatcgaacgtgcggtggccgaagacggccgccgccacggcgacgagaccgaggactgagcgtggcccaggtgaagcgtatccgccgctccatcagcggcatcctggtgctcgacaagcctcgcggcatgagttccaaccaggcactgcagaaagtccgctggctgctcaatgccgagaaggccggccacaccggcagcctcgacccgctggccaccggggtgctgccgctgtgcttcggcgaggcgaccaagttctcccagtatcttctcgatgccgacaagggttacgagacggtgatgcgcatgggcatcaccaccaccaccggcgacgccgagggcgaactgctcgccgagcgggacgtgaccgtcggtcgggacgatctcgaacaggccctgccgcgcttccgtggcgacatagagcaggtaccgccgatgtactcggcgctgaagaaagacggacagccgctgtacaagctagcccgtgcaggagaggtagtggagcgcgaggcgcgttctgttactattacgcgcctggatttgctctccttcgagccgccctgtgcgaccctggccgtttcctgcagcaaaggcacctacgtgcgtacgctggtggaagatcttggccaggtcctgggctgcggcgcgcacgtcgcggcactgcggcggacccaggccgggccgttcgccctggcccaggcgatcaccctcgagacgctcgaacgcgtgcatgccgaaggtggtccggaagcgctggaccaattcctgatgccggaagacagcggcctgttgcattggccggtgttgcagttgtccgagcacagtgcgtactactggctgcacgggcagccggtgcgggccccggaagcgccgaagttcggctggctgcgggtgcaggatcacacaggtcgtttcatcggtatcggtgaagtgaccgacgatgggcgtatcgccccgcgtcgactgattcggtcataa

SEQ ID NO: 10797 - DNA, 465 bp, Pseudomonas aeruginosa
cccaccagctcggtcatctggtgcaggacgcggtggacttccggcatcacgtcgacgccatcgaccagcaccttgtcgccgatcggtcgacgcagcgcggtatgcagtaccggtcggcgctcggaggcattgatcgcctcgccgtcgaacatcgcccggatcgcgtcgctcagccgtgcttcctcggccagcttcaccagcaggtcgatggtgtcctggcgaatcaggttcttcgaaaagtcgaggaacagcccacaggcgctgaaggaaaaccgcttgaagcgctccggatcgtcgatgaacgcctggcgcatcctgaagtcctgcagttcctggcgatgggcggccagggcgcgccaactgtcgagttgcgtggcatccagcggagtgaggtggtgcttcatggctgaccttctggttggaattcgatggcgcacttatttgaacatgaaaaagcccggatga

SEQ ID NO: 10798 - DNA, 1005 bp, Pseudomonas aeruginosa
cggtgttcatgcgttgaatccgtgttcggcggcggggaaggacacgtccttgacggcgcggacataggccgcgatggcggccgggatgctctcctggccttgcatgaaatccttgacgaacttgggcgagcggccggtcagcgagagaccgagcatgtcgtgcatgaccagcacctggccatcggtcgccgcaccggcgccaatcccgatcaccgggatcttcaccgcctgggtgatctcttcggccagcacgctgggcacgcactccagcagcagcatggcggcgccggcctgctccagggcgatggcatcggcgcgcaactggcgcgcctgggtttcctggcggccctggaccttgaagccgccgaacaggttgaccgcctgcggggtcaggccgagatgcgcgcagaccggcacgcccatctgtgccaggcgggcgatcggctccgccagccaggccccaccctccagcttgaccatgtgtgcgccggcctgcatcaggcggaccgcgtcggcaagggtctgggccacggaatggctggattcgaaggccaggtcggtgacgatcagggaacctttgttaccgcgtttcacgcaggccgtgtgataggccatttcctcgttgctgaccggcagggtgctgtcgtgaccctgcaataccattccgagcgaatctccgaccagaagcacgtccacgccggcctggctggcggtgtgggcgaaggtggcgtcgtagcaggtcagcatggcgatcttctcgccgctctgcttcaacccttgcagggtggtcagggttacatcaggcatggaaaggctcctcgttgggccggtgatgagccggcgcggggcaaacggccacttatagtccggatggggtggctcgaagtcaattgcaggtgttaccgcattgttacggcgttactgccactgccgaacgccgcgccgcctgcggttgcgcgcgcagtgtacgcccatccgcggcgtccttcgtcagcttttcggtaa

SEQ ID NO: 10799 - DNA, 1017 bp, Pseudomonas aeruginosa
aggtcttcgcggaattgcccggtcttggccagggttttcaggtcgcggtgggtggcggcgatcaggcgcacgtcgaccttctgcgattgcaccgagccgacccggcggatctcgccttcctgcaatacgcgcagcaggcgggcctgggcctccagcggcagttcgccgatctcgtcgaggaacagggtgccgccgtcggccgcttcgaccagcccggcgcgcccggcgctggcaccggtgaaggcgcctttttcatggccgaacagctcggattcgatcagggtttccggaatcgccgcacagttcaccgagatcagcggcgccttggcgcgcttcgacaggttgtgcagggcgcgggcgaccagttccttgccggtgccggactcgccctggatcagtaccgtggagtcggtcggcgcgaccttgcgaatcttgctgtacagctcttgcatcggcgcacaggagccgatgatgcctatctcgccgtcggctgccgccgggctggcgccgcgctcgccgccggccttgccgccgttggcggaggaccggggccgcgctgcggttctcctggcggtccttgaggatgcgcgccacggcctggagcatttcgtcgtggtcgaaaggcttggcgatgtagtccaccgcgcccatcttcatcgaatccaccgccgaacgcaggctggcgtagctggtcatgatcagcaccggaatgccttcggcgagcttgatcagttcggtgccgggggcgcccggcaggcgcaggtcgctgaccaccatgtcgaaggaggggatggtgtagcgctcctgggcttcctgcaccgagccggcttcgctgacctggtactggttgcgctccagcaggcgtcgcaatgcagatcggataatggtttcgtcttcgacgatcagaatatgtgccatgtattcagctctctcgacgtgctcgtctacagctcggccgtcgggccagggtgccgcggcagggtcacgcggaagcgagtgccgccttctcgctggtga

SEQ ID NO: 10800 - DNA, 711 bp, Pseudomonas aeruginosa
accagtgcgaggccgagcccggtccccttgccggggtccttggtggtgaagaacggttcgaacaactggtccatgatcgccttcggaatgccgctgccctcgtcctcgacgaccaggtccacggtatgttccgaggcttcgctgcggacccggatcgcgccgcccggcgggctggcgtcgcgagcattggagagcaggttgatcagcacctgggccaggcgctgcgagtctccctcgacccagtgcgccggatcgcagaggttgaagaactctacttcgacgctacgccggttcagcgacagcagtccgatggcctcctgggcgacttcgctcaggcacaccggttccagggcctgcaggtggctgccggagtgggcgaagctcatcaacgactggacgatgcgcgatacgcgcttggtctggtcgaggatctgctcgctgatttcggtcagctcgccgtcgccttcgcgttcctcgcgcaggttctgcgccaggcaggcgatgccggtgatcggattgccgatctcgtgggccaccccggcggctaggcggccgatggaagccaggcgctcggagtggaccagcttgtcttccaacagttgggtttcggtgaggtcttccaccagtagcaccaggccgctgttgcccggcgccaggggttcctcgatggccgccttgtgcaggttcagccagcgggtgtggccgtcgtag

SEQ ID NO: 10801 - DNA, 1395 bp, Pseudomonas aeruginosa
gcgacgctgatcaggatcagctgggtcaggctaaagctcgtcagcatcgcgctggctctgcaggatgaaagtgaccacgatgaggatcagccacagcaggtacgggcggtaccaggcgccgttggggtcgatccaccagtccatgatggcgggggaaaagagatagatgcccacgaccaggagcaggaccagtcggtagatgtacatgccgcttccctcatgcttgggccggcaggctacaggctgcgggtgggtgccggcaagccgccgggcgggctacaggcgttcctcgggaagggtagcgcagcgcgggatgcgcgtggcgtcccagtgcgcgacgccccacgccagcgcctcgctggcgctggcctgggccagttcggccggcggccgctggccgagcgcgcgcagggcgcgggtctgcggcgcggcggcctgctcggcgggcagtggcggggagcggtaggacttgccgagcttgtgcccgtccggctggacgatcagcggcacgtgcaggtagcgcggctggctcaaccccagcaattcctggaggtaaagctggcgcggggtccactcgagcaggtcggcgccgcggacgatgtcggtgatgccctgccaggcgtcgtccagcaccaccgccagttggtaggcgtagaagccatcgcggcgctggatgacgaaatcgccgacctcgcggccgagatgctggtggacttcgccctgcacgcggtcgacgaagcgatattccagctccggcacgcgcaggcggatcgccgcatcctcgcgggcgtgcccggcgtcgcggcagaagcccgggtagatcccggcgaatccctcaagctgcttgcgcgagcaagtgcaggcgtaggccaggccgctgcgcagcagttgctcgaccactgcggcgtagtccgggaagcgttcgctctgccgctccaccgcgccgtcccattcgaagccgtagcgctccagggtttccaggatcgcctgctgggcgcccgggacttcgcggggcgggtcgaggtcctccatgcgcaccagccagcggccgccgacggcacgtgcgtccaggtaggaggcgacggccgccaccagggaaccgaagtgcaggtagccgctgggcgtcggggcgaagcggcctacataggaagaggtcatggcgcgagcggtgcggcggggaacggcggaaacgaaacggggcgccttggcgccccgtcggtccggctcaggagccgagttgcttctcgcggatttccgcgagggtcttgcagtcgatgcagagggtcgcggtggggcgcgcctccaggcgacggatgccgatctcgacgccgcaggagtcgcaccagccgtactcttcgtcttcgatcagttgcagggtctcgtcgatcttcttga

SEQ ID NO: 10802 - DNA, 675 bp, Pseudomonas aeruginosa
cgcgcgcagtcgggccatcgagcctttccatgtcatggccctgctggcgcgggccaacgagttgcaggccgccggccacgatgtgatccacctggagatcggcgagccggacttcaccacggccgagccgatcgtcgaggccgggcgcgccgccctggccgccgggcatacccgctacaccgccgcccgcggcctgccggcgctgcgcgaggcgatcgcgaaattctacggcgaacgctacggggtcgacctcgacccacagcgcgtgctggtcactccgggcggttccggagccctgctgctggccagcagcttgctggtcgaccccggccgccactggttgctcgccgacccgggctacccgtgcaacaggcatttcctgcgcctggtggaaggcgccgcgcaactggtgccggtggggccggacagccgttaccaactgacaccggatctcatcgagcggcactgggactcagacagtgtaggcgctctggtggcgacgccggcgaatccgaccgggaccctgctcgatcgcgacgaactggccggcctgtcgggcgccttgaaggcccgcggcgggcacctggtggtggacgagatctatcacgggctgacctatggcgtggacgccgcgtcggtgctggaagtcgacgacgacgctttcgtcctgaatag

SEQ ID NO: 10803 - DNA, 1116 bp, Pseudomonas aeruginosa
gctggagaagctggctcagaacctctacatcagcgcgccgagcatggcccagcaggccgcgctggcctgtttcgcgccgaccaccatcgccattctcgaagagcgtcgcgaagagttcgcccgccgtcgcgacttcctcctgccggccctgcgcgagctgggtttcggaatcgccgtggagccggaaggcgccttctatctctacgccgatatcagtgcgttcggcggcgatgcctacgccttctgcaagcacttcatcgagaccgagcacgtggccttcactccggggctggatttcggccgccaccaggccggccaccacgtgcgtttcgcctatacccagaacctgccgcgcctgcaggaagcggtggagcggatcgcccgcggcctgcaggactggcggccctgatgcgtttcgagcagccactggaagaaggccgcctgctgcgtcgctacaagcgtttcctcgccgatatcgagagcgccggcggcgagcgcctgactatccactgtccgaataccggttcgatgctcaattgcatgagcgaaggttgccgggtctggttcagccgctccaacgaccccaagcgcaagctgccggggacctgggagctgagcgagactccgcagggccgcctggcctgcgtcaacacggcgcgggccaaccgcctggtagaggaggcgctgctggccggggacatcgcggagcttgccggtttcaccgctctgcgccgggaagtggcctacggcgtggagaacagtcgcgccgactttcgcctggaataccccacgggcgcactgttcatcgaggtgaagagcgtcaccctgggcttcgacgaaaccgccgtggcggcctttcccgacgcggtgacgctgcgcggcgccaagcacctgcgcgaactggcggcgctggcgcgggaggggatccgcgcggtgcagctgtactgcgtgaacctttccggggtcgaggcggtgcgccccgccgacgagatcgatccagcctatggcaaggcgttgcgcgaggcggcgcaagcgggcgtcgaggtgctggcctatggcgccgaggtgacgacggaaggattgcacctggcgcggcgcctcccggtgcgactctga

SEQ ID NO: 10804 - DNA, 1266 bp, Pseudomonas aeruginosa
ggcatggccgcgccgtggggcgcggccactcgctcagcggcgttcgagcaggacgccgctttccatgtggtgggtgtaggggaactggtcgaacagcgcgcagcggctgatccggtgcgtgtcgtgcagttgagcgatgttctgcgccagggtttccgggttgcacgaaatgtacaggatgcgctcgaagcgccgggtcagctcgcaggtgtccggatccatgccggctcgtggcggatcgacgaagacactgccgaaggcgtagctcttcaggtcgatgtcggccaggcggcggaacgggcgaacctcgttcagcgcctgggtcagctcttcggccgacaggcgcaccaggctgacgttgtccaccgcgttgtcggccaggttggccagcgccgcattgaccgaggacttgctgatctcggtggccagcaccttgcgtacccgggtggccaggggcagggtgaagttgccgttgccgcagtacagttcgagcaggtcgtcgtcgcgctggccgagcgcctcgtaggcccagccgagcatcttctggttgacctcgccgttgggctgggtgaaagccccctcgggctggcggtagcggaagcgccggccggcgaccgacagttcctcctccacatagtcgcgtccgacgacgatacgcttgccgcgcgaacgcccgaccaggttcacgcccagttccgccgccagcttttccgctgcctgtcgccaggcgtcgtcgatcggccggtggtagcagagggtgatcagcgcgtcgccggccagggtggtgagaaactccacctggaacagcttgaagcccagcgccgggtcggcccaggccgccttcaggcgcggcatcagttcgttgatgcggcggctggcgatggggaaatcctcgatcaggatcggcgtgtgcttgtcgccctgctcgaacatcgcgtagtgacgcttctcgttgccggtttcccgccacagacgaaattcggcgcgcagccggtaatgctcgcgcggcgactcgaagatctcgggcgcgggtgccgcgaacggggccagcaaaccggcgaggcgggacttcttgtcttccagttgtgcggcgtaggcgctggggtcgaactgtggacggctcatgcgttgaagaagcccagcttgatcacgaacaggacggagaggatcaccagcgccgggttcagttcgcgccagcgcccggacagcaccttgatcgcggtccaggaaatgaagccgaaggcgatgccggtggcgatcgaatag

SEQ ID NO: 10805 - DNA, 246 bp, Pseudomonas aeruginosa
gtgaacggcatggccagcgcggtgacgaccaccggcgcggcgacggtgatgtcttcccagtcgatttctgccaggcccgaggccatcagtacggcgacgaagagcagcgccggggcggtggcgaaggccggtacgctgccagccagcggggcgaagaacagcgcgaggaggaacaggatggcgacgacgatggcggtcaggccggtgcggccgccggcgctgacgcccgcggcggactcgatgtag

SEQ ID NO: 10806 - DNA, 648 bp, Pseudomonas aeruginosa
ctggtggtggtcgaggtgcccagcagcgagccgcccatggcggcggtactgtcggcgatcagcgcgcggcccatcttcggcatgtggccgtccttgcccatcagtccggcgcgcttggcaacgccgatcagggtgccggagttgtcgaacaggtcgacgaagaggaaggcgaagatcacgctgaccaggccgatgtccagcgcgcccttgatgtccagttggaggaaggtcggcgccagcgacggcggcatcgagaccacgccgccgaactgggtcacgccgagcaggatggcgatggcggtgaccaccaggataccgatcagcaccgcgccggtgacgctacgcgcctccagggcgacgatcaggatgaagccgagggtggcgaggatcggtgccggcttggtcaggtcgcccatgccgatcagggttgccgggttgtccaccacgatgcccgcgttctgcagggcaatcagtgcgaggaacaggccgatgccggcggcgatcgccgagcgcagcggcagggggatgctgttgatgatccattcgcggatgcgaaagatcgacagcaggaagaacatggtggcggaaatgaacactgcgcccagcgcgacctgccagctgtggcccatgtgcagcaccacggtgtag

SEQ ID NO: 10807 - DNA, 1389 bp, Pseudomonas aeruginosa
aatggaatgaaaaacgcgaggggggactcgacaagcagcctatcggcctttatgttcgccgacaagaaagcgcctggctggcgctttccaggccgccgcagcggtcggcgtcgctcggacggttccgggcgcttacgttactccgaggacagcatggctgaatcacgccctgcgcgccgtttcgcgcgcatcgaccgccttcccccctacgttttcaatatcaccgccgaactgaagatggccgctcgtcgccgtggcgaggacatcatcgacctgagcatgggcaatcccgacgggccgaccccgccgcatatcgtcgagaagctctgcaccgtcgcccagcgcgaagacacccatggctactccacctcgcgcggcatcccgcgcctgcgccgggccatctcgcactggtaccgcgaccgctacgacgtgcagatcgacccggaaagcgaagccatcgtcaccatcggctccaaggaaggcctggcgcacctgatgctggcgaccctcgaccatggcgacaccatcctcgtgcccaacccgagctatccgatccatatctacggtgcggtgatcgccggcgcccaggtgcgctcggtgccgctggtgccgggcatcgatttcttcaacgagctggaacgggcgatccgtgaatcgattcccaagccacgcatgatgattctcggcttcccctccaacccgaccgcgcagtgcgtcgagctggacttcttcgagcgcgtggtggcgctggccaagcagtacgacgtgatggtcgtgcacgacctggcctatgccgacatcgtctacgacggctggaaagcgccgtcgatcatgcaggtgccgggcgccaaggacatcgccgtggagttcttcaccctgtcgaagagctacaacatggccggctggcggatcggcttcatggtcggcaatcccgagctggtctcggccctggcgcggatcaagagctaccacgactacggcaccttcacgcccctgcaggtggcggccatcgccgctctggaaggcgaccagcagtgcgtccgcgatatcgcccggcagtaccagcagcgccgcgacgtcctggtgaaggggctgcgcgaggccggctggatggtggagaacccgaaggcctcgatgtacgtctgggcgaagatccccgagccctacgcgcatctgggctcgctggagttcgccaagaagctgttgcaggacgccaaggtctcggtgtcgccggggatcggcttcggcgactacggcgacgatcatgtgcgtttcgccctgatcgagaaccgcgaccgcctgcgccaggcggtgcgcgggatcaaggcgatgttccgcgccgacgggctgctgtcgccgcagaggaaggtcgatagcctggcggagtga

SEQ ID NO: 10808 - DNA, 630 bp, Pseudomonas aeruginosa
gctgtatccacttgtgacgaagcgatgcgctgcccgccgcgccgggttgccgttgggcagggacggattgtcgcagcgaactcgtcggcgcggtttgggtctgctgtccttagggttgccggggcgttcgccgccggtgtcgaactgaccgctggggcaacaggcccgaggagaaaggggatgctcttcgcccgtttggttttgctggttcaggcgctggtatggggcgcgctgggagtgctgtactgggtgcgtccctacgagatggccaatctcagtggcatgctgctgatggagccttcggcggtcagcgatgcgcgggtgttctatggcggccatcagttcgccctggcgttgttcctgctgttcgccctgcgccgggcttcgctggtgcagccggcgttgatcctggtagtgctgctgcaatcgatcctgaccctgtcgcggctattgattgcctggatcgagggcgggatggaggccgacggcaacctgttcggcctgctgttccgcggcgcaatggctgccctggggatcgccgccctgtggtggctgcaacggcggccgccccggctgtcggcacccggcgagagcgccgagcgtcgcgaggacgacttcgacggcctgtga

SEQ ID NO: 10809 - DNA, 1542 bp, Pseudomonas aeruginosa
cgcgaccgaaccggatatgcccgaggaaccgtcgatgagcagcactcccagcctttcccattcccctgccgagctttaccgcgcctggcaggacctgcgcgccgagcgaccgcagctacgcgcgcgcgacgccgccgcgctgttgcaggtcagcgaaggcgagctggtcgccagccgggtcggcatcgatgctgtgcgcctgcggccggactgggccgccttgctgccggcgctcggcgaactggggccgatcatggcgctgacccgcaacgagcattgcgtccacgaacgcaaggggccgtatcgcgaagtgacggtctctgccaatgggcagatgggcctggtggtctcgccggatatcgacctgcgcctgttcctggggggttggaacgctgtcttcgccattgccgaggagacagcgcggggtacccagcgcagcatccaggtgttcgaccagcagggcgtggcggtgcacaaggtgttccttaccgaggccagcgacgtccgcgcctgggagccgctggtcgagcgcctgcgggctgccgagcaggatgccgtgctggcgctgcacgaaccccgcgcaccggctgcgacgctcgtcgatgcgcagatcgatgccgccgccttgcgcgaaggctgggccgcgttgaaggacacccatcatttccacgccctgctgaagaagcatggcgcgcagcgcacccaggcgctgcgcctggctggcggcgaatgggccgagcgcctggacaatggcgacctggcgaaactcttcgaagcggcggccgaaagcggattgccgatcatggtgttcgtcggcaacgcccactgcatccagatccataccgggccagtgtgcaacctgaagtggctggacgactggttcaacgtgctcgatccggaattcaacctgcacttgaagaccaccggcatcgccgaactttggcgggtgcgcaagccgagcaccgatggcatcgtaaccagctgggaggccttcgacgccgacggcgaactgatcgtgcaactgttcggcgcgcgcaagcccggcgagcccgagcgcgacgactggcgcgaactggccgaatccttcaaggcgctctgaggagagatcatgcgtatcgatcgactattcaacgggttggcgctgggcatcctgctcggcaccggcatggcccaggccgccgagctgccgcaacgctgggtgagcgcgggcggctcgctgagcgaatgggtggtggcgttgggcggcgagagcaagttggtcggggtggacaccaccagccagcatccgcaggcgctgaaacagttgccgagcgtcggctaccagcgccaactggctgccgagggcgtgctggcgttgcgtccggatatcctcatcggcaccgaggaaatggggcctccgccggtactcaagcagctcgaaggcgccggcgtgcgagtcgagaccctctccgccaagccggatctggaggcactggaaagcaatctgaagaagctcggcgactggctcggcgtgccccagcgcgccgaggccgccgaacttga

SEQ ID NO: 10810 - DNA, 1167 bp, Pseudomonas aeruginosa
cggacgactgctggtgctggacccgacgctcctggtgggcggcctcggtccgcgcctgccggatggcctggcggctctctccgcagccttttatccttccgcgaaaccgctgagtacggaagccgcccattgaaatcggttgttcgtccccgcgcactgttcggtgcgctggggatttcgctcgtgttggtcctctggttgtccctcgccctcggtcccgtcagcctgccgctgggcgataccctgcgcgccgcgctgcgcctggccgggctgccgctcgatggaacgggcctggcccaggcggaaatgatcctcggccagatccgcctgccgcggaccctgctcggcctggccgtgggcgcggtgctggcgctgtccggggtggcgatgcagggcctgttccgcaacccgctggccgatccagggctggtcggggtgtccagcggcgcggccctcggcgcggcgctggccatcgtattcggcgcctcgctgggtggcttgccggcgttcctcgcgccctacctgctgtcgctgtgcgccttcggcggcggcctgggggtgacctggctggtctatcgacttggccgccgcgatggccagaccagcgtggccaccatgttgctggcagggatcgccttgaccgcgctgtccggcgcggtgatcggactgtttacctatctcgccgatgacgccaccttgcgtaccctgaccttctggaacctgggcagcctgaacggcgccagctacccacgactctggccgctgctgctggtggcgctgctggtggcctgctggctaccgcgccgggcagatgcgctgaacgcactgctgctcggcgagtccgaggcccgtcacctgggcttcgacgtcgagcgattgaaggccgaactggtgctttgcactgccctcggcgtcggcgccgcagtggcggcggcggggatgatcggcttcatcggcctggtggtgccgcacctgatccgtctggttgccggtccggatcatcggacgttgctgccggcctcgatgatggccggcgccattctcctgctgcttgccgacctgctggcgcgcctggcgctggctccggcggagttgccgatcggcatcgtcacggcactgatcggcgcgccgttcttcctttatctgctattgcgggggcgggcctga

SEQ ID NO: 10811 - DNA, 579 bp, Pseudomonas aeruginosa
tgctgcgcgtggagaacctgtccatccgccgtggcggaaagactgtactggaaggcctcgagctggagctgcggcctggcgagatgctcggcgtactcggccccaacggcgctggcaagagcaccttgcttggcgctctctgtggcgaactggagccggccgaagggctggtgctgctcgacgagcgcggcctcgacgactggccgggcgtcgctcgcgcgcagcgcctggcggtgctgccgcagagttcgtcgctgggcttcgcctttccggtggaggcggtggtcggcttcggtcggctgccccattccagcggccgcgagcgcgatgtgcagatcgtcgccgaggccttggcggcggccgacgccaggcatctggccgggcgcagctacctggcgctgtccggcggcgaacgccagcgcgtgcacctggcgcgggtgctggcgcagctgtggccgggcgagccggggcaggtgctgctgctcgacgaaccgacctcggcgctcgacccgctgcaccagcacactaccctgcaggcggtgcatgatttcgcccgccgcggtgcctcggtgctggtga

SEQ ID NO: 10812 - DNA, 912 bp, Pseudomonas aeruginosa
tcgtcgcccgttgaaggagtcgccatgcgcattcgcctgttcgctttctgtctgctgctgggcggctgccagtcccaactgccgccgctgcctgattggcagagcccggaagggcgcgacgatccgcagacgggacgaatcgtcgaattgcgcagcggcgtgacgctgagcccgcagcaactggtcgcacgcctggcggccgcgccgcgagtgatcgtcggcgagaagcacgacaatcccgatcatcatgccgtggaactgtggctggcgcaggccctgggcgaatatcgggcgcagggcagcctgctgctggaaatgctcgatcccggccagcaaccacgggtggatgcggtccgcgtacaactcgggaccggcaagccggtggcgaacctggagcaggccctggactggcagaaaggttgggactggacgcagtacggacccctggtgtcctgggcggttgcgcaacccgcgccgttgctggcggcgaacctccagcggagcgagatcatgcgcatctacagggagcgaccgccgcttcccggaacggcctccaggcgtgacagcgtgcgcctgccgctgcttgcgcagattcgcgaatcccactgcggcatgcttcccgacgatcaattgccggcgatgctcgccgtccagcagcaacgcgaccgccgcatggccgagcgtcttcgcgatgcgccactgccggcgatgctcgtcgccggccgcttccacgcccgacgcgacctcggcgtaccggtccacctgcgcgaccttggtgcggagaagggcgcgcaggtactgatgctggtcgaggccgggcaggcggtaacgacgcgtgaggccgactacgcctggtacacgccggcacagccggacaaggactattgcgcggagatgaagaaggcacgttga

SEQ ID NO: 10813 - DNA, 1398 bp, Pseudomonas aeruginosa
aagaattattcagctttcagcgtgatgcgcgcgaaagccttcttccctgcctggaacacacgggtttcacccagcgccagcatgaaaggtgcggtcgacgacctgcccatccaccttgacgctgccagcacccaggagatcgcgagccgcagccgcattcttcaccaaccccgccttattaaggacagaggcaacgggcatatcctcgggggacgacaactcgatctccggcaggtcttccggcagctcgccctccttcagacgattgccggccgacttgtgtgcgctcaccgccgcctcctcgccatggaagcgggcgacgatctcctcggccagcttgatcttgatgtcacgcgggttggcgcccgcctcgacgtccttgcggaagctatcgatctcatccagggaacggaagctgagcagttcgaagtaacgccacatcagcgtgtcaggaatggagaccagcttgctgtacatgacacccggcgcttcctggataccaatatagttgcccagcgacttggacatcttcttcacgccatccagcccttccagcaacggcatggtcaggatcacctgggcctcctggccataggcacgctgcagctcgcgccccatcagcaggttgaacttctggtcggtgccacccaactcgacgtccgccttcagcgcgacggagtcatagccctggaccagcggatagaggaactcatggatagcgatgggctgattgctggcatagcgcttgctaaagtcatcgcgctccagcatgcgcgcaacggtgtactgagaggcaagacgaatgaagtcagccggggtcagttggtccatccaggtggaattgaaggctacttcggtcttggccgggtcgaggatcttgaagacctgggacttgtacgtctccgcattctccagaacctgctcgcgcgtcaggggaggacgggtaacacttttcccactggggtcaccaatcatcccagtgaagtcgccgatgaggaagatcacctgatgccccaggtcctggaactggcgcagcttattaataagcacggtatggccaagatgcagatcgggagcggtcgggtcgaagccggccttgatccgcaagggctggccacgcttcagcttggccaccagttccgcctctaccaggatctcgtctgcaccgcgctggatcagcgccagctgctcttcaaccgacttcatttacaggttctgcccaattgccaagatcgaaagggaaccaaccatacaagatcgcagactaaaaacaaattttgccgaccgtcagggggacggagccaggccagacgcgacttttggcttgattcaaggagattttggttatattttaggcagttatttattcacaatccaaaaacaccaatcacgccatga

SEQ ID NO: 10814 - DNA, 537 bp, Pseudomonas aeruginosa
tgtgaccggtgcgctcggtcccagaactctgggcgcgctgtatcccgcctgaaacgaaaacgccgcgcatataagcgcggcgttttcgtagcggccccatcgacgtcagatcgagaacgactgtccgcaaccgcaagtcgtggcggcgttcgggttcttgatgacgaacctcgaaccttccaggccttcctggtagtcgacttccgagcccgccaggtactggaagctcatcgggtccaccaccaagcccacaccatcgcgctcgatcacggtatcgtcatcggcgatatcttcgtcgaaggtgaagccatactggaagcccgagcaaccgccgccggtgacgaatacacgcagtttcaggcgaggattgccctcttcgtcaatcaacgtcttcaccttgttggctgcgcctggggtaaagagcaggggcgtaggggtgaaggtctcgatgctcatgtttccgaatctcccggcttgaggccgtgcgttacaacattacgcccattatcctcttgtcccagaaaaatggtcaactaa

SEQ ID NO: 10815 - DNA, 477 bp, Pseudomonas aeruginosa
cgcgttccagccatgcctctactatcggggcaccgtgatcaagaggatgtcctgatgtacctgtggctcaaagccttccatatcatcgccgtggtctgctggttcgccggcctgttctacctgccgcgcctgttcgtctaccacgccatgagcgaggaccagaccagccgggaacgcttctgcgtcatggagcgcaagctctaccgggggatcatgatgccctcgatgctcgccaccctgatccttggcctctggatgctctatctcacccccggctggctgagccaaggctggctgcacgccaagctgaccctggtggtcctgctgatcggctaccaccacgcctgcggcgccatgctcaagcgcttcgcccgcggcgagccggggcgtagccatgtgttctaccgctggttcaacgaagtgcctgtactgttcctgctgctgatcgtcctactggtggtgctcaaacctttctga

SEQ ID NO: 10816 - DNA, 597 bp, Pseudomonas aeruginosa
ctacggcggcctggtattccacgacgtcaccacccgccgccacgccgaaaaggccgccgaggccggggtcgacggtctgatcgcggtggcggccggcgcgggcgggcacgccgggacctggagccctttcgcactggtcgcggaaatccgccagttcttcgacaagactctgctgctggccggctgcatcaaccacggccacgagattctcgccgcacagatgctcggcgccgacctggcctatctcggcacccgcttcatcgccacccgcgagagcaatgcctccgacgcctacaagcagatgatcctggaggcacgcgccgccgacatcgtgcacaccccggcggtgtccggcgtaccggccagcttcatgcggcaaagcctggaggccgccggctacgatctgaagcgcctgaccgacaaggcagacatgaactacggcgagaaactcaagccggtgaacgacgaggccaaggcctggaagaccgtgtggtccgccggccagggcgcgggcaacatagacgacttgcccggcgtcgacgagttggtcgcccgcctcgaccgggaatatcgagacgccctgcggaacatggatag

SEQ ID NO: 10817 - DNA, 714 bp, Pseudomonas aeruginosa
tcctggtggcgcgccagcgcgacgcgctggagagcatcgcctatgagctgccgcagcgtttcggcgtggaagtgctgttccgcaacctgcgatctttccgagccgctgcaactgtcagggttgttgcacgaactggaacagggcgaacgacagatcgacctgctggttaacaatgccgggatcggtacctccggccccttcatcgaccaggaatgggcgcgggaacaggagctgatcgaactcaacatcctggccctggcccgcctttgccactccctcggcgcccgcatggcggcacagggcggtggccagatactcaatatcgcctcggtggccgccttccagcccggcgcctggatgagcaactactacgccagcaaggcctacgtcctgcacttctcggaaggcttgcgggaagaactgaaagggcgcggcgtcaaggtctcggtgctgtgccctgggccaacccgtacggcattcttccgggaagccgggatgcggctcggcaggctcgaccggagcaagctgatgatgaccccggaggaagtcgcgctgctggccctgcgcgggctggacaagaaccgcgccctgatcgtccccggttggcgcaatcgcctgctggcgctgagcccacgcctggcgccacgctggctggtgcgccgactcgccgcgcggatcaacgcctcggcggtaccctccgccccacggggttga

SEQ ID NO: 10818 - DNA, 1077 bp, Pseudomonas aeruginosa
ctggaacttggtgcggttcagctcgggcaggtcctcctgggtgatcgctccatcgttgcagatcacgttgcgcgccagcagtcgcgcctcggcatggctgagcccgcgcaggttcttcaccacctgctgcagggtccggttgtcggtgcgcacgcgggcaccacggttgcgctcgctccagcgcgtcgcttcctcgcggacgatgccgagcagttcgtcctcgctgggcagggacagcgagaaccgcgcggcgaagcgctgcacctcggccggcagcttcagcgcatgggacaccagcaccacggtcggtcgatgattgccttcggccatggcgatttccttgagcaggcgcaccagggtcgggctgtcgccaaggaaaggatgcaggtcgcagagcacgtagagattcgcctgctgatcgtgcttgatcaagcgcaacgccgcgaccgggtcgcggctctcctccccgcccagcggctcgccgccgaagcccaggcgctgcacgccctcggtcaccgaccaggcatacaggccaaggccgcgcctgaccgccaggccggtgagggtttccatcaccttcggctcgtcccaggactcgatcaggatcagcttgacccgggaatccaggaccaggccgaggtcgtgtatgtcgttcttcactgcggctccttcacgcttgggcggtcgcgacgggcaccgctacactcgggaaagcacccgaggccggaggaatcgcccatggactgtctgttctgcaagatcgtggcgggggaagttcccgcgcgcaagttctacgaagacgaggaagttgtcgcgtttcacgatatcggcccgcaggcgccggtgcacttcctggtcatcccgaaaaggcacattcccaccctcgagcacctgaccgaggcagaccggccgctggcaggccatatcctcttcaccgcccagcgcctggcccgggagcagggctgcgaggaaggcttccgtgtggtgatgaactgcaacgaccttggcgggcagaccgtgcaccacatccacatgcacgtgctgggtcaacgccagatgcactggccgccgggctga

SEQ ID NO: 10819 - DNA, 681 bp, Pseudomonas aeruginosa
actggtgcgatctttcgtttccggaggtgcgccatgtccgccgaccgccactattcgcccatcgaccgtttcctgctgcaggccgactccgccctgcgcaccctgctgccgttcagcggccagccggcgcgaccgtcgccggccatcgtggaacccgatggcgaactgagcgaggaagacacccgccatatcgccggcctgatgcgcatcaaccacaccggcgaggtctgcgcccaggcgctgtaccagggccagtcgctgaccgccaagctgcccgaggtccgcgaggcgatggaggaagccgccgaggaggagatcgaccacctggcctggtgcgagcaacgcatccgccagttgggcagccgtcccagcgtcctcaatccgatcttctacggcctgtccttcggcgtcggtgccgccgccgggctggtcagcgaccgggtcagcctgggcttcgtcgccgccaccgaagaccaggtgtgcaagcatctggacgaacacctggcgcagattccccaggaggatcggaaatcccgtgccatcctcgagcagatgcgtatcgacgaggaacagcattcgagcaacgccctggccgccggcggcctgcgcttcccggcaccggtgaagctgggcatgagcctgctggcgaaggtgatgaccaagagcacctaccgcatctga

SEQ ID NO: 10820 - DNA, 1203 bp, Pseudomonas aeruginosa
atcgcacgcatgaaaaagcccgctcgaagcgggctttttcttcctcgtgtgcgatcagcgcggcatgttgcgcgcgtagaagatctccagcatttcgtgcttgagccgttccgtgacctgctcacgctgttccgccgagagcgtccgggtagcgtcgccgaacaggtagttctccagttcgaagtccttgagcagcatcttggtgtggaacaggttctcctggtacacgttcacgtcggtcatctggtaggcctcgcgcgtgtcgtcggagagatagttctggatcgagttgatctcgtggtcgatgaaatgcttgcgcccctcgatgtcgcgggtgaagccgcggacccgatagtcgaccgtgacgatgtccgagtcgaactggtggatcaggtagttcagggccttcagcggggagatcactccgcaggtggacacatcgatgtccacgcggaaggtcgcgatgccgtccaccggatggatttccgggtaggtatgcacggtgatgtggctcttgtccaggtgcgccaggatggtgtccggcagcgggcccggggactcttcgatctggctgtcggtcggagtgaccggctgctcggagatcaggatggtcacgctggcgccctgggggtcgtagtcctgacgcgcgatgttcaggatattggcgccgatgatgtcgacaacatcggtaagaatctgcgtcagacgctccgcgtcatactcttcgtcgatgtactgcacgtaggcctggaggtcttcgggcgtctcggcgtagcagatgtcgtagatgttgaagctcaaggtcttcgtcaggttgttgaacccgtggagcttgagtttgcttttcaccgtggggaactctctcggttgcttgcggctctgccgcagggttggggcatgcccgtcagatgcgaacgacgcacctgcgtaggacggttaacacctcttcgcgatggcgattgtggtttgttgagttgcacgggcgccggctggcgccattggtcacccgaccgggatggctcgggaaacgtctatcagagcggaagaatcttccgaactgaacggccgcccgacggaatcgcgcggcacgaaaaaaggggcgcattatgcagagccaatcaagcctccgccagagtttgcgccccttttatgatgaccggatgtcgtctcagccgagttcgacgatctcgtagtcgtgggtga

SEQ ID NO: 10821 - DNA, 906 bp, Pseudomonas aeruginosa
aaaaggccggtcgcaaccggcctttttcatggggttcgacagcgcggatcagtcaggatcggcgcccagcaccacaccaccacgctcctggaagaacaggcgcttcagctcgaggccaggatcgtcggcccgcatgaacgcctcgccaaccaggaaggcgtagacctcgctgacttccatcagctccacgtcggcccggttgagaataccgctctcggtgaccaccaggcggtcgcggggaatttccggcaacaggtcgagggtggtttccaggctcacctcgaaggtgtgcaggttgcggttgttgatgcccaccaacggcgtgtccagggtcttcagtgcacgttccagctcggtgccgtcatgcacttcgaccagtacgtcgagaccgaccgacttggcagtcgccgccagttcggccatcagcacgtcgtccagcgccgagacgatcagcaggatgcagtcggcaccgatcgcccgcgcctcgacgatctggtacggatcgatcatgaagtccttgcggatcaccggcagcgcacaggcggcccgcgcttccttcagataggcatcggcgccctggaagaagtccacgtcggtgagcaccgacaggcacgccgcgccacccgcctcgtagctgcgggcgatctccgccgggacgaagtgttcgcgcagcacgcccttgctcggcgatgccttcttgatctcggcgatcactgccggctccttgcgcttggcccgctccagcagggcattggcgaagccgcgcggcgcatcggcgctacgcgccagccgctcgacctctgccaggttgacgcgcgcacggcgctcggcgacctcctcggccttgcgggcgaggatcttctgcagaaccgtcggcacactcactgtgcgttctcctctctgtaa

SEQ ID NO: 10822 - DNA, 558 bp, Pseudomonas aeruginosa
atgccctcgtgcaggctggtcgccagatcggcagcgtacagtgccgggccggcattcatcacgatcagctcggcggccttctgcccagcctcggtcttgcgccgccccaaagcgtcgcggatcagttccagcgaggcctgcggactgtcgacctccagccccatcagggtctggctcttgatcccgaagtcctcgggacgcacttcgtactcgcgtacctcgccgtccttcaactcggcaatgtgggtcgccgcggccagactgaactcgtccagcccgtcgcgcgaatgcaccaccagcacatgctcgctgccgagacgcttgagcacttcagccagcggcttgcacagttcctgggtgaacaccccgaccacctggtgcctgactcccgccgggttggtcagtgggccaagcatgttgaacagagtccgcaagcccagctcgcggcgcggaccggcggcgtacttcatcgccttgtggtggacctgggcgaacatgaacccgacgccgacggtgtcgatgcaacgcgccacctgttcggaggtcagttccaggtag

SEQ ID NO: 10823 - DNA, 1326 bp, Pseudomonas aeruginosa
atgccggcggcttccagcaagtcggcgctgccgctcttgccggagaccgcgcggttaccgtgtttggcgaccttgccgccagcggcggcgaccacgaaggacgccgccgaggatacgttgaagatgttcgcgccatcgccgccggtgccgaccacgtcgaccacatgcttcagcgtaggcaactgcacgccgtcggccagttcgcgcatcaccgccaccgcgccgacgatctcgtcgatggtttcgctcttcatccgcatgcccatcaggaaggcgccgatctgcgcgtcggtgcactgcccggtcatgatctggcgcatgaccgcctgcatttcctcggtggtcaggtcgagctggttgacgatgcgattgagggctcccttgatatccatctcagttgccctccccacgcacgccgccctgctggcggaggaagttggccagcaactcgtggccctgctcggtgaggatggactcgggatggaactgcacgccctcgacattcagggtcttgtggcgtacgcccatgatctcgtcgagcgatccgtcggcatgttgggtccaggcggtgatctccaggcactccggcaggctctctcgcttcaccaccagcgagtggtagcgcgtcaccgtcaggggattggccaggccggcgaacacgccgaggtccttgtggtggatcgggctggtcttgccatgcatcacctgccgcgcccgcaccacttcgccgccgaaggcctggccgatgctctggtggccaagacagacaccgagcaatggcagcttgccggcgaagcgctcgatcacggccagcgagacgccggcctcgttgggggtgcagggaccgggggaaaggacgatgcgctcgggcgccagggcctcgatctgttccacgctcagttcgtcgttgcgcaccaccttgacctcggccttgagctcgccgaagtactgcaccaggttgtaggtgaaggagtcgtagttatcgatcatcagcagcatgctggctgtaacctcttgatttcattcttatgcgaatcgcatcacccggctttcgccacacccggttcccggcgcgctcgcggaggaagggggagtggatcgtcggcattatgcctgtggaaaacgggggacgcagggagacgtgaccggccaggccggcgaagaagaagtcaggcgcgccagcgccaacgggcgaatgccttgatgagggaggtgatgatgctgctgaggtggatcacgatagcggtctcacggagccatgttggggaacatagcccagtggggaggatgggtgcaacagcgggatgtcggaagaaagaggcttaa

SEQ ID NO: 10824 - DNA, 183 bp, Pseudomonas aeruginosa
gaaccactgacttgtctcgacttcaatatttctttccaacagaagagaaaggttatgaaactctccatctattacagtctgccccaagccattccttaccaagaccccatactcactcataccttggccaccacatataaggttccagaagtatggaatagtgatggccaccaatcctcgtag

SEQ ID NO: 10825 - DNA, 537 bp, Pseudomonas aeruginosa
cccagttcgaccaggcgccgacgttgccgctacggtcgatcaagcgaccgcggaacgccagccgttcgccggccggtatcggcgataccaggtgggtattgcctgggtaggcgaacaggcccagcgcccgtgcggtctcctcgctgccgccgggagtggcggactgctggatctcggtgtaggcggtgtccgctgcgccgctggccgggaacccccactccaggccgatgcgccaggggccggccacgcagcgcaggtaggccagcgccggcggcggcgtggtcttgccctcaagagcggtctccacactgctggcgtagaccgagccgacctccatcacgttcaaggcgcgtacccgcaccagataacgaccggcatagatgcccggcacgtcgaaaccgagcgccgaggttcgcggcacccgcacccagttgcccgagtccttgcgccattcggcctcgtaggccaccgcgttcggcgcggcatcccaggaggccgacaggctggtcaccgccaacccctggtcgaccttggtga

SEQ ID NO: 10826 - DNA, 453 bp, Pseudomonas aeruginosa
ccctgccgctggcggcgctcggcgagcaatgcgcgaaccttggcctgcagcgaatcgccggccttcagcgtggcgccggcccagctcggcgggcgcacgtcaggtacacggcagggcactgccaggggaacctcgacgcgcactgggcgaggtgtcgtcggtgaggctgcgcagcccgcgaaaagcagacaaagccccagcaggagacgagtcatagtcccagctcccggtcgatcgccgcacctgccgcctggcagtccgtgccaaagtcgggttcttggagcagacgcacggccgcggcatactgctccgcggcctgcgccctggcctcgccgagtgcctgctcgacgtccttcgcgcgcctctcggcgctcgcccgcaccgccgccagcgcgcgctgctgctcatcgagcaaagcctcgagctggccgctggcgacgcggctggcagtga

SEQ ID NO: 10827 - DNA, 1761 bp, Pseudomonas aeruginosa
cagaggctgtccagcatgtcgccgtcagcggttcggcaggtcgtcgccatagcgcttgaactccaggtcgaaggtttgtttgcggggagcgccgttgcccagcagggcgctctggttctcgctgatccgcaccagacaccagaggcccatctgcacctcgccgtagccgctgctcaggatcagcggctcacgccgctccgccaaccggcgcagcgcttcgagctgctccagaccgacgaccttttcctggttacctacctgtcgacgcagcgggaataccgcacccttgagcaggatgctctcctcgcccatgccgacgctctgcagcgccggccgccgacccaggcgcacctgcccgctccagttgtaggcactgttgcgctgcagggcgtcgaaggcggcagtattcaggttgaagtagaacggttgggcattggcggtcagcggctgcagtaccagcaggtgcggcaagggcgctgcggcctcgctcgggggcgtcgccgagggtgccagcagccacgacggcagcacccccgccagcgtcggactgatgtcgccagcgaccttgccgaccgcctgcgcggcactgtttacctgcaccttcagcgcatccacgcgttcgtcgataccaagcaacgcccggctcgcccggtcataggtggagaccacgcggttcaccttgccctgcgcctggccgatgccgcgcatggcacgctgcagccgggcagccatttccggcgatacgccgggcaggttctccagctccgcggctgcgccgcggatctcgctgatcgcaccgttcaccggagcgaccaccttgtccagactcttgcgtccggactcgccggcgcgacccaggtacctcaggccggcctgcaattgttccagatatgccatggggactccttagaccatcgccgggtcgtagaggctgcgccgctgccgctcgtcggcgaagtcgacaagcatgcgttgcaggtagggcagcaactcgtcggccaggcgctgcggctcgtgtacgttgccttgcaccgtcaggttgatctgcggcgcgaaggtccagttgggcacagccgcgacgggttcggcctgtggtacgggcaccgccggcttgttgtccgaggccgccggcggatcgccagccagactgcgtcccagacgcccccccagttcgctaccgccccaggcgccgatagcgccgccaaccaatccaccgatcagcgtaccgaccaccggcaccaccgagccgatgctcgctcccagagcggcgccagccagggaaccagccagggaggcaccggcctcgccataggcgatggtcttttcgctctccgacaggtcgctggagtagacctcagcaacatcgatcaacgacgaggccacttgcagcggcgcgttgcgtatgggcaaacgcgacaggcgcggcagctttcctgccatcgcccccaagcctcctccagccgagaagccaagggatggaagggagcgggccttcagcccaccgcccttgcctctcttcctgcgtggtgtttgaccgcgctttcgttgtgccggcctcctcgcggactccagcgtagagtcgcctcccggcaccggccagttggtaacgaacacgcgctgtatttcgctaccacccgatacccggcctgcaccccgttcgatcaggtcgccgacggcagcggtccctcgccgaccgagccgaccgccacgcagcacgtcgatagcgccgcgccctcccttgtaggcgagatacccggataa

SEQ ID NO: 10828 - DNA, 1341 bp, Pseudomonas aeruginosa
gccagcccggcagtcgattctcttgggtcatgtccggagctcctcttacaggccgaggtcgttgcgcatgccggccaactggtcgacaccgttgatcgcgcggacaccgttgaccggatcgatctcgtagacctcgcggccatcgacttccagcttgtagtagctgaccgcaacggcgtacttgaactcggctttctcgccggccttccagtcgcccgggtcgacctccttgagcaggccgcgcagggtagccaccactggcacgctggcgcccttctggcccttgaaggagccgcggaacacgccattgaaagcgctctggtcggccaggccgaagaaattcagtgcttctcggcgggcaccgttggtggagaacttggcctccatcgcctccaggcccatgtcgatggataccggcgcatccatgccgccggcacggtattgctcggtcttcacagccagcttgggcagggtcagggatggcacgtcaccggcgaagctcacgccgtcgatgaacaggttggtattggtcagggtttgcggaatcatcacgggcgctccttaggcgacatccagaacttcggtgagccactgatcggtcacctcgacacggaaattggggttctcggcaggcggcacatcggtgaagcggatgttccagtacaccttgccctgggacagctggctggcgctgttcaggtccgggtcggcatagacctcgaagttgatcaccgcgccctggttcttcagatcgcgcatgaaggcgcgcaggccctcggtgacatccttcacgtaggtcttggtgatgccgcggtccaccgcccacttgtgcccggcgaggatcgcatccatcaccaggtccatggtccgaacgcgggtgacgaaagcccacttgctgtcgctggacaaggtgcgattgccccacaggcgatagccatcgtcgcgaatgatcgtggcgatattggcgttgttgagcaggttggcgcgacaggtctcatcaccgtcgaggaactccaccggacggctggtgccggtgatgcccttgatctccttgttcgacggcgaggaccagaagccgtactcggcgtcggtccaggcgaacaggccggcggcgtaggccgaagccggggccttgcgtgcggcattggtggcgctgtcccaaacctgcacgcccgggtcgaccatgaacaggcgcttgctgccgaagttcttggcgtaggcgacggccgcctcgtcggtgctattgggaccatcgagaatggcgatggcccgcagtttctcggccagcccgtccatggcggtggccaccgcttgctgggccgaatgacccggcgcaactag

SEQ ID NO: 10829 - DNA, 1848 bp, Pseudomonas aeruginosa
cctggtcacgtcgctgtcgaacatcttcggctacgacatcgacttcgccctcgatctgcgagaaggcgacgagttcgacgtgatctacgaacaacacaaggtcaacggcaagcaagtggcgaccggcaatatcctcgccgcccgcttcgtcaaccgcggcaagacctacaccgccgtgcgctataccaacaagcagggcaataccagctactaccgcgccgacggctccagcatgcgcaaggcattcatccgtacgccggtggatttcgcccgcatcagctcgcgcttctccctgggccgccgccacccgatcctgaacaagatccgcgcgcacaagggcgtcgactacgctgcccccatcggcacaccgatcaaggccaccggagacggcaagatcctcgaagccggacgcaaggggggctacggcaacgccgtggtgatccagcacggccagcgctatcggaccatctacggacacatgagccgcttcgccaagggtatccgcgccggtaccagcgtgaagcagggccagatcatcggttacgtgggcatgacgggcctggccaccggcccacacctgcactacgaattccagatcaatggccgtcacgtcgatccgctgagtgccaagctgcccatggcggacccgctcggtggcgcagatcgcaagcgcttcatggcgcagacccagccgatgatcgcgcgcatggatcaggagaagaaaaccctcctggccctgaacaagcagcgctgatcgtgccgcgctacctggggttgatgtccggaaccagcctggacggcatggacatcgtcctgatcgagcaaggtgatcgcaccaccttgctcgcttcccattacctacccatgccggccgggctgcgcgaagacatcctcgccctgtgcgtccccggtcccgatgaaatcgcccgcgccgccgaagtcgagcaacgctgggtcgcccttgcagcacagggcgtgcgcgaactgctgctccagcagcagatgagccccgacgaagtccgtgccatcggcagtcacggtcaaaccatccgacatgaacccgctcgccacttcacggtgcagatcggcaaccccgccctgctggcggagctgaccggcatcgatgtcgtcgccgacttccgccgccgcgacgtcgcagccggcggccagggcgccccgctggtaccggccttccatcaggcgctgtttggcgatgatgacgcctccagggcggtcctgaacatcggtggcttcagcaacgtttcgctgctcagccccggaaagccggtacgcggcttcgactgcggcccgggcaacgtgctgatggacgcctggattcatcaccaacgcggcgaacatttcgaccgggacggtgcgtgggccgccagcggccagatgaaccacgcactgctggcaagcctgctggcggatgagttcttcgccgcgcgtggccccaagagcaccgggcgcgagcgcttcaacctgtcctggctgcaggagcacctggctcgtcaccctgccttgccggcagcggatatccaggcaaccctgctggaactgagcgcgcgcagcatcagcgaatcgctgctggacgcccagccggactgcgaagaggtgctggtatgcggcggcggcgccttcaatacggcgctgatgaagcgcctggccctgctgatgcccgaagctcgggtcgccagtaccgacgaatacggcattccccctgcctggatggagggcatggcattcgcctggctagcccatcggtttctcgagcgcctgcccggcaactgccctgatgtgaccggtgcgctcggtcccagaactctgggcgcgctgtatcccgcctga

SEQ ID NO: 10830 - DNA, 1305 bp, Pseudomonas aeruginosa
ggcgttctccgctgcgcaacacctcgatttcggtacgcaggcgctccagctcggccttctgctcgccgatcagggtttcctggcgttgcgaatcggcctcgctgcgagcggcgtccgccccggtcgaccagcgaccgccgagaaacgccagcggaaccgccagcagcagcgcacccaccccgaggcggaccagccaggcccgccgtggatcacggaactggagttcccagccggacatcaggggagcagggccgcatgcgagaggcccaggcgctcgtccagcccgaacaggatgttcatgttctggagcgcctgacccgaggcgcccttgaccaggttgtcgatcaccgacagcaccaccaccaggtcgccgccctgggggcgatgcacggcgattcggcagacattggcgccacgcacgctacgggtctccggatggctgccggccggcatcacgtcgacgaagggttcgtcggcgtagcgcttctcgaacagcgcctggaggtcgaccgagcgatccgcgacatgggcatagagggttgcatggataccgcggatcattggcgtcaggtgcggtacgaacgtcagcccgacgtcgccgccggaggcccgacgcaggccctggctgatttccgggagatgccgatgccccttgaccgcgtaggccatcatgctttcgcccgcctcgcagaacagcgagccaaccttggcgccccgaccggcgccgctgaccccggacttgcaatcggcgatcagccgcgaggcgtcggccaggccggcctccagcagcgggatcaggcccagttgggtcgcggtcgggtagcaacccggcacggcgatcaggcgggcctggcggatcttctcgcggttcacttccggcaggccgtagacagcctcgtcgagcagcgccggagcgccatgcggctggccgtaccagcgcgcccactcctcggcgtccgccaggcggaagtcagcggacagatcgatgacccgggtccccgcgtccagcagttcgccagccagcgcgtgcgccacgccgtgcggcgtggcgaagaacaccacgtcgcaggcgccgaggcgctgcacgtccggcacgctgaactgcaggtcgtcataatgacctcgcaggttcgggtacatgtcggcgaccttcacccccgcctcggaacgcgaagtgatcacttccacccgggcctgcggatgctgcgccagcaggcgcagcagttccacgcccgtataacccgtaccgccaacgatgccgaccttgatcatctgtccatcactccgcgcgctgaagcaagctag

SEQ ID NO: 10831 - DNA, 1017 bp, Pseudomonas aeruginosa
tcgtcctactggtggtgctcaaacctttctgacccaggagtcctgtccatgtccttgcccgccctgctcgaccaacgcctgcgactgccgatggtggccgcgccgatgttcctggtatccaacccgcagttggtgctggcctgctgccgcagcggcatcgtcggcagcttcccggcgctcaaccagcgcgagagcagcggcttcgagggttggctggaggaaatcggggccggcctgcaggcgctggacaatcccgcgccctatgcggtgaacctgatcgtccacaacaccaatccgcggttgcaggccgacctgcggatctgcgtcgagcaccgcgtaccgatcgtcatcaccagcctcggcgcagtgcgcgaagtggtagacgctgtgcatagctacggcggcctggtattccacgacgtcaccacccgccgccacgccgaaaaggccgccgaggccggggtcgacggtctgatcgcggtggcggccggcgcgggcgggcacgccgggacctggagccctttcgcactggtcgcggaaatccgccagttcttcgacaagactctgctgctggccggctgcatcaaccacggccacgagattctcgccgcacagatgctcggcgccgacctggcctatctcggcacccgcttcatcgccacccgcgagagcaatgcctccgacgcctacaagcagatgatcctggaggcacgcgccgccgacatcgtgcacaccccggcggtgtccggcgtaccggccagcttcatgcggcaaagcctggaggccgccggctacgatctgaagcgcctgaccgacaaggcagacatgaactacggcgagaaactcaagccggtgaacgacgaggccaaggcctggaagaccgtgtggtccgccggccagggcgcgggcaacatagacgacttgcccggcgtcgacgagttggtcgcccgcctcgaccgggaatatcgagacgccctgcggaacatggatagcctggccaaccgctggccgcgctga

SEQ ID NO: 10832 - DNA, 471 bp, Pseudomonas aeruginosa
ccggatgtcgtctcagccgagttcgacgatctcgtagtcgtgggtgatctccaccccgccgcgaccgagcatgatcgacgccgagcagtatttctccgccgacagctccaccgcgcgcttgacctgggcctccttgagaccgcggcccttgaccacgaagtgcacgtggatcttcgtgaacaccttgggctcctcgtcggccctttcggcctcgaggaaggcttcgcagctctccaccggctggcgcgccttcttcaggatgctgaccacatcgaagttggtgcagccgccgaggccgatcaggaccatctccatagggcgcaccccgaggttgcgtccgccatggtccggcggaccgtccatgaccaccacgtggccgctaccggactcgccgaggaacatcgcctcgcccgcccactggatacgcgctttcatcgttcagactcccgccggcaaagggcgccagcttag

SEQ ID NO: 10833 - DNA, 402 bp, Pseudomonas aeruginosa
acctcgctgacttccatcagctccacgtcggcccggttgagaataccgctctcggtgaccaccaggcggtcgcggggaatttccggcaacaggtcgagggtggtttccaggctcacctcgaaggtgtgcaggttgcggttgttgatgcccaccaacggcgtgtccagggtcttcagtgcacgttccagctcggtgccgtcatgcacttcgaccagtacgtcgagaccgaccgacttggcagtcgccgccagttcggccatcagcacgtcgtccagcgccgagacgatcagcaggatgcagtcggcaccgatcgcccgcgcctcgacgatctggtacggatcgatcatgaagtccttgcggatcaccggcagcgcacaggcggcccgcgcttccttcagatag

SEQ ID NO: 10834 - DNA, 3066 bp, Pseudomonas aeruginosa
cgtcgtgcgagtggcctgggcctcgttttcggtggcccgtacggtttcctcctgggctgcccgggcaacggtcttccagccgcgcagggcatcggccatggcgccattgccgtcatccgcgtcgtcacgggtcgccgcctgcagtacgccaaggcgcgatgcctgggcggtaaggctgccgtcgagttcgctgatttcagcggtatggctcgccacctgctgcgccagcccgttggcggtttccagcgactggccgatatcggaccagtaggccgcgttcggcggcgccgtcttcgccggcacagctttcagggcctggtacagccgctgcccctgtcgcaccatgtcgttcttcgcgtagaccttagccgggtcgtacagcagaacgtcggcgaggtcgccgacctgcttctgcaagcccccgatatccacctgcatccgctcgatatcggagaagaactgctggcccagcgccgactcgacgtactcctgggtgatcaactggttgtattcgctggcgtcgctggagctggtgccggtgacccagttcgaccaggcgccgacgttgccgctacggtcgatcaagcgaccgcggaacgccagccgttcgccggccggtatcggcgataccaggtgggtattgcctgggtaggcgaacaggcccagcgcccgtgcggtctcctcgctgccgccgggagtggcggactgctggatctcggtgtaggcggtgtccgctgcgccgctggccgggaacccccactccaggccgatgcgccaggggccggccacgcagcgcaggtaggccagcgccggcggcggcgtggtcttgccctcaagagcggtctccacactgctggcgtagaccgagccgacctccatcacgttcaaggcgcgtacccgcaccagataacgaccggcatagatgcccggcacgtcgaaaccgagcgccgaggttcgcggcacccgcacccagttgcccgagtccttgcgccattcggcctcgtaggccaccgcgttcggcgcggcatcccaggaggccgacaggctggtcaccgccaacccctggtcgaccttggtgaaagccttgatccgcacgttctgcggcggcgcctgcacgcccggcggaatgctggtgaccggcggcagctcgatgcgcgcaccgttgtcgatggcgtcgaacttgctcgcgttgtgttgcagcgcggtgatctcgaaaagattgtcctccggccgggtgatgctcatgatgcggaagcgctgggtggtcaggctgttgctctgcagcgcccactgcccctggggccgaggcgtctccgaataggcggcggtcacggtcagcacgcggcctaccaccgactggacgctgcgcgcctcggccttgccgttcggcaggttgaccagcaggcgatcgccgggtcgggcctcgacgtcgcggtcgagggtcagcgcgcggccatccaccgcgctcaggcgtccgccgatctgcttgccggacttgaccgggtcggctacggcgatgatcttccccggcgccagcccacggccatccatgccggtgcggaaggtcaccgcgtcctgctccagctcctcggtcagcagcgcccactggccacgccgctgcgcctcgccctcggaggtgcagccgatcgcggtgatctccaactggctgatgccgtagcggcgctgcgctcgatcattgttcaccgctaccggctggctctggtagccgttgcccggattgtcgtagttgaccagggccagggtgtggcgatcgcgctggcggctgctgctgtagttgaagtggctgccgtcgtcgccacgcacggtgttcgacggcgagaaggtgtaggcctcgtcctccggcatgtcggataccgccaccatttccgcgccggaccagtaggacatgccgcggaagatcgctgccaggtcgcgcagcactgtccaggcttcggcgcgactctgcaggtacaggttgcagctgaagcgcggctcctggccgcccttgccgtcgggcaccgactggtcgcagtactgggcgatgcggtacagcgaccacttgtcgaccatgctcgcgtcgatccgccgaccgaggccgaagcgcttgtgcaacacgatgtcgtaccagtgccaggccgggttgctggtccaggccgacttgaacgagccgtcccaggtgccgctgtagctacgggtctgcggatcgtagttgctcggcacccgcacccgccggccgcgcgcttccaccgatatctgcggaatgctctggaactggctggcatcgaactcgacgaacagcagcgcggtgttcgggtagcgcagcttggcgtcgatcacctcggtgatcgcctcgacccgcatggtgtcggcgatgcggttgttgttctggttcggcgtcaggcggcgcacgcgcacctgccagccgctccgcgcctccggcaggtcgacacggtgggagcgctcgtagcggctggtggacttgtcgtccagcgaagccttcagcgcttcctgccaggcaccgccgtcgacggcgatgtcgatcgcgtagtcgatgcggtagccgaccacgtcaccgttttcctgctggcgctggatggccggccaggacaggcgcaggcgcaccgccgagagctgggtgttgctcaccgcgcggacccagggcgcgtcactcttgagttcgacgccgaccgccagttcgttttccacggcgggcacaccggcaatgtgttcctggtccaccgagcccggacggaactcccaggtcactccggggaagttcaccgagccgtccgccgccagcagcggcgtatcgtccaggtagatcgaacggccgtcgacgccaccgtcaaactcgccttcgcccagtgccaggagaatcttcgcccgcgcgatcgagcgcaccgagtccggcatctccaccggctggcgcggcttcttgctgccacccttgtggcccgtgatggtcttgttcatgacgttccttcaggcaaaaaaacgcccgcgcatggcgggcctgttacggcgttgccggctacagccggtcctcggcatagatgccggcgctga

SEQ ID NO: 10835 - DNA, 594 bp, Pseudomonas aeruginosa
ggccctgactcagggtgtcattcatggacctgttcctctcgtaaagagccgattccgacggctcgcttgaatatgtcgttcactgcggcatccgcgtgtgccgcaagaccaggcgcgtgcgttcgatccagggtccgccaaacacgtcgcgggtcgacagccgtccgtacaggtggtgcagcaggaacggtccgtcgccgccgagcgcctggaccggctcgctgtccagacgccagtcattgcccaggtagatgcccgcgtggttcgggtgcagcgccctcccgacctgcatcaccagcatgtcgccgcggcggattccggccagcggcaccggccggaatccagccgccgcatagtgctgctcgtagaggctctcgccggtttcccaccaaccgtcgcggcgcggatagtccggaagctccagacctgcctcgcggcggtaccagtcgcgacagaggctccagcagtcgagcacgccgtgggcgaactcgcggccgagcagcggcgcccgatagccctccggcgctagatgcgcgacatcgccttccggccaggacaggatcacccagggcagaccatgcagttcgcaactga

SEQ ID NO: 10836 - DNA, 426 bp, Pseudomonas aeruginosa
agcgttccagatcagccattcaccatcctccataccaggccgccggggcgcagctcctgcgccaccacgttgcgcgcggcatcgttgatcattcccgccagctgctgtcccgtaccgtcgtcgccgctggccgtcgccgcgccctcgcggccaccgcccaggctgacgctggtggagaaattgaagacgttgcccccctcgccgccgccgagcgcgcgcacgccgagcacgccatcggaaccgcgactcagcggcatgatggcttccggcccacgctcgccgatcagcgccggacgaccgccggccatgctgaacagcgccggcgcgctctggatgccatcgttgaaggcaccgcccctggcgaacccaggcatgcctccggcgcgttgcttgctgacccaattggccatgtccgagccggtatag

SEQ ID NO: 10837 - DNA, 510 bp, Pseudomonas aeruginosa
tcgttgatcctgccaaccttgtccatcccggccctgtacccttcgctgcgaaggaccaggtcgagcgtcaggctgccgtcggtattcgtggccatgattcatgtcttccagaaaaagaccccgccgcagcggggtggcctgtcatgcccattgatccatcgcctggtgcagcgaaaggggctggagagccatatgcggacggaacgcgtcgggatcggcgtccgctcccagcgcatgcccgagcaacgcagcgatccgagccagcgcaagctccagccggtgtcccggatggagcgagccgcgcttgttcagataggcgacccaggcgcggtactcggcgtagctgagccgctccttggcctcggcaatggtcgacccgccgacgccgttcagcaccagttcgtgccaaacctcgtcggcgggggtcagtttttttccgcgtcctcgacccggttgacctcaccgaccgcctgcagcagcaggaagcccagcgccgggtcgaggtcgtag

SEQ ID NO: 10838 - DNA, 429 bp, Pseudomonas aeruginosa
ctccttcgatcagtttcaatgcgggccacggtcgtccgactgttcctcgggcagctcgcaaacccccaggcgccgggcggcccagcgttcgtagagaccgactgcgatctccgcgccggccgcggcggtcaggctgcccagcgccgcggcgaacagcagcgcggcgccgcaagccaacgccagcagcatcaccgccacgccgcagacgatcgacgcgccggagcgcagcgccaggcgccgcaacaaggcccagccgccgagaccggccttgtcggcacgccacatctcgccgctgacgccgcccagcgcggcgagcaggatcagtacccagagcggcatttccgtcagtgtctgcggttcgttgcccatgggtccctccttggcaggcagcgccgggcacgtccgcacgaacgttttcccgggcaataa

SEQ ID NO: 10839 - DNA, 1479 bp, Pseudomonas aeruginosa
gcagttatttattcacaatccaaaaacaccaatcacgccatgacgcaatccgatcagaaagcgccgccgtattacccgaaaagccacttgttggccgccagcggtgttgcagcgctcctcagtttggcactactggtgttcccctcgagcgaagtcgaggccaagaggaccacgctcaatctggagcttgaaagcaacaccgatcgcctccttcaggagaaagacgacctcctgccgcaatcggtcaccaattccagcgacgaaggcacgcctttcgctcaggtagaaggcgcctccgacgacaacaccgccgagcaagactcgggcaagccgggcgcatctgtagccgatgccgataccaagcccgtcgatcccgagtggaagaccatcaccgtcgccagtggcgatacgctgtcgaccgtattcaccaaggcaggcctttccacctcggccatgcacgacatgctgaccagcagcaaggatgccaagcgcttcactcatctgaaggtcggccaggaggtcaagctcaagctcgaccccaaaggagagctgcaggcgctgcgagtcaagcagagcgaactcgagaccatcggcctggacaagaccgacaagggctactccttcaaacgcgagaaagcccagatcgacctgcataccgcctatgcccatggccgcatcaccagctcgctgttcgttgccggtcgtaacgccggcctgccctataacctggtcacgtcgctgtcgaacatcttcggctacgacatcgacttcgccctcgatctgcgagaaggcgacgagttcgacgtgatctacgaacaacacaaggtcaacggcaagcaagtggcgaccggcaatatcctcgccgcccgcttcgtcaaccgcggcaagacctacaccgccgtgcgctataccaacaagcagggcaataccagctactaccgcgccgacggctccagcatgcgcaaggcattcatccgtacgccggtggatttcgcccgcatcagctcgcgcttctccctgggccgccgccacccgatcctgaacaagatccgcgcgcacaagggcgtcgactacgctgcccccatcggcacaccgatcaaggccaccggagacggcaagatcctcgaagccggacgcaaggggggctacggcaacgccgtggtgatccagcacggccagcgctatcggaccatctacggacacatgagccgcttcgccaagggtatccgcgccggtaccagcgtgaagcagggccagatcatcggttacgtgggcatgacgggcctggccaccggcccacacctgcactacgaattccagatcaatggccgtcacgtcgatccgctgagtgccaagctgcccatggcggacccgctcggtggcgcagatcgcaagcgcttcatggcgcagacccagccgatgatcgcgcgcatggatcaggagaagaaaaccctcctggccctgaacaagcagcgctga

SEQ ID NO: 10840 - DNA, 1128 bp, Pseudomonas aeruginosa
gctgtcggctgcatttctctcaccccagctgacaaggatgcctgcatgaccgaccaacgcttcaagatcgtcttctccggcgagctgatgcccgacgcatcgctcgaaaccgtgaaggacaatctcgcccgcctgttcaagagcgaaccgggcaagatcgacgccctcttcggcggccgcccggtggtgctgaaacgcgaacttccagaggccgaggcggagcgttacctgaccgccctgcgccaggccggcgccaatgcctacaaggaagtcgacctggcggccagcctgagcctggtggaaacgcccgatcacaacccccaggtcgcggaggaaaccccagcgcaagacctgcctcccatgacctgcccgaaatgcggccatgaacagcccagcggagcggaatgttcggcttgcggcatcatcatcgagaagtacctggcgcgccaggcgcagctcggcgaaaacgccgcgcctgcggcctccgcggccgcgggcgcgggcgcgtctccctacacaccacccagcgcccaggtcggcgaagccctccccgagttcggcgagctgaacgtgttcaccaccaacggccggatcggacgcctgcgctatctcggctggtcgatggcgatgacgctctgtttcctcgtcatcatgggcctgggcttcctgctcggcgaaaccgtcggcgtggccgtcaccgccctggcctcgatcgccttcatcgtcattgccgtgatgatcggcgtgcagcgcctgcatgacctcggctggtcgggctggctctggctgctcaacttcgtccccttcgtcggcagcgtgttcggcatcctgatgctggtcctgcccggcagcaccggcgccaaccgctacggtccgccgccgccggcgaacagcaccggggtgaaagtcctggccagtctgatcatcctgctgccgatagtcggtatcatcgccgccatcgccctgccgtcctaccagggttacctggagcgcgcgaactatgacggcggcgccagcgctccagccgacccgtacaccacggacgagcaggccgccgcagcggcggccgaagccgatgaagccgccacggcggcggcagaggccatggaagacgacgaccaacagtag

SEQ ID NO: 10841 - DNA, 318 bp, Pseudomonas aeruginosa
ccacgcaacccctcgcgacgggcggggtccaattccccgtccgtttcggagaagtctcgaatgccccgttatgccctgatcaccggcgcttccagcggtatcggcctggccctagccgaagccctggcccggcgcggtcgcgccctgatcctggtggcgcgccagcgcgacgcgctggagagcatcgcctatgagctgccgcagcgtttcggcgtggaagtgctgttccgcaacctgcgatctttccgagccgctgcaactgtcagggttgttgcacgaactggaacagggcgaacgacagatcgacctgctggttaa

SEQ ID NO: 10842 - DNA, 1314 bp, Pseudomonas aeruginosa
cccgggaatccaggaccaggccgaggtcgtgtatgtcgttcttcactgcggctccttcacgcttgggcggtcgcgacgggcaccgctacactcgggaaagcacccgaggccggaggaatcgcccatggactgtctgttctgcaagatcgtggcgggggaagttcccgcgcgcaagttctacgaagacgaggaagttgtcgcgtttcacgatatcggcccgcaggcgccggtgcacttcctggtcatcccgaaaaggcacattcccaccctcgagcacctgaccgaggcagaccggccgctggcaggccatatcctcttcaccgcccagcgcctggcccgggagcagggctgcgaggaaggcttccgtgtggtgatgaactgcaacgaccttggcgggcagaccgtgcaccacatccacatgcacgtgctgggtcaacgccagatgcactggccgccgggctgagtccctgctggcgctgcgacatcgcagcccgtccgcaacatcctgctatcagcgcacttccggtaaactggtgcgatctttcgtttccggaggtgcgccatgtccgccgaccgccactattcgcccatcgaccgtttcctgctgcaggccgactccgccctgcgcaccctgctgccgttcagcggccagccggcgcgaccgtcgccggccatcgtggaacccgatggcgaactgagcgaggaagacacccgccatatcgccggcctgatgcgcatcaaccacaccggcgaggtctgcgcccaggcgctgtaccagggccagtcgctgaccgccaagctgcccgaggtccgcgaggcgatggaggaagccgccgaggaggagatcgaccacctggcctggtgcgagcaacgcatccgccagttgggcagccgtcccagcgtcctcaatccgatcttctacggcctgtccttcggcgtcggtgccgccgccgggctggtcagcgaccgggtcagcctgggcttcgtcgccgccaccgaagaccaggtgtgcaagcatctggacgaacacctggcgcagattccccaggaggatcggaaatcccgtgccatcctcgagcagatgcgtatcgacgaggaacagcattcgagcaacgccctggccgccggcggcctgcgcttcccggcaccggtgaagctgggcatgagcctgctggcgaaggtgatgaccaagagcacctaccgcatctgaatcgcacgcatgaaaaagcccgctcgaagcgggctttttcttcctcgtgtgcgatcagcgcggcatgttgcgcgcgtagaagatctccagcatttcgtgcttga

SEQ ID NO: 10843 - DNA, 840 bp, Pseudomonas aeruginosa
ctgcgtcgcaaaatcacatcgaccttcatggtccgtctgttaagctggacgcggtttactggcacacttcctgatctgcccggttggggggagctctccgctgagctcccgggccctggcaggtctctccataagaactcaaaaaaacatcgccttgtacgtcaggcatattctttattctttcgggactcgggcatggtagctattacccacacacccaaactcaaacacctagacaagctgctcgcacactgtcaccgccgccgctacaccgcaaagagcaccatcatctatgccggcgatcgctgcgaaacgctgttcttcatcatcaagggttcggtcaccatcctcatcgaggacgacgacggccgcgaaatgatcatcggctacctcaacagcggtgatttcttcggcgagctgggattgttcgaaaaggaaggcagcgaacaggaacgcagcgcctgggttcgtgccaaggtggaatgcgaagtcgccgagatcagctatgcgaagttccgcgaactgtcgcagcaggactcggagatcctctacaccctcggcagccagatggccgaccgcctgcgcaagaccacccgcaaggtgggcgacctggccttcctcgacgtcaccggacgcgtcgcccgcaccttgctggacctgtgccagcaaccggacgccatgacccacccggacggcatgcagatcaagatcacccgccaggagatcggccggatcgtcggctgctcgcgggaaatggtcggacgcgtgctgaagagcctggaggagcagggcctggtgcatgtgaaaggaaagaccatggtggtcttcggcacccgctga

SEQ ID NO: 10844 - DNA, 1194 bp, Pseudomonas aeruginosa
cgcgcgcacggcgctcggcgacctcctcggccttgcgggcgaggatcttctgcagaaccgtcggcacactcactgtgcgttctcctctctgtaaacggcggtgaaggccaccagttcgtccatcttctcccgtgccagcccggtgtgcagggcatcgtgggccagttgaatgccctcgtgcaggctggtcgccagatcggcagcgtacagtgccgggccggcattcatcacgatcagctcggcggccttctgcccagcctcggtcttgcgccgccccaaagcgtcgcggatcagttccagcgaggcctgcggactgtcgacctccagccccatcagggtctggctcttgatcccgaagtcctcgggacgcacttcgtactcgcgtacctcgccgtccttcaactcggcaatgtgggtcgccgcggccagactgaactcgtccagcccgtcgcgcgaatgcaccaccagcacatgctcgctgccgagacgcttgagcacttcagccagcggcttgcacagttcctgggtgaacaccccgaccacctggtgcctgactcccgccgggttggtcagtgggccaagcatgttgaacagagtccgcaagcccagctcgcggcgcggaccggcggcgtacttcatcgccttgtggtggacctgggcgaacatgaacccgacgccgacggtgtcgatgcaacgcgccacctgttcggaggtcagttccaggtagatgccggcggcttccagcaagtcggcgctgccgctcttgccggagaccgcgcggttaccgtgtttggcgaccttgccgccagcggcggcgaccacgaaggacgccgccgaggatacgttgaagatgttcgcgccatcgccgccggtgccgaccacgtcgaccacatgcttcagcgtaggcaactgcacgccgtcggccagttcgcgcatcaccgccaccgcgccgacgatctcgtcgatggtttcgctcttcatccgcatgcccatcaggaaggcgccgatctgcgcgtcggtgcactgcccggtcatgatctggcgcatgaccgcctgcatttcctcggtggtcaggtcgagctggttgacgatgcgattgagggctcccttgatatccatctcagttgccctccccacgcacgccgccctgctggcggaggaagttggccagcaactcgtggccctgctcggtga

SEQ ID NO: 10845 - DNA, 483 bp, Pseudomonas aeruginosa
atgcgcgacatcgccttccggccaggacaggatcacccagggcagaccatgcagttcgcaactgacccgatcggccatgctcggcgtggccggaacgtccgggtggctgtggacgatggccaggacctcgccctggtcctcggcggcgcaccagtcctggtgatcgatcacgaagtgctcgctgggcgatccggctgcgttgcgacaggccacgtagcggcgttgacgcacaccgcgaacgatcagcccgcagcattcgcgcggatgctcgcgggcggcgtgtgcggcgatggcccgctgcaggctgcggctcagttccatgctcacatcctgaccaggccggcgccggcgaagccgccgtgggacagcgggttgtccgcgccgaagcgcagcttgcaatcgctgacccggccgccgcagcggtccagcgccggatcgtccaccggattgccgtcggcatcgaacatcgccgtaccggtgtag

SEQ ID NO: 10846 - DNA, 309 bp, Pseudomonas aeruginosa
acagcatgtccatcattcccgagacgtcctgcgcctggtcgcgcaggctcgcccaggaggcgtccatctgttcgacccaactgcccaccggcttgccagcggccgaagcccctccagccgagaccttggaaccgtccccggtctgcccggaagcagtggccaccatcgcgccgacatccatcgccgctgccggcattggcgcggcaccctgggccgcgggagcgcccgctgccgcttgtcccgcagctgcgcgggccttttccagtagcgaggtatagggcttctggctggccagttgcgcctcggtga

SEQ ID NO: 10847 - DNA, 276 bp, Pseudomonas aeruginosa
cgtagggaaaggaatcgggaacgtaatcgaagcatcggcatcggcggggcaagtgacctgcccccattgcctaatgaggccagtgtcattgtcccgccaccatccgctcgccccaagggaagcagtcgcaggaacccctgctccgatagtgctacgtgctcccgctgccgtattcgaaccgacgccgccacgtgccagggggagaatgcccgaagtaagctgtccgacgtcatggttatgtgcggatggtggaaaagtggcaggttttcccggtaa

SEQ ID NO: 10848 - DNA, 744 bp, Pseudomonas aeruginosa
gacctggcgtttcgacgacggcgcctcgttgagttacgactgggctgcgcatcgctaccgcgtcgagctgcccagcggcaccgtggaagtgagggtcggcgccagcgaggtgcgggtcagcgacggggcggtcagtctcaaggcgccgaagatcagcctggaaggaccggtggagatcgccgggacactgacggtcagcggagacatcctcggcggcggctcgatcatcgacaccgtcggcaacagcaaccaccacacccattgaacatacgacggggcggccgaagggcggtccgtcgaacattcaaccggcccgcgcgagcgggccttttcgtttgcggagttcgccatgggcaacactcacagccattcggagccaggcgcggcctgtctctgccggagcgggagggcagggcgatgatcgggatggatcgccgtagcgggctgcccctgtccggcctggctcatcttaaacagtccgtcgaggacatcctgaccaccccgttgggcagcaggcgcatgcgccccgagtacggcagcaagctgcggcggatggtcgacatgccggtgagcgaaggctggaaaagcgccgtgcaggccgaggtagcccgttccctggggcgctgggaaccgcgcatcgcattgtctgccgtgcgagtcgtcgcggtcgtcgatggccgcgtggatctgctcctgagcggcgtgttcgagggcgagcacatcaatatggaggtctcggcgtga

SEQ ID NO: 10849 - DNA, 588 bp, Pseudomonas aeruginosa
atgaaacccaggcggcctattgcacggggtacgcgatcaccttgggaggcgtcgatgagtagccgcctgctgccgccaaacaggagttctctggaacgctctctgggtgatgtattgcctgccgagctgccggtgccgcttcgtgagcttaacgatccggcccgctgtgaggcggccttgctgccctactgggcctggacgcgctcggtggaccgctgggacccggactggagcgacgaggccaagcgcaatgcggtagcgacgtccttcgtcctgcaccagcgcaaaggcacgctgaccgcgttgcgccaagtggtcgagccgatcggtgcgctgagcgaggtcaccgaatggtggcagcgaagcccgcttggcgtgccggggaccttcgagatcaccgtggacgtcagcgaccgtggcatcgacgaaggcaccgtactggagctggagcgcttgctcgatgacgtccgcccggtgagcagacacctgacccggctggacctgcgcattaccccggtaatccggtcccgtcacggactggccgtgaccgacggcgacaccctggaaatcttcccctggaaacagtga

SEQ ID NO: 10850 - DNA, 678 bp, Pseudomonas aeruginosa
gcaatgggggcaggtcacttgccccgccgatgccgatgcttcgattacgttcccgattcctttccctacgctatgcctcggcggatatgcgaatcagacgagtgctttccatccgggaacggatgccagtacaggtttccgtggagcgactaccactaccgcggtgattcgcaatggctactttgctcaggcggttctttcatgggaggcatttggacgatgaagggcgaatattatttctctccaagccaggtggcattctatccggcctccttgcgagaggtttatgaatacgcaggctgctggccagtcgatggcgagtgggtcagcgcagagctacatgaacaactgatgaacgaacaggcggcaggccgagcaatcagttccgacgtgaatgggaacccagtagcgatcgagcgccctccgctttcccgtcagcaacgtagcgcccatgagcggagatggcgggatagtcagctgttggcgaccgacggcctagttgttcgccatcgagatcaattggaaaccggaaaggaaacgaccttactccctgtccaataccatgaactcatgtcgtacagagccagcttacgggattggccggaagagcctttatttcccgacagtggcggacgtccgtccgtaccagattggctcagacgttatgtcaccccctga

SEQ ID NO: 10851 - DNA, 1203 bp, Pseudomonas aeruginosa
accccgcctcgtgcggggtttttcattaatggagatctacctatgagtttcttccacggcgttacggtaaccaacgtcgatatcggtgcgcgcaccatcgccctgccggccagctccgtcatcggcctctgcgatgtgttcacgccgggggcgcaggcaagcgccaagcccaacgttccggtgctgctcaccagcaagaaggacgccgccgcggcgttcggcatcggctcgtctatctacctggcctgcgaggccatctataaccgtgcccaggccgtgatcgtggcggtgggcgtggaagccgcggagactcccgaggcccaggccagcgccgtcataggtggtgtcagcgccgccggcgagcgcaccggacttcaggctctgctagacggcaagagccgcttcaatgctcagccgcgtctactagttgcgccgggtcattcggcccagcaagcggtggccaccgccatggacgggctggccgagaaactgcgggccatcgccattctcgatggtcccaatagcaccgacgaggcggccgtcgcctacgccaagaacttcggcagcaagcgcctgttcatggtcgacccgggcgtgcaggtttgggacagcgccaccaatgccgcacgcaaggccccggcttcggcctacgccgccggcctgttcgcctggaccgacgccgagtacggcttctggtcctcgccgtcgaacaaggagatcaagggcatcaccggcaccagccgtccggtggagttcctcgacggtgatgagacctgtcgcgccaacctgctcaacaacgccaatatcgccacgatcattcgcgacgatggctatcgcctgtggggcaatcgcaccttgtccagcgacagcaagtgggctttcgtcacccgcgttcggaccatggacctggtgatggatgcgatcctcgccgggcacaagtgggcggtggaccgcggcatcaccaagacctacgtgaaggatgtcaccgagggcctgcgcgccttcatgcgcgatctgaagaaccagggcgcggtgatcaacttcgaggtctatgccgacccggacctgaacagcgccagccagctgtcccagggcaaggtgtactggaacatccgcttcaccgatgtgccgcctgccgagaaccccaatttccgtgtcgaggtgaccgatcagtggctcaccgaagttctggatgtcgcctaa

SEQ ID NO: 10852 - DNA, 516 bp, Pseudomonas aeruginosa
ggagcgcccgtgatgattccgcaaaccctgaccaataccaacctgttcatcgacggcgtgagcttcgccggtgacgtgccatccctgaccctgcccaagctggctgtgaagaccgagcaataccgtgccggcggcatggatgcgccggtatccatcgacatgggcctggaggcgatggaggccaagttctccaccaacggtgcccgccgagaagcactgaatttcttcggcctggccgaccagagcgctttcaatggcgtgttccgcggctccttcaagggccagaagggcgccagcgtgccagtggtggctaccctgcgcggcctgctcaaggaggtcgacccgggcgactggaaggccggcgagaaagccgagttcaagtacgccgttgcggtcagctactacaagctggaagtcgatggccgcgaggtctacgagatcgatccggtcaacggtgtccgcgcgatcaacggtgtcgaccagttggccggcatgcgcaacgacctcggcctgtaa

SEQ ID NO: 10853 - DNA, 2256 bp, Pseudomonas aeruginosa
cagacgagacgaaccgtcatgagtaaagacatggacctggtggtctccatcggcggcatcgccgacccctccttgggcaaggcattcgagaccgtcaaggcacggctcgacagtctccaggaacgttcccgccaggcttccagcctgagggatgtgctgggagacgccatacgcctggagcgagagctcgccgatatgcgcaaggtcggggaccgcggcgttgctgagcatgcccggcagcttggcgaacgccaggagcaactgaagcgactcggcatcgaggccagggccgcgggcgatgcctacgctcgactgggcgagatgcagcgtggcctggatatgcaggtccgcggcctgcaacggctggagcaggccagccaggcaatgccattggctagcgcattttccggactggtcgtggaagccagcaagacggctgccggttatcaagcgcggttgcgcgacctggcgatccgcaacggcctggacgtcggccgggagccagccttggcatccctgatccaggacagcgccaaccagagcggcctgggacgcacggcgacgctggacatgctggagcacttgaacgccaccggcatggggttcgccgccgcgcaaatgaatatgggactggcgggccgcttcggctttggccaagggattgcttcagccgaggttgcggggctggttcgagcgttgcaactggcccagggttcggactcgccagagcaattgtccgcctccctcgaccgtctggtcgtcctgggtaaaggcagagtcggcagtgaggccctggcgcgtcgcctgcctgccttgttgtcagcgctgggcaatgcgggagaggccacggccggcgatgtcggtgcactgggtgccttgctggagattcaggcaaagaacaccacgccagacaaagcggacgtgcggatgaaggcctggctggagttcgtcggcagcggcagcttgaaacgcgcttatggccaggactacgaccgggacctggaagcgctgcgcaaggacggagcgagtctgctggaggccaacctggagctggctgcgcgctatcgggataagggcggcaagctcagcgccggcgtggcgtcgccggcgcttgaagcctatcgagcgtcgcgcggcgagttccagggcttgctcgaatcccagcagtcttccgtaggctcttcggagcgcgatgcgcagcgtcgcaaggggatgtcccaggagctgtggaaggcttccagcgacagttgggagagggcgcagaccgctttgggcagcgccctgaatccatatctggacaacctggccaaggggagcgcggtactcggcgagtcgactgcggagctgctcgaagcctatccgcggacgacggccggtcttaccgccgccgcaggtgcggtgttatccgggtatctcgcctacaagggagggcgcggcgctatcgacgtgctgcgtggcggtcggctcggtcggcgagggaccgctgccgtcggcgacctgatcgaacggggtgcaggccgggtatcgggtggtagcgaaatacagcgcgtgttcgttaccaactggccggtgccgggaggcgactctacgctggagtccgcgaggaggccggcacaacgaaagcgcggtcaaacaccacgcaggaagagaggcaagggcggtgggctgaaggcccgctcccttccatcccttggcttctcggctggaggaggcttgggggcgatggcaggaaagctgccgcgcctgtcgcgtttgcccatacgcaacgcgccgctgcaagtggcctcgtcgttgatcgatgttgctgaggtctactccagcgacctgtcggagagcgaaaagaccatcgcctatggcgaggccggtgcctccctggctggttccctggctggcgccgctctgggagcgagcatcggctcggtggtgccggtggtcggtacgctgatcggtggattggttggcggcgctatcggcgcctggggcggtagcgaactgggggggcgtctgggacgcagtctggctggcgatccgccggcggcctcggacaacaagccggcggtgcccgtaccacaggccgaacccgtcgcggctgtgcccaactggaccttcgcgccgcagatcaacctgacggtgcaaggcaacgtacacgagccgcagcgcctggccgacgagttgctgccctacctgcaacgcatgcttgtcgacttcgccgacgagcggcagcggcgcagcctctacgacccggcgatggtctaa

SEQ ID NO: 10854 - DNA, 882 bp, Pseudomonas aeruginosa
ggagtccccatggcatatctggaacaattgcaggccggcctgaggtacctgggtcgcgccggcgagtccggacgcaagagtctggacaaggtggtcgctccggtgaacggtgcgatcagcgagatccgcggcgcagccgcggagctggagaacctgcccggcgtatcgccggaaatggctgcccggctgcagcgtgccatgcgcggcatcggccaggcgcagggcaaggtgaaccgcgtggtctccacctatgaccgggcgagccgggcgttgcttggtatcgacgaacgcgtggatgcgctgaaggtgcaggtaaacagtgccgcgcaggcggtcggcaaggtcgctggcgacatcagtccgacgctggcgggggtgctgccgtcgtggctgctggcaccctcggcgacgcccccgagcgaggccgcagcgcccttgccgcacctgctggtactgcagccgctgaccgccaatgcccaaccgttctacttcaacctgaatactgccgccttcgacgccctgcagcgcaacagtgcctacaactggagcgggcaggtgcgcctgggtcggcggccggcgctgcagagcgtcggcatgggcgaggagagcatcctgctcaagggtgcggtattcccgctgcgtcgacaggtaggtaaccaggaaaaggtcgtcggtctggagcagctcgaagcgctgcgccggttggcggagcggcgtgagccgctgatcctgagcagcggctacggcgaggtgcagatgggcctctggtgtctggtgcggatcagcgagaaccagagcgccctgctgggcaacggcgctccccgcaaacaaaccttcgacctggagttcaagcgctatggcgacgacctgccgaaccgctga

SEQ ID NO: 10855 - DNA, 1068 bp, Pseudomonas aeruginosa
cgtcggcagcttcgacgttacctacgacgaccgcagcctgatgagaacggtgaagacccgctaccaattgcccggcagcggcgaggtcaagagcgtcgagctgaagaacccgaaggcaccggctacggctacgggcgagcatgtcgaccggcatctctatgccagccgtggagaggccgagcaggcggcgaaggctcgcctggcgagcttcagccgctccagtgccagtgtgcgcctggagctgccagggcgtggcgacctgttcgccgagcgcagcctgctgctccaaggcttcaaggcgggaatcgacggcgagttcctgatcgactcggtggagcacacctacagctccagcggatggaccactgtcgtgcaatgcaacggcggccgaggcggcaaggggtgacgcctgaaacccaccggagtgcaggaggatcgatgaaactgaccgagcagcaattgctgcgcatttttcccaacgcccgcctcgtcgcgggcgttttcgttgcggcgttgcaacgggccatggacgagagggagatcgacacaccggcgcggcgtgccgcgtttctcgcccaggtcggccacgaaagcagccagttgacccggctggtggagaacctcaactacagtgcccaaggcttggcggcgacctggccgggccgctatctcggccccgacgggcagcccaacgcgttggccttgcggctggcgcgcaatccgcaggcgattgccgacaacacctacgccacgcgcaacggcaatggcgacgaagcgtccggcgatggctggcgcttccgcgggcgtggcttgctacagatcaccgggcgtgccaactaccggttggtcggcgaggccctcggcgagccgctggaagccgagccctggcgcctggagcagcccgtgccggcggcccgcagcgccgcctggtggtgggccggtcacgggctcaacgagctggccgaccgcggcgagttcgctgccatcacccgccgcatcaacggcggcctgaatggccaggcggagcgcctggcgttgtggcagcgggccagggcggtgctgtcatga

SEQ ID NO: 10856 - DNA, 348 bp, Pseudomonas aeruginosa
atgaatctcaacgaacttcgtgcggcgggcggtttcatcgagtcggcgctggtgcgcaaggagattacctggacccgcgttcccgccggcaggaagaaggcggtcagcgacaccttccaggtgttcgtccgacgcaacagttttggcgcggtggagcgcctgttctccgccgaaggcgaccagcagagccgcaacgcgcgctacctcgccgaatgcattcgcctgggcgagacgggagaggaaagcctgacctacgaacaggcctacgacctcgacccggcgctgggcttcctgctgctgcaggcggtcggtgaggtcaaccgggtcgaggacgcggaaaaaaactga

SEQ ID NO: 10857 - DNA, 1839 bp, Pseudomonas aeruginosa
atcatggccacgaataccgacggcagcctgacgctcgacctggtccttcgcagcgaagggtacagggccgggatggacaaggttggcaggatcaacgatcagaaaatgcgcgccatggaggcgcgcgcggaaaaggctggcaaggctatcggcaaaagcctggacagttcggcactgattgccagcagcgtgctggaccaggcgctggacatgctgggcaggaccagtcgccaggcgggtcaggccaagaagcctgtgcagagcgcccaggacaaggtactggccgagtggaagacccggcagaaggagctgggcgaagcctggaagagctatcgcgaaccactccaggatctgtccaagctcaacgaagcactactgaagaactcttccgacaagctcgacaaggcgctgctcaatctcagcgagaccggcaagctgtcgcttgccaacgtgggcaaggccgcctacgccgatgctgcgcgcctcgcctcgcggcagatgaccctgatgctgctggacgggctgtttggctgggtcgccagcgtcggtaccgagaagcccaaggtcgacgacaaggcgggcaagggacaggcgaaggctggcgacgacgagaaggaacagccgtcgctccagtcgcaggtcttcaagcagtggctgttgcagatgaacagtgtctggggcgcctaccgcgcgcccctgcaggatatctccgggatgaccgacgagctgttcaggaatgcgtcggagaagctcgagaagtcgctgttcaatttcgccactagcggaaagctgtccttgagcaacttcgccaagacggtgatcgacgatgtcgcccggatcgccgcgcggcagctttcaatgctcgccctggacggattgttcggctggatgaatggcaaggccggcatcaccgaggcgcaactggccagccagaagccctatacctcgctactggaaaaggcccgcgcagctgcgggacaagcggcagcgggcgctcccgcggcccagggtgccgcgccaatgccggcagcggcgatggatgtcggcgcgatggtggccactgcttccgggcagaccggggacggttccaaggtctcggctggaggggcttcggccgctggcaagccggtgggcagttgggtcgaacagatggacgcctcctgggcgagcctgcgcgaccaggcgcaggacgtctcgggaatgatggacatgctgtttaccaacgccttcaccaatatggagaacgccctgttcacctttgccaccacgggcaagctgtcgttcaaggatttcgccgactcggtgatccaggatatggcgcggatcgccgcgcggcaggcgacgctgcagatcatcggcagcatcgtcggtgcggtcagcgggttcttcggtagcggcgcaacggcgggctcgcggatttccgactataccggctcggacatggccaattgggtcagcaagcaacgcgccggaggcatgcctgggttcgccaggggcggtgccttcaacgatggcatccagagcgcgccggcgctgttcagcatggccggcggtcgtccggcgctgatcggcgagcgtgggccggaagccatcatgccgctgagtcgcggttccgatggcgtgctcggcgtgcgcgcgctcggcggcggcgaggggggcaacgtcttcaatttctccaccagcgtcagcctgggcggtggccgcgagggcgcggcgacggccagcggcgacgacggtacgggacagcagctggcgggaatgatcaacgatgccgcgcgcaacgtggtggcgcaggagctgcgccccggcggcctggtatggaggatggtgaatggctga

SEQ ID NO: 10858 - DNA, 888 bp, Pseudomonas aeruginosa
cctgggagctgtccgctccgccggatttccagggccagcagatcccggcgcgccagatcacctcgctgtgccactggtgcatcaccaacgagtaccgcgggcaggactgcaactacaccggtacggcgatgttcgatgccgacggcaatccggtggacgatccggcgctggaccgctgcggcggccgggtcagcgattgcaagctgcgcttcggcgcggacaacccgctgtcccacggcggcttcgccggcgccggcctggtcaggatgtgagcatggaactgagccgcagcctgcagcgggccatcgccgcacacgccgcccgcgagcatccgcgcgaatgctgcgggctgatcgttcgcggtgtgcgtcaacgccgctacgtggcctgtcgcaacgcagccggatcgcccagcgagcacttcgtgatcgatcaccaggactggtgcgccgccgaggaccagggcgaggtcctggccatcgtccacagccacccggacgttccggccacgccgagcatggccgatcgggtcagttgcgaactgcatggtctgccctgggtgatcctgtcctggccggaaggcgatgtcgcgcatctagcgccggagggctatcgggcgccgctgctcggccgcgagttcgcccacggcgtgctcgactgctggagcctctgtcgcgactggtaccgccgcgaggcaggtctggagcttccggactatccgcgccgcgacggttggtgggaaaccggcgagagcctctacgagcagcactatgcggcggctggattccggccggtgccgctggccggaatccgccgcggcgacatgctggtgatgcaggtcgggagggcgctgcacccgaaccacgcgggcatctacctgggcaatga

SEQ ID NO: 10859 - DNA, 627 bp, Pseudomonas aeruginosa
tcgacgccaagctgcgctacccgaacaccgcgctgctgttcgtcgagttcgatgccagccagttccagagcattccgcagatatcggtggaagcgcgcggccggcgggtgcgggtgccgagcaactacgatccgcagacccgtagctacagcggcacctgggacggctcgttcaagtcggcctggaccagcaacccggcctggcactggtacgacatcgtgttgcacaagcgcttcggcctcggtcggcggatcgacgcgagcatggtcgacaagtggtcgctgtaccgcatcgcccagtactgcgaccagtcggtgcccgacggcaagggcggccaggagccgcgcttcagctgcaacctgtacctgcagagtcgcgccgaagcctggacagtgctgcgcgacctggcagcgatcttccgcggcatgtcctactggtccggcgcggaaatggtggcggtatccgacatgccggaggacgaggcctacaccttctcgccgtcgaacaccgtgcgtggcgacgacggcagccacttcaactacagcagcagccgccagcgcgatcgccacaccctggccctggtcaactacgacaatccgggcaacggctaccagagccagccggtag

SEQ ID NO: 10860 - DNA, 600 bp, Pseudomonas aeruginosa
aagctgtgccggcgaagacggcgccgccgaacgcggcctactggtccgatatcggccagtcgctggaaaccgccaacgggctggcgcagcaggtggcgagccataccgctgaaatcagcgaactcgacggcagccttaccgcccaggcatcgcgccttggcgtactgcaggcggcgacccgtgacgacgcggatgacggcaatggcgccatggccgatgccctgcgcggctggaagaccgttgcccgggcagcccaggaggaaaccgtacgggccaccgaaaacgaggcccaggccactcgcacgacgctactggaggcgcgcaccgccgatgccgaagggcgtatcgccacggtggaacgggtcgcgaccagcgatcgccaggccaccgcgcaacgtctggaccagctctcggcctcgatcggtggcaccgccgccagcctacagagcgaacagaccgcccgcgccaacgccgacagcgccctcgcacagcggatcgacaccgtgcaggcgagcaccgacaccaatagcgcagcgatccagaccacctcccaggcggtcacctcgctggatggcaacgtcaaggcgatgtacagcgtga

SEQ ID NO: 10861 - DNA, 342 bp, Pseudomonas aeruginosa
cgacaccattacggtgatggctgtggggaggtggtactgatgcgtatcgaactcagtccggttgtagtcctgcccgaggactcgactgatatggatgtcatggtttccggagattcgatagccgtctcgggtgtcatgtacgacttctcgcagttaccggaggggggatatctgccagcctctgccatccatgaggggcctttttccgggagggttaccagggcaggcggagagatatgcctgacattggtgtttcccatccgggggagctacagcgaagctgccaaattccctgtccccatccatatcgttgaagacggaaccgtggagttgcccaagtga

SEQ ID NO: 10862 - DNA, 627 bp, Pseudomonas aeruginosa
aatcaagaggttacagccagcatgctgctgatgatcgataactacgactccttcacctacaacctggtgcagtacttcggcgagctcaaggccgaggtcaaggtggtgcgcaacgacgaactgagcgtggaacagatcgaggccctggcgcccgagcgcatcgtcctttcccccggtccctgcacccccaacgaggccggcgtctcgctggccgtgatcgagcgcttcgccggcaagctgccattgctcggtgtctgtcttggccaccagagcatcggccaggccttcggcggcgaagtggtgcgggcgcggcaggtgatgcatggcaagaccagcccgatccaccacaaggacctcggcgtgttcgccggcctggccaatcccctgacggtgacgcgctaccactcgctggtggtgaagcgagagagcctgccggagtgcctggagatcaccgcctggacccaacatgccgacggatcgctcgacgagatcatgggcgtacgccacaagaccctgaatgtcgagggcgtgcagttccatcccgagtccatcctcaccgagcagggccacgagttgctggccaacttcctccgccagcagggcggcgtgcgtggggagggcaactga

SEQ ID NO: 10863 - DNA, 1263 bp, Pseudomonas aeruginosa
agtgctcaagcgtctcggcagcgagcatgtgctggtggtgcattcgcgcgacgggctggacgagttcagtctggccgcggcgacccacattgccgagttgaaggacggcgaggtacgcgagtacgaagtgcgtcccgaggacttcgggatcaagagccagaccctgatggggctggaggtcgacagtccgcaggcctcgctggaactgatccgcgacgctttggggcggcgcaagaccgaggctgggcagaaggccgccgagctgatcgtgatgaatgccggcccggcactgtacgctgccgatctggcgaccagcctgcacgagggcattcaactggcccacgatgccctgcacaccgggctggcacgggagaagatggacgaactggtggccttcaccgccgtttacagagaggagaacgcacagtgagtgtgccgacggttctgcagaagatcctcgcccgcaaggccgaggaggtcgccgagcgccgtgcgcgcgtcaacctggcagaggtcgagcggctggcgcgtagcgccgatgcgccgcgcggcttcgccaatgccctgctggagcgggccaagcgcaaggagccggcagtgatcgccgagatcaagaaggcatcgccgagcaagggcgtgctgcgcgaacacttcgtcccggcggagatcgcccgcagctacgaggcgggtggcgcggcgtgcctgtcggtgctcaccgacgtggacttcttccagggcgccgatgcctatctgaaggaagcgcgggccgcctgtgcgctgccggtgatccgcaaggacttcatgatcgatccgtaccagatcgtcgaggcgcgggcgatcggtgccgactgcatcctgctgatcgtctcggcgctggacgacgtgctgatggccgaactggcggcgactgccaagtcggtcggtctcgacgtactggtcgaagtgcatgacggcaccgagctggaacgtgcactgaagaccctggacacgccgttggtgggcatcaacaaccgcaacctgcacaccttcgaggtgagcctggaaaccaccctcgacctgttgccggaaattccccgcgaccgcctggtggtcaccgagagcggtattctcaaccgggccgacgtggagctgatggaagtcagcgaggtctacgccttcctggttggcgaggcgttcatgcgggccgacgatcctggcctcgagctgaagcgcctgttcttccaggagcgtggtggtgtggtgctgggcgccgatcctgactga

SEQ ID NO: 10864 - DNA, 882 bp, Pseudomonas aeruginosa
ccgtcctacgcaggtgcgtcgttcgcatctgacgggcatgccccaaccctgcggcagagccgcaagcaaccgagagagttccccacggtgaaaagcaaactcaagctccacgggttcaacaacctgacgaagaccttgagcttcaacatctacgacatctgctacgccgagacgcccgaagacctccaggcctacgtgcagtacatcgacgaagagtatgacgcggagcgtctgacgcagattcttaccgatgttgtcgacatcatcggcgccaatatcctgaacatcgcgcgtcaggactacgacccccagggcgccagcgtgaccatcctgatctccgagcagccggtcactccgaccgacagccagatcgaagagtccccgggcccgctgccggacaccatcctggcgcacctggacaagagccacatcaccgtgcatacctacccggaaatccatccggtggacggcatcgcgaccttccgcgtggacatcgatgtgtccacctgcggagtgatctccccgctgaaggccctgaactacctgatccaccagttcgactcggacatcgtcacggtcgactatcgggtccgcggcttcacccgcgacatcgaggggcgcaagcatttcatcgaccacgagatcaactcgatccagaactatctctccgacgacacgcgcgaggcctaccagatgaccgacgtgaacgtgtaccaggagaacctgttccacaccaagatgctgctcaaggacttcgaactggagaactacctgttcggcgacgctacccggacgctctcggcggaacagcgtgagcaggtcacggaacggctcaagcacgaaatgctggagatcttctacgcgcgcaacatgccgcgctga

SEQ ID NO: 10865 - DNA, 1521 bp, Pseudomonas aeruginosa
cggtgcccgtcgcgaccgcccaagcgtgaaggagccgcagtgaagaacgacatacacgacctcggcctggtcctggattcccgggtcaagctgatcctgatcgagtcctgggacgagccgaaggtgatggaaaccctcaccggcctggcggtcaggcgcggccttggcctgtatgcctggtcggtgaccgagggcgtgcagcgcctgggcttcggcggcgagccgctgggcggggaggagagccgcgacccggtcgcggcgttgcgcttgatcaagcacgatcagcaggcgaatctctacgtgctctgcgacctgcatcctttccttggcgacagcccgaccctggtgcgcctgctcaaggaaatcgccatggccgaaggcaatcatcgaccgaccgtggtgctggtgtcccatgcgctgaagctgccggccgaggtgcagcgcttcgccgcgcggttctcgctgtccctgcccagcgaggacgaactgctcggcatcgtccgcgaggaagcgacgcgctggagcgagcgcaaccgtggtgcccgcgtgcgcaccgacaaccggaccctgcagcaggtggtgaagaacctgcgcgggctcagccatgccgaggcgcgactgctggcgcgcaacgtgatctgcaacgatggagcgatcacccaggaggacctgcccgagctgaaccgcaccaagttccagctactcgacctggagggcgtgctgagcttcgagtacgacaccgcgcgcttcgccgaggtcggcgggcttgccgcgctcaagcgctggctcggcgagcgtcagtcggcgttcctcgccggcacgcctggcgaccagccgaagggcatgatgctggtcggcgtacagggcgccggcaagagcctggcggccaaggcggtggccggcctctggggcttgccgttgctgcgtctggatttcgcctgtctctacaacaagtacttcggcgaaaccgagcgcaacctgcgcgaggcgctgcgcctggccgaacagatggcgccctgcgtgctgtggatggatgaagtggagaagggcatttctggtggcgaccaggacaacggcgtcagtcagcgcgtgctgggtaccctgctgacctggatggccgagcgcgaggcgccggtcttcatggtcgccaccgcgaacgctatcgaccgcctgccgcccgaactgatccgcaagggacgcttcgacgaattgttcttcgtcgacctgccgacgccggaggttcgcgccgagatcttccgcatccacctgcaacgccgcgagctggagccggcacagttcgacctccttctgctggcggctgccagcgagggtttcagcggggcggagatcgagcaggcggtggtggcggcactgtacgccgggcaggcgcgacagcaggcggtggatcaggatctgttgctcagggagctgtcgcgaacctcgccgctgtcggtgctgatggcggaaaagctcgccgcgctgcggacctgggccaaggggcgggcggtgccggcagactga

SEQ ID NO: 10866 - DNA, 390 bp, Pseudomonas aeruginosa
tgttgtaacgcacggcctcaagccgggagattcggaaacatgagcatcgagaccttcacccctacgcccctgctctttaccccaggcgcagccaacaaggtgaagacgttgattgacgaagagggcaatcctcgcctgaaactgcgtgtattcgtcaccggcggcggttgctcgggcttccagtatggcttcaccttcgacgaagatatcgccgatgacgataccgtgatcgagcgcgatggtgtgggcttggtggtggacccgatgagcttccagtacctggcgggctcggaagtcgactaccaggaaggcctggaaggttcgaggttcgtcatcaagaacccgaacgccgccacgacttgcggttgcggacagtcgttctcgatctga

SEQ ID NO: 10867 - DNA, 1140 bp, Pseudomonas aeruginosa
atgaagtcggttgaagagcagctggcgctgatccagcgcggtgcagacgagatcctggtagaggcggaactggtggccaagctgaagcgtggccagcccttgcggatcaaggccggcttcgacccgaccgctcccgatctgcatcttggccataccgtgcttattaataagctgcgccagttccaggacctggggcatcaggtgatcttcctcatcggcgacttcactgggatgattggtgaccccagtgggaaaagtgttacccgtcctcccctgacgcgcgagcaggttctggagaatgcggagacgtacaagtcccaggtcttcaagatcctcgacccggccaagaccgaagtagccttcaattccacctggatggaccaactgaccccggctgacttcattcgtcttgcctctcagtacaccgttgcgcgcatgctggagcgcgatgactttagcaagcgctatgccagcaatcagcccatcgctatccatgagttcctctatccgctggtccagggctatgactccgtcgcgctgaaggcggacgtcgagttgggtggcaccgaccagaagttcaacctgctgatggggcgcgagctgcagcgtgcctatggccaggaggcccaggtgatcctgaccatgccgttgctggaagggctggatggcgtgaagaagatgtccaagtcgctgggcaactatattggtatccaggaagcgccgggtgtcatgtacagcaagctggtctccattcctgacacgctgatgtggcgttacttcgaactgctcagcttccgttccctggatgagatcgatagcttccgcaaggacgtcgaggcgggcgccaacccgcgtgacatcaagatcaagctggccgaggagatcgtcgcccgcttccatggcgaggaggcggcggtgagcgcacacaagtcggccggcaatcgtctgaaggagggcgagctgccggaagacctgccggagatcgagttgtcgtcccccgaggatatgcccgttgcctctgtccttaataaggcggggttggtgaagaatgcggctgcggctcgcgatctcctgggtgctggcagcgtcaaggtggatgggcaggtcgtcgaccgcacctttcatgctggcgctgggtga

SEQ ID NO: 10868 - DNA, 627 bp, Pseudomonas aeruginosa
  unsure (14): Identity of nucleotide at the above locations are unknown.
gactggctcagacngaagcggctactgcggcggcaacctgatcgccatgctgatcgccagcaagggcgaggtggtccgcggccaccgtggcagccgggtgatcctcgaccgtgtggcggaggtcgatcgcctggtgaatcgcctacccgaggaactgaagaacgtggtggtggagcactatctcaatcgcgacagcttccccgagcagaagtaccgccactgcggttgcagccgcaacaccttctatctgcgcctgcatgtggcgcaccagggtatccaggacggcctgctgcggcgggtggcctgagttcctggactggataccgtgtcccccctggaattttccaaccggccttcgagccggtttttttatgcctgtcgcccatggaggcggcgagccccatgcacagcagcggaccctgcacggtagaggcggggtcgggctggcggagccatccttttcgtcagtcgatgccgggcttttccatatcggaagtgggtacgcgcttgcccggatgcctggcgaaggttcccagggcggtatatcaccctcatatcgtggtgcgtctccctcctattgcagtggattgtcgagaaggcattgccgggctgggaatcgggcggtaa

SEQ ID NO: 10869 - DNA, 588 bp, Pseudomonas aeruginosa
gccggactacttcgctccggaggcgctggcatgagctatgtcagtgcggagcatgaccgcatgctcgccgcgatgatcctgccctgcgtggtggtcgccgtggacctggcagcggcgcgggtacgggtgcgctccggcgactggaccagcggctggctgcgctggcactccctggcagccggcaaggttcgccactggcgtgcgccgagcataggcgaacaggggatactgctcagcccgtcgggcggagtgtcaatgggcacctttattcccggtctgtacggcgatgcgggcacggcgccggacaacagcgccagcagtgagacctggcgtttcgacgacggcgcctcgttgagttacgactgggctgcgcatcgctaccgcgtcgagctgcccagcggcaccgtggaagtgagggtcggcgccagcgaggtgcgggtcagcgacggggcggtcagtctcaaggcgccgaagatcagcctggaaggaccggtggagatcgccgggacactgacggtcagcggagacatcctcggcggcggctcgatcatcgacaccgtcggcaacagcaaccaccacacccattga

SEQ ID NO: 10870 - DNA, 873 bp, Pseudomonas aeruginosa
gcggcgtgttcgagggcgagcacatcaatatggaggtctcggcgtgatcatcgatctttcccagttgccggagccagaggttatcgaaaacctcgatttcgagacgatttaccaagagctgttgggcgacttccgcgaagccatggctggcgaatgggcagcggaggtggagtccgatccggttctcaagcttctgcaactggcggcctatcgagaactgctgctgcgggcgcggatcaacgatgcggcgcgggcggtgatgctggcatacgccagcggtgccgatctcgaccagatcggtgccggcttcaatgtgcagcgtttgctgatcaggcccgcacagcccgaggcggtaccgccggtggaggcgcagtacgagagcgacaagtcgctgcgcaatcgcatccagctcgcgttcgagcagctatccgtcgcaggaccgcggaacgcctatatagcccatgcactgggcgcggatggaagggtggcggatgcctctgcgaccagtccggcgccctgcgaagtgctgatcagcgtgctcggggtggaaggcaacgggcaggcaccggaagcggtgttgcaggcagtgcgcctggcgctgaacgcggaggacgtgcgtcctgtcgcggatcgggtaacggtgcgctcggcaggcatcgttccctatcaggtcaaggcgcagctctacctgtttcccggccccgaggccgagctgatccgtgccgccgccgaggcttcgctgcgcgactacatctccgcccagcgccgcctgggccgcgacatccggcgttcggccctgttcgccaccctgcatgtcgaaggcgtgcagcgcgtcgaactgcaggagcctgcggccgacgtggtcctgaatga

SEQ ID NO: 10871 - DNA, 2118 bp, Pseudomonas aeruginosa
ccgacggcgacaccctggaaatcttcccctggaaacagtgacatgacgaccaatactccgaaatacggtggcctgctcaccgacataggtgccgctgcgctggctgcggccagtgcagcaggcaagaaatggcagccgactcatatgctgatcggcgatgccggcggtgcgccgggcgacacgccggatccattgccttctgcggcgcagaagagcctgatcaaccaacgccatcgggctcagctgaatcggctgttcgtttccgacaagaacgccaataccttggttgccgaggtggtgctgccagttgaggtaggtggcttctggatccgcgagatcggcctgcaggatgccgacggcaagttcgtcgcggtatccaactgcccgcccagctacaaggctgcaatggaaagtggcagtgcgcggacccagaccattcgggtgaacatcgcactctccgggctggagaatgtccagctgctgatcgacaacggcattatctacgccactcaggactgggtgaaggaaaaggtcgctgccgatttcaagggccgcaagatcctggctggcaatggcctggtcggtgggggcgatctttctgccgaccgcagcattggcctggcgccttccggcgtgacggcgggcagctatcgctcggtcacggtgaacgccaacggggtggtcacccagggcagcaatccgaccaccctggccggctatgcgatcggagatgcctataccaaggccgataccgacggaaaactggcgcagaaagcgaacaaggccaccaccctggccggctatggcatcaccgatgcgctgcgagtcgatggcaacgccgtgtcatccagcaggctggccgcaccgcgcagcctggcagccagtggcgatgcctcctggtcggtgaccttcgacggcagtgccaatgtttctgcgccgctgagtctttccgctaccggtgtggcggcgggcagctatccgaaggtgaccgtggatacgaagggaagggtgactgctggaatggcgctggcggcgacggacattcccgggctggatgcgtcgaagctggtcagcggggtgctggccgagcagcgtttgccggtattcgcgcgcgggttggctactgctgtctcgaacagtagcgatccgaacaccgcgaccgtgccgttgatgctgaccaatcatgcgaacggacctgttgccgggcgatacttctacatccagtcgatgttctatccggatcagaacggcaatgcttcgcagattgcaacgagctacaacgctacatccgagatgtatgtacgggtgtcctatgcggccaaccctagcatccgggagtggttgccctggcagcgctgcgacattggaggttccttcaccaaagaggccgatggtgaactgcctggaggcgtcaacctggattcgatggtgacctcagggtggtggagccaaagttttactgcccaagctgccactggagccaactaccctatagttcgggccggcctgcttcatgtgtacgccgcgagtagcaatttcatctatcagacgtatcaagcctacgatggtgagagtttctatttccggtgccggcattcaaatacctggtttccctggcgtcgcatgtggcatggcggagacttcaaccccagtgactatctgttgaagtcggggttctattggaatgcgttaccgggaaaacctgccacttttccaccatccgcacataaccatgacgtcggacagcttacttcgggcattctccccctggcacgtggcggcgtcggttcgaatacggcagcgggagcacgtagcactatcggagcaggggttcctgcgactgcttcccttggggcgagcggatggtggcgggacaatgacactggcctcattaggcaatgggggcaggtcacttgccccgccgatgccgatgcttcgattacgttcccgattcctttccctacgctatgcctcggcggatatgcgaatcagacgagtgctttccatccgggaacggatgccagtacaggtttccgtggagcgactaccactaccgcggtgattcgcaatggctactttgctcaggcggttctttcatgggaggcatttggacgatga

SEQ ID NO: 10872 - DNA, 225 bp, Pseudomonas aeruginosa
ttgttcgccatcgagatcaattggaaaccggaaaggaaacgaccttactccctgtccaataccatgaactcatgtcgtacagagccagcttacgggattggccggaagagcctttatttcccgacagtggcggacgtccgtccgtaccagattggctcagacgttatgtcaccccctgaaccccgcctcgtgcggggtttttcattaatggagatctacctatga

SEQ ID NO: 10873 - DNA, 486 bp, Pseudomonas aeruginosa
ttgcgccgggtcattcggcccagcaagcggtggccaccgccatggacgggctggccgagaaactgcgggccatcgccattctcgatggtcccaatagcaccgacgaggcggccgtcgcctacgccaagaacttcggcagcaagcgcctgttcatggtcgacccgggcgtgcaggtttgggacagcgccaccaatgccgcacgcaaggccccggcttcggcctacgccgccggcctgttcgcctggaccgacgccgagtacggcttctggtcctcgccgtcgaacaaggagatcaagggcatcaccggcaccagccgtccggtggagttcctcgacggtgatgagacctgtcgcgccaacctgctcaacaacgccaatatcgccacgatcattcgcgacgatggctatcgcctgtggggcaatcgcaccttgtccagcgacagcaagtgggctttcgtcacccgcgttcggaccatggacctggtga

SEQ ID NO: 10874 - DNA, 330 bp, Pseudomonas aeruginosa
gcagcggctacggcgaggtgcagatgggcctctggtgtctggtgcggatcagcgagaaccagagcgccctgctgggcaacggcgctccccgcaaacaaaccttcgacctggagttcaagcgctatggcgacgacctgccgaaccgctgacggcgacatgctggacagcctctgctaccacgtctatggccatctgttgggctgcgtcgaggcgaccctcgacgccaatcccgggctggccgatgagcagcagccattccgcgccggcttgctgatcagtttccctgacatgccggtggtcaatgtcgaacaggtgcgcctgtgggattga

SEQ ID NO: 10875 - DNA, 1047 bp, Pseudomonas aeruginosa
tcgaccgctcacccgcaaccccgccttggcggggtttttcttttctggagaaaccaggtgcaaccgagtttccgtatcgttgccgacggcaccgacgtcacccagcggctgaatgaccgcctgctcaagctgaccctgctggacaagccgggcatggagtccgacagcctgaccttgaggatcgacgatcgcgatggacaggtggccttacccaggcgcggtgcggtgctggaggttcatctcggctatgccggcgagccactgatgcgcatgggacgctttaccgtggacaccttgcagtgggctggtccgccggactgcctgaccgtcactgccaaggccggcgacatgcgcggcagtggcaagacgatacgcagcggaggttgggagggcactaccctggctcaggtctgccgcgatgttggcgcacgcaacggctggcgcgtggagtgtccgttgcaggtggcgatcgcccgggtcgaccaggtcaacgagtccgactaccacttcgtcacccgtctggcgcgccaatacgactgcaccgccaagctggccgagggcatgctcatggtgctgccgcgacagagcgggcagagcgccacggggcgtcggatcgaacctttggtgttgggacgtgctgacgtcggcagcttcgacgttacctacgacgaccgcagcctgatgagaacggtgaagacccgctaccaattgcccggcagcggcgaggtcaagagcgtcgagctgaagaacccgaaggcaccggctacggctacgggcgagcatgtcgaccggcatctctatgccagccgtggagaggccgagcaggcggcgaaggctcgcctggcgagcttcagccgctccagtgccagtgtgcgcctggagctgccagggcgtggcgacctgttcgccgagcgcagcctgctgctccaaggcttcaaggcgggaatcgacggcgagttcctgatcgactcggtggagcacacctacagctccagcggatggaccactgtcgtgcaatgcaacggcggccgaggcggcaaggggtga

SEQ ID NO: 10876 - DNA, 750 bp, Pseudomonas aeruginosa
ttccgcagcgttgtcgagccgggaatcggtcggtacaacgtagtcatgcttgtacaggtgtgtccccccagggatgtcacctgcaacctcagagcccggccagtgtgccgggctttttcgtttgcatccgacaacggctcgggacgtggaggctcctcgccgaccgcgtaccgcgccacggctgaccgtcctggaggcggggccagacgacccgcctggtgcgggtcttttcatgtgcataaaggagagttttccatgtccatcctgactcaaggtacccagatctacgccctggttccgccggtatccggtaccggtgccgctaccgtcctggagatcgaaggcgtgacctcgttcaacccgggcggcaatccggccgaccagatcgaagacccgtgcctgagcgacacttcgcgcaagtacaagaaaggcctgcgcacccctggccaggcgacactcggcatcaacgccgatccacgcctggccagtcacgttcggttgttccagctgtccgagaaagatggcgagacgagcgtcaagtgggccatcggctggtccgacggaatcgacgtaaagccgaccgtcagcaccgaaggcgacgatttcgtgctgccgccggcgcgcacctggttcaccttcgaaggctacgtcagcgacttccccttcgatttcgccagcaacacgctggtcgctacccaggccaccatccagcgttccggcgccggcaagtggacgccgaagtcggcttga

SEQ ID NO: 10877 - DNA, 342 bp, Pseudomonas aeruginosa
atggctgatctggaacgctttacctgggacatctcgatcgattccgccggccaggcgaaccaactggtacgtcaggtgcagtacggcggcggctacagccaggcgctcggcgacgggctgaacaacctcagcgagacctggcaggtttcgcgtaccggcgatctcgcgctgatcggcccgatccgcgatttcctcaagcgccacggcggctaccgctcgttcctctggaccttgcccactggcgaaccggtacgggtgcgcgcccagggctggcaattgcggccgcgcggcaacggcgtgttcaccctgaacaccaccttccagcaagtcttcaatccgtga

SEQ ID NO: 10878 - DNA, 1251 bp, Pseudomonas aeruginosa
cgtgggcaacatcgacggcagcatcagcgcgctctgcctgttcttcgatggcctggtaggcgcgcgcctgaccgtgcgcgagacctatgcgcactacctggatgcggccaacttcgccgaaggcaacccgcaggccgacccctcccaggagcgcctgaacatctggttcctcgagcagaagaccgccgagaacagcgtccaggtgacctgggagctgtccgctccgccggatttccagggccagcagatcccggcgcgccagatcacctcgctgtgccactggtgcatcaccaacgagtaccgcgggcaggactgcaactacaccggtacggcgatgttcgatgccgacggcaatccggtggacgatccggcgctggaccgctgcggcggccgggtcagcgattgcaagctgcgcttcggcgcggacaacccgctgtcccacggcggcttcgccggcgccggcctggtcaggatgtgagcatggaactgagccgcagcctgcagcgggccatcgccgcacacgccgcccgcgagcatccgcgcgaatgctgcgggctgatcgttcgcggtgtgcgtcaacgccgctacgtggcctgtcgcaacgcagccggatcgcccagcgagcacttcgtgatcgatcaccaggactggtgcgccgccgaggaccagggcgaggtcctggccatcgtccacagccacccggacgttccggccacgccgagcatggccgatcgggtcagttgcgaactgcatggtctgccctgggtgatcctgtcctggccggaaggcgatgtcgcgcatctagcgccggagggctatcgggcgccgctgctcggccgcgagttcgcccacggcgtgctcgactgctggagcctctgtcgcgactggtaccgccgcgaggcaggtctggagcttccggactatccgcgccgcgacggttggtgggaaaccggcgagagcctctacgagcagcactatgcggcggctggattccggccggtgccgctggccggaatccgccgcggcgacatgctggtgatgcaggtcgggagggcgctgcacccgaaccacgcgggcatctacctgggcaatgactggcgtctggacagcgagccggtccaggcgctcggcggcgacggaccgttcctgctgcaccacctgtacggacggctgtcgacccgcgacgtgtttggcggaccctggatcgaacgcacgcgcctggtcttgcggcacacgcggatgccgcagtga

SEQ ID NO: 10879 - DNA, 657 bp, Pseudomonas aeruginosa
acgacatattcaagcgagccgtcggaatcggctctttacgagaggaacaggtccatgaatgacaccctgagtcagggcctcaccaccatccgtctatacggggttctgggcaagcgcttcggccgcatgcacggccggttattggaaagcggcacggtacgcgaggcgatgagcgccctgaagcacaccatggagggattcgagacgttcatgcgcgaggcggaatcgaaagggctgaccttcgccgtgttccgtgggcgtaccaacctgtccggcgagcaactggacatgcgcggacgcgaggatatccgcatcgtgccgttggtgatcgggagcaagcagtccggattgtttcagacggtattaggagctgcactcattgccgtaggtgtcttcgcaacgagtcttacgctcgggacaagcacgtttctgatctctgccggcgccagcatgatgctcggtggcgtcatgcagatgctcagcccccaacccaagggcctgaagggccgagaggcccccgagaacgcccccagctatgccttcggcggcccggtcaacaccatcgcccagggccatccggtcggcgtgctctacggcaagcgccgcatcggcggcgcggtgatcagcgccggcatctatgccgaggaccggctgtag

SEQ ID NO: 10880 - DNA, 861 bp, Pseudomonas aeruginosa
tcgagcgcagcgccgctacggcatcagccagttggagatcaccgcgatcggctgcacctccgagggcgaggcgcagcggcgtggccagtgggcgctgctgaccgaggagctggagcaggacgcggtgaccttccgcaccggcatggatggccgtgggctggcgccggggaagatcatcgccgtagccgacccggtcaagtccggcaagcagatcggcggacgcctgagcgcggtggatggccgcgcgctgaccctcgaccgcgacgtcgaggcccgacccggcgatcgcctgctggtcaacctgccgaacggcaaggccgaggcgcgcagcgtccagtcggtggtaggccgcgtgctgaccgtgaccgccgcctattcggagacgcctcggccccaggggcagtgggcgctgcagagcaacagcctgaccacccagcgcttccgcatcatgagcatcacccggccggaggacaatcttttcgagatcaccgcgctgcaacacaacgcgagcaagttcgacgccatcgacaacggtgcgcgcatcgagctgccgccggtcaccagcattccgccgggcgtgcaggcgccgccgcagaacgtgcggatcaaggctttcaccaaggtcgaccaggggttggcggtgaccagcctgtcggcctcctgggatgccgcgccgaacgcggtggcctacgaggccgaatggcgcaaggactcgggcaactgggtgcgggtgccgcgaacctcggcgctcggtttcgacgtgccgggcatctatgccggtcgttatctggtgcgggtacgcgccttgaacgtgatggaggtcggctcggtctacgccagcagtgtggagaccgctcttga

SEQ ID NO: 10881 - DNA, 396 bp, Pseudomonas aeruginosa
caccgccagcgtggccagcgggatggccgccagctatgtcgccatggggaggtggaattgatgaagctgttgttgaaacctttgttgcagcagggcatcacgcctgacagggaacgtctcagcgatgtccaggtgcgagggtcggtgtttatcctggatggcgtcgaatacgatttcggaagaatgcagcctggggggtacctgcctccggaggcataccatgatacgccattcattgatattcgcttcgtggacggcgaccgcctgtacctgcactacatccaccaggtgacctctgaagtgatgatgcagtttcccagggagatcgagtcaattccggtcgaccaggatggaaaagtcgaggtagcgttcagctatgaacatccaatgggataa

SEQ ID NO: 10882 - DNA, 1101 bp, Pseudomonas aeruginosa
  unsure (618): Identity of nucleotide at the above locations are unknown.
ccctatcaagcccgccgactgcgggtttttcattatctggagaacgtcatgccttggtattccacaggcacggtttccgtcgtcctcaattcggacacggtgaccggcagcggcaccgccttcagcgccaatgcgcgcgccggcgatgccttcagagggccggatggccgttggtacgagatcggcaacgtcaccagctccaccgtgttgaccatcaagcccgcatatcaaggagctaccgccaacgggcaggcatattcgatcaccccggtgcaggggtactcgaagacactggcggatcagttccgtgacctcagcaatcaatggggttccctcctggcggcagtgaagccttgggcgatagcgtctaccggttcgcaggcgcaggctgacatggggatcaccgaagttggccgtgctatcaatggagcctctaccgtaggcaatgcattggggtttttgggaggtgtttccaagacccaagcccccatggccctggatatggacacggtgaacgaaagcggatggttttcgataacccccaatacttacaacgtgcctctcggaaacaacaatatcagcggtgtgaacggccatgtcgctctgtcgatggtattngacgccagtacccgctatcagctgttcttcgtgagaaataccaacctcccagaggtttggtacaggagctgtaccaatggaacctggaaggaatgggtcaggttttatacgacagacaatatcgtggggaccgtaacgaggcgacttgttacgggtaagcccaccggggctgtgatggagagcgggacaacttccaacggctggtacgttcgctttgcggatggtacccagatggcagcggcaagatccgaaccgggcctttcgtttggagctaacgtgatacagctaccagctgccttcgttacgggcttcaataccggggtgacctgcaattggattccctccagcggatggcctgccactgcagggcagggggttcgtggagcctatctcaacggtagcagctctgtttctttcgcgacggcgcaggcactgggggctaacgacaccattacggtgatggctgtggggaggtggtactga

SEQ ID NO: 10883 - DNA, 1161 bp, Pseudomonas aeruginosa
atgtcgagggcgtgcagttccatcccgagtccatcctcaccgagcagggccacgagttgctggccaacttcctccgccagcagggcggcgtgcgtggggagggcaactgagatggatatcaagggagccctcaatcgcatcgtcaaccagctcgacctgaccaccgaggaaatgcaggcggtcatgcgccagatcatgaccgggcagtgcaccgacgcgcagatcggcgccttcctgatgggcatgcggatgaagagcgaaaccatcgacgagatcgtcggcgcggtggcggtgatgcgcgaactggccgacggcgtgcagttgcctacgctgaagcatgtggtcgacgtggtcggcaccggcggcgatggcgcgaacatcttcaacgtatcctcggcggcgtccttcgtggtcgccgccgctggcggcaaggtcgccaaacacggtaaccgcgcggtctccggcaagagcggcagcgccgacttgctggaagccgccggcatctacctggaactgacctccgaacaggtggcgcgttgcatcgacaccgtcggcgtcgggttcatgttcgcccaggtccaccacaaggcgatgaagtacgccgccggtccgcgccgcgagctgggcttgcggactctgttcaacatgcttggcccactgaccaacccggcgggagtcaggcaccaggtggtcggggtgttcacccaggaactgtgcaagccgctggctgaagtgctcaagcgtctcggcagcgagcatgtgctggtggtgcattcgcgcgacgggctggacgagttcagtctggccgcggcgacccacattgccgagttgaaggacggcgaggtacgcgagtacgaagtgcgtcccgaggacttcgggatcaagagccagaccctgatggggctggaggtcgacagtccgcaggcctcgctggaactgatccgcgacgctttggggcggcgcaagaccgaggctgggcagaaggccgccgagctgatcgtgatgaatgccggcccggcactgtacgctgccgatctggcgaccagcctgcacgagggcattcaactggcccacgatgccctgcacaccgggctggcacgggagaagatggacgaactggtggccttcaccgccgtttacagagaggagaacgcacagtga

SEQ ID NO: 10884 - DNA, 648 bp, Pseudomonas aeruginosa
aaaaggccggttgcgaccggcctttttcatgggtgctgttcagcgggtgccgaagaccaccatggtctttcctttcacatgcaccaggccctgctcctccaggctcttcagcacgcgtccgaccatttcccgcgagcagccgacgatccggccgatctcctggcgggtgatcttgatctgcatgccgtccgggtgggtcatggcgtccggttgctggcacaggtccagcaaggtgcgggcgacgcgtccggtgacgtcgaggaaggccaggtcgcccaccttgcgggtggtcttgcgcaggcggtcggccatctggctgccgagggtgtagaggatctccgagtcctgctgcgacagttcgcggaacttcgcatagctgatctcggcgacttcgcattccaccttggcacgaacccaggcgctgcgttcctgttcgctgccttccttttcgaacaatcccagctcgccgaagaaatcaccgctgttgaggtagccgatgatcatttcgcggccgtcgtcgtcctcgatgaggatggtgaccgaacccttgatgatgaagaacagcgtttcgcagcgatcgccggcatagatgatggtgctctttgcggtgtagcggcggcggtgacagtgtgcgagcagcttgtctag

SEQ ID NO: 10885 - DNA, 1305 bp, Pseudomonas aeruginosa
ggccaggccgataccgctggaagcgccggtgatcagggcataacggggcattcgagacttctccgaaacggacggggaattggaccccgcccgtcgcgaggggttgcgtggctactgttggtcgtcgtcttccatggcctctgccgccgccgtggcggcttcatcggcttcggccgccgctgcggcggcctgctcgtccgtggtgtacgggtcggctggagcgctggcgccgccgtcatagttcgcgcgctccaggtaaccctggtaggacggcagggcgatggcggcgatgataccgactatcggcagcaggatgatcagactggccaggactttcaccccggtgctgttcgccggcggcggcggaccgtagcggttggcgccggtgctgccgggcaggaccagcatcaggatgccgaacacgctgccgacgaaggggacgaagttgagcagccagagccagcccgaccagccgaggtcatgcaggcgctgcacgccgatcatcacggcaatgacgatgaaggcgatcgaggccagggcggtgacggccacgccgacggtttcgccgagcaggaagcccaggcccatgatgacgaggaaacagagcgtcatcgccatcgaccagccgagatagcgcaggcgtccgatccggccgttggtggtgaacacgttcagctcgccgaactcggggagggcttcgccgacctgggcgctgggtggtgtgtagggagacgcgcccgcgcccgcggccgcggaggccgcaggcgcggcgttttcgccgagctgcgcctggcgcgccaggtacttctcgatgatgatgccgcaagccgaacattccgctccgctgggctgttcatggccgcatttcgggcaggtcatgggaggcaggtcttgcgctggggtttcctccgcgacctgggggttgtgatcgggcgtttccaccaggctcaggctggccgccaggtcgacttccttgtaggcattggcgccggcctggcgcagggcggtcaggtaacgctccgcctcggcctctggaagttcgcgtttcagcaccaccgggcggccgccgaagagggcgtcgatcttgcccggttcgctcttgaacaggcgggcgagattgtccttcacggtttcgagcgatgcgtcgggcatcagctcgccggagaagacgatcttgaagcgttggtcggtcatgcaggcatccttgtcagctggggtgagagaaatgcagccgacagcctaatcggcggccttggcgcccacaagcgcgagatgagaactcccgcacaagccggggcgccgtga

SEQ ID NO: 10886 - DNA, 903 bp, Pseudomonas aeruginosa
cgtgcgtggcgccaatgtctgccgaatcgccgtgcatcgcccccagggcggcgacctggtggtggtgctgtcggtgatcgacaacctggtcaagggcgcctcgggtcaggcgctccagaacatgaacatcctgttcgggctggacgagcgcctgggcctctcgcatgcggccctgctcccctgatgtccggctgggaactccagttccgtgatccacggcgggcctggctggtccgcctcggggtgggtgcgctgctgctggcggttccgctggcgtttctcggcggtcgctggtcgaccggggcggacgccgctcgcagcgaggccgattcgcaacgccaggaaaccctgatcggcgagcagaaggccgagctggagcgcctgcgtaccgaaatcgaggtgttgcgcagcggagaacgcctcagccagcaggccaccgaacagagccggcagaccatcaagctgcttgaggaccaggtgttcaagcagcaacaggacatcgcgttctacaagggggtagtcgcgccggccagcaaggcggatgcgctggaaatccgtgcctttgaggtgcagggcacggacgacccgcagcgcttccgctataaggtgatgctcagccgcctgggcagggacgaccgcaagctggatgggcggctgaaagtccgcatcagcggcaagctggcgcgcaaggacgctacctacgacctcgaacagctctcgccggaactgggcaagacagggctgtcgatttccctccggcatttccagtcgatcccagaaggggggcgtttcgccgagctggagctgccgaagaacttcatcccgaagctgatcgacgtacgtgcggagctgaatggccagtccaaaccgctacagcgccgtttcgattggccgaagcagtga

SEQ ID NO: 10887 - DNA, 423 bp, Pseudomonas aeruginosa
gtgagcattatgtggagcaagaacaaaggccgggccgacgtccagcgtttcaccgggcagaccagcctgatcgccagcggcgccgaactggtcggtgacatgaacctcaagggcgcggtgcagatcgacggcaccgtccgcggagcgttgcaggcgcacgaagggctggtgcgggtcagcgccggcggtcgagtcgatggcgaaatccgggccccccatgtgatcatcgacggtcaggtggatggcgacatccatgccatcgaacgcctggagctgggggcccaggcccgggtgaagggcaatcttcactatgggctgatcgaaaccgccatgggggcccagatcgagggccgcctgtgcccgatgaccgaggccagtccgcgcccgctggaactgcctgccagcgtggaaactgtggattag

SEQ ID NO: 10888 - DNA, 1668 bp, Pseudomonas aeruginosa
agtggcgagcgggttcatgtcggatggtttgaccgtgactgccgatggcacggacttcgtcggggctcatctgctgctggagcagcagttcgcgcacgccctgtgctgcaagggcgacccagcgttgctcgacttcggcggcgcgggcgatttcatcgggaccggggacgcacagggcgaggatgtcttcgcgcagcccggccggcatgggtaggtaatgggaagcgagcaaggtggtgcgatcaccttgctcgatcaggacgatgtccatgccgtccaggctggttccggacatcaaccccaggtagcgcggcacgatcagcgctgcttgttcagggccaggagggttttcttctcctgatccatgcgcgcgatcatcggctgggtctgcgccatgaagcgcttgcgatctgcgccaccgagcgggtccgccatgggcagcttggcactcagcggatcgacgtgacggccattgatctggaattcgtagtgcaggtgtgggccggtggccaggcccgtcatgcccacgtaaccgatgatctggccctgcttcacgctggtaccggcgcggatacccttggcgaagcggctcatgtgtccgtagatggtccgatagcgctggccgtgctggatcaccacggcgttgccgtagccccccttgcgtccggcttcgaggatcttgccgtctccggtggccttgatcggtgtgccgatgggggcagcgtagtcgacgcccttgtgcgcgcggatcttgttcaggatcgggtggcggcggcccagggagaagcgcgagctgatgcgggcgaaatccaccggcgtacggatgaatgccttgcgcatgctggagccgtcggcgcggtagtagctggtattgccctgcttgttggtatagcgcacggcggtgtaggtcttgccgcggttgacgaagcgggcggcgaggatattgccggtcgccacttgcttgccgttgaccttgtgttgttcgtagatcacgtcgaactcgtcgccttctcgcagatcgagggcgaagtcgatgtcgtagccgaagatgttcgacagcgacgtgaccaggttatagggcaggccggcgttacgaccggcaacgaacagcgagctggtgatgcggccatgggcataggcggtatgcaggtcgatctgggctttctcgcgtttgaaggagtagcccttgtcggtcttgtccaggccgatggtctcgagttcgctctgcttgactcgcagcgcctgcagctctcctttggggtcgagcttgagcttgacctcctggccgaccttcagatgagtgaagcgcttggcatccttgctgctggtcagcatgtcgtgcatggccgaggtggaaaggcctgccttggtgaatacggtcgacagcgtatcgccactggcgacggtgatggtcttccactcgggatcgacgggcttggtatcggcatcggctacagatgcgcccggcttgcccgagtcttgctcggcggtgttgtcgtcggaggcgccttctacctgagcgaaaggcgtgccttcgtcgctggaattggtgaccgattgcggcaggaggtcgtctttctcctgaaggaggcgatcggtgttgctttcaagctccagattgagcgtggtcctcttggcctcgacttcgctcgaggggaacaccagtag

SEQ ID NO: 10889 - DNA, 321 bp, Pseudomonas aeruginosa
  unsure (28): Identity of nucleotide at the above locations are unknown.
atctcttgtggtgagactggctcagacngaagcggctactgcggcggcaacctgatcgccatgctgatcgccagcaagggcgaggtggtccgcggccaccgtggcagccgggtgatcctcgaccgtgtggcggaggtcgatcgcctggtgaatcgcctacccgaggaactgaagaacgtggtggtggagcactatctcaatcgcgacagcttccccgagcagaagtaccgccactgcggttgcagccgcaacaccttctatctgcgcctgcatgtggcgcaccagggtatccaggacggcctgctgcggcgggtggcctga

SEQ ID NO: 10890 - DNA, 474 bp, Pseudomonas aeruginosa
aggtgcgtccccagggaggcactcgtgaagcaccggaacccggccctggcgccgggttttttattgcccgggaaaacgttcgtgcggacgtgcccggcgctgcctgccaaggagggacccatgggcaacgaaccgcagacactgacggaaatgccgctctgggtactgatcctgctcgccgcgctgggcggcgtcagcggcgagatgtggcgtgccgacaaggccggtctcggcggctgggccttgttgcggcgcctggcgctgcgctccggcgcgtcgatcgtctgcggcgtggcggtgatgctgctggcgttggcttgcggcgccgcgctgctgttcgccgcggcgctgggcagcctgaccgccgcggccggcgcggagatcgcagtcggtctctacgaacgctgggccgcccggcgcctgggggtttgcgagctgcccgaggaacagtcggacgaccgtggcccgcattga

SEQ ID NO: 10891 - DNA, 531 bp, Pseudomonas aeruginosa
tcgaaggagtcaaccatgcctgaacaggctgttacgctcgaggctctgtacgcggccatcgagcaggtactgcgtgagcgtctgccggaggcgcagttgatcggcttctggccaggcgtgccggaaaataccccggcggtttccctggagatagccgagctactgcccgagcgcgatcccggtaccggcgagagtgccctgctgtgccgcctgcaggcgcggataatggtgccgcctggtgccgatcgccaggcggtatccattgcttgcggaatcgttcggacattgcgcgagcagacctggaacctgtctctgcagccggcgcgcttcgtacgctcggccgtcgacggcagtcgcgaggagctgaagagcctgcgtgtctggctggtcgagtggacgcagtcgctgcgtctcggagacccggagtgggcctgggaggaccagccgccgggcagcctgatgctgggcttcgacccgcagaccggccccggccatgagccggactacttcgctccggaggcgctggcatga

SEQ ID NO: 10892 - DNA, 1155 bp, Pseudomonas aeruginosa
acagtccgtcgaggacatcctgaccaccccgttgggcagcaggcgcatgcgccccgagtacggcagcaagctgcggcggatggtcgacatgccggtgagcgaaggctggaaaagcgccgtgcaggccgaggtagcccgttccctggggcgctgggaaccgcgcatcgcattgtctgccgtgcgagtcgtcgcggtcgtcgatggccgcgtggatctgctcctgagcggcgtgttcgagggcgagcacatcaatatggaggtctcggcgtgatcatcgatctttcccagttgccggagccagaggttatcgaaaacctcgatttcgagacgatttaccaagagctgttgggcgacttccgcgaagccatggctggcgaatgggcagcggaggtggagtccgatccggttctcaagcttctgcaactggcggcctatcgagaactgctgctgcgggcgcggatcaacgatgcggcgcgggcggtgatgctggcatacgccagcggtgccgatctcgaccagatcggtgccggcttcaatgtgcagcgtttgctgatcaggcccgcacagcccgaggcggtaccgccggtggaggcgcagtacgagagcgacaagtcgctgcgcaatcgcatccagctcgcgttcgagcagctatccgtcgcaggaccgcggaacgcctatatagcccatgcactgggcgcggatggaagggtggcggatgcctctgcgaccagtccggcgccctgcgaagtgctgatcagcgtgctcggggtggaaggcaacgggcaggcaccggaagcggtgttgcaggcagtgcgcctggcgctgaacgcggaggacgtgcgtcctgtcgcggatcgggtaacggtgcgctcggcaggcatcgttccctatcaggtcaaggcgcagctctacctgtttcccggccccgaggccgagctgatccgtgccgccgccgaggcttcgctgcgcgactacatctccgcccagcgccgcctgggccgcgacatccggcgttcggccctgttcgccaccctgcatgtcgaaggcgtgcagcgcgtcgaactgcaggagcctgcggccgacgtggtcctgaatgaaacccaggcggcctattgcacggggtacgcgatcaccttgggaggcgtcgatgagtag

SEQ ID NO: 10893 - DNA, 801 bp, Pseudomonas aeruginosa
cgtgccatccctgaccctgcccaagctggctgtgaagaccgagcaataccgtgccggcggcatggatgcgccggtatccatcgacatgggcctggaggcgatggaggccaagttctccaccaacggtgcccgccgagaagcactgaatttcttcggcctggccgaccagagcgctttcaatggcgtgttccgcggctccttcaagggccagaagggcgccagcgtgccagtggtggctaccctgcgcggcctgctcaaggaggtcgacccgggcgactggaaggccggcgagaaagccgagttcaagtacgccgttgcggtcagctactacaagctggaagtcgatggccgcgaggtctacgagatcgatccggtcaacggtgtccgcgcgatcaacggtgtcgaccagttggccggcatgcgcaacgacctcggcctgtaagaggagctccggacatgacccaagagaatcgactgccgggctggctcacgctggatgctgacgccgccctcgttcgtctctcgcgtccggcacagtgcaacggggtcagcgtcgacacgctgaccctgcgtgcacccaccgtgcgtgatatccgcctggccggcaaggtggccggcgacgatgccgaggagcgcgaactgcaactgttcgcctcgctggcgcaggtcagccgccaggacctggaggggctgaagctgagcgactaccagcggctgcaaggagcctactttcgcctggtgcaagacgacacggacgacaccttcgcgtatgcgtcaactggcgaggcgcctggccattga

SEQ ID NO: 10894 - DNA, 318 bp, Pseudomonas aeruginosa
ggtcaaccgggtcgaggacgcggaaaaaaactgacccccgccgacgaggtttggcacgaactggtgctgaacggcgtcggcgggtcgaccattgccgaggccaaggagcggctcagctacgccgagtaccgcgcctgggtcgcctatctgaacaagcgcggctcgctccatccgggacaccggctggagcttgcgctggctcggatcgctgcgttgctcgggcatgcgctgggagcggacgccgatcccgacgcgttccgtccgcatatggctctccagcccctttcgctgcaccaggcgatggatcaatgggcatga

SEQ ID NO: 10895 - DNA, 825 bp, Pseudomonas aeruginosa
caggccaccccgctgcggcggggtctttttctggaagacatgaatcatggccacgaataccgacggcagcctgacgctcgacctggtccttcgcagcgaagggtacagggccgggatggacaaggttggcaggatcaacgatcagaaaatgcgcgccatggaggcgcgcgcggaaaaggctggcaaggctatcggcaaaagcctggacagttcggcactgattgccagcagcgtgctggaccaggcgctggacatgctgggcaggaccagtcgccaggcgggtcaggccaagaagcctgtgcagagcgcccaggacaaggtactggccgagtggaagacccggcagaaggagctgggcgaagcctggaagagctatcgcgaaccactccaggatctgtccaagctcaacgaagcactactgaagaactcttccgacaagctcgacaaggcgctgctcaatctcagcgagaccggcaagctgtcgcttgccaacgtgggcaaggccgcctacgccgatgctgcgcgcctcgcctcgcggcagatgaccctgatgctgctggacgggctgtttggctgggtcgccagcgtcggtaccgagaagcccaaggtcgacgacaaggcgggcaagggacaggcgaaggctggcgacgacgagaaggaacagccgtcgctccagtcgcaggtcttcaagcagtggctgttgcagatgaacagtgtctggggcgcctaccgcgcgcccctgcaggatatctccgggatgaccgacgagctgttcaggaatgcgtcggagaagctcgagaagtcgctgttcaatttcgccactag

SEQ ID NO: 10896 - DNA, 612 bp, Pseudomonas aeruginosa
cggaaagctgtccttgagcaacttcgccaagacggtgatcgacgatgtcgcccggatcgccgcgcggcagctttcaatgctcgccctggacggattgttcggctggatgaatggcaaggccggcatcaccgaggcgcaactggccagccagaagccctatacctcgctactggaaaaggcccgcgcagctgcgggacaagcggcagcgggcgctcccgcggcccagggtgccgcgccaatgccggcagcggcgatggatgtcggcgcgatggtggccactgcttccgggcagaccggggacggttccaaggtctcggctggaggggcttcggccgctggcaagccggtgggcagttgggtcgaacagatggacgcctcctgggcgagcctgcgcgaccaggcgcaggacgtctcgggaatgatggacatgctgtttaccaacgccttcaccaatatggagaacgccctgttcacctttgccaccacgggcaagctgtcgttcaaggatttcgccgactcggtgatccaggatatggcgcggatcgccgcgcggcaggcgacgctgcagatcatcggcagcatcgtcggtgcggtcagcgggttcttcggtag

SEQ ID NO: 10897 - DNA, 558 bp, Pseudomonas aeruginosa
cggcgcaacggcgggctcgcggatttccgactataccggctcggacatggccaattgggtcagcaagcaacgcgccggaggcatgcctgggttcgccaggggcggtgccttcaacgatggcatccagagcgcgccggcgctgttcagcatggccggcggtcgtccggcgctgatcggcgagcgtgggccggaagccatcatgccgctgagtcgcggttccgatggcgtgctcggcgtgcgcgcgctcggcggcggcgaggggggcaacgtcttcaatttctccaccagcgtcagcctgggcggtggccgcgagggcgcggcgacggccagcggcgacgacggtacgggacagcagctggcgggaatgatcaacgatgccgcgcgcaacgtggtggcgcaggagctgcgccccggcggcctggtatggaggatggtgaatggctgatctggaacgctttacctgggacatctcgatcgattccgccggccaggcgaaccaactggtacgtcaggtgcagtacggcggcggctacagccaggcgctcggcgacgggctga

SEQ ID NO: 10898 - DNA, 735 bp, Pseudomonas aeruginosa
acaccaccttccagcaagtcttcaatccgtgaggtaagcatgaccatcacagccgatgaccaggccctcgagcctggggcgctggtgcgcctgttcgacctggattgcaccgggttcggcggcgagatgctgcgcttccacggccacctgcagcaggggccgatccactggcagggcaacgcctaccaagcttggccactggaggcgcgcggcttcgagcagcgcggcgacggccgggccagttcgccgacccttagcgtgggcaacatcgacggcagcatcagcgcgctctgcctgttcttcgatggcctggtaggcgcgcgcctgaccgtgcgcgagacctatgcgcactacctggatgcggccaacttcgccgaaggcaacccgcaggccgacccctcccaggagcgcctgaacatctggttcctcgagcagaagaccgccgagaacagcgtccaggtgacctgggagctgtccgctccgccggatttccagggccagcagatcccggcgcgccagatcacctcgctgtgccactggtgcatcaccaacgagtaccgcgggcaggactgcaactacaccggtacggcgatgttcgatgccgacggcaatccggtggacgatccggcgctggaccgctgcggcggccgggtcagcgattgcaagctgcgcttcggcgcggacaacccgctgtcccacggcggcttcgccggcgccggcctggtcaggatgtga

SEQ ID NO: 10899 - DNA, 3624 bp, Pseudomonas aeruginosa
aggaacgtcatgaacaagaccatcacgggccacaagggtggcagcaagaagccgcgccagccggtggagatgccggactcggtgcgctcgatcgcgcgggcgaagattctcctggcactgggcgaaggcgagtttgacggtggcgtcgacggccgttcgatctacctggacgatacgccgctgctggcggcggacggctcggtgaacttccccggagtgacctgggagttccgtccgggctcggtggaccaggaacacattgccggtgtgcccgccgtggaaaacgaactggcggtcggcgtcgaactcaagagtgacgcgccctgggtccgcgcggtgagcaacacccagctctcggcggtgcgcctgcgcctgtcctggccggccatccagcgccagcaggaaaacggtgacgtggtcggctaccgcatcgactacgcgatcgacatcgccgtcgacggcggtgcctggcaggaagcgctgaaggcttcgctggacgacaagtccaccagccgctacgagcgctcccaccgtgtcgacctgccggaggcgcggagcggctggcaggtgcgcgtgcgccgcctgacgccgaaccagaacaacaaccgcatcgccgacaccatgcgggtcgaggcgatcaccgaggtgatcgacgccaagctgcgctacccgaacaccgcgctgctgttcgtcgagttcgatgccagccagttccagagcattccgcagatatcggtggaagcgcgcggccggcgggtgcgggtgccgagcaactacgatccgcagacccgtagctacagcggcacctgggacggctcgttcaagtcggcctggaccagcaacccggcctggcactggtacgacatcgtgttgcacaagcgcttcggcctcggtcggcggatcgacgcgagcatggtcgacaagtggtcgctgtaccgcatcgcccagtactgcgaccagtcggtgcccgacggcaagggcggccaggagccgcgcttcagctgcaacctgtacctgcagagtcgcgccgaagcctggacagtgctgcgcgacctggcagcgatcttccgcggcatgtcctactggtccggcgcggaaatggtggcggtatccgacatgccggaggacgaggcctacaccttctcgccgtcgaacaccgtgcgtggcgacgacggcagccacttcaactacagcagcagccgccagcgcgatcgccacaccctggccctggtcaactacgacaatccgggcaacggctaccagagccagccggtagcggtgaacaatgatcgagcgcagcgccgctacggcatcagccagttggagatcaccgcgatcggctgcacctccgagggcgaggcgcagcggcgtggccagtgggcgctgctgaccgaggagctggagcaggacgcggtgaccttccgcaccggcatggatggccgtgggctggcgccggggaagatcatcgccgtagccgacccggtcaagtccggcaagcagatcggcggacgcctgagcgcggtggatggccgcgcgctgaccctcgaccgcgacgtcgaggcccgacccggcgatcgcctgctggtcaacctgccgaacggcaaggccgaggcgcgcagcgtccagtcggtggtaggccgcgtgctgaccgtgaccgccgcctattcggagacgcctcggccccaggggcagtgggcgctgcagagcaacagcctgaccacccagcgcttccgcatcatgagcatcacccggccggaggacaatcttttcgagatcaccgcgctgcaacacaacgcgagcaagttcgacgccatcgacaacggtgcgcgcatcgagctgccgccggtcaccagcattccgccgggcgtgcaggcgccgccgcagaacgtgcggatcaaggctttcaccaaggtcgaccaggggttggcggtgaccagcctgtcggcctcctgggatgccgcgccgaacgcggtggcctacgaggccgaatggcgcaaggactcgggcaactgggtgcgggtgccgcgaacctcggcgctcggtttcgacgtgccgggcatctatgccggtcgttatctggtgcgggtacgcgccttgaacgtgatggaggtcggctcggtctacgccagcagtgtggagaccgctcttgagggcaagaccacgccgccgccggcgctggcctacctgcgctgcgtggccggcccctggcgcatcggcctggagtgggggttcccggccagcggcgcagcggacaccgcctacaccgagatccagcagtccgccactcccggcggcagcgaggagaccgcacgggcgctgggcctgttcgcctacccaggcaatacccacctggtatcgccgataccggccggcgaacggctggcgttccgcggtcgcttgatcgaccgtagcggcaacgtcggcgcctggtcgaactgggtcaccggcaccagctccagcgacgccagcgaatacaaccagttgatcacccaggagtacgtcgagtcggcgctgggccagcagttcttctccgatatcgagcggatgcaggtggatatcgggggcttgcagaagcaggtcggcgacctcgccgacgttctgctgtacgacccggctaaggtctacgcgaagaacgacatggtgcgacaggggcagcggctgtaccaggccctgaaagctgtgccggcgaagacggcgccgccgaacgcggcctactggtccgatatcggccagtcgctggaaaccgccaacgggctggcgcagcaggtggcgagccataccgctgaaatcagcgaactcgacggcagccttaccgcccaggcatcgcgccttggcgtactgcaggcggcgacccgtgacgacgcggatgacggcaatggcgccatggccgatgccctgcgcggctggaagaccgttgcccgggcagcccaggaggaaaccgtacgggccaccgaaaacgaggcccaggccactcgcacgacgctactggaggcgcgcaccgccgatgccgaagggcgtatcgccacggtggaacgggtcgcgaccagcgatcgccaggccaccgcgcaacgtctggaccagctctcggcctcgatcggtggcaccgccgccagcctacagagcgaacagaccgcccgcgccaacgccgacagcgccctcgcacagcggatcgacaccgtgcaggcgagcaccgacaccaatagcgcagcgatccagaccacctcccaggcggtcacctcgctggatggcaacgtcaaggcgatgtacagcgtgaagctccaagcgcatgccaatgggcagaagtatgcggcgggatggcaactggggttcgacagtgggacaagtgtgtcgaccatggcgtttcaggcggatcggtttatctggttcgacagctccagcgggacggcggtagcgccggtttccattgttaatggacagatgtttatcaagaacgccctgattcaggacggagcgatagataacgcgaaaattggaaatgtcattcagtcaaatgcaatgtccaataacggtatgccgatatggaggctggataaagcgggtacttatacagtacgagacagtgcaggccaggtcagagttgagatggggcttttacagtcatga

SEQ ID NO: 10900 - DNA, 1110 bp, Pseudomonas aeruginosa
tttttgggagataatgctatggcttggcattcgaaaggttcggtttccgtcacgctgaattccgaagcggtgttaggaaacgctactgattttatcgccaatgtgcgaaccggcgatgcgttccgtggccctgacggccggtggtacgaaatcaccaatgtgaccagtgcaacagttatttctatcaagcccaattatcagggtgcgaccgctagcggccaagtttatgcggttgtcccaatacatggttattcaaaaaacttggcagaccaattccgcgacatcaacaaccagtggggggccaccctggcagggatcaaaccctgggcggtgtcctcgacgggccagcaggcgcaggccgacatgggaatctcggctgttggtcgggccctgaacaatgcttcgacgccggccaacgccttgagttacctggggggcgtcgcgcccaatcagatgggctgggctggcaacgcgatgaatacggcggacctcgattcgctgaccgtctcggggctatacgctcatggcacggcggtgccttcgccggtgaacaatgcccagggctatgtcttgcatatgcagcacggcaacccagacttcgccgtccagcagtggtaccagttgaattccgccactggccagtacatgcggatcaaggccgggggtaactggtcgcgctgggtgttgcagtacagccagttcaaccttgtcggactggcgagcttcgatgcatcgaacaatccatccggcgccatcatccagcgcggcgggactgtcggtttcaacgagtatgtacgttacgccgacggaacccagatctgctggggcaacaccactaccaatgtgggagccaccatggcctaccagccggctggtacgttgtcgttctatatcactccggttgcttactcgtgggggttcccggtctcgttctcccggcctccgtctgtcatggtcaacccgatgagagcagcaggaaacaacgcttcccgtccctggggttcgacgatgtcggtcaccgaaacgctgttttcctggtacggctatgacaccgccagcgtggccagcgggatggccgccagctatgtcgccatggggaggtggaattga

SEQ ID NO: 10901 - DNA, 240 bp, Pseudomonas aeruginosa
cgttcagctatgaacatccaatgggataagtacgtcagccctgcaaaggccgcggcagatgtgcgcgatcaggccttggccagtgctcaggccaagcgccttctggcctatcgggaagaaagcgatccgctcaagaccgaagccgagttcgatgcgatcaaggccggcgtcgagccggactatggcgcctggatcgccaaggtggaagagatcaagtcacgatacccgatgcctgaatag

SEQ ID NO: 10902 - DNA, 255 bp, Pseudomonas aeruginosa
agacggaaccgtggagttgcccaagtgatcgattggaaaatgatgaaaacaccggatcaggtttccagagagcgggttcagcaagaatatgatgctgtgttggccagacgtgccgaggcctaccgtttggaaagcgatccgatcaaaacggaagtggagttcgattcgatccgtgcaggtgtggagacggattacgccgcctggcttgccaaggtcgaagagatcaaggccagatatccgctcccgcgcatctga

SEQ ID NO: 10903 - DNA, 426 bp, Pseudomonas aeruginosa
acgatgaaagcgcgtatccagtgggcgggcgaggcgatgttcctcggcgagtccggtagcggccacgtggtggtcatggacggtccgccggaccatggcggacgcaacctcggggtgcgccctatggagatggtcctgatcggcctcggcggctgcaccaacttcgatgtggtcagcatcctgaagaaggcgcgccagccggtggagagctgcgaagccttcctcgaggccgaaagggccgacgaggagcccaaggtgttcacgaagatccacgtgcacttcgtggtcaagggccgcggtctcaaggaggcccaggtcaagcgcgcggtggagctgtcggcggagaaatactgctcggcgtcgatcatgctcggtcgcggcggggtggagatcacccacgactacgagatcgtcgaactcggctga

SEQ ID NO: 10904 - DNA, 1008 bp, Pseudomonas aeruginosa
aggagccgcagtgaagaacgacatacacgacctcggcctggtcctggattcccgggtcaagctgatcctgatcgagtcctgggacgagccgaaggtgatggaaaccctcaccggcctggcggtcaggcgcggccttggcctgtatgcctggtcggtgaccgagggcgtgcagcgcctgggcttcggcggcgagccgctgggcggggaggagagccgcgacccggtcgcggcgttgcgcttgatcaagcacgatcagcaggcgaatctctacgtgctctgcgacctgcatcctttccttggcgacagcccgaccctggtgcgcctgctcaaggaaatcgccatggccgaaggcaatcatcgaccgaccgtggtgctggtgtcccatgcgctgaagctgccggccgaggtgcagcgcttcgccgcgcggttctcgctgtccctgcccagcgaggacgaactgctcggcatcgtccgcgaggaagcgacgcgctggagcgagcgcaaccgtggtgcccgcgtgcgcaccgacaaccggaccctgcagcaggtggtgaagaacctgcgcgggctcagccatgccgaggcgcgactgctggcgcgcaacgtgatctgcaacgatggagcgatcacccaggaggacctgcccgagctgaaccgcaccaagttccagctactcgacctggagggcgtgctgagcttcgagtacgacaccgcgcgcttcgccgaggtcggcgggcttgccgcgctcaagcgctggctcggcgagcgtcagtcggcgttcctcgccggcacgcctggcgaccagccgaagggcatgatgctggtcggcgtacagggcgccggcaagagcctggcggccaaggcggtggccggcctctggggcttgccgttgctgcgtctggatttcgcctgtctctacaacaagtacttcggcgaaaccgagcgcaacctgcgcgaggcgctgcgcctggccgaacagatggcgccctgcgtgctgtggatggatga

SEQ ID NO: 10905 - DNA, 561 bp, Pseudomonas aeruginosa
agtggagaagggcatttctggtggcgaccaggacaacggcgtcagtcagcgcgtgctgggtaccctgctgacctggatggccgagcgcgaggcgccggtcttcatggtcgccaccgcgaacgctatcgaccgcctgccgcccgaactgatccgcaagggacgcttcgacgaattgttcttcgtcgacctgccgacgccggaggttcgcgccgagatcttccgcatccacctgcaacgccgcgagctggagccggcacagttcgacctccttctgctggcggctgccagcgagggtttcagcggggcggagatcgagcaggcggtggtggcggcactgtacgccgggcaggcgcgacagcaggcggtggatcaggatctgttgctcagggagctgtcgcgaacctcgccgctgtcggtgctgatggcggaaaagctcgccgcgctgcggacctgggccaaggggcgggcggtgccggcagactgagccgacggctaacctcgttgccctgcgaggagaggccgatcaaccccgtggggcggagggtaccgccgaggcgttga

SEQ ID NO: 10906 - DNA, 1158 bp, Pseudomonas aeruginosa
actgccgaccgaagggccgaaccggtcgcaaagccggacgcccagcgctgttcatgccggcgctcggctcttatcattggcctcttttggctagcttgcttcagcgcgcggagtgatggacagatgatcaaggtcggcatcgttggcggtacgggttatacgggcgtggaactgctgcgcctgctggcgcagcatccgcaggcccgggtggaagtgatcacttcgcgttccgaggcgggggtgaaggtcgccgacatgtacccgaacctgcgaggtcattatgacgacctgcagttcagcgtgccggacgtgcagcgcctcggcgcctgcgacgtggtgttcttcgccacgccgcacggcgtggcgcacgcgctggctggcgaactgctggacgcggggacccgggtcatcgatctgtccgctgacttccgcctggcggacgccgaggagtgggcgcgctggtacggccagccgcatggcgctccggcgctgctcgacgaggctgtctacggcctgccggaagtgaaccgcgagaagatccgccaggcccgcctgatcgccgtgccgggttgctacccgaccgcgacccaactgggcctgatcccgctgctggaggccggcctggccgacgcctcgcggctgatcgccgattgcaagtccggggtcagcggcgccggtcggggcgccaaggttggctcgctgttctgcgaggcgggcgaaagcatgatggcctacgcggtcaaggggcatcggcatctcccggaaatcagccagggcctgcgtcgggcctccggcggcgacgtcgggctgacgttcgtaccgcacctgacgccaatgatccgcggtatccatgcaaccctctatgcccatgtcgcggatcgctcggtcgacctccaggcgctgttcgagaagcgctacgccgacgaacccttcgtcgacgtgatgccggccggcagccatccggagacccgtagcgtgcgtggcgccaatgtctgccgaatcgccgtgcatcgcccccagggcggcgacctggtggtggtgctgtcggtgatcgacaacctggtcaagggcgcctcgggtcaggcgctccagaacatgaacatcctgttcgggctggacgagcgcctgggcctctcgcatgcggccctgctcccctga

SEQ ID NO: 10907 - DNA, 894 bp, Pseudomonas aeruginosa
ccaggcgaatgccatgccctccatccaggcagggggaatgccgtattcgtcggtactggcgacccgagcttcgggcatcagcagggccaggcgcttcatcagcgccgtattgaaggcgccgccgccgcataccagcacctcttcgcagtccggctgggcgtccagcagcgattcgctgatgctgcgcgcgctcagttccagcagggttgcctggatatccgctgccggcaaggcagggtgacgagccaggtgctcctgcagccaggacaggttgaagcgctcgcgcccggtgctcttggggccacgcgcggcgaagaactcatccgccagcaggcttgccagcagtgcgtggttcatctggccgctggcggcccacgcaccgtcccggtcgaaatgttcgccgcgttggtgatgaatccaggcgtccatcagcacgttgcccgggccgcagtcgaagccgcgtaccggctttccggggctgagcagcgaaacgttgctgaagccaccgatgttcaggaccgccctggaggcgtcatcatcgccaaacagcgcctgatggaaggccggtaccagcggggcgccctggccgccggctgcgacgtcgcggcggcggaagtcggcgacgacatcgatgccggtcagctccgccagcagggcggggttgccgatctgcaccgtgaagtggcgagcgggttcatgtcggatggtttgaccgtgactgccgatggcacggacttcgtcggggctcatctgctgctggagcagcagttcgcgcacgccctgtgctgcaagggcgacccagcgttgctcgacttcggcggcgcgggcgatttcatcgggaccggggacgcacagggcgaggatgtcttcgcgcagcccggccggcatgggtag

SEQ ID NO: 10908 - DNA, 1401 bp, Pseudomonas aeruginosa
acgacctgccgctgctggagaaggtcagccggccggtggccgtcgaccccgatccgcgcctgcgcgccgaggcggaaaaacgcggctggccgatcatttccctgcgttgacccactgacaagcgcgccgtccgacgggcagcgccacggcggacccaggatgccccacactgcccccgctcccggctcgctgcggccggtcgtgatcgtcgccctggtcaccgcgctatgcctggccggcgattcgatgctttatatcgccctgccgatctactggcacgaggtcggcctggaggcgctctggcaggtcggcgtgctgctgtcgatcaaccgcctgatccgcctgcccttcaatccgctgatcggccgcctgtacaagcacctggcactgaagaccggcctgctcctggcggtcgtcatcggcgtgttgagcaccgccggctacggcctggccagcggtttcctggcctgggtgctgctgcgcggactgtgggggatcggctggtcgttcttccgcatcggcgggctctcggcggtggtctactgcgccgccgaccaccagcgcggccgcgccatgggcctgtacaacggcctctaccgcctgggcagcctggtcggcatgctgctcggcgggctgctggtgccggtcctcggcctgccggcgctggcgctgtccttcgcgatcctggcactgctcggcctgccgctgctggcgaagggtttcgacctaccggagaatcccgccggacatgcgcggacctccgccgcaacggcatccaccagcgtcgccaggcgcccgccgccgcgcggcctggtgatcctcagcggcttcgccaccgcgctcctgatccagggcgtactcgccgccaccctgagcgcgctgatcgcccgcagcttcggcaccgaggtcagcctgctcggcctggcgctcagcgccgccggcctttccgggatcatccaggccctgcgctggtcctgggagccgtggctggccgggcgcttcggtgcctggtcggatggcccgcgcgggcgtcggcgcttctacgtggctgcgctactggtcggcgcaatgggcttcggcctgctttccagcaggctgcccattctcgcctggctggccatcgccctgctggtgatgctggtcgccaccgccctcaccaccctgaccgacgccctcgccgccgacgtcgcccgcgccggcgacgtggtcggcttcatgacccgctactccatcgtccaggacctcggcgccgcgctgggcccggccctggccttcctcctgctggagcggcccggcggcttcgcctggttgtactggggcggctccctggcgttcctggtcctggcgttgctctggttgcgccgaggggactctcagaccggcttgttgaccatcaggtag

SEQ ID NO: 10909 - DNA, 942 bp, Pseudomonas aeruginosa
tcgccaggctgtagccaagcatcagccagaactgcgccagcagcgcgcgccggcgccagcggcggagcagcaggccgacgccgagcgcaccgtcgagcagggccccggcgatcaccgccaggctcgccggccagccgtggatgccggcctcgccgaggatccgcaggccccaaccgtaacccggccccaggcaggcgaccagggtacccagccagatcagcaccagggccgccagcatcagcggccgcatcagcgccgccaggctgcgtgccgcctgcggccagccgagcaggcgactggccagcggcgcgcaacgatagccgcaggccgcatcgaggagtgccgggtcggccaggttgtcgtggcgcaccagcttcagcatcgatggactcagtgtccgccagccagcacgccggccaagcccgcccaacgcatcgagaagcgccgcgggcggcaccacatagcggccgcgcggccaaccctgggcgcggcgcagctcgtccagcagctcgccctgggtcagcgcctgcggacccaccagcggaatcacctgcgcccgctccggccagcggcgcagcaaggccagcaccgcgccgaccaggtcctcgacatgcagcggttgcaggcgcgcgcgattgtccagcaagggaatcagcggtagcggcgacaggcgttccagccaggcgctgctggcgccgcccggccccagcagcagggacgggcgcagcaccagcgccgggatgcccagttccagcaggtggcggtcggccgccgccttgctggcgaggaaggccacgtccgggtgcgcaccggcgcccagcgcggaaatctgcaggaccttcgccccatgggctgcagcgaggtcgaagagtgttcgcgcgccgctgtcctggacgcgagccatgctcgcctcgtcgaggctcatggtgccggcggcattga

SEQ ID NO: 10910 - DNA, 750 bp, Pseudomonas aeruginosa
ccgacaacggcaatatcatcctcgacgtgcacaacctgcgcatcgacagcccggtggaactggaagagaagatcaacgccatcgtcggcgtggtcaccaacggcctgttcgccgcccgcccggccgacctgctgctgctcggcaccgccgacggcgtcaagaccctcaaggcctgagcccgctcgccccaggccgatgaccggtgcggggcgacactgcaacaaaagcggctacgctgtgtctcagcagacggctggtccgttgcgatccgccgcaccccgtgaacaaggagctagacatggcagccaaattccatctgaagaaagcgaaagacggccagttccacttcaacctgcatgccgccaacggcgagatcattctcaccagcgaactgtacaaggccaaggactcggcgctcggcggcatcgagtcggtgcgcaagaactcccagcgcgacggtgccttcgaggtcaagccggccaacaacggcaagttccacttcgtgctcaaggccaccaatggccaggtcgtcggccagagccagctctatgccagccaggccaacgccgaagccggcgtgcagtcggtgaagcgcgcagcgccggaagccggtctcagcgacgaaagctgaggcctggcggcgcctgtgccgaggcacaagcgccgcccatccacctctgcattcccttccgcggttacttcccgtcccaggagttgaacgcagcgccccattttcaggctcgcaagtaa

SEQ ID NO: 10911 - DNA, 1902 bp, Pseudomonas aeruginosa
cgatgtgtccctggatatccacgccaacgaattcttcaccctcctcggcccttccggctgcggcaagaccaccctcctccgcctcatcgccggcttcgaacagcccagttccggcagcatccgcctctatggcgaacacatggaaggcctgccgccgttccgccgcccggtcaacacggtgttccagagttatgcgctgttcccgcacatgagcgtcgccgacaacatcggcttcggcctggagatgcagggccgcccgcgcagcgagatcgacgccaccgtgagccgcatgctcgacctggtgaagctgccggaggtcggcaagcgccgcgccgaccagttgtccggtggccagcagcaacgcatcgccctggcccgcgcgctggccagccggcccaaggtgctgctgctcgacgagtcgctgtcggcgctggacctgaagctgcgcaaggaaatgcagatcgagctgaagcgcctgcagcacgagaccgggatcaccttcatcttcgtcacccacgaccaggaggaagcgctgaccatgtccgaccgcatcgcggtgatgagcaagggcaaggtgttgcaggtcggcacgcccagcgacatctacgaggcgccgctgaaccgggcggtcgccgacttcatcggcgaaaccaacttcctcgagggccaggccgacgccgacggcgtgcgcctggcggacggccagcggctggccgcgacgaccccgggcagcggcgctgtgaccttggcgatccgcccggagcgcaccgaactggccgccgacggccagttggaaggcgtgctggaaaacatcgtctatgtcggcaccgataccgtctaccacctgaacgtggccggacagccgggcttccgcgtgcgccagcagaaccgcgacggcgcacgctgcccgcacagtccgggggcgaaggtgcgggtgcggattcccgccgccgccatccgggtgctcgccgaatgagcaccgccggccgacctaccgcgcaacagtcggccgaacgccggcagctgcgtcggcgcctgctgctgagcagcccggcgatgctgatgctggtgctgttcctggtgatcccgctgggcatcatgttcgccgtgtcgatccagcaatccggcgactacggcggagtgaaatggggccagcacagcctggaggcctacctcaatttcctctgggaacgcgacctggacgacagcctggtgttcaacgccgactacctgggcatcttccagcgctcgttctggctctcgctgctgaccaccctcggctgcctggcgctcggcttccccaccgcgctgtacctggcgttgcagccggaacgccggcgcaacctgctgctgttcctggtcaccgtgccgttctggaccaacctgctggtgcgggtctacgcctggatcctgctgctgcgcaacggcgggctggtggacgccggcctgcaaggcatcggcctgaccgacaccgggctggggctgctctataccgacaacgcggtgatcatcggcctcctttatacctacctgccgttcatggtgctgccgatctacagcagcctggaaaagatggactggcgcctggtggaggcggcattcgacctcggcgccaaccgctggaaagcgctgcgccgggtgatcgtgccgctggcgatgccggggatagtcgccggctgcatcctggtattcatcccggccctgggcagctacatcattccggaattgctcggcggcggtaaggcgctgatgatcggcaacctgatccagctgcaattcggtaccgcgcacaactggccgttcggcgccgccctttcgttcgccctgctggccttcgtcctgctggcgatgctgatctacaacctgcgcttccgggccaacgccggcggaggccagccatga

SEQ ID NO: 10912 - DNA, 2964 bp, Pseudomonas aeruginosa
cccgtccattcacccggcgcaggaaaggtccgcccaagcggccgcctgcgggatcgatacggcatttcgcgaggagcggaacatggccagcgaacgcaacaacggcatcctcatcggcggcaagcgccccgagtacgtccacagcgcccagggcaccggcctgcggcgcatcctcgggcttcccgccctggtcttcttcgggctggtctacatggttccgctgaccatgttcaccacctacggggtagtcaccgagatcaccggcggtcgtaccgccagcgcctacctggtcaccctggcggcgatgctcttcaccgccttttcctacagcttcatggtgaagaaatatcccatcgccggctcggcctattcctataccagcctcagcttcggcccctgcgtcggcttcctcgccggctggtcgctgctgctcgactacctgttcctgccgatgatcaactacctgctcatcggcctgttcctcaacatcgccttcccgatggtgccggcctgggtcttcgtgctcgcggcgatcggcctggtcaccgtgctcaacgtgatcggcatcagctcggtggccggcatgagcaacgtgatcgtcggcgcccagttcgtcttcgccgtggtgttcgtcgccatggcggtcaagcacctggccggcatcccctcgctggacctgagcctgcccttcgtcggcgacggcagccagccgggcttcgccccgttgatggccggcgcggcggtgctgtgcctgtcgttcctcggcttcgacgcggtctcgaccctggccgaggaaacccgcgacccgcaacgcgacatcccgcgcgccatcgtcatcaccacggtcggcgccggcctgctgttcaccgtgctggcggtcttcagccaactggtgttccccggcagcgtattccaggacgccgagtcggcggccaacgaagtgatgctggcggccggcggcaagttcctcgccagcttcttcaccgccgcctacgtcgccggcgccgccggctcggcgctggcctcgcaggcctcggtgtcgcgcatcctctacagcatgggccgcgacggcatcctgccgcggcgcgtgttcggcagcctctcggagcgcttcaagacgccagtgatcgcgatcctggtggtctcggtgatttccctgctggcggtggtcatcgacctcaccaccctggcctcgatgatcagcttcggcgcgctggtggcgttctccgcggtgaacctggcggtgatccgcagctacctgctgctcgacggccgccgcgccccgcgcgacctgctgcgctacgggctggtgccggccatcggcctgggcctgaccctgtggctgtggaccagcctctcggcgctgaccctggtgatcggcctgacctggttcgccgccggcctcgcctacctggcgttgcataccggcggtttccgccgcaaggcgccgaccgtgaccttctccgaacagaactgagcccgggagcccgacatgctgaccatctacagcgacgaccatcgcctgcaccacggccggcacgaactgatcggcggccagttcaccccctgcttcgaaaaacccagccgcgccgacatggtcctcgaccgcgtgaaggccgtcggcctcggcgaagtccgcgcaccgcgcgacttcggcctggaaccgatccgccgggtgcacagcgagggtttcgtgcgtttcctgcagaacgcctggcaggactggctggccaccggccgcagccacgacatgctgccgatcgcctggccgacccggcgcctgcggcagacggagccggacaacatcgacggtcgcctcggctactactccttcgacgcaggcgcgccgatcaccgccgggacctggcaggcgatcaccagttcggccaacgtcgccctcagcggccagtccgaactcgccaacggcgcgcgctcggtattttcgctctgtcgcccgccgggccaccacgccgcggccgactacatgggcggctattgcttcttcaacaatgccgccatcgccgcccaggccttcctcgaccggggcgccgggcgggtggcgatcctcgacgtcgactaccaccatggcaacggcacccaggacatcttctacgaccgcgccgatgtgctgttcacctcgatccacggcgatccgcgcttcgaatacccctatttcctcggctacgccgacgagaagggcaacggcgtcggcaccggctacaacttcaactacccactggcggccggcagcgactgggcgacctggagccaggcgctgcaggcggcgatccggcagatccaggcctatgcggcggacatcctgatcgtttctctgggggtggataccttcaaggaggacccgatttcccagttccgcctggacagccccgactacctgcgcatgggcgaagccatcggcaagctcggcctggccacgctgttcgtgatggagggaggctacgcggtggaggaaatcgggatcaacgcggtgaacgtgctacagggtttcgaaggggttcaccggtaagcccgcccgcaacttcgcccggtcggaacgcgaaacggcccgcctcccggaagagaggcgggccgtttcgattcagggccttacttgatcacttcgacgaactcgacgtcaatctcgcggccgaccaggtcgcggtcgacttcgccggtcagcttgacccgggtcttgtcgttgatttccatcggcgggaagtcttcgtcgtcgatctccaccttcatgctgccggtggcatcgcggaactcgtagatgtcgcccttgatgcgcttgacgatggtgccctggaggaccaccggggtgtcgtcggcggcttccagcgcggccttcaccgtggtggtggtcggggtagcgcccgggccggtatagccggcggccagggtgacggtggagaacaggccgatggcagcgatgaggggcaggtgacgaagtttcatgggtaa

SEQ ID NO: 10913 - DNA, 873 bp, Pseudomonas aeruginosa
gctggtactggccgaggcgatcctgctgctgcgcggcatcccggaaaagaacgcctcctgccatcgcggcggctggatcaagagcgcggcgaattccttcgagatccgtggcaagaagctcggcatcgtcggctacggctcgatcggcacccagctctcggtactcgccgaggccctgggcatgcaggtgttcttctacgacaccgtgaccaagctgccgctgggcaacgcggtgcagatcggcagcctgcacgagctgctgggcatgtccgacatcgtctcgctgcacgttcccgaactgccctccacccagtggatgatcggcgagaaggaaatccgcgcgatgaagaagggcggcatcctgatcaacgccgcgcgcggcacagtggtcgagctggaccacctggccgccgcgatcaaggacgagcacctgatcggcgccgccatcgacgtgttcccggtcgagccgaaatccaacgacgaggaattcgccagcccgctgcgtggcctggaccgggtgatcctgaccccgcacatcggcggctccaccgccgaggcacaggccaacatcggcctggaagtggcggagaagctggtcaagtacagcgacaacggcacctcggtgtcctcggtcaacttccccgaagtcgccctgccgtcgcacccgggcaagcaccgcctgctgcacatccacgccaacatccccggcgtgatgagcgagatcaacaaggtcttcgccgacaacggcatcaacgtttccggccagtacctgcaaaccaacgagaaggtcggctacgtagtgatcgacgtcgatgccgagtactcggacctggccctggagaaactccagcaggtcaacggtaccatccgtag

SEQ ID NO: 10914 - DNA, 414 bp, Pseudomonas aeruginosa
tcgtgcgcgccgacgaaacccgccagttcaagtcgctggaagacctcaagggcctcaagctcggcgtcgggccagggcaccaactacgccgacctggcgaagtcggtggccggcgtcaacgtgcgcacctatccgggcgccccggaatacctgcaggacctggccagcaaacgcatcgacgcggcgctcaacgaccgcctgctgatccccttcgccatccgcgaggccaagctgccggtcaagcccggcgcggcggtgggaccggtggcgaacatggcgattccctaccggaagaacaatccgaagttcggcgaggcgctgaatgcggcgctggagaagatcaaggccgacggccgcttcgccaagctctcggaaaagtggttcggcctggacgtcagccagccgccgaagtga

SEQ ID NO: 10915 - DNA, 585 bp, Pseudomonas aeruginosa
ccgcgccgctgcggcgctgagcgttcagccgccggcgtcgaggccggccaggcagaccgcggcgcggtccagttcatcctcgttgaataccagcacgcccatgcgcttgagggcggcggcggtaacgccctcgccggcgacccggttgccgttgaagcgcccgtcgtagttctccaggttgccgcaggaaggactgcgcgccttgagcacggccatccggatgtcatggcggcggaccagctccactgccgcctccgcacccagcaggaatgcttcgctgacatcctcgccgtcgacggtgaagacccggttcagccggtccagcacttcgccgccctggccgccggggatatccgctggcgggcggggcgtcggcaggcctccggcgacctccgggcaaagggcgacgatccgcccctgcgcatgccagcgcgagagcaggtcgaacgggccatggctgccaccgtcgtagcgcaccaggtggcccagcaggcaacggctgaccagaaccttctgcatggatgctccacccctttgacaggcacacagagtagcccgccgctcgccgatggtcacgcccggtaa

SEQ ID NO: 10916 - DNA, 762 bp, Pseudomonas aeruginosa
aactgcgggcggcccatggcgaacctccgccgccccgagcagactggcttcccgcgcaaccgcgaaggaaccgcccgtcatgctcccgacccgctcgcttctaccgtttttcctggcccccgcgttgctcgccagcgctgccagccaggcggccatggaggccctggacaacgacagtctcagccaggtcaccggccaggccggcatcagcctgcgcctggacctgcgcgccggcgcggccagggtcgcctgggtggacgacggcggcagcctctcgctgcgcaacctggtgatcgacaacggctgcgtgaaggccggcgactgcccggacgggcgcggcggcaacatccccctgggcgccgcccagctcggcatgagcttgccgatattcggggtagagcagccgaccctggcactggacgtgaccaccggcagcggcggcgggcagcaactggcgatcagcttgccggacctcgccaccatcaacgaccagttgatcgccagcggcctgccggcgcagcgcatccgcctgcgggtggccagcgacctgtacatcggcgacaactcgatcggccgcatcgaactgcgcgacatcaccgacctgcgcggcacgatcaaggtctggggtcactgaggcggcgacgccgccgagggttcaggagagttgcaggagggattcgttgcgccggcggaaccagccggtcagcgacagccggtcgcggctggcgggcaggacttcgtgctcggtgccggcggacatga

SEQ ID NO: 10917 - DNA, 933 bp, Pseudomonas aeruginosa
tgtgcattgtccattgtagcgtgccgccccggtgtctcgacaagcggtccgccgcatgtcgacaatagcgccccatggacggcaccacccgaacgacgaggctttcgccgccaaaggagtatcaatgcgcgctttgctcgccttcgctttactgctggttggtctgcccgccctggccgacccttatcaacgcctgtaccaggccgctggctggcccgaccagcgcgcgcatttcagcgatgccctggacgcggcgcagaagcgctaccaggacaagctgccgcccgcgctctaccagaccctggtggacaacagcaatcgccgcttcgccccggccgaagtcgaccagcgcgccctcaacggcctgcgcgagaacctgccggacagcgccagcccgctgaatttcttcgagtcgccgctggggcgcaaggtggtcgccgccgaggtgctcgccacccgccgcgaccagttgctccagcacagcaacggcctgccgcggcagaccgccagcgagccacgccgggccctggtcaagcgcctggcccaggtccttccggcccgagaggccggcgcggaagtcagcctggccctggccggggtcgccgccgacagcctcagccagatgcttccgggcctccccggcctgcttggcggcggacagaccggccagttgctggaaggccagcgccagcgcctggtgcagcagatcgacgcggacctggagaacaccctgctgtatgtctaccgcgatctctccgatgcggaactcacccagtacgtgaacttcgccgagtcgccggccggtcgcagctactaccaggcggccctggccgcgctgaaagccggcctggcggtggaccaggcggtcgccccctgatcgacgcggggcctggaactcaggcccccagcgcgtcgctcaggaaatcgaaatag

SEQ ID NO: 10918 - DNA, 711 bp, Pseudomonas aeruginosa
tcggggttgaaggcttctgacatcggcggttccgggctgcaatcgattcgtggccgggccacgggcgaaacccagggatattcagctgcgcgcgaacacatggcaagcttggcacccgttttccgtgtgaatgccatgactccccgccgcaagacgctcctcgtcagcctggtcggcctgctctgggccggcggcctgctcgccgcctactggtggttcgagatccgctacatccgcccgttcagcgagcagaccaccctgttctccggcgacagcctgcgcctgccggccgagctggccgggccgggggcgatccgcctggtgcatttctgggacccggcctgcccctgcaacgtcggcaaccagcagcacctcggcgagctgatcgaacgcttcgccggcaagggcgtggagttccatgtcctgcagaagcctggcagccagggccgcctgccggacaacctggccgccctgcgccccctcgctggtctgcccggttccgagcagttgccggccagcccggccgtggcgatctgggaccgcgacggccgcctggcctacttcggcccctatagcgagggcgcggtatgcacctccagcaacagcttcatcgaaccgatcctcgaagcgctgctgcagggacgtccggtggatgccacccataccctcgccgtgggttgctactgcccctggaccccggaaaaaggctga

SEQ ID NO: 10919 - DNA, 486 bp, Pseudomonas aeruginosa
tcgagcgtgtcgacgacctccaggaggaccgtctggaactgcgcgacaagtacgtcaagcgcatcgccgagaacgtctcgcccaagcgcgccatgcgcttcctgcagatcgagatccagctcgacgccatcgccaccctggagatcggccgtcaggtaccgctggtcgagtaaccctcttcccgcttcgccagccgcgccctgtattgctccgggggcgcggcgtgccagcggcgaaaggcccggtagaacggcgacagctcggcgaacccgcaagccttggccacctcgcggatggcgcgaccggccaacagcatctcgctcgcccgctgccggcgaacctcatcgcgaacctgccggaaactcgctcccccagcggccagcgcacgctgcaaggcaccgctgccaaggcccagctccgccgcgcactggcgcaagccatagccctccccgaggcgcagctcgatcaggtagcgcacgcgattga

SEQ ID NO: 10920 - DNA, 765 bp, Pseudomonas aeruginosa
acgggtcgtcctgcatggcggctcctcgcgattgaccaaagacttccagggtccgagcattcggtcaatgccgcgggccgacggcatccgcagaatgctcggcactacaacaaggagaaaggatcgatgaaacgcaccctgaccgtgatcgccgtggcggtcgccgccgcggctgccggcggcgcctggtacctccatgccaagcagccgctccgcaacggctcgctcgccgtggcccacctgcaggcgccggtcgacgtgcgctacgacgagcgcggggttccgcacctgtatgcgcagaaccagaccgacctctaccgcgccctcggctacgtgcacgcccaggaccgcctgttccagatggaaatgctgcggcgcctggcgcgcggcgagctggccgaagtgctcggacccaagctggtggataccgaccgtctgttccgcaccctgcgcatccgcgaccacgccgccgaatacagcgcccgccaggacaagcagtcgcagccctggaaagtgctggaggcctacctggacggggtcaaccagttccaggaaaacaacccggcgccgctcgaattcgatctgctgggcatacccaggcgtcccttcacccccgaagataccctgagcatcgccggctacatggcctacagcttcgccgccgccttccgcacccgagccggtgctgatctacatccgcgacgaactgggcagcgactacctgcgcatcttcgatctcgattggcatccgcaggggcgtgctga

SEQ ID NO: 10921 - DNA, 477 bp, Pseudomonas aeruginosa
acccgagcttcatcctcgacggcagcaagggcgaggcggacaagtccggcttctatccgttcgccgacaacccacaggaggaaaacccggcgcgcggctacatcgtctccgccaacttccagccggtcccggccaatggccggccgattcccggctactacaacctggcggaccgcggccagtggctggatacccaactggccgaccgcggcaccaaatggaacctggacaacagccgcgcgctgcaactcggcaatcgcaccggctacgcgccgcgcctgctcgcacccttgctgccggtcctgcgcgaggtggtcgacgacgccgaaggcaagcgcctggtcgagcaactggcggcctggaagggcgactacccggtcgactcgaccgccgccacgctgttcaaccagttgctgttccagattgccgagggcgccttgcacgacgaactgggcgatgccttcttcgacagcctga

SEQ ID NO: 10922 - DNA, 501 bp, Pseudomonas aeruginosa
ccaggcatttcccgccaccgacgcgccaatgaaaaaggccacccgcaggtggccttttcttttcggcggagggctcaggccggggtcggcgagcctttctgccagtcggtcgcggtctcttccatcgcctgctggatcgcccggcgacgccgctcctcggcctggcgggtgaagtaccaggcgaagaaggtgaacagcgaaacgctcagcaggatcaggctggccaccgcgttgatctccggcttcacgcccaggcgtaccgccgagaacacttccatcggcaaggtggtcgagccgggtccggagacgaagctggccagtaccaggtcgtccagcgacagggcgaaggacatcatgccgcccgccgccagcgagggcgcgatcatcgggatggtgatcagcaggaacaccttccagggcttggcgcccaggtccatcgccgcttcctcgatcgacaggtcgagttcacgcaggcgcgccgacaccaccaccgccacgtag

SEQ ID NO: 10923 - DNA, 240 bp, Pseudomonas aeruginosa
gacgagcagaagctggtgtgggcgatccagatggtcacgataccccgttcctgcggccagccgatcagttgcgccatggccacgaacaacagcagcagcgacaggccggtgatcacttccggcatcaccagcggcgcggtgaccatgccgccgaacagcgtacgaccgcggaagcgcgggatgcgggtgaggacgaaggccgccagggtgccgaggagcaccgaggagaacgccgtatag

SEQ ID NO: 10924 - DNA, 1116 bp, Pseudomonas aeruginosa
ctgcagtaccacgccgctgtcgtcgtaccagctgatgtacaccgactggtcccaggtcggccgggtgacgtggcgctcggcgttggccatgaaggcctggacgatcatcccggaggccagcttgatgtagtacaccgagtggccgccaaggtaggcgatgtcgtagacggtgccctgggcccagttgtgcccggcgtgttccaggttgtccggcttctgcgcgctgatcatcactttctccggccgcagcgcgtaggtgatgcgcttgtcctcggcgcgggtgctgatgccgtggccgatgtagatcgggttctccagctgcggacaggcgatcaccgcatggtcctgcacgtcctccaccagcacgccgtcgaacaggttgacgttgccgatgaactcgcagaccaggcggctcgccggggtctcgtagatgtccatcgggctgccgatctgctcgatgcagcccaggtgcatgatggcgatgcgctgggccatggtcatggcctcttcctggtcgtgggtcaccatcacgcaggtcacgccgacgcgctcgatgatctccaccagttccagttgcatctgcgagcgcagcttcttgtccagcgcgcccatcggctcgtcgagcagcagcagcttcggccgcttggccagcgaacgggccagggccacccgctggcgctggccgccggagagctggtgcggcttgcgcttggcgtactgggtcatgtgcaccagcttgagcatctcggccacgcgctcgtcgatctcggccttgggcaggccgtcctgcttgaggccgaaggcgatgttctgcgccacgctcatgtgcgggaacagcgcataggactggaacatcatattgatcggccgctcgtagggcggcaggtcggtgatgtcctggccatcgaggaagatccgcccctcggtgggccgctcgaaaccggcgagcatgcgcaacagggtggatttacccgaaccggagccgccgagcagggcgaagatctcgcccttgttgatggtcagggacacggtgtccaccgccagcgtctcgtcgaactgcttggttacccggtcgatctttaccagcacctctttcggctgctggttgccctctag

SEQ ID NO: 10925 - DNA, 1260 bp, Pseudomonas aeruginosa
ggctttcttgtaggcaccggaggctatcgccattaccacaactcccaagtcgttgagcccggtcacgctaccgggcggaatttgaacttatttgccggtcttgatccgggtccaggtacgggtctgcaggcgcagcaccttggccggcaacacggcggaaacgtagagcttgtcgagcacggcctgcggcggatacacctcctcgctgtcgctgacgctcttgtccatcagcgggcgggcccccggtatcgcgttggcgtagccgacgtagtcgctgaccttggcgatcacctccggacgcagcaggtagtcgatgaacgcgtaggcgttatcggcggccttggcatcggcgggaatcgccatcaggtcgaaccacaggttggcgccttccttgggaatcacgtactggatgtcgatgcccttgccggcctcttcggcgcgggcagcggcctggaagacgtccccggaatagccgaaggcgacgcagatgttgccgttggccaggtcggagatgtacttggaggagtggaagtagctgacgtaggggcgaaccttggtcaggacttcctcggccttcttgtagtccttcgggtcgtgggtgttggggtccagccccagatagttgagggcggcgggcagcatctcgtcgccgctgtccatgaaggccacaccgcacttggcgagcttcttcatgttctccggctcgaagaggatggcccaggagtcgatcggctggtcgccgaggacttccttgaccttggccacgttgtaaccgatgccgttggtgccccacaggtagggaaccgcgtactggttgcccgggtcgctgacctccagttgcttgagcagcgccggatcgaggttcttccagttcggcagcttgctcttgtccagcttctggaaggcaccggcctggatctgcttgccgaggaagttgttcgacggcaccacgatgtcatagccggagtggccggagaccagcttgccctcgagggtctcgttggagtcgaagacgtcgtagctgacgtcgatcccgctctccttggtgaagtccttgagggtggtgggagcgatgtaatcggtccagttatagatgtgcaggctcttcttctccgcctgcacggggcccgcgatcgccgtagccagagcggctaccagcagtgtcttgccaatggaatgttgcatgtccgactcctgttccgggccttttcacggcagcaccctgcctgttcgacccgtgttcttcaagtgccgatgtaa

SEQ ID NO: 10926 - DNA, 1347 bp, Pseudomonas aeruginosa
accgagcgagttcctcaaggaacatcccgaggtccagttcgtcgacctccttattgcagacatgaatggcgtggttcgcggcaagcggatcgaacgcaacagtctgaacaaagtcttcgaaaaaggtatcaatctccccgcttccctgttcgccctcgatatcaccggctccaccgtagagagtaccggcctgggtctcgacatcggcgacgccgaccggatctgctacccgatccccggcaccctctccatggaaccctggcagaagcgcccgaccgcgcaactgctgatgaccatgcacgaactggaaggcgagccgttcttcgccgacccccgcgaagtcctgcgccaggtggtggccaggttcaccgagatggaactgaccatcgtcgccgccttcgagctggagttctacctgatcgaccaggagaacgtgaacggccggccgcagccgcctcgctcgccgatctccggcaagcgtccgcagtcggtgcaggtgtactccatcgacgacctcgacgaatacgtcgagtgcctccaggacatcatcgacggcgcccgcgcccagggcatcccggccgacgccatcgtcgccgaatccgcaccggcgcagttcgaggtcaacctcaaccacgtcaacgacgccctcaaggcctgcgaccacgcggtgctgctcaagcgcctggtcaagaacatcgcctacgaccacgagatggacaccaccttcatggccaagccctatccgggccaggccgggaacggactgcacgtgcatatctcgctgctcgacaagcatggcaacaacatcttcaccagcgaggatcccgagcagaacgccgcattgcgccatgcgatcggcggtgtgctcgagaccctgccggcctccatggccttcctctgcccgaacgtcaactcctaccgccgcttcggttcgcagttctacgtgccgaacgcgccgagctggggcctggacaaccgcaccgtggccctgcgcgtgcccaccggcagcccggacgcggtacgcctggaacaccgcgtggccggcgccgacgccaacccctacctgctactggcagcggtgctggcaggcgttcatcacgggctgaccaacaaggtcgagccgggcgcgccgatcgaaggcaactcctacgagcagatggagccgagcctgccgaacaacctgcgcgacgccctgcgcgagctggacgaaagcgagatcatggcgaagtacatcgacccgaagtacatcgacatcttcgtcgcctgcaaggaaagcgagctggaggagttcgagcactcgatctccgacctcgagtacaactggtacctgcataccgtctgaggtag

SEQ ID NO: 10927 - DNA, 1443 bp, Pseudomonas aeruginosa
caatcgccacgccgtcccctatctatggggtgccgtaggcctggccatcaataccccgcaggccgaagccgcctatggcgggccgctgcccaacagctggagcctgctgttcgacgccagccagagccagcgcctgaaaagctgcggcatcagcctgctggacgcgccggacgaaaccctggcgatcctcctcaactaccagggccgcaacctcggtcgtactgcgccgagccaggtacgccgcgccgccgaggcgctgcacggactgcgaccgaacctgcgctacgtcgacagcgagcgctacatcgccgacctcgaaggcggtcgcctctgcctggccatggcctgggtcggcgacgccctgcgcgcggccaaggcgggccagccggtaagtttcgaggtaccgcaggaaggctcggtgctgttcatcgacaacctggtgatcccggccggcgcccagcatccacgcgaggcgcaccgtttcatcgactacctgatgcaaccgaagatcgccgcacagatcaccgccgccaccctctaccccagcggcaacgccgacgccgccggcttcctcgatcccgccctgcgccagcaacccggcctgtatccggaccgcgacaccagccgccgcctgttcgccctggaaacgccgccggaaaaactccggccggtggtcgacgagatctggaaggccttccgcggcgccagccagtgagcggcttgccccggtcgcgtgagctggcgtccaatagccgctcacgcccggagacccgccacatgcagcccacctcgcccacccgcaagccccgcgccagcagccaggcccggatcgccgcgatcctcgacgccgcccgcgacctgctcgccgacgaaggcatcggcggcctgtccatctacagcgtggccgaacgcgcggaaatgccaccatcgtcggtctaccacttcttccccagcgtgccggccctgctccaggggctgaccggcgaggtccacgccgccttccgcgcgtgcctcgaacagccggtggaacatgcaggcctgcgctgctggcgcgacctgtcgcggatcgtcgaggagcgcatgctggcggtctacgcccgcgacgcggcggcccgccaactgattctcgccagccacggcctggccgaagtcacccaggccgatcgccagcatgacgtgcaactcggccaggccatgcgcgccctgttcgagcggcatttcctgctgccaccgctgccgaccgatatcgagatcttcagcctggccatggagctaggcgatcgcgtctacgcattgtcggtccagcgtcacgggatcatcgacgcacgcctggcggaagaaggcatgcgggtgttcgacgcctacctggggctctacctgccgccgatcctggaaaagcgtagcgaaccattaaccggatttatatccgatttaaatcgatag

SEQ ID NO: 10928 - DNA, 786 bp, Pseudomonas aeruginosa
aaaacccataaaactctcttaaaccgcttcacagtccgatttttatcggatataaatccgcccatccctcgatcgggcgcgacaccccgttcccgcccgcccgacccactaccggccgccgccaagcccggcagccatccgagccagcacacgaggtgctccatgacccgcaacgtcaccgtcgccgccacccagatggcctgctcctgggatcgtccggcgaacatcgcccgcgccgagaaactggtgcgccaggccgccgccaggggtgcgcagatcatcctgatccaggaactgttcgagaccccctacttctgccagaagccgaacccggactacctgcagctggccaccacggtcgaggagaacgccgccatcgcccacttccaggccctcgcccgggagttgcaggtggtattgccgatcagcttcttcgaacgcgccgggcgcgcccgcttcaacagcatcgcggtcatcgacgccgatggcggcaacctcggggtctaccgcaagagccacatcccggacggcccgggctaccacgagaagtactacttcaatccgggcgacaccggcttcaagatttggcagacccgcctacgcacggatcggcgtcggtatctgctgggaccagtggttccccgaatcggcgcgcagcatggccttggctcggcgcggaactcctgttctacccgaccgccatcggtagcgaaccgcacgacgccagcatcagctcgcgcgatcactggcagcgcgtgcagcaaggccatgccggagccaacctga

SEQ ID NO: 10929 - DNA, 1221 bp, Pseudomonas aeruginosa
agaccctggacggttcgctggagtcctgaggcctcgggaaacgatccgcgcggggacgccccgcgcattccgcgccggcgtccgccgcgcatagtaacgatttcaggagcagcgatgagcaacccgaccagcaccccacgcgccgacggcttccgcatgcccgccgaatgggaaccccacgagcagacctggatggtctggccggaacgcccggacaactggcgcaacggcggcaagccggcccaggcggccttcgccgcggtggccaaggccatcgcgcgcttcgagccggtcaccgtctgcgccagcgccgggcagtacgagaacgcgcgcgcacgcctcgacgacggcaacatccgcgtcgtggaaatcagcagcgacgatgcctgggtccgcgacaccggcccgaccttcgtcatcgacgacaagggcgatgtacgcggcgtcgactggggcttcaacgcctggggcggcttcgaaggcggcctgtacttcccctggcagcgcgacgaccaggtggcacgcaagatcctcgagatcgaacggcgcgcccgctaccgcaccgacgacttcgtcctcgagggcggctcgatccacgtcgacggcgaaggcacgctgatcaccaccgaggaatgcctgctcaaccacaaccgcaacccgcacctgagccaggcggagatcgagcggaccctgcgcgactaccttgcggtggagagcatcatctggctgccgaacggcctctacaacgacgagaccgacggccacgtcgacaacttctgctgctacgtgcgtcccggcgaggtgctgctggcctggaccgacgaccaggacgacccgaactacctgcgctgccaggccgccctccgcgtgctggaagaaagccgcgacgccaagggacgcaagctggtggtacacaagatgccgatccccggcccgctgtacgcgacccaggaagagtgcgacggcgtggatatcgtcgagggcagccagccgcgcgatccctccattcgcctggccggctcctacgtgaacttcctgatcgtcaacggcggcatcatcgcgccgagcttcgacgatcccaaggacgccgaggccagggcgatcctccagcgcgtgttccccgagcacgaggtggtgatggtcccggggcgcgagatcctcctcggcggcggcaacatccattgcatcacccagcagcaaccggcgccgcgcaaggcctga

SEQ ID NO: 10930 - DNA, 1488 bp, Pseudomonas aeruginosa
tcacaattgccgagcgatgccgttcgtattcgccggagcctgcacgcccagttgtttctgcgcctcgaacagcgagcgcaggaacagggtcagggtcggtcgttcttcgtgtccctgacgggtaatgcaatggaattccgagtcgtaggccagttgccgtggccggatcgcccgcatgcgcccttcggcgacccaggtggcggcatagtgcgtcggcaggtagccgatgtaggtgccgctgaagaccagggtagcgatggcctccatggtgtaggcgtcggtcccctggttgaagcgcaggtcgtgcgggcgatggttttccgccatgtagccgcggccgacatagtcggcggcgcagatctcgtccagtgtcggctcgtcgtccgcccgggcgaagaaggggtgcgcgctgccgcaatagaggttctgctcctcgcggaacaggggttggtagtagagcccggacaaccggtggtgaaaggcccccaccgccagttgcaggcgctcttccagcaccgcgtgctcgagttcgtcgggacgccgcgtgtgcagcttgagcagcacctccggggcgcgctggcgaaacagccggatggccagcggcaacggcaggcaatgctggccgatgacgccatcgacgcagcccaggtgcaacgcctcgcgatcgcgcccgccgaggccgcggacctgctcgcggaaacgggcgatgtcgctgaacaggccgagcgcggcgtcgtagagctcctgcccctcctcggtcaactggaaaccgccgttgccgcgccggcacagggaatagcccaggcgcacctccaagtcgcgcaccagcacgctcaggcgcgacaggctggtgttcaggcgcgcctgggcggcagtgaagccgccggcctcgacgatggcgcagaaggtgcgcagcatgcgcaggtcgatgtcgttgaggttgcccagcattcccgcccccatggcgttcggtccgccttcgttatagcgccaaagccaggccggcggaacgccgtcaggcgcttcgcgcggccgactcggcaatcatgcatatcagttcgaacatcatggtcgcccccaccaacgccgtggcgccgccgacatcgaacggcggcgagacttccaccacgtcggcgccgaccaggtccagcccgcgcaggccgcggaccagttgctgggcctggaggctggtcatgccgccgatctccggggtgccggtgccacgcgcgaaagccgggtcgaacacgtcaacgtcgaaactcacataggtcggcccgtcgcccaccacccgccgggcttcggccaaggtcgcctcgacgcccagttcgacgaactcttccatgtggatcacggcggatgccgcactcgcgggcgaaagcgtcgtcgtccggcgaatacaccgagccgcgaatgccgatctgcaccgtgcgcaccgggtcgagcagaccttcctcgatggccctgcggaatggcgtgccgtgggtgtag

SEQ ID NO: 10931 - DNA, 1326 bp, Pseudomonas aeruginosa
ccgccaacggctgttattcttgcccgcaaccggccggctcgtgtacctctacctggtacgccagttccgccgcaaggcccaggcctacgacgaactgcacggcagcgagcagcgcctgaaccgcgccctggaagcggtgcgcgacggactctgggactgggacctggtgaccgaccggatgttcgtctcgccgggctacgccgcgctgatcggcctcgctccggaggaactcggcgaccccatcgagacctggaagaagcgcctgctccccgaagagtacgccaccgtgctggaggcccaccgcaacctcctgcagggcctgaccgacaatctcgaccacatctaccgcctgcgccacaaggacggcgactaccgctggatccactcgcgcggccgggtcctccgcgacgccctgggcaagccgctgcactacactggcgtggcccgcgacatcaccctgcaacggctcaaggaagaccacctgcgccaggccgcggcggtattcgacagcacccgcgagggcgttctggtcaccgatgcccaggcggtgatcgtgcacgtcaacccttccttcgagcgcatcaccggctaccgctccgaagacgtgctcggcaagaccccggcgatcctccgctccggccgccaggaccaggcgttctaccagcgcctgtggctggccctgcgcgagcaggacgtctggagcggagaaatctggaaccggcgcaagagcggcgagatctacccgcagtggctgcacatccgcgtggtgcgcaacgaccagggccagctgacccactacgtcggggtgttctccgacctgagcagcatcaagcgctcggagaacgagctggacttcctcgcccaccacgactcgctgaccggcctgcccaaccgcgtgctgctgcgcgagcgcatcgagcaggcgctggagaacggcaaggaccggacggtggccggggccctgctgctgatcgacctcgaccacttcaagcacatcaacgacagcctcggccatacaactggcgacatgctcctcaaggaggtcagcaagcgcctgcaacaccagctcgacgagcgctgcctgctgtcgcgactgggcggcgacgaattcgccatcctcgtcgagaacgacgacccggaagccgtcgcgcgcctctcgcagcgcatcctcgacggtttcaacgcgccgttcgacatccactgccagccgatctatatcagcgcaagcctcggtgtcagcctctacccggaagacgccagcgacgtcgaccacctgatgcaacacgccgacgccgcgctgttccaggccaaggacagcgggcgtaa

SEQ ID NO: 10932 - DNA, 864 bp, Pseudomonas aeruginosa
cgcctacgccttctacacccgcgtgctgaccgcccgggcccgcgcccatgtccaggtggaatcggccctgcgccatgcgctggatcacgacgaactgcgcgtccactaccagccggtgcacgacctggccagcgggcggatcgtcggcgtcgagtcgctggtgcgctggcagcatcccgagcgcggcctggtgccgccaggcgagttcgtcccggtggcggaggaatgcgggctgatcgccgcgctggacaactgggtgctcaagcgtgcctgccggcagatgcgcgagtggcaacagcgcggcgtcgagctggagttcgtcgcggtcaacgtctccagccggctgttcaaccgcggcggcctggaggaaaggatcgccaatgccctggaagagtccggactggagccccgctacctggagctggaagtcaccgaaagcgcggtgatggaggacttcgagcagtccctcaacctgctctgccgcctgcgtatcctcggcgtgaacctggccatcgacgacttcggcaccggctattcctcgctgatgcgcctcaagcggctgccggtgcacaagctgaagatcgaccagggcttcgtcgccggcctgcccggcgcggtggacgacgccgcgatcgcccgggcgatcgttgccctggcgcaaagcatggggctgcgggtggttgccgagggcatcgagcatcaggaccaggcgctgttcctgcgcgaacatggctgcgacttcggccaaggctactggtacggacggccgcaaccggcggaagcgctgcgcttcgacctgccgcccgtggcgctgccggaagactgagcctggcggcgaagccgggccgcttcgccgtcttataa

SEQ ID NO: 10933 - DNA, 810 bp, Pseudomonas aeruginosa
cgcatttccccggtcatacccggcttcgggctgaccctgggatacaccctggtgtacctcagcctgctggtcctgatcccgctgggggccatgttcctcaagaccacccagctcagctgggagcaattctgggccatcatcagcgcgccgcgggtgctcgccgcgctcaagctgagcttcggcaccgcgctcgccgccgccgtgctcaacggcttgatcggcacgctgctggcctgggtcctggtgcgctacgaattccccggacggaagatcatcgatgccatgatcgacctgcccttcgccctacccaccgccgtcgccggtatcgccctcaccgcgctctatgcgccggccggcctggtcggccagttcgccagcgacctcggcttcaagatcgcctatacccccctggggatcaccctggcgctgactttcgtgaccctgccgttcgtggtccgcacggtgcagccggtgctcgccgacattcccaaggaagtcgaggaagccgccgcctgcctcggcgccaggccgctgcaggtgttccgccatatcctcgtgccggcgctgctgccggcctggctgaccggtttcgccctggccttcgcccggggcgtcggcgaatacggctcggtgatcttcatcgccggcaacatgccgatgaagaccgagatcctgccgctgctgatcatggtcaagctggaccagtacgactacaccggcgccaccgccatcggcgtgctgatgctggtggtgtccttcatcctgctgctgctgatcaacctgctgcagcgtcgcatcgaaaccccgtaa

SEQ ID NO: 10934 - DNA, 1335 bp, Pseudomonas aeruginosa
cgtcagcaagaacttcaacgccttcaaggccctggacaacatcaacctggatatccagagcggcgaactggtggccctgctcggcccctccgggtgcggaaagaccaccctgctgcggatcatcgccgggctggaaaccccggacgccggcaacatcgtgttccatggcgaggacgtctcgcagcacgacgtgcgcgaccgcaacgtcggcttcgtcttccagcactacgcgctgttccgccacatgacggtgttcgacaacgtcgccttcggcctgcgcatgaagcccaagggcgagcggccgggcgagtccgcgatcaaggccaaggtccacgagctgctcaacatggtgcagctcgactggctcgccgaccgctatccagagcaactctccggcggccagcggcagcgtatcgccctggcccgcgcgctggcggtggagccgaagatcctgctcctcgacgaacccttcggcgccctcgacgccaaggtacgcaaggagctgcgccgctggctggcgcgcctgcacgaggagatcaacctgacctcggtgttcgtcacccacgaccaggaagaagcgatggaagtggccgaccgcatcgtggtgatgaacaagggcgtgatcgagcagatcggctcgcccggcgaggtctacgagaacccggccagcgatttcgtctaccacttcctcggcgactccaaccgcctgcaactgggcaacgaccagcacctgctgttccgcccccacgaagtgtcgctgtcgcgttccgaggtggccgagcaccgcgccgccgaggtccgcgacatccgtccgctgggggctatcacccgggtaacgctgaaggtcgacggccaggacgaactgatcgaagccgaagtggtgaaggaccacgacagcctggccggcctggcccgcggcgagaccctctacttcaagccgaaggccttccagccggtggccaatctctgatcccgcggcgggttcagcccgccgtgcgctccgccaggccgcgcagtcccgcgcggcccttcgacgacacctgcaacgcccgcgagccgtcctgcggccgcaaccagccctggcgcagacaggcctccagcaacgccgcccccagcgcgccgccgaggtgcggcttgcgttcgctccagtcggggcaggcgcaggcgaactgccgacggcggcggcggacctccgacaggtcgattcccaacctggccagcccggcctcgccggtcgcgctcaggcgcagcgtcctgccctcctgctcgatccagccggcatccagcatccgtgcgaacacaccgaccgcgagttcgccggccaggtggtcgtag

SEQ ID NO: 10935 - DNA, 330 bp, Pseudomonas aeruginosa
aagcgattgcgcccgcgcgcctccaggctcagcacgccgccctcgaccagccgtcccaggtggccgctggcggaggacggcgagacgcccgccagcagcgccagctcgctggccgggcgggcgctgccatccatcagtgcccagatcatctgcgcgcggccgggatcggcgagcagcgccgccagcgaactgaagccgggattgaattgcatgcttcacctccggatgaaacattgcctgtcgacgacgagagatactggccgccatcgcccgttcgcgccagcccgagacaaggaagaacccgcatgtccgtcgacctccacgccctga

SEQ ID NO: 10936 - DNA, 963 bp, Pseudomonas aeruginosa
tggcgctcccgacgccgtcaggacgccccgatgctgatcgccaacggcctgcgcaaggtcgacatgcaggacctgctggtcttcctccaggtccaccaacgacagaacctcgtcgaggtcgccgaacacctgaacctcagtccgtcgacggtcagctactgcctgaagaagctgcgccaggccttcgacgacgagctgttcatcgccacccgcggcggcatgcagccgacccacaagagtcgcgccatgctgccccacgtggaggaaatgctcgcccgcatcaacgcctgtcacgccgcccagggcagcttcgacccgcgtggcgagccgcggacctttaccctctgcgcgccggaatacgtcgagctgctgatccttccggcactcctgcgacggctcgccgccaacggcccgaggatcggcctggacatccgccgcctgggtcccgaactgcccaccgaagcattgctcgacggccaggtcgacctggtcttcgacttcggtcccgagtaccaccgaccggcaccggagctacaggcgctcgccctgttcagcgacgagctgctctgcgtacaggatcgtgcccagccgcgccacgagcgcctggaactggacgagttctgccggcgccgcttcgtcttcccgaccccgctcgacgccagcaacgccaacctggtggacacgtggctgcgacgccagggccgcagccgcgaggtcgccgcgcgcgccaacaggtacgtcgccgccctgcaactgctgtcgggcagcgacttcgtgctgatgctgccacggcgtatccatgcactgctcgacgatggccgccatcacgcctgcctcgcaccgcccgggctgccgccgttcgccctgcacctgtcatggagccgcgccgccgaccaggacccggcgaacctctggctgcgcgagcaggtactgatcgtctgcgccgagctgggtttgctctag

SEQ ID NO: 10937 - DNA, 3141 bp, Pseudomonas aeruginosa
tctgcgaagtgcgcaggtagaccagttcgatcaacgggcgctccaggccggccttggccagggccttttccaggccgagcatggcggcataggcgtcgggggaggctttggcccattcgaggcgggtggtcatggcgaatctccttggctgattggcagccgcgagagtggaaagcggcgcggcatggggtaacactaagcctgcctttggcttccacgaagagccaattaccagaaataccaggtagccaatttcgccatggaactgcaactgatcctcgacggccgccacgacctggtcggccagctctatcgccagctgcgcgacgcgatcctccatggtcgcctggccaccggcgatcgcctgccagccacgcgatacctcgccgaacgcctggaagtgtcgcgcaagaccgtcagcgaagcctacgagcgcctcgccagcgagggcttcctcgaaggccgggtcggcagcggcaccttcgtcgcccgcgggcccgccggggaagcgccgccgcagcgcgccgacggtccgttgcggccggccgcgcgctgggcacgcatcgaaccgcagtccggtctgatggaccagcgagcaccgctccgctacagcttcgccggcggcacgaccgacaagcgccgctttcccttcgatacctggcgtacctgcgtgctccaggcgctacgcctgcaacagcgctcgccggcgttctacaaggaaaccgaaggcgaccccgagctgcgcctggcgatctcccgctacctggcgatcaaccgcgccgtgcagtgcgactggaacgccctgatggtcacccagggcgcccagcagggactcgacctgctggcccgggtgatgctcgaccccggcgacctggcggtggtcgaggaacccggttatccgccggcccgcgccagcctgctggccaccggcgccgaggtgcgcggagtgccggtggacgccgaggggctgcgcgtcgacctgctgccggacaacgccaagctggtctacgtcaccccgtcgcaccagttcccgctgggcatgccgatgagcctggagcggcgcctgcagttgctggactgggcgcagcgccaccgggcgctgatcatcgaggacgactacgacagcgagtaccgcttcgacgggcgttcgctggagtcgctgcgcagcctcgaccggaacggccaggtggcctacctcgggaccttttccaagaccctcttccccgagctgcgcctcggctacctgctgccgccggcaagcctgcgcgaagcggtgctggcggcgcgcaagctggtcgaccggcacagcgagaccttgcagcaacgcgccctcgcgctgttcatccagcgcggcgacttcgcccgccatacgcgccgcttgcaacgcgaatacgcccagcgtcgcgggcgcctgctggaacgcctgcacggcgacctgagcccctggctcgaagcgctgccggcggtggccgggatccacctcgcggcgcgctgtcgcgaaccgctggatgtgctgcgcatcgcccgtcatttgcgccagcaaggcctggaggtcggcaccctgccgcccttctacgcggaaaccccggcacaggccggcttcctcttcggcttcggctgcatcgaacgggacgacatcgacccggcgttggacctgttgcgcgccgagctgcggcgctaggcgcgcttccgcccatccacggccggcaactcggcggcgcgcaggtaggtgccgatctccccggccagaggctcgattgcaaccgcgccccatgcccagcggcgcatgacgcgccgcgttacccgccctacgggaggcgccgccccttgcaaaggcacggcgaggacggctcagggctgcagcagtttcgccagtcgttcgccgtccaggccgagcatgcgggcagccttgctctcggccagttgctccgcgttgtcctcgggcaggctggcggcctgggtcgccaggctgaggatcagctcttcgcgggaaagcacgccaccgaactggtacgccgcagcgatcagccggcgcagctccagcggcagccgccaacgcgcccgcagggccgagccgaagctggcgccgaaacgccccagcagctcgtcgagccgcgcctcgtccagcgcgccgccgccatcgcaccaatcctgcaatgtccgcagcagcgccaggtcgcccaggcgatgcagcagccctgcggtatagcagcgctcgacgtccgcgccgagggcgtcggccagttcccaggcgatgtccgcgcaacgttgcgaaagatcccagaagtgcatggcgcgctcggccagcagcggctcgccgagctggatggcccgctgcaggctgaaaccgagcaccaggttcaggctgtgcccgagtcccagccgccgcagggcctggcccagggtctggcaggccggaccgacgtgccgggcggcgctgttggcggcggcgatcaggccagcggtgatctgcggatcgcggccgaactcatcctccagcacgcgcagcggatgctcctcggcgctcaggcaacgatcgctggcggcacgcacgtcggccagcaacggcgccccctccgcggagtcgcgcgcgcgttcgaggaaagcctccaggttctcgcccgcgtcccgctccggcagcggacaggcgaccacttcgtcgcccttcagcaacaaccctcgcaggcgttgcatcaggttctcggcctggaacggcttcaccaggtaggcggtcggcgccagtgccacggcggcgcgcacgctggcctggtcggcgcggtcgctgatcaggatgaacggctgctcggcgaccgagcggcgcaggcgcgcttcgcgcagcagctcgaagccatccacctgcggcaggttcagctcggccaggatcaacgcgaagcgccggcgccggcaatgcgccagcgcttctccgccatcgccgcagaggaccagccgggcatcgcaacgcacgccgaggaccagttggccaagcaagtcgcgactccaggggtccgggtcggcaatcaggatgacgggggcctttttcgcggcactcatggcgttcctcttcgaacctggcgaaccgagcgggacgcaccaggcatgacaggcgggcacgacacggcccgcgggcacacaagggtatga

SEQ ID NO: 10938 - DNA, 870 bp, Pseudomonas aeruginosa
gacgccaggccgaactcggtgtcgttggacatggcgatgacctcggcctcgtccttgaagcggaacaccggcgccagcgggccgaaggtctcgtccttggacaccagggcgttcttcggcacgtcgaccaggatggtcggctcgaagaaggtgccgccgagggcgtgcggcttgccgccggaaaccaccttggcgcccttggagaccgcgtcggcgatgtgttcctcgaccttggccacggccttggcgtcgatcagcggaccggtggtcacgccggcttccaggccgttgccgatgttcagcttggccacggcggccttcagcttgtcgacgaaggcgtcgtacacgccgtcctgcacgtacaggcggttggcgcagacgcaggtctggccgttattgcggtacttggaaatcagcgcgccctcgacggcggcgtccagatcggcgtcgtcgaacacgatgaacggcgcgttgccgcccagctccagggacaccttcttgatgtcctgggcgcactcggccatcagttggcggccgatttcggtggaaccggtgaaggtcagcttgcgcacgatcgggttgctggtcagctcgccgccgacttcgccggcgctaccggtgaccacgctgaacacgcccttcggaataccggcgcgctctgccagttcggccagggccagcgcggaatacggggtttgcgaagcaggcttgagcaccatggtgcagccggcggccagggccgggcccgccttgcgggtgatcatcgccgaggggaagttccacggcgtgatggccgcggtcacgccgatcggctgcttgatcacgatgatgcgcttgtccggctggtggccgggaatggtgtcgccgtag

SEQ ID NO: 10939 - DNA, 774 bp, Pseudomonas aeruginosa
agctggccagcgacaagaacgccatcgatttcaagcaggtactcgaccagccgggcaccttcaccctctggcaggacggccgtccggcccgctacgtccatggcatcgtcagccacttcacccaaggcagctcgggttttcgccggacccgctacgaactgctgctggaaccgcagttggcgcgcctggagctgtgctgcaactggcggatattccaggagaagagtgttccggagattctccaggcgctgctcaaggagcaccgggtgctcgactacgaacagcgtatctaccacgagcacctgccgcgcgaatactgcgtgcaggccggcgacagcgatcactacctgcacgaccggctggccttcgaggaaggcctggtctactacttccgcttcgacgaacaccgccacaccctggtctgcagcgaccggctctacgtccaggagcgtatcgccggcggcccggtgctgttcagcgcccagccggagggcgacaacccgcagccggtgcttcattctttccgctacagcgaaaatgttcgtacggctcgacagacccagcgggactacagcttcaagcgcccgacctacgaccaggagcatcatctcgctggcgaggcgctcgagcatcaggactcgtcctacgagcgctacgactaccccggtcgctacaagcggagcggcgccggccggcctttcagcgaaagccgcctcagagggcaccggcgcgatgcgcgggaggcatcggtcagcggcgacgacccgcggctga

SEQ ID NO: 10940 - DNA, 1155 bp, Pseudomonas aeruginosa
caaaggagggacatgatgcatccccgtcggttgcttgctgtacttggagtggtggtcttgaccagcatgaccagttgcacttcgttttcttcttctcggagctcttccatggacaagaccggatggattactcattgctttggtcgctttctgattgatctgccacctgacgcggtaatcaatgccggatactacctatggggagacagaattgagtacttagatgataaacctaccgaactggcagccagggttgatcgtcttgaacaagagtggaggactcagagacataaatccaaaggcaacatgcttcttcgtaaaattgactttggcaatgaatcagtaggtttattgtcttggtcttcagaggttgcctctaaaacctatttattggatacctatgttacatctaagcctacgtggcatgcctatcgttggaaagggaaagtttcggtagacagagagcaacatgctgtggagatatctagggctttagctcgaaatctacgttctcgcgcgccaaaagaaatccccagcgagccgggcttttgcatcgaccacgcttatattgcaggggatagttttcaagtggagaggtttggagtgggagtcactttccctgagcaccccggcgcgcgctttgaattccgctcctccacgggagctgagctaaacagccttcttgagcgagtcgacggcttcgtgcaaaacatgctctccacgtttgcaggtatggaaacattaagaaaaggaaagcatcctgtcgggagccttcccggagaggagtatctggttgcgggaagcgataaggggcagcgcggctataccttcatgtgggaggttcaaggcaaggaggaatcgctaaccgagcccaatcttactgcgggactggcggtactggaacgcagcaatgaaaacggtaaaccaccgccccctgccttcaaatcggataaagaagcattggaactgtgggacaccattgtcgattcgattcgcgtgcgcccgacgtcttcatcgccacgtggcggaaatgccggtccttcccctgctccgaaacccgctacgcctggcggccaaacgctcggtgatgactatgtctacgaggaattcctctccagcctgaagccgaaagacagctggctggacgacctatag

SEQ ID NO: 10941 - DNA, 273 bp, Pseudomonas aeruginosa
gagcgacccgcgatggacatcattcgccttggcgacaccaccagccatggaggcacggtgattgaggcgttcggccagaccgacctcaacggcaagccgatggccggtgtaggccaccaagtggtttgccccttgtgcaagggaaccttccccattaccgaaggtagcgccctgctggatgtgaatggggtcccggtcgcgctacatgggatgaaaacagcttgtggtgccagcctgattgccagtggcccgttgggcgctgccgaaaactga

SEQ ID NO: 10942 - DNA, 1269 bp, Pseudomonas aeruginosa
aaacgcctgaggtgttgcatgtccgtggtaactgatcgccgcatccccgactcgcccgtagaccagcgcctgccgctgacgcagctgctgctggtgggcttccagcatgtgctgctgatgtacggtggcgccgtcgccgtgcctctgatcgtcggccaggcggccggcctctcgcgcgaggaaatcgccttcctgatcaacgccgacctgctggtcgccggcatcgccaccctggtccagtcgctgggcatcggcccgatgggcatccgcatgccggtgatgatgggcgccagcttcgccgccgtcggcagcatggtggcgatggccgggatgcccggcgtgggcatcaccgggatcttcggcgcgaccatcgccgccggtttcttcggcatgctcatcgcccccttcatgtcgcgcatcgtgcgtttcttcccaccgctggtgaccggcacggtgatcacctcgatcggcatgtgcctgttcccggtggcgatcaactgggccggcggcggcaagggcgcggaagacttcggctccctgcacttcctgttcctctccagcctggtgctctgcaccatcctcctgatcaaccgcttcatgcgcggtttctgggtcaacatctcggtgctgatgggcatgggcctgggctacgcgatcgccggcggcatgggcatggtcgacctcggcggtctggccgagcgcccctggttcgacatcgtcaccccgctgcacttcggcgcgccgaccttcgacctggcgccgatcctgtcgatgtgccctggtggtagtgatcatcttcgtcgagtccaccggcatgttcctcgccctgggcaagatcaccggccgcgagatcaccccgaccgaactgcgccgcggcctgctctgcgacgccggcgcctcgttcttcgccggtttcctgaacaccttcacccattcctcgttcgcccagaacatcggcctggtgcagatgaccggggtgcgcagccgctacgtcacggtggccgccgccggtttcctgatcctcctcagcatgctgcccaaggccgccttcctggtcgcctcgatcccgccggcggtactcggcggcgccggcatcgccatgttcggcatggtcgccgccagcggcatccagatcctccacgaggccaacatcaccgaccgccgcaaccagttgctggtggcggtaagcatcggcatgggcatggtgccggtggtgcgcccggacttctttgcccgcctgccggtctggatggagccgatcacccatag

SEQ ID NO: 10943 - DNA, 1884 bp, Pseudomonas aeruginosa
tataagaacgaggaacaaaacgatggccagaatgagagcaatcgaagccgccgtactggtgatgcgccgcgaaggcgtggataccgcgttcggcgtccccggtgccgcgatcaaccccatgtacgccgcgctgaagaagatcggcggcatcgaccatgtcctggcccgtcacgtcgaaggcgcctcgcacatggccgagggctacacccgtaccaaggccggcaacatcggcgtctgcatcggcacctccggccctgccggcaccgacatgatcaccggcctctactccgcctccgccgactccatcccgattctctgcattaccggccaggcaccgcgcgcccgcctgcacaaggaagacttccaggcggtcgacatctccagcatcgccgcgccggtggccaagtgggcgaccaccgtgctggaaccggcccaggtcccctatgtattccagaaggccttccagctgatgcgcagcgaccggcccggcccggtactgatcgacctgccgttcgacgtacagatggccgagatcgagttcgacatcgacgcctacgagcccctcccggtgagcaagccgaaggccacccgggtccaggccgagaaggtcctggccatgctcgacgaagccgagcgcccgctgctggtggccggcggcggcatcttcaacgccgacgccgccgagcgcttccgcgaattcgccgagctgaccggcatcccggtgatcccgaccctgatgggctggggcgtaatccccgacgaccacccgcagatggccggcatggtcggcctgcagacctcgcaccgctacggcaacgccaccctgctggaatccgacctggtgctcggcatcggcaaccgctgggccaaccgccacaccggcagcgtcgaggtctataccgaaggtcgccgcttcatccatgtcgacatcgaaccgacccagatcggccgggtgttcatgcccgacctgggcatcgtctccgacgccggcgccgccctcgacgcattcctcgaagtggcccgcgaatggaaggccgccggcaagctgaagtcgcgcgccgcctggctggaaagctgccagcagcgcaaacgcacgctgcagcgcaagacccacttcgacaacgtgccggtgaaaccgcagcgcgtctacgaagagatgaacgagttcttcggcaaggatgcctgctacgtcagcaccatcggcctgtcgcagatcgccggcgcacagttcctccatgtctaccaaccgcgccactggatcaactgcggccaggccggcccgctgggctggaccattcccgccgcgctgggggtggtcaaggccgacccgagccgccaggtggtggcgctctccggcgactacgacttccagttcatgatcgaggaactggcggtcggcgcgcagttcaagctgccctatatccacgtactggtgaacaactcctacctgggcctgatccgccaggcgcagcgcggcttcgacatggactattgcgtgcagctggccttcgacaacatcaacgcccccgagctggaaggctacggcgtcgaccacgtcgcggtggtcgagggcctgggctgcaaggcgatccgggtgttcgacccgaacgagatcggcgccgccctggccaaggcccgcgaactgatgcaacagcaccaggtgccggtggtggtcgaggtgatcctggagcgcgtcaccaacatctccatgggtaccgagatcaacgccatcaacgagttcgaggaactggccgagaaaggcgccgacgcgccgaccgccatctcgctgctcgactgatcgccggcctttcccggaggcgcggacggtgcgtgcggcaccccgcccccggcgaaaggcctcccgaacgtttgaccgaacgatag

SEQ ID NO: 10944 - DNA, 792 bp, Pseudomonas aeruginosa
gagcaagacatgccccgtttctgcgccaacctgtccatgctgttcaccgaggtggatttcctcgaacgcttcgacgccgccgccaaggccggcttcgccggcgtcgagtacctcttcccctatgacgtcgaggccgaggcgatcaaggcccgcctggaagccaacggcctggagcaggtgctgttcaacctgccggccggcgattgggccaagggcgagcgcggcatcgcctgccacccggatcgggtccaggagttccgcgagggggtcgacaaggccatcgcctacgccagggtgctgggcaaccgccaggtgaactgcctcgccgggatccggccgcaggggcacgactgcgccagcgtcgagaagaccttcgtcgacaacctgcgctacgccgccgacaagctggaagccgcaggcatccgcctggtcatggagatgatcaacaccctcgacatccccggcttctacctgcagaacacccgccaggccctggagatccgcgacaaggtcggcagcgccaacctgttcctgcaatacgacatctatcacatgcagatcatggaaggcgacctggcccgcaccctggaaaaccagttggcggcgatcaaccacgtgcaactcgccgacaaccccggccgccacgaaccgggcaccggcgagatcaactaccgcttcctcttcgagcacctggaccgcatcggctaccagggctggatcggctgcgagtacaagccggccaccaccaccgaagccggcctcggctggatgaagacgcacaacgtcgtctga

SEQ ID NO: 10945 - DNA, 1434 bp, Pseudomonas aeruginosa
aggaagcgaacgcccggccgggagattcacggcctctgcgtccgggcgcctcgcttccattccccagttcccgccggcgcgggtgctgcggaatggaagcgtcgacgacgctgcgaccgccggtccgaccggcggcacgacaacaagaaattcggagcctgtcatgagtaccgatccacgcgcctttctcaccgagctgttcaataccgcggtggcagccggccatccctaccaggtgctggccgaccacctgccggaagatcgcagcgggcgcgccatcgtcatcggtgccggcaaggccgccggagccatggccgaagtggtggagaagcactggcagggcgagatccagggcctggtagtggcgccttaccgctacggcgcgcaatgcagtcgcatcgaggtggtggaagcctcccatccggtgcccgacgacgccggcgagcgcgtcgcccgtcgcgtgctggaactgatcagcggcctgaacgagagcgaccgggtgatcttccttctctccggcggcggctccgcactgctttcgctgcctgccgaaggcattggcctggcggacaagcaggcggtgaacaaggcgctgctcaagtccggcgccgccatcggcgagatgaactgcgtgcgcaagcacctctcggcgatcaagggcggtcgcctggccaaggcctgctggccggccagcgtctttacctacgcgatttccgacgttcccggcgacgaggccacggtgatcgcctccggccccagcgtcggcgacccgaccacctccgccgacgccctggcgatcctcaggcgctacgccatcgacgtgccgcagaacgtcctcgactggctcgccgacccgcgctcggaaaccgtcaagcccgacgacccgtgcctggcgcgcagccacttccagttgatcgccacgccacagaacgccctcgacgcagcagcggtgaagtgccgcgcggccggcttctcgacgctgatcctcggcgacctggagggcgaggcgcgggaagtcgccaaggtccacgccggcatcgcccggcagatccgcaagcacggccagccgctggcggcgccctgcgtgatcctctccggcggcgagaccaccgtcaccgtgcgcggcaacggtcgcggcggacgcaacgccgagttcctcctcagcctcaccgccgagctcaagggcgaaccgaacatctgggccctggccggcgacaccgacggcatcgacggctcggaagacaacgccggcgcgctgatgacgccctgctcccatgcccgcggcgaaaaggccgggctgaagatccgcgacgagctcgacgacaacaacggctacggctatttccaggccctcggcgacctgctggtgaccggaccgacccgcaccaacgtgaacgacttccgcgccattctcatcctcgagtcctgacatga

SEQ ID NO: 10946 - DNA, 1197 bp, Pseudomonas aeruginosa
ggtgccgcatccatcatcaggagccacgatgagcgcacccgacagctggcgcgaacgcctctatatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctcgccctgctctaccccgacgcccagtacctgctgatcgtccgggtgatacgcatgctgcggatcttccgcgtgctcaagctacgccagtacctgagccaagccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccccgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaaggcagccatgggaagtcttgaccggcagcgctgggacgccctctggcagcgactcggcggcaacccgccggcggatgccttcgacgcgctgctggcggcctatggcggggccgaccggcactaccacagcgatcgccacatcctcgcctgcctggagcacttcgaccgctggcgccaactggcgctgcggccggacctggtggagctggggtggtggacccacgacctggtctacgacacccagcgccaggacaacgaggccgccagcgccgccagcaccgagcactggctcgaccatgccgggctggccgcgctgcggccggccctgcgcgaactga

SEQ ID NO: 10947 - DNA, 777 bp, Pseudomonas aeruginosa
cgagaacaaggccaaggagttcgtcggcaaactgttcaagcaggtaccggtgctcgacaccggcggccgcgccgccaccactaccttcatgcagaaccagatcggcgacgtactggtgaccttcgagaacgaagccgagatgatcgcccgcgaattcggccgaggcggcttcgaggtggtctacccgagcgtgtccgccgaggccgagcctccggtggcggtggtcgacaaggtggtcgagaagaaaggcagccgcgcccaggccgaggcctacctgaagtacctgtggtcggacgaaggccagaccatcgccgccaacaactacctgcgcccgcgcaacccggagatcctcgccaagttcgccgaccgcttcccgaaagtcgacttcttctcggtggagaagacctttggcgactggcgcagcgtgcagaagacccacttcatcgacggcggcgtattcgaccagatctacagccccaactgatccctcgccgctcgacgaaaaagccggaagcgctcgcgcttccggctttttcattcggcttgcagttcagccactgccgcctcagcgaaactcgtgctccacctcggaccagaggctcacccgctgtccgccggcctcgaagaactccatctcgcggcggatgccggcgctgtctcgccagcccggcaggtcgaggacgatcagctcttccaggtgatccatgtagaaggcgtccaccggcgcccacaacctgccgatcgccgcgcggtcgagatcggccaggcacaggttga

SEQ ID NO: 10948 - DNA, 1446 bp, Pseudomonas aeruginosa
ataccacgtggccggcgcggacgatggtcgccgcgacctcgttgcaggcacggaagcgctgctcgaccacctcggcgtcggcatggctgtagggacaggctaggaatatcttgcgcatggttacctcgttgcggaaagcgacgccgcgatggctcgcggcgctcgtcgggggatgtttcaggctgcgtgcagggcgcttttttccgcctcgtcatgctcctgctcctgccgggcatagcgctcggcggcaggcaccgagatgcggatggcgatgaataccgccagcaggccgccgaacaatttgccgagcaggatcggcaggatcagcgtcggctggaagttggcggtgaatgccaggtgatcgccgatggtggcctgggcgcagacgcccagggccacgcaaagcaccttgtcgcgagcattcatgtatttgaacaggtggtaggtggcgatgatgttcgccagtaccatgacaaaggcggtggcgcccggctgggacagccccaggtaacggccgaggaccgccatcgggcgcttgcagtagcgctggaacaggtagcagatggggaaggtcccggccagcatgatgccgatgtagccagcgatctcgatggcgcggaacaactctttctcgtcggcgaacatcgggtcgaagccccagccgccgaagaccttggtgaagactccggtgaagtgctggacgatggaaagcgccagggccatcttgatgaacgcgtccatcaccttgccgaataccaggaacccggtgaccatcgccgtcgcccggtacttcaggccggcggccagcaggaagcagaagacgaacagcggcgccagcagccgaagcatgtcgaggaagtccagcgacaggtagtgcagggccggcgaaccggtcgataccagttcgcgcaccgggatgtggttgagggtaatcagcagcaacgccgccagcaccgcgaacggaatgctgatcaacccggccatcgcccccagcgccaggtacttgtggtccttgcgctcgagcatggtcaggccgaccgggatcaggtagacgatggtcgcgccggaggtgtagcccaccagcatggcggtaatccacatgtcgcggttggcggtcagggcatcggccaactggtagccgcccatgtccaccgcgatgatcgacagcgcggcgatggatacgtcggaaccgagggtctggaagaacgggccgagggcatgggaaatcgccttcgacagatagggaatggctaccatgatgccggcctgggcgaggaacaccggaccgatggcgtggatgccgttgacgaactcgcggcccagaccgctttccgggcgcaggatggaagccagcgcgccaagtaccgcacccagcatgatcaggtaaatcacatagtttccgaactcggccatctgcgtcgttctcccctcggcaggctcccgtag

SEQ ID NO: 10949 - DNA, 558 bp, Pseudomonas aeruginosa
cagcatcttcatcgacaccggcaccaccaccctgctgttcgcccgcgaactggcgcgccagagccatctgacggtgatcaccaactcgctgttgatcgccggcagcgtcggcgcctccggcaaccgtgcattcatgatcggcggcgagtaccgcccggaatccgaacagaacgtcggcgccctggccatcgagcagatcgcccggttcaacgccgagcatgcggtgatcaccgtcggcgcgctgaacggcgatggcgccatggatttttccatcgaggaagccgagatcgcccgtgccatgatcgcccaggcccgccaactgacggttatcgccgactcctcgaagctcggccggcgcgccctgttccaggtcttcccgctgagccggatcaaccgcctggtggtcgaccgcaagcctaccggggaactctgggaagccctgcaacaggcgcgggtggaagtccacgaagcccccctgcgcaccccgcaggcctgactcccctcgcgggcagccccggagacagaccggggctgtgccggtggctgcccgtcgattaa

SEQ ID NO: 10950 - DNA, 393 bp, Pseudomonas aeruginosa
tcgacgccgccgtcgagcggatccccggcctgcgcggcatgccggtcaccgccacctacgcaggattgcgaccggccagcgaaaagaaggaataccgcatccgccaggtcgacggacgcaactggatcagtgtcggcggcatccgttccaccggtctcaccgcggcgctgggcatcgcacgccacgtctatcgtctctaccagggcgagcgcttccacgaagcggttcgcgagccgctctggccacaggtaccgaacctcgccgaacacctgccgcgcgactggcagcgtcccggctacgacgagatcgtctgccactgcgagatggtcacccgccgggaaatcctcgccgccctggaaggcccgctgccagccggcgacttcggcggcctga

SEQ ID NO: 10951 - DNA, 1281 bp, Pseudomonas aeruginosa
gcgccggccgcctcgcccagcccttcgccaccgggagttgccatgagcatcactgaacaggtcgacgtcgccatcgtcggcagcggtcccgccggattggcagccgccatcgaaatacgccgccagggtgtcgcccgggtctgcgtgctggagcgcgacggcgaggccggcggtataccccggcattgcgcgcatccgccgtttggcctgcgcgaacacggccgcctgttgaccggcccggcctatgcacagtgtaacgtcgaacaggccgaacgggccggggtggatatccgcctgcgccatagcgtggttgctctcgccgccgccggcctgctgcaactggccaccccggaaggcccgcgcagtctgcgcgcgacacgcgtgctgctggccaccggcgcacgcgagacgccgcgctcggcgcgcctgctgggcggcgaccggccactgggcgtgatcaataccggcgcgctgcaagcctatctctatctgcaaggcctgaagccgttcgaacggccgctgatcgtcggcaccgagctggtcagcctgtccgccgtgatgagttgccggcgtgccggcatccgcccggtggccatgctcgaacgcaacgcacgggccactgcgcgttggccgctatcgttgtttcccaggctgtgcggagtaccgatgtacttctccagcgagctgctggagatcgaaggccgcggccgggtcgaggcggcgcgggtacgcctgggcgacgggcgcgtcgaacggatcgcctgtgacggcatcctcctcagcggacgcttcgttcccgaatcgagcctggtccgcctcagccacctggaactggacccggccagcggcggcccgcgcatcgatcagttcggccgctgctccgaccccgcctatttcgccgccggcaacctgctccggccgatcgagaccgccggctggtcgttccgcgagggacgaaggatcgccggcctgctggccgccgacctgcgggccgaactgccgagtgccgcacctggcatagccatcgattgcagtggtccgctcaagctgtgcgtgccgcagcggctgctggccgacccgacacccggcctggcgcatctgcagctacgcgtaagcgaggccgccagcggccgcctgcggatcctggccgatggtcgcccggtgtgggagcgtgccctgtcctgcctgccggagcgccgcctgctggtgccgctggccgccctgcgcctgccgccggacacccggcgcctggaagtcgccttcctcacctccggccactga

SEQ ID NO: 10952 - DNA, 357 bp, Pseudomonas aeruginosa
ccctcagcggcgagcggatcatccgctcgccggagacaggcctgctcgccaccatcgcctggcagatcgatggcaaaccggtgtacgccatggacggcggggtctacgacgccagcgccgcggtcgagtgggccgggcgtctcggcctgttcagcgacttctcggaactggccggcttcgaccggccgccggccatcgagcgcggcctggccttcgtcccggccctgtcgggactcgcatgcccgcactgggaccgcagcgccggcgcgatgtggctgggaatggacgccggcacccgccgcgaggacctctgccaggccctgctcgaaggcgtggtgctgcgcagcgccgaggtga

SEQ ID NO: 10953 - DNA, 1425 bp, Pseudomonas aeruginosa
aggtcaccgaccgcctgtccatcgacggcggcctggcgcgcagcccctacttcgcccagttcctcgccgacagcctgcaacggcgcatcgtcacccagcgcttcgacgaactcaccgccttcggttgcgccgcccttgccgcgcgtggcctcggctacgagctggcggagccgcgcaatacccgcacggagttccagccgcgggtcgacgccggcaccgcccggcgctggcaggtgcgtttcagcgaagcggtggcgcgcacccgcggctggcgctgagccgctttcagcgtcccggccagccggtctcgcgcagcgccgccaggagcgtctcccccttcagcgcgggcaccagccggccgtcctcggtgcgcatgtcctcgccggccagcagcacgttgacgatggcttcttccaccgcctccgccgccgcggcgaacaacggcgagatgtggtcgttgttgagcatccgcagcggcgtgctctgcggcaggtccttgcgcgcatagtcggctggcggcaggtcctggttgccggtggcgaaggcgaggaacacgtcgccgctggagtcctcggtgccaccgccggtgcgagcgatgccgatcgaggcgcgctgcgccaggcgctggcactggtgcggcagcagcggcgcgtcggtggccaggatcaccacgatggagcccatgcccggggtgccttcctcgctgaacggcgaggggatgtcgcccagccggcggccgaccggatagccatcgacccgcagctcgcgacgctggccgtggttggcctggaccagcgcgcccaccgtccagccgccctgctccgccggcagccgccgcgatgcgctaccgatgccacccttgaactcgtggcagatcatcccggtgccgccgcccaccgaaccttcgcggaccggtccggactcggcgcaggccagcgcctcgccgacctggcgggcgccgacatgctggccccagatatcgttgagcaggccgtcgaaggtctccatcaccaccggcatgcaccagtacagcccgctgtcgccgagttcggcgcgctcctcggcgatcagcgcgtcgcgcaccgcgccgacgctgtgggtattggtgatggcgatcggggtggtcagcaggccggcttcgcggatccactccaggcccgtggcgtcgccgttgccgttgagcacatggcagccggcgaagcagggttgcaggcgcgccgcaccggcgcgcggctggaccagggtgacgccggtgcgaacctgcctgccgtcgatccgctggttcagggtgctgtggccgacgcgcacgccgggaacgtcggtgatcgcgttgaacgggccgggagtgcccaggccgagggtgatgccaagttgtcgagcgcgcatgcggactcctgtttcaaagcttctggaacgccggactga

SEQ ID NO: 10954 - DNA, 408 bp, Pseudomonas aeruginosa
ccaggcgcgacagcgtctcgttgccatggctgttcaacaggtagccgatcgggtcggggctggcgagcatcgccgggagcgacggcgcgccgatcagcagcgcggcgagcgggacgatctcgatcagtactaccagcgccagcgaccagagcaccgcgcgatgcacgctgtgaccgccgtccttcatgtcctcggcgagcagcaccgcgccgccgaaaccgttgtaggagaacagcgcggtaccgaccgctccgatcaccaatgcccagggtgcgatcgccagcagcccgccgtcgccgactacctgcggctgcagaaggacgctcgccggttgctgtacatggccgaaaccgaggccgacgatcaccagcagcgccgccacttccagcagcaggcaggtacccgtga

SEQ ID NO: 10955 - DNA, 1074 bp, Pseudomonas aeruginosa
tggcgaccacgtcgaacacgcccagcgtgggtttcagcgcactttcgggcgcgggggaagagctcatgtcgttgtcctctgattgttattgaagttgaggcagtaacggagactcgcggcggccccttgccggggcgctggttatgcgccgactctaggagcgcggaaccggcgggccaatcaccctttggggttgcgccccttgacgcggcgggtggaaaagccgcaaaccggagcctgcgaaaacccaccgtggagcgaatacggatgcacaccctgttccgggacatcggcatgcacgccagcctgggccgcgccatcgaacagatcggcggcaaccgtttctggaagcaattgatcctgctgctgcgccagcacctgccgttcgacaacgccctggcgatcttctaccccgccaacggcgtgccggtggccctggaggaatacgacgccgaaccgcacgccgggccggcctcgatgctcgcctacctgaacgggctgtacctgctcgaccccttctaccaggcttgccgggaaggcctggccagcggcctgtaccgcctcgaggagatcgccccggaccatttccggcagagcgagtactacctcagctacttccacgacaacgttctggaggacgaggtgcagttcatcctacaggtgcccggccagggcgcgctgtcgctgtccctgggcatgcagaggatgttcgccgacgaggaatgcgggatgctcggcttgctctcgagctgggtcctggcgctgatgcagcagcactggcagcaacgcagccagcgcctgttgccggctgcaccgcaggaagagatggccacgcagatacgcgacgccctcagccacttcggcgccagcgtgctatcggaacgggaactggagatcgcccgcctgatccttcgcggctactcgtcgaaggccatggccgagcgcctggcgatctcgccggagacgatcaaggtccatcggcgccacctgtacgccaagctggacatttcctcgcaaccggagctgttctcgctgttcatccagtcgctcgggcacgacccggagaacccctag

SEQ ID NO: 10956 - DNA, 2283 bp, Pseudomonas aeruginosa
ccggcggcttgtagcgaacgaaatcaccgtagcgggcaaccatgtagtcgacgatctcgccgtcgctcttgccctgctgcaactggccgtagatctgcttgcgcaggtcggcggcgatcggtgcgttggagtcggcgatgtcctggttctggcacttcgggcagcgcagttcctgggtcaggttgcggaagcgttcgcgctcggcgtcgctggcgaactcgtaggtgtcgatggcggcccgggccacgccgcagagggcgagaccgagcagcgcggtggcgaggaaacgcttcatcgggcctccggctcgtccagcagttgctggtacagcggcgccagttgctcgcgccagactttctggtcgaccaccccgacgatcttgtggcggatgatgccctgtttgtcgatcaggtaggtttccggcgcaccgtacacgcccaggtccaggcccagggtgccgtcggcgtcgctgatgctcagcaggtagggattgtgcagctcgttcagccacttgatggcggcggcgttgtcgtccttgtagttgatcccgtagatcaccacgccctgctcggccagtcgggtcagttccgggtgctcgacccggcacgacgggcaccaggtgccccagacgttgaccagcgccggcttgcccttgaggtcggcctcggtcaggcgccgggccgggtcctgcacgctgggcaggtcgaaggccgggaacggcttgccgatcagcgccgagggcagctcgctggggtccagccagaggccgcggaagaggaacaccgcgacgatcaggaagatccccagcggcagcagcagaatcgctcgtttcaagactcaggctccctgaccggggaggcccagggcctcgcgcacacgtgttttcaccttcacccggtagcgccggtcgagcgccgccagggcgcccccgaggcccatcagcaggccaccgaaccagatccagcggacgaacggcttgacgtgcacgcgcaccgcccaggcaccgttatccagcggctcgccgagcgccacgtagaggtcgcgggtaaagccggcatcgatccctgcctcggtcatcatcgaactctgcacggtgtacaggcgcttctccggatgcagggtggcgatctccttgccgtcgcggctgacgtggatgctgcccttgtccgaggtgtagttcggcccttcgtggtgcttcgcgccgtcgaagaggaagtggtagccgcccagttcgacggtgtcgccgggcgacatgcgcaggtcacgctgggcgctgtactggctgctgaggacgatgccgatggcgcacacggcgatgcccaggtgcgccagttgcatgccccagtagctgcgggtcaggctgcgggcgccggccagcacgcccttgtgccgggtcttgtcgaggaagtcgcggaaaccggccaggaccacccaggcggacagcaggaacaccgccagcaccgcccagttgaaatcgccgaagtacatcgaaccggccgccgccaggaccgcgctggccaccagcaccggggtcagcatgccgagcagccagcggctcggggtgtccttccagcgcaccagcacgccgaccgccagcgccgccatcagcgccgccatcagcggcaggaacatggcgttgaagtacggcgggccgaccgacagcttggcgccgctgagggcatcgagcagcagcgggtagagggtcccgaggaggatcatcgaggccgccaccaccagcaccaggttgttcagcagcagcagggtctcgcgcgaccacagggcgaagccgacctggctcttgaccaccggcgcgcgcagggcgaacagggtcagcgagccgccgaccaccagcagcaggaaggcgaggatgaacaccccgcgctccgggtcggaggcgaaggcgtgcaccgaggtgagcacgccggagcggaccaggaaggtgcccagcaggctcagggagaaagcggcgatcgccagaagcacggtccagctcttgaacacgccgcgcttctcggtcaccgccagcgagtggatcagtgcagtgccgaccagccagggcatgaaggaagcgttttccaccggatcccagaaccaccagcccccccagcccagctcgtagtaagcccaccaggagccgagcacgatgccgataccgaggaaagcccatgctaccattgtccacggccgcgaccagcgcgcccatgcggcgtccaggcggccgccgagcactgcggcgatggcgaacgcgaaagccaccgaaaatccgacgtaacccatgtatag

SEQ ID NO: 10957 - DNA, 1062 bp, Pseudomonas aeruginosa
catcggcgggtggacgatcaggccgacgtcctgcaacagaaggttgaagtcgtcgccgtccatccgggtctgcggcagcaggcggctgaacgggttggaggtgatgatcaggaacagcaggaagccggtgctgatcatgcccatcaccgccagcacgcgggccagcatgacctccggcagttgccgggagaagatcgacacggcgaaggtccagccaccgaggatcagcgcccagagcagcagcgaaccttcgtgggcgccccaaacggcgctgaacttgtagtaccagggcagcgcgctgttggagttgccggccacgtaggccaccgagaagtcgtcgcgcaggaaggcccaggtcaggcaaccgaaggcgaaggcgaggaaggcgaactgcccccaggccgccgggcgcgccaggctcatccactggcggtcgccgcgccaggcgccgaccagcggcaggctcgactgcaccagggccaggcagagggcgaggatcagggccaggtggccgagttcggggatcatctacttgccctcctggttgtacgaggtctcgccggcggccttgccgttctcgtagtgcttcagttggccgctgtccttgagcgccttggtgacttccggcggcatgtagttctcgtcgtgcttggccagcacttcatcggccaccagcacgccgtcgccgcccagcttgccgagggcgacgatgccctgcccctcgcggaacaggtcgggaaggatgccatggtaggcgatggtcacttccttggcgccgtcggtgaccacgaaacgcacgttcagcgaatcctcgctgcgttgcagagaacccttttccaccaggccgccggcgcgtatgcgggtgtcggtcggcgcttcgccgttggcgatctgggtcggggtgtagaacaggttgatgttctgttgcagggccgacagcgccaggcccaccgcggcgccgacacccgccacgatggcgaggacgatgatcagacgtttcttgcggaccggattcactgctgggcctcccggcgcagacgacgcgcctcttcttgcaggtag

SEQ ID NO: 10958 - DNA, 402 bp, Pseudomonas aeruginosa
atgtccgctgctgggcagtccctgcagcgaagcctgcagcgccccgctaccgagaatcagcaccgggatgtacagcggcaggatcagcagcgccagcaacaggccgccgcgcttgaggcccacggtcaaggccgcgccgacggcgccgagcaggctcagcaccggcgtaccgagcaacagggaaagcagcagcaccggtatgcaacgggccggcaggcccagcatcagcgcgaacagcggcgacatcaggaccagggccagcccggaaaacagccagtgtgccagcaccttggccagcaccagaagagccagggggtgcggcgaaaggacccactgctccagagaaccgtcctcgaaatcgctgcggaacagcccttccagcgagagcagcacggccaatag

SEQ ID NO: 10959 - DNA, 699 bp, Pseudomonas aeruginosa
ccggcgggcatctgctgcaggctgtggtgggtggtcagcaccaccatcccgccgcgctggcaatgcccggccaggtgcgtttccagttgcgccaccccctgtttgtcgagggcggtgaagggttcatcgaggatccacaagggcggtgcgtccaggtacaggcgggccagcgccacgcggcgttgctggccggcggaaagggtgtggcagggaacgtcctcgaagccacgcaggccgacgtcggccagggcctgccagatcgcctcgcggctggccggctggtgcagcgcgcagagccaggtgaggttctcctcggcgctgagcaggcccttgattcccgcggcgtggccgatccacagcaggctgcgggccagttcgccgcgctgttcggcgagcggccggccgttcaggcggacttccccggcggtcggctgcatcagtccggacagcaggcgcagcaggctggtcttgccgctgccgttgggacccaccacctgcaacatctcaccggcggccaggcgcaggtcgaggcgctcgaacagcatgcgccagtcgcgctcgcaggcgagcccgacggtttccagcaaggggctggctgtggggacttcagcaggatcggacatcgaacaacatcgccaagcgtctttcctcgtcgcggcgccggaggccttcacggaacagaccctaaagtcgggataa

SEQ ID NO: 10960 - DNA, 441 bp, Pseudomonas aeruginosa
tggaacacaccgccgtggacgacccttgcgccaggcccggcgaggcgatccctgcgggacagccaggcgctcgtcgacggcgaatacctgaacctggccatcgagcgtcgagaagacggccaattgctcggcagttgtatcctcttccatttcgagaaaggctcgcgccgcgccgaactcggctactgcctggcacgtgcagcccagggccggggttacatgggcgaggcgctgcgcaggctgctggcgttcgctttcgatgaaatcgacctgaaccgcctggaggcggagatcgatccgcgcaaccggccttcggccgccagcctggagcgcctgggcttccgccaggagggcctgctcgcacaacgctggatcgtttccggagaagtctccgactcggcgctctacggattgctcgccgagcactggcgcaaccgctga

SEQ ID NO: 10961 - DNA, 468 bp, Pseudomonas aeruginosa
atcgagccgaggcacaccagcggcaccgccagggtcagcccggcgacgtcgaacagcaggcactcgaagggctccgccgcccaggccggacgaccgtcgtcgagcagcggcaggtcgagcagcggcggctcgccgacgctcgccggggcgctcggcacgcgcaactcgatgacttcgtggggccgtggctcgaccggcagctcgcgcaacgtcgtcggttcgtcgagcagggccgccggcgccggcggaaccaggcgcgcatcgcggacctgctcctcgagcaccgcggcctcgaactcgtcgaacccgtggtcgaccggcagcgtttccagcgccggggccggtgtcgccacttcggcgaccgccagcgcgacaggcttcaacggcgcgggcgcaggcgctggcggcgtctcgacgagaggttccaggtcctcgaaagtggcctcctggagcaacgcatccaggtag

SEQ ID NO: 10962 - DNA, 294 bp, Pseudomonas aeruginosa
ttcaggcgttcgtcgccggggaggatgcgcaccgtgccgcggccgtcgaccatcatctgcttgccgcccggcgccagcagcgccaggccgggacgcaggatgtcgccgtcctctgcttccttgacgctgatccggcacagcttgtcgaggcgctcggcgaaagccttggtgaaggccgccggcatgtgctggatcagtaccagcggcgccgggaagttggccggcaactgggtcagcacccgctgcaaggcaaccggtccaccggtggaggtaccgatcgcgaccagccggtag

SEQ ID NO: 10963 - DNA, 243 bp, Pseudomonas aeruginosa
gccttgcgcttcggcgccgccgaggtcgacgccggggccggcgacgcgccggcactggcacgcgcgctcgcgccgaggctggaggacgacgccggcgcatggctggacgaggtggccgaaggcagcggcggcaggctgatcgagcgacgattgctacgggcgatggtcaggaccttctcgcagagcaactggcggaccttgtccgggttgcgcgagatgtcctcgaaattcttcggcaggtag

SEQ ID NO: 10964 - DNA, 852 bp, Pseudomonas aeruginosa
cggcagcgatgccgcagtcttgagccgggcgggtcagaaacccaggctggacagcagatcgtccacgtcatcctgcccggacaccacatcctctcgtttttccgcggcgacctgcggcccctcgcccttggccgaacgctccagcgcggcctggtggcgcatgctcacgtggtcgtgctcgattccggcgtaacggtccacctggccggccatccagaccagcttcacgaggttgctctcgacctcggtgaccagcttggtgacacgcttgatcacctggccggtcaggtcctggtaatcctgcgccagcaggatgtcattgagctgcgaggacaactggccggcgttctcgccgctgcgcacgaggaactgttcgatgcgcttggccagctcgcggaagccgtcagcgtcgatttcccggcgcatgaagcgttgccactcctggtgcagctcccgcgaatcgtcgcccaactggttgaccagcggggcgctctgctccaccaggtccatggtccggttggcggccttctcggtcatttccaccacgtaggaaagacgatcggtggcatcggcgatctgcgacatttcctgcgcgtggggggaatgcgggtcgatctggaaatcgacgatggcgttgtgcagttcgcgggtcagcttgcccacttcctggtagaggccacggtccctggcctggctgagctcctggatcaattgcaccgcctgctggaagtgcccccgttcgagacagtccaccagttcgcgcgcatgttttttcagggtcgattcgaattcgtcgcccgtggaatcgttaccaagcaccatgacaccctcttggccggcttcagccgttga

SEQ ID NO: 10965 - DNA, 648 bp, Pseudomonas aeruginosa
gcatcggtgatcgaggtcggctcgtcgcagacgaccagcagcacctcctgcgcggcgcggacgaaactgaccaccgaatcgccgatcccggcggcagtgtcgacgaccaggacatcgaggttgtcgctgatatcgctgaacgcctggatcagccccgcatgctgcatcggcgagaggtgcaccatgctctgcgtgccggaggccgcgggaacgatgcgcacgccaccgggaccgaggaggaggacatcgcgcagttcgcagcgtccctcgatcacgtcggccagggtgcgcttgggcgtgagtcccagcaggacgtcgacgttggccaggccgaggtcggcatccagcagcatgacgcgacggccgagatcggccagagccagtgccaggttcaccgacacattggtcttgccgacgccgcccttgccgccagttactgcgatcacctgtacgggatgcatgctacccatctgcttcataccttgtgttgtcgtcttcccggaacgccccttccagcgctctccggtattggcgggaacgatgcgccatcgctcccggcccggcggaagccaccttcgcttccgtcacccgcgccacgcgcggttcttcccacgtcctcagccggcacgccgcgccggttgctggtag

SEQ ID NO: 10966 - DNA, 945 bp, Pseudomonas aeruginosa
acagccagtcggcggcgaccaggtggcggaaggtcaccgcgatcaccggcaactgcccgctgcgccaggcgcgcagggcgtagtaggccgaccccaggccggtgccgaagagaatggtcgaggaaaggatatgcagggttttcagcagcaggtaaaggttcatccacgggcctccctggctcgaggttcgtcgcccagcagccagagcgtggccaccatcagcacgatgttcttgccgaccgccatgtaggggtcgtaccagtagtgcggcaggatcaggctgatcgccaggctgtagccaagcatcagccagaactgcgccagcagcgcgcgccggcgccagcggcggagcagcaggccgacgccgagcgcaccgtcgagcagggccccggcgatcaccgccaggctcgccggccagccgtggatgccggcctcgccgaggatccgcaggccccaaccgtaacccggccccaggcaggcgaccagggtacccagccagatcagcaccagggccgccagcatcagcggccgcatcagcgccgccaggctgcgtgccgcctgcggccagccgagcaggcgactggccagcggcgcgcaacgatagccgcaggccgcatcgaggagtgccgggtcggccaggttgtcgtggcgcaccagcttcagcatcgatggactcagtgtccgccagccagcacgccggccaagcccgcccaacgcatcgagaagcgccgcgggcggcaccacatagcggccgcgcggccaaccctgggcgcggcgcagctcgtccagcagctcgccctgggtcagcgcctgcggacccaccagcggaatcacctgcgcccgctccggccagcggcgcagcaaggccagcaccgcgccgaccaggtcctcgacatgcagcggttgcaggcgcgcgcgattgtccagcaagggaatcagcggtag

SEQ ID NO: 10967 - DNA, 969 bp, Pseudomonas aeruginosa
cgtattgttcgagcatcggaggcggttcggcggacttcacggaagcccggagtctactccaggcccgccgggcggactaccggcgcgccgcaggaaaacaccgcgactgccggtcatccggggcaagaccggaggacgccaggccgctataattcgtcccttcgtatcgcagcggcacaggacgtgccggaaacccgccgggccgccccggccgcgcgcaccctccgcctgcgccgccgggacggccggccaggcaaccagacaggcacccgggatgaaccaggatcagctcaagcaggcagtggcacaggccgccgtcgaccacattcttccgcacctcgacagcaagagcatcgtcggcgtcggcacaggctccaccgccaacttcttcatcgatgccctggcccgccacaaggccgagttcgacggcgcagtggccagttcggaggccaccgccaagcgcctgaaggaacatggcatcccggtctacgagctgaacacggtcagcgagctggagttctacgtcgacggcgccgacgaaagcaacgagcgcctggagctgatcaagggcggcggtgccgcgctgacccgcgagaagatcgtcgccgcggtggccaagaccttcatttgcatcgccgatgccagcaagctggtacccatcctcggccagttcccgctgccggtggaggtcatcccgatggctcgcagccacgtcgcccgccaactggtgaagctcggcggcgatccggtctaccgcgaaggcgtgctgaccgacaacggcaatatcatcctcgacgtgcacaacctgcgcatcgacagcccggtggaactggaagagaagatcaacgccatcgtcggcgtggtcaccaacggcctgttcgccgcccgcccggccgacctgctgctgctcggcaccgccgacggcgtcaagaccctcaaggcctgagcccgctcgccccaggccgatga

SEQ ID NO: 10968 - DNA, 432 bp, Pseudomonas aeruginosa
ccggtgcggggcgacactgcaacaaaagcggctacgctgtgtctcagcagacggctggtccgttgcgatccgccgcaccccgtgaacaaggagctagacatggcagccaaattccatctgaagaaagcgaaagacggccagttccacttcaacctgcatgccgccaacggcgagatcattctcaccagcgaactgtacaaggccaaggactcggcgctcggcggcatcgagtcggtgcgcaagaactcccagcgcgacggtgccttcgaggtcaagccggccaacaacggcaagttccacttcgtgctcaaggccaccaatggccaggtcgtcggccagagccagctctatgccagccaggccaacgccgaagccggcgtgcagtcggtgaagcgcgcagcgccggaagccggtctcagcgacgaaagctga

SEQ ID NO: 10969 - DNA, 2157 bp, Pseudomonas aeruginosa
acgcagcgccccattttcaggctcgcaagtaacactcccggccgctgcctctctctgcttcgccgtccaagccgctgccagttacaacgtagcgacacctcaggtcgcccaggcgtcaattcgtgctccagagacatgaaacggtccgcatcctgctttccgcggcgcgagcatcattcgatgcaccatcgtaccgacacagaggaaagtgccgtgttcaaaccattagctgtcgctgtaggcctgggatgtgctgcgctgtcgttgggtgccaacgcctatcaatacggggaatacgccggggagaccctggagcgcctgatcaccgactacccgggccgctatcgcggcaccgccagcttcgccggcgccagcgaactgatgcagtcgcgcctgggcttcggctaccagaccagtcgccaggacttcacctgggccggcaaccgcagttcgcagaacgtcatcgcctcggcgcccggcagcagcgggaagttcctggtactcggcgcgcactacgacacctactacggtcgcccgaccctgcagggcctggacgataacgcctcgggcgcggcggtgctcaccgagatcgcccgcaacctcggcggcatcgccctggagaacggcctcgaggtggtcggtttcggcgccgaggaggaaggcctgcgcggttcgcgtgcctacgtcgagtccctcgacgccagccagcgcgccaacctgctgggaatgatcaacctcgacagcctggtcaccggcgacaagatgtacgcccatgccggctccaacagcgtgtccaacccggccctcggcgcctaccgcgaacagatcctgcgcatcgcccgcgagctggacatcccgctgttcaccaaccccggcctgaacgccgaatacccggcgggtaccggctgctgcagcgacggcgaaagcttcaacgggatggacatcccggtgttgttcatcgaggcgaccaactgggaactgggcgacctggacggctacgagcagaccgacaacccggcgattcccggcggctcaacctggcacgacccggccgaggacaacaaggaagtactgaccaacgccctcggccaggagcgcatcgagcaacgcatgcgcgacttttcccgcctgctgacgcgcctggtgctggagctgaccaacgccgacctgctggcctccaccgcctccggcggcgccctggcgcggcagatggaagaccagttgcagcgccagcaccaggcactgacccgcctgcacgaccgccgctggctgaccctgctcggcagcaaccggccggtaggcagcttcgacggcgaggtgggcgcggagggcgaggtctcgccggacagcggtttcgacatgcctggcgatccggagtccaggcgcgccggcgtgcatctgctcggcgactaccgctacagcgaggccctgaccctcggcggcagcctggccttccagcgcagccgcgacaagctggaccatggcgggcgcatcgagggcgacacctggcagctcggcctgttcggcctgtacaacgacggcggtccggaatggctggccggcgagctgaacctcgggcatacccgctacgacagcaagcgttcggtctacctccaggccgccggcgggccggtgctgctcgaccagcgtctgtcgggcgacacctcggcctggtcctggggcgcccggctggaaggcggctatgacttcagcttcggcgaactgcggagcgggccgctggccggtctcgactacatgcgctaccgcatcgacgacttccgcgaggacgaggccctgcgtaccgcgctcggctacgagaagcaggactacgactcgctggaggtgagtctcggctggcgcctgcgcggcgagctggcgctgggcgcgaggatgcgcctgcaaccctacgccagcctgcgctgggtccgcgagctggcggacggacgcctggacgacatggacctgaccagccgcggcgacgggcgtgtccgggtcgccgacatgggcggcgtggacaaggatttcggccgcgcccagcttggcgcgcaactggcaatcaccgagcagctcggggtcttcgccgaagccaacagccgcttcgcccacagcgaaggcaaccaggcgggctattcgctcggggtgaactggcagttctga

SEQ ID NO: 10970 - DNA, 1077 bp, Pseudomonas aeruginosa
caactgcttgactgcatggaattcagcatgaccagcgcgatagccatcgagcggatctgcatggaattcggtacccccggccaaggcctgaaggcccttgacgatgtgtccctggatatccacgccaacgaattcttcaccctcctcggcccttccggctgcggcaagaccaccctcctccgcctcatcgccggcttcgaacagcccagttccggcagcatccgcctctatggcgaacacatggaaggcctgccgccgttccgccgcccggtcaacacggtgttccagagttatgcgctgttcccgcacatgagcgtcgccgacaacatcggcttcggcctggagatgcagggccgcccgcgcagcgagatcgacgccaccgtgagccgcatgctcgacctggtgaagctgccggaggtcggcaagcgccgcgccgaccagttgtccggtggccagcagcaacgcatcgccctggcccgcgcgctggccagccggcccaaggtgctgctgctcgacgagtcgctgtcggcgctggacctgaagctgcgcaaggaaatgcagatcgagctgaagcgcctgcagcacgagaccgggatcaccttcatcttcgtcacccacgaccaggaggaagcgctgaccatgtccgaccgcatcgcggtgatgagcaagggcaaggtgttgcaggtcggcacgcccagcgacatctacgaggcgccgctgaaccgggcggtcgccgacttcatcggcgaaaccaacttcctcgagggccaggccgacgccgacggcgtgcgcctggcggacggccagcggctggccgcgacgaccccgggcagcggcgctgtgaccttggcgatccgcccggagcgcaccgaactggccgccgacggccagttggaaggcgtgctggaaaacatcgtctatgtcggcaccgataccgtctaccacctgaacgtggccggacagccgggcttccgcgtgcgccagcagaaccgcgacggcgcacgctgcccgcacagtccgggggcgaaggtgcgggtgcggattcccgccgccgccatccgggtgctcgccgaatga

SEQ ID NO: 10971 - DNA, 1923 bp, Pseudomonas aeruginosa
tctacaacctgcgcttccgggccaacgccggcggaggccagccatgaacggccgcaatccactctggaccttcagcggcgtgcgccaggccgcctggctgttcttcgccttcctctacatcccgatcctggtgctggtagtgctcagcttcaacagcggccagtcggcgacgctctgggagagcttcagcctgaaatggtatgcggtggtggccaacgatccggaaatcctccgcgcggcgaagaactcgctgctcgtcgccaccctcgccaccctggcctcgaccgtcctggccaccctcgccgcgctgggcatgcgcggtcgcgccttccgcgggcagaccctgatgaacggcgttctcggcctgccgctgctggtgccggagatcgtcaccgcggtggcgaccctgatgttcttctccttcatcggcctgaagctgtcgttgttcaccatcctcatcgcccacatcgtgttctgcatccccttcgcctacctgccgatccgcgcccgcctggagggcctggacccgcgcctggcggaggccgccgccgacctctacgcctcgccgtggaaggccttctggaaaatcaccctgccgctgctgatgcccggcgtgctgtccggggcgatgctcgcgttcatcatctcgatggacgatttcgtcatcacctatttcgtcgccggcgccggcgcaaccaccctgccggtgtacatcttcagctccatccgcatgggcatatccccgaagatcaatgcgatttcctcgatcatcctcatgatttccatcgccttcgtcgccctgtcgtactacctcggccaacgccgccgctgagaacctgcctccacgaagaaaaaacagaagatcgccaggagtccatcatgacctaccgcacaccgctcaccctgctcttcgccgccggtctagccctgggcggccaggctcgcgccgaaggcaccctgcacttcgccaactggtcggactactacccgccggagttactgaagaagttcgagaaggacaccgggatcaaggccaccctcgacgcctacgacagcaacgagacgctgctggccaagctcaaggccggtggcggcgcctacgacgtggtggtgccgtcggacagtttcatagaaatattcgtcaaggaggggctgctgcaaaagctcgacaagagccagttgccgagcctgggcaatctgaaggaaaacttccggacccttggcttcgatcccggccacgactacagcattccctatctctggggcaccaccggctacagctacgatacggcgaaggtgccgggcggcaggctggaagaaagctggaagccgttcttcgaaccaccagccgagctgaaaggcaaggtggtggctctgaactccatcgaggaactgttcattcccgccacctactacctcggcatcgacgaatgcaccgaggacgccagggaagcgcagaaggtcctcgacctgctgctcaggcaaaagccggcgctggccatgtacaacagcgacggcaccatcgagcgcatggccgccggcgaggtcgccatgcaccagcagtggaacggcgccttccaccgcgcccacgcccaacgcgccagcctcgaatacgtctatccgaaggaaggcatccggctgttcatcgacaacttcgcgattccgcgcgacgccagcaacgtcaaggaagcccacgtcttcatcgactggatgatgcgcccggagaacatcgccgccgcctccaacttcgccaagtacaacaacgccatcgtcggctcggagaaattcatggagaaagcactgttcgacgacccggcgatcaacaccccgcaggacaagctcgaccgcctgaagccgttcaagctctgctcgccgaaagccctggcgttgcgcagcaaggtctggaccaagcttaagaaatga

SEQ ID NO: 10972 - DNA, 1578 bp, Pseudomonas aeruginosa
acactatcgacgccccaacgcccgtgcccgcacacgccgcgcgccctctcgtcactgccatttccaccgacccggcggaaaccccagcggttttccactagcccgtccattcacccggcgcaggaaaggtccgcccaagcggccgcctgcgggatcgatacggcatttcgcgaggagcggaacatggccagcgaacgcaacaacggcatcctcatcggcggcaagcgccccgagtacgtccacagcgcccagggcaccggcctgcggcgcatcctcgggcttcccgccctggtcttcttcgggctggtctacatggttccgctgaccatgttcaccacctacggggtagtcaccgagatcaccggcggtcgtaccgccagcgcctacctggtcaccctggcggcgatgctcttcaccgccttttcctacagcttcatggtgaagaaatatcccatcgccggctcggcctattcctataccagcctcagcttcggcccctgcgtcggcttcctcgccggctggtcgctgctgctcgactacctgttcctgccgatgatcaactacctgctcatcggcctgttcctcaacatcgccttcccgatggtgccggcctgggtcttcgtgctcgcggcgatcggcctggtcaccgtgctcaacgtgatcggcatcagctcggtggccggcatgagcaacgtgatcgtcggcgcccagttcgtcttcgccgtggtgttcgtcgccatggcggtcaagcacctggccggcatcccctcgctggacctgagcctgcccttcgtcggcgacggcagccagccgggcttcgccccgttgatggccggcgcggcggtgctgtgcctgtcgttcctcggcttcgacgcggtctcgaccctggccgaggaaacccgcgacccgcaacgcgacatcccgcgcgccatcgtcatcaccacggtcggcgccggcctgctgttcaccgtgctggcggtcttcagccaactggtgttccccggcagcgtattccaggacgccgagtcggcggccaacgaagtgatgctggcggccggcggcaagttcctcgccagcttcttcaccgccgcctacgtcgccggcgccgccggctcggcgctggcctcgcaggcctcggtgtcgcgcatcctctacagcatgggccgcgacggcatcctgccgcggcgcgtgttcggcagcctctcggagcgcttcaagacgccagtgatcgcgatcctggtggtctcggtgatttccctgctggcggtggtcatcgacctcaccaccctggcctcgatgatcagcttcggcgcgctggtggcgttctccgcggtgaacctggcggtgatccgcagctacctgctgctcgacggccgccgcgccccgcgcgacctgctgcgctacgggctggtgccggccatcggcctgggcctgaccctgtggctgtggaccagcctctcggcgctgaccctggtgatcggcctgacctggttcgccgccggcctcgcctacctggcgttgcataccggcggtttccgccgcaaggcgccgaccgtgaccttctccgaacagaactga

SEQ ID NO: 10973 - DNA, 1050 bp, Pseudomonas aeruginosa
gcccgggagcccgacatgctgaccatctacagcgacgaccatcgcctgcaccacggccggcacgaactgatcggcggccagttcaccccctgcttcgaaaaacccagccgcgccgacatggtcctcgaccgcgtgaaggccgtcggcctcggcgaagtccgcgcaccgcgcgacttcggcctggaaccgatccgccgggtgcacagcgagggtttcgtgcgtttcctgcagaacgcctggcaggactggctggccaccggccgcagccacgacatgctgccgatcgcctggccgacccggcgcctgcggcagacggagccggacaacatcgacggtcgcctcggctactactccttcgacgcaggcgcgccgatcaccgccgggacctggcaggcgatcaccagttcggccaacgtcgccctcagcggccagtccgaactcgccaacggcgcgcgctcggtattttcgctctgtcgcccgccgggccaccacgccgcggccgactacatgggcggctattgcttcttcaacaatgccgccatcgccgcccaggccttcctcgaccggggcgccgggcgggtggcgatcctcgacgtcgactaccaccatggcaacggcacccaggacatcttctacgaccgcgccgatgtgctgttcacctcgatccacggcgatccgcgcttcgaatacccctatttcctcggctacgccgacgagaagggcaacggcgtcggcaccggctacaacttcaactacccactggcggccggcagcgactgggcgacctggagccaggcgctgcaggcggcgatccggcagatccaggcctatgcggcggacatcctgatcgtttctctgggggtggataccttcaaggaggacccgatttcccagttccgcctggacagccccgactacctgcgcatgggcgaagccatcggcaagctcggcctggccacgctgttcgtgatggagggaggctacgcggtggaggaaatcgggatcaacgcggtgaacgtgctacagggtttcgaaggggttcaccggtaa

SEQ ID NO: 10974 - DNA, 1332 bp, Pseudomonas aeruginosa
tgcctctgggcgccgagttgcgggtgccggccagcgccggccggacccgcttcgcgcagttcgctttccagccacttcctccgggacaacaggtttacgcagatgagcaagacctctctcgacaagagcaagatcaagttccttcttctcgaaggtgtccaccagaacgccgtggacacgctgaaggccgccggctacaccaacatcgagtacctcaagaccgcgctttccggcgacgagctgaaggaaaggatcgccgatgcgcacttcatcggcattcgctcccgcacccagctgaccgaagaggtcttcgactgcgcgaagaaactgatcgcggtcggctgcttctgcatcggcaccaaccaggtcgacctcaacgccgcccgcgaacgcggtatcgccgtgttcaacgcgccctactcgaacacccgctctgtggctgagctggtactggccgaggcgatcctgctgctgcgcggcatcccggaaaagaacgcctcctgccatcgcggcggctggatcaagagcgcggcgaattccttcgagatccgtggcaagaagctcggcatcgtcggctacggctcgatcggcacccagctctcggtactcgccgaggccctgggcatgcaggtgttcttctacgacaccgtgaccaagctgccgctgggcaacgcggtgcagatcggcagcctgcacgagctgctgggcatgtccgacatcgtctcgctgcacgttcccgaactgccctccacccagtggatgatcggcgagaaggaaatccgcgcgatgaagaagggcggcatcctgatcaacgccgcgcgcggcacagtggtcgagctggaccacctggccgccgcgatcaaggacgagcacctgatcggcgccgccatcgacgtgttcccggtcgagccgaaatccaacgacgaggaattcgccagcccgctgcgtggcctggaccgggtgatcctgaccccgcacatcggcggctccaccgccgaggcacaggccaacatcggcctggaagtggcggagaagctggtcaagtacagcgacaacggcacctcggtgtcctcggtcaacttccccgaagtcgccctgccgtcgcacccgggcaagcaccgcctgctgcacatccacgccaacatccccggcgtgatgagcgagatcaacaaggtcttcgccgacaacggcatcaacgtttccggccagtacctgcaaaccaacgagaaggtcggctacgtagtgatcgacgtcgatgccgagtactcggacctggccctggagaaactccagcaggtcaacggtaccatccgtagccgcgtgctgttctaa

SEQ ID NO: 10975 - DNA, 600 bp, Pseudomonas aeruginosa
gcccgaccgacgttcattcccacccgaggagtactacatgcgatttctgccccgcctgctgatgctggtatccctggccgctccgctggcccatgccgagctgctcgacgacgtccaccagcgcggcgccctgcgcatcgccctggagggcacctatccgccgttcaacttcaagcagggcggcaagctcaccggcttcgagaccgaactgggcgaactgctggccgccgaactggcggtcaagccggaattcgtcaccaccgaatggagcggcatcctcgccggcctgcagagcggcaagtacgacatcgcgctgaaccaggtctcggtgaacgagcagcggcgcaaggtcttcgacttcagcgagccatacaccatctccagcgcccagttgatcgtgcgcgccgacgaaacccgccagttcaagtcgctggaagacctcaagggcctcaagctcggcgtcgggccagggcaccaactacgccgacctggcgaagtcggtggccggcgtcaacgtgcgcacctatccgggcgccccggaatacctgcaggacctggccagcaaacgcatcgacgcggcgctcaacgaccgcctgctga

SEQ ID NO: 10976 - DNA, 1005 bp, Pseudomonas aeruginosa
atgcggcgctggagaagatcaaggccgacggccgcttcgccaagctctcggaaaagtggttcggcctggacgtcagccagccgccgaagtgagttcccgcccgaacgggggaagcggccgcgcccgagagacgcggccgtcgtgtttgtcgatggagtgttgaatgaattcgctgcagaaattgctcgaatggctcgccaacctggtcgagctgctcgggatggcctggcccttcctgctccagggcgcgatgtataccgtgctgttcgccgcggtatcgatggtcctgggcctgatcctcggcttcagcgtcgcggtggtccgggtgaccaaggtgccggtggtctcgcagatcgccgcggtctacgtcagcgccttccgcgggacgccactgctggtgcagatcttcgtcctgtactacgggctgccgagcgtaggcatcgagttcaccccggtcaccgcgggcatcctggcgctgaccctgaatgtcgcggcctatctctcggagtccatgcgcggggcgatcctcggcatcgacaagggacaatgggaagccgggctctcggtcggcctgacctggggccagaccctgtggaacatcatcaccccgcaggccctgcgcctggcggtgccgagcctgtcgaacagcctgatcagcctgatcaaggacacctcgctgatctccgtgatcaccgtgaccgaactgatgctggcgaccaaggaggtcatcgccgagaccttccagccgctgccgctctatctcgccgccgccgggatctactggctgctttcggcactcttcgagcgtgtgcagaaagccctggagaaccgcctgaccgcgccgctgcggcgctgagcgttcagccgccggcgtcgaggccggccaggcagaccgcggcgcggtccagttcatcctcgttgaataccagcacgcccatgcgcttgagggcggcggcggtaacgccctcgccggcgacccggttgccgttgaagcgcccgtcgtag

SEQ ID NO: 10977 - DNA, 303 bp, Pseudomonas aeruginosa
ttctccaggttgccgcaggaaggactgcgcgccttgagcacggccatccggatgtcatggcggcggaccagctccactgccgcctccgcacccagcaggaatgcttcgctgacatcctcgccgtcgacggtgaagacccggttcagccggtccagcacttcgccgccctggccgccggggatatccgctggcgggcggggcgtcggcaggcctccggcgacctccgggcaaagggcgacgatccgcccctgcgcatgccagcgcgagagcaggtcgaacgggccatggctgccaccgtcgtag

SEQ ID NO: 10978 - DNA, 639 bp, Pseudomonas aeruginosa
gatagaactgcgggcggcccatggcgaacctccgccgccccgagcagactggcttcccgcgcaaccgcgaaggaaccgcccgtcatgctcccgacccgctcgcttctaccgtttttcctggcccccgcgttgctcgccagcgctgccagccaggcggccatggaggccctggacaacgacagtctcagccaggtcaccggccaggccggcatcagcctgcgcctggacctgcgcgccggcgcggccagggtcgcctgggtggacgacggcggcagcctctcgctgcgcaacctggtgatcgacaacggctgcgtgaaggccggcgactgcccggacgggcgcggcggcaacatccccctgggcgccgcccagctcggcatgagcttgccgatattcggggtagagcagccgaccctggcactggacgtgaccaccggcagcggcggcgggcagcaactggcgatcagcttgccggacctcgccaccatcaacgaccagttgatcgccagcggcctgccggcgcagcgcatccgcctgcgggtggccagcgacctgtacatcggcgacaactcgatcggccgcatcgaactgcgcgacatcaccgacctgcgcggcacgatcaaggtctggggtcactga

SEQ ID NO: 10979 - DNA, 858 bp, Pseudomonas aeruginosa
cgtgccgccccggtgtctcgacaagcggtccgccgcatgtcgacaatagcgccccatggacggcaccacccgaacgacgaggctttcgccgccaaaggagtatcaatgcgcgctttgctcgccttcgctttactgctggttggtctgcccgccctggccgacccttatcaacgcctgtaccaggccgctggctggcccgaccagcgcgcgcatttcagcgatgccctggacgcggcgcagaagcgctaccaggacaagctgccgcccgcgctctaccagaccctggtggacaacagcaatcgccgcttcgccccggccgaagtcgaccagcgcgccctcaacggcctgcgcgagaacctgccggacagcgccagcccgctgaatttcttcgagtcgccgctggggcgcaaggtggtcgccgccgaggtgctcgccacccgccgcgaccagttgctccagcacagcaacggcctgccgcggcagaccgccagcgagccacgccgggccctggtcaagcgcctggcccaggtccttccggcccgagaggccggcgcggaagtcagcctggccctggccggggtcgccgccgacagcctcagccagatgcttccgggcctccccggcctgcttggcggcggacagaccggccagttgctggaaggccagcgccagcgcctggtgcagcagatcgacgcggacctggagaacaccctgctgtatgtctaccgcgatctctccgatgcggaactcacccagtacgtgaacttcgccgagtcgccggccggtcgcagctactaccaggcggccctggccgcgctgaaagccggcctggcggtggaccaggcggtcgccccctga

SEQ ID NO: 10980 - DNA, 1707 bp, Pseudomonas aeruginosa
cggctacactgcccgggtcggcccacgaggggccgttgccgaaccaaggagtcgctgcatgtccctacgtcccaccctcgccctgctcgccctcgtcagcctgccactgatggccgcccagaacgaccctcagcccagcagcaaggaactgatgaaggagcaccaggcgcagatccagaacgacctggccgacgtcgactacaagcgcaagcgcatcgtcgaggccaacatgaacctcaccgaccaggaaggcgagaagttctggccgatctacaacacctaccgcaccgagtcggacaagctcagcaaggaaaccctcaagctcctgctcgactacgcccaggcctacaacagcggcaacgtcagcgacgaccaggcgagcaagctgatcgagcgtgtcgacgacctccaggaggaccgtctggaactgcgcgacaagtacgtcaagcgcatcgccgagaacgtctcgcccaagcgcgccatgcgcttcctgcagatcgagatccagctcgacgccatcgccaccctggagatcggccgtcaggtaccgctggtcgagtaaccctcttcccgcttcgccagccgcgccctgtattgctccgggggcgcggcgtgccagcggcgaaaggcccggtagaacggcgacagctcggcgaacccgcaagccttggccacctcgcggatggcgcgaccggccaacagcatctcgctcgcccgctgccggcgaacctcatcgcgaacctgccggaaactcgctcccccagcggccagcgcacgctgcaaggcaccgctgccaaggcccagctccgccgcgcactggcgcaagccatagccctccccgaggcgcagctcgatcaggtagcgcacgcgattgagcaagcggttctcgctgagttcgcgggactgttcttccgcgtggcgggtcagcacgtcatgcatgtccggattggcgttgcgcgaaggacgccgcagcaaggcggcggaaaacaccagggcatcgtgcggccgcgagaacagcggcagcctgccgaacaaccggcggtgttcgcccagccgcggcggggctcggtggcggaactcgatgcgctcggcgacgaactcgtcgtcgctgatcagcgccagcagcttgaggaacagcagcatcaggcattcgatctgctggcgcagcgaggcatagcccaggtagttgatgtcgaggatcagccttgccgtttccccttcgacctcgaggcgcgcggcgaaaccgccggagagaatgtgctggaaacgcacgaagctgcgcagcgcctcctccaggtcgcgcgcggacagcagcaggtagccgaccacatcgagcaggcgcggcttcattgcctcgcccaggtgcaggccgatgtcggcatcgccggtcaccgccgccagctcggtccagaacaacggggcgttgtcatgcaccaggcggccgcccagggtcggcggcggcagcgggatacgccggtagacgctgcggtagacgcgggtggggtcgagcccgagggcgtccagggcttcatacaacagacgccgcaacgtggcggaatgggtcagggggctggtagacgggtcgtcctgcatggcggctcctcgcgattgaccaaagacttccagggtccgagcattcggtcaatgccgcgggccgacggcatccgcagaatgctcggcactacaacaaggagaaaggatcgatga

SEQ ID NO: 10981 - DNA, 480 bp, Pseudomonas aeruginosa
tcgccgtggcggtcgccgccgcggctgccggcggcgcctggtacctccatgccaagcagccgctccgcaacggctcgctcgccgtggcccacctgcaggcgccggtcgacgtgcgctacgacgagcgcggggttccgcacctgtatgcgcagaaccagaccgacctctaccgcgccctcggctacgtgcacgcccaggaccgcctgttccagatggaaatgctgcggcgcctggcgcgcggcgagctggccgaagtgctcggacccaagctggtggataccgaccgtctgttccgcaccctgcgcatccgcgaccacgccgccgaatacagcgcccgccaggacaagcagtcgcagccctggaaagtgctggaggcctacctggacggggtcaaccagttccaggaaaacaacccggcgccgctcgaattcgatctgctgggcatacccaggcgtcccttcacccccgaagataccctga

SEQ ID NO: 10982 - DNA, 1962 bp, Pseudomonas aeruginosa
gcatcgccggctacatggcctacagcttcgccgccgccttccgcacccgagccggtgctgatctacatccgcgacgaactgggcagcgactacctgcgcatcttcgatctcgattggcatccgcaggggcgtgctgacgccatccggcgcactgggcgccggcgactggaaggacctcggcgccctcgcccgtctcagccagcaggccctggaggacgccggcctgccgcagttcgagggcagcaacgcctgggtcgtcgccggcagccgcaccgccagcggcaagcccctgctggccggcgacccgcatatccgcttcgccgcgccggcggtatggtacgaggcccagctgagcgcgcccggcttcgaactctatggccaccaccaggcgctcaaccccttcgcctcggtgggccacaaccgtgcgttcggctggagcctgacgatgttccagaacgacgacctcgacctgatcgccgagaaggtcaacccggacaaccccaaccaggtctggtaccagggcgaatgggtcgacctgcagagcgaggagcaggaaatcgcggtcaagggcgctgcgccggtgaagctcaccctgcgccgctcgccccacggtccgatcgtcaacgacgcgctcggcgtcagctccggcaggaccccgatcgccatgtggtgggctttcctcgagaccgagaacccggtgctcgacgccttctaccagctgaatcgcgccgataccctggccaaggcccgcgcggcggcctcgaagatccattcgccgggactcaacctggtctgggccaatgccgccggcgatatcggctggtgggcctcggcggccctgccgaagcggccggagggggtgaacccgagcttcatcctcgacggcagcaagggcgaggcggacaagtccggcttctatccgttcgccgacaacccacaggaggaaaacccggcgcgcggctacatcgtctccgccaacttccagccggtcccggccaatggccggccgattcccggctactacaacctggcggaccgcggccagtggctggatacccaactggccgaccgcggcaccaaatggaacctggacaacagccgcgcgctgcaactcggcaatcgcaccggctacgcgccgcgcctgctcgcacccttgctgccggtcctgcgcgaggtggtcgacgacgccgaaggcaagcgcctggtcgagcaactggcggcctggaagggcgactacccggtcgactcgaccgccgccacgctgttcaaccagttgctgttccagattgccgagggcgccttgcacgacgaactgggcgatgccttcttcgacagcctgatcgccacccgcgccatcgacagcgcgctgcctcggctggctgccgacgccgactcgccctggtgggacgaccgccgcacagaacgccgggaaacccgcgcggatatcgtcaggaccgcttggaacgcctccctcgcgcatctgcgcagcaccctcggcaacgacccgtccggctggctgtggggcaaggcgcataccctgacccacgagcacgccctgggccagcaggcgctgctcaagcgccttctcaacgtcggtccgttcgccgcccccggcacccacgaggtaccgaacaatctgtcggcgaagatcggcccggccccctgggcggtcacctacggtccatcgacccggcgcctggtggacttcgccgacccgacccacagcctcggcatcaacccggtcgggcagagcggcgtgcccttcgacggccactacgacgaccaggccgaggcctacatcgagggccactacctgccgcagcactacgaggaaaacgaggtgaaggcgaacagcaagggcgtgctggtgctggagccgaagcgctgagccggccggcgtggggtcgggcgagtagccgcatggtggttgtccgccggatacaacgggctatcggcggataa

SEQ ID NO: 10983 - DNA, 1065 bp, Pseudomonas aeruginosa
cgttggagaaattccagcgcttcataccttgccctccagttctttggcctggttcttgttgaacaggatgatcgggatgatcaggatcgccagcatcaccaccgccagggcggacgccaccggccagtcgcggttgttgaagaactcctgccagagcaccttgccgatcatcagggtctcggggccgccgagcagttccgggatgacgaactcgcccaccgccgggatgaacaccagcatgcagccggcgatgatgccgttcttcgacagcggcacggtgatcttccagaagctggtgaagttacgcgcgcccaggtcggaagcggcctccagcaggctcgggtcgtgcttcaccaggttggcgtagagcggcaggatcatgaacggcaggtaggaatagacgatgccgatgtacaccgcgatgttggtattgaggatggtcagcggctcgctgatgagccccagccccatcagtacgctgttgagcaggccgttgttggaaaggatgcccatccaggcatagacccggatcaggatcgccgtccaggtcggcatcatgatcagcagcagcaggacggtctgcgaggactggctggagcgggcgatggcgtaggccatcgggtagcccaccagcaggcagatcagggtactgatgaaggccatcttcagcgagccgaggtaggcatcgatgtagagcgggtcatcggtcagcatcaggtagttgccgaggttgaggagcacctgcaactgctggtccgcgtaggcgaagatctcggtgtagggcgggatggccacgtccgcttccgccaggctgatcttcagcacgatggcgaagggcagcaggaagaacaggaagagccacaggaacggcaccccgatgaccgcatgccgcccggtgggcatgcgctttttcaggctgttggcgaatttcatgactgcagtaccacgccgctgtcgtcgtaccagctgatgtacaccgactggtcccaggtcggccgggtgacgtggcgctcggcgttggccatgaaggcctggacgatcatcccggaggccagcttgatgtag

SEQ ID NO: 10984 - DNA, 414 bp, Pseudomonas aeruginosa
atgtccatcgggctgccgatctgctcgatgcagcccaggtgcatgatggcgatgcgctgggccatggtcatggcctcttcctggtcgtgggtcaccatcacgcaggtcacgccgacgcgctcgatgatctccaccagttccagttgcatctgcgagcgcagcttcttgtccagcgcgcccatcggctcgtcgagcagcagcagcttcggccgcttggccagcgaacgggccagggccacccgctggcgctggccgccggagagctggtgcggcttgcgcttggcgtactgggtcatgtgcaccagcttgagcatctcggccacgcgctcgtcgatctcggccttgggcaggccgtcctgcttgaggccgaaggcgatgttctgcgccacgctcatgtgcgggaacagcgcatag

SEQ ID NO: 10985 - DNA, 252 bp, Pseudomonas aeruginosa
ggcggcaggtcggtgatgtcctggccatcgaggaagatccgcccctcggtgggccgctcgaaaccggcgagcatgcgcaacagggtggatttacccgaaccggagccgccgagcagggcgaagatctcgcccttgttgatggtcagggacacggtgtccaccgccagcgtctcgtcgaactgcttggttacccggtcgatctttaccagcacctctttcggctgctggttgccctctagggctttcttgtag

SEQ ID NO: 10986 - DNA, 1623 bp, Pseudomonas aeruginosa
atgtgcaggctcttcttctccgcctgcacggggcccgcgatcgccgtagccagagcggctaccagcagtgtcttgccaatggaatgttgcatgtccgactcctgttccgggccttttcacggcagcaccctgcctgttcgacccgtgttcttcaagtgccgatgtaagcccagatcactcgggtttcatgacaacccgacgattccgccgggaaacatgagtgagctgggttccctaccggcgtgttggtttcaggttttccgggccctcggccccggtgcgagcgacacgaccggccccggcgcggcagattggcgcagcgcccatggcagcgtcttcgtcgtcgatactgcgtccggtcgtcgggcccccaggaggaagcgtctggacgaacgggcaaaagagtcgaacctcttcgcaggggagcgcgaccggaggaaacccggccgcgttccggttctctcgtgccggagcgccggcggcttcaggcgccgccgggctcctcgcggatcacttgccggacttgatcttggtccagctgcgggtcatcgcccgctgggtcttggccggcaggtcggggaaggtatacagcttcttcatgacctcttcgctcgggtagatgcccgggtcgttgcggatcgcctcggacaccagcggggtggccgccgcgttgccgttggggaactgaaccacgtcggtgatctcggccatgatttccggcttcatcaggaagttgacgaaggccagggcgccctcggtgttctcggcgtccttcggaatggcgaccatgtcgaagaagctgccggcgccttccttgggaatgttgtacttgacggtgaccttgttcttcgcctcttcggcgcgggacttggcctggtagatgtcgccggagtagccgatggcgacgcagatgttgccgttggccaggtcggaaatgtacttcgacgagtggaagtaggtgacgtagggacggatcttcaggaacagctcttcggccgccttgagttccttgggattgtcggtgtccggcttgtagccgagataatgcagggccgccgggaggatctcggtcggcgagtcgaggaagctgacgccgcactgcttcagcttctggatgttctccggcttgaataccaggtcccaggaatccaccggcgcgttgtcgccgaaggccgccttgaccttgtccgggttgtagccgatgccgatggtgccccacatgtagggaatcgcatgctcgttgcccgggtcgctgacttccagggtgtgcatcaggtccttgttcaggttcttccagttcggcagcttggacttgtcgagtttctggtagaccccggccttgatctgcttggcgaggaaggagttggacggcaccaccacgtcgtacccggacttgcccgccagcaacttggcttccagcacttcgttgctgtcgtagacgtcgtagacgaccttgatcccagtttccttggtgaacttctccagggtgtccggcgcgatgtagtcggaccagttgtacacgtgcagcaccttgttgtccgcagcctgcgccataccggccacagagcccgccaaggtcagggcgagcagggtcttaccgaaacgtttcatcatgcggggtag

SEQ ID NO: 10987 - DNA, 1425 bp, Pseudomonas aeruginosa
tttggctgttcatgtcacacctcttctattcaagactgtccgggagcggcggaccacgccggccgcccccggtcaggatcaaacggaaagcaggaggaattcccgctcccaggagctgattacccgcttgaaattctcgtgctccgcacgcttcaccgcgacgtagccgctgatgaacttgctgccgagatactgctcgaggggcttgcagttctccatgcgctccagcgccgcttcgatcgtcagcggcaggcgcaggttgcggcgttcatagccgcgacctttgacctgggcgctcggcttgatgccttcgaccatgccgatgtagccgcacagcaggctggcagccagcgccaggtaagggttggcgtcggcgccggcgagacggttctcgacccggcggttctccgggctggagtccggcacgcgcaggccgacggtacggttctcttcgccccactcgacgttcaccggcgccgaggtatcgggcaggaagcggcggaacgagttcacgttgggcgcgaacagcggcagcacttccgggatgaacttctgcaggccgccgatatggtgcaggaacagctcgctcatggtgccgtcggcattggagaagatgttcttgccggtcttcacgtcgacgatgctctggtgcaggtgcatcgcgctgcccggctcgccggtcatcggcttggccatgaaggtcgcggcgacgttgtgcttgagcgcggcctcgcgcatggtgcgcttgaacaccaggatctggtcggccaggtcgagggcgtcgccatgacggaagttgatctccatctgcgcggtgccttcctcgtggatcagcgtatccaggtcaaggccctgggcctcgcaccagtcgtacatgtcctcgaacagcgggtcgaactcgttggcggcgtcgatggagaacgactgacgcccggtttcctggcgtccggagcggcccaccggggcctgcaacggatagtcggggtcgtcgctgcgcttggtcaggtagaactccatctctggcgccacgatcggccgccagcccttatcggcatacatcttcaacacgcgcttgaggatgttgcgcggcgacagctcgatgggattgccgagcttgtcgaaggtgtcgtggatcaccatcgcggtgggctcgatggcccaggggacgaggaacacggcattctcgtccgggcggcagaccatatcgatgtcggccgggtcgagcaggtcgtagtaaatgtcgtcttccacgtagtcgccggtgacggtctgcagcagaacgctctccggcaggcgcatgcccttttccgcgatgaatttgttggtcggcgagatcttgccgcgggcgatgcctgtcagatcggaaatcaggcattccacttcggtgatcttgcgttccttcagccagctggtcagctggtctaa

SEQ ID NO: 10988 - DNA, 1395 bp, Pseudomonas aeruginosa
caaaaaaggtgttgcatcatgtcggtaccccagcgtgccgttcagctcactgaaccgagcgagttcctcaaggaacatcccgaggtccagttcgtcgacctccttattgcagacatgaatggcgtggttcgcggcaagcggatcgaacgcaacagtctgaacaaagtcttcgaaaaaggtatcaatctccccgcttccctgttcgccctcgatatcaccggctccaccgtagagagtaccggcctgggtctcgacatcggcgacgccgaccggatctgctacccgatccccggcaccctctccatggaaccctggcagaagcgcccgaccgcgcaactgctgatgaccatgcacgaactggaaggcgagccgttcttcgccgacccccgcgaagtcctgcgccaggtggtggccaggttcaccgagatggaactgaccatcgtcgccgccttcgagctggagttctacctgatcgaccaggagaacgtgaacggccggccgcagccgcctcgctcgccgatctccggcaagcgtccgcagtcggtgcaggtgtactccatcgacgacctcgacgaatacgtcgagtgcctccaggacatcatcgacggcgcccgcgcccagggcatcccggccgacgccatcgtcgccgaatccgcaccggcgcagttcgaggtcaacctcaaccacgtcaacgacgccctcaaggcctgcgaccacgcggtgctgctcaagcgcctggtcaagaacatcgcctacgaccacgagatggacaccaccttcatggccaagccctatccgggccaggccgggaacggactgcacgtgcatatctcgctgctcgacaagcatggcaacaacatcttcaccagcgaggatcccgagcagaacgccgcattgcgccatgcgatcggcggtgtgctcgagaccctgccggcctccatggccttcctctgcccgaacgtcaactcctaccgccgcttcggttcgcagttctacgtgccgaacgcgccgagctggggcctggacaaccgcaccgtggccctgcgcgtgcccaccggcagcccggacgcggtacgcctggaacaccgcgtggccggcgccgacgccaacccctacctgctactggcagcggtgctggcaggcgttcatcacgggctgaccaacaaggtcgagccgggcgcgccgatcgaaggcaactcctacgagcagatggagccgagcctgccgaacaacctgcgcgacgccctgcgcgagctggacgaaagcgagatcatggcgaagtacatcgacccgaagtacatcgacatcttcgtcgcctgcaaggaaagcgagctggaggagttcgagcactcgatctccgacctcgagtacaactggtacctgcataccgtctga

SEQ ID NO: 10989 - DNA, 1317 bp, Pseudomonas aeruginosa
ggtagcggtatcggcgcgccggtcctgggccggcgccgtacgcagcgaaatccggggcggtttcgcagacactcaacgcgggggcgtctgtgtctgggaaaccgccccggtccttttctcggaaccgggaaatgtgcgccacggcacagcctgccgccacgcctcccgccagactcgatgctggcctgcatcaatgcctctgccgcctggctccggcaccatcgtccgctccgttccgtccagcgagaagattccatgccccgcctttccgccctgctgttcctcgccctcgcaccctggctggcccaggccgaggagaccctgcgcgtctacaactggaacgactacatcgccccacaggtgctcgagtccttccagaaggacaccggcatccgcgtcgagtaccacaccttcgccaccgccgaggaactggacaaggcgctgcgcagtggcgaggcgatcgacgtcgccgtcccctcccacgacaccctgccggccctgctgaaggacaacctgctgcggccgctggacttcacccagctgcccaaccgcagccatctcgaccgtcaattgctgagcaaactggccgcggtcgatcctgacaatcgccacgccgtcccctatctatggggtgccgtaggcctggccatcaataccccgcaggccgaagccgcctatggcgggccgctgcccaacagctggagcctgctgttcgacgccagccagagccagcgcctgaaaagctgcggcatcagcctgctggacgcgccggacgaaaccctggcgatcctcctcaactaccagggccgcaacctcggtcgtactgcgccgagccaggtacgccgcgccgccgaggcgctgcacggactgcgaccgaacctgcgctacgtcgacagcgagcgctacatcgccgacctcgaaggcggtcgcctctgcctggccatggcctgggtcggcgacgccctgcgcgcggccaaggcgggccagccggtaagtttcgaggtaccgcaggaaggctcggtgctgttcatcgacaacctggtgatcccggccggcgcccagcatccacgcgaggcgcaccgtttcatcgactacctgatgcaaccgaagatcgccgcacagatcaccgccgccaccctctaccccagcggcaacgccgacgccgccggcttcctcgatcccgccctgcgccagcaacccggcctgtatccggaccgcgacaccagccgccgcctgttcgccctggaaacgccgccggaaaaactccggccggtggtcgacgagatctggaaggccttccgcggcgccagccagtga

SEQ ID NO: 10990 - DNA, 423 bp, Pseudomonas aeruginosa
tccaggaactgttcgagaccccctacttctgccagaagccgaacccggactacctgcagctggccaccacggtcgaggagaacgccgccatcgcccacttccaggccctcgcccgggagttgcaggtggtattgccgatcagcttcttcgaacgcgccgggcgcgcccgcttcaacagcatcgcggtcatcgacgccgatggcggcaacctcggggtctaccgcaagagccacatcccggacggcccgggctaccacgagaagtactacttcaatccgggcgacaccggcttcaagatttggcagacccgcctacgcacggatcggcgtcggtatctgctgggaccagtggttccccgaatcggcgcgcagcatggccttggctcggcgcggaactcctgttctacccgaccgccatcggtag

SEQ ID NO: 10991 - DNA, 501 bp, Pseudomonas aeruginosa
gcaacccgaccagcaccccacgcgccgacggcttccgcatgcccgccgaatgggaaccccacgagcagacctggatggtctggccggaacgcccggacaactggcgcaacggcggcaagccggcccaggcggccttcgccgcggtggccaaggccatcgcgcgcttcgagccggtcaccgtctgcgccagcgccgggcagtacgagaacgcgcgcgcacgcctcgacgacggcaacatccgcgtcgtggaaatcagcagcgacgatgcctgggtccgcgacaccggcccgaccttcgtcatcgacgacaagggcgatgtacgcggcgtcgactggggcttcaacgcctggggcggcttcgaaggcggcctgtacttcccctggcagcgcgacgaccaggtggcacgcaagatcctcgagatcgaacggcgcgcccgctaccgcaccgacgacttcgtcctcgagggcggctcgatccacgtcgacggcgaaggcacgctga

SEQ ID NO: 10992 - DNA, 765 bp, Pseudomonas aeruginosa
  unsure (515): Identity of nucleotide at the above locations are unknown.
cgccaaagccaggccggcggaacgccgtcaggcgcttcgcgcggccgactcggcaatcatgcatatcagttcgaacatcatggtcgcccccaccaacgccgtggcgccgccgacatcgaacggcggcgagacttccaccacgtcggcgccgaccaggtccagcccgcgcaggccgcggaccagttgctgggcctggaggctggtcatgccgccgatctccggggtgccggtgccacgcgcgaaagccgggtcgaacacgtcaacgtcgaaactcacataggtcggcccgtcgcccaccacccgccgggcttcggccaaggtcgcctcgacgcccagttcgacgaactcttccatgtggatcacggcggatgccgcactcgcgggcgaaagcgtcgtcgtccggcgaatacaccgagccgcgaatgccgatctgcaccgtgcgcaccgggtcgagcagaccttcctcgatggccctgcggaatggcgtgccgtgggtgtaggggttgtctcccaantaacggtcgttggtatcggaatgcgcatctaaatgcaccatgcccagcggccgctcgcgacccagggcgcgaaagatcggcagggtctccaggtggtcgccaccgaccgacagcggcagggtaccggcggcatggacctggcgatagaagccttcgatgcggcgcaacgaatcgagcaggtcgatgggattcaccggcgcatcaccgaggtcgccgacccgcaccaggtcgtagggcgcgatgcggctga

SEQ ID NO: 10993 - DNA, 1332 bp, Pseudomonas aeruginosa
acgatcggcgagttggcgagccaggccgtcgcgggccatgcaggcgatcaccgccaggcaaccggcgacgatgctggcgatcgccccctgcggactggcccggcgccacagcagcgcgccgacgatcggcaccagcaggccgccgaccagcaggttgtaggcgatgctcagggccgcgatgacatcgttgaccaggcacgccaggaccagcatcgccacgcccatcagcagggtgatgcaacggctcagacggatgtcgctggtggtaccggggcgcaggaagcgcgcgtagatgtcttcctgcagcacggtggccgctgccagcaggcacccgctggcggtggacatgatcgccgacagcgcggccgccaccaccaggccgcgcaggcccggcgccagtacctcgcgggtgatctcggcgtaggcgttctccggcaccgccaggtccggcaggaggacccgcgccgccgcgccgatcagcgcgcaggcggcgccgtagagcatgcagtagacgccggcgccaagcccggcgtagcgcaccaccgtctcgctgcgcgcggtgaacacccgctgccagatgtcctggccgatcagcgcgccgaagaagtacaggaggaagtaggtgagtatggtatccaggccgatgtggccgaggtcgaagaagcccgccggcagcacctcctgcatgcgcgccaggccaccggcgccgtcgatcgacaacggcagcaggaccaggaagataccgacggtcttgatcacgaactggatgatgtcggtcagcgtaagggaccacatgccgccgatcaccgaatagacgatgacgatcccgccaccgcagaggatcgccgggatccgcgggatgccgaataccacctcggtgaccgagccgatggcgatggtcgcggtgaccgccaccatcaggtcgtaggcgaccatgaccaccccgccgatcaggcgcgaggaggcctggtagcgctgctccagcacctgggtcacggtgaacacccgcaggcgcgcgatctgccgcgagaacaccaggctgaggacgatgatccccaggccgagcatgaacaccagccacaagccggacaggccgaactggtagccgagcttgaccgtaccaatggtcgacgcgccgccgagcaccaccgcggccatggttcccaggtagaggccggggccgaggcggcgtccggcgacgaggaaatcgctctggctcttcgccttgcgcattccgtaccagcccaggcccagcatggccagggcgtagaccagcatgatcaggtaatccagcaacatcgcccgcgctccttttcttgttgttctgcgtga

SEQ ID NO: 10994 - DNA, 1386 bp, Pseudomonas aeruginosa
cgcccggcgtggcgcctgggcacgccgaagataggccgggcgccgcccgggctgaatcccggatcaggcaagtcgacttgcggaggaagagaagtatcggcggggcgtcgcactggcgacgccgaaacgcaacgcgccggcaggagccggcgcgttgcagaggcggctgacgcacccgcgagggcgcgccaggcgtcaggcgggacgcagcgagtaggtcttcagttgcgcggcgaactccttcagcgactggataccgctggcttccgcctcatgcacccagtccttgatcgccgccagcatgtcgtggccgttggcgctggtcttggcccagatctgctgcaacgccaggcgcttctcgtagatcaccttcagcgcctggctgtgggcgagcatcgagtcgatgcgcacgtggtggcggtcctgcagcaggctggtctcgcgcgacagcaggcgcttggcgcggcggaacaggtggcgcaccgactcgtcggccttggccacttcctgcttgaccagcggcgcgatcaccagcttgcggtactgcgccatgatctggaagcggttgttgaggatcgccatggcggtgtccatgtccaggctgtgcttgccctcgacccgatgggcgatcggcgcgacccgggcgaccctggccaggcgcaggaagctgaacagcttgatccaggcccagcccaggtcgaattcccacttcttcaccgacagcttggccgagttcgggtaggtgtggtggttgttgtgcagctcttcgccgccgatgaggatgccccagggcaccaggttggtggcggcgtcgcggcattcgaagttgcgatagccgaccgcgtggccgaggccgttgaccacgccggcggcccagaacggaatccataccatctgcacggcccagacggtcaggccaagggcgccgaacagggccaggtcgatgagcgccatcagcaccacgccgccgatcgggaagcgcgagtagagattgcgctcgatccagtcgtccgggcagttcttgccgtagatgcgcagggtgtcctggttcttcgcctcggccttgtacagctccgcgcctgcgcgcaggacggtgaacaggcccttgtgcaccgggctgtgcggatcctcgacggtctcgcacttggcatggtgcttacggtggatcgcggtccattcgcgcgtgttcatccctgtggtcaaccacaaccagaaacggaagaagtgctgcagcgcggggtgcaggtcgagtgcacggtgggcggaatagcgatgcaggtagacggtcacgctgacgatggtgatatgcgtcagcaccagggtaactgccaccagttgccacggcgacaggtcgagaaaaccgttgaaccacataggcggtactga

SEQ ID NO: 10995 - DNA, 2289 bp, Pseudomonas aeruginosa
aaatcccatgagcccccgcctgagtgcccttcgcctgagcctggcttatctcgcaatcgccatcgcctgggcgtgcctgagggatcatttgttaccaaaccaggtccaggaccaggaccaactggtgttttggatgaccgccaacggctgttattcttgcccgcaaccggccggctcgtgtacctctacctggtacgccagttccgccgcaaggcccaggcctacgacgaactgcacggcagcgagcagcgcctgaaccgcgccctggaagcggtgcgcgacggactctgggactgggacctggtgaccgaccggatgttcgtctcgccgggctacgccgcgctgatcggcctcgctccggaggaactcggcgaccccatcgagacctggaagaagcgcctgctccccgaagagtacgccaccgtgctggaggcccaccgcaacctcctgcagggcctgaccgacaatctcgaccacatctaccgcctgcgccacaaggacggcgactaccgctggatccactcgcgcggccgggtcctccgcgacgccctgggcaagccgctgcactacactggcgtggcccgcgacatcaccctgcaacggctcaaggaagaccacctgcgccaggccgcggcggtattcgacagcacccgcgagggcgttctggtcaccgatgcccaggcggtgatcgtgcacgtcaacccttccttcgagcgcatcaccggctaccgctccgaagacgtgctcggcaagaccccggcgatcctccgctccggccgccaggaccaggcgttctaccagcgcctgtggctggccctgcgcgagcaggacgtctggagcggagaaatctggaaccggcgcaagagcggcgagatctacccgcagtggctgcacatccgcgtggtgcgcaacgaccagggccagctgacccactacgtcggggtgttctccgacctgagcagcatcaagcgctcggagaacgagctggacttcctcgcccaccacgactcgctgaccggcctgcccaaccgcgtgctgctgcgcgagcgcatcgagcaggcgctggagaacggcaaggaccggacggtggccggggccctgctgctgatcgacctcgaccacttcaagcacatcaacgacagcctcggccatacaactggcgacatgctcctcaaggaggtcagcaagcgcctgcaacaccagctcgacgagcgctgcctgctgtcgcgactgggcggcgacgaattcgccatcctcgtcgagaacgacgacccggaagccgtcgcgcgcctctcgcagcgcatcctcgacggtttcaacgcgccgttcgacatccactgccagccgatctatatcagcgcaagcctcggtgtcagcctctacccggaagacgccagcgacgtcgaccacctgatgcaacacgccgacgccgcgctgttccaggccaaggacagcgggcgtaacgcctacgccttctacacccgcgtgctgaccgcccgggcccgcgcccatgtccaggtggaatcggccctgcgccatgcgctggatcacgacgaactgcgcgtccactaccagccggtgcacgacctggccagcgggcggatcgtcggcgtcgagtcgctggtgcgctggcagcatcccgagcgcggcctggtgccgccaggcgagttcgtcccggtggcggaggaatgcgggctgatcgccgcgctggacaactgggtgctcaagcgtgcctgccggcagatgcgcgagtggcaacagcgcggcgtcgagctggagttcgtcgcggtcaacgtctccagccggctgttcaaccgcggcggcctggaggaaaggatcgccaatgccctggaagagtccggactggagccccgctacctggagctggaagtcaccgaaagcgcggtgatggaggacttcgagcagtccctcaacctgctctgccgcctgcgtatcctcggcgtgaacctggccatcgacgacttcggcaccggctattcctcgctgatgcgcctcaagcggctgccggtgcacaagctgaagatcgaccagggcttcgtcgccggcctgcccggcgcggtggacgacgccgcgatcgcccgggcgatcgttgccctggcgcaaagcatggggctgcgggtggttgccgagggcatcgagcatcaggaccaggcgctgttcctgcgcgaacatggctgcgacttcggccaaggctactggtacggacggccgcaaccggcggaagcgctgcgcttcgacctgccgcccgtggcgctgccggaagactga

SEQ ID NO: 10996 - DNA, 1008 bp, Pseudomonas aeruginosa
gagctgcacatgtcccttcgtcgtttcgccctggccgcactcgccagcgccctggtctccggcccggttgccgcagccacgcaactgctgaacgtttcctacgacccgacccgcgagctgtaccaggcctacaacgcggccttcatcaagcactggaaggcccagggcggcgaggacctgaccgtccagcagtcccacggcggctccggcaagcaggcccgcgcggtgatcgacgggctcaaggccgacgtggtgaccctggccctggccggcgacatcgacgaactgcacaagctcggcaagctgctgccggccgactggcaggcacgcctgccggacaacagcaccccctacacctcgaccatcgtgttcctggtgcgcaagggcaaccccaagggaatcaaggactggggcgacctgaccaaggaaggcgtggaagtcatcacgccgaacccgaagacctccggcggcgcgcgctggaacttcctcgccgcctgggcctgggcgaagaagcagtacggcagcgacgagaaggccaaggactacgtgcaggcgctgtacaagcacgtaccggtactcgacactggcgcccgcggctcgaccatcaccttcgtcaacaaccagatcggcgacgtgctgctggcctgggagaacgaggcgttcctggcgaagaaggaacagggcggggaaaacttcgagatcgtcgtaccctccatctccatccttgccgaaccgccggtcgcggtggtcgacaaggtggtcgagaagaaaggcacccgcaaggtcgccgaggcgtacctgcaatacctgtacagcgaggaaggccagcgcatcgccgcgcagaacttataccggccgcgcaaccagaaggtcgccgccgagttcgccacgcagttcccgaaactgaacctggtcaccgtcgactccgatttcggcggctggaagacggcccagccgaagttcttcaacgacgggggcattttcgaccagatctaccaggcgcaatga

SEQ ID NO: 10997 - DNA, 915 bp, Pseudomonas aeruginosa
tcaacctgctgcagcgtcgcatcgaaaccccgtaaggagggcgccatgtccagtgcaagcatttccgctgccaccgccagcgcctcccgccgcggcaacgccggcggccgcctggccctgatcgtcctggcctggctggtcttcgccctgttcctcctgctgccgctctacgtggtcctgagcgaggcgctgaagcagggtttcggcaccttcttcgaggcgatcctcgaacccgacgcgctggccgcgctgaagctgaccctgatcgcggtggccatctcggtgccgctcaacctgctgttcggtgtcgccgccgcctggtgcgtgagcaagttcgagtttcgcggcaagagcatcctggtgaccctgatcgacctgccgttctcggtctcgccggtgatcgccggcctgatctacgtgctgttgttcggcgcccagggctacttcggcgaatggctgagcgaccacgacatccagatcgtcttcgcggtgcccggaatcgtcctggcgaccctcttcgtcaccgtgcccttcgtcgcccgcgaactgatcccgctgatgcaggagcagggcacccaggaggaggaagccgcccgcctgctcggcgccaacggctggcagatgttctggcacgtgaccctgccgaacatcaagtggggcctgatctacggcgtggtgctctgcaccgcgcgggcgatgggcgagttcggcgcggtgtcggtggtttccgggcatatccgcggtgtcaccaacaccctgccgctgcacgtcgagatcctctacaacgaatacaaccatgtcgccgccttcagcgtcgccagcctgttgctgctgatggcgctggtcatccttctgctcaagcagtggagcgaatcccgcatgtcccgactgaaaagcaatgctgacgaggaatga

SEQ ID NO: 10998 - DNA, 993 bp, Pseudomonas aeruginosa
accatgagcatcgaaatccgtaacgtcagcaagaacttcaacgccttcaaggccctggacaacatcaacctggatatccagagcggcgaactggtggccctgctcggcccctccgggtgcggaaagaccaccctgctgcggatcatcgccgggctggaaaccccggacgccggcaacatcgtgttccatggcgaggacgtctcgcagcacgacgtgcgcgaccgcaacgtcggcttcgtcttccagcactacgcgctgttccgccacatgacggtgttcgacaacgtcgccttcggcctgcgcatgaagcccaagggcgagcggccgggcgagtccgcgatcaaggccaaggtccacgagctgctcaacatggtgcagctcgactggctcgccgaccgctatccagagcaactctccggcggccagcggcagcgtatcgccctggcccgcgcgctggcggtggagccgaagatcctgctcctcgacgaacccttcggcgccctcgacgccaaggtacgcaaggagctgcgccgctggctggcgcgcctgcacgaggagatcaacctgacctcggtgttcgtcacccacgaccaggaagaagcgatggaagtggccgaccgcatcgtggtgatgaacaagggcgtgatcgagcagatcggctcgcccggcgaggtctacgagaacccggccagcgatttcgtctaccacttcctcggcgactccaaccgcctgcaactgggcaacgaccagcacctgctgttccgcccccacgaagtgtcgctgtcgcgttccgaggtggccgagcaccgcgccgccgaggtccgcgacatccgtccgctgggggctatcacccgggtaacgctgaaggtcgacggccaggacgaactgatcgaagccgaagtggtgaaggaccacgacagcctggccggcctggcccgcggcgagaccctctacttcaagccgaaggccttccagccggtggccaatctctga

SEQ ID NO: 10999 - DNA, 693 bp, Pseudomonas aeruginosa
tcccgcggcgggttcagcccgccgtgcgctccgccaggccgcgcagtcccgcgcggcccttcgacgacacctgcaacgcccgcgagccgtcctgcggccgcaaccagccctggcgcagacaggcctccagcaacgccgcccccagcgcgccgccgaggtgcggcttgcgttcgctccagtcggggcaggcgcaggcgaactgccgacggcggcggcggacctccgacaggtcgattcccaacctggccagcccggcctcgccggtcgcgctcaggcgcagcgtcctgccctcctgctcgatccagccggcatccagcatccgtgcgaacacaccgaccgcgagttcgccggccaggtggtcgtagcaggtccgcgcctcgcgcaacgccgacggcgtgccgtggctcggcggcaggctgcgccgctgcggctgcagggccagggaggcgctggccagcgcttccaccgcctgtcccacttccggcccggccaggcgatagaagcgattgcgcccgcgcgcctccaggctcagcacgccgccctcgaccagccgtcccaggtggccgctggcggaggacggcgagacgcccgccagcagcgccagctcgctggccgggcgggcgctgccatccatcagtgcccagatcatctgcgcgcggccgggatcggcgagcagcgccgccagcgaactga

SEQ ID NO: 11000 - DNA, 1080 bp, Pseudomonas aeruginosa
aacattgcctgtcgacgacgagagatactggccgccatcgcccgttcgcgccagcccgagacaaggaagaacccgcatgtccgtcgacctccacgccctgatcccactgatcgccctcaccttccttctcgcgggcttcgtcaagggcgtggtcggcctgggcctgccgacggtctcggtgggcctgctcggcctggccatgccgccgatgcaggcggcggcgctgctgatcgtaccgtcgatggtgaccaacctctggcagctcgcctgcggcccgcgcttcctcggcttgatgaagcgcctggccggcctgctgctcggggtgatcgtgggcaccctgctggtcggcgcatggctcggcggcgacgccccaaggcaggccaccggcgtgctcggcctggccctggcggcctacgcgctgctcggcctggccgcgatcccgctgcacctgccggcgcgccacgagccctgggccggcccgctggtcgggctggcgaccggcgcgctgaccgcggtcaccggggttttcgtgattcccgcggtgccctatctgggagccctaggattgcagcgcgacgaactggtccaggccctcggcctgtcgttcagcgcctcgaccctggccctggcggtcactctcggcgtgcacggcgacctgctcgaaccgcagatgctcggcgcctctctgctgaccctggtcccggcgctgggcgggatgctcctcggccagtggctgcgccagcggatcagcgcgacgctgttcaggcgctgcttcttcgtcggtctcctgctgctcggcgccgacctcgcctggcgcggtttccactgacgccagggacgcattgcgcacccgccagggcgggcctgcggccttcgcgggacttccgacgaacggcacaagtcgctatcatccgccgccgcgcgccccccaccgggcgcgcggcaccgggcggaacacgcccgtccggcacggaacgccacctatcgcaaggagcacacgatgaagacccgtctttccctttccgccctggccctcgcctgcgccaccctggccggctgccagaacctgccccagggtga

SEQ ID NO: 11001 - DNA, 855 bp, Pseudomonas aeruginosa
cctcatgcagcacggcatgatggcggtgaaggctgcaaccctgagcgacgccgaggtccgccaggtcgccgaccaggcctgcgccgagtccgaccagcaaaaccgcatcgccccggccaacagcaagtacggccagcgcctggacaagatcgccaaggccctgggcgaccagatcgacggcgtgccggtgaactacaaggtctacctcaccgaggaggtcaacgcctgggccatggccaacggctgcatccgcgtctacagcgggctgatggagctgatgagcgacaacgagatcgaaggcgtgctcggccacgagatgggccacgtcgccctcggccacacccgcaaggccgcccagaccgcctacgcggccgccgcggtgcgcggcgccgccggcgcctcgaagagcggcgcgctggccgccctgtccggctcccagctgggcgaactcaccgaatcgctggtcaacgcgcagttctcccagtcccaggaatccgacgccgacgatttctcctacgagctactgaagaagcgcggagtgaacacccagggcctggtcaccgccttcgagaagctggccaagctgggcggcggcgacagcagcatgttcgattcgcacccgggctcccaggcccgcgccgatcacatccgccagcgcatcgctgcggatcgcaagtaacgctcccaccccggtctcccgcgctcgcgggagaccgcctcacgccgcccgcttgtgctcgcgaatgcaggtcgggccggcgcgctcctcgacctcgcgctgcacgtcgccgcgcagccccagcagaaaggccagttccgccagcacgaagagcggaccgacgatcaacccgctga

SEQ ID NO: 11002 - DNA, 1218 bp, Pseudomonas aeruginosa
agatgttgcgccggtcgcggtggtaggcggcgtattgcgcaaggtgatcgactagggttttcattgttgtggtctcacgccagggttctcgcatcatcgcgccgccccggttttccactctgtcagctagacgacaaacatgaacgagcgtaccgactaccgttcgcaactccaggccggccgctggttccagggtttgccggaggccttgcagacgcacctgctggcactcgcccaaccgcgccagttgccgccgggccagcgcctgttcgcccgcggcgacgcgccctgcggactgtactgcgtggtcgagggcgcgatccgtatcagcgcggtcagcgagaacggcaaggaggcgctgctgatcctggtggaagcgccgcactggttcggcgagatcgccctgttcgacggccaggcgcgcacccacgacgcctacgccgaaggccacacccagctactccaggtgccgcaggcggcgctgctcgaactgcttcgccgcgagccgcactactggcgcgacgtggccctgctgatgagccacaagctgcgcctggcattcatcgccctggaagagatggccctgctgccggccgcacaacgcctggcgcggcgcctgctgatgctcgccgagggctacgacaacagccgcagccggcaggtcctgcacctgccgcaggagcagttggcattgatgctgtcgctgtcgcggcagaccaccaaccagatcctcaaggacctcgaagcccagggcatcctccagctcagctacggcggcatcgagattctcgacctcgccggcctgcgcgcggccacccacggctgagcgcgaatcacactttcgaacgcttgcaggcgcgccatggccggctaccgtgtgcagggcacctgccctcggtgcggatatccataacgacaacaacaggatctccccatgctccgtcccgcgcttcccgctgtcctctgtctttactgcctgctgctggtgctgccggcgcgcgccgccctcgacgaccagcaacgcgccctgcaacaactgcaggtccaggcctgtcgcgcggtgggcagcctgttgttgctgcgcggcgagggtttccaggaacagcacgcggcgcaactggagaaggacctcgccagcctcgaccgcgcgctcgccgccgcccccgagggggtgctcctgcggcaagacgaaaagacgctggtggcgcgcatccgtga

SEQ ID NO: 11003 - DNA, 438 bp, Pseudomonas aeruginosa
cttcctcaacctggtggaacgccaggtgccaccgcccccgccaggccagcccctgccgctatggcagttgccggtgcgggtcgagtacctgtccctgcaatacctggcgcgcgcctacctgggcgggctggagactgcccgcgagcagccccgggactatctcggccaggacgagagcgtgctggtcccgctgatcgaccggcgcatcgccctgctggtggcgcaaagcgccaacccggcgggactgaagaaactggaaaaccgctgggagtacctgagccaggccctgcgcgacctgaacagcaagagcagcgcgctggtcagcgcttccggcaggccctgggcgccgatcatcgtcgaccgccacgcgcgtgccctgagcgaaagcctgatgcgcttgagtgcggagtgaggccacgcgccgcacggggcggataa

SEQ ID NO: 11004 - DNA, 1407 bp, Pseudomonas aeruginosa
cctcgcgactcgcaacgttgcgccagcgtccgccccgactccctggccagcgcattttttcgaatccgccctgcggattttgatttgccgccacgccctggcgcatgcgcaatggtgctcccgaaaggagatcgccatgccctctgccaacccacccggccgcaccctctggctgatggccgccatcgtcctggtcggcctcaacctgcggccctccatggccgccgtcggcccactgctgaacgccatgcgcggcgagatcgcgctcagcttcggcgccgtctcgctgctgaccgccctgccggtgatgaccctcggcctcggcatgttcttcggcctgggcatcgcccgccgcgtcggcgagtggcgttcggtggccctcgccctgctgctgatcggcgccgccagcgccatgcgcctgggcagccgaggcctgcccgacctgctcggcagcgccatgctcgccggtctcggcatcgccctgatccaggcgctgatgccggccctgatcaaggcccgtttcggcgcgcgcacgccgctctgcatggggctctacgtcaccgccatcatggctggcgcggcgctgtccgccagcgccgcgccgaccctggcggagcacgccggctggcggatcggcctcggtgcctgggcggcgctcgccgcgctcgcgctgctggcctggtggctgcaacccggcacccgcctgcgcctgcccgacgcgcagccgggcaggagcttcctgcgctatccgcggacctggctgctggtcctgttcttcggcctcggcacggcctgctacacctgcgtgctggcctggctcgcgccctattacctggagcagggctggagcgcccaggaatccgggctgctgctcggtttcctgacggccatggaggtgctctccgggttgctcgcgccggccatggccagccgctcgcgggatcgccgcccggtgctggtcgggctaacggcgctgatgctggccggcttcctcggcctcgcatgggcgccggccagcctgccgctgctctgggcgctgtgtctgggactgggcatcggcgggctgttccccatgggcttgatcgtctgcctcgaccacttcgacgcgccgcaacgcgccggtcaactggctgccctggtacaaggcgccggctacctgatcgccggggtctcgccatggatcgccgggctgctgcgcgacagcctcggcagcttcaccggagcctggctcgggctggccacggtggcggcgctgctactggggctgggcctgcgcttcgacccgcggcgctatgcggcactgttcgccgagcggcaggcgcgaggcgtcggcgccgaaagcttgcgctgaggaaagggacgggttctgatggcgctcccgacgccgtcaggacgccccgatgctga

SEQ ID NO: 11005 - DNA, 1482 bp, Pseudomonas aeruginosa
gcctgcctttggcttccacgaagagccaattaccagaaataccaggtagccaatttcgccatggaactgcaactgatcctcgacggccgccacgacctggtcggccagctctatcgccagctgcgcgacgcgatcctccatggtcgcctggccaccggcgatcgcctgccagccacgcgatacctcgccgaacgcctggaagtgtcgcgcaagaccgtcagcgaagcctacgagcgcctcgccagcgagggcttcctcgaaggccgggtcggcagcggcaccttcgtcgcccgcgggcccgccggggaagcgccgccgcagcgcgccgacggtccgttgcggccggccgcgcgctgggcacgcatcgaaccgcagtccggtctgatggaccagcgagcaccgctccgctacagcttcgccggcggcacgaccgacaagcgccgctttcccttcgatacctggcgtacctgcgtgctccaggcgctacgcctgcaacagcgctcgccggcgttctacaaggaaaccgaaggcgaccccgagctgcgcctggcgatctcccgctacctggcgatcaaccgcgccgtgcagtgcgactggaacgccctgatggtcacccagggcgcccagcagggactcgacctgctggcccgggtgatgctcgaccccggcgacctggcggtggtcgaggaacccggttatccgccggcccgcgccagcctgctggccaccggcgccgaggtgcgcggagtgccggtggacgccgaggggctgcgcgtcgacctgctgccggacaacgccaagctggtctacgtcaccccgtcgcaccagttcccgctgggcatgccgatgagcctggagcggcgcctgcagttgctggactgggcgcagcgccaccgggcgctgatcatcgaggacgactacgacagcgagtaccgcttcgacgggcgttcgctggagtcgctgcgcagcctcgaccggaacggccaggtggcctacctcgggaccttttccaagaccctcttccccgagctgcgcctcggctacctgctgccgccggcaagcctgcgcgaagcggtgctggcggcgcgcaagctggtcgaccggcacagcgagaccttgcagcaacgcgccctcgcgctgttcatccagcgcggcgacttcgcccgccatacgcgccgcttgcaacgcgaatacgcccagcgtcgcgggcgcctgctggaacgcctgcacggcgacctgagcccctggctcgaagcgctgccggcggtggccgggatccacctcgcggcgcgctgtcgcgaaccgctggatgtgctgcgcatcgcccgtcatttgcgccagcaaggcctggaggtcggcaccctgccgcccttctacgcggaaaccccggcacaggccggcttcctcttcggcttcggctgcatcgaacgggacgacatcgacccggcgttggacctgttgcgcgccgagctgcggcgctag

SEQ ID NO: 11006 - DNA, 480 bp, Pseudomonas aeruginosa
gtgccgatctccccggccagaggctcgattgcaaccgcgccccatgcccagcggcgcatgacgcgccgcgttacccgccctacgggaggcgccgccccttgcaaaggcacggcgaggacggctcagggctgcagcagtttcgccagtcgttcgccgtccaggccgagcatgcgggcagccttgctctcggccagttgctccgcgttgtcctcgggcaggctggcggcctgggtcgccaggctgaggatcagctcttcgcgggaaagcacgccaccgaactggtacgccgcagcgatcagccggcgcagctccagcggcagccgccaacgcgcccgcagggccgagccgaagctggcgccgaaacgccccagcagctcgtcgagccgcgcctcgtccagcgcgccgccgccatcgcaccaatcctgcaatgtccgcagcagcgccaggtcgcccaggcgatgcagcagccctgcggtatag

SEQ ID NO: 11007 - DNA, 519 bp, Pseudomonas aeruginosa
cagcgctcgacgtccgcgccgagggcgtcggccagttcccaggcgatgtccgcgcaacgttgcgaaagatcccagaagtgcatggcgcgctcggccagcagcggctcgccgagctggatggcccgctgcaggctgaaaccgagcaccaggttcaggctgtgcccgagtcccagccgccgcagggcctggcccagggtctggcaggccggaccgacgtgccgggcggcgctgttggcggcggcgatcaggccagcggtgatctgcggatcgcggccgaactcatcctccagcacgcgcagcggatgctcctcggcgctcaggcaacgatcgctggcggcacgcacgtcggccagcaacggcgccccctccgcggagtcgcgcgcgcgttcgaggaaagcctccaggttctcgcccgcgtcccgctccggcagcggacaggcgaccacttcgtcgcccttcagcaacaaccctcgcaggcgttgcatcaggttctcggcctggaacggcttcaccaggtag

SEQ ID NO: 11008 - DNA, 1557 bp, Pseudomonas aeruginosa
agcttaagcgagttcgtcgaagcactcggccaggatggccaggcccttctccagttgcgcgtcggggatggtgacgggcatgaggaagcggatgacgttgtagtaggtgccgcaggagagcaggatcaggcccttctcgcgcgcacggacgacgatcttgctgaccagctcggcggccggcttgtgggtatcgccgccctcgaacagctcgatggccaccatcgaacccaggccacgaacgtcgccgatcaccttgtgcttggcctggatctcgcgcaggccggccttgagacgctcgccgacggcttgcgaacgttccagcagcttctcttcctcgaacaccttcagcacggccagtgccgcggcgcaggcgatcgggctgccggcataggtgccgcccaggccgccgggcgcgatgacgtccatgatctcggccttgccggccacgccggagatcgggaagccgccgccgaccgacttggcgaaggtggtcaggtcaggaacgatgcccagttgctcggtagcgaagaaggtgccggtacggccggcgccggtctgcacttcgtcggcgatcagcaggatgccgtgctggtcgcacagggcgcgcaggcgctgcatgaaggacttggagttgacgtagaagccaccctcgccctgcaccggctcgatgatgatcgcggcgatgtcctggggctgggcatcgttcttgaagatgcgctcgatgctggcgatggagtcgtcctcgctcacgccgtgcagctcgcagggcgccagggcgcggaagatgccgcccggcatcaggcccatgccggcggagtacgggaccaccttgccggtcaggcccagggtcatcatggtgcggccgtggtacgcgccggtgaaggcgatcacgccagcgcggccggtggcggcgcgggcgatcttgacggcgttctccacggcttcggagccggaggtgaccagcagggtcttcttcgggaagtcgcccggcacgcgcttggcgatttcctcggccagctcgatgtagggttcgtaggccagcacctggaagcaggtgtgggacagcttgcccagttgctcctggaccgcggcgatcaccttcggatgcaggtggccggtgttcagcacggcgatgccgccggcgaagtcgatgtactcgcggccttccacgtcccagacggtggagttctcggcgcgctcggcgacgaccgggtggatctggcccacgccgcggggtaccgcggcctggcgacgcttcagcagggattcgttggtcttgctcatggcttcctcagtggccgctcatcgggtcggccgggtcaaaggatgaaggcgggaaggaagctccccaaggcagcatgcgatgatcgactgcctcgggacttgcaggcccgccagggctcggagccgcttcgcgatcggcgaccgcgtctcccggttcgtccggtgccaccaccggcaacgtcgacaccggacggcgcagctcttgcctgccgtccggcccctccggatgcgttcctcgccgggctcagataccgcccaggcagaggtacttga

SEQ ID NO: 11009 - DNA, 405 bp, Pseudomonas aeruginosa
agcggaacaccggcgccagcgggccgaaggtctcgtccttggacaccagggcgttcttcggcacgtcgaccaggatggtcggctcgaagaaggtgccgccgagggcgtgcggcttgccgccggaaaccaccttggcgcccttggagaccgcgtcggcgatgtgttcctcgaccttggccacggccttggcgtcgatcagcggaccggtggtcacgccggcttccaggccgttgccgatgttcagcttggccacggcggccttcagcttgtcgacgaaggcgtcgtacacgccgtcctgcacgtacaggcggttggcgcagacgcaggtctggccgttattgcggtacttggaaatcagcgcgccctcgacggcggcgtccagatcggcgtcgtcgaacacgatga

SEQ ID NO: 11010 - DNA, 573 bp, Pseudomonas aeruginosa
caccgatgcccccggcatatcgcctgggcactttcaacgacaaggaacgtatccatggcaacccccgcctatatgtccatcaccggcaccaagcagggcctgatcaccgccggcgccttcaccgaggattcggtcggcaacacctaccaggaaggccacgaggaccaggtgatggtccagggcttcaaccacgaagtgatcatcccgcgcgacccgcagtccggccagccgaccggccagcgcgtgcacaagccggtggtcatcaccaaggtcttcgacaaggcctcgccgctgctgctggccgccctgacctccggcgagcgcctgaccaaggtcgagatccagtggtaccgcacctccgccgccggcacccaggagcactactacaccaccgtcctggaagacgcgatcatcgtcgacatcaaggactacatgcacaactgccaggacccgggcaacgcccacttcacccacctggaagacgtgcacttcacctaccgcaagatcacctggacccacgaagtctccggcacctccggctccgacgactggcgctcgccggtcgcagggtga

SEQ ID NO: 11011 - DNA, 1317 bp, Pseudomonas aeruginosa
acaccgagccaagactttcggcagcggctgagcaagagtaacgtggggctcgcttctccaacggatgggggaggaaccgcccgccaggaacaaggaacgatccatgcgtcaaagggacctgaaattcaccttcgtcgtcggcgaagggaaactcgcgttcgatgtcgtcgagttcgaactggaagaagcgctctgcgagcctttccgcctgaacctgaagctggccagcgacaagaacgccatcgatttcaagcaggtactcgaccagccgggcaccttcaccctctggcaggacggccgtccggcccgctacgtccatggcatcgtcagccacttcacccaaggcagctcgggttttcgccggacccgctacgaactgctgctggaaccgcagttggcgcgcctggagctgtgctgcaactggcggatattccaggagaagagtgttccggagattctccaggcgctgctcaaggagcaccgggtgctcgactacgaacagcgtatctaccacgagcacctgccgcgcgaatactgcgtgcaggccggcgacagcgatcactacctgcacgaccggctggccttcgaggaaggcctggtctactacttccgcttcgacgaacaccgccacaccctggtctgcagcgaccggctctacgtccaggagcgtatcgccggcggcccggtgctgttcagcgcccagccggagggcgacaacccgcagccggtgcttcattctttccgctacagcgaaaatgttcgtacggctcgacagacccagcgggactacagcttcaagcgcccgacctacgaccaggagcatcatctcgctggcgaggcgctcgagcatcaggactcgtcctacgagcgctacgactaccccggtcgctacaagcggagcggcgccggccggcctttcagcgaaagccgcctcagagggcaccggcgcgatgcgcgggaggcatcggtcagcggcgacgacccgcggctgatcccgggccacgcctttgccttggaaggtcatccgcgtgccgacttcaacgcctggtggcggccggtgcgggtggtccatcgcggcacccagtatgccggccaggaggaagagtccgccgacgcccctctgggggtgagctacgacctgcgcgccgaactggtacccgaggacgtcgaatggcgtcccgcaccgctgcctcggccgcgtatcgatggtccgcagatcgcgacggtagtcggcccggcaggggaagagatccattgcgacgagtggggacgggtgaaagtccagttcccctgggatcgcgagggacgtcacgatga

SEQ ID NO: 11012 - DNA, 1110 bp, Pseudomonas aeruginosa
attcagtacctgctggatacgggtcgcgcagaactgggcaggtgccgactgggggcacatggcgatcccgcggattggccaggaggtgatcgtcgattacctggacggcgactgcgaccagccgatcgtcaccgggcgcacctaccgggcgaccaaccgaccgccctacgcgctgcccgaccacaagatcctcagcaccatcaagagcaaggagtacaagggcagtcgggccaacgagctgcgcatcgacgacaccacggcgcagatcagtgcggcgctgatgagcgaccacggtgccagcgcgctgcacctgggctacctgacccatcctcggcccgaaggcggcaagccgcgcggcgagggcttcgaactgcgcaccgacgaacatggcgcggtgcgtgcggccaaggggctgctgctgagcaccgaggagcagctcagggccggcgccggccatctcgaccgaggcgtcgtggtgcaggtgctggaggccgcgctggagctggcccgcgagctgggcgactacgccggggagcaccagggcgtggggcacgacgcggcgccgcagcaaaccctccaggaagccgtgcgcgacctcggccacggtgccaacgacgagtccggcaagagcaacggaggcaagccggcgatcgccttgagcggtccggcagggatcgccgcggcgacgccggcgagcctgaccctggccgccggcgagcacgtcgacagcgtggcccggcagaaccagcaggtgaccgccgggcagaaggtggtgatcaacgccggcagcgacatcggcctgttcgcccaaggcggcgagctgcgccagatcacccaccaggggccgatgctgctgcaggcgcagaagaacgacatccgcctggaggccgagcagagcgtggaggtcagcgccagccagcagcacgtgctggtcaccgcgaaggagcacatcaccctgatgtgcggcggcgcctacctgaccctcaagggcggcaacatcgagctgggcatgcccggcaacttcgtggtcaaggcggcgaagcacagtcatgtcggtcccgctcatgcatcgaccagcttcaacgcctgggattcgacaccgttcgatga

SEQ ID NO: 11013 - DNA, 1854 bp, Pseudomonas aeruginosa
agtgatacgaggcgatggtggtgtggtgaaactgatgaccgacagccagggccgtttacccaagcaacaacacctggccatggacccggtgcagatacgcatcctgggcaagggcagtcacaacagcgacacggagtccaacacatgagcagcgaaccgctcgagccgaatcaggatgtgatcatccctcgctctcgcgacagtctgggacggcctgtctacaaggcgcagttgacccgtaccgacaaccagagcgaaaaggtggcactgattcggcagaccgctcccctgccggtgatcttcattccggggatcatgggaaccaacctgcgcaacaaggcagataaaagcgaggtctggaggccgccgaatggtctgtggcccatggatgacctgtttgcctccatcggtgcgttgtggacttgggcctggaggggtccaaaggcccgtcaggagctcctgaaggctgagcaagtagaattcgatgaccagggtacgatcgatgtcggtcaatctggtttgtccgaagaagctgcccgcctgcgcggctggggcaaggtcatgcgcaatgcgtataacccggtcatgggattaatggacaggcgactggataacatcgtcagccggcgggaactccaggcatggtggaatgacgaagccctctctcctcctggagatcagggtgaggagcagggaaaggtggggccgatcgatgaagaggaattgctcagggccagccgataccagttcgatgtctggtgcgccggctataactggctacagtccaaccggcagtcggcgctggatgtacgcgactatatcgagaataccgtgttgcctttctaccaaaaggagtgcggtctcgatcccgagcaggtgagacgtatgaaggtcattctggtcacccattcgatgggagggctggtggctcgcgccctgacgcagttgcacggctatgagtgcgtattgggagtggtgcatggcgtacaacctgcgacgggttcctcgaccatctaccatcatatgcgctgtggctatgaaggtatcgcacaggtcgtgctggggcgaaatgccggtgaagtgacagccattgtcgccaattcggccggcgcgctggaattggcccctagcgccgaataccgggaagggcgtccttggctatttctgtgcgacgcgcaggggcaggtgctcaaggatatcgatggaaagcctcgggcttatccgcagaatcaggacccttatgaagagatatacaagaacactacgtggtatggattggtgcctgagcaaaattcacaatatctagacatgtcagacaaaaaagaaggtttaagagttggcccccgtgataactttgaagacttgatagatagcattgctaattttcatggggaattgtcagcagcaggatatcattcagagacctatgcccattacggagctgacgatagccgccatagttggcgcgacctgatctggaagggtgaccatacccctctggagacccctggtgccacactcaacgacgatgagaacggcacttacaacagttggttccgccggggcttgcccaccatagtgcagggtccgctggagacgggaaatcctctggacgcttccggtagcggaggtgacgaaacggtaccgaccgactccggccaggcgcctgccctggcgggcgtcaaggccagctttcggcatggcagcaagggcaagggacaggccaataccaaacggggctatgagcaccaggagagttacaacgatgctcgtgctcaatgggcagcgctatatggggtgatcaaaatcacccagttggcggattggcatcctaatgacaaaggagggacatga

SEQ ID NO: 11014 - DNA, 756 bp, Pseudomonas aeruginosa
tgggcatgggcctgggctacgcgatcgccggcggcatgggcatggtcgacctcggcggtctggccgagcgcccctggttcgacatcgtcaccccgctgcacttcggcgcgccgaccttcgacctggcgccgatcctgtcgatgtgccctggtggtagtgatcatcttcgtcgagtccaccggcatgttcctcgccctgggcaagatcaccggccgcgagatcaccccgaccgaactgcgccgcggcctgctctgcgacgccggcgcctcgttcttcgccggtttcctgaacaccttcacccattcctcgttcgcccagaacatcggcctggtgcagatgaccggggtgcgcagccgctacgtcacggtggccgccgccggtttcctgatcctcctcagcatgctgcccaaggccgccttcctggtcgcctcgatcccgccggcggtactcggcggcgccggcatcgccatgttcggcatggtcgccgccagcggcatccagatcctccacgaggccaacatcaccgaccgccgcaaccagttgctggtggcggtaagcatcggcatgggcatggtgccggtggtgcgcccggacttctttgcccgcctgccggtctggatggagccgatcacccatagcggcatcgccatgaccgcgatctgggcggtggtgctgaacctgctgttcaacatcctcagccgcaacgaccgcagccacttgtgcggcagccacgcgccggcgcccaagcactcctga

SEQ ID NO: 11015 - DNA, 1632 bp, Pseudomonas aeruginosa
aatgaagccgatccggctgggctcgtcgccgatctggtaataccgcgacggcccgccgctgcgcgccaggctcggggtcagcggccagcggcgctcgatgatcgcgcggacttcgtcgctggtgcagagcgtcagctcgcgacggtggctggtgatgctgcccagcggcatttcctcgatgaaactgatgtccaactggttggccagggcgtactcgaccaggttgaggatctcgtcgtcgttgcggcccttctgtaccacgcagttcagcttgatccgctcgaaaccggcttcgcgcgccgcctggatgccgtccagcacctgctccaggcgatcgctacgggtgaaggcggcgaagcgttcgcgctgcagcgagtcgaggctgacgttgaggcggcggacgccggcggccttcagctcggcggcgcgctcgcgcagttgcgaaccgttggtggtgatcgccaggtcttccagttccgcacgctgccccaggcgtgccagcaggccggtgatgcccttgcgcaccagcggctcgccgccggtgatacgaatgcgccgcacgccgaggccgatgaaggcgtcggccaccgcgtaaagttcctccaggctgaggacctggtcgcggggaaggaactgcatgtcttcgctcatgcagtaggtgcagcggaagtcgcagcgatccgtcaccgacaggcgcaggtaggtgatgcgacggccgaagggatcgaccagacgggaatcggacatagtgactcgttctgttccgggggctcgcccggcgctcggtgggtgagtgcgagcgggcgactcgatacccctaacgaatactccaaataccggaaaatgtatagggcaaatgaaccggcgggtcaggatttcccgggcctccgcctcgctcgcaccttgcttgaggggcgctccgggcgggtgctaccatcctcggcttcctgccgccgttgcagcaatgaagaacaaggactgatgaccagcatccgcgagcgcaacaagcgcctgatcctccgcgccgccagcgaggaattcgccgacaagggcttcgcggcgaccaagaccagcgacatcgccgcccgcgccggcctgcccaagcccaacgtctactactacttccagtccaaggaaaacctctatcgctgcgtgctggaaagcatcgtcgagccgctgctgcaagcgtcggcgccgttccgcgtggaagacgacccgctgctcgccctgcccgcctacatccgctcgaagatccgcatctcccgcgagctgccgcatgcctccaaggtcttcgccagcgagatcatgcacggcgcgccgcacctgccgaaggaatacctcgacgaactgaacgcccaggcccagcgcaacgtcacctgcctgcagacctggatcgaccgtggccagctcgccccggtggacccgcatcacctgctcttcgccatctgggcggcgacccagacctatgccgacttcgattggcagatttccatcgtcaccggcaaggaacagctcagcgacgccgactacgacgctgcggtggaaaccatcacccgcctggtcctgaaaggctgcacgcccgacgggcaatccggcaagagcaccggccggcttcggccgctgccgctctga

SEQ ID NO: 11016 - DNA, 1869 bp, Pseudomonas aeruginosa
gcgtatacaacccatcttgaccttgcgctccccctctgcctagaatcgttccaacttttgtacacaattagtataagaacgaggaacaaaacgatggccagaatgagagcaatcgaagccgccgtactggtgatgcgccgcgaaggcgtggataccgcgttcggcgtccccggtgccgcgatcaaccccatgtacgccgcgctgaagaagatcggcggcatcgaccatgtcctggcccgtcacgtcgaaggcgcctcgcacatggccgagggctacacccgtaccaaggccggcaacatcggcgtctgcatcggcacctccggccctgccggcaccgacatgatcaccggcctctactccgcctccgccgactccatcccgattctctgcattaccggccaggcaccgcgcgcccgcctgcacaaggaagacttccaggcggtcgacatctccagcatcgccgcgccggtggccaagtgggcgaccaccgtgctggaaccggcccaggtcccctatgtattccagaaggccttccagctgatgcgcagcgaccggcccggcccggtactgatcgacctgccgttcgacgtacagatggccgagatcgagttcgacatcgacgcctacgagcccctcccggtgagcaagccgaaggccacccgggtccaggccgagaaggtcctggccatgctcgacgaagccgagcgcccgctgctggtggccggcggcggcatcttcaacgccgacgccgccgagcgcttccgcgaattcgccgagctgaccggcatcccggtgatcccgaccctgatgggctggggcgtaatccccgacgaccacccgcagatggccggcatggtcggcctgcagacctcgcaccgctacggcaacgccaccctgctggaatccgacctggtgctcggcatcggcaaccgctgggccaaccgccacaccggcagcgtcgaggtctataccgaaggtcgccgcttcatccatgtcgacatcgaaccgacccagatcggccgggtgttcatgcccgacctgggcatcgtctccgacgccggcgccgccctcgacgcattcctcgaagtggcccgcgaatggaaggccgccggcaagctgaagtcgcgcgccgcctggctggaaagctgccagcagcgcaaacgcacgctgcagcgcaagacccacttcgacaacgtgccggtgaaaccgcagcgcgtctacgaagagatgaacgagttcttcggcaaggatgcctgctacgtcagcaccatcggcctgtcgcagatcgccggcgcacagttcctccatgtctaccaaccgcgccactggatcaactgcggccaggccggcccgctgggctggaccattcccgccgcgctgggggtggtcaaggccgacccgagccgccaggtggtggcgctctccggcgactacgacttccagttcatgatcgaggaactggcggtcggcgcgcagttcaagctgccctatatccacgtactggtgaacaactcctacctgggcctgatccgccaggcgcagcgcggcttcgacatggactattgcgtgcagctggccttcgacaacatcaacgcccccgagctggaaggctacggcgtcgaccacgtcgcggtggtcgagggcctgggctgcaaggcgatccgggtgttcgacccgaacgagatcggcgccgccctggccaaggcccgcgaactgatgcaacagcaccaggtgccggtggtggtcgaggtgatcctggagcgcgtcaccaacatctccatgggtaccgagatcaacgccatcaacgagttcgaggaactggccgagaaaggcgccgacgcgccgaccgccatctcgctgctcgactga

SEQ ID NO: 11017 - DNA, 330 bp, Pseudomonas aeruginosa
tcaacaccctcgacatccccggcttctacctgcagaacacccgccaggccctggagatccgcgacaaggtcggcagcgccaacctgttcctgcaatacgacatctatcacatgcagatcatggaaggcgacctggcccgcaccctggaaaaccagttggcggcgatcaaccacgtgcaactcgccgacaaccccggccgccacgaaccgggcaccggcgagatcaactaccgcttcctcttcgagcacctggaccgcatcggctaccagggctggatcggctgcgagtacaagccggccaccaccaccgaagccggcctcggctggatga

SEQ ID NO: 11018 - DNA, 918 bp, Pseudomonas aeruginosa
agacgcacaacgtcgtctgatccgcacccacgaacaagacgctcccgcctccctgcgcggagccactcgacagacagaaccaggagacactctcatggccaagatcggattcatcggcaccggaatcatgggcaagcccatggcgcagaacctgcagaaggccggccacagcctgttcctttccacccaccacgacgccgctccggccgacctgctggaggccggcgccattgccctggccaacccgaaggaagtggcccaggaagccgagttcatcatcgtcatggtgccggacaccccgcaggtcgaggatgtgctgttccgcaaggacggtatcgccgagggcgtcggcccgaacaaggtggtgatcgacatgagttcgatctcccccaccgccaccaagggcttcgccgagaagatcaaggctaccggcgcgcagtatctggacgccccggtctccggcggcgaggtcggcgccaaggcggcgaccctgagcatcatggtcggcggctgcccgaacagcttcgaacgcgccctgccgctgttccaggcgatgggcaagaacatcacccgcgtcggcggcaacggcgacggccagaccgccaaggtggccaaccagatcatcgtcgcgctgaacatccaggcggtcgccgaggccctgctgttcgccgcccgcaacggcgccgatccggccaaggtgcgcgaggcgctgatgggtggcttcgcctcctcgcggatcctcgaggtacacggcgaacgcatggtcaagggcaccttcgacccgggcttccgcatcagcctgcaccagaaggacctaaacctggccctggccggcgcccgcgagctgaacctgaacctacccaacaccgccaacgcccagcaggtgttcagcacctgcgcggccatcggcggcagtaa

SEQ ID NO: 11019 - DNA, 1629 bp, Pseudomonas aeruginosa
ctgggaccactcggcgctgatcaagggcctggagcacatggccaacttctcgatccgcgacgagtgatccgcagtccgcgcgggccgtcaccccgcgcggagcgacgaaccccttttcgaagggctcggggagaggaacggtcggcgaactccggtgttcgccgccgccctcttccttccccgcccacaaggcggggtaaaggaagcgaacgcccggccgggagattcacggcctctgcgtccgggcgcctcgcttccattccccagttcccgccggcgcgggtgctgcggaatggaagcgtcgacgacgctgcgaccgccggtccgaccggcggcacgacaacaagaaattcggagcctgtcatgagtaccgatccacgcgcctttctcaccgagctgttcaataccgcggtggcagccggccatccctaccaggtgctggccgaccacctgccggaagatcgcagcgggcgcgccatcgtcatcggtgccggcaaggccgccggagccatggccgaagtggtggagaagcactggcagggcgagatccagggcctggtagtggcgccttaccgctacggcgcgcaatgcagtcgcatcgaggtggtggaagcctcccatccggtgcccgacgacgccggcgagcgcgtcgcccgtcgcgtgctggaactgatcagcggcctgaacgagagcgaccgggtgatcttccttctctccggcggcggctccgcactgctttcgctgcctgccgaaggcattggcctggcggacaagcaggcggtgaacaaggcgctgctcaagtccggcgccgccatcggcgagatgaactgcgtgcgcaagcacctctcggcgatcaagggcggtcgcctggccaaggcctgctggccggccagcgtctttacctacgcgatttccgacgttcccggcgacgaggccacggtgatcgcctccggccccagcgtcggcgacccgaccacctccgccgacgccctggcgatcctcaggcgctacgccatcgacgtgccgcagaacgtcctcgactggctcgccgacccgcgctcggaaaccgtcaagcccgacgacccgtgcctggcgcgcagccacttccagttgatcgccacgccacagaacgccctcgacgcagcagcggtgaagtgccgcgcggccggcttctcgacgctgatcctcggcgacctggagggcgaggcgcgggaagtcgccaaggtccacgccggcatcgcccggcagatccgcaagcacggccagccgctggcggcgccctgcgtgatcctctccggcggcgagaccaccgtcaccgtgcgcggcaacggtcgcggcggacgcaacgccgagttcctcctcagcctcaccgccgagctcaagggcgaaccgaacatctgggccctggccggcgacaccgacggcatcgacggctcggaagacaacgccggcgcgctgatgacgccctgctcccatgcccgcggcgaaaaggccgggctgaagatccgcgacgagctcgacgacaacaacggctacggctatttccaggccctcggcgacctgctggtgaccggaccgacccgcaccaacgtgaacgacttccgcgccattctcatcctcgagtcctga

SEQ ID NO: 11020 - DNA, 2337 bp, Pseudomonas aeruginosa
catgacagccgacaagaaagccaagatccttgccaccctcggcccggccacccgcagccgcgacgatatccgtgccctggtggaggccggcgccaacctgttccgcctgaacttcagccacggcgactacgccgatcacgcgcagcgcttcgcctgggtgcgcgaggtggaagcggagctgaactacccgatcggcgtgctcatggacctgcagggtccgaagctgcgggtcggccgcttcgccgccggtgccgtgcaattgcagcgtgggcagaccttcactctcgacctcagcgacgcccccggcgacgagcggcgggtcaacctgccgcatccggagatcatccatgccctggaaccgggcatgagcctgctgctggacgacggcaagatccgcctggaagtggtcaactgccacagcgacgccatcgagacccgcgtggcggtgggtggcgagctgtccgatcgcaagggcgtcaacgtgccggaagcggtcctgcaactcagcccgctgaccgacaaggaccgccgcgacctggccttcggcctggaactgggggtcgactgggtggcgctgtccttcgtgcaacgcccggaggacatcgacgaggcccgtgggctgatcggcgacaaggccttcctcatggccaagatcgagaagcccagcgcggtgagcgccatcgaggcgatcgccgagcgcgccgacgcgatcatggtggcgcgcggcgacctcggcgtagaggtgccggcggagagcgtgccaggcatccagaaacgcatcgtccaggtctgccgccagctcggcaagccggtggtggtggccacccagatgctcgagtcgatgcgcttctcccccgccccgacccgcgccgaggtgaccgacgtagccaccgcggtgggcgccggcgccgacgcggtgatgctctcggcggaaaccgcttccggacaataccctcgcgaggcggtagagatgatggcgaagatcgtccgccaggtggaggccgagccggactaccacgtccagctcgaggtcaaccgtccgcagcccgacgctaccgtctccgatgcgatcagctgcgcgatccgccgggtcagccggatcctcccggtggcggtgctggtgaactacaccgagtcgggcaactcgaccctgcgcgccgcccgcgagcggcccaaggcgccgatcctcagcctgaccccgaacctgcgcaccgcgcggcgactgaccgtagcctggggcgtgtattcggtggtcaacgagcaactggcgcacgtcgacgagatctgctcgaccgccctcgacatcgccctggcccagcgcatggcgcgccgcggcgacaccgtggtggtcaccgccggcgtgccgttcggttgccccggctcgaccaacatgctgcgcatcgagaccgtggcgccgccgctgggagatctctgaagcaacgagttcggtccggctcgcgccgtccccccgggcatgcgggtcgggccacccttgtctctctcggatggatggggccggaaatacggggccgcgtctccatccatccgggaaagaccttcttgtcggaccatggcctccctcgcgcactcccatgcaggccatggacattcaaggcctccggttcaactcctgccggaggtctttttttcttcttggaacgccctgcatgcatgaccctcgcctggccttctcgtccggggtgcgtcgcctccgcgccagaccctacaatgaccgcccccgcccctcgcgcaggcctggcatctccgtgcctgccgagcggcccttgccgcactgaccgccatgcccctgcaatctctcctcaatgcatcccgaatcctcctgcgcggcatcagccaggtgttcctccagggcgacccacgcctgggcctggcctgtctgctggcgatcgccgtcggcgcgccgccgctgctcgccggcgccctccttggcggcgccctcggcccgctgctggcgcgcctgttgcactgcgccgacagcgacatcgaggccgggctgtacggctacaacgccgtgctgatcggcatgctgctggcattccgcttcgcctggtcgccggggctggtgtcactggtagcgctcggctgcctggccagcgtggcgttgcagcgcctgttcctgcatgggctgcgccgacgccgctggcttccgccctataccctgggcttcgtcctcaacggctggtggctggtgcccctcggcgcctggctaggcctggccccggcgacccatggcggctgcttcagctgcgcctggagcggcacggcggagctggcggcgctagcgcaggggatcggcgagatcatcttcctcggtga

SEQ ID NO: 11021 - DNA, 408 bp, Pseudomonas aeruginosa
accgctggcagggctgctggtctggctcggcctgctgctggtctcgcgtccctccgccgcctgggccctcgccggcgccgcggccagcctgccgctggcctggctgctgggctacgactgggcgagcgcgctcgccgggttctacggcctgaacgccgcccttgccgggctggccctggccttgcgctaccgcagcgcctggccgccactgctcggcatgggcctggcggtgacgctgcaaccgctgttcggcctgctcggcctgccggcgctgaccgcaccgttcatcctcgcctgcctgctttgcatcggcggcgagcgcctgtacctgcgcctggccggcagcctcggcgcgcgcctcggccggcgacgctcctgagcgggggaacgctggcgccggcgggctag

SEQ ID NO: 11022 - DNA, 888 bp, Pseudomonas aeruginosa
tctggtaaggtgccgcatccatcatcaggagccacgatgagcgcacccgacagctggcgcgaacgcctctatatcgtcatcttccagaccgacacccgcgacggccggcgcttcgacagcgcgctgctgctggtgatcctggccagcctgctggtagtgatgatcgacagcatcgacgaaatccaccaggactacggcgacctgctggcctacatcgaatggggcttcaccggcatcttcctggtggaatacctgctgcgcctgtactgctcgcccaagccgctgcgctatgccttcagcttctacggcctggtcgacctgctggcgatcctccccggcttcctcgccctgctctaccccgacgcccagtacctgctgatcgtccgggtgatacgcatgctgcggatcttccgcgtgctcaagctacgccagtacctgagccaagccaatttcctgctcaccgccctgcgcggcagcaagcagaagatcatcgtgttcttcctcaccgtgatgaccctggtcaccgtgttcggcgcgctgatgtacgtggtcgaaggcccggagcacggtttcaccagcatcccccgcggcatctactgggcgatcgtcaccctgaccacggtcggcttcggcgacatcaccccgaagaccccgctcggccaggccatcgccagcctggtgatgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaaggcagccatgggaagtcttga

SEQ ID NO: 11023 - DNA, 1323 bp, Pseudomonas aeruginosa
ccgcggcagcgtgctcgaagcgcagaagaagttcctcgccgacatccagagcggcagcacccagcccggcaaggatcgccccatgcccggcatcgacgagctgaaaagcctgctgcaactgaccgaaggcaacctcgaacgcctgctcgccgagcagcgccagctggacgaccgcgccgccgaactggaacagcgcaagcagcagttgcaggagcagcgcggcaccctcaacggcgacggcaagcgcttcaagcgcgcggtcctgcgggtcgccctggagcaaccggcacaggtcgaggtgaagctcgactacaccctgcgcgacgcctcctggcagccgacctacgacgcacgcctgcgcgacggcgcgaataccatcgaactgacctaccagggcctggtccggcagagcagcggcgaagactggaccgacgtcgacctgaccctctccaccgcccgtccggccctgggcggcaacgtaccgcggctgaatccctggatcgtcgacatcgacgcgcccaacgcctactacggtgccgagatggccatgcaggacgttccggcgcccatgccgcaagccgcgcccatcgccaggacctcggcgaagatggccatgccggccccggcgccgaagctggccgaggcgcggctcgccaccgcggaggtcagcagcggcgccgccagcgcctctttccacatccccgtgccggcgaccctgaacagcgacggcagcgcgcagaaggtcaccatcgcccgcctggaaatgccggccaagctgcgctatctggcggccccggccctgcgcgaaaccgcctacctggaggcggagacccgcaacgacagcgactacccgctgctccccggcaccctgaatacctttctcggcaacagcttcgtcgccagcggccatctgcgcggggtgatgcccggcgagagcttcgaactggcactgggcgccgacgagggcatcggcatcgaacgcaagctggtcaagcgctataccgacagcagcggcctgatcggcaaccgcacgcgggtcaactacgaattccgcatcgacgtgcgcaacaaccacaagaacgccgaacgcgtgcagttcgaggaccagttgccggtctcgcgcaacgagcagatccaggtcaccttgctggaacccaaggcgcaggaagtcaagcgcgaggacgacggcaagctgaagtgggactggaccctgcaacccggcgagaaacgcagcgccaccctgaagttcagcgtggagtatcccaaggacctggcggtcagcggcctcgactagcgctggccaaagcgccggccgcggcatag

SEQ ID NO: 11024 - DNA, 1047 bp, Pseudomonas aeruginosa
cccgacgttatagtcgagccactacaacatgctcaaaggaactgccctgtgaaacgactgttcagcgcctccctgctggccgccggcctggcgctcggcggcgccgctcacgccgcccagcccctgctcaacgtctcctacgacgtgatgcgcgacttctacaaggaatacaacccggccttccagaaatactggaaagcggagaaaggcgagaacatcaccatccagatgtcccatggcggttccagcaagcaggcgcgctcggtgatcgacggtctgcccgccgacgtcatcaccatgaaccaggccaccgacatcgacgccctcgccgacaacggcggcctggtgccgaaggactgggcgacccgcctgccgaacaacagcgcgccgttcacctcggccaccgtgttcatcgttcgcaagggcaaccccaaggccctgaaggactggccggacctgctcaaggacggcgtccaggtagtggtgccgaaccccaagacctccggcaacggccgctatacctatctctccgcctggggctacgtgctgaagaacggcggtgacgagaacaaggccaaggagttcgtcggcaaactgttcaagcaggtaccggtgctcgacaccggcggccgcgccgccaccactaccttcatgcagaaccagatcggcgacgtactggtgaccttcgagaacgaagccgagatgatcgcccgcgaattcggccgaggcggcttcgaggtggtctacccgagcgtgtccgccgaggccgagcctccggtggcggtggtcgacaaggtggtcgagaagaaaggcagccgcgcccaggccgaggcctacctgaagtacctgtggtcggacgaaggccagaccatcgccgccaacaactacctgcgcccgcgcaacccggagatcctcgccaagttcgccgaccgcttcccgaaagtcgacttcttctcggtggagaagacctttggcgactggcgcagcgtgcagaagacccacttcatcgacggcggcgtattcgaccagatctacagccccaactga

SEQ ID NO: 11025 - DNA, 963 bp, Pseudomonas aeruginosa
attggtcacccatacggtcaagtaggcggccaatccaagagcgtacctgccttacggacctgtgggattttccgccgggcctgcgcaaagcctcgccccgcccccttccgcccagcgccgccaggcgctaccgggcgattcacggtaacaatcgccgcaccaggatgcggcccatgggagaacacgatgcgccccgaggaacgccgccgccacattctcgaattgctgcgccagcgcgagcggatctcggtggacgaactggcgcggaccctttccacctctcaggaaaccattcgccgcgacctcgccgcgctggccgaacaaggcctggtcagcaaattccacggaggggccgccctgccgcccagcggcgagcacgagaacgccttccagacgcgaatgaacgagcacgcccaggaaaaacgcgcagtcgcccgctacgccgccggcctgttcgggcccggtgacagcatcttcatcgacaccggcaccaccaccctgctgttcgcccgcgaactggcgcgccagagccatctgacggtgatcaccaactcgctgttgatcgccggcagcgtcggcgcctccggcaaccgtgcattcatgatcggcggcgagtaccgcccggaatccgaacagaacgtcggcgccctggccatcgagcagatcgcccggttcaacgccgagcatgcggtgatcaccgtcggcgcgctgaacggcgatggcgccatggatttttccatcgaggaagccgagatcgcccgtgccatgatcgcccaggcccgccaactgacggttatcgccgactcctcgaagctcggccggcgcgccctgttccaggtcttcccgctgagccggatcaaccgcctggtggtcgaccgcaagcctaccggggaactctgggaagccctgcaacaggcgcgggtggaagtccacgaagcccccctgcgcaccccgcaggcctga

SEQ ID NO: 11026 - DNA, 906 bp, Pseudomonas aeruginosa
gcgaggccgccagcggccgcctgcggatcctggccgatggtcgcccggtgtgggagcgtgccctgtcctgcctgccggagcgccgcctgctggtgccgctggccgccctgcgcctgccgccggacacccggcgcctggaagtcgccttcctcacctccggccactgaacccgcgaagagaaccgaccatgcgaatcgccgccctcgaccagggaaccaccagtacccgcgtgctggtcgccagccaggacggcagcgccgatattcagttggcgctgcgtcaccagcaacaccatccgcagtccggctgggtcgagcacgatccgctggaactgctggccaacctgcaacgctgcctggaggccagcggccgggtcgacgccatcggcctcgccaaccagggcgaaagctgcatggcctgggacgcccgcagcggcgagccgttgtcgccgctgatcgtctggcaggacaaccgcaccaccccgcacatcgagcgtctacgcgccagcggcgccgaggcgctggtcctggaacgcagcggcctgccgctcgacgcctatttctcggccagcaagctgggctggatcgtcgagcaccttccggccgctcgcagggctttgaaggcaggccgcctgcgcctgggaaccagcgatgcctggtttctcgaccgcttgtgcggaaccttcgccaccgacgtcaccaccgcctcgcgtaccgcattgatgaacctcgccgagggccgctgggaccccgacctgtgcgccctgttcggcgtgccgatcgagtgcctgccggaaatccgcgataccgtcggccatttcggggtgatcggcaacaccccgctgacggcctcggtggtcgaccagcaggcctcgctctacggtcacggctgccgccagcccggtga

SEQ ID NO: 11027 - DNA, 2043 bp, Pseudomonas aeruginosa
ccatcgacccgcagctcgcgacgctggccgtggttggcctggaccagcgcgcccaccgtccagccgccctgctccgccggcagccgccgcgatgcgctaccgatgccacccttgaactcgtggcagatcatcccggtgccgccgcccaccgaaccttcgcggaccggtccggactcggcgcaggccagcgcctcgccgacctggcgggcgccgacatgctggccccagatatcgttgagcaggccgtcgaaggtctccatcaccaccggcatgcaccagtacagcccgctgtcgccgagttcggcgcgctcctcggcgatcagcgcgtcgcgcaccgcgccgacgctgtgggtattggtgatggcgatcggggtggtcagcaggccggcttcgcggatccactccaggcccgtggcgtcgccgttgccgttgagcacatggcagccggcgaagcagggttgcaggcgcgccgcaccggcgcgcggctggaccagggtgacgccggtgcgaacctgcctgccgtcgatccgctggttcagggtgctgtggccgacgcgcacgccgggaacgtcggtgatcgcgttgaacgggccgggagtgcccaggccgagggtgatgccaagttgtcgagcgcgcatgcggactcctgtttcaaagcttctggaacgccggactgagcttgccgtaggtgcagtagagaatcaccgacaccgccagcagtccgacaatgatcatcacgtccctggccgaggccgccaggaacaggttgagcagcaggtatcccgcgccgctcaccgccagcagcgccggcagcgccggcagcggccacagcggcatccggtagggatgctcgcggtcgcgccgcagcacccggctgaacagcgcgcagagggcgacgatcaggtagaccatgacgatcagcaacacggtgaacgaggtcagttcggccaggttggagctgaagctcagcgccgccgagggaatggcgaggaacagcgtggccagccagggcgattcccagcgcggatggatacgggtgaaggcacggttcaacgccggcatccagagcgcgtcgcgaccgctgctgaagatcacccgggcgctctggatgacgatggcgacgatggcgttgaacaccgagaggaagatcccggcgctgaccaggcgcgacagcgtctcgttgccatggctgttcaacaggtagccgatcgggtcggggctggcgagcatcgccgggagcgacggcgcgccgatcagcagcgcggcgagcgggacgatctcgatcagtactaccagcgccagcgaccagagcaccgcgcgatgcacgctgtgaccgccgtccttcatgtcctcggcgagcagcaccgcgccgccgaaaccgttgtaggagaacagcgcggtaccgaccgctccgatcaccaatgcccagggtgcgatcgccagcagcccgccgtcgccgactacctgcggctgcagaaggacgctcgccggttgctgtacatggccgaaaccgaggccgacgatcaccagcagcgccgccacttccagcagcaggcaggtacccgtgacccaggcgttgacgcggatgttgaggatgcccagcaggtagctgaaggcaacgatcgccagggccacggtctgcgcatcgaagtgggtgccgagggcagcgttcaggtaagtcgccgcgccggtggcgagcaccggcgggatgaacagcagcatcgccagcaccgtgaggaaggtggcgtagccggccaagccgccgaacacccgcttggcgtagacatactcgccgccggcggtgctgtgcgccctgcccagctcggcatagcaccaggcgaacatcagcgccagcaccccggccagggcgaaggcccagaaagcgccggtgccggcctgctggatggcgaagggggcgatgacgaagacggaactggcgggagtgactgcggaaacggtgatggcgaccacgtcgaacacgcccagcgtgggtttcagcgcactttcgggcgcgggggaagagctcatgtcgttgtcctctga

SEQ ID NO: 11028 - DNA, 1119 bp, Pseudomonas aeruginosa
gttcggcggcgcgttcgaaggcccgcgctgcatcggcgccgcgttcctgggtcatgtaggtgcgaccgaggaagtaccagccctgggcggaatccggctgagcctgtaccgcgcgctccaggcgcgcagtcatctcttccatggagtgcggcgcctgggcgaattcgcgggccagctcgaccttgtcgctggcgccccaatgcaggtacaggccgagcgcgaccaacggcaccagcagcgccgcgaccagcgggaccgcccggcccaggcgcgagctacgctcttcgccgctgccctcggtgtcggcgagcagttcgcgggcagcctcggcgcggccattctccagttgctcggcggtcagcgtgccggcggcctgctggccggccagctcggcgatccgctcctgataaagcgcgacgttcagggcggtacggtcttcctcggcctgggcgcgacggccacgcagcagcggaatcagcaggaatgccagggccgccagcagcagcaggccggcagcgagccagaaatcgatcatttgtcgttcttcaacaggttggcgaggcgcgcttgctcctcggcggacagggtggtttgcaccttggcagcggtgcgccggcggcgcaggacgatcacgccgatcaccagcacgccgaacagcagcaaggcgcccggaccgaaccagagcagccaggtacgctcgttgaccggcggcttgtagcgaacgaaatcaccgtagcgggcaaccatgtagtcgacgatctcgccgtcgctcttgccctgctgcaactggccgtagatctgcttgcgcaggtcggcggcgatcggtgcgttggagtcggcgatgtcctggttctggcacttcgggcagcgcagttcctgggtcaggttgcggaagcgttcgcgctcggcgtcgctggcgaactcgtaggtgtcgatggcggcccgggccacgccgcagagggcgagaccgagcagcgcggtggcgaggaaacgcttcatcgggcctccggctcgtccagcagttgctggtacagcggcgccagttgctcgcgccagactttctggtcgaccaccccgacgatcttgtggcggatgatgccctgtttgtcgatcaggtag

SEQ ID NO: 11029 - DNA, 420 bp, Pseudomonas aeruginosa
agggtcccgaggaggatcatcgaggccgccaccaccagcaccaggttgttcagcagcagcagggtctcgcgcgaccacagggcgaagccgacctggctcttgaccaccggcgcgcgcagggcgaacagggtcagcgagccgccgaccaccagcagcaggaaggcgaggatgaacaccccgcgctccgggtcggaggcgaaggcgtgcaccgaggtgagcacgccggagcggaccaggaaggtgcccagcaggctcagggagaaagcggcgatcgccagaagcacggtccagctcttgaacacgccgcgcttctcggtcaccgccagcgagtggatcagtgcagtgccgaccagccagggcatgaaggaagcgttttccaccggatcccagaaccaccagcccccccagcccagctcgtag

SEQ ID NO: 11030 - DNA, 1671 bp, Pseudomonas aeruginosa
tgccgtaggccgaccagacgtagggaccgtgatggcccatggcgaggaagtcgccgaacgattcgaagctcatcgtgccttctccaccagggccttcacctcggctttcgcccaggtggtgcgggactcgcgcttgagcacttccaggcgcatgcgcaccagcagcatggccgcgaagaagcaatagaagccgaggaccatgatcagcaacggcaaccacatctccaccggcatcgccggtttctcggtgatggtgaaggtggccggctggtgcagggtgttccaccattccaccgagtacttgatgatcgggatgttcaccacgccgacgatggccagtacggcacaggccttggccgcgctgtcgcggttactgatcgcctggccgagggcgatgatgccgaaatagaggaaaagcaggatcagcatcgccgtcaggcgtgcgtcccagacccaccaggcgccccaggtcggcttgccccatacggccccggtaagcagcgcgacgaaggtcatccaggcgccgatgggagcggcgcactgcaccgccacgtcggcgatcttcatcttccagatcagcccgacggcaccggccacggccagcatgacgtagcaggactgggcgaggaaggccgccggcacatggatatagatgatgcggaagctattgccctgctggtagtccggcggcgcgaaggccagcccccagacgcagccggtgacgatcagcagcgccgccgccacggcgaaccagggcagccagcggccgctgatctcgtagaaccacttgggcgacccaagcttgtgaaaccatgtccaattcatcatcaggctctgtttacagggctctttggaaataccgggcagaccttccgctgccagcccgggtcaagcgtgggcggcacagccgcccggtaccgcacgcccgccgatgccttcggcgggcggactcactcgcctacgctgatcttcaggccggcagcgatggcgaatggcgtgagtgtcaatgctagcgccgtcaggctcgccagccacaataaatgtccgctgctgggcagtccctgcagcgaagcctgcagcgccccgctaccgagaatcagcaccgggatgtacagcggcaggatcagcagcgccagcaacaggccgccgcgcttgaggcccacggtcaaggccgcgccgacggcgccgagcaggctcagcaccggcgtaccgagcaacagggaaagcagcagcaccggtatgcaacgggccggcaggcccagcatcagcgcgaacagcggcgacatcaggaccagggccagcccggaaaacagccagtgtgccagcaccttggccagcaccagaagagccagggggtgcggcgaaaggacccactgctccagagaaccgtcctcgaaatcgctgcggaacagcccttccagcgagagcagcacggccaatagcgccgccacccagaccaggccgggcgacaaggtttgtagcaattggctctccggcccgaccgccagggggaacagggcgatgacgatggcgaagaacaccagcggattggccagctccgccggtcggcggaacagcaggcgcgcctcgcgcgccaggagcaggctgaagacgttgctcatgccgggtcgcccagcgccggctcgaccgtcgcgccgctggccgccttga

SEQ ID NO: 11031 - DNA, 1356 bp, Pseudomonas aeruginosa
cgccgagatgaccctgaagctggtgcagaccctggccggcctgctgggcgaaggcgagtcgggcaaggccgaggtgctggcggtcaaggaaggcctggcgaacaatttccaggtcctgctcaagctgaccctggcgaacagcgggcagagcctggtggaagtgcagagcaatcggccgctggtgccgggcaacctgctcaacgtcagcgccaccagcaacaccagcgtggttgcaaccctgctcgacagcatggccggcgctggcccgctgagcagcctcgacctggagcaactgccgcccggcaccctgctccagggcaaggtcctgtccagcaccgcgctgccggcggacaaggcccagcaggtggtctaccgggtcctgctgaacctgctcaacacgccgctcgccggcagcaagctgagcctcgactcgccccaggcgctgccggtcggcagcctgctcacggcgctggtgaaaaacagccagcagatcgacttcctgccgctcagcggacgcctcgaccagcttgcgctgggccagcaactggccgggcagagcgcccgccaggcttccctggaaggcctgttcgccgccctgcaggggctgaacggccgcaacgacctgccggacagcctgcgccaggccgtggagcgcctcttcgccggcctgccggaggcgcagaagatgggcgattccaagctgctcggccaggccctgcagcagagcggcctgttcctcgaggcgcgcctgatgcagggcgccaccgatcatctcggccaggacctgaaggccaacctgttgcgcctgttcgcccagctgtcgccgctgccgccgaccggcgcccaggcgccgggcatgttcgccggcaacacggcgaacctggcccaggcgctgccggcctttgtccgcaacgccctgggcaacctgggacagagcgccaacaagacccaggcactgaactttcccctgccgagcaaggttctccaactgttcgacgaggacatggaactggagtcactgctgcgccttgccgccgcggcgatctcccgcctgcagacccatcagttgtcgagcctggcgcagaccagcaccctgccggatggcacccaactggcgacctggcagatggaggtgcccatgcgccatcagcactcggtggtaccgttgcaggtgaagttccaggaagaacagcgcaagaccggcgaagaggcccgcgaaagcctctggcgcgtcgaactggccttcgacctggagccgctgggaccgctgcacgcccaggcgaccctgctacgcggcagcctgtccagccagctttgggccgagcgagacgcgaccgcgcggctggtcgagcatga

SEQ ID NO: 11032 - DNA, 462 bp, Pseudomonas aeruginosa
actcggccacctgcgccaacgcctgcgcgacgccggcctgaccgttggcgagatcacctgccaacgcggccgcccgccccagggcccgcgagcgaccatcgaacaacgctgggtagacgaaaccgcatgaacagaaagcagtcacccgccccgcgccaggccatcgccctgagctacgacggccaggccgcgccgaccctttccgccaagggcgacgccgaactggccgaggcgatcctggccatcgcccgcgactacgaggtaccgatctacgagaacgccgagctggtccgcctgctcgcccgcctggaactcggcgacgccattccggaagcgctgtatcgcaccatcgccgagatcatcgccttcgcctggcacctgaaaggcaagtgtcccgagggattcgcgccggacgccgcggatggcaaccagatgctgctactcggcggtcccggcgactga

SEQ ID NO: 11033 - DNA, 1923 bp, Pseudomonas aeruginosa
ttggcgactgcccaaactttcattgctctactcttcctggcatgggtctacccggttggggccgcgctaatggccagttcggccccggcgcccgtacgcaaaccatggttcgcgcgctcatggcgaaggcgacggggaattgacggttgccggcgcgggcgccggcgtaccgccagtatctgcagcttgcgtgccagctgccgagcctgcgtggcggagcgccgaatccggttgcgccttgccgctgccgaccccgctgacgctgcgtcgcacctccaggttgcgcgagatcaccagcaccacccggcgattcttcgcccgcccctcggcgctggcattgtccgccaccggctgaaattcaccatagcccaccgcagccatccgcgacggctcgaccccatcgttgccgagcaggcggacgatgctcgccgcccgcgccgccgacagttcccagttggtgggatagcgcgggctatggatcggcacgtcgtcggtgaagccctcgacatggatcgggttcttgtagggcgccaggatcttggcgaccttctcgacgatatcgaaggcggcatcgttgggcagcgcatcgccgctgggaaacagcaggctggaattaagagtgatctcgatccacagctcgttaccgcgcacgctcaactggtcggaggcgatcaagtcgccgaaggcatcgcgcacgctgtcggcgatccgctccagcgagtcggcgctggccgcgttgtcgctgggctgctcctcgacgctggtgcgctccggctcggtggtgcgcggccgctcgtcgccgatgggaatcggcttcaacgagcggtcgggctggttgaacacgccggtgagggtctccgagaggatcttgtacttgccctcgttgatcgaggaaatcgaatacatcaccacgaagaaggcgaacagcagggtgatgaagtcggcataggaaaccagccagcgttcgtggttctcgtgttcctcctggtggcgacggcggcgctgcatgctcggctccggtcagtccatgaagccttgcagcttcaactcgatggaacgcgggttctcgccctcggcgatggacagcaggccctccaggagcatctcgcggtagcgcgactggcgcagcaccagggttttcagcttgttgccgatcggcagcaggagcaggttggcgaagccgacgccatagatggtggcgacgaaggccacggcgatgccgctgccgagctgcgccgggttggccaggttgcccatcacatggatcaggcccattaccgcgccgatgatgccgatggtcggcgcatagccgcccatgctctcgaacaccttggcggcctgcaggtcgcggctttcctgggtgaacaggtcgacctcgaggatgctgcggatgacttccggctcggcgccgtccaccagcagttgcaggcccttgcgcgcatagggatcgggctccgcgtcggcgatgctctccaggccgagcaggccttccttgcgcgcggtcatgctccaggagacgatccggtcgattcccccggaaagatcctcgcgcggcgggaagaacacccagccgagcatgcccaggccgcgcttgagcacgttcaccggggtctgcaacagcgccgcggccagggtgccgccgatcacgatcagcgccgccggaccgttgagcagggcccccgcgtggccgccctcgagaaagtttccgccgacgatggcgacgaacgccaggatgatcccgaccaggctgagcacatccatcagcgcgtcctctcggctcggcgaaggcgcgcgcaggtcgtcacgtgggtggccatcgaaggcagtctcctcattcctgcacgcacgcttactggcacgcctcgaccaggtgccggccgatgtcgtcgagcccgtacaccgcgtccgccaggttggccttga

SEQ ID NO: 11034 - DNA, 789 bp, Pseudomonas aeruginosa
ctactcctcagagggcgacgctcctgcgccgccggaaacccatacgcggcgtcagatgcgccgtgcgtaacgcttgagcatgctcggcacatcgaggatcagggcgatgcgcccgtccccggtgatggtggcgcccgccatgccgggggtgccctgcaacatcttgccgagtggcttgatcaccacttcttcttgtcccaccaactggtcgacgacgaaaccgatgcgctgggtgccgaccgacaggatcaccacgtgcccctcgccctgctcctcgtgggccgcgctcggcaccagccagcgcttgaggtagaacagcggcaaggccttgtcgcggacgatcaccacttcctggccatccacgacattggtgcgcgacaggtcaagatggaagatttcgttgacgttgaccagcgggaaggcgaacgcctggctgcccagcatcaccataagggtaggcatgatcgccagggtcagcggcaccttgatgacgatcttcgagccggaccccttctgcgagaacacgttgaccgtgccgttgagctgggaaatcttggtcttcaccacgtccatgccgacgccgcggccggacacgtcggaaatctcggtcttggtcgagaaacccggggcgaaaatcaggttgtagcactccaggtcggtcaggcggtccgccgcatcgcgctccagcaggcccttctccaccgccttgttgcgcagcacctcggcgtccatgcccttgccgtcgtcggtgatcatcaggaggatgtggtcaccctcctgctccgctga

SEQ ID NO: 11035 - DNA, 1641 bp, Pseudomonas aeruginosa
cagcaccacctggccgacccgcggcttgccggcggcctcgcgctcctccggactctcgatgccgtggtcgacggcgttgcgcaccaggtgcaccagcggatcggcgagggcctcgaccaggttcttgtcgaggtcggtctcttcgcccaccagctccaggttgatctctttcttcatgttccgcgccaggtcgcgaaccaggcgcgggaagcggccgaagaccttcttgatcggctgcatgcgggtcttcatcaccgacatctgcaggtcgccggtgaccacgtcgaggttggccacggccttggccatggcctcgtcgccactgttcaggcccaggcgcaccaggcggttacgcaccagcaccagctcgccgaccatgttcatgatctcgtcgagacgcgccgtatccacccgcacggtggtctccgcctcgcttgccgcgggcctgtcgggcgccgccggacgcgcggcggcggccttggccggagcgaccggtttcgccgcgggactcttcgccgcgatgttcttggctaccgccgcggcggccgccacggcctcggaggcgccgttgaacttgcccttgccgtgcagttcgtcgagcagcgactcgaactcgtcgtcgctgatctcatcgccgcccgcggcggccggcgccttgccctgctccgccggcgcagccgctggagccgcggcagccggtgcggcgggtgtgccggcagcttccgggacatcgccgaacttgcccttgccgtgcagttcgtcgagcagcgcctcgaactcgtcgtcgctgatatcgtcaccagcggcagccgcggccggctcgaccgcctcggcggggacttgcgcaggctcggccgagaccgccggcgggacgaacttgcccttgccgtgcaactggtcgagcaacgcctcgaactcggcgtcgctgatctcgtcgccagcgggagccgcgggcgcttctgcaacggcggaggccggcgcttcgtcgccctgcagagcatccagcaactgctcgaactcgtcgtcggtgatatcgctggaggcactctgcgcgggcgcttccggcggcgccgcaggctcggctggcggaacggccgccggcggcgcttgcacaggttccgcgggctcggcgccctcgggctcggccaggcgggcaagggccgccagcagctcgggcgtcgccggggtcggttcggactgctcgcgcacctggtcgaacatcgcgttgaccgtatccagcgcctgcagcaccacatccatcagttcggagctgacgcgccgctcgcccttgcgcaggatatcgaagacgttttccgcaatgtggcagcattccaccagcgcgttcagctggaggaagccggcaccgcccttgaccgtatggaacccacggaaaatggcattgagcaggtccatatcgtccggccggctctccagctcgaccagttgctcggacaattgctcgagaatctcgccggcctcaaccaggaagtcctggaggatttcttcatcggcgtcgaagctcattcggctgctcccagagacgtgttactcgaaaggatcggcaggaccgctgtcctgccggaaataccggcccggctttccggaccgacttcagcccgcccgccgggatcaccggcatga

SEQ ID NO: 11036 - DNA, 774 bp, Pseudomonas aeruginosa
aggccacggtccctggcctggctgagctcctggatcaattgcaccgcctgctggaagtgcccccgttcgagacagtccaccagttcgcgcgcatgttttttcagggtcgattcgaattcgtcgcccgtggaatcgttaccaagcaccatgacaccctcttggccggcttcagccgttgacccgctcgaaaatcttctcgatcttttccttcaggacctgagcggtgaagggtttgaccacatagccgttgaccccggcctgggcagcttcgatgatctggtcgcgtttggcctcggcggtgaccatcagcaccggcaggtgcttgaggcgctcgtcggcgcgaaccgcgcgcagcagatcgatgccggtcatgcccggcatgttccagtcggtgacgagaaagtcgaaattgccgctgtgcagcatcggcagcgccgtggtgccgtcgtcggcctcggcggtattggtgaagcccaagtcccgcaagaggttcttgatgatgcgtctcatcgtggaaaagtcgtccacgatgagaattttcatgttcttgtccaagtaaacctccgtacagaccagagcgcgccccaggggacgcgccacacattcttttgcgttaacggttacaagctgcggtcgaggccggttcaggccgaccgccaatcggccaggcgcgcgcgcaaacgcgcggcgcactggctgtgcaactggctgacccgcgattcgctgacgcccagtacctcgccgatctccttgaggttgagttcctcgtcgtaa

SEQ ID NO: 11037 - DNA, 696 bp, Pseudomonas aeruginosa
ggacgtagcgcgcggccatcttcgccagggtggtggtcttgccggcacctgccgggccgaccagggccagtacgccgcccgcatcgagcgggtcctgctcgggggtctgcacggcacgcgacaggtgcgccaacagcatgcgccaggcctggcgcgtatcgcccaccgcggcgacccgctccagcaacggcttgctcagctccgccggcaagcccatgcgctgcaggcgccgccagagattggcctgctgcggacgctggtgctgcaactggccccaggcgatggagcccagttgtacctcgatcagctcgcgcaggccgttcagttcgaaacgcattgcctcgagggtctggccgcccgcctggggcttggcctgcgccgccgtcatggactcggccagggacggacgcgccggcttctcctcggcgaacaattgacggtccttgcgctggttttccgccggacgcgccgtcaactcggcgcgcgcctcggcgatccgcgcctgggtcttgcgcagctccacttccagcgccgggttgggcttgctcggcgccggcggggcctggtaatccagcgccgcggtcagctcgatgccgccggcgacccggcggttgccgagaatcgcggcgtccggacccagttcgtcgcggaccagtttcatggcctggcgcatatcggcggcgaagaagcgtttga

SEQ ID NO: 11038 - DNA, 2454 bp, Pseudomonas aeruginosa
cttgcattgcccgaacccctcagttcagtagtcttgccggcaacctcaggttgcccggtgtgccggccctggagccggcgcagccctcgttcagttctgtcccaccgtcgcgacgatggtgacttgcttgttgtccgggatttcctggtaggccagcacatgcatgctgggcaccgccatccgcgcgaagcgcgacatcatcgagcggatcggtccggcaaccagcaggatcgccggcttaccaagcatctcctggcgttgcgcgctctcgatcagcgagcgttgcagcttctcggccatccccggctccagcaacatgccgtcctcggagccttgtccggccttctgcatgctgttcagcaaaatctgttccaacctcggctcgagcgtgatcacaggcagctccggctcaagcccgacaatgctttgcacgattgcgcgggacaacgcgacgcgaaccgcggcgaccatcgcgccgggatcttgactccgtggagcgacgttggcgatggcctcggcgatggtacggatgtcgcgcaccggcacctgctcctggagcagcgcctgcaggaccttgagcagggtggacagggaaatcagccccggcaccagctcttccgccagcttcggcgagctgcgcgcgagcaattgcaggagctgttgcacttcttcatggcccagcagctcgtgggcgtgcttgtgcagcacctgattcaggtgagtggcgaccacggtgctcgcatccaccacggtgtagcccagcgactgcgcctggtcgcgctggccgggctcgatccataccgcctccaggccgaaggccgggtccttgccggcgatgccgttgaggctgccgaatacctggccggggttgatcgccagctcgcgatcgggatagatctccgcttcggccacgctgacccccatcagggtcagacggtaggcgttgggcagcaggtcgaggttgtcgcggatgtgcaccgagggcatcaggaagcccagctcctgggacagcttcttgcgtacgcccttgatccgcgccagcagttgcccgccctggttgcggtcgaccagcgggatcagccggtagccgacttccaggccgaccatgtccaccggggtgacgtcgtcccaacccagttccttgacctcctgggcgcgctgcgccggcagcagctcctgctggcgctgcacctcctgctcggcgacctgcttggccttgttctgccggtgccagatccagtaggcggcagcgccggccagggcgccgaggccgatgaaggaaacatgcggcatgcccggcacggcgcccatggcgatcaggatcgccgcggaaatcgccagcgccttgggcgaggcgaacatctgccggttgacctgctggcccatgtcctcggaactggagacccgcgtcaccatgatcgccgccgcagtcgacagcagcagcgacggcagttgtgccaccaggccgtcaccgatggtcagcagggcgtagaccttgccggcgtcgccgaaggacatcgaatgctggatcatgccgatggcgacgccgccgatcaggttgatgaagagaatcagcaggccggcgatggcgtcgccgcggacgaacttgctggcaccgtccatcgaaccgtagaagtcggcctcctgggccacctcgctgcggcgcttcttggcttcctcctgctcgatcaggccggcgttgaggtcggcgtcgatggccatctgcttgccgggcatggcatccagggtgaagcgcgcgctgacttcggaaatccgcccggcgcccttggtcaccaccacgaagttgatgatcatgaggatcgcgaacaccaccaccccgaccacgtagttgccgccgatcaccacttcgccgaaggcctggatcaccttgcctgcggcgccatggccgtcgtggccgtggagcagcaccacgcgggtcgaggcaacgttcagcgccaggcgcaacagggtcgccaccagcaggatggtcgggaacacggcgaagtccagcggccgcagggcgtacacgcagaccagcaggacgacgatggacagggcgatgttgaaggtgaacagcacgtccagcaggaatggcgggatcggcagggtcatcatcgccagcatggccagcagcaggaccggcacgccgaggctgccgcgccccagtcccgccaggttgctgcgcacattgctgatcagttgcgtgcgatccactctcgactcccctgccctgcgtatggcgcccgtaggtgggcgccgaacaaacttttgacgccggaatgcgcgtcgggcgggtcattgcaggaaccgttccaacttttcaattcattgattgaaaagggttttcgccaatcaccaactaccggaggcgccaccgccgccactcgagcctccgccgccggagaacgagtccgaagacgaactggacgaactggacgacgaggaacccgatga

SEQ ID NO: 11039 - DNA, 1263 bp, Pseudomonas aeruginosa
  unsure (1099): Identity of nucleotide at the above locations are unknown.
gctagcgtaatcgccgccgcgtcgacgccctccccccgagccgccggcgctgaaattgcaaccgatgagcagcggcaggcaagcggcgggcaggatgatcagcgcctcgatgctgttcagcgggtcgtccaccagcaacagcaggcactccagggccagggtcagcagcaggccgagcaggcccggcaggtaggcccagcgccgtcctctgcgcagcccctgccaggcaccggccagcatcagcagggtcagtcccagcgaaagcggcacggccaatccgtaatggagcaccggcaggccataacggctgtaggcccagaacagcccctgcgcatagagcacaagaatggcgaagaaccagcgggcaccgcgcgaatacttgagcaacgcgccgaagccgacgcccaggaccgccaccatctccgccagcgccaccatcgcccctgccggccagtgccgccccagtgccaacgccgcagcgagcgccactaccgcccccagggtccagtaccaggcgcgcggacgtaccagcagcgccaccccgccgagagcgccgagcaggaatgcgatagccagggtctgccgtaccgcgccgggctccagcgggtcgcgcggcggcggcggcaacgcctcgccgtcgatcagtcgtaccaggcgctgcgccgccgcttccaggccgccggcgtagtcttgctgacggaacgcaggggtcatgtattcgcggatgatccgcccggcatcgatgtcggtgatcgttccttccaggccatagccgacttcgatgcgcatgcgccggtcgtccttcgccaccagcaccaggacgccgtcatcgatccccttgcgccccagcttccacgcctcgaagacccgcgtcgcataggcctcaatgctgtccggataggtgctgggcaccatcaggatcgttacctgggcacctttccgggcatccagcgcggccagcgaagcttccaggcgggcacgctcggcggcgtcgagggtcgcggtaaggtcggtcacccgccgcgccagcgctggaacctccgcggactcgtagcccgcatcgcgcgctgcttcggcctcggcgccgaccgccgatgcntccacggcctcctcctcgacatcggacgctgccaccgcgacggtgaccggcaccgtcgcggtggcaacggagggaatcgcggcggcgcagagcagcatgccgaacaggcgaagcatggcgagataacgcgtgattgcagacatccttgtctccgaatgaaatga

SEQ ID NO: 11040 - DNA, 741 bp, Pseudomonas aeruginosa
gctaggggttttcccaaggcccggtgggagccttcgcaaaaggctctcgcggccctcccgccacccgccaaccgatggagtcaccccgtgcgtctggcccttttcgatctcgacaacaccctgctcgccggcgacagcgaccatagctggggcgaatggctgtgccagcgcggcctggtcgacgccgccgaataccaggcgcgcaacgacgccttctatgccgactacgtggccggcaagctcgacgtccttgcctaccaggccttcacccaggcgatcctcggtcgcaccgagatggcccagctggaaacctggcaccgccaattcatgcaggaagtgatcgagccgatcgtgctggccaagggcgaggcgctgctcgccgagcaccgcgccgccggcgaccggctggtgatcatcaccgccaccaaccgcttcgtcaccggcccgatcgccgaacgactcggggtggagaccctgatcgccaccgagtgcgagatgcgcgacggccgctacaccgggcagaccttcgacgtgccctgcttccagggcggcaaggtggttcgcctgcaacgctggctcgacgagaacggcctgaacctggaaggcgccagcttctatagcgactcgctgaacgacctgccgctgctggagaaggtcagccggccggtggccgtcgaccccgatccgcgcctgcgcgccgaggcggaaaaacgcggctggccgatcatttccctgcgttga

SEQ ID NO: 11041 - DNA, 1440 bp, Pseudomonas aeruginosa
cccactgacaagcgcgccgtccgacgggcagcgccacggcggacccaggatgccccacactgcccccgctcccggctcgctgcggccggtcgtgatcgtcgccctggtcaccgcgctatgcctggccggcgattcgatgctttatatcgccctgccgatctactggcacgaggtcggcctggaggcgctctggcaggtcggcgtgctgctgtcgatcaaccgcctgatccgcctgcccttcaatccgctgatcggccgcctgtacaagcacctggcactgaagaccggcctgctcctggcggtcgtcatcggcgtgttgagcaccgccggctacggcctggccagcggtttcctggcctgggtgctgctgcgcggactgtgggggatcggctggtcgttcttccgcatcggcgggctctcggcggtggtctactgcgccgccgaccaccagcgcggccgcgccatgggcctgtacaacggcctctaccgcctgggcagcctggtcggcatgctgctcggcgggctgctggtgccggtcctcggcctgccggcgctggcgctgtccttcgcgatcctggcactgctcggcctgccgctgctggcgaagggtttcgacctaccggagaatcccgccggacatgcgcggacctccgccgcaacggcatccaccagcgtcgccaggcgcccgccgccgcgcggcctggtgatcctcagcggcttcgccaccgcgctcctgatccagggcgtactcgccgccaccctgagcgcgctgatcgcccgcagcttcggcaccgaggtcagcctgctcggcctggcgctcagcgccgccggcctttccgggatcatccaggccctgcgctggtcctgggagccgtggctggccgggcgcttcggtgcctggtcggatggcccgcgcgggcgtcggcgcttctacgtggctgcgctactggtcggcgcaatgggcttcggcctgctttccagcaggctgcccattctcgcctggctggccatcgccctgctggtgatgctggtcgccaccgccctcaccaccctgaccgacgccctcgccgccgacgtcgcccgcgccggcgacgtggtcggcttcatgacccgctactccatcgtccaggacctcggcgccgcgctgggcccggccctggccttcctcctgctggagcggcccggcggcttcgcctggttgtactggggcggctccctggcgttcctggtcctggcgttgctctggttgcgccgaggggactctcagaccggcttgttgaccatcaggtagaagatgaccatgaaggcgatgaaggccggccagccgaggatgaaccaggcgttcatgtagcggtacgccagcggttcgatgggccgcgcctcgcgcaaggccgcctcggccatgtcgcgtacgcggatctgcaaccacaccaccggtag

SEQ ID NO: 11042 - DNA, 714 bp, Pseudomonas aeruginosa
cggccgcgcggccaaccctgggcgcggcgcagctcgtccagcagctcgccctgggtcagcgcctgcggacccaccagcggaatcacctgcgcccgctccggccagcggcgcagcaaggccagcaccgcgccgaccaggtcctcgacatgcagcggttgcaggcgcgcgcgattgtccagcaagggaatcagcggtagcggcgacaggcgttccagccaggcgctgctggcgccgcccggccccagcagcagggacgggcgcagcaccagcgccgggatgcccagttccagcaggtggcggtcggccgccgccttgctggcgaggaaggccacgtccgggtgcgcaccggcgcccagcgcggaaatctgcaggaccttcgccccatgggctgcagcgaggtcgaagagtgttcgcgcgccgctgtcctggacgcgagccatgctcgcctcgtcgaggctcatggtgccggcggcattgatcagcaggtcgaccccggcgggccaggcgaagctgtccggcctttccgcaagccgctccaggtcgagcgccagccagcgtacgccggcaggcgcatcgaccggcgggcggcgcgcggtgaggagcagttcgtgtccggcggcgagcagcgccgggagcaggtgccgcccgacgaaacctcccgcgcctaccagcagaatacgcatgcgttcctacagaaccggcgaaggccggtga

SEQ ID NO: 11043 - DNA, 2472 bp, Pseudomonas aeruginosa
  unsure (1279): Identity of nucleotide at the above locations are unknown.
cagcccgtgtcggcgagccgccgcgggtcagccgaggaacagctggtaggccgggttggcggtctcgtcccagtacggatagccgatcgcctccagggtctgcgggatcaggtggcgctcgtcttccggcacctgcaacccggccaccacccggccgtcggccgcgccatggttgcggtagtggaacatcgagatgttccagcgcccgccgagcttggtgaggaagttgaacagcgcgccgggccgctcggggaattcgaagcggaacaccatctcgtcgctgactttcaccgcatggccgccgaccatgtggcgaatgtgcagcttggccagttcgttgtcggtcaggtcgaggaccgggaagcccttctcgcgcagataggccaccagcgcctcgcgcgggtcgttctccgggtgggtctgcacgccgacgaagatgtgcgcctcgctgccgctgtggtagcgatagttgaactcggtgatctggcgcttgccgaccgcctcgcagaaggccttgaagctgcccggccgctcgggaatggtcaccgcgatgatcgcttcgcggcgctcgcccagttcggcgcgttcggcgacatgccgcaggcgatcgaagttgacgttggcgccggagtcgatcgccaccagggtctgcccctcggcgcgctcgcgctcgacgtacttcttgatcccggccaccgccagcgcgccggccggctcggtgatcgagcgggtgtcgtcgtagatgtccttgatcgccgcacagatctcgtcggtgctgacggtgatcacttcgtcgacgtggtccttgcagatgtcgaaggtgtgctggccgatctgcgccaccgccacgccgtcggcgaacagcccgacctggcccagcaccacccgctcgccggcggccatggccgcctgcaggcagttcgactcgtccggctcgacgccgatcaccttgatctccggacgcaggtacttgacgtaggcggcgatgccggcgaccagtccgccaccgcccaccgggacgaagatcgcatcgaggcggccgggctgctggcggaggatctccatggccacggtgccctggccggcgatggtgtccggatcgtcgtagggatggacgaaggtgtagcccttctcgtcgaccagcttcagcgcgtgggccagagcctcggggaaggcgtcgccgtgcagcaccgccttggcgccgtgggcgcgcaccgcctggaccttgatctcgggggtggtcttgggcatcacgatgaccgccctgatcccctgccgnttggccgccagggccaggccctgggcgtgattgccggccgaggcggcgatcaccccgcgggccttctcctcctcggtgagctgcgcgaccttgttgtaggcgccgcggatcttgaaggaaaacaccggctgcaggtcctcgcgcttgagcaggacctggttgccgaggcgttcggacaactggcgggcgggttgcaggggcgtttccaccgcgacgtcgtaaacgcgcgaggtgaggatcttcttgacgtattgttcgagcatcggaggcggttcggcggacttcacggaagcccggagtctactccaggcccgccgggcggactaccggcgcgccgcaggaaaacaccgcgactgccggtcatccggggcaagaccggaggacgccaggccgctataattcgtcccttcgtatcgcagcggcacaggacgtgccggaaacccgccgggccgccccggccgcgcgcaccctccgcctgcgccgccgggacggccggccaggcaaccagacaggcacccgggatgaaccaggatcagctcaagcaggcagtggcacaggccgccgtcgaccacattcttccgcacctcgacagcaagagcatcgtcggcgtcggcacaggctccaccgccaacttcttcatcgatgccctggcccgccacaaggccgagttcgacggcgcagtggccagttcggaggccaccgccaagcgcctgaaggaacatggcatcccggtctacgagctgaacacggtcagcgagctggagttctacgtcgacggcgccgacgaaagcaacgagcgcctggagctgatcaagggcggcggtgccgcgctgacccgcgagaagatcgtcgccgcggtggccaagaccttcatttgcatcgccgatgccagcaagctggtacccatcctcggccagttcccgctgccggtggaggtcatcccgatggctcgcagccacgtcgcccgccaactggtgaagctcggcggcgatccggtctaccgcgaaggcgtgctgaccgacaacggcaatatcatcctcgacgtgcacaacctgcgcatcgacagcccggtggaactggaagagaagatcaacgccatcgtcggcgtggtcaccaacggcctgttcgccgcccgcccggccgacctgctgctgctcggcaccgccgacggcgtcaagaccctcaaggcctga

SEQ ID NO: 11044 - DNA, 195 bp, Pseudomonas aeruginosa
acgccgaatacccggcgggtaccggctgctgcagcgacggcgaaagcttcaacgggatggacatcccggtgttgttcatcgaggcgaccaactgggaactgggcgacctggacggctacgagcagaccgacaacccggcgattcccggcggctcaacctggcacgacccggccgaggacaacaaggaagtactga

SEQ ID NO: 11045 - DNA, 894 bp, Pseudomonas aeruginosa
acgtggccggacagccgggcttccgcgtgcgccagcagaaccgcgacggcgcacgctgcccgcacagtccgggggcgaaggtgcgggtgcggattcccgccgccgccatccgggtgctcgccgaatgagcaccgccggccgacctaccgcgcaacagtcggccgaacgccggcagctgcgtcggcgcctgctgctgagcagcccggcgatgctgatgctggtgctgttcctggtgatcccgctgggcatcatgttcgccgtgtcgatccagcaatccggcgactacggcggagtgaaatggggccagcacagcctggaggcctacctcaatttcctctgggaacgcgacctggacgacagcctggtgttcaacgccgactacctgggcatcttccagcgctcgttctggctctcgctgctgaccaccctcggctgcctggcgctcggcttccccaccgcgctgtacctggcgttgcagccggaacgccggcgcaacctgctgctgttcctggtcaccgtgccgttctggaccaacctgctggtgcgggtctacgcctggatcctgctgctgcgcaacggcgggctggtggacgccggcctgcaaggcatcggcctgaccgacaccgggctggggctgctctataccgacaacgcggtgatcatcggcctcctttatacctacctgccgttcatggtgctgccgatctacagcagcctggaaaagatggactggcgcctggtggaggcggcattcgacctcggcgccaaccgctggaaagcgctgcgccgggtgatcgtgccgctggcgatgccggggatagtcgccggctgcatcctggtattcatcccggccctgggcagctacatcattccggaattgctcggcggcggtaa

SEQ ID NO: 11046 - DNA, 945 bp, Pseudomonas aeruginosa
ggcgctgatgatcggcaacctgatccagctgcaattcggtaccgcgcacaactggccgttcggcgccgccctttcgttcgccctgctggccttcgtcctgctggcgatgctgatctacaacctgcgcttccgggccaacgccggcggaggccagccatgaacggccgcaatccactctggaccttcagcggcgtgcgccaggccgcctggctgttcttcgccttcctctacatcccgatcctggtgctggtagtgctcagcttcaacagcggccagtcggcgacgctctgggagagcttcagcctgaaatggtatgcggtggtggccaacgatccggaaatcctccgcgcggcgaagaactcgctgctcgtcgccaccctcgccaccctggcctcgaccgtcctggccaccctcgccgcgctgggcatgcgcggtcgcgccttccgcgggcagaccctgatgaacggcgttctcggcctgccgctgctggtgccggagatcgtcaccgcggtggcgaccctgatgttcttctccttcatcggcctgaagctgtcgttgttcaccatcctcatcgcccacatcgtgttctgcatccccttcgcctacctgccgatccgcgcccgcctggagggcctggacccgcgcctggcggaggccgccgccgacctctacgcctcgccgtggaaggccttctggaaaatcaccctgccgctgctgatgcccggcgtgctgtccggggcgatgctcgcgttcatcatctcgatggacgatttcgtcatcacctatttcgtcgccggcgccggcgcaaccaccctgccggtgtacatcttcagctccatccgcatgggcatatccccgaagatcaatgcgatttcctcgatcatcctcatgatttccatcgccttcgtcgccctgtcgtactacctcggccaacgccgccgctga

SEQ ID NO: 11047 - DNA, 711 bp, Pseudomonas aeruginosa
aggccgtcggcctcggcgaagtccgcgcaccgcgcgacttcggcctggaaccgatccgccgggtgcacagcgagggtttcgtgcgtttcctgcagaacgcctggcaggactggctggccaccggccgcagccacgacatgctgccgatcgcctggccgacccggcgcctgcggcagacggagccggacaacatcgacggtcgcctcggctactactccttcgacgcaggcgcgccgatcaccgccgggacctggcaggcgatcaccagttcggccaacgtcgccctcagcggccagtccgaactcgccaacggcgcgcgctcggtattttcgctctgtcgcccgccgggccaccacgccgcggccgactacatgggcggctattgcttcttcaacaatgccgccatcgccgcccaggccttcctcgaccggggcgccgggcgggtggcgatcctcgacgtcgactaccaccatggcaacggcacccaggacatcttctacgaccgcgccgatgtgctgttcacctcgatccacggcgatccgcgcttcgaatacccctatttcctcggctacgccgacgagaagggcaacggcgtcggcaccggctacaacttcaactacccactggcggccggcagcgactgggcgacctggagccaggcgctgcaggcggcgatccggcagatccaggcctatgcggcggacatcctga

SEQ ID NO: 11048 - DNA, 1509 bp, Pseudomonas aeruginosa
ctcatttaccgactcctgaacgggtggaaaggcatccgtggcgcccgccacagacgagaagggccggatgaccggccctctgcgttgcgacacctgctactcggcgaagatcttgccgggattcatgatcccgttggggtcgaacaccgccttcagtgccttcatataggcaatttcggtttccgagcgggtgtaggtcaagtagtcgcgcttggtcatgcccacgccatgctcggcggaaatcgagccgttgtacttctcgacggtctcgaacacccacttgttgacggtcgcgcacttggcgaagaactcgtccttgccgaggttttccggcttgaggatgttcaggtgcaggttgccgtcgccgatgtggccgaaccacaccacctcgaagtccgggtagttggcctcgacgatggcgtcgatgtccttgaggaaggcgggcacccgggaaaccgtgaccgagatgtcgttcttgtacggcgtccagtgggagatggtctcggagatgtactcgcgcagcttccacaggttctgcaactgctgctcgctctggctcatcaccccgtccagcacccagccctgctcgacgcagtgctcgaaggtggccagcgcctcgttggcgacttcctcggtggtcgcctcgaactccagcagggcgtagaacgggcagtcggtttcgaacgcccgcggtacgtcgccacgggccaggaccttggccagggccttgtcggagaagaactcgaaggcggtcaggtcgagcttgctctggaaggcatgcagcaccggcatgatcgagtcgaagtcgggcgtgccgaggaccatagcggtgaggttcttcggcgtgcgctccaggcgcatggtcgcctcgaccacgaagcccagggtgccttcggcgccgatgaacagctggcgcatatcgtagccggtggcgttcttgatcaggtccttgttcagctcgagcaggtcgcccttgccggtgacgaccttcatcccggccacccagttacgggtcatgccgtagcgaatgaccttgatcccgccggcattggtgccgatattgccgccgatctggctggaaccggaagaagcgaagtcaaccgggtagtacaggccgttttcctcggcgaaggtctgcagttgcttggtaaccacgcccggctggcagactacggtgcggtcgaaggcattgaagtcgagtatccggttcatgtagtcgaaggccaccacgacttcgccgttggccgccacggccgcggcggagagcccggtacgaccgcccgacgggaccagaccgaccttgtgctggttggcccagcggacgatcgcctggacctgctcgacgctcttggggaacacgatggccagcggcgcaggggcgaaatgcttggtccagtccttgccgtaggcgtccagggaggcggcgtcgtcgagcagcttgccaggctcgaccaggggcttgagcgattcgatcagggcttcgcgggtcattcgggaactctcaaatga

SEQ ID NO: 11049 - DNA, 1107 bp, Pseudomonas aeruginosa
cacccgggaaacaccactggacggaatttccccggcactcttcgtgccttccgaatcagggaaaggcatcgctggcacagcgatttccactgcgaagcccgtgttagagcggcgctcgcgcacataatccgggtcaatgcccgcaacccctggaaagaccgcatgcaacccagtaggttcgcgattgtccaggacgcgggcccggctaagctgaacgaacagcataggcccgaccgacgttcattcccacccgaggagtactacatgcgatttctgccccgcctgctgatgctggtatccctggccgctccgctggcccatgccgagctgctcgacgacgtccaccagcgcggcgccctgcgcatcgccctggagggcacctatccgccgttcaacttcaagcagggcggcaagctcaccggcttcgagaccgaactgggcgaactgctggccgccgaactggcggtcaagccggaattcgtcaccaccgaatggagcggcatcctcgccggcctgcagagcggcaagtacgacatcgcgctgaaccaggtctcggtgaacgagcagcggcgcaaggtcttcgacttcagcgagccatacaccatctccagcgcccagttgatcgtgcgcgccgacgaaacccgccagttcaagtcgctggaagacctcaagggcctcaagctcggcgtcgggccagggcaccaactacgccgacctggcgaagtcggtggccggcgtcaacgtgcgcacctatccgggcgccccggaatacctgcaggacctggccagcaaacgcatcgacgcggcgctcaacgaccgcctgctgatccccttcgccatccgcgaggccaagctgccggtcaagcccggcgcggcggtgggaccggtggcgaacatggcgattccctaccggaagaacaatccgaagttcggcgaggcgctgaatgcggcgctggagaagatcaaggccgacggccgcttcgccaagctctcggaaaagtggttcggcctggacgtcagccagccgccgaagtgagttcccgcccgaacgggggaagcggccgcgcccgagagacgcggccgtcgtgtttgtcgatggagtgttga

SEQ ID NO: 11050 - DNA, 693 bp, Pseudomonas aeruginosa
atgaattcgctgcagaaattgctcgaatggctcgccaacctggtcgagctgctcgggatggcctggcccttcctgctccagggcgcgatgtataccgtgctgttcgccgcggtatcgatggtcctgggcctgatcctcggcttcagcgtcgcggtggtccgggtgaccaaggtgccggtggtctcgcagatcgccgcggtctacgtcagcgccttccgcgggacgccactgctggtgcagatcttcgtcctgtactacgggctgccgagcgtaggcatcgagttcaccccggtcaccgcgggcatcctggcgctgaccctgaatgtcgcggcctatctctcggagtccatgcgcggggcgatcctcggcatcgacaagggacaatgggaagccgggctctcggtcggcctgacctggggccagaccctgtggaacatcatcaccccgcaggccctgcgcctggcggtgccgagcctgtcgaacagcctgatcagcctgatcaaggacacctcgctgatctccgtgatcaccgtgaccgaactgatgctggcgaccaaggaggtcatcgccgagaccttccagccgctgccgctctatctcgccgccgccgggatctactggctgctttcggcactcttcgagcgtgtgcagaaagccctggagaaccgcctgaccgcgccgctgcggcgctga

SEQ ID NO: 11051 - DNA, 744 bp, Pseudomonas aeruginosa
cgagggcgcggtatgcacctccagcaacagcttcatcgaaccgatcctcgaagcgctgctgcagggacgtccggtggatgccacccataccctcgccgtgggttgctactgcccctggaccccggaaaaaggctgacctggctcaacaccgggccttccggagggggcgccggaaggcgtagcggctacactgcccgggtcggcccacgaggggccgttgccgaaccaaggagtcgctgcatgtccctacgtcccaccctcgccctgctcgccctcgtcagcctgccactgatggccgcccagaacgaccctcagcccagcagcaaggaactgatgaaggagcaccaggcgcagatccagaacgacctggccgacgtcgactacaagcgcaagcgcatcgtcgaggccaacatgaacctcaccgaccaggaaggcgagaagttctggccgatctacaacacctaccgcaccgagtcggacaagctcagcaaggaaaccctcaagctcctgctcgactacgcccaggcctacaacagcggcaacgtcagcgacgaccaggcgagcaagctgatcgagcgtgtcgacgacctccaggaggaccgtctggaactgcgcgacaagtacgtcaagcgcatcgccgagaacgtctcgcccaagcgcgccatgcgcttcctgcagatcgagatccagctcgacgccatcgccaccctggagatcggccgtcaggtaccgctggtcgagtaa

SEQ ID NO: 11052 - DNA, 654 bp, Pseudomonas aeruginosa
ccaaagacttccagggtccgagcattcggtcaatgccgcgggccgacggcatccgcagaatgctcggcactacaacaaggagaaaggatcgatgaaacgcaccctgaccgtgatcgccgtggcggtcgccgccgcggctgccggcggcgcctggtacctccatgccaagcagccgctccgcaacggctcgctcgccgtggcccacctgcaggcgccggtcgacgtgcgctacgacgagcgcggggttccgcacctgtatgcgcagaaccagaccgacctctaccgcgccctcggctacgtgcacgcccaggaccgcctgttccagatggaaatgctgcggcgcctggcgcgcggcgagctggccgaagtgctcggacccaagctggtggataccgaccgtctgttccgcaccctgcgcatccgcgaccacgccgccgaatacagcgcccgccaggacaagcagtcgcagccctggaaagtgctggaggcctacctggacggggtcaaccagttccaggaaaacaacccggcgccgctcgaattcgatctgctgggcatacccaggcgtcccttcacccccgaagataccctgagcatcgccggctacatggcctacagcttcgccgccgccttccgcacccgagccggtgctga

SEQ ID NO: 11053 - DNA, 1827 bp, Pseudomonas aeruginosa
tctacatccgcgacgaactgggcagcgactacctgcgcatcttcgatctcgattggcatccgcaggggcgtgctgacgccatccggcgcactgggcgccggcgactggaaggacctcggcgccctcgcccgtctcagccagcaggccctggaggacgccggcctgccgcagttcgagggcagcaacgcctgggtcgtcgccggcagccgcaccgccagcggcaagcccctgctggccggcgacccgcatatccgcttcgccgcgccggcggtatggtacgaggcccagctgagcgcgcccggcttcgaactctatggccaccaccaggcgctcaaccccttcgcctcggtgggccacaaccgtgcgttcggctggagcctgacgatgttccagaacgacgacctcgacctgatcgccgagaaggtcaacccggacaaccccaaccaggtctggtaccagggcgaatgggtcgacctgcagagcgaggagcaggaaatcgcggtcaagggcgctgcgccggtgaagctcaccctgcgccgctcgccccacggtccgatcgtcaacgacgcgctcggcgtcagctccggcaggaccccgatcgccatgtggtgggctttcctcgagaccgagaacccggtgctcgacgccttctaccagctgaatcgcgccgataccctggccaaggcccgcgcggcggcctcgaagatccattcgccgggactcaacctggtctgggccaatgccgccggcgatatcggctggtgggcctcggcggccctgccgaagcggccggagggggtgaacccgagcttcatcctcgacggcagcaagggcgaggcggacaagtccggcttctatccgttcgccgacaacccacaggaggaaaacccggcgcgcggctacatcgtctccgccaacttccagccggtcccggccaatggccggccgattcccggctactacaacctggcggaccgcggccagtggctggatacccaactggccgaccgcggcaccaaatggaacctggacaacagccgcgcgctgcaactcggcaatcgcaccggctacgcgccgcgcctgctcgcacccttgctgccggtcctgcgcgaggtggtcgacgacgccgaaggcaagcgcctggtcgagcaactggcggcctggaagggcgactacccggtcgactcgaccgccgccacgctgttcaaccagttgctgttccagattgccgagggcgccttgcacgacgaactgggcgatgccttcttcgacagcctgatcgccacccgcgccatcgacagcgcgctgcctcggctggctgccgacgccgactcgccctggtgggacgaccgccgcacagaacgccgggaaacccgcgcggatatcgtcaggaccgcttggaacgcctccctcgcgcatctgcgcagcaccctcggcaacgacccgtccggctggctgtggggcaaggcgcataccctgacccacgagcacgccctgggccagcaggcgctgctcaagcgccttctcaacgtcggtccgttcgccgcccccggcacccacgaggtaccgaacaatctgtcggcgaagatcggcccggccccctgggcggtcacctacggtccatcgacccggcgcctggtggacttcgccgacccgacccacagcctcggcatcaacccggtcgggcagagcggcgtgcccttcgacggccactacgacgaccaggccgaggcctacatcgagggccactacctgccgcagcactacgaggaaaacgaggtgaaggcgaacagcaagggcgtgctggtgctggagccgaagcgctga

SEQ ID NO: 11054 - DNA, 1254 bp, Pseudomonas aeruginosa
aaaaggccacccgcaggtggccttttcttttcggcggagggctcaggccggggtcggcgagcctttctgccagtcggtcgcggtctcttccatcgcctgctggatcgcccggcgacgccgctcctcggcctggcgggtgaagtaccaggcgaagaaggtgaacagcgaaacgctcagcaggatcaggctggccaccgcgttgatctccggcttcacgcccaggcgtaccgccgagaacacttccatcggcaaggtggtcgagccgggtccggagacgaagctggccagtaccaggtcgtccagcgacagggcgaaggacatcatgccgcccgccgccagcgagggcgcgatcatcgggatggtgatcagcaggaacaccttccagggcttggcgcccaggtccatcgccgcttcctcgatcgacaggtcgagttcacgcaggcgcgccgacaccaccaccgccacgtaggacgagcagaagctggtgtgggcgatccagatggtcacgataccccgttcctgcggccagccgatcagttgcgccatggccacgaacaacagcagcagcgacaggccggtgatcacttccggcatcaccagcggcgcggtgaccatgccgccgaacagcgtacgaccgcggaagcgcgggatgcgggtgaggacgaaggccgccagggtgccgaggagcaccgaggagaacgccgtatagaaggcgatctccagggagcgtccgaccgagctgaccagttgggtgttgtccagcaggccgacgtaccacttcaccgaccagccgccccacaccgtcaccagcttggaggcgttgaacgaatagatcaccaggatcagcatcggcaggtagatgaagagcaggccgacgatcagcatgacgttggagaaattccagcgcttcataccttgccctccagttctttggcctggttcttgttgaacaggatgatcgggatgatcaggatcgccagcatcaccaccgccagggcggacgccaccggccagtcgcggttgttgaagaactcctgccagagcaccttgccgatcatcagggtctcggggccgccgagcagttccgggatgacgaactcgcccaccgccgggatgaacaccagcatgcagccggcgatgatgccgttcttcgacagcggcacggtgatcttccagaagctggtgaagttacgcgcgcccaggtcggaagcggcctccagcaggctcgggtcgtgcttcaccaggttggcgtag

SEQ ID NO: 11055 - DNA, 1749 bp, Pseudomonas aeruginosa
tcggaccagttgtacacgtgcagcaccttgttgtccgcagcctgcgccataccggccacagagcccgccaaggtcagggcgagcagggtcttaccgaaacgtttcatcatgcggggtagctccatttttgttgaagtatccgggcggtggcgcaaccgatcgcgtcaccacccggtgagcctggccaacgcactggcgcagtctggcaaaagtccgctcagggactcaagccaggacggcggcggcggtctgatcgaggcacttgcgcgccagggtgatcaactcatcgatctgcgacggatcgatcaccagcggcggcgagataatcatagtgtcgcccaccgcgcgcatgatcaaaccgttgcggaaacaatgttcccggcacagcatcccgacgcccttgtcggtgaaacgctcgcgggtcttcttgttcttgaccagctccagggcggcgaccatgccgaccccgcgcgcttcgcccaccaacgggtggtcggccagctcctgccagcgtttctgcaaatacggtgccgtttccgccttcaccttctcgatgatcttctcttcgcgcaggatgcggatgttctccagggccacggcggccgccaccgggtgaccggaataggtgaagccgtggtagaactcgccgccctggttgagcacttcgacgatctcgtcgcgcaccaccaccccgcccatggggatgtagccggaggtgaggcccttggcgatcggcatcaggtccggggcgttgccgtagtactggctgccgaaccactcgccggtacggccgaagccgcagatcacttcgtcggcgatgaacaggatgtcgtacttggcgaggatctcgcggatcttcggccagtaggtgtccggcgggacgatcacgccgccggcgccctggatcggctcggcgatgaaggcggcgacgttttcctcgcccacttcgagaatcttcttctccagctgctcggcggcccagacgccgaactcgtccggcgacatgtcgccgccctcgccgtaccagtagggctgggcgatgtggacgatgcccgggatggggaaatcaccctgctcatgcaacgccttcatgccgcccaggctgacgccggcgacggtggagccgtggtagccgttccagcggccgatcaccactttcttctgcggctggcccttggtcgcccaatagtggcggaccatacgcagcacggtgtcgttggcctcggagccggagccggtgaagaacacgtggttcatgccttccggagcgacgtcggcgatcgccttggccagctcgaccaccggcgggtgggcggtctggaagaacaggttgtagaacggcaactcgcgcatctgccgggtggcggcctggaccaactcctcgcggccgtagccgacgttgacgcaccagaggccggccatcgcatcgaggatcttgttgccctcgctgtcccagatatagacgccttcggccttggtgatgatccgcgcgcccttctcgttcaactgcttgtagtcggtgaacggcggcagatggtggtcgcggctcaacgcctgccactcacgggtcttggcgttggtgatttggctgttcatgtcacacctcttctattcaagactgtccgggagcggcggaccacgccggccgcccccggtcaggatcaaacggaaagcaggaggaattcccgctcccaggagctgattacccgcttgaaattctcgtgctccgcacgcttcaccgcgacgtag

SEQ ID NO: 11056 - DNA, 429 bp, Pseudomonas aeruginosa
gggttggcgtcggcgccggcgagacggttctcgacccggcggttctccgggctggagtccggcacgcgcaggccgacggtacggttctcttcgccccactcgacgttcaccggcgccgaggtatcgggcaggaagcggcggaacgagttcacgttgggcgcgaacagcggcagcacttccgggatgaacttctgcaggccgccgatatggtgcaggaacagctcgctcatggtgccgtcggcattggagaagatgttcttgccggtcttcacgtcgacgatgctctggtgcaggtgcatcgcgctgcccggctcgccggtcatcggcttggccatgaaggtcgcggcgacgttgtgcttgagcgcggcctcgcgcatggtgcgcttgaacaccaggatctggtcggccaggtcgagggcgtcgccatga

SEQ ID NO: 11057 - DNA, 669 bp, Pseudomonas aeruginosa
acggccggccgcagccgcctcgctcgccgatctccggcaagcgtccgcagtcggtgcaggtgtactccatcgacgacctcgacgaatacgtcgagtgcctccaggacatcatcgacggcgcccgcgcccagggcatcccggccgacgccatcgtcgccgaatccgcaccggcgcagttcgaggtcaacctcaaccacgtcaacgacgccctcaaggcctgcgaccacgcggtgctgctcaagcgcctggtcaagaacatcgcctacgaccacgagatggacaccaccttcatggccaagccctatccgggccaggccgggaacggactgcacgtgcatatctcgctgctcgacaagcatggcaacaacatcttcaccagcgaggatcccgagcagaacgccgcattgcgccatgcgatcggcggtgtgctcgagaccctgccggcctccatggccttcctctgcccgaacgtcaactcctaccgccgcttcggttcgcagttctacgtgccgaacgcgccgagctggggcctggacaaccgcaccgtggccctgcgcgtgcccaccggcagcccggacgcggtacgcctggaacaccgcgtggccggcgccgacgccaacccctacctgctactggcagcggtgctggcaggcgttcatcacgggctga

SEQ ID NO: 11058 - DNA, 741 bp, Pseudomonas aeruginosa
ccaacaaggtcgagccgggcgcgccgatcgaaggcaactcctacgagcagatggagccgagcctgccgaacaacctgcgcgacgccctgcgcgagctggacgaaagcgagatcatggcgaagtacatcgacccgaagtacatcgacatcttcgtcgcctgcaaggaaagcgagctggaggagttcgagcactcgatctccgacctcgagtacaactggtacctgcataccgtctgaggtagcggtatcggcgcgccggtcctgggccggcgccgtacgcagcgaaatccggggcggtttcgcagacactcaacgcgggggcgtctgtgtctgggaaaccgccccggtccttttctcggaaccgggaaatgtgcgccacggcacagcctgccgccacgcctcccgccagactcgatgctggcctgcatcaatgcctctgccgcctggctccggcaccatcgtccgctccgttccgtccagcgagaagattccatgccccgcctttccgccctgctgttcctcgccctcgcaccctggctggcccaggccgaggagaccctgcgcgtctacaactggaacgactacatcgccccacaggtgctcgagtccttccagaaggacaccggcatccgcgtcgagtaccacaccttcgccaccgccgaggaactggacaaggcgctgcgcagtggcgaggcgatcgacgtcgccgtcccctcccacgacaccctgccggccctgctga

SEQ ID NO: 11059 - DNA, 423 bp, Pseudomonas aeruginosa
ccgctcacgcccggagacccgccacatgcagcccacctcgcccacccgcaagccccgcgccagcagccaggcccggatcgccgcgatcctcgacgccgcccgcgacctgctcgccgacgaaggcatcggcggcctgtccatctacagcgtggccgaacgcgcggaaatgccaccatcgtcggtctaccacttcttccccagcgtgccggccctgctccaggggctgaccggcgaggtccacgccgccttccgcgcgtgcctcgaacagccggtggaacatgcaggcctgcgctgctggcgcgacctgtcgcggatcgtcgaggagcgcatgctggcggtctacgcccgcgacgcggcggcccgccaactgattctcgccagccacggcctggccgaagtcacccaggccgatcgccagcatga

SEQ ID NO: 11060 - DNA, 1032 bp, Pseudomonas aeruginosa
aactctcttaaaccgcttcacagtccgatttttatcggatataaatccgcccatccctcgatcgggcgcgacaccccgttcccgcccgcccgacccactaccggccgccgccaagcccggcagccatccgagccagcacacgaggtgctccatgacccgcaacgtcaccgtcgccgccacccagatggcctgctcctgggatcgtccggcgaacatcgcccgcgccgagaaactggtgcgccaggccgccgccaggggtgcgcagatcatcctgatccaggaactgttcgagaccccctacttctgccagaagccgaacccggactacctgcagctggccaccacggtcgaggagaacgccgccatcgcccacttccaggccctcgcccgggagttgcaggtggtattgccgatcagcttcttcgaacgcgccgggcgcgcccgcttcaacagcatcgcggtcatcgacgccgatggcggcaacctcggggtctaccgcaagagccacatcccggacggcccgggctaccacgagaagtactacttcaatccgggcgacaccggcttcaagatttggcagacccgcctacgcacggatcggcgtcggtatctgctgggaccagtggttccccgaatcggcgcgcagcatggccttggctcggcgcggaactcctgttctacccgaccgccatcggtagcgaaccgcacgacgccagcatcagctcgcgcgatcactggcagcgcgtgcagcaaggccatgccggagccaacctgatgccgctggtggcttccaaccgcatcggccgcgaggagcaggatggctacgacatcaccttctatggttcttcgttcatcgccgacccgttcggcgagaaagtcgaggagctgaaccgcaccgaggaaggtatccttgtccacaccttcgacctcgatgtgctggagcgcacccgcagcgcctggggcgtgttccgcgaccgccggccgaacctctacggtccgctgaagaccctggacggttcgctggagtcctga

SEQ ID NO: 11061 - DNA, 1269 bp, Pseudomonas aeruginosa
ggcctcgggaaacgatccgcgcggggacgccccgcgcattccgcgccggcgtccgccgcgcatagtaacgatttcaggagcagcgatgagcaacccgaccagcaccccacgcgccgacggcttccgcatgcccgccgaatgggaaccccacgagcagacctggatggtctggccggaacgcccggacaactggcgcaacggcggcaagccggcccaggcggccttcgccgcggtggccaaggccatcgcgcgcttcgagccggtcaccgtctgcgccagcgccgggcagtacgagaacgcgcgcgcacgcctcgacgacggcaacatccgcgtcgtggaaatcagcagcgacgatgcctgggtccgcgacaccggcccgaccttcgtcatcgacgacaagggcgatgtacgcggcgtcgactggggcttcaacgcctggggcggcttcgaaggcggcctgtacttcccctggcagcgcgacgaccaggtggcacgcaagatcctcgagatcgaacggcgcgcccgctaccgcaccgacgacttcgtcctcgagggcggctcgatccacgtcgacggcgaaggcacgctgatcaccaccgaggaatgcctgctcaaccacaaccgcaacccgcacctgagccaggcggagatcgagcggaccctgcgcgactaccttgcggtggagagcatcatctggctgccgaacggcctctacaacgacgagaccgacggccacgtcgacaacttctgctgctacgtgcgtcccggcgaggtgctgctggcctggaccgacgaccaggacgacccgaactacctgcgctgccaggccgccctccgcgtgctggaagaaagccgcgacgccaagggacgcaagctggtggtacacaagatgccgatccccggcccgctgtacgcgacccaggaagagtgcgacggcgtggatatcgtcgagggcagccagccgcgcgatccctccattcgcctggccggctcctacgtgaacttcctgatcgtcaacggcggcatcatcgcgccgagcttcgacgatcccaaggacgccgaggccagggcgatcctccagcgcgtgttccccgagcacgaggtggtgatggtcccggggcgcgagatcctcctcggcggcggcaacatccattgcatcacccagcagcaaccggcgccgcgcaaggcctgacgggcatcccgcagggcggatggccagccgcggcgctgttcgccctggccggcccggcacgccgagtggcgccatga

SEQ ID NO: 11062 - DNA, 1416 bp, Pseudomonas aeruginosa
atgaaaaaagcccgcgtcctccaggaggacgcgggctttttcctgtccggccggagcttacagcagcggcagggtgtagctgacgatcaggcggttctcgtcctggtcgcgctggttgttgctcgaaccggcagccggcaggccgctgcggaaggaggcgttcttccaggtgaagcccaggcccttgaaggtgccgtccgggatcacgtaggccagggagatatcgcgttcccactcgctctggtcgccgcgggcggtcttgatcttgtcgccgctcaggtaaatggtattgaaggtcaggcccggcacgccgacggtggcgaagtcgtagccgtagcggacctgccaggtgcgctcgccggcacgctggaacttgccgatctgcacgtcggtgatcaggtacgcggtagaaccttcgccatcgccacggttcaggaacgggaagtcactgtcgccgttgaggatctggtagccggcgccgatgctgtggccgctgacggtataggtgaagaggccgctgaaggcgcggttgtcgacttcgcccttggtcacgccgctgccgtagtagccgctgctgacgtagccgtcggcacggccggaacggctgccgttcttgccgtcggagctgctgtcgaaggcgcgcaggtcggtcttcaggacgcccgggccaatctgccagttgtggatcaggccgaggaagtgctgcttgtagaagtcgtccaggttgccgtagtagtactgcagggtcaggtccttgttgaccttgtagtcgccacccgcgtagtagaacttgttgctgtcgcgcgaactggcgctgctgccgttggcgccggcgatgctcaggctgcggttgtcggtggagttacggcccttggagtgctccagttggccggcaaccagggtgaagtccttgaggtcggtcgaggtgacctggccgccctcgaaggtgaccggcagcaggcggccgtcgttgtaggtgaccacgggcagcttcggctgcagggtgccgtagcggaactcggtgttggacaccttggccttggcggtcaggcccaggctggcgaagtcgtgcaccggctcgccgttgctttccagcgggaacacggtgcccggctggcggtccaggccgctcttgccggcacggccgccgccgtccaggcgcacgccgagcaggcccagcgcgtcgacgccgaagccgacggtgccctgggtgaagcccgactggtaattcaggatgaagccctggccccactcttcctgcttgctcggcgaggcggtgccattgcggttgtcggtattgatgtagaagttgcgcagggtcagcgatgccttgctgtcctcgatgaaaccggcggcgaccgcctgttgcgccagggcaccgagggtaccggcagtgatggccagggccagtcgtga

SEQ ID NO: 11063 - DNA, 1290 bp, Pseudomonas aeruginosa
gccaatctttccatcgggctccgccttcgcgtcctctcgggcttcctgcccttctcccggctgacgggccgaagggtgtcggcagaaaaccgcctattacagcttcctttctggcgagttaccgccacgtttcagaaatcgttatttcccgcgctttatagcgcacgggtaataaacagtaaaatatccgcaataaacctaaaaagaattaattattcatatttaatagctttaaggaatattgtaccgcagccgcgacctgccggtcgcctccccaaagaggtattccgtggcgccgtcgacaaaacggaaacgtttgcccagcggtcagcccacgacgatgcagtccttgccctggcgcttggccgagtacatcgcggcgtcggcccggctgtagagggcaccgagtccctcgtcatcggcctggaggaccgtcaggccctggctgacggtgatcccgaagctgtgctcgccctcctggaagcgcaggcgttgcacctcgcgctgcaggcgtgcgccgatctgtcgcgcggtctgctcgtcgcagccgggcagcagcacggcgaactcctcgccgccgatccgcccgaacaggtcgccacggcgcagcgcggcactgccgctctgggcgatacgctggaggacctggtcgccgacctggtggccgaagcggtcgttgatcttcttgaagtcatcgacgtccagcagcaggaacgccaacggtatcccctcgcggcgacactccttgaaggccgcctcggcactgtcgaagaaatagcgacggttgctgctctgggtcagcacgtcggtggtggccagccgttgcagctcgctctccatgtgcttcttgtcggtgatgtcctcggcgatgcccaccaccatcagcggcagtcccgcctcgccctggcggctgacgaagcacttgtcgttgagccagcggacctcgccgtcgccacgcacgatgcggtattcgcgttgttccacggcgccacgttcgagcacctgcagcaggctgctgtcggcgtagtcgaggtcgtccgggtagatgctgttgcgccattcctcgtagtccgccagcagcagcgccgcggaacggccgaagattttctcgtaggcgggactgacgtagaccattcgccggttctgccagtcgtaggcccagagcaccgagttgacgctggccagcaaggcgctgaagagttgctcgcgctccttcagccgggccacttcggcacggctgtgcagcaaggccagcgcggcctcctgcgggtcttcgggaatgccggttag

SEQ ID NO: 11064 - DNA, 534 bp, Pseudomonas aeruginosa
atgcaccatgcccagcggccgctcgcgacccagggcgcgaaagatcggcagggtctccaggtggtcgccaccgaccgacagcggcagggtaccggcggcatggacctggcgatagaagccttcgatgcggcgcaacgaatcgagcaggtcgatgggattcaccggcgcatcaccgaggtcgccgacccgcaccaggtcgtagggcgcgatgcggctgacgtgatgcaccttgcgcatcaggctggacaggttgcgcacttcgcgcgggccatggcgggcaccggcgcggttggtggtgccgccatcccagggcacgccgatcaggccgacctgcagcgccgccgggtcggtgaacgccggcaggcgcatgaaggtcgggatgccggcgaagcgtggaatatcggcggcgtcgaggggctgcggatggtcgttcgacatggggcgtctccgtgtggcgggaagaaagcgccgggcgccgcccggcgcggtgggttcattccggctgggctcgcaggctggcggcaggacgggtag

SEQ ID NO: 11065 - DNA, 267 bp, Pseudomonas aeruginosa
ttgcccactgaaaatcccatgagcccccgcctgagtgcccttcgcctgagcctggcttatctcgcaatcgccatcgcctgggcgtgcctgagggatcatttgttaccaaaccaggtccaggaccaggaccaactggtgttttggatgaccgccaacggctgttattcttgcccgcaaccggccggctcgtgtacctctacctggtacgccagttccgccgcaaggcccaggcctacgacgaactgcacggcagcgagcagcgcctga

SEQ ID NO: 11066 - DNA, 207 bp, Pseudomonas aeruginosa
ccgcccgggcccgcgcccatgtccaggtggaatcggccctgcgccatgcgctggatcacgacgaactgcgcgtccactaccagccggtgcacgacctggccagcgggcggatcgtcggcgtcgagtcgctggtgcgctggcagcatcccgagcgcggcctggtgccgccaggcgagttcgtcccggtggcggaggaatgcgggctga

SEQ ID NO: 11067 - DNA, 270 bp, Pseudomonas aeruginosa
gaatattgcccactgcttactatgcgcctcacgccgcctccacttcgtcgagcaacgcggcacctcgagccacaggagcagagacccatgagcgcaaccctcagaagcctggatggccaggacgaagccaccatcctgcgtgaaatccagagtgccctgcgcggcctgcgcttcggcgccgtcgagatcaccgtgcacaacggccaggtggtgcagatcgagcgcaaggaaaaattccgtctgcagcaaccggccgtcaagcaggcctga

SEQ ID NO: 11068 - DNA, 486 bp, Pseudomonas aeruginosa
ccaaggaaggcgtggaagtcatcacgccgaacccgaagacctccggcggcgcgcgctggaacttcctcgccgcctgggcctgggcgaagaagcagtacggcagcgacgagaaggccaaggactacgtgcaggcgctgtacaagcacgtaccggtactcgacactggcgcccgcggctcgaccatcaccttcgtcaacaaccagatcggcgacgtgctgctggcctgggagaacgaggcgttcctggcgaagaaggaacagggcggggaaaacttcgagatcgtcgtaccctccatctccatccttgccgaaccgccggtcgcggtggtcgacaaggtggtcgagaagaaaggcacccgcaaggtcgccgaggcgtacctgcaatacctgtacagcgaggaaggccagcgcatcgccgcgcagaacttataccggccgcgcaaccagaaggtcgccgccgagttcgccacgcagttcccgaaactga

SEQ ID NO: 11069 - DNA, 1644 bp, Pseudomonas aeruginosa
aggaccacgacagcctggccggcctggcccgcggcgagaccctctacttcaagccgaaggccttccagccggtggccaatctctgatcccgcggcgggttcagcccgccgtgcgctccgccaggccgcgcagtcccgcgcggcccttcgacgacacctgcaacgcccgcgagccgtcctgcggccgcaaccagccctggcgcagacaggcctccagcaacgccgcccccagcgcgccgccgaggtgcggcttgcgttcgctccagtcggggcaggcgcaggcgaactgccgacggcggcggcggacctccgacaggtcgattcccaacctggccagcccggcctcgccggtcgcgctcaggcgcagcgtcctgccctcctgctcgatccagccggcatccagcatccgtgcgaacacaccgaccgcgagttcgccggccaggtggtcgtagcaggtccgcgcctcgcgcaacgccgacggcgtgccgtggctcggcggcaggctgcgccgctgcggctgcagggccagggaggcgctggccagcgcttccaccgcctgtcccacttccggcccggccaggcgatagaagcgattgcgcccgcgcgcctccaggctcagcacgccgccctcgaccagccgtcccaggtggccgctggcggaggacggcgagacgcccgccagcagcgccagctcgctggccgggcgggcgctgccatccatcagtgcccagatcatctgcgcgcggccgggatcggcgagcagcgccgccagcgaactgaagccgggattgaattgcatgcttcacctccggatgaaacattgcctgtcgacgacgagagatactggccgccatcgcccgttcgcgccagcccgagacaaggaagaacccgcatgtccgtcgacctccacgccctgatcccactgatcgccctcaccttccttctcgcgggcttcgtcaagggcgtggtcggcctgggcctgccgacggtctcggtgggcctgctcggcctggccatgccgccgatgcaggcggcggcgctgctgatcgtaccgtcgatggtgaccaacctctggcagctcgcctgcggcccgcgcttcctcggcttgatgaagcgcctggccggcctgctgctcggggtgatcgtgggcaccctgctggtcggcgcatggctcggcggcgacgccccaaggcaggccaccggcgtgctcggcctggccctggcggcctacgcgctgctcggcctggccgcgatcccgctgcacctgccggcgcgccacgagccctgggccggcccgctggtcgggctggcgaccggcgcgctgaccgcggtcaccggggttttcgtgattcccgcggtgccctatctgggagccctaggattgcagcgcgacgaactggtccaggccctcggcctgtcgttcagcgcctcgaccctggccctggcggtcactctcggcgtgcacggcgacctgctcgaaccgcagatgctcggcgcctctctgctgaccctggtcccggcgctgggcgggatgctcctcggccagtggctgcgccagcggatcagcgcgacgctgttcaggcgctgcttcttcgtcggtctcctgctgctcggcgccgacctcgcctggcgcggtttccactga

SEQ ID NO: 11070 - DNA, 930 bp, Pseudomonas aeruginosa
cgccagggacgcattgcgcacccgccagggcgggcctgcggccttcgcgggacttccgacgaacggcacaagtcgctatcatccgccgccgcgcgccccccaccgggcgcgcggcaccgggcggaacacgcccgtccggcacggaacgccacctatcgcaaggagcacacgatgaagacccgtctttccctttccgccctggccctcgcctgcgccaccctggccggctgccagaacctgccccagggtgacctcatgcagcacggcatgatggcggtgaaggctgcaaccctgagcgacgccgaggtccgccaggtcgccgaccaggcctgcgccgagtccgaccagcaaaaccgcatcgccccggccaacagcaagtacggccagcgcctggacaagatcgccaaggccctgggcgaccagatcgacggcgtgccggtgaactacaaggtctacctcaccgaggaggtcaacgcctgggccatggccaacggctgcatccgcgtctacagcgggctgatggagctgatgagcgacaacgagatcgaaggcgtgctcggccacgagatgggccacgtcgccctcggccacacccgcaaggccgcccagaccgcctacgcggccgccgcggtgcgcggcgccgccggcgcctcgaagagcggcgcgctggccgccctgtccggctcccagctgggcgaactcaccgaatcgctggtcaacgcgcagttctcccagtcccaggaatccgacgccgacgatttctcctacgagctactgaagaagcgcggagtgaacacccagggcctggtcaccgccttcgagaagctggccaagctgggcggcggcgacagcagcatgttcgattcgcacccgggctcccaggcccgcgccgatcacatccgccagcgcatcgctgcggatcgcaagtaa

SEQ ID NO: 11071 - DNA, 546 bp, Pseudomonas aeruginosa
cgctcccaccccggtctcccgcgctcgcgggagaccgcctcacgccgcccgcttgtgctcgcgaatgcaggtcgggccggcgcgctcctcgacctcgcgctgcacgtcgccgcgcagccccagcagaaaggccagttccgccagcacgaagagcggaccgacgatcaacccgctgagatcgtcgacgaaggccggcttgcgcccttcgtagtaatgaccgacgaactggatgatccagccgaccacgaacaggccgacgccccagcccagccaggccgcggtagtccccgccgccaattgcgcagcgccccacaccgtcagcgccagcagcgccgtcatggccacgccgaagcgcaggtccaggcgcaggtagaacagcgccgcggcgagcgccagcagcagcgccggagacaggccgaaccccagcgccggccgcgccagcaacacggcgatggagaggacgatcatcggaatgccgatgaaatggctgaagatgttgcgccggtcgcggtggtaggcggcgtattgcgcaaggtgatcgactag

SEQ ID NO: 11072 - DNA, 696 bp, Pseudomonas aeruginosa
acgacaaacatgaacgagcgtaccgactaccgttcgcaactccaggccggccgctggttccagggtttgccggaggccttgcagacgcacctgctggcactcgcccaaccgcgccagttgccgccgggccagcgcctgttcgcccgcggcgacgcgccctgcggactgtactgcgtggtcgagggcgcgatccgtatcagcgcggtcagcgagaacggcaaggaggcgctgctgatcctggtggaagcgccgcactggttcggcgagatcgccctgttcgacggccaggcgcgcacccacgacgcctacgccgaaggccacacccagctactccaggtgccgcaggcggcgctgctcgaactgcttcgccgcgagccgcactactggcgcgacgtggccctgctgatgagccacaagctgcgcctggcattcatcgccctggaagagatggccctgctgccggccgcacaacgcctggcgcggcgcctgctgatgctcgccgagggctacgacaacagccgcagccggcaggtcctgcacctgccgcaggagcagttggcattgatgctgtcgctgtcgcggcagaccaccaaccagatcctcaaggacctcgaagcccagggcatcctccagctcagctacggcggcatcgagattctcgacctcgccggcctgcgcgcggccacccacggctga

SEQ ID NO: 11073 - DNA, 792 bp, Pseudomonas aeruginosa
cgacaacaacaggatctccccatgctccgtcccgcgcttcccgctgtcctctgtctttactgcctgctgctggtgctgccggcgcgcgccgccctcgacgaccagcaacgcgccctgcaacaactgcaggtccaggcctgtcgcgcggtgggcagcctgttgttgctgcgcggcgagggtttccaggaacagcacgcggcgcaactggagaaggacctcgccagcctcgaccgcgcgctcgccgccgcccccgagggggtgctcctgcggcaagacgaaaagacgctggtggcgcgcatccgtgaaggcgcggcctacggcccccgcgaagaggacctgccctggcgctacccgcagcaactgagccgcgccctgcgtgacttcctcaacctggtggaacgccaggtgccaccgcccccgccaggccagcccctgccgctatggcagttgccggtgcgggtcgagtacctgtccctgcaatacctggcgcgcgcctacctgggcgggctggagactgcccgcgagcagccccgggactatctcggccaggacgagagcgtgctggtcccgctgatcgaccggcgcatcgccctgctggtggcgcaaagcgccaacccggcgggactgaagaaactggaaaaccgctgggagtacctgagccaggccctgcgcgacctgaacagcaagagcagcgcgctggtcagcgcttccggcaggccctgggcgccgatcatcgtcgaccgccacgcgcgtgccctgagcgaaagcctgatgcgcttgagtgcggagtga

SEQ ID NO: 11074 - DNA, 1377 bp, Pseudomonas aeruginosa
ggccacgcgccgcacggggcggataacctcgcgactcgcaacgttgcgccagcgtccgccccgactccctggccagcgcattttttcgaatccgccctgcggattttgatttgccgccacgccctggcgcatgcgcaatggtgctcccgaaaggagatcgccatgccctctgccaacccacccggccgcaccctctggctgatggccgccatcgtcctggtcggcctcaacctgcggccctccatggccgccgtcggcccactgctgaacgccatgcgcggcgagatcgcgctcagcttcggcgccgtctcgctgctgaccgccctgccggtgatgaccctcggcctcggcatgttcttcggcctgggcatcgcccgccgcgtcggcgagtggcgttcggtggccctcgccctgctgctgatcggcgccgccagcgccatgcgcctgggcagccgaggcctgcccgacctgctcggcagcgccatgctcgccggtctcggcatcgccctgatccaggcgctgatgccggccctgatcaaggcccgtttcggcgcgcgcacgccgctctgcatggggctctacgtcaccgccatcatggctggcgcggcgctgtccgccagcgccgcgccgaccctggcggagcacgccggctggcggatcggcctcggtgcctgggcggcgctcgccgcgctcgcgctgctggcctggtggctgcaacccggcacccgcctgcgcctgcccgacgcgcagccgggcaggagcttcctgcgctatccgcggacctggctgctggtcctgttcttcggcctcggcacggcctgctacacctgcgtgctggcctggctcgcgccctattacctggagcagggctggagcgcccaggaatccgggctgctgctcggtttcctgacggccatggaggtgctctccgggttgctcgcgccggccatggccagccgctcgcgggatcgccgcccggtgctggtcgggctaacggcgctgatgctggccggcttcctcggcctcgcatgggcgccggccagcctgccgctgctctgggcgctgtgtctgggactgggcatcggcgggctgttccccatgggcttgatcgtctgcctcgaccacttcgacgcgccgcaacgcgccggtcaactggctgccctggtacaaggcgccggctacctgatcgccggggtctcgccatggatcgccgggctgctgcgcgacagcctcggcagcttcaccggagcctggctcgggctggccacggtggcggcgctgctactggggctgggcctgcgcttcgacccgcggcgctatgcggcactgttcgccgagcggcaggcgcgaggcgtcggcgccgaaagcttgcgctga

SEQ ID NO: 11075 - DNA, 1917 bp, Pseudomonas aeruginosa
ggaaagggacgggttctgatggcgctcccgacgccgtcaggacgccccgatgctgatcgccaacggcctgcgcaaggtcgacatgcaggacctgctggtcttcctccaggtccaccaacgacagaacctcgtcgaggtcgccgaacacctgaacctcagtccgtcgacggtcagctactgcctgaagaagctgcgccaggccttcgacgacgagctgttcatcgccacccgcggcggcatgcagccgacccacaagagtcgcgccatgctgccccacgtggaggaaatgctcgcccgcatcaacgcctgtcacgccgcccagggcagcttcgacccgcgtggcgagccgcggacctttaccctctgcgcgccggaatacgtcgagctgctgatccttccggcactcctgcgacggctcgccgccaacggcccgaggatcggcctggacatccgccgcctgggtcccgaactgcccaccgaagcattgctcgacggccaggtcgacctggtcttcgacttcggtcccgagtaccaccgaccggcaccggagctacaggcgctcgccctgttcagcgacgagctgctctgcgtacaggatcgtgcccagccgcgccacgagcgcctggaactggacgagttctgccggcgccgcttcgtcttcccgaccccgctcgacgccagcaacgccaacctggtggacacgtggctgcgacgccagggccgcagccgcgaggtcgccgcgcgcgccaacaggtacgtcgccgccctgcaactgctgtcgggcagcgacttcgtgctgatgctgccacggcgtatccatgcactgctcgacgatggccgccatcacgcctgcctcgcaccgcccgggctgccgccgttcgccctgcacctgtcatggagccgcgccgccgaccaggacccggcgaacctctggctgcgcgagcaggtactgatcgtctgcgccgagctgggtttgctctagcctgcgtcatcctgcacttcgaggctcgccgccagggagcgccagagcacttcggcgaatacctgctggatgccgccggccaggtagtcgaacatctgctgcgcttcccgccactggctgcacaccagccagagatccggctcgagggcgtccctgcgcacctggtactccaggcaacccggcgcctccagccccggttcgaccagttgttgcaggcgcaggccaagccgttccgactgaccgttgcgcgcgcgaatacggatgacctggctggcgctcatgacggacgctcctccgggcgaacgagcgacgcctcagtgggcgccgcgctccagtggcttgaggatcgggtcgccctccttgagcaactcccagaccagcaacttggccggcttcatcggatcgggattgcgtgccagcaggtgcggcacgttcgccggctcgtaccagctctggcccaccgtgtaggtctccaccgggccgccttccagttgcgtctgcacggtgccttcgagcacgtagacgaacaccgagccgggatgcacatggggcgcggagacctggccgggcttgaacgacaccgtcagcatcaacccacgatggccgggaatctcggccagggcctggtcgtgcagggtttccaccttctccgcaacatgggcgctggccagcgtcggcagcgcggcgagcagcaggcaggcgatcgatcgattggccttcatcgccgtccacctcattccgcttgcatgcccatgccgacgccgaagcggttccaggcgttgatggccgagaccgccagggtcagttcggcgatctccttgtcgtcgaagtgctcgcgcagttcgtcgagcaggccgtgcggcaacgccccctggctgaggcgggcgagttgctcggtccaggccagggcagcgcgctcgcgcggggtgaagtag

SEQ ID NO: 11076 - DNA, 2091 bp, Pseudomonas aeruginosa
aggcgggaaggaagctccccaaggcagcatgcgatgatcgactgcctcgggacttgcaggcccgccagggctcggagccgcttcgcgatcggcgaccgcgtctcccggttcgtccggtgccaccaccggcaacgtcgacaccggacggcgcagctcttgcctgccgtccggcccctccggatgcgttcctcgccgggctcagataccgcccaggcagaggtacttgatctcgaggtagtcctcgatcccgtacttggaaccttcgcggcccaggcccgaggccttgatgccgccgaacggcgccacttcgttggagatcaggccggtgttgatgccgaccatgccgtactccagttgctcggcgacgcggaacacgcgggccaggtcgcgggcgtagaagtaggacgccaggccgaactcggtgtcgttggacatggcgatgacctcggcctcgtccttgaagcggaacaccggcgccagcgggccgaaggtctcgtccttggacaccagggcgttcttcggcacgtcgaccaggatggtcggctcgaagaaggtgccgccgagggcgtgcggcttgccgccggaaaccaccttggcgcccttggagaccgcgtcggcgatgtgttcctcgaccttggccacggccttggcgtcgatcagcggaccggtggtcacgccggcttccaggccgttgccgatgttcagcttggccacggcggccttcagcttgtcgacgaaggcgtcgtacacgccgtcctgcacgtacaggcggttggcgcagacgcaggtctggccgttattgcggtacttggaaatcagcgcgccctcgacggcggcgtccagatcggcgtcgtcgaacacgatgaacggcgcgttgccgcccagctccagggacaccttcttgatgtcctgggcgcactcggccatcagttggcggccgatttcggtggaaccggtgaaggtcagcttgcgcacgatcgggttgctggtcagctcgccgccgacttcgccggcgctaccggtgaccacgctgaacacgcccttcggaataccggcgcgctctgccagttcggccagggccagcgcggaatacggggtttgcgaagcaggcttgagcaccatggtgcagccggcggccagggccgggcccgccttgcgggtgatcatcgccgaggggaagttccacggcgtgatggccgcggtcacgccgatcggctgcttgatcacgatgatgcgcttgtccggctggtggccgggaatggtgtcgccgtagatgcgcttggcttcttcgccgaaccattcgaggaaggaggcggcgtaggcgatctcgcccttggcctcggccagcggcttgccctgctcgatggtcatcaggcgggccaggtcgtcctggttctcgatcatcaggtcgaaccagcggcgcagcttgttggcgcgctccttggcggtcagcgcacgccaggccggcagggccttgtcggcagcctcgatggcgcggcgggtctcggcggcgcccatcttcggcacgctgccgatgatctcgccggtggccgggttgttcaccttgatggtctggccgttgtcggcatccacccaggcgccatcgacgtaggcttgttgacggaacagcttggcatctttgagttgcatgacctgtctccttcgaggaatgccgtgagcagcgggtctacctcgactaccccgcgtgcctggttgtctggttcggttgtaaccggaaagtgttgcctgctggttattcgaaagggccagcgccccggtgttccatttcctgcgccctgtgccagcggcgtcgccgttaccggccggccaccgtgcgcaacgggcggacgcggacgaacgcgaccgccggcaggcgtcggggaggatacgaaagactcgtgcgggaaagggattgcggacgaaacgccacgccggcaccacggcggcccggcagcgcgaaaggccggacgagcgacgggcaggtcagaaagaggtcattccaggggcacgcggccggctgaactgatgccaattccccggtctcctgttgttgtggctttgggggcgtttgaaatctcaaacgaatcctag

SEQ ID NO: 11077 - DNA, 2601 bp, Pseudomonas aeruginosa
gcaagagtaacgtggggctcgcttctccaacggatgggggaggaaccgcccgccaggaacaaggaacgatccatgcgtcaaagggacctgaaattcaccttcgtcgtcggcgaagggaaactcgcgttcgatgtcgtcgagttcgaactggaagaagcgctctgcgagcctttccgcctgaacctgaagctggccagcgacaagaacgccatcgatttcaagcaggtactcgaccagccgggcaccttcaccctctggcaggacggccgtccggcccgctacgtccatggcatcgtcagccacttcacccaaggcagctcgggttttcgccggacccgctacgaactgctgctggaaccgcagttggcgcgcctggagctgtgctgcaactggcggatattccaggagaagagtgttccggagattctccaggcgctgctcaaggagcaccgggtgctcgactacgaacagcgtatctaccacgagcacctgccgcgcgaatactgcgtgcaggccggcgacagcgatcactacctgcacgaccggctggccttcgaggaaggcctggtctactacttccgcttcgacgaacaccgccacaccctggtctgcagcgaccggctctacgtccaggagcgtatcgccggcggcccggtgctgttcagcgcccagccggagggcgacaacccgcagccggtgcttcattctttccgctacagcgaaaatgttcgtacggctcgacagacccagcgggactacagcttcaagcgcccgacctacgaccaggagcatcatctcgctggcgaggcgctcgagcatcaggactcgtcctacgagcgctacgactaccccggtcgctacaagcggagcggcgccggccggcctttcagcgaaagccgcctcagagggcaccggcgcgatgcgcgggaggcatcggtcagcggcgacgacccgcggctgatcccgggccacgcctttgccttggaaggtcatccgcgtgccgacttcaacgcctggtggcggccggtgcgggtggtccatcgcggcacccagtatgccggccaggaggaagagtccgccgacgcccctctgggggtgagctacgacctgcgcgccgaactggtacccgaggacgtcgaatggcgtcccgcaccgctgcctcggccgcgtatcgatggtccgcagatcgcgacggtagtcggcccggcaggggaagagatccattgcgacgagtggggacgggtgaaagtccagttcccctgggatcgcgagggacgtcacgatgaattcagtacctgctggatacgggtcgcgcagaactgggcaggtgccgactgggggcacatggcgatcccgcggattggccaggaggtgatcgtcgattacctggacggcgactgcgaccagccgatcgtcaccgggcgcacctaccgggcgaccaaccgaccgccctacgcgctgcccgaccacaagatcctcagcaccatcaagagcaaggagtacaagggcagtcgggccaacgagctgcgcatcgacgacaccacggcgcagatcagtgcggcgctgatgagcgaccacggtgccagcgcgctgcacctgggctacctgacccatcctcggcccgaaggcggcaagccgcgcggcgagggcttcgaactgcgcaccgacgaacatggcgcggtgcgtgcggccaaggggctgctgctgagcaccgaggagcagctcagggccggcgccggccatctcgaccgaggcgtcgtggtgcaggtgctggaggccgcgctggagctggcccgcgagctgggcgactacgccggggagcaccagggcgtggggcacgacgcggcgccgcagcaaaccctccaggaagccgtgcgcgacctcggccacggtgccaacgacgagtccggcaagagcaacggaggcaagccggcgatcgccttgagcggtccggcagggatcgccgcggcgacgccggcgagcctgaccctggccgccggcgagcacgtcgacagcgtggcccggcagaaccagcaggtgaccgccgggcagaaggtggtgatcaacgccggcagcgacatcggcctgttcgcccaaggcggcgagctgcgccagatcacccaccaggggccgatgctgctgcaggcgcagaagaacgacatccgcctggaggccgagcagagcgtggaggtcagcgccagccagcagcacgtgctggtcaccgcgaaggagcacatcaccctgatgtgcggcggcgcctacctgaccctcaagggcggcaacatcgagctgggcatgcccggcaacttcgtggtcaaggcggcgaagcacagtcatgtcggtcccgctcatgcatcgaccagcttcaacgcctgggattcgacaccgttcgatgaccggtatgtcctgcgcgacgaagccacgctggagccgttacccaatatcgccgttgaagtgatacgaggcgatggtggtgtggtgaaactgatgaccgacagccagggccgtttacccaagcaacaacacctggccatggacccggtgcagatacgcatcctgggcaagggcagtcacaacagcgacacggagtccaacacatga

SEQ ID NO: 11078 - DNA, 324 bp, Pseudomonas aeruginosa
cgcggtattcgacccgcggcggcagctccgcatacacctcgcctggacgctatcggcggagttgctcgagcgcggtatccgggtcaacgccctgaacccggggccgacccggacgccagcgctggacaaagccgctaccgatctcgaggccacccaggcgctgagggagaagattggccgggacgcctgggggagccgctggagatcgccagtgccgcgctattcctggcctcgaacgagccccgctgcaggtatggcacggagatcctggtggatggcggcgtacgccacctgaagaagggagcgaaggcccggtcctggtga

SEQ ID NO: 11079 - DNA, 1632 bp, Pseudomonas aeruginosa
cgtcgaggccgaggcgatcaaggcccgcctggaagccaacggcctggagcaggtgctgttcaacctgccggccggcgattgggccaagggcgagcgcggcatcgcctgccacccggatcgggtccaggagttccgcgagggggtcgacaaggccatcgcctacgccagggtgctgggcaaccgccaggtgaactgcctcgccgggatccggccgcaggggcacgactgcgccagcgtcgagaagaccttcgtcgacaacctgcgctacgccgccgacaagctggaagccgcaggcatccgcctggtcatggagatgatcaacaccctcgacatccccggcttctacctgcagaacacccgccaggccctggagatccgcgacaaggtcggcagcgccaacctgttcctgcaatacgacatctatcacatgcagatcatggaaggcgacctggcccgcaccctggaaaaccagttggcggcgatcaaccacgtgcaactcgccgacaaccccggccgccacgaaccgggcaccggcgagatcaactaccgcttcctcttcgagcacctggaccgcatcggctaccagggctggatcggctgcgagtacaagccggccaccaccaccgaagccggcctcggctggatgaagacgcacaacgtcgtctgatccgcacccacgaacaagacgctcccgcctccctgcgcggagccactcgacagacagaaccaggagacactctcatggccaagatcggattcatcggcaccggaatcatgggcaagcccatggcgcagaacctgcagaaggccggccacagcctgttcctttccacccaccacgacgccgctccggccgacctgctggaggccggcgccattgccctggccaacccgaaggaagtggcccaggaagccgagttcatcatcgtcatggtgccggacaccccgcaggtcgaggatgtgctgttccgcaaggacggtatcgccgagggcgtcggcccgaacaaggtggtgatcgacatgagttcgatctcccccaccgccaccaagggcttcgccgagaagatcaaggctaccggcgcgcagtatctggacgccccggtctccggcggcgaggtcggcgccaaggcggcgaccctgagcatcatggtcggcggctgcccgaacagcttcgaacgcgccctgccgctgttccaggcgatgggcaagaacatcacccgcgtcggcggcaacggcgacggccagaccgccaaggtggccaaccagatcatcgtcgcgctgaacatccaggcggtcgccgaggccctgctgttcgccgcccgcaacggcgccgatccggccaaggtgcgcgaggcgctgatgggtggcttcgcctcctcgcggatcctcgaggtacacggcgaacgcatggtcaagggcaccttcgacccgggcttccgcatcagcctgcaccagaaggacctaaacctggccctggccggcgcccgcgagctgaacctgaacctacccaacaccgccaacgcccagcaggtgttcagcacctgcgcggccatcggcggcagtaactgggaccactcggcgctgatcaagggcctggagcacatggccaacttctcgatccgcgacgagtga

SEQ ID NO: 11080 - DNA, 1470 bp, Pseudomonas aeruginosa
acgacttccgcgccattctcatcctcgagtcctgacatgacagccgacaagaaagccaagatccttgccaccctcggcccggccacccgcagccgcgacgatatccgtgccctggtggaggccggcgccaacctgttccgcctgaacttcagccacggcgactacgccgatcacgcgcagcgcttcgcctgggtgcgcgaggtggaagcggagctgaactacccgatcggcgtgctcatggacctgcagggtccgaagctgcgggtcggccgcttcgccgccggtgccgtgcaattgcagcgtgggcagaccttcactctcgacctcagcgacgcccccggcgacgagcggcgggtcaacctgccgcatccggagatcatccatgccctggaaccgggcatgagcctgctgctggacgacggcaagatccgcctggaagtggtcaactgccacagcgacgccatcgagacccgcgtggcggtgggtggcgagctgtccgatcgcaagggcgtcaacgtgccggaagcggtcctgcaactcagcccgctgaccgacaaggaccgccgcgacctggccttcggcctggaactgggggtcgactgggtggcgctgtccttcgtgcaacgcccggaggacatcgacgaggcccgtgggctgatcggcgacaaggccttcctcatggccaagatcgagaagcccagcgcggtgagcgccatcgaggcgatcgccgagcgcgccgacgcgatcatggtggcgcgcggcgacctcggcgtagaggtgccggcggagagcgtgccaggcatccagaaacgcatcgtccaggtctgccgccagctcggcaagccggtggtggtggccacccagatgctcgagtcgatgcgcttctcccccgccccgacccgcgccgaggtgaccgacgtagccaccgcggtgggcgccggcgccgacgcggtgatgctctcggcggaaaccgcttccggacaataccctcgcgaggcggtagagatgatggcgaagatcgtccgccaggtggaggccgagccggactaccacgtccagctcgaggtcaaccgtccgcagcccgacgctaccgtctccgatgcgatcagctgcgcgatccgccgggtcagccggatcctcccggtggcggtgctggtgaactacaccgagtcgggcaactcgaccctgcgcgccgcccgcgagcggcccaaggcgccgatcctcagcctgaccccgaacctgcgcaccgcgcggcgactgaccgtagcctggggcgtgtattcggtggtcaacgagcaactggcgcacgtcgacgagatctgctcgaccgccctcgacatcgccctggcccagcgcatggcgcgccgcggcgacaccgtggtggtcaccgccggcgtgccgttcggttgccccggctcgaccaacatgctgcgcatcgagaccgtggcgccgccgctgggagatctctga

SEQ ID NO: 11081 - DNA, 984 bp, Pseudomonas aeruginosa
ccgcccccgcccctcgcgcaggcctggcatctccgtgcctgccgagcggcccttgccgcactgaccgccatgcccctgcaatctctcctcaatgcatcccgaatcctcctgcgcggcatcagccaggtgttcctccagggcgacccacgcctgggcctggcctgtctgctggcgatcgccgtcggcgcgccgccgctgctcgccggcgccctccttggcggcgccctcggcccgctgctggcgcgcctgttgcactgcgccgacagcgacatcgaggccgggctgtacggctacaacgccgtgctgatcggcatgctgctggcattccgcttcgcctggtcgccggggctggtgtcactggtagcgctcggctgcctggccagcgtggcgttgcagcgcctgttcctgcatgggctgcgccgacgccgctggcttccgccctataccctgggcttcgtcctcaacggctggtggctggtgcccctcggcgcctggctaggcctggccccggcgacccatggcggctgcttcagctgcgcctggagcggcacggcggagctggcggcgctagcgcaggggatcggcgagatcatcttcctcggtgaaccgctggcagggctgctggtctggctcggcctgctgctggtctcgcgtccctccgccgcctgggccctcgccggcgccgcggccagcctgccgctggcctggctgctgggctacgactgggcgagcgcgctcgccgggttctacggcctgaacgccgcccttgccgggctggccctggccttgcgctaccgcagcgcctggccgccactgctcggcatgggcctggcggtgacgctgcaaccgctgttcggcctgctcggcctgccggcgctgaccgcaccgttcatcctcgcctgcctgctttgcatcggcggcgagcgcctgtacctgcgcctggccggcagcctcggcgcgcgcctcggccggcgacgctcctga

SEQ ID NO: 11082 - DNA, 819 bp, Pseudomonas aeruginosa
tgctcaccggctactcgatcatcgcggtgcccaccgggatcttcaccgccgaactcgccaccgcgatgcgccaggacccggccaacctgttgcagcgggattgcccggtgtgccgcaaggcgacccacgaagtgcaggcggcattctgctgccgctgcggcaacccgttgttccctcgcgaggaaggcagccatgggaagtcttgaccggcagcgctgggacgccctctggcagcgactcggcggcaacccgccggcggatgccttcgacgcgctgctggcggcctatggcggggccgaccggcactaccacagcgatcgccacatcctcgcctgcctggagcacttcgaccgctggcgccaactggcgctgcggccggacctggtggagctggggtggtggacccacgacctggtctacgacacccagcgccaggacaacgaggccgccagcgccgccagcaccgagcactggctcgaccatgccgggctggccgcgctgcggccggccctgcgcgaactgatcatggccacctgtcaccaggcgccgccgggagacgccgacgcagccctggtggtggatatcgacctcgccatcctccccgcgccggcgccggtctacgcgcgctacgaggcggacgtccgcgccgaatacgcctgggtgccggaaccgctgttccgcgccgggcgcggcaagttgctgcgccagttgctggagcaaccggcgctgtaccactgcgaaccgctgcggcaacgctgggaggccgccgcccgcgccaacctgcgcggtgccctggagcgcctggaacagccggcctga

SEQ ID NO: 11083 - DNA, 1779 bp, Pseudomonas aeruginosa
gccgcacgggaaaatttcttcgcgccgcttaacccgtctttcgccgcgcttgcgtctcaggcagcaggaagggaccgcacgcacgggttcctcgcccctccatccgcccaaggaagagatatcgtgaatcgactcgccgcctctccgctcctgttcgccggcctgttcgccagcgctccgttgctggccgcgccacaagcggtcgacagccgcatcagcgcggtcaccgtctacgccgaccgtgccgtggtcacccgcaccgcccgcctgcaattgcccaagggccagcatgagatcgccctggagcaactgcccttccagctcgacgacaccagcctgcgcgcgtccctcggcgccagcgccgccgccaccctgctcgacgtcagcagcgccgcgcaacgggtcgagcgcccggacgacaaccgtgtgcagcagctcgaccagcaactgcgcgagatagaccggcaactgcgggaaatccatgaccgcggcagcgtgctcgaagcgcagaagaagttcctcgccgacatccagagcggcagcacccagcccggcaaggatcgccccatgcccggcatcgacgagctgaaaagcctgctgcaactgaccgaaggcaacctcgaacgcctgctcgccgagcagcgccagctggacgaccgcgccgccgaactggaacagcgcaagcagcagttgcaggagcagcgcggcaccctcaacggcgacggcaagcgcttcaagcgcgcggtcctgcgggtcgccctggagcaaccggcacaggtcgaggtgaagctcgactacaccctgcgcgacgcctcctggcagccgacctacgacgcacgcctgcgcgacggcgcgaataccatcgaactgacctaccagggcctggtccggcagagcagcggcgaagactggaccgacgtcgacctgaccctctccaccgcccgtccggccctgggcggcaacgtaccgcggctgaatccctggatcgtcgacatcgacgcgcccaacgcctactacggtgccgagatggccatgcaggacgttccggcgcccatgccgcaagccgcgcccatcgccaggacctcggcgaagatggccatgccggccccggcgccgaagctggccgaggcgcggctcgccaccgcggaggtcagcagcggcgccgccagcgcctctttccacatccccgtgccggcgaccctgaacagcgacggcagcgcgcagaaggtcaccatcgcccgcctggaaatgccggccaagctgcgctatctggcggccccggccctgcgcgaaaccgcctacctggaggcggagacccgcaacgacagcgactacccgctgctccccggcaccctgaatacctttctcggcaacagcttcgtcgccagcggccatctgcgcggggtgatgcccggcgagagcttcgaactggcactgggcgccgacgagggcatcggcatcgaacgcaagctggtcaagcgctataccgacagcagcggcctgatcggcaaccgcacgcgggtcaactacgaattccgcatcgacgtgcgcaacaaccacaagaacgccgaacgcgtgcagttcgaggaccagttgccggtctcgcgcaacgagcagatccaggtcaccttgctggaacccaaggcgcaggaagtcaagcgcgaggacgacggcaagctgaagtgggactggaccctgcaacccggcgagaaacgcagcgccaccctgaagttcagcgtggagtatcccaaggacctggcggtcagcggcctcgactag

SEQ ID NO: 11084 - DNA, 423 bp, Pseudomonas aeruginosa
agtacctgtggtcggacgaaggccagaccatcgccgccaacaactacctgcgcccgcgcaacccggagatcctcgccaagttcgccgaccgcttcccgaaagtcgacttcttctcggtggagaagacctttggcgactggcgcagcgtgcagaagacccacttcatcgacggcggcgtattcgaccagatctacagccccaactgatccctcgccgctcgacgaaaaagccggaagcgctcgcgcttccggctttttcattcggcttgcagttcagccactgccgcctcagcgaaactcgtgctccacctcggaccagaggctcacccgctgtccgccggcctcgaagaactccatctcgcggcggatgccggcgctgtctcgccagcccggcaggtcgaggacgatcagctcttccaggtga

SEQ ID NO: 11085 - DNA, 1434 bp, Pseudomonas aeruginosa
taccaaaagaaacaggcagaaacgatgactgagccgcttgcgacaaagaccgcgatcttcgacgttgcagtgatcggcgctggcgtggtgggttgcgccatggcccgccgcttcgccctggaaggtgcgcgggtggtcctgctggaaaaaagcaccgacatcctctccggtgccagcaagggcaacagcgcgatcctccataccggtttcgacgcgccgcccggcagcatcgaactggcctgcatgcaggagggctatcgcgaataccgcgacatccatgcgcgcctcaacctgccgctgctggaaaccggcgccctggtggccgcatggagcgacgaggatctggcgcgcctgccggctatcgtcgagcaggcccacggcaacggtgtcgatgacgtccgccaggtcggtcgcgacgaggtcctggcgctggagccgcagttggccggcaacgtgctcggcgcggtgcgggtccccggggaacatctggtcgacccttggtccgcgccgctcgcctatctgcaacaggcgctggcccatggcgccgaggcctgtttcgacgtcgaggtgctggacggcgccttcgacggcggcgaatggctgttgcatacccgccgcggcgatctgcgcgcgcgccaggtaatcaactgcgccggactcttcggtgaccaactggaacagcgcctgctcggcgcggcgagcttcgccatccatccgcgcaagggccagttcgtggtcttcgacaaggccgccgcggcgctgctgcggcacatcctgctaccggtacccaacgagcggaccaagggggtggtattcacccgtactgtcttcggcaacctgttcgccggccccaccgccgaggaacaggacgaccgcgaacaggcacgggtcgacagcgacaccctgcagcgactgatcgacgccgccgtcgagcggatccccggcctgcgcggcatgccggtcaccgccacctacgcaggattgcgaccggccagcgaaaagaaggaataccgcatccgccaggtcgacggacgcaactggatcagtgtcggcggcatccgttccaccggtctcaccgcggcgctgggcatcgcacgccacgtctatcgtctctaccagggcgagcgcttccacgaagcggttcgcgagccgctctggccacaggtaccgaacctcgccgaacacctgccgcgcgactggcagcgtcccggctacgacgagatcgtctgccactgcgagatggtcacccgccgggaaatcctcgccgccctggaaggcccgctgccagccggcgacttcggcggcctgaagcgtcgcactcgcgcctgcatgggacgttgccagggtttctactgcaacgcgcgggtcgccgagctgagcgccggccgcctcgcccagcccttcgccaccgggagttgccatgagcatcactga

SEQ ID NO: 11086 - DNA, 1950 bp, Pseudomonas aeruginosa
cggcatcctcctcagcggacgcttcgttcccgaatcgagcctggtccgcctcagccacctggaactggacccggccagcggcggcccgcgcatcgatcagttcggccgctgctccgaccccgcctatttcgccgccggcaacctgctccggccgatcgagaccgccggctggtcgttccgcgagggacgaaggatcgccggcctgctggccgccgacctgcgggccgaactgccgagtgccgcacctggcatagccatcgattgcagtggtccgctcaagctgtgcgtgccgcagcggctgctggccgacccgacacccggcctggcgcatctgcagctacgcgtaagcgaggccgccagcggccgcctgcggatcctggccgatggtcgcccggtgtgggagcgtgccctgtcctgcctgccggagcgccgcctgctggtgccgctggccgccctgcgcctgccgccggacacccggcgcctggaagtcgccttcctcacctccggccactgaacccgcgaagagaaccgaccatgcgaatcgccgccctcgaccagggaaccaccagtacccgcgtgctggtcgccagccaggacggcagcgccgatattcagttggcgctgcgtcaccagcaacaccatccgcagtccggctgggtcgagcacgatccgctggaactgctggccaacctgcaacgctgcctggaggccagcggccgggtcgacgccatcggcctcgccaaccagggcgaaagctgcatggcctgggacgcccgcagcggcgagccgttgtcgccgctgatcgtctggcaggacaaccgcaccaccccgcacatcgagcgtctacgcgccagcggcgccgaggcgctggtcctggaacgcagcggcctgccgctcgacgcctatttctcggccagcaagctgggctggatcgtcgagcaccttccggccgctcgcagggctttgaaggcaggccgcctgcgcctgggaaccagcgatgcctggtttctcgaccgcttgtgcggaaccttcgccaccgacgtcaccaccgcctcgcgtaccgcattgatgaacctcgccgagggccgctgggaccccgacctgtgcgccctgttcggcgtgccgatcgagtgcctgccggaaatccgcgataccgtcggccatttcggggtgatcggcaacaccccgctgacggcctcggtggtcgaccagcaggcctcgctctacggtcacggctgccgccagcccggtgatgcgaagatcaccttcggcaccggcgccttcgccctgaccctcagcggcgagcggatcatccgctcgccggagacaggcctgctcgccaccatcgcctggcagatcgatggcaaaccggtgtacgccatggacggcggggtctacgacgccagcgccgcggtcgagtgggccgggcgtctcggcctgttcagcgacttctcggaactggccggcttcgaccggccgccggccatcgagcgcggcctggccttcgtcccggccctgtcgggactcgcatgcccgcactgggaccgcagcgccggcgcgatgtggctgggaatggacgccggcacccgccgcgaggacctctgccaggccctgctcgaaggcgtggtgctgcgcagcgccgaggtgatccaggcgatggacggctacctgaaggtcaccgaccgcctgtccatcgacggcggcctggcgcgcagcccctacttcgcccagttcctcgccgacagcctgcaacggcgcatcgtcacccagcgcttcgacgaactcaccgccttcggttgcgccgcccttgccgcgcgtggcctcggctacgagctggcggagccgcgcaatacccgcacggagttccagccgcgggtcgacgccggcaccgcccggcgctggcaggtgcgtttcagcgaagcggtggcgcgcacccgcggctggcgctga

SEQ ID NO: 11087 - DNA, 897 bp, Pseudomonas aeruginosa
cgcggcgggtggaaaagccgcaaaccggagcctgcgaaaacccaccgtggagcgaatacggatgcacaccctgttccgggacatcggcatgcacgccagcctgggccgcgccatcgaacagatcggcggcaaccgtttctggaagcaattgatcctgctgctgcgccagcacctgccgttcgacaacgccctggcgatcttctaccccgccaacggcgtgccggtggccctggaggaatacgacgccgaaccgcacgccgggccggcctcgatgctcgcctacctgaacgggctgtacctgctcgaccccttctaccaggcttgccgggaaggcctggccagcggcctgtaccgcctcgaggagatcgccccggaccatttccggcagagcgagtactacctcagctacttccacgacaacgttctggaggacgaggtgcagttcatcctacaggtgcccggccagggcgcgctgtcgctgtccctgggcatgcagaggatgttcgccgacgaggaatgcgggatgctcggcttgctctcgagctgggtcctggcgctgatgcagcagcactggcagcaacgcagccagcgcctgttgccggctgcaccgcaggaagagatggccacgcagatacgcgacgccctcagccacttcggcgccagcgtgctatcggaacgggaactggagatcgcccgcctgatccttcgcggctactcgtcgaaggccatggccgagcgcctggcgatctcgccggagacgatcaaggtccatcggcgccacctgtacgccaagctggacatttcctcgcaaccggagctgttctcgctgttcatccagtcgctcgggcacgacccggagaacccctagggatcatggattggcgtagcgccggctga

SEQ ID NO: 11088 - DNA, 1590 bp, Pseudomonas aeruginosa
tgcgcggcggggtggcgccgggcgcgctggacggaccgggctgcggctggctctgcggcggcagcgaggccggcggttcgctggtctgcggcggatgcaccacgcacccgccgagaccgcccaggagaatcgccagacccagatacttcgccttcaccgccgcacctccccaaccgattgtcgttatggccgggccgcctggggctggtccgggccgtcgatggtcagcgcttgcgccgacgactgggcagtagacaacggtttgccgcgtccgatccactcgccggagatggcgttgccggcgcgggatacccgtgccaccagctcgacctgcgggaaaccgctgagcttgagctgcggcatcatggcgtcggcatcgctcaggctgacctcggccggcaggtcggcgacggtcaggcgcttcactgccaacggcatcggcgggccgccgacggcgcgggcgaagacgaacacgctgtcgtcggccttgacctggcccttcaccgcgtcgctgatatccaccttcaccgtcagggtcaccccggcggcagcgggcgcggccggcgccggcggagtctgcccggcctcggtcatgcgctcgcgggcgcgctggatgccgccctggatcgccgagcgtgccgggtcctcgttcggcaacaccgacaccaggcgctcccagaagccgatggcgtcggcgtagcgctgctcttcgaaggcggcgatgccgagcaggccaagggtggtcacttcggccgggtcgcccttcagcgcctcgtcggccagggccttgatctgcgcggtcattttcttgccaccggagaaatacagtgcctgcgcccactggccgagcacttccggctgccgcccgctgagttcggcggcgcgttcgaaggcccgcgctgcatcggcgccgcgttcctgggtcatgtaggtgcgaccgaggaagtaccagccctgggcggaatccggctgagcctgtaccgcgcgctccaggcgcgcagtcatctcttccatggagtgcggcgcctgggcgaattcgcgggccagctcgaccttgtcgctggcgccccaatgcaggtacaggccgagcgcgaccaacggcaccagcagcgccgcgaccagcgggaccgcccggcccaggcgcgagctacgctcttcgccgctgccctcggtgtcggcgagcagttcgcgggcagcctcggcgcggccattctccagttgctcggcggtcagcgtgccggcggcctgctggccggccagctcggcgatccgctcctgataaagcgcgacgttcagggcggtacggtcttcctcggcctgggcgcgacggccacgcagcagcggaatcagcaggaatgccagggccgccagcagcagcaggccggcagcgagccagaaatcgatcatttgtcgttcttcaacaggttggcgaggcgcgcttgctcctcggcggacagggtggtttgcaccttggcagcggtgcgccggcggcgcaggacgatcacgccgatcaccagcacgccgaacagcagcaaggcgcccggaccgaaccagagcagccaggtacgctcgttgaccggcggcttgtag

SEQ ID NO: 11089 - DNA, 1596 bp, Pseudomonas aeruginosa
gacaggttgttacccatgccagccgagataggcgcttccccgccactacccccggtttccgccccacgcccgctgccgccggcgcaatcgcagggcaacgcccaggctgacgccgagatgaccctgaagctggtgcagaccctggccggcctgctgggcgaaggcgagtcgggcaaggccgaggtgctggcggtcaaggaaggcctggcgaacaatttccaggtcctgctcaagctgaccctggcgaacagcgggcagagcctggtggaagtgcagagcaatcggccgctggtgccgggcaacctgctcaacgtcagcgccaccagcaacaccagcgtggttgcaaccctgctcgacagcatggccggcgctggcccgctgagcagcctcgacctggagcaactgccgcccggcaccctgctccagggcaaggtcctgtccagcaccgcgctgccggcggacaaggcccagcaggtggtctaccgggtcctgctgaacctgctcaacacgccgctcgccggcagcaagctgagcctcgactcgccccaggcgctgccggtcggcagcctgctcacggcgctggtgaaaaacagccagcagatcgacttcctgccgctcagcggacgcctcgaccagcttgcgctgggccagcaactggccgggcagagcgcccgccaggcttccctggaaggcctgttcgccgccctgcaggggctgaacggccgcaacgacctgccggacagcctgcgccaggccgtggagcgcctcttcgccggcctgccggaggcgcagaagatgggcgattccaagctgctcggccaggccctgcagcagagcggcctgttcctcgaggcgcgcctgatgcagggcgccaccgatcatctcggccaggacctgaaggccaacctgttgcgcctgttcgcccagctgtcgccgctgccgccgaccggcgcccaggcgccgggcatgttcgccggcaacacggcgaacctggcccaggcgctgccggcctttgtccgcaacgccctgggcaacctgggacagagcgccaacaagacccaggcactgaactttcccctgccgagcaaggttctccaactgttcgacgaggacatggaactggagtcactgctgcgccttgccgccgcggcgatctcccgcctgcagacccatcagttgtcgagcctggcgcagaccagcaccctgccggatggcacccaactggcgacctggcagatggaggtgcccatgcgccatcagcactcggtggtaccgttgcaggtgaagttccaggaagaacagcgcaagaccggcgaagaggcccgcgaaagcctctggcgcgtcgaactggccttcgacctggagccgctgggaccgctgcacgcccaggcgaccctgctacgcggcagcctgtccagccagctttgggccgagcgagacgcgaccgcgcggctggtcgagcatgaactcggccacctgcgccaacgcctgcgcgacgccggcctgaccgttggcgagatcacctgccaacgcggccgcccgccccagggcccgcgagcgaccatcgaacaacgctgggtagacgaaaccgcatga

SEQ ID NO: 11090 - DNA, 627 bp, Pseudomonas aeruginosa
aatcgacctgaaccgcctggaggcggagatcgatccgcgcaaccggccttcggccgccagcctggagcgcctgggcttccgccaggagggcctgctcgcacaacgctggatcgtttccggagaagtctccgactcggcgctctacggattgctcgccgagcactggcgcaaccgctgaaggaggaaccaccggcagggcccgccatccgtcgctttccacagaacctgtcgttcgcgcaacggtctttagacggcacaccacatgcctgcggaggcatccctcaaatgaaaaaacataccctgttcgccgtagctgctctcggcctgctgttcgcgggcagcaccctgctgcctggcgagctttctcctgtcggctccgcctatgccaagggcggaaatggcggcggcaacggtggcggccatagcggcggcaagggcggcagccatggcggcaacctcggcggccactccagcaaaggccatggttcagccacctccggcatcgccagctcccgcgacagccgcgggctgtcgcaggccagcgcgatctccgccaccacccccggcgatcacaacagcaagggcttgagcaacgccatcggctcttcgaccaagaacgaccgctga

SEQ ID NO: 11091 - DNA, 1320 bp, Pseudomonas aeruginosa
acagcagacaaccgtcatgactatccaggatttccggacaataccgatacgcggtcacggcttgcgcgcgatccaggcgtactgctgacgcttctcctcgcccaggcgctggcgtcggcgatgactggcgaacgcatcgccggaacagtaggtgcagacggcgctggcttcgatctgcgccggcccgacgccggcggcctggaacaactggcgacagaaggccaccaggtccagccaggcgccctgctccgcctgccttggctcgggcggagcgaaccggggtggccgctcggggagcggacgacgctggctccagggcggcaccgcgccctcccagaggcggccgtggccgacctgcaacgcctcgatgaacccggcactcacctcgtagcagcaggctttgatcccgggaccgatggcgacccggatgtccgcgctggcgacgccgcgcgcattgaagcgcgccaccgccgcgccgacgataccggcgacgagcccctgccagccgccgtgcagggcggccaccacccgaccgtcgcgactgctcatgagaatcggcaggcagtccgcggtgaccaccgcgaccgccagcggcccttcgctgaaaacaccgtcggcggcatgccgtcccgattccgacaacgagcgcgcgtcgacgatctcggcgccatgcacctgccggcaatggaatatccgttcggagagtgcctggccggcttgctggaagccatgctcgatgccttcgatcgccttgaggatgtcggcctggacggtcatgctgtctcgccatggaaggttggaaaacgaccttacctcatcttcccggaagccgcctcaggcgatgccgcgcaggaggtcggggcagccgcgatcacgcttgatcaacgcagccagggcgacctggcccaaaggccggtcggacaccgcgccgatgctcaggccatggcctctgctccactcgaacaacagacgcttctcgcggcaatcgagttcgcccaccagcaggaagcgccggatgctgccgctgcgtcccagcatcgccagcgtgcccttgcagccctggtccaggcggaatccgtcgtagaggcaatagtcgtacgggtaaccctggtccagggagcgccgcagctcccgtcggtccaggcacaggctcaggtggaagtagccgcagcggttgaacagcgctccgtacctgagcagacggccggggttggcgcacagcaccatggcgcgcaggggtattgcaggcatccttgtggcctcctggaaacgtgcgggttgaccaggaccgattctagaaagcgacagccgcgcaattaa

SEQ ID NO: 11092 - DNA, 759 bp, Pseudomonas aeruginosa
cctatatcccccctaccctgcgttcagcccggttgcgatgcgcaacgtgcgttacctgaacggagatggaaaatggaacctgtactgttttatggcgtaccccacggctgttccttcggctcgatcgtggccctcgagtggctcggccgcccctatcgcctgtgtcggatcgagatgccgctggagaccggcgagcgcacctacgtgcgcctgaacccggctcgccagacgcccaccctgctcctggaggacggccgcgcgctcagcgaaagcctggccattctccagcacctggcggcgcgcgacctgtgcaggaagctcggttatccgcagggcagcgccgagttcgacgaactgaacttcgccctcgccctcctgcataccgaatgccattcggcctggggagccctgttctatctggaggacgccgacgcaaccacgacggcaagggcgctgacgcgcgcggcgcgagcctatggccggatcgacaagctgctcggcgaccgcaagtggctggccggcgaagggccgagcgtggccgacgcctacctcgcgggtaccgctcgctggggacgggagctgggctacttcgacctgcaacacgactttccgcgcctgcatcgacacctggagaagctggagcaggacccggcggtgcgcttcgcccatgccatcgaggatcgcctgccggcgcagagctgcggggagttcaggggagaggtgacactggtagaagtggcgagccgcctgctcgcctga

SEQ ID NO: 11093 - DNA, 1557 bp, Pseudomonas aeruginosa
aacgcatcagatgctgcccagctccgaccattcttcctcggtcatcatcttgtccagctcgaccaggatcagcagctcgccgttcttgttgcagacaccctggatgaacttggccgactcttcgttgccgacgttcggcgcggtctcgatttccgactgcttcaggtagaccacctcggcgacgctgtcgaccaggatgccgaccacctgcttgtccgcctcgataatgacgatccgcgtgttgtcgctgaccggcgcagggtccaggccgaagcgctggcgggtgtcgatcaccgtgaccacgttaccgcgcaggttgatgatgcccagcacgtagctcggcgcgcccggcaccggggcgatctcggtgtagcgcagcacctcctggacctgcatcacattgatgccgtagctctcattgtccaggcgaaaggtgacccactgcaggatcggatcttcggcgctttgcgcggtggctttgctcattcccctaacctctcgaaaaccgccgcaagtggcggaagctgtctatcaatggtcgccgtgcaggcgcttgacggcgccgctggcgatcagttcggcgagcgccgccacatccagcagcgcacacatgtgttcgatgaccgtgccggccagccagggccgctggctacgctggctgcgccatttcacctcggccgggtcgaggcggatcgagcggctcacctggtgcaccgccagcccccactcgtagccctggaccgagatcacgtacttgaggccgtcgcgatagtcgtcgcggtagcgttcgggcatcacccagcgtgcggtgtccaacaccttcaggttgcccgcctgcgacggcaggatgccgaggaaccagtcgggctggccgaacaacggggtcagttcctggttctccagcggatagatcgagccgaggcacaccagcggcaccgccagggtcagcccggcgacgtcgaacagcaggcactcgaagggctccgccgcccaggccggacgaccgtcgtcgagcagcggcaggtcgagcagcggcggctcgccgacgctcgccggggcgctcggcacgcgcaactcgatgacttcgtggggccgtggctcgaccggcagctcgcgcaacgtcgtcggttcgtcgagcagggccgccggcgccggcggaaccaggcgcgcatcgcggacctgctcctcgagcaccgcggcctcgaactcgtcgaacccgtggtcgaccggcagcgtttccagcgccggggccggtgtcgccacttcggcgaccgccagcgcgacaggcttcaacggcgcgggcgcaggcgctggcggcgtctcgacgagaggttccaggtcctcgaaagtggcctcctggagcaacgcatccaggtaggactgcaaggccagttgcgaacgggtggcggtggcggcgctcatgtgggtattccgcgacaggggtctacaacggttatcggccgcactccggtgcggcttgaatgcgcctgtcggcgcggcgaccggcgcgccatcaggccacccgggtggccggctgctgcgccagcagatgcttga

SEQ ID NO: 11094 - DNA, 1584 bp, Pseudomonas aeruginosa
ggatcgggctccgcgtcggcgatgctctccaggccgagcaggccttccttgcgcgcggtcatgctccaggagacgatccggtcgattcccccggaaagatcctcgcgcggcgggaagaacacccagccgagcatgcccaggccgcgcttgagcacgttcaccggggtctgcaacagcgccgcggccagggtgccgccgatcacgatcagcgccgccggaccgttgagcagggcccccgcgtggccgccctcgagaaagtttccgccgacgatggcgacgaacgccaggatgatcccgaccaggctgagcacatccatcagcgcgtcctctcggctcggcgaaggcgcgcgcaggtcgtcacgtgggtggccatcgaaggcagtctcctcattcctgcacgcacgcttactggcacgcctcgaccaggtgccggccgatgtcgtcgagcccgtacaccgcgtccgccaggttggccttgaccacggccatcggcatcccgtagatcacgcaactggcctcgtcctgcgcccacacctggctgccgccctgcttgagcaggcgcgcaccctcgcgtccgtcggcgcccatgccggtgaggaccaccgccaggaccttgtcgttgtaggccttggccgccgagccgaaggtcacgtcgacgcagggcttgtagttcaggcgttcgtcgccggggaggatgcgcaccgtgccgcggccgtcgaccatcatctgcttgccgcccggcgccagcagcgccaggccgggacgcaggatgtcgccgtcctctgcttccttgacgctgatccggcacagcttgtcgaggcgctcggcgaaagccttggtgaaggccgccggcatgtgctggatcagtaccagcggcgccgggaagttggccggcaactgggtcagcacccgctgcaaggcaaccggtccaccggtggaggtaccgatcgcgaccagccggtaggccttgcgcttcggcgccgccgaggtcgacgccggggccggcgacgcgccggcactggcacgcgcgctcgcgccgaggctggaggacgacgccggcgcatggctggacgaggtggccgaaggcagcggcggcaggctgatcgagcgacgattgctacgggcgatggtcaggaccttctcgcagagcaactggcggaccttgtccgggttgcgcgagatgtcctcgaaattcttcggcaggtagtcgaccgctccggcgtccagcgcatccagggtcacccgcgcgccctcgtgggtcagcgaggagaacatcaggaccggggtcgggcaacgctgcatgatgttgcgtaccgcggtgatgccgtccatcagcggcatctcgtaatccatggtgatcacatcgggtctcagggccagcgcctgctcgatggcctcgcggccattggtggcggtgccgaccacctggatctgtccatcggcggagagaatctccgagacacggcggcggaagaaccccgaatcgtccaccaccaggactttgactgccatagctactcctcagagggcgacgctcctgcgccgccggaaacccatacgcggcgtcagatgcgccgtgcgtaa

SEQ ID NO: 11095 - DNA, 1857 bp, Pseudomonas aeruginosa
cactccaggtcggtcaggcggtccgccgcatcgcgctccagcaggcccttctccaccgccttgttgcgcagcacctcggcgtccatgcccttgccgtcgtcggtgatcatcaggaggatgtggtcaccctcctgctccgctgacagcaccacctggccgacccgcggcttgccggcggcctcgcgctcctccggactctcgatgccgtggtcgacggcgttgcgcaccaggtgcaccagcggatcggcgagggcctcgaccaggttcttgtcgaggtcggtctcttcgcccaccagctccaggttgatctctttcttcatgttccgcgccaggtcgcgaaccaggcgcgggaagcggccgaagaccttcttgatcggctgcatgcgggtcttcatcaccgacatctgcaggtcgccggtgaccacgtcgaggttggccacggccttggccatggcctcgtcgccactgttcaggcccaggcgcaccaggcggttacgcaccagcaccagctcgccgaccatgttcatgatctcgtcgagacgcgccgtatccacccgcacggtggtctccgcctcgcttgccgcgggcctgtcgggcgccgccggacgcgcggcggcggccttggccggagcgaccggtttcgccgcgggactcttcgccgcgatgttcttggctaccgccgcggcggccgccacggcctcggaggcgccgttgaacttgcccttgccgtgcagttcgtcgagcagcgactcgaactcgtcgtcgctgatctcatcgccgcccgcggcggccggcgccttgccctgctccgccggcgcagccgctggagccgcggcagccggtgcggcgggtgtgccggcagcttccgggacatcgccgaacttgcccttgccgtgcagttcgtcgagcagcgcctcgaactcgtcgtcgctgatatcgtcaccagcggcagccgcggccggctcgaccgcctcggcggggacttgcgcaggctcggccgagaccgccggcgggacgaacttgcccttgccgtgcaactggtcgagcaacgcctcgaactcggcgtcgctgatctcgtcgccagcgggagccgcgggcgcttctgcaacggcggaggccggcgcttcgtcgccctgcagagcatccagcaactgctcgaactcgtcgtcggtgatatcgctggaggcactctgcgcgggcgcttccggcggcgccgcaggctcggctggcggaacggccgccggcggcgcttgcacaggttccgcgggctcggcgccctcgggctcggccaggcgggcaagggccgccagcagctcgggcgtcgccggggtcggttcggactgctcgcgcacctggtcgaacatcgcgttgaccgtatccagcgcctgcagcaccacatccatcagttcggagctgacgcgccgctcgcccttgcgcaggatatcgaagacgttttccgcaatgtggcagcattccaccagcgcgttcagctggaggaagccggcaccgcccttgaccgtatggaacccacggaaaatggcattgagcaggtccatatcgtccggccggctctccagctcgaccagttgctcggacaattgctcgagaatctcgccggcctcaaccaggaagtcctggaggatttcttcatcggcgtcgaagctcattcggctgctcccagagacgtgttactcgaaaggatcggcaggaccgctgtcctgccggaaataccggcccggctttccggaccgacttcagcccgcccgccgggatcaccggcatgacgaaggctgtgccagcagcccgcggatgccagcgttcaatgcttacttaacggcagcgatgccgcagtcttga

SEQ ID NO: 11096 - DNA, 2073 bp, Pseudomonas aeruginosa
tgcgacgtcgaggaaacggtcagtgaccttggtcagtttggcgaacaggttgcgtccttcctgcgggctgtgggccatgttggccaggacccggaagcgggtcatgccgtggtcgcggttgagcagtttgatcagggcgtaggcatcggtgatcgaggtcggctcgtcgcagacgaccagcagcacctcctgcgcggcgcggacgaaactgaccaccgaatcgccgatcccggcggcagtgtcgacgaccaggacatcgaggttgtcgctgatatcgctgaacgcctggatcagccccgcatgctgcatcggcgagaggtgcaccatgctctgcgtgccggaggccgcgggaacgatgcgcacgccaccgggaccgaggaggaggacatcgcgcagttcgcagcgtccctcgatcacgtcggccagggtgcgcttgggcgtgagtcccagcaggacgtcgacgttggccaggccgaggtcggcatccagcagcatgacgcgacggccgagatcggccagagccagtgccaggttcaccgacacattggtcttgccgacgccgcccttgccgccagttactgcgatcacctgtacgggatgcatgctacccatctgcttcataccttgtgttgtcgtcttcccggaacgccccttccagcgctctccggtattggcgggaacgatgcgccatcgctcccggcccggcggaagccaccttcgcttccgtcacccgcgccacgcgcggttcttcccacgtcctcagccggcacgccgcgccggttgctggtagagcccggcgaacatctcggccatggcgtcctcgctgggctcttccggtgcctgcaggctcaccgcccggctgaccagttggtgactgcgcgccacctgcaggtcgtccggaatccgcggcccatccgccagataggctaccgggagacgctgggcgatagccagcgccatcgattcaccgaggctgcccgcctcgtccagcttagtcaggatgcaacccgccagcccgcagtgccgataggtctggtaggccgacttgagcacctggctctggctggtggtggccatcaccaggtaattcttcacgttcaggctcggcgacgccagtgcctcgagctgcatgcgcaatgccgggtcgctggccggcaggccggcggtatcgatcagcaccatgcgcttgcgcgccagcggcgccagggcctggatcagcgactggccgggatcgaccagggtcaccggtacgttgaggatccgaccgagggtcttgatctgctcctgggcgccgatccggtagctgtccatgctcaccagcgccaggctctgggcgccgtacttgaggacgtagcgcgcggccatcttcgccagggtggtggtcttgccggcacctgccgggccgaccagggccagtacgccgcccgcatcgagcgggtcctgctcgggggtctgcacggcacgcgacaggtgcgccaacagcatgcgccaggcctggcgcgtatcgcccaccgcggcgacccgctccagcaacggcttgctcagctccgccggcaagcccatgcgctgcaggcgccgccagagattggcctgctgcggacgctggtgctgcaactggccccaggcgatggagcccagttgtacctcgatcagctcgcgcaggccgttcagttcgaaacgcattgcctcgagggtctggccgcccgcctggggcttggcctgcgccgccgtcatggactcggccagggacggacgcgccggcttctcctcggcgaacaattgacggtccttgcgctggttttccgccggacgcgccgtcaactcggcgcgcgcctcggcgatccgcgcctgggtcttgcgcagctccacttccagcgccgggttgggcttgctcggcgccggcggggcctggtaatccagcgccgcggtcagctcgatgccgccggcgacccggcggttgccgagaatcgcggcgtccggacccagttcgtcgcggaccagtttcatggcctggcgcatatcggcggcgaagaagcgtttgacttgcattgcccgaacccctcagttcagtag

SEQ ID NO: 11097 - DNA, 423 bp, Pseudomonas aeruginosa
ttgccgccgatcaccacttcgccgaaggcctggatcaccttgcctgcggcgccatggccgtcgtggccgtggagcagcaccacgcgggtcgaggcaacgttcagcgccaggcgcaacagggtcgccaccagcaggatggtcgggaacacggcgaagtccagcggccgcagggcgtacacgcagaccagcaggacgacgatggacagggcgatgttgaaggtgaacagcacgtccagcaggaatggcgggatcggcagggtcatcatcgccagcatggccagcagcaggaccggcacgccgaggctgccgcgccccagtcccgccaggttgctgcgcacattgctgatcagttgcgtgcgatccactctcgactcccctgccctgcgtatggcgcccgtaggtgggcgccgaacaaacttttga

SEQ ID NO: 11098 - DNA, 1248 bp, Pseudomonas aeruginosa
tgtcgcgcttcgcgcggatggcggtgcccagcatgcatgtgctggcctaccaggaaatcccggacaacaagcaagtcaccatcgtcgcgacggtgggacagaactgaacgagggctgcgccggctccagggccggcacaccgggcaacctgaggttgccggcaagactactgaactgaggggttcgggcaatgcaagtcaaacgcttcttcgccgccgatatgcgccaggccatgaaactggtccgcgacgaactgggtccggacgccgcgattctcggcaaccgccgggtcgccggcggcatcgagctgaccgcggcgctggattaccaggccccgccggcgccgagcaagcccaacccggcgctggaagtggagctgcgcaagacccaggcgcggatcgccgaggcgcgcgccgagttgacggcgcgtccggcggaaaaccagcgcaaggaccgtcaattgttcgccgaggagaagccggcgcgtccgtccctggccgagtccatgacggcggcgcaggccaagccccaggcgggcggccagaccctcgaggcaatgcgtttcgaactgaacggcctgcgcgagctgatcgaggtacaactgggctccatcgcctggggccagttgcagcaccagcgtccgcagcaggccaatctctggcggcgcctgcagcgcatgggcttgccggcggagctgagcaagccgttgctggagcgggtcgccgcggtgggcgatacgcgccaggcctggcgcatgctgttggcgcacctgtcgcgtgccgtgcagacccccgagcaggacccgctcgatgcgggcggcgtactggccctggtcggcccggcaggtgccggcaagaccaccaccctggcgaagatggccgcgcgctacgtcctcaagtacggcgcccagagcctggcgctggtgagcatggacagctaccggatcggcgcccaggagcagatcaagaccctcggtcggatcctcaacgtaccggtgaccctggtcgatcccggccagtcgctgatccaggccctggcgccgctggcgcgcaagcgcatggtgctgatcgataccgccggcctgccggccagcgacccggcattgcgcatgcagctcgaggcactggcgtcgccgagcctgaacgtgaagaattacctggtgatggccaccaccagccagagccaggtgctcaagtcggcctaccagacctatcggcactgcgggctggcgggttgcatcctgactaa

SEQ ID NO: 11099 - DNA, 828 bp, Pseudomonas aeruginosa
ctggccgctgccggccaacccgcgcgggcacctggagttcttcgtcgaacgactggtccaacaccccgcgacaggttcggccgtatgacagcggcctctggagtgcgtatgtatagcaaggcgcaagcgcagaactcccaggagcaactgatccagcgttacgcaccactggtcaagcgcatcgcctatcacctgctcggccgcctgccggccagcgtgcaggtggaggacctgatgcaggccggcatgatcggcctgctcgaggccgcgaagaaatacgacgccggcaagggcgccagcttcgagacctatgccggcatccgcatccgcggggccatgctcgacgaggtccgcaagggcgactgggcgccgcgttcggtgcaccgcaacacgcgcatggtgaccgacgcgatccgcgcgatcgaggcgagaaccgggcgcgacgctaaagatcacgaagttgctgccgaactccaattgagcctcgaagattactacggcatcctcagcgacacgcagggcagccgcctgtacagcttcgacgacctgttgcaggacggcgaacatggattgccggaagacaccagcctcagtcacaacgaaccgatccacggcctgctcgacgaacgtttccaggcggccctggcggatgccatcgccaagttgccggagcgcgagcgcctggtgctggcgttgtattacgacgaggaactcaacctcaaggagatcggcgaggtactgggcgtcagcgaatcgcgggtcagccagttgcacagccagtgcgccgcgcgtttgcgcgcgcgcctggccgattggcggtcggcctga

SEQ ID NO: 11100 - DNA, 849 bp, Pseudomonas aeruginosa
aggaaaagatcgagaagattttcgagcgggtcaacggctgaagccggccaagagggtgtcatggtgcttggtaacgattccacgggcgacgaattcgaatcgaccctgaaaaaacatgcgcgcgaactggtggactgtctcgaacgggggcacttccagcaggcggtgcaattgatccaggagctcagccaggccagggaccgtggcctctaccaggaagtgggcaagctgacccgcgaactgcacaacgccatcgtcgatttccagatcgacccgcattccccccacgcgcaggaaatgtcgcagatcgccgatgccaccgatcgtctttcctacgtggtggaaatgaccgagaaggccgccaaccggaccatggacctggtggagcagagcgccccgctggtcaaccagttgggcgacgattcgcgggagctgcaccaggagtggcaacgcttcatgcgccgggaaatcgacgctgacggcttccgcgagctggccaagcgcatcgaacagttcctcgtgcgcagcggcgagaacgccggccagttgtcctcgcagctcaatgacatcctgctggcgcaggattaccaggacctgaccggccaggtgatcaagcgtgtcaccaagctggtcaccgaggtcgagagcaacctcgtgaagctggtctggatggccggccaggtggaccgttacgccggaatcgagcacgaccacgtgagcatgcgccaccaggccgcgctggagcgttcggccaagggcgaggggccgcaggtcgccgcggaaaaacgagaggatgtggtgtccgggcaggatgacgtggacgatctgctgtccagcctgggtttctga

SEQ ID NO: 11101 - DNA, 729 bp, Pseudomonas aeruginosa
tggatgtggtgctgcaggcgctggatacggtcaacgcgatgttcgaccaggtgcgcgagcagtccgaaccgaccccggcgacgcccgagctgctggcggcccttgcccgcctggccgagcccgagggcgccgagcccgcggaacctgtgcaagcgccgccggcggccgttccgccagccgagcctgcggcgccgccggaagcgcccgcgcagagtgcctccagcgatatcaccgacgacgagttcgagcagttgctggatgctctgcagggcgacgaagcgccggcctccgccgttgcagaagcgcccgcggctcccgctggcgacgagatcagcgacgccgagttcgaggcgttgctcgaccagttgcacggcaagggcaagttcgtcccgccggcggtctcggccgagcctgcgcaagtccccgccgaggcggtcgagccggccgcggctgccgctggtgacgatatcagcgacgacgagttcgaggcgctgctcgacgaactgcacggcaagggcaagttcggcgatgtcccggaagctgccggcacacccgccgcaccggctgccgcggctccagcggctgcgccggcggagcagggcaaggcgccggccgccgcgggcggcgatgagatcagcgacgacgagttcgagtcgctgctcgacgaactgcacggcaagggcaagttcaacggcgcctccgaggccgtggcggccgccgcggcggtag

SEQ ID NO: 11102 - DNA, 801 bp, Pseudomonas aeruginosa
caatcgtcgctcgatcagcctgccgccgctgccttcggccacctcgtccagccatgcgccggcgtcgtcctccagcctcggcgcgagcgcgcgtgccagtgccggcgcgtcgccggccccggcgtcgacctcggcggcgccgaagcgcaaggcctaccggctggtcgcgatcggtacctccaccggtggaccggttgccttgcagcgggtgctgacccagttgccggccaacttcccggcgccgctggtactgatccagcacatgccggcggccttcaccaaggctttcgccgagcgcctcgacaagctgtgccggatcagcgtcaaggaagcagaggacggcgacatcctgcgtcccggcctggcgctgctggcgccgggcggcaagcagatgatggtcgacggccgcggcacggtgcgcatcctccccggcgacgaacgcctgaactacaagccctgcgtcgacgtgaccttcggctcggcggccaaggcctacaacgacaaggtcctggcggtggtcctcaccggcatgggcgccgacggacgcgagggtgcgcgcctgctcaagcagggcggcagccaggtgtgggcgcaggacgaggccagttgcgtgatctacgggatgccgatggccgtggtcaaggccaacctggcggacgcggtgtacgggctcgacgacatcggccggcacctggtcgaggcgtgccagtaagcgtgcgtgcaggaatgaggagactgccttcgatggccacccacgtgacgacctgcgcgcgccttcgccgagccgagaggacgcgctga

SEQ ID NO: 11103 - DNA, 813 bp, Pseudomonas aeruginosa
acccatgccaggaagagtagagcaatgaaagtttgggcagtcgccaatcagaaaggaggggtcggcaagaccacctcgtccatcgccctggccggcctgttggcggatgccggcaagcgcgtggtcgtggtcgacctagacccccacggctcgatgaccagctatttcggctatgacccggacaccctcgagcacagcgccttcgacctgttcctgcaccagggcaacgtccccgaggggctgccggcctcgctgctgcgcagcaccagcaacgaacgcatttccctgctgccgtcgagtaccgcgctggccaccctggagcgccagtcgccgggcaagagcggtctcggcctggtggtctcgaagagcctggcgcagctctggcaggatttcgaccatgcgatcatcgacagcccgccgctgctcggcgtgctgatggtcaacgccctggccgccagccagcacctggtgatcccggtgcagaccgagttcctcgcggtgaaagggctggagcggatggtcaacaccctggcgatgatcaaccggtcgcgcaaacaggcgttgccctataccatcgtacctacgctgttcgaccggcggacccaggcttcgctgagcacgctgcggattctcaacgagaactacccggacaacctgtggcaggcgttcattcccatcgatacccgcctgcgcgatgccagccgggccggggtcacgccgtcgcagcacgacggcaagagtcgcggggtgatcgcctaccgcgccttgctcaagcatctgctggcgcagcagccggccacccgggtggcctga

SEQ ID NO: 11104 - DNA, 795 bp, Pseudomonas aeruginosa
acccctgtcgcggaatacccacatgagcgccgccaccgccacccgttcgcaactggccttgcagtcctacctggatgcgttgctccaggaggccactttcgaggacctggaacctctcgtcgagacgccgccagcgcctgcgcccgcgccgttgaagcctgtcgcgctggcggtcgccgaagtggcgacaccggccccggcgctggaaacgctgccggtcgaccacgggttcgacgagttcgaggccgcggtgctcgaggagcaggtccgcgatgcgcgcctggttccgccggcgccggcggccctgctcgacgaaccgacgacgttgcgcgagctgccggtcgagccacggccccacgaagtcatcgagttgcgcgtgccgagcgccccggcgagcgtcggcgagccgccgctgctcgacctgccgctgctcgacgacggtcgtccggcctgggcggcggagcccttcgagtgcctgctgttcgacgtcgccgggctgaccctggcggtgccgctggtgtgcctcggctcgatctatccgctggagaaccaggaactgaccccgttgttcggccagcccgactggttcctcggcatcctgccgtcgcaggcgggcaacctgaaggtgttggacaccgcacgctgggtgatgcccgaacgctaccgcgacgactatcgcgacggcctcaagtacgtgatctcggtccagggctacgagtgggggctggcggtgcaccaggtgagccgctcgatccgcctcgacccggccgaggtgaaatggcgcagccagcgtag

SEQ ID NO: 11105 - DNA, 867 bp, Pseudomonas aeruginosa
cgagctggccaggcgcctggaggtggatggacggacgctgcgtcgctatatcgtcgccctcgaggagctgggcatacccatctcggcggagcgcggacgccatggcggttaccgcctggtggccggtttcaagctcccgccgctgatgttcagcgcggaggaaaccctggccgtgtccctcggcctgctggcggtgcgcagtctcggcctgggcgaaagcgagctggccctggaaagtgcgcaggccaagctgagcagggtgatgcccgttgcgctgcggcggcgcctcgtggcgctccgcgagaccgccagcctggacctggcccgcgcccgggcgggaaccagtgtggcggcgctggcgaccctcgccgaagccgcccaggtccgtgcgcgggtcgagttccgctatcgcgacccgcagggcgccgaaaccctccgccaactcgatccctacggcctggcctatcgcaacggctgctggtacgtcagcggtttctgccacctgcgccaggcgttgcgctcgttccgtctcgatcgcctggacgcgccgcgcatgctggcggagcgcttcgagcgaccggcggatttcgataccctccgccacctgcgggagagcttcgcccggatgccgcgcgcctacccggtggaaattctgatgcgggcggcgagggagcaggtggtcgcggtgctcggcgagcccctcggtctgctcgccgaggtcgatggcggtacgctgttgcgcgccagcaccgacgacctggactggttcgcccggcgcctgtgcggcctgccgttcgacttcgaggtcaggcagccgctggagttgcgcgagccgttgaggcgccaggccgagcgtgtcctgcgtaa

SEQ ID NO: 11106 - DNA, 1185 bp, Pseudomonas aeruginosa
ggtaaggtcgttttccaaccttccatggcgagacagcatgaccgtccaggccgacatcctcaaggcgatcgaaggcatcgagcatggcttccagcaagccggccaggcactctccgaacggatattccattgccggcaggtgcatggcgccgagatcgtcgacgcgcgctcgttgtcggaatcgggacggcatgccgccgacggtgttttcagcgaagggccgctggcggtcgcggtggtcaccgcggactgcctgccgattctcatgagcagtcgcgacggtcgggtggtggccgccctgcacggcggctggcaggggctcgtcgccggtatcgtcggcgcggcggtggcgcgcttcaatgcgcgcggcgtcgccagcgcggacatccgggtcgccatcggtcccgggatcaaagcctgctgctacgaggtgagtgccgggttcatcgaggcgttgcaggtcggccacggccgcctctgggagggcgcggtgccgccctggagccagcgtcgtccgctccccgagcggccaccccggttcgctccgcccgagccaaggcaggcggagcagggcgcctggctggacctggtggccttctgtcgccagttgttccaggccgccggcgtcgggccggcgcagatcgaagccagcgccgtctgcacctactgttccggcgatgcgttcgccagtcatcgccgacgccagcgcctgggcgaggagaagcgtcagcagtacgcctggatcgcgcgcaagccgtgaccgcgtatcggtattgtccggaaatcctggatagtcatgacggttgtctgctgtttatccgccaatacccggcttctagactttccctgtcgatgcgtggctgtcgccacgctcattccaggagagtcccagcatgcctgacatcacccaagccgccatcgtcaccggcgcctcccgcggcatcggtcgcgccattgcccggcggttggccgccgacggtttcgcggtcgcggtcaactatgccggcaaccagaccatggccgacgaggtcgtggccgaaatcgtcgccgccggcggcacggccatcgccgtacagggcgacgtggccagcccggaggacatggacaagctgttcgaagccaccaggagcgccttcggccgcatcgacgtggtggtcaacagcgccggcacgatgccctacctga

SEQ ID NO: 11107 - DNA, 1677 bp, Pseudomonas aeruginosa
tcgcccgggcgctgcccagctacggtccgtacatcgcgtccaagtccggggtcgaggggctggtgcacgtgctggccaacgagttgcgcggccaggacatcagggtcaacgcggtggcgcccggcccggtggccaccgagctgttcttcaacggcaagagcgccgaacagatcgaccagatcgccaggctggcgccgctggagcgtctcggcgaaccggacgagatcgccgcggcggtgtccttcctcgccgggccggacgggacctgggtcaattcccaggtgctgcgggtcaacggcggtttcgcctgagccgtgtgggcggggcacgaaaaagccggcgcgaaggccggctttttcgtggtcgccactggcggtcagcggtcgttcttggtcgaagagccgatggcgttgctcaagcccttgctgttgtgatcgccgggggtggtggcggagatcgcgctggcctgcgacagcccgcggctgtcgcgggagctggcgatgccggaggtggctgaaccatggcctttgctggagtggccgccgaggttgccgccatggctgccgcccttgccgccgctatggccgccaccgttgccgccgccatttccgcccttggcataggcggagccgacaggagaaagctcgccaggcagcagggtgctgcccgcgaacagcaggccgagagcagctacggcgaacagggtatgttttttcatttgagggatgcctccgcaggcatgtggtgtgccgtctaaagaccgttgcgcgaacgacaggttctgtggaaagcgacggatggcgggccctgccggtggttcctccttcagcggttgcgccagtgctcggcgagcaatccgtagagcgccgagtcggagacttctccggaaacgatccagcgttgtgcgagcaggccctcctggcggaagcccaggcgctccaggctggcggccgaaggccggttgcgcggatcgatctccgcctccaggcggttcaggtcgatttcatcgaaagcgaacgccagcagcctgcgcagcgcctcgcccatgtaaccccggccctgggctgcacgtgccaggcagtagccgagttcggcgcggcgcgagcctttctcgaaatggaagaggatacaactgccgagcaattggccgtcttctcgacgctcgatggccaggttcaggtattcgccgtcgacgagcgcctggctgtcccgcagggatcgcctcgccgggcctggcgcaagggtcgtccacggcggtgtgttccactaacgcatgacttccgggtcggacatcatgggaaacagcgggccggcgtcttcctctcggaaagtgggtaccccgcaggcgcggggtgtccaacgggtggggaaagacgaagttcatcgggcgctcctttgccgaggtcggaggctgcgcagcttagcgcgcagcggcgaggtcctggagctgatgtgcgtgcggatgtttcgccgtgcgggctggctcagtcgccgggaccgccgagtagcagcatctggttgccatccgcggcgtccggcgcgaatccctcgggacacttgcctttcaggtgccaggcgaaggcgatgatctcggcgatggtgcgatacagcgcttccggaatggcgtcgccgagttccaggcgggcgagcaggcggaccagctcggcgttctcgtag

SEQ ID NO: 11108 - DNA, 903 bp, Pseudomonas aeruginosa
tctcgccaacggtcaggccggcgtcgcgcaggcgttggcgcaggtggccgagttcatgctcgaccagccgcgcggtcgcgtctcgctcggcccaaagctggctggacaggctgccgcgtagcagggtcgcctgggcgtgcagcggtcccagcggctccaggtcgaaggccagttcgacgcgccagaggctttcgcgggcctcttcgccggtcttgcgctgttcttcctggaacttcacctgcaacggtaccaccgagtgctgatggcgcatgggcacctccatctgccaggtcgccagttgggtgccatccggcagggtgctggtctgcgccaggctcgacaactgatgggtctgcaggcgggagatcgccgcggcggcaaggcgcagcagtgactccagttccatgtcctcgtcgaacagttggagaaccttgctcggcaggggaaagttcagtgcctgggtcttgttggcgctctgtcccaggttgcccagggcgttgcggacaaaggccggcagcgcctgggccaggttcgccgtgttgccggcgaacatgcccggcgcctgggcgccggtcggcggcagcggcgacagctgggcgaacaggcgcaacaggttggccttcaggtcctggccgagatgatcggtggcgccctgcatcaggcgcgcctcgaggaacaggccgctctgctgcagggcctggccgagcagcttggaatcgcccatcttctgcgcctccggcaggccggcgaagaggcgctccacggcctggcgcaggctgtccggcaggtcgttgcggccgttcagcccctgcagggcggcgaacaggccttccagggaagcctggcgggcgctctgcccggccagttgctggcccagcgcaagctggtcgaggcgtccgctga

SEQ ID NO: 11109 - DNA, 870 bp, Pseudomonas aeruginosa
acccttcaccgccctcgacaaacagggggtggcgcaactggaaacgcacctggccgggcattgccagcgcggcgggatggtggtgctgaccacccaccacagcctgcagcagatgcccgccggctaccgcgagctggacctcggtgcgctcaaggcggccagcggcgcgacggtcgagccggcgctgggcgacccggcatgagcaacgtcttcagcctgctcctggcgcgcgaggcgcgcctgctgttccgccgaccggcggagctggccaatccgctggtgttcttcgccatcgtcatcgccctgttccccctggcggtcgggccggagagccaattgctacaaaccttgtcgcccggcctggtctgggtggcggcgctattggccgtgctgctctcgctggaagggctgttccgcagcgatttcgaggacggttctctggagcagtgggtcctttcgccgcaccccctggctcttctggtgctggccaaggtgctggcacactggctgttttccgggctggccctggtcctgatgtcgccgctgttcgcgctgatgctgggcctgccggcccgttgcataccggtgctgctgctttccctgttgctcggtacgccggtgctgagcctgctcggcgccgtcggcgcggccttgaccgtgggcctcaagcgcggcggcctgttgctggcgctgctgatcctgccgctgtacatcccggtgctgattctcggtagcggggcgctgcaggcttcgctgcagggactgcccagcagcggacatttattgtggctggcgagcctgacggcgctagcattgacactcacgccattcgccatcgctgccggcctgaagatcagcgtaggcgagtga

SEQ ID NO: 11110 - DNA, 684 bp, Pseudomonas aeruginosa
aggccctggtggagaaggcacgatgagcttcgaatcgttcggcgacttcctcgccatgggccatcacggtccctacgtctggtcggcctacggcatcagcctgctggtgctggcgatcaatgtcgccgagccgctgctggcccggcgccgctacctgcaagaagaggcgcgtcgtctgcgccgggaggcccagcagtgaatccggtccgcaagaaacgtctgatcatcgtcctcgccatcgtggcgggtgtcggcgccgcggtgggcctggcgctgtcggccctgcaacagaacatcaacctgttctacaccccgacccagatcgccaacggcgaagcgccgaccgacacccgcatacgcgccggcggcctggtggaaaagggttctctgcaacgcagcgaggattcgctgaacgtgcgtttcgtggtcaccgacggcgccaaggaagtgaccatcgcctaccatggcatccttcccgacctgttccgcgaggggcagggcatcgtcgccctcggcaagctgggcggcgacggcgtgctggtggccgatgaagtgctggccaagcacgacgagaactacatgccgccggaagtcaccaaggcgctcaaggacagcggccaactgaagcactacgagaacggcaaggccgccggcgagacctcgtacaaccaggagggcaagtag

SEQ ID NO: 11111 - DNA, 1974 bp, Pseudomonas aeruginosa
atgatccccgaactcggccacctggccctgatcctcgccctctgcctggccctggtgcagtcgagcctgccgctggtcggcgcctggcgcggcgaccgccagtggatgagcctggcgcgcccggcggcctgggggcagttcgccttcctcgccttcgccttcggttgcctgacctgggccttcctgcgcgacgacttctcggtggcctacgtggccggcaactccaacagcgcgctgccctggtactacaagttcagcgccgtttggggcgcccacgaaggttcgctgctgctctgggcgctgatcctcggtggctggaccttcgccgtgtcgatcttctcccggcaactgccggaggtcatgctggcccgcgtgctggcggtgatgggcatgatcagcaccggcttcctgctgttcctgatcatcacctccaacccgttcagccgcctgctgccgcagacccggatggacggcgacgacttcaaccttctgttgcaggacgtcggcctgatcgtccacccgccgatgctatacatgggttacgtcggattttcggtggctttcgcgttcgccatcgccgcagtgctcggcggccgcctggacgccgcatgggcgcgctggtcgcggccgtggacaatggtagcatgggctttcctcggtatcggcatcgtgctcggctcctggtgggcttactacgagctgggctgggggggctggtggttctgggatccggtggaaaacgcttccttcatgccctggctggtcggcactgcactgatccactcgctggcggtgaccgagaagcgcggcgtgttcaagagctggaccgtgcttctggcgatcgccgctttctccctgagcctgctgggcaccttcctggtccgctccggcgtgctcacctcggtgcacgccttcgcctccgacccggagcgcggggtgttcatcctcgccttcctgctgctggtggtcggcggctcgctgaccctgttcgccctgcgcgcgccggtggtcaagagccaggtcggcttcgccctgtggtcgcgcgagaccctgctgctgctgaacaacctggtgctggtggtggcggcctcgatgatcctcctcgggaccctctacccgctgctgctcgatgccctcagcggcgccaagctgtcggtcggcccgccgtacttcaacgccatgttcctgccgctgatggcggcgctgatggcggcgctggcggtcggcgtgctggtgcgctggaaggacaccccgagccgctggctgctcggcatgctgaccccggtgctggtggccagcgcggtcctggcggcggccggttcgatgtacttcggcgatttcaactgggcggtgctggcggtgttcctgctgtccgcctgggtggtcctggccggtttccgcgacttcctcgacaagacccggcacaagggcgtgctggccggcgcccgcagcctgacccgcagctactggggcatgcaactggcgcacctgggcatcgccgtgtgcgccatcggcatcgtcctcagcagccagtacagcgcccagcgtgacctgcgcatgtcgcccggcgacaccgtcgaactgggcggctaccacttcctcttcgacggcgcgaagcaccacgaagggccgaactacacctcggacaagggcagcatccacgtcagccgcgacggcaaggagatcgccaccctgcatccggagaagcgcctgtacaccgtgcagagttcgatgatgaccgaggcagggatcgatgccggctttacccgcgacctctacgtggcgctcggcgagccgctggataacggtgcctgggcggtgcgcgtgcacgtcaagccgttcgtccgctggatctggttcggtggcctgctgatgggcctcgggggcgccctggcggcgctcgaccggcgctaccgggtgaaggtgaaaacacgtgtgcgcgaggccctgggcctccccggtcagggagcctga

SEQ ID NO: 11112 - DNA, 546 bp, Pseudomonas aeruginosa
gtcttgaaacgagcgattctgctgctgccgctggggatcttcctgatcgtcgcggtgttcctcttccgcggcctctggctggaccccagcgagctgccctcggcgctgatcggcaagccgttcccggccttcgacctgcccagcgtgcaggacccggcccggcgcctgaccgaggccgacctcaagggcaagccggcgctggtcaacgtctggggcacctggtgcccgtcgtgccgggtcgagcacccggaactgacccgactggccgagcagggcgtggtgatctacgggatcaactacaaggacgacaacgccgccgccatcaagtggctgaacgagctgcacaatccctacctgctgagcatcagcgacgccgacggcaccctgggcctggacctgggcgtgtacggtgcgccggaaacctacctgatcgacaaacagggcatcatccgccacaagatcgtcggggtggtcgaccagaaagtctggcgcgagcaactggcgccgctgtaccagcaactgctggacgagccggaggcccgatga

SEQ ID NO: 11113 - DNA, 1407 bp, Pseudomonas aeruginosa
ctcgcgcctgggccgggcggtcccgctggtcgcggcgctgctggtgccgttggtcgcgctcggcctgtacctgcattggggcgccagcgacaaggtcgagctggcccgcgaattcgcccaggcgccgcactccatggaagagatgactgcgcgcctggagcgcgcggtacaggctcagccggattccgcccagggctggtacttcctcggtcgcacctacatgacccaggaacgcggcgccgatgcagcgcgggccttcgaacgcgccgccgaactcagcgggcggcagccggaagtgctcggccagtgggcgcaggcactgtatttctccggtggcaagaaaatgaccgcgcagatcaaggccctggccgacgaggcgctgaagggcgacccggccgaagtgaccacccttggcctgctcggcatcgccgccttcgaagagcagcgctacgccgacgccatcggcttctgggagcgcctggtgtcggtgttgccgaacgaggacccggcacgctcggcgatccagggcggcatccagcgcgcccgcgagcgcatgaccgaggccgggcagactccgccggcgccggccgcgcccgctgccgccggggtgaccctgacggtgaaggtggatatcagcgacgcggtgaagggccaggtcaaggccgacgacagcgtgttcgtcttcgcccgcgccgtcggcggcccgccgatgccgttggcagtgaagcgcctgaccgtcgccgacctgccggccgaggtcagcctgagcgatgccgacgccatgatgccgcagctcaagctcagcggtttcccgcaggtcgagctggtggcacgggtatcccgcgccggcaacgccatctccggcgagtggatcggacgcggcaaaccgttgtctactgcccagtcgtcggcgcaagcgctgaccatcgacggcccggaccagccccaggcggcccggccataacgacaatcggttggggaggtgcggcggtgaaggcgaagtatctgggtctggcgattctcctgggcggtctcggcgggtgcgtggtgcatccgccgcagaccagcgaaccgccggcctcgctgccgccgcagagccagccgcagcccggtccgtccagcgcgcccggcgccaccccgccgcgcatcaccccgcaaccgcagactccggcgcagcccagccgctcgcgtccgcagttcgccccgccgccaggcggcaagggcgtctgggacggcagcctgggggtctacgtgatccgtggcgagcgcgatctctactaccgccagcgcacctactaccggtgggacggcggctggttctggtccaccagcccgcagggtccatggaccgagaccgacgctcgcggcatcccgcccggtctcagccggcgctacgccaatccatga

SEQ ID NO: 11114 - DNA, 1164 bp, Pseudomonas aeruginosa
ttctctactgcacctacggcaagctcagtccggcgttccagaagctttgaaacaggagtccgcatgcgcgctcgacaacttggcatcaccctcggcctgggcactcccggcccgttcaacgcgatcaccgacgttcccggcgtgcgcgtcggccacagcaccctgaaccagcggatcgacggcaggcaggttcgcaccggcgtcaccctggtccagccgcgcgccggtgcggcgcgcctgcaaccctgcttcgccggctgccatgtgctcaacggcaacggcgacgccacgggcctggagtggatccgcgaagccggcctgctgaccaccccgatcgccatcaccaatacccacagcgtcggcgcggtgcgcgacgcgctgatcgccgaggagcgcgccgaactcggcgacagcgggctgtactggtgcatgccggtggtgatggagaccttcgacggcctgctcaacgatatctggggccagcatgtcggcgcccgccaggtcggcgaggcgctggcctgcgccgagtccggaccggtccgcgaaggttcggtgggcggcggcaccgggatgatctgccacgagttcaagggtggcatcggtagcgcatcgcggcggctgccggcggagcagggcggctggacggtgggcgcgctggtccaggccaaccacggccagcgtcgcgagctgcgggtcgatggctatccggtcggccgccggctgggcgacatcccctcgccgttcagcgaggaaggcaccccgggcatgggctccatcgtggtgatcctggccaccgacgcgccgctgctgccgcaccagtgccagcgcctggcgcagcgcgcctcgatcggcatcgctcgcaccggcggtggcaccgaggactccagcggcgacgtgttcctcgccttcgccaccggcaaccaggacctgccgccagccgactatgcgcgcaaggacctgccgcagagcacgccgctgcggatgctcaacaacgaccacatctcgccgttgttcgccgcggcggcggaggcggtggaagaagccatcgtcaacgtgctgctggccggcgaggacatgcgcaccgaggacggccggctggtgcccgcgctgaagggggagacgctcctggcggcgctgcgcgagaccggctggccgggacgctga

SEQ ID NO: 11115 - DNA, 1392 bp, Pseudomonas aeruginosa
gtaaaacgaaccttcaaatcaacacgaaaaccaaattgtggcacgcgaaatgcgagtgttcgcttcggcggagcgaccggcgtggccggcctcccgaccagacaaccagaagaacgcatcccgctacgggagcctgccgaggggagaacgacgcagatggccgagttcggaaactatgtgatttacctgatcatgctgggtgcggtacttggcgcgctggcttccatcctgcgcccggaaagcggtctgggccgcgagttcgtcaacggcatccacgccatcggtccggtgttcctcgcccaggccggcatcatggtagccattccctatctgtcgaaggcgatttcccatgccctcggcccgttcttccagaccctcggttccgacgtatccatcgccgcgctgtcgatcatcgcggtggacatgggcggctaccagttggccgatgccctgaccgccaaccgcgacatgtggattaccgccatgctggtgggctacacctccggcgcgaccatcgtctacctgatcccggtcggcctgaccatgctcgagcgcaaggaccacaagtacctggcgctgggggcgatggccgggttgatcagcattccgttcgcggtgctggcggcgttgctgctgattaccctcaaccacatcccggtgcgcgaactggtatcgaccggttcgccggccctgcactacctgtcgctggacttcctcgacatgcttcggctgctggcgccgctgttcgtcttctgcttcctgctggccgccggcctgaagtaccgggcgacggcgatggtcaccgggttcctggtattcggcaaggtgatggacgcgttcatcaagatggccctggcgctttccatcgtccagcacttcaccggagtcttcaccaaggtcttcggcggctggggcttcgacccgatgttcgccgacgagaaagagttgttccgcgccatcgagatcgctggctacatcggcatcatgctggccgggaccttccccatctgctacctgttccagcgctactgcaagcgcccgatggcggtcctcggccgttacctggggctgtcccagccgggcgccaccgcctttgtcatggtactggcgaacatcatcgccacctaccacctgttcaaatacatgaatgctcgcgacaaggtgctttgcgtggccctgggcgtctgcgcccaggccaccatcggcgatcacctggcattcaccgccaacttccagccgacgctgatcctgccgatcctgctcggcaaattgttcggcggcctgctggcggtattcatcgccatccgcatctcggtgcctgccgccgagcgctatgcccggcaggagcaggagcatgacgaggcggaaaaaagcgccctgcacgcagcctga

SEQ ID NO: 11116 - DNA, 204 bp, Pseudomonas aeruginosa
accacctcgaagccgcctcggccgaattcgcgggcgatcatctcggcttcgttctcgaaggtcaccagtacgtcgccgatctggttctgcatgaaggtagtggtggcggcgcggccgccggtgtcgagcaccggtacctgcttgaacagtttgccgacgaactccttggccttgttctcgtcaccgccgttcttcagcacgtag

SEQ ID NO: 11117 - DNA, 513 bp, Pseudomonas aeruginosa
tcagttcgcgcagggccggccgcagcgcggccagcccggcatggtcgagccagtgctcggtgctggcggcgctggcggcctcgttgtcctggcgctgggtgtcgtagaccaggtcgtgggtccaccaccccagctccaccaggtccggccgcagcgccagttggcgccagcggtcgaagtgctccaggcaggcgaggatgtggcgatcgctgtggtagtgccggtcggccccgccataggccgccagcagcgcgtcgaaggcatccgccggcgggttgccgccgagtcgctgccagagggcgtcccagcgctgccggtcaagacttcccatggctgccttcctcgcgagggaacaacgggttgccgcagcggcagcagaatgccgcctgcacttcgtgggtcgccttgcggcacaccgggcaatcccgctgcaacaggttggccgggtcctggcgcatcgcggtggcgagttcggcggtgaagatcccggtgggcaccgcgatgatcgagtag

SEQ ID NO: 11118 - DNA, 1209 bp, Pseudomonas aeruginosa
gagtgtctcctggttctgtctgtcgagtggctccgcgcagggaggcgggagcgtcttgttcgtgggtgcggatcagacgacgttgtgcgtcttcatccagccgaggccggcttcggtggtggtggccggcttgtactcgcagccgatccagccctggtagccgatgcggtccaggtgctcgaagaggaagcggtagttgatctcgccggtgcccggttcgtggcggccggggttgtcggcgagttgcacgtggttgatcgccgccaactggttttccagggtgcgggccaggtcgccttccatgatctgcatgtgatagatgtcgtattgcaggaacaggttggcgctgccgaccttgtcgcggatctccagggcctggcgggtgttctgcaggtagaagccggggatgtcgagggtgttgatcatctccatgaccaggcggatgcctgcggcttccagcttgtcggcggcgtagcgcaggttgtcgacgaaggtcttctcgacgctggcgcagtcgtgcccctgcggccggatcccggcgaggcagttcacctggcggttgcccagcaccctggcgtaggcgatggccttgtcgaccccctcgcggaactcctggacccgatccgggtggcaggcgatgccgcgctcgcccttggcccaatcgccggccggcaggttgaacagcacctgctccaggccgttggcttccaggcgggccttgatcgcctcggcctcgacgtcataggggaagaggtactcgacgccggcgaagccggccttggcggcggcgtcgaagcgttcgaggaaatccacctcggtgaacagcatggacaggttggcgcagaaacggggcatgtcttgctcctatcgttcggtcaaacgttcgggaggcctttcgccgggggcggggtgccgcacgcaccgtccgcgcctccgggaaaggccggcgatcagtcgagcagcgagatggcggtcggcgcgtcggcgcctttctcggccagttcctcgaactcgttgatggcgttgatctcggtacccatggagatgttggtgacgcgctccaggatcacctcgaccaccaccggcacctggtgctgttgcatcagttcgcgggccttggccagggcggcgccgatctcgttcgggtcgaacacccggatcgccttgcagcccaggccctcgaccaccgcgacgtggtcgacgccgtag

SEQ ID NO: 11119 - DNA, 594 bp, Pseudomonas aeruginosa
aaccagcgtttgaaaaaatgtatacaaaattatgttcatattgttctggaatgttgctttcgtagggccggtcggctactaaattgggtacaaattttcgaacgcgcccgcatagcgggtggtttcccgatttctagccttaacaactcgagaggaacgaccatgaccaccatcagtctggaaaccgcgctgggcattacccgccaggcgctggcggtggggcgcgagctgtccaccgcgcccctgaccatcgcggtgctcgatgctggcggccacctggtggcgctgcagcgcgaggacggcgccagcatgctgcgaccgcagatcgccatcggcaaggcctggggcgccgtggccctgggcaagtcgtcgcggctgctggcggcggatgcgcagcagcggccttcgttcatttccgcggtgaacaccctggcccatggcaatctggttccggcgccgggcggggtgctgattcgcaacgacaaggcagaggtggtcggcgcggtcggtatcagcggcgatacctcggatatcgacgagcaatgcgcgatccagggcgtgctggcggtcgggctggtgcccgacgccggttga

SEQ ID NO: 11120 - DNA, 600 bp, Pseudomonas aeruginosa
aaggcaagcgcctggtctgcctggatatcccggacgactacgcctacatgcaggcggaattgctgcatctgctggagcgcaaggcggggcctttccttcggcgggactgagtggtgcggaccgcgagcggaaaaaagaagccggacgaagtccggcccgagggaagggcggaccgggagtgtcgccggtccgccagggagtcaggagtgcttgggcgccggcgcgtggctgccgcacaagtggctgcggtcgttgcggctgaggatgttgaacagcaggttcagcaccaccgcccagatcgcggtcatggcgatgccgctatgggtgatcggctccatccagaccggcaggcgggcaaagaagtccgggcgcaccaccggcaccatgcccatgccgatgcttaccgccaccagcaactggttgcggcggtcggtgatgttggcctcgtggaggatctggatgccgctggcggcgaccatgccgaacatggcgatgccggcgccgccgagtaccgccggcgggatcgaggcgaccaggaaggcggccttgggcagcatgctgaggaggatcaggaaaccggcggcggccaccgtgacgtag

SEQ ID NO: 11121 - DNA, 1158 bp, Pseudomonas aeruginosa
cggctgcgcaccccggtcatctgcaccaggccgatgttctgggcgaacgaggaatgggtgaaggtgttcaggaaaccggcgaagaacgaggcgccggcgtcgcagagcaggccgcggcgcagttcggtcggggtgatctcgcggccggtgatcttgcccagggcgaggaacatgccggtggactcgacgaagatgatcactaccaccagggcacatcgacaggatcggcgccaggtcgaaggtcggcgcgccgaagtgcagcggggtgacgatgtcgaaccaggggcgctcggccagaccgccgaggtcgaccatgcccatgccgccggcgatcgcgtagcccaggcccatgcccatcagcaccgagatgttgacccagaaaccgcgcatgaagcggttgatcaggaggatggtgcagagcaccaggctggagaggaacaggaagtgcagggagccgaagtcttccgcgcccttgccgccgccggcccagttgatcgccaccgggaacaggcacatgccgatcgaggtgatcaccgtgccggtcaccagcggtgggaagaaacgcacgatgcgcgacatgaagggggcgatgagcatgccgaagaaaccggcggcgatggtcgcgccgaagatcccggtgatgcccacgccgggcatcccggccatcgccaccatgctgccgacggcggcgaagctggcgcccatcatcaccggcatgcggatgcccatcgggccgatgcccagcgactggaccagggtggcgatgccggcgaccagcaggtcggcgttgatcaggaaggcgatttcctcgcgcgagaggccggccgcctggccgacgatcagaggcacggcgacggcgccaccgtacatcagcagcacatgctggaagcccaccagcagcagctgcgtcagcggcaggcgctggtctacgggcgagtcggggatgcggcgatcagttaccacggacatgcaacacctcaggcgtttttattgttgtcagtcgcaggcggacaccggaaaaggcaggttccggcggccgggtatttctggccgaacatccaccccaggcttcagggcgatgcggtggggtgttttatatccccgttgtgtgctcgattcaatcgattttttgtatacaaagtaattttttgtagttga

SEQ ID NO: 11122 - DNA, 183 bp, Pseudomonas aeruginosa
cgttctatccacagctttatccaccaaaaagttgcacaatggcttttggattgtgaggctgaatggtcggagtattttctgcctctgcccctatccaaacaacgcttcagcacgggtagtctgattgtccaaacgttcaccaagcccagccggtacaagctcacctttccaccgtatgcgtga

SEQ ID NO: 11123 - DNA, 672 bp, Pseudomonas aeruginosa
acccgctgctcacggcattcctcgaaggagacaggtcatgcaactcaaagatgccaagctgttccgtcaacaagcctacgtcgatggcgcctgggtggatgccgacaacggccagaccatcaaggtgaacaacccggccaccggcgagatcatcggcagcgtgccgaagatgggcgccgccgagacccgccgcgccatcgaggctgccgacaaggccctgccggcctggcgtgcgctgaccgccaaggagcgcgccaacaagctgcgccgctggttcgacctgatgatcgagaaccaggacgacctggcccgcctgatgaccatcgagcagggcaagccgctggccgaggccaagggcgagatcgcctacgccgcctccttcctcgaatggttcggcgaagaagccaagcgcatctacggcgacaccattcccggccaccagccggacaagcgcatcatcgtgatcaagcagccgatcggcgtgaccgcggccatcacgccgtggaacttcccctcggcgatgatcacccgcaaggcgggcccggccctggccgccggctgcaccatggtgctcaagcctgcttcgcaaaccccgtattccgcgctggccctggccgaactggcagagcgcgccggtattccgaagggcgtgttcagcgtggtcaccggtag

SEQ ID NO: 11124 - DNA, 807 bp, Pseudomonas aeruginosa
cggccagacctgcgtctgcgccaaccgcctgtacgtgcaggacggcgtgtacgacgccttcgtcgacaagctgaaggccgccgtggccaagctgaacatcggcaacggcctggaagccggcgtgaccaccggtccgctgatcgacgccaaggccgtggccaaggtcgaggaacacatcgccgacgcggtctccaagggcgccaaggtggtttccggcggcaagccgcacgccctcggcggcaccttcttcgagccgaccatcctggtcgacgtgccgaagaacgccctggtgtccaaggacgagaccttcggcccgctggcgccggtgttccgcttcaaggacgaggccgaggtcatcgccatgtccaacgacaccgagttcggcctggcgtcctacttctacgcccgcgacctggcccgcgtgttccgcgtcgccgagcaactggagtacggcatggtcggcatcaacaccggcctgatctccaacgaagtggcgccgttcggcggcatcaaggcctcgggcctgggccgcgaaggttccaagtacgggatcgaggactacctcgagatcaagtacctctgcctgggcggtatctgagcccggcgaggaacgcatccggaggggccggacggcaggcaagagctgcgccgtccggtgtcgacgttgccggtggtggcaccggacgaaccgggagacgcggtcgccgatcgcgaagcggctccgagccctggcgggcctgcaagtcccgaggcagtcgatcatcgcatgctgccttggggagcttccttcccgccttcatcctttga

SEQ ID NO: 11125 - DNA, 1647 bp, Pseudomonas aeruginosa
tcctgctctcctgcggcacctactacaacgtcatccgcttcctcatgcccgtcaccatccccgacgcgcaactggagaagggcctggccatcctggccgagtgcttcgacgaactcgcttaagcttcaccggcaaagcgatacccccgaggcccgcgcgtccgcgcgggcctttctttcagaggcttcacggaaacggaagcctcttttttctgccagggttttccgcgaaacgcccgacgaacggttttcgcctgttacccttgggcgcctggcgcatacgaatcctcccgcattcctccggtcgttccgttcgtggcgattaggacaggtcctagaggcgcaccgtgttcgtccgtcatacccttgtgtgcccgcgggccgtgtcgtgcccgcctgtcatgcctggtgcgtcccgctcggttcgccaggttcgaagaggaacgccatgagtgccgcgaaaaaggcccccgtcatcctgattgccgacccggacccctggagtcgcgacttgcttggccaactggtcctcggcgtgcgttgcgatgcccggctggtcctctgcggcgatggcggagaagcgctggcgcattgccggcgccggcgcttcgcgttgatcctggccgagctgaacctgccgcaggtggatggcttcgagctgctgcgcgaagcgcgcctgcgccgctcggtcgccgagcagccgttcatcctgatcagcgaccgcgccgaccaggccagcgtgcgcgccgccgtggcactggcgccgaccgcctacctggtgaagccgttccaggccgagaacctgatgcaacgcctgcgagggttgttgctgaagggcgacgaagtggtcgcctgtccgctgccggagcgggacgcgggcgagaacctggaggctttcctcgaacgcgcgcgcgactccgcggagggggcgccgttgctggccgacgtgcgtgccgccagcgatcgttgcctgagcgccgaggagcatccgctgcgcgtgctggaggatgagttcggccgcgatccgcagatcaccgctggcctgatcgccgccgccaacagcgccgcccggcacgtcggtccggcctgccagaccctgggccaggccctgcggcggctgggactcgggcacagcctgaacctggtgctcggtttcagcctgcagcgggccatccagctcggcgagccgctgctggccgagcgcgccatgcacttctgggatctttcgcaacgttgcgcggacatcgcctgggaactggccgacgccctcggcgcggacgtcgagcgctgctataccgcagggctgctgcatcgcctgggcgacctggcgctgctgcggacattgcaggattggtgcgatggcggcggcgcgctggacgaggcgcggctcgacgagctgctggggcgtttcggcgccagcttcggctcggccctgcgggcgcgttggcggctgccgctggagctgcgccggctgatcgctgcggcgtaccagttcggtggcgtgctttcccgcgaagagctgatcctcagcctggcgacccaggccgccagcctgcccgaggacaacgcggagcaactggccgagagcaaggctgcccgcatgctcggcctggacggcgaacgactggcgaaactgctgcagccctga

SEQ ID NO: 11126 - DNA, 213 bp, Pseudomonas aeruginosa
acatgcatgccaacgacgcgcgcaaggccggcgagaccgagcagcgtctgcaagcgctctgcgtctggcaggaaaccccctacttcaccccgcgcgagcgcgctgccctggcctggaccgagcaactcgcccgcctcagccagggggcgttgccgcacggcctgctcgacgaactgcgcgagcacttcgacgacaaggagatcgccgaactga

SEQ ID NO: 11127 - DNA, 795 bp, Pseudomonas aeruginosa
ccctggcggtctcggccatcaacgcctggaaccgcttcggcgtcggcatgggcatgcaagcggaatgaggtggacggcgatgaaggccaatcgatcgatcgcctgcctgctgctcgccgcgctgccgacgctggccagcgcccatgttgcggagaaggtggaaaccctgcacgaccaggccctggccgagattcccggccatcgtgggttgatgctgacggtgtcgttcaagcccggccaggtctccgcgccccatgtgcatcccggctcggtgttcgtctacgtgctcgaaggcaccgtgcagacgcaactggaaggcggcccggtggagacctacacggtgggccagagctggtacgagccggcgaacgtgccgcacctgctggcacgcaatcccgatccgatgaagccggccaagttgctggtctgggagttgctcaaggagggcgacccgatcctcaagccactggagcgcggcgcccactgaggcgtcgctcgttcgcccggaggagcgtccgtcatgagcgccagccaggtcatccgtattcgcgcgcgcaacggtcagtcggaacggcttggcctgcgcctgcaacaactggtcgaaccggggctggaggcgccgggttgcctggagtaccaggtgcgcagggacgccctcgagccggatctctggctggtgtgcagccagtggcgggaagcgcagcagatgttcgactacctggccggcggcatccagcaggtattcgccgaagtgctctggcgctccctggcggcgagcctcgaagtgcaggatga

SEQ ID NO: 11128 - DNA, 648 bp, Pseudomonas aeruginosa
agctgccgaggctgtcgcgcagcagcccggcgatccatggcgagaccccggcgatcaggtagccggcgccttgtaccagggcagccagttgaccggcgcgttgcggcgcgtcgaagtggtcgaggcagacgatcaagcccatggggaacagcccgccgatgcccagtcccagacacagcgcccagagcagcggcaggctggccggcgcccatgcgaggccgaggaagccggccagcatcagcgccgttagcccgaccagcaccgggcggcgatcccgcgagcggctggccatggccggcgcgagcaacccggagagcacctccatggccgtcaggaaaccgagcagcagcccggattcctgggcgctccagccctgctccaggtaatagggcgcgagccaggccagcacgcaggtgtagcaggccgtgccgaggccgaagaacaggaccagcagccaggtccgcggatagcgcaggaagctcctgcccggctgcgcgtcgggcaggcgcaggcgggtgccgggttgcagccaccaggccagcagcgcgagcgcggcgagcgccgcccaggcaccgaggccgatccgccagccggcgtgctccgccagggtcggcgcggcgctggcggacagcgccgcgccagccatga

SEQ ID NO: 11129 - DNA, 888 bp, Pseudomonas aeruginosa
gggcgatcagtgggatcagggcgtggaggtcgacggacatgcgggttcttccttgtctcgggctggcgcgaacgggcgatggcggccagtatctctcgtcgtcgacaggcaatgtttcatccggaggtgaagcatgcaattcaatcccggcttcagttcgctggcggcgctgctcgccgatcccggccgcgcgcagatgatctgggcactgatggatggcagcgcccgcccggccagcgagctggcgctgctggcgggcgtctcgccgtcctccgccagcggccacctgggacggctggtcgagggcggcgtgctgagcctggaggcgcgcgggcgcaatcgcttctatcgcctggccgggccggaagtgggacaggcggtggaagcgctggccagcgcctccctggccctgcagccgcagcggcgcagcctgccgccgagccacggcacgccgtcggcgttgcgcgaggcgcggacctgctacgaccacctggccggcgaactcgcggtcggtgtgttcgcacggatgctggatgccggctggatcgagcaggagggcaggacgctgcgcctgagcgcgaccggcgaggccgggctggccaggttgggaatcgacctgtcggaggtccgccgccgccgtcggcagttcgcctgcgcctgccccgactggagcgaacgcaagccgcacctcggcggcgcgctgggggcggcgttgctggaggcctgtctgcgccagggctggttgcggccgcaggacggctcgcgggcgttgcaggtgtcgtcgaagggccgcgcgggactgcgcggcctggcggagcgcacggcgggctgaacccgccgcgggatcagagattggccaccggctggaaggccttcggcttgaagtag

SEQ ID NO: 11130 - DNA, 639 bp, Pseudomonas aeruginosa
agcggcagcaggaggaacagggcgaagaccagccaggccaggacgatcagggccaggcggccgccggcgttgccgcggcgggaggcgctggcggtggcagcggaaatgcttgcactggacatggcgccctccttacggggtttcgatgcgacgctgcagcaggttgatcagcagcagcaggatgaaggacaccaccagcatcagcacgccgatggcggtggcgccggtgtagtcgtactggtccagcttgaccatgatcagcagcggcaggatctcggtcttcatcggcatgttgccggcgatgaagatcaccgagccgtattcgccgacgccccgggcgaaggccagggcgaaaccggtcagccaggccggcagcagcgccggcacgaggatatggcggaacacctgcagcggcctggcgccgaggcaggcggcggcttcctcgacttccttgggaatgtcggcgagcaccggctgcaccgtgcggaccacgaacggcagggtcacgaaagtcagcgccagggtgatccccaggggggtataggcgatcttgaagccgaggtcgctggcgaactggccgaccaggccggccggcgcatagagcgcggtgagggcgataccggcgacggcggtgggtag

SEQ ID NO: 11131 - DNA, 450 bp, Pseudomonas aeruginosa
atctggtcgaaaatgcccccgtcgttgaagaacttcggctgggccgtcttccagccgccgaaatcggagtcgacggtgaccaggttcagtttcgggaactgcgtggcgaactcggcggcgaccttctggttgcgcggccggtataagttctgcgcggcgatgcgctggccttcctcgctgtacaggtattgcaggtacgcctcggcgaccttgcgggtgcctttcttctcgaccaccttgtcgaccaccgcgaccggcggttcggcaaggatggagatggagggtacgacgatctcgaagttttccccgccctgttccttcttcgccaggaacgcctcgttctcccaggccagcagcacgtcgccgatctggttgttgacgaaggtgatggtcgagccgcgggcgccagtgtcgagtaccggtacgtgcttgtacagcgcctgcacgtag

SEQ ID NO: 11132 - DNA, 1044 bp, Pseudomonas aeruginosa
ttgccgagtcggccgcgcgaagcgcctgacggcgttccgccggcctggctttggcgctataacgaaggcggaccgaacgccatgggggcgggaatgctgggcaacctcaacgacatcgacctgcgcatgctgcgcaccttctgcgccatcgtcgaggccggcggcttcactgccgcccaggcgcgcctgaacaccagcctgtcgcgcctgagcgtgctggtgcgcgacttggaggtgcgcctgggctattccctgtgccggcgcggcaacggcggtttccagttgaccgaggaggggcaggagctctacgacgccgcgctcggcctgttcagcgacatcgcccgtttccgcgagcaggtccgcggcctcggcgggcgcgatcgcgaggcgttgcacctgggctgcgtcgatggcgtcatcggccagcattgcctgccgttgccgctggccatccggctgtttcgccagcgcgccccggaggtgctgctcaagctgcacacgcggcgtcccgacgaactcgagcacgcggtgctggaagagcgcctgcaactggcggtgggggcctttcaccaccggttgtccgggctctactaccaacccctgttccgcgaggagcagaacctctattgcggcagcgcgcaccccttcttcgcccgggcggacgacgagccgacactggacgagatctgcgccgccgactatgtcggccgcggctacatggcggaaaaccatcgcccgcacgacctgcgcttcaaccaggggaccgacgcctacaccatggaggccatcgctaccctggtcttcagcggcacctacatcggctacctgccgacgcactatgccgccacctgggtcgccgaagggcgcatgcgggcgatccggccacggcaactggcctacgactcggaattccattgcattacccgtcagggacacgaagaacgaccgaccctgaccctgttcctgcgctcgctgttcgaggcgcagaaacaactgggcgtgcaggctccggcgaatacgaacggcatcgctcggcaattgtga

SEQ ID NO: 11133 - DNA, 417 bp, Pseudomonas aeruginosa
ctccaccgacaaccgcagcctgagcatcgccggcgccaacggcagcagcgccagttcgcgcgacagcaacaagttctactacgcgggtggcgactacaaggtcaacaaggacctgaccctgcagtactactacggcaacctggacgacttctacaagcagcacttcctcggcctgatccacaactggcagattggcccgggcgtcctgaagaccgacctgcgcgccttcgacagcagctccgacggcaagaacggcagccgttccggccgtgccgacggctacgtcagcagcggctactacggcagcggcgtgaccaagggcgaagtcgacaaccgcgccttcagcggcctcttcacctataccgtcagcggccacagcatcggcgccggctaccagatcctcaacggcgacagtga

SEQ ID NO: 11134 - DNA, 1641 bp, Pseudomonas aeruginosa
cttcccgttcctgaaccgtggcgatggcgaaggttctaccgcgtacctgatcaccgacgtgcagatcggcaagttccagcgtgccggcgagcgcacctggcaggtccgctacggctacgacttcgccaccgtcggcgtgccgggcctgaccttcaataccatttacctgagcggcgacaagatcaagaccgcccgcggcgaccagagcgagtgggaacgcgatatctccctggcctacgtgatcccggacggcaccttcaagggcctgggcttcacctggaagaacgcctccttccgcagcggcctgccggctgccggttcgagcaacaaccagcgcgaccaggacgagaaccgcctgatcgtcagctacaccctgccgctgctgtaagctccggccggacaggaaaaagcccgcgtcctcctggaggacgcgggcttttttcattcatggcgccactcggcgtgccgggccggccagggcgaacagcgccgcggctggccatccgccctgcgggatgcccgtcaggccttgcgcggcgccggttgctgctgggtgatgcaatggatgttgccgccgccgaggaggatctcgcgccccgggaccatcaccacctcgtgctcggggaacacgcgctggaggatcgccctggcctcggcgtccttgggatcgtcgaagctcggcgcgatgatgccgccgttgacgatcaggaagttcacgtaggagccggccaggcgaatggagggatcgcgcggctggctgccctcgacgatatccacgccgtcgcactcttcctgggtcgcgtacagcgggccggggatcggcatcttgtgtaccaccagcttgcgtcccttggcgtcgcggctttcttccagcacgcggagggcggcctggcagcgcaggtagttcgggtcgtcctggtcgtcggtccaggccagcagcacctcgccgggacgcacgtagcagcagaagttgtcgacgtggccgtcggtctcgtcgttgtagaggccgttcggcagccagatgatgctctccaccgcaaggtagtcgcgcagggtccgctcgatctccgcctggctcaggtgcgggttgcggttgtggttgagcaggcattcctcggtggtgatcagcgtgccttcgccgtcgacgtggatcgagccgccctcgaggacgaagtcgtcggtgcggtagcgggcgcgccgttcgatctcgaggatcttgcgtgccacctggtcgtcgcgctgccaggggaagtacaggccgccttcgaagccgccccaggcgttgaagccccagtcgacgccgcgtacatcgcccttgtcgtcgatgacgaaggtcgggccggtgtcgcggacccaggcatcgtcgctgctgatttccacgacgcggatgttgccgtcgtcgaggcgtgcgcgcgcgttctcgtactgcccggcgctggcgcagacggtgaccggctcgaagcgcgcgatggccttggccaccgcggcgaaggccgcctgggccggcttgccgccgttgcgccagttgtccgggcgttccggccagaccatccaggtctgctcgtggggttcccattcggcgggcatgcggaagccgtcggcgcgtggggtgctggtcgggttgctcatcgctgctcctga

SEQ ID NO: 11135 - DNA, 783 bp, Pseudomonas aeruginosa
tttccccatcccgggcatcgtccacatcgcccagccctactggtacggcgagggcggcgacatgtcgccggacgagttcggcgtctgggccgccgagcagctggagaagaagattctcgaagtgggcgaggaaaacgtcgccgccttcatcgccgagccgatccagggcgccggcggcgtgatcgtcccgccggacacctactggccgaagatccgcgagatcctcgccaagtacgacatcctgttcatcgccgacgaagtgatctgcggcttcggccgtaccggcgagtggttcggcagccagtactacggcaacgccccggacctgatgccgatcgccaagggcctcacctccggctacatccccatgggcggggtggtggtgcgcgacgagatcgtcgaagtgctcaaccagggcggcgagttctaccacggcttcacctattccggtcacccggtggcggccgccgtggccctggagaacatccgcatcctgcgcgaagagaagatcatcgagaaggtgaaggcggaaacggcaccgtatttgcagaaacgctggcaggagctggccgaccacccgttggtgggcgaagcgcgcggggtcggcatggtcgccgccctggagctggtcaagaacaagaagacccgcgagcgtttcaccgacaagggcgtcgggatgctgtgccgggaacattgtttccgcaacggtttgatcatgcgcgcggtgggcgacactatgattatctcgccgccgctggtgatcgatccgtcgcagatcgatga

SEQ ID NO: 11136 - DNA, 294 bp, Pseudomonas aeruginosa
ccttggcgggctctgtggccggtatggcgcaggctgcggacaacaaggtgctgcacgtgtacaactggtccgactacatcgcgccggacaccctggagaagttcaccaaggaaactgggatcaaggtcgtctacgacgtctacgacagcaacgaagtgctggaagccaagttgctggcgggcaagtccgggtacgacgtggtggtgccgtccaactccttcctcgccaagcagatcaaggccggggtctaccagaaactcgacaagtccaagctgccgaactggaagaacctga

SEQ ID NO: 11137 - DNA, 1122 bp, Pseudomonas aeruginosa
aaaggcccggaacaggagtcggacatgcaacattccattggcaagacactgctggtagccgctctggctacggcgatcgcgggccccgtgcaggcggagaagaagagcctgcacatctataactggaccgattacatcgctcccaccaccctcaaggacttcaccaaggagagcgggatcgacgtcagctacgacgtcttcgactccaacgagaccctcgagggcaagctggtctccggccactccggctatgacatcgtggtgccgtcgaacaacttcctcggcaagcagatccaggccggtgccttccagaagctggacaagagcaagctgccgaactggaagaacctcgatccggcgctgctcaagcaactggaggtcagcgacccgggcaaccagtacgcggttccctacctgtggggcaccaacggcatcggttacaacgtggccaaggtcaaggaagtcctcggcgaccagccgatcgactcctgggccatcctcttcgagccggagaacatgaagaagctcgccaagtgcggtgtggccttcatggacagcggcgacgagatgctgcccgccgccctcaactatctggggctggaccccaacacccacgacccgaaggactacaagaaggccgaggaagtcctgaccaaggttcgcccctacgtcagctacttccactcctccaagtacatctccgacctggccaacggcaacatctgcgtcgccttcggctattccggggacgtcttccaggccgctgcccgcgccgaagaggccggcaagggcatcgacatccagtacgtgattcccaaggaaggcgccaacctgtggttcgacctgatggcgattcccgccgatgccaaggccgccgataacgcctacgcgttcatcgactacctgctgcgtccggaggtgatcgccaaggtcagcgactacgtcggctacgccaacgcgataccgggggcccgcccgctgatggacaagagcgtcagcgacagcgaggaggtgtatccgccgcaggccgtgctcgacaagctctacgtttccgccgtgttgccggccaaggtgctgcgcctgcagacccgtacctggacccggatcaagaccggcaaataa

SEQ ID NO: 11138 - DNA, 1209 bp, Pseudomonas aeruginosa
gttcaaattccgcccggtagcgtgaccgggctcaacgacttgggagttgtggtaatggcgatagcctccggtgcctacaagaaagccctagagggcaaccagcagccgaaagaggtgctggtaaagatcgaccgggtaaccaagcagttcgacgagacgctggcggtggacaccgtgtccctgaccatcaacaagggcgagatcttcgccctgctcggcggctccggttcgggtaaatccaccctgttgcgcatgctcgccggtttcgagcggcccaccgaggggcggatcttcctcgatggccaggacatcaccgacctgccgccctacgagcggccgatcaatatgatgttccagtcctatgcgctgttcccgcacatgagcgtggcgcagaacatcgccttcggcctcaagcaggacggcctgcccaaggccgagatcgacgagcgcgtggccgagatgctcaagctggtgcacatgacccagtacgccaagcgcaagccgcaccagctctccggcggccagcgccagcgggtggccctggcccgttcgctggccaagcggccgaagctgctgctgctcgacgagccgatgggcgcgctggacaagaagctgcgctcgcagatgcaactggaactggtggagatcatcgagcgcgtcggcgtgacctgcgtgatggtgacccacgaccaggaagaggccatgaccatggcccagcgcatcgccatcatgcacctgggctgcatcgagcagatcggcagcccgatggacatctacgagaccccggcgagccgcctggtctgcgagttcatcggcaacgtcaacctgttcgacggcgtgctggtggaggacgtgcaggaccatgcggtgatcgcctgtccgcagctggagaacccgatctacatcggccacggcatcagcacccgcgccgaggacaagcgcatcacctacgcgctgcggccggagaaagtgatgatcagcgcgcagaagccggacaacctggaacacgccgggcacaactgggcccagggcaccgtctacgacatcgcctaccttggcggccactcggtgtactacatcaagctggcctccgggatgatcgtccaggccttcatggccaacgccgagcgccacgtcacccggccgacctgggaccagtcggtgtacatcagctggtacgacgacagcggcgtggtactgcagtcatga

SEQ ID NO: 11139 - DNA, 672 bp, Pseudomonas aeruginosa
ggatcggcaagaaatagccctggtccccgccatacgggcgctggagcgctaccgcgaggcctaactccggttgggtggagggcgggtttccccggtgcttcccggctactgttaccgggcgtgaccatcggcgagcggcgggctactctgtgtgcctgtcaaaggggtggagcatccatgcagaaggttctggtcagccgttgcctgctgggccacctggtgcgctacgacggtggcagccatggcccgttcgacctgctctcgcgctggcatgcgcaggggcggatcgtcgccctttgcccggaggtcgccggaggcctgccgacgccccgcccgccagcggatatccccggcggccagggcggcgaagtgctggaccggctgaaccgggtcttcaccgtcgacggcgaggatgtcagcgaagcattcctgctgggtgcggaggcggcagtggagctggtccgccgccatgacatccggatggccgtgctcaaggcgcgcagtccttcctgcggcaacctggagaactacgacgggcgcttcaacggcaaccgggtcgccggcgagggcgttaccgccgccgccctcaagcgcatgggcgtgctggtattcaacgaggatgaactggaccgcgccgcggtctgcctggccggcctcgacgccggcggctga

SEQ ID NO: 11140 - DNA, 597 bp, Pseudomonas aeruginosa
ccgaccttctcgttggtttgcaggtactggccggaaacgttgatgccgttgtcggcgaagaccttgttgatctcgctcatcacgccggggatgttggcgtggatgtgcagcaggcggtgcttgcccgggtgcgacggcagggcgacttcggggaagttgaccgaggacaccgaggtgccgttgtcgctgtacttgaccagcttctccgccacttccaggccgatgttggcctgtgcctcggcggtggagccgccgatgtgcggggtcaggatcacccggtccaggccacgcagcgggctggcgaattcctcgtcgttggatttcggctcgaccgggaacacgtcgatggcggcgccgatcaggtgctcgtccttgatcgcggcggccaggtggtccagctcgaccactgtgccgcgcgcggcgttgatcaggatgccgcccttcttcatcgcgcggatttccttctcgccgatcatccactgggtggagggcagttcgggaacgtgcagcgagacgatgtcggacatgcccagcagctcgtgcaggctgccgatctgcaccgcgttgcccagcggcagcttggtcacggtgtcgtag

SEQ ID NO: 11141 - DNA, 387 bp, Pseudomonas aeruginosa
cctggacccatcgaaaccaactacgaggcgttacccatgaaacttcgtcacctgcccctcatcgctgccatcggcctgttctccaccgtcaccctggccgccggctataccggcccgggcgctaccccgaccaccaccacggtgaaggccgcgctggaagccgccgacgacaccccggtggtcctccagggcaccatcgtcaagcgcatcaagggcgacatctacgagttccgcgatgccaccggcagcatgaaggtggagatcgacgacgaagacttcccgccgatggaaatcaacgacaagacccgggtcaagctgaccggcgaagtcgaccgcgacctggtcggccgcgagattgacgtcgagttcgtcgaagtgatcaagtaa

SEQ ID NO: 11142 - DNA, 531 bp, Pseudomonas aeruginosa
gcggcggtgaagaagctggcgaggaacttgccgccggccgccagcatcacttcgttggccgccgactcggcgtcctggaatacgctgccggggaacaccagttggctgaagaccgccagcacggtgaacagcaggccggcgccgaccgtggtgatgacgatggcgcgcgggatgtcgcgttgcgggtcgcgggtttcctcggccagggtcgagaccgcgtcgaagccgaggaacgacaggcacagcaccgccgcgccggccatcaacggggcgaagcccggctggctgccgtcgccgacgaagggcaggctcaggtccagcgaggggatgccggccaggtgcttgaccgccatggcgacgaacaccacggcgaagacgaactgggcgccgacgatcacgttgctcatgccggccaccgagctgatgccgatcacgttgagcacggtgaccaggccgatcgccgcgagcacgaagacccaggccggcaccatcgggaaggcgatgttgaggaacaggccgatgagcaggtag

SEQ ID NO: 11143 - DNA, 1089 bp, Pseudomonas aeruginosa
aggtccagagtggattgcggccgttcatggctggcctccgccggcgttggcccggaagcgcaggttgtagatcagcatcgccagcaggacgaaggccagcagggcgaacgaaagggcggcgccgaacggccagttgtgcgcggtaccgaattgcagctggatcaggttgccgatcatcagcgccttaccgccgccgagcaattccggaatgatgtagctgcccagggccgggatgaataccaggatgcagccggcgactatccccggcatcgccagcggcacgatcacccggcgcagcgctttccagcggttggcgccgaggtcgaatgccgcctccaccaggcgccagtccatcttttccaggctgctgtagatcggcagcaccatgaacggcaggtaggtataaaggaggccgatgatcaccgcgttgtcggtatagagcagccccagcccggtgtcggtcaggccgatgccttgcaggccggcgtccaccagcccgccgttgcgcagcagcaggatccaggcgtagacccgcaccagcaggttggtccagaacggcacggtgaccaggaacagcagcaggttgcgccggcgttccggctgcaacgccaggtacagcgcggtggggaagccgagcgccaggcagccgagggtggtcagcagcgagagccagaacgagcgctggaagatgcccaggtagtcggcgttgaacaccaggctgtcgtccaggtcgcgttcccagaggaaattgaggtaggcctccaggctgtgctggccccatttcactccgccgtagtcgccggattgctggatcgacacggcgaacatgatgcccagcgggatcaccaggaacagcaccagcatcagcatcgccgggctgctcagcagcaggcgccgacgcagctgccggcgttcggccgactgttgcgcggtaggtcggccggcggtgctcattcggcgagcacccggatggcggcggcgggaatccgcacccgcaccttcgcccccggactgtgcgggcagcgtgcgccgtcgcggttctgctggcgcacgcggaagcccggctgtccggccacgttcaggtggtag

SEQ ID NO: 11144 - DNA, 414 bp, Pseudomonas aeruginosa
atgtcgctgggcgtgccgacctgcaacaccttgcccttgctcatcaccgcgatgcggtcggacatggtcagcgcttcctcctggtcgtgggtgacgaagatgaaggtgatcccggtctcgtgctgcaggcgcttcagctcgatctgcatttccttgcgcagcttcaggtccagcgccgacagcgactcgtcgagcagcagcaccttgggccggctggccagcgcgcgggccagggcgatgcgttgctgctggccaccggacaactggtcggcgcggcgcttgccgacctccggcagcttcaccaggtcgagcatgcggctcacggtggcgtcgatctcgctgcgcgggcggccctgcatctccaggccgaagccgatgttgtcggcgacgctcatgtgcgggaacagcgcataa

SEQ ID NO: 11145 - DNA, 414 bp, Pseudomonas aeruginosa
tcgccgagcagatgcacgccggcgcgcctggactccggatcgccaggcatgtcgaaaccgctgtccggcgagacctcgccctccgcgcccacctcgccgtcgaagctgcctaccggccggttgctgccgagcagggtcagccagcggcggtcgtgcaggcgggtcagtgcctggtgctggcgctgcaactggtcttccatctgccgcgccagggcgccgccggaggcggtggaggccagcaggtcggcgttggtcagctccagcaccaggcgcgtcagcaggcgggaaaagtcgcgcatgcgttgctcgatgcgctcctggccgagggcgttggtcagtacttccttgttgtcctcggccgggtcgtgccaggttgagccgccgggaatcgccgggttgtcggtctgctcgtag

SEQ ID NO: 11146 - DNA, 1620 bp, Pseudomonas aeruginosa
  unsure (301): Identity of nucleotide at the above locations are unknown.
actccgggcttccgtgaagtccgccgaaccgcctccgatgctcgaacaatacgtcaagaagatcctcacctcgcgcgtttacgacgtcgcggtggaaacgcccctgcaacccgcccgccagttgtccgaacgcctcggcaaccaggtcctgctcaagcgcgaggacctgcagccggtgttttccttcaagatccgcggcgcctacaacaaggtcgcgcagctcaccgaggaggagaaggcccgcggggtgatcgccgcctcggccggcaatcacgcccagggcctggccctggcggccaancggcaggggatcagggcggtcatcgtgatgcccaagaccacccccgagatcaaggtccaggcggtgcgcgcccacggcgccaaggcggtgctgcacggcgacgccttccccgaggctctggcccacgcgctgaagctggtcgacgagaagggctacaccttcgtccatccctacgacgatccggacaccatcgccggccagggcaccgtggccatggagatcctccgccagcagcccggccgcctcgatgcgatcttcgtcccggtgggcggtggcggactggtcgccggcatcgccgcctacgtcaagtacctgcgtccggagatcaaggtgatcggcgtcgagccggacgagtcgaactgcctgcaggcggccatggccgccggcgagcgggtggtgctgggccaggtcgggctgttcgccgacggcgtggcggtggcgcagatcggccagcacaccttcgacatctgcaaggaccacgtcgacgaagtgatcaccgtcagcaccgacgagatctgtgcggcgatcaaggacatctacgacgacacccgctcgatcaccgagccggccggcgcgctggcggtggccgggatcaagaagtacgtcgagcgcgagcgcgccgaggggcagaccctggtggcgatcgactccggcgccaacgtcaacttcgatcgcctgcggcatgtcgccgaacgcgccgaactgggcgagcgccgcgaagcgatcatcgcggtgaccattcccgagcggccgggcagcttcaaggccttctgcgaggcggtcggcaagcgccagatcaccgagttcaactatcgctaccacagcggcagcgaggcgcacatcttcgtcggcgtgcagacccacccggagaacgacccgcgcgaggcgctggtggcctatctgcgcgagaagggcttcccggtcctcgacctgaccgacaacgaactggccaagctgcacattcgccacatggtcggcggccatgcggtgaaagtcagcgacgagatggtgttccgcttcgaattccccgagcggcccggcgcgctgttcaacttcctcaccaagctcggcgggcgctggaacatctcgatgttccactaccgcaaccatggcgcggccgacggccgggtggtggccgggttgcaggtgccggaagacgagcgccacctgatcccgcagaccctggaggcgatcggctatccgtactgggacgagaccgccaacccggcctaccagctgttcctcggctgacccgcggcggctcgccgacacgggctgctaagcttcacgggcaggtgatctccttcctcgggaactga

SEQ ID NO: 11147 - DNA, 519 bp, Pseudomonas aeruginosa
gcccgcccccggcccctcaaacgggccgggaacacggacaaggatgcgctgatggaacattttctccagatcaagattctccacggagtcgccaccgtgctgctgttcggcggcctgctcggcctggcgttctacgcctggcgcagctggcggacgggcgacgcggctcgggtcgcgcgcggtttcaagcgggtccgcctgatcggctggccgctgctggggctcagcctgctggccctgccggtcagcggctggtggctggtgcacctggccggctggccgttgggccagagctggctgctgttcggcgcctgcctctatctgctcggctgcatcttctggctggtcctcgccggccgcctggcgcgggtccagcaccaggccggcgccgccgagacggcgggggccgcgctgggcgagcagaccctgcgcgagatcaaggtgggcctggtcatggccctgctcggtgcggccagcttcatcgcggtggcggtactgatggtcagcaagccgctctga

SEQ ID NO: 11148 - DNA, 843 bp, Pseudomonas aeruginosa
tggtggccacgctctggctgctgggcgacgaacctcgagccagggaggcccgtggatgaacctttacctgctgctgaaaaccctgcatatcctttcctcgaccattctcttcggcaccggcctggggtcggcctactacgccctgcgcgcctggcgcagcgggcagttgccggtgatcgcggtgaccttccgccacctggtcgccgccgactggctgttcatcgccaccaccgcggtgttccagccgctcagcggcctggccatggtgcatgtcgccggctggtcgctggcccagggctggttgctgtggagcctgggcctctacgtgttcgccgggctctgctggctaccggtggtgtggttgcagatccgcgtacgcgacatggccgaggcggccttgcgcgaggcgcggcccatcgaaccgctggcgtaccgctacatgaacgcctggttcatcctcggctggccggccttcatcgccttcatggtcatcttctacctgatggtcaacaagccggtctgagagtcccctcggcgcaaccagagcaacgccaggaccaggaacgccagggagccgccccagtacaaccaggcgaagccgccgggccgctccagcaggaggaaggccagggccgggcccagcgcggcgccgaggtcctggacgatggagtagcgggtcatgaagccgaccacgtcgccggcgcgggcgacgtcggcggcgagggcgtcggtcagggtggtgagggcggtggcgaccagcatcaccagcagggcgatggccagccaggcgagaatgggcagcctgctggaaagcaggccgaagcccattgcgccgaccagtag

SEQ ID NO: 11149 - DNA, 501 bp, Pseudomonas aeruginosa
gtcgaaacccttcgccagcagcggcaggccgagcagtgccaggatcgcgaaggacagcgccagcgccggcaggccgaggaccggcaccagcagcccgccgagcagcatgccgaccaggctgcccaggcggtagaggccgttgtacaggcccatggcgcggccgcgctggtggtcggcggcgcagtagaccaccgccgagagcccgccgatgcggaagaacgaccagccgatcccccacagtccgcgcagcagcacccaggccaggaaaccgctggccaggccgtagccggcggtgctcaacacgccgatgacgaccgccaggagcaggccggtcttcagtgccaggtgcttgtacaggcggccgatcagcggattgaagggcaggcggatcaggcggttgatcgacagcagcacgccgacctgccagagcgcctccaggccgacctcgtgccagtagatcggcagggcgatataaagcatcgaatcgccggccaggcatag

SEQ ID NO: 11150 - DNA, 597 bp, Pseudomonas aeruginosa
  unsure (319),(364): Identity of nucleotide at the above locations are unknown.
cctaccggcttttgccggccctgtatcctccccgcacgagtcgcaaagccgcgcgttgccgctatcacaagctttatggaacaatgcgggcacatgcgatttcgaggatgtcccagcgtgatcgattccgatggttttcgcccgaatgtcggcatcattctcgccaacgaggcggggcaggtgctgtgggcgcggcgtatcaatcaggaagcctggcagttcccgcagggaggcatcaatgatcgcgaaacgccggaagaggcgctgtatcgcgaattgaacgaagaagtcgggctggaggccggggacgtgcgcatcntggcctgcacccgcggctggttgcgctaccgtttgccgcagcgcntggtgcggacccacagccagccgctgtgcatcggccagaagcagaaatggttcctgctgcggctgatgtccgacgaggcgcgcgtgcgcatggatatcaccagcaagcccgagttcgacggctggcgctgggtgagttactggtaccccctgggacaggtggtgaccttcaagcgcgaggtctaccgccgcgccctgaaggaactggccccgcgccttctggcgcgggactga

SEQ ID NO: 11151 - DNA, 825 bp, Pseudomonas aeruginosa
cggcgtcctggtgctggtggcgaaggacgaccggcgcatgcgcatcgaagtcggctatggcctggaaggaacgatcaccgacatcgatgccgggcggatcatccgcgaatacatgacccctgcgttccgtcagcaagactacgccggcggcctggaagcggcggcgcagcgcctggtacgactgatcgacggcgaggcgttgccgccgccgccgcgcgacccgctggagcccggcgcggtacggcagaccctggctatcgcattcctgctcggcgctctcggcggggtggcgctgctggtacgtccgcgcgcctggtactggaccctgggggcggtagtggcgctcgctgcggcgttggcactggggcggcactggccggcaggggcgatggtggcgctggcggagatggtggcggtcctgggcgtcggcttcggcgcgttgctcaagtattcgcgcggtgcccgctggttcttcgccattcttgtgctctatgcgcaggggctgttctgggcctacagccgttatggcctgccggtgctccattacggattggccgtgccgctttcgctgggactgaccctgctgatgctggccggtgcctggcaggggctgcgcagaggacggcgctgggcctacctgccgggcctgctcggcctgctgctgaccctggccctggagtgcctgctgttgctggtggacgacccgctgaacagcatcgaggcgctgatcatcctgcccgccgcttgcctgccgctgctcatcggttgcaatttcagcgccggcggctcggggggagggcgtcgacgcggcggcgattacgctag

SEQ ID NO: 11152 - DNA, 798 bp, Pseudomonas aeruginosa
cggcctggtggcacaactgccgtcgctgctgctgtcgactgcggcggcgatcatggtgacgcgggtctccagttccgaggacatgggccagcaggtcaaccggcagatgttcgcctcgcccaaggcgctggcgatttccgcggcgatcctgatcgccatgggcgccgtgccgggcatgccgcatgtttccttcatcggcctcggcgccctggccggcgctgccgcctactggatctggcaccggcagaacaaggccaagcaggtcgccgagcaggaggtgcagcgccagcaggagctgctgccggcgcagcgcgcccaggaggtcaaggaactgggttgggacgacgtcaccccggtggacatggtcggcctggaagtcggctaccggctgatcccgctggtcgaccgcaaccagggcgggcaactgctggcgcggatcaagggcgtacgcaagaagctgtcccaggagctgggcttcctgatgccctcggtgcacatccgcgacaacctcgacctgctgcccaacgcctaccgtctgaccctgatgggggtcagcgtggccgaagcggagatctatcccgatcgcgagctggcgatcaaccccggccaggtattcggcagcctcaacggcatcgccggcaaggacccggccttcggcctggaggcggtatggatcgagcccggccagcgcgaccaggcgcagtcgctgggctacaccgtggtggatgcgagcaccgtggtcgccactcacctgaatcaggtgctgcacaagcacgcccacgagctgctgggccatga

SEQ ID NO: 11153 - DNA, 1302 bp, Pseudomonas aeruginosa
ggggttcgggcaatgcaagtcaaacgcttcttcgccgccgatatgcgccaggccatgaaactggtccgcgacgaactgggtccggacgccgcgattctcggcaaccgccgggtcgccggcggcatcgagctgaccgcggcgctggattaccaggccccgccggcgccgagcaagcccaacccggcgctggaagtggagctgcgcaagacccaggcgcggatcgccgaggcgcgcgccgagttgacggcgcgtccggcggaaaaccagcgcaaggaccgtcaattgttcgccgaggagaagccggcgcgtccgtccctggccgagtccatgacggcggcgcaggccaagccccaggcgggcggccagaccctcgaggcaatgcgtttcgaactgaacggcctgcgcgagctgatcgaggtacaactgggctccatcgcctggggccagttgcagcaccagcgtccgcagcaggccaatctctggcggcgcctgcagcgcatgggcttgccggcggagctgagcaagccgttgctggagcgggtcgccgcggtgggcgatacgcgccaggcctggcgcatgctgttggcgcacctgtcgcgtgccgtgcagacccccgagcaggacccgctcgatgcgggcggcgtactggccctggtcggcccggcaggtgccggcaagaccaccaccctggcgaagatggccgcgcgctacgtcctcaagtacggcgcccagagcctggcgctggtgagcatggacagctaccggatcggcgcccaggagcagatcaagaccctcggtcggatcctcaacgtaccggtgaccctggtcgatcccggccagtcgctgatccaggccctggcgccgctggcgcgcaagcgcatggtgctgatcgataccgccggcctgccggccagcgacccggcattgcgcatgcagctcgaggcactggcgtcgccgagcctgaacgtgaagaattacctggtgatggccaccaccagccagagccaggtgctcaagtcggcctaccagacctatcggcactgcgggctggcgggttgcatcctgactaagctggacgaggcgggcagcctcggtgaatcgatggcgctggctatcgcccagcgtctcccggtagcctatctggcggatgggccgcggattccggacgacctgcaggtggcgcgcagtcaccaactggtcagccgggcggtgagcctgcaggcaccggaagagcccagcgaggacgccatggccgagatgttcgccgggctctaccagcaaccggcgcggcgtgccggctga

SEQ ID NO: 11154 - DNA, 948 bp, Pseudomonas aeruginosa
cggaagcgaaggtggcttccgccgggccgggagcgatggcgcatcgttcccgccaataccggagagcgctggaaggggcgttccgggaagacgacaacacaaggtatgaagcagatgggtagcatgcatcccgtacaggtgatcgcagtaactggcggcaagggcggcgtcggcaagaccaatgtgtcggtgaacctggcactggctctggccgatctcggccgtcgcgtcatgctgctggatgccgacctcggcctggccaacgtcgacgtcctgctgggactcacgcccaagcgcaccctggccgacgtgatcgagggacgctgcgaactgcgcgatgtcctcctcctcggtcccggtggcgtgcgcatcgttcccgcggcctccggcacgcagagcatggtgcacctctcgccgatgcagcatgcggggctgatccaggcgttcagcgatatcagcgacaacctcgatgtcctggtcgtcgacactgccgccgggatcggcgattcggtggtcagtttcgtccgcgccgcgcaggaggtgctgctggtcgtctgcgacgagccgacctcgatcaccgatgcctacgccctgatcaaactgctcaaccgcgaccacggcatgacccgcttccgggtcctggccaacatggcccacagcccgcaggaaggacgcaacctgttcgccaaactgaccaaggtcactgaccgtttcctcgacgtcgcactacagtatgtaggtgtcatcccttacgacgagtcggtacgcaaggccgtgcagaaacagcgagccgtatacgaggcattcccccgctcgaaggcgtccctggccttcaaggcggtcgcgcagaaggtcgatagctggccgctgccggccaacccgcgcgggcacctggagttcttcgtcgaacgactggtccaacaccccgcgacaggttcggccgtatga

SEQ ID NO: 11155 - DNA, 378 bp, Pseudomonas aeruginosa
gcctcgaagattactacggcatcctcagcgacacgcagggcagccgcctgtacagcttcgacgacctgttgcaggacggcgaacatggattgccggaagacaccagcctcagtcacaacgaaccgatccacggcctgctcgacgaacgtttccaggcggccctggcggatgccatcgccaagttgccggagcgcgagcgcctggtgctggcgttgtattacgacgaggaactcaacctcaaggagatcggcgaggtactgggcgtcagcgaatcgcgggtcagccagttgcacagccagtgcgccgcgcgtttgcgcgcgcgcctggccgattggcggtcggcctgaaccggcctcgaccgcagcttgtaaccgttaa

SEQ ID NO: 11156 - DNA, 513 bp, Pseudomonas aeruginosa
cgcaaaagaatgtgtggcgcgtcccctggggcgcgctctggtctgtacggaggtttacttggacaagaacatgaaaattctcatcgtggacgacttttccacgatgagacgcatcatcaagaacctcttgcgggacttgggcttcaccaataccgccgaggccgacgacggcaccacggcgctgccgatgctgcacagcggcaatttcgactttctcgtcaccgactggaacatgccgggcatgaccggcatcgatctgctgcgcgcggttcgcgccgacgagcgcctcaagcacctgccggtgctgatggtcaccgccgaggccaaacgcgaccagatcatcgaagctgcccaggccggggtcaacggctatgtggtcaaacccttcaccgctcaggtcctgaaggaaaagatcgagaagattttcgagcgggtcaacggctgaagccggccaagagggtgtcatggtgcttggtaacgattccacgggcgacgaattcgaatcgaccctga

SEQ ID NO: 11157 - DNA, 681 bp, Pseudomonas aeruginosa
ggccggcgagattctcgagcaattgtccgagcaactggtcgagctggagagccggccggacgatatggacctgctcaatgccattttccgtgggttccatacggtcaagggcggtgccggcttcctccagctgaacgcgctggtggaatgctgccacattgcggaaaacgtcttcgatatcctgcgcaagggcgagcggcgcgtcagctccgaactgatggatgtggtgctgcaggcgctggatacggtcaacgcgatgttcgaccaggtgcgcgagcagtccgaaccgaccccggcgacgcccgagctgctggcggcccttgcccgcctggccgagcccgagggcgccgagcccgcggaacctgtgcaagcgccgccggcggccgttccgccagccgagcctgcggcgccgccggaagcgcccgcgcagagtgcctccagcgatatcaccgacgacgagttcgagcagttgctggatgctctgcagggcgacgaagcgccggcctccgccgttgcagaagcgcccgcggctcccgctggcgacgagatcagcgacgccgagttcgaggcgttgctcgaccagttgcacggcaagggcaagttcgtcccgccggcggtctcggccgagcctgcgcaagtccccgccgaggcggtcgagccggccgcggctgccgctggtga

SEQ ID NO: 11158 - DNA, 1116 bp, Pseudomonas aeruginosa
ggagtagctatggcagtcaaagtcctggtggtggacgattcggggttcttccgccgccgtgtctcggagattctctccgccgatggacagatccaggtggtcggcaccgccaccaatggccgcgaggccatcgagcaggcgctggccctgagacccgatgtgatcaccatggattacgagatgccgctgatggacggcatcaccgcggtacgcaacatcatgcagcgttgcccgaccccggtcctgatgttctcctcgctgacccacgagggcgcgcgggtgaccctggatgcgctggacgccggagcggtcgactacctgccgaagaatttcgaggacatctcgcgcaacccggacaaggtccgccagttgctctgcgagaaggtcctgaccatcgcccgtagcaatcgtcgctcgatcagcctgccgccgctgccttcggccacctcgtccagccatgcgccggcgtcgtcctccagcctcggcgcgagcgcgcgtgccagtgccggcgcgtcgccggccccggcgtcgacctcggcggcgccgaagcgcaaggcctaccggctggtcgcgatcggtacctccaccggtggaccggttgccttgcagcgggtgctgacccagttgccggccaacttcccggcgccgctggtactgatccagcacatgccggcggccttcaccaaggctttcgccgagcgcctcgacaagctgtgccggatcagcgtcaaggaagcagaggacggcgacatcctgcgtcccggcctggcgctgctggcgccgggcggcaagcagatgatggtcgacggccgcggcacggtgcgcatcctccccggcgacgaacgcctgaactacaagccctgcgtcgacgtgaccttcggctcggcggccaaggcctacaacgacaaggtcctggcggtggtcctcaccggcatgggcgccgacggacgcgagggtgcgcgcctgctcaagcagggcggcagccaggtgtgggcgcaggacgaggccagttgcgtgatctacgggatgccgatggccgtggtcaaggccaacctggcggacgcggtgtacgggctcgacgacatcggccggcacctggtcgaggcgtgccagtaa

SEQ ID NO: 11159 - DNA, 1044 bp, Pseudomonas aeruginosa
tcgcctaccgcgccttgctcaagcatctgctggcgcagcagccggccacccgggtggcctgatggcgcgccggtcgccgcgccgacaggcgcattcaagccgcaccggagtgcggccgataaccgttgtagacccctgtcgcggaatacccacatgagcgccgccaccgccacccgttcgcaactggccttgcagtcctacctggatgcgttgctccaggaggccactttcgaggacctggaacctctcgtcgagacgccgccagcgcctgcgcccgcgccgttgaagcctgtcgcgctggcggtcgccgaagtggcgacaccggccccggcgctggaaacgctgccggtcgaccacgggttcgacgagttcgaggccgcggtgctcgaggagcaggtccgcgatgcgcgcctggttccgccggcgccggcggccctgctcgacgaaccgacgacgttgcgcgagctgccggtcgagccacggccccacgaagtcatcgagttgcgcgtgccgagcgccccggcgagcgtcggcgagccgccgctgctcgacctgccgctgctcgacgacggtcgtccggcctgggcggcggagcccttcgagtgcctgctgttcgacgtcgccgggctgaccctggcggtgccgctggtgtgcctcggctcgatctatccgctggagaaccaggaactgaccccgttgttcggccagcccgactggttcctcggcatcctgccgtcgcaggcgggcaacctgaaggtgttggacaccgcacgctgggtgatgcccgaacgctaccgcgacgactatcgcgacggcctcaagtacgtgatctcggtccagggctacgagtgggggctggcggtgcaccaggtgagccgctcgatccgcctcgacccggccgaggtgaaatggcgcagccagcgtagccagcggccctggctggccggcacggtcatcgaacacatgtgtgcgctgctggatgtggcggcgctcgccgaactgatcgccagcggcgccgtcaagcgcctgcacggcgaccattga

SEQ ID NO: 11160 - DNA, 522 bp, Pseudomonas aeruginosa
acagcttccgccacttgcggcggttttcgagaggttaggggaatgagcaaagccaccgcgcaaagcgccgaagatccgatcctgcagtgggtcacctttcgcctggacaatgagagctacggcatcaatgtgatgcaggtccaggaggtgctgcgctacaccgagatcgccccggtgccgggcgcgccgagctacgtgctgggcatcatcaacctgcgcggtaacgtggtcacggtgatcgacacccgccagcgcttcggcctggaccctgcgccggtcagcgacaacacgcggatcgtcattatcgaggcggacaagcaggtggtcggcatcctggtcgacagcgtcgccgaggtggtctacctgaagcagtcggaaatcgagaccgcgccgaacgtcggcaacgaagagtcggccaagttcatccagggtgtctgcaacaagaacggcgagctgctgatcctggtcgagctggacaagatgatgaccgaggaagaatggtcggagctgggcagcatctga

SEQ ID NO: 11161 - DNA, 438 bp, Pseudomonas aeruginosa
tgcgttctaccgacacgagggcctgctgagatggaggtcgtcgcgctggcactggcgctcgccgcctgcctcggcctggcggcggcgtgcctgtggctgcgccgtgaattgcgccgcctgcaagctgcgctggcgcagcaggcggaggagggcgccgcgcgcgagcgccggctcaaggagctgagcaagcgcatcgagtcctaccagcaggtcaacgtgcgcatgggcgaggccttgcaggacctcggcaagcaactcgcgccgcttcccgaccgggtcgcgcgcctggagcagcgcgatccgaccacgctgtcgttcagccaggccgcacgcctggtcgggctcggcgccagcgccgaagacctgacccaggcctgcggtctgtcgcaggccgaggccgagctggtggcgcgcctgcacgaagccaagggcaagtga

SEQ ID NO: 11162 - DNA, 1020 bp, Pseudomonas aeruginosa
gggggatataggctatattcggtcctgatttttccggtggatcgaaaaatgtccaagcccacggtgcgcgtgctcgccctgctcgaactgctgcagagccacggccagctcagcggtagcgagctggccaggcgcctggaggtggatggacggacgctgcgtcgctatatcgtcgccctcgaggagctgggcatacccatctcggcggagcgcggacgccatggcggttaccgcctggtggccggtttcaagctcccgccgctgatgttcagcgcggaggaaaccctggccgtgtccctcggcctgctggcggtgcgcagtctcggcctgggcgaaagcgagctggccctggaaagtgcgcaggccaagctgagcagggtgatgcccgttgcgctgcggcggcgcctcgtggcgctccgcgagaccgccagcctggacctggcccgcgcccgggcgggaaccagtgtggcggcgctggcgaccctcgccgaagccgcccaggtccgtgcgcgggtcgagttccgctatcgcgacccgcagggcgccgaaaccctccgccaactcgatccctacggcctggcctatcgcaacggctgctggtacgtcagcggtttctgccacctgcgccaggcgttgcgctcgttccgtctcgatcgcctggacgcgccgcgcatgctggcggagcgcttcgagcgaccggcggatttcgataccctccgccacctgcgggagagcttcgcccggatgccgcgcgcctacccggtggaaattctgatgcgggcggcgagggagcaggtggtcgcggtgctcggcgagcccctcggtctgctcgccgaggtcgatggcggtacgctgttgcgcgccagcaccgacgacctggactggttcgcccggcgcctgtgcggcctgccgttcgacttcgaggtcaggcagccgctggagttgcgcgagccgttgaggcgccaggccgagcgtgtcctgcgtaacctgggccaggaggaagcttcggatcacaggtag

SEQ ID NO: 11163 - DNA, 507 bp, Pseudomonas aeruginosa
gcatttagaggaaaagtcctattaattgcgcggctgtcgctttctagaatcggtcctggtcaacccgcacgtttccaggaggccacaaggatgcctgcaatacccctgcgcgccatggtgctgtgcgccaaccccggccgtctgctcaggtacggagcgctgttcaaccgctgcggctacttccacctgagcctgtgcctggaccgacgggagctgcggcgctccctggaccagggttacccgtacgactattgcctctacgacggattccgcctggaccagggctgcaagggcacgctggcgatgctgggacgcagcggcagcatccggcgcttcctgctggtgggcgaactcgattgccgcgagaagcgtctgttgttcgagtggagcagaggccatggcctgagcatcggcgcggtgtccgaccggcctttgggccaggtcgccctggctgcgttgatcaagcgtgatcgcggctgccccgacctcctgcgcggcatcgcctga

SEQ ID NO: 11164 - DNA, 780 bp, Pseudomonas aeruginosa
ggcggcttccgggaagatgaggtaaggtcgttttccaaccttccatggcgagacagcatgaccgtccaggccgacatcctcaaggcgatcgaaggcatcgagcatggcttccagcaagccggccaggcactctccgaacggatattccattgccggcaggtgcatggcgccgagatcgtcgacgcgcgctcgttgtcggaatcgggacggcatgccgccgacggtgttttcagcgaagggccgctggcggtcgcggtggtcaccgcggactgcctgccgattctcatgagcagtcgcgacggtcgggtggtggccgccctgcacggcggctggcaggggctcgtcgccggtatcgtcggcgcggcggtggcgcgcttcaatgcgcgcggcgtcgccagcgcggacatccgggtcgccatcggtcccgggatcaaagcctgctgctacgaggtgagtgccgggttcatcgaggcgttgcaggtcggccacggccgcctctgggagggcgcggtgccgccctggagccagcgtcgtccgctccccgagcggccaccccggttcgctccgcccgagccaaggcaggcggagcagggcgcctggctggacctggtggccttctgtcgccagttgttccaggccgccggcgtcgggccggcgcagatcgaagccagcgccgtctgcacctactgttccggcgatgcgttcgccagtcatcgccgacgccagcgcctgggcgaggagaagcgtcagcagtacgcctggatcgcgcgcaagccgtga

SEQ ID NO: 11165 - DNA, 936 bp, Pseudomonas aeruginosa
catcacccaagccgccatcgtcaccggcgcctcccgcggcatcggtcgcgccattgcccggcggttggccgccgacggtttcgcggtcgcggtcaactatgccggcaaccagaccatggccgacgaggtcgtggccgaaatcgtcgccgccggcggcacggccatcgccgtacagggcgacgtggccagcccggaggacatggacaagctgttcgaagccaccaggagcgccttcggccgcatcgacgtggtggtcaacagcgccggcacgatgccctacctgaagatcgccgacggcgacctggagggcttcgaccgggtgatccgcaccaacctgcgcggcgccttcatcgtgctcggcctggctgcccggcatgtcgagcgcggcggacggatcattgccctgtccaccagcgtgatcgcccgggcgctgcccagctacggtccgtacatcgcgtccaagtccggggtcgaggggctggtgcacgtgctggccaacgagttgcgcggccaggacatcagggtcaacgcggtggcgcccggcccggtggccaccgagctgttcttcaacggcaagagcgccgaacagatcgaccagatcgccaggctggcgccgctggagcgtctcggcgaaccggacgagatcgccgcggcggtgtccttcctcgccgggccggacgggacctgggtcaattcccaggtgctgcgggtcaacggcggtttcgcctgagccgtgtgggcggggcacgaaaaagccggcgcgaaggccggctttttcgtggtcgccactggcggtcagcggtcgttcttggtcgaagagccgatggcgttgctcaagcccttgctgttgtgatcgccgggggtggtggcggagatcgcgctggcctgcgacagcccgcggctgtcgcgggagctggcgatgccggaggtggctga

SEQ ID NO: 11166 - DNA, 831 bp, Pseudomonas aeruginosa
tgccgcgcctgtcaaacaggctggccgcgtcgtcaccagtatagcggccgtgtttatcccgactttagggtctgttccgtgaaggcctccggcgccgcgacgaggaaagacgcttggcgatgttgttcgatgtccgatcctgctgaagtccccacagccagccccttgctggaaaccgtcgggctcgcctgcgagcgcgactggcgcatgctgttcgagcgcctcgacctgcgcctggccgccggtgagatgttgcaggtggtgggtcccaacggcagcggcaagaccagcctgctgcgcctgctgtccggactgatgcagccgaccgccggggaagtccgcctgaacggccggccgctcgccgaacagcgcggcgaactggcccgcagcctgctgtggatcggccacgccgcgggaatcaagggcctgctcagcgccgaggagaacctcacctggctctgcgcgctgcaccagccggccagccgcgaggcgatctggcaggccctggccgacgtcggcctgcgtggcttcgaggacgttccctgccacaccctttccgccggccagcaacgccgcgtggcgctggcccgcctgtacctggacgcaccgcccttgtggatcctcgatgaacccttcaccgccctcgacaaacagggggtggcgcaactggaaacgcacctggccgggcattgccagcgcggcgggatggtggtgctgaccacccaccacagcctgcagcagatgcccgccggctaccgcgagctggacctcggtgcgctcaaggcggccagcggcgcgacggtcgagccggcgctgggcgacccggcatga

SEQ ID NO: 11167 - DNA, 474 bp, Pseudomonas aeruginosa
ccgcgacagcgcggccaaggcctgtgccgtactggccatcgtcggcgtggtgaacatcccgatcatcaagtactcggtggaatggtggaacaccctgcaccagccggccaccttcaccatcaccgagaaaccggcgatgccggtggagatgtggttgccgttgctgatcatggtcctcggcttctattgcttcttcgcggccatgctgctggtgcgcatgcgcctggaagtgctcaagcgcgagtcccgcaccacctgggcgaaagccgaggtgaaggccctggtggagaaggcacgatgagcttcgaatcgttcggcgacttcctcgccatgggccatcacggtccctacgtctggtcggcctacggcatcagcctgctggtgctggcgatcaatgtcgccgagccgctgctggcccggcgccgctacctgcaagaagaggcgcgtcgtctgcgccgggaggcccagcagtga

SEQ ID NO: 11168 - DNA, 1416 bp, Pseudomonas aeruginosa
tttcgttcgctacaagccgccggtcaacgagcgtacctggctgctctggttcggtccgggcgccttgctgctgttcggcgtgctggtgatcggcgtgatcgtcctgcgccgccggcgcaccgctgccaaggtgcaaaccaccctgtccgccgaggagcaagcgcgcctcgccaacctgttgaagaacgacaaatgatcgatttctggctcgctgccggcctgctgctgctggcggccctggcattcctgctgattccgctgctgcgtggccgtcgcgcccaggccgaggaagaccgtaccgccctgaacgtcgcgctttatcaggagcggatcgccgagctggccggccagcaggccgccggcacgctgaccgccgagcaactggagaatggccgcgccgaggctgcccgcgaactgctcgccgacaccgagggcagcggcgaagagcgtagctcgcgcctgggccgggcggtcccgctggtcgcggcgctgctggtgccgttggtcgcgctcggcctgtacctgcattggggcgccagcgacaaggtcgagctggcccgcgaattcgcccaggcgccgcactccatggaagagatgactgcgcgcctggagcgcgcggtacaggctcagccggattccgcccagggctggtacttcctcggtcgcacctacatgacccaggaacgcggcgccgatgcagcgcgggccttcgaacgcgccgccgaactcagcgggcggcagccggaagtgctcggccagtgggcgcaggcactgtatttctccggtggcaagaaaatgaccgcgcagatcaaggccctggccgacgaggcgctgaagggcgacccggccgaagtgaccacccttggcctgctcggcatcgccgccttcgaagagcagcgctacgccgacgccatcggcttctgggagcgcctggtgtcggtgttgccgaacgaggacccggcacgctcggcgatccagggcggcatccagcgcgcccgcgagcgcatgaccgaggccgggcagactccgccggcgccggccgcgcccgctgccgccggggtgaccctgacggtgaaggtggatatcagcgacgcggtgaagggccaggtcaaggccgacgacagcgtgttcgtcttcgcccgcgccgtcggcggcccgccgatgccgttggcagtgaagcgcctgaccgtcgccgacctgccggccgaggtcagcctgagcgatgccgacgccatgatgccgcagctcaagctcagcggtttcccgcaggtcgagctggtggcacgggtatcccgcgccggcaacgccatctccggcgagtggatcggacgcggcaaaccgttgtctactgcccagtcgtcggcgcaagcgctgaccatcgacggcccggaccagccccaggcggcccggccataa

SEQ ID NO: 11169 - DNA, 1833 bp, Pseudomonas aeruginosa
aagatcgccagggcgttgtcgaacggcaggtgctggcgcagcagcaggatcaattgcttccagaaacggttgccgccgatctgttcgatggcgcggcccaggctggcgtgcatgccgatgtcccggaacagggtgtgcatccgtattcgctccacggtgggttttcgcaggctccggtttgcggcttttccacccgccgcgtcaaggggcgcaaccccaaagggtgattggcccgccggttccgcgctcctagagtcggcgcataaccagcgccccggcaaggggccgccgcgagtctccgttactgcctcaacttcaataacaatcagaggacaacgacatgagctcttcccccgcgcccgaaagtgcgctgaaacccacgctgggcgtgttcgacgtggtcgccatcaccgtttccgcagtcactcccgccagttccgtcttcgtcatcgcccccttcgccatccagcaggccggcaccggcgctttctgggccttcgccctggccggggtgctggcgctgatgttcgcctggtgctatgccgagctgggcagggcgcacagcaccgccggcggcgagtatgtctacgccaagcgggtgttcggcggcttggccggctacgccaccttcctcacggtgctggcgatgctgctgttcatcccgccggtgctcgccaccggcgcggcgacttacctgaacgctgccctcggcacccacttcgatgcgcagaccgtggccctggcgatcgttgccttcagctacctgctgggcatcctcaacatccgcgtcaacgcctgggtcacgggtacctgcctgctgctggaagtggcggcgctgctggtgatcgtcggcctcggtttcggccatgtacagcaaccggcgagcgtccttctgcagccgcaggtagtcggcgacggcgggctgctggcgatcgcaccctgggcattggtgatcggagcggtcggtaccgcgctgttctcctacaacggtttcggcggcgcggtgctgctcgccgaggacatgaaggacggcggtcacagcgtgcatcgcgcggtgctctggtcgctggcgctggtagtactgatcgagatcgtcccgctcgccgcgctgctgatcggcgcgccgtcgctcccggcgatgctcgccagccccgacccgatcggctacctgttgaacagccatggcaacgagacgctgtcgcgcctggtcagcgccgggatcttcctctcggtgttcaacgccatcgtcgccatcgtcatccagagcgcccgggtgatcttcagcagcggtcgcgacgcgctctggatgccggcgttgaaccgtgccttcacccgtatccatccgcgctgggaatcgccctggctggccacgctgttcctcgccattccctcggcggcgctgagcttcagctccaacctggccgaactgacctcgttcaccgtgttgctgatcgtcatggtctacctgatcgtcgccctctgcgcgctgttcagccgggtgctgcggcgcgaccgcgagcatccctaccggatgccgctgtggccgctgccggcgctgccggcgctgctggcggtgagcggcgcgggatacctgctgctcaacctgttcctggcggcctcggccagggacgtgatgatcattgtcggactgctggcggtgtcggtgattctctactgcacctacggcaagctcagtccggcgttccagaagctttgaaacaggagtccgcatgcgcgctcgacaacttggcatcaccctcggcctgggcactcccggcccgttcaacgcgatcaccgacgttcccggcgtgcgcgtcggccacagcaccctga

SEQ ID NO: 11170 - DNA, 2643 bp, Pseudomonas aeruginosa
cgtcgggttatatgcagggtaaatatcaaaaactgctttgcttattacccgctcgagcctatgccgcggccggcgctttggccagcgctagtcgaggccgctgaccgccaggtccttgggatactccacgctgaacttcagggtggcgctgcgtttctcgccgggttgcagggtccagtcccacttcagcttgccgtcgtcctcgcgcttgacttcctgcgccttgggttccagcaaggtgacctggatctgctcgttgcgcgagaccggcaactggtcctcgaactgcacgcgttcggcgttcttgtggttgttgcgcacgtcgatgcggaattcgtagttgacccgcgtgcggttgccgatcaggccgctgctgtcggtatagcgcttgaccagcttgcgttcgatgccgatgccctcgtcggcgcccagtgccagttcgaagctctcgccgggcatcaccccgcgcagatggccgctggcgacgaagctgttgccgagaaaggtattcagggtgccggggagcagcgggtagtcgctgtcgttgcgggtctccgcctccaggtaggcggtttcgcgcagggccggggccgccagatagcgcagcttggccggcatttccaggcgggcgatggtgaccttctgcgcgctgccgtcgctgttcagggtcgccggcacggggatgtggaaagaggcgctggcggcgccgctgctgacctccgcggtggcgagccgcgcctcggccagcttcggcgccggggccggcatggccatcttcgccgaggtcctggcgatgggcgcggcttgcggcatgggcgccggaacgtcctgcatggccatctcggcaccgtagtaggcgttgggcgcgtcgatgtcgacgatccagggattcagccgcggtacgttgccgcccagggccggacgggcggtggagagggtcaggtcgacgtcggtccagtcttcgccgctgctctgccggaccaggccctggtaggtcagttcgatggtattcgcgccgtcgcgcaggcgtgcgtcgtaggtcggctgccaggaggcgtcgcgcagggtgtagtcgagcttcacctcgacctgtgccggttgctccagggcgacccgcaggaccgcgcgcttgaagcgcttgccgtcgccgttgagggtgccgcgctgctcctgcaactgctgcttgcgctgttccagttcggcggcgcggtcgtccagctggcgctgctcggcgagcaggcgttcgaggttgccttcggtcagttgcagcaggcttttcagctcgtcgatgccgggcatggggcgatccttgccgggctgggtgctgccgctctggatgtcggcgaggaacttcttctgcgcttcgagcacgctgccgcggtcatggatttcccgcagttgccggtctatctcgcgcagttgctggtcgagctgctgcacacggttgtcgtccgggcgctcgacccgttgcgcggcgctgctgacgtcgagcagggtggcggcggcgctggcgccgagggacgcgcgcaggctggtgtcgtcgagctggaagggcagttgctccagggcgatctcatgctggcccttgggcaattgcaggcgggcggtgcgggtgaccacggcacggtcggcgtagacggtgaccgcgctgatgcggctgtcgaccgcttgtggcgcggccagcaacggagcgctggcgaacaggccggcgaacaggagcggagaggcggcgagtcgattcacgatatctcttccttgggcggatggaggggcgaggaacccgtgcgtgcggtcccttcctgctgcctgagacgcaagcgcggcgaaagacgggttaagcggcgcgaagaaattttcccgtgcggctcaggccggctgttccaggcgctccagggcaccgcgcaggttggcgcgggcggcggcctcccagcgttgccgcagcggttcgcagtggtacagcgccggttgctccagcaactggcgcagcaacttgccgcgcccggcgcggaacagcggttccggcacccaggcgtattcggcgcggacgtccgcctcgtagcgcgcgtagaccggcgccggcgcggggaggatggcgaggtcgatatccaccaccagggctgcgtcggcgtctcccggcggcgcctggtgacaggtggccatgatcagttcgcgcagggccggccgcagcgcggccagcccggcatggtcgagccagtgctcggtgctggcggcgctggcggcctcgttgtcctggcgctgggtgtcgtagaccaggtcgtgggtccaccaccccagctccaccaggtccggccgcagcgccagttggcgccagcggtcgaagtgctccaggcaggcgaggatgtggcgatcgctgtggtagtgccggtcggccccgccataggccgccagcagcgcgtcgaaggcatccgccggcgggttgccgccgagtcgctgccagagggcgtcccagcgctgccggtcaagacttcccatggctgccttcctcgcgagggaacaacgggttgccgcagcggcagcagaatgccgcctgcacttcgtgggtcgccttgcggcacaccgggcaatcccgctgcaacaggttggccgggtcctggcgcatcgcggtggcgagttcggcggtga

SEQ ID NO: 11171 - DNA, 522 bp, Pseudomonas aeruginosa
cgatatagaggcgttcgcgccagctgtcgggtgcgctcatcgtggctcctgatgatggatgcggcaccttaccagactagcccgccggcgccagcgttcccccgctcaggagcgtcgccggccgaggcgcgcgccgaggctgccggccaggcgcaggtacaggcgctcgccgccgatgcaaagcaggcaggcgaggatgaacggtgcggtcagcgccggcaggccgagcaggccgaacagcggttgcagcgtcaccgccaggcccatgccgagcagtggcggccaggcgctgcggtagcgcaaggccagggccagcccggcaagggcggcgttcaggccgtagaacccggcgagcgcgctcgcccagtcgtagcccagcagccaggccagcggcaggctggccgcggcgccggcgagggcccaggcggcggagggacgcgagaccagcagcaggccgagccagaccagcagccctgccagcggttcaccgaggaagatgatctcgccgatcccctgcgctag

SEQ ID NO: 11172 - DNA, 1626 bp, Pseudomonas aeruginosa
atgtccatggcctgcatgggagtgcgcgagggaggccatggtccgacaagaaggtctttcccggatggatggagacgcggccccgtatttccggccccatccatccgagagagacaagggtggcccgacccgcatgcccggggggacggcgcgagccggaccgaactcgttgcttcagagatctcccagcggcggcgccacggtctcgatgcgcagcatgttggtcgagccggggcaaccgaacggcacgccggcggtgaccaccacggtgtcgccgcggcgcgccatgcgctgggccagggcgatgtcgagggcggtcgagcagatctcgtcgacgtgcgccagttgctcgttgaccaccgaatacacgccccaggctacggtcagtcgccgcgcggtgcgcaggttcggggtcaggctgaggatcggcgccttgggccgctcgcgggcggcgcgcagggtcgagttgcccgactcggtgtagttcaccagcaccgccaccgggaggatccggctgacccggcggatcgcgcagctgatcgcatcggagacggtagcgtcgggctgcggacggttgacctcgagctggacgtggtagtccggctcggcctccacctggcggacgatcttcgccatcatctctaccgcctcgcgagggtattgtccggaagcggtttccgccgagagcatcaccgcgtcggcgccggcgcccaccgcggtggctacgtcggtcacctcggcgcgggtcggggcgggggagaagcgcatcgactcgagcatctgggtggccaccaccaccggcttgccgagctggcggcagacctggacgatgcgtttctggatgcctggcacgctctccgccggcacctctacgccgaggtcgccgcgcgccaccatgatcgcgtcggcgcgctcggcgatcgcctcgatggcgctcaccgcgctgggcttctcgatcttggccatgaggaaggccttgtcgccgatcagcccacgggcctcgtcgatgtcctccgggcgttgcacgaaggacagcgccacccagtcgacccccagttccaggccgaaggccaggtcgcggcggtccttgtcggtcagcgggctgagttgcaggaccgcttccggcacgttgacgcccttgcgatcggacagctcgccacccaccgccacgcgggtctcgatggcgtcgctgtggcagttgaccacttccaggcggatcttgccgtcgtccagcagcaggctcatgcccggttccagggcatggatgatctccggatgcggcaggttgacccgccgctcgtcgccgggggcgtcgctgaggtcgagagtgaaggtctgcccacgctgcaattgcacggcaccggcggcgaagcggccgacccgcagcttcggaccctgcaggtccatgagcacgccgatcgggtagttcagctccgcttccacctcgcgcacccaggcgaagcgctgcgcgtgatcggcgtagtcgccgtggctgaagttcaggcggaacaggttggcgccggcctccaccagggcacggatatcgtcgcggctgcgggtggccgggccgagggtggcaaggatcttggctttcttgtcggctgtcatgtcaggactcgaggatga

SEQ ID NO: 11173 - DNA, 288 bp, Pseudomonas aeruginosa
atctcccggccgggcgttcgcttcctttaccccgccttgtgggcggggaaggaagagggcggcggcgaacaccggagttcgccgaccgttcctctccccgagcccttcgaaaaggggttcgtcgctccgcgcggggtgacggcccgcgcggactgcggatcactcgtcgcggatcgagaagttggccatgtgctccaggcccttgatcagcgccgagtggtcccagttactgccgccgatggccgcgcaggtgctgaacacctgctgggcgttggcggtgttgggtag

SEQ ID NO: 11174 - DNA, 882 bp, Pseudomonas aeruginosa
gtccttctggtgcaggctgatgcggaagcccgggtcgaaggtgcccttgaccatgcgttcgccgtgtacctcgaggatccgcgaggaggcgaagccacccatcagcgcctcgcgcaccttggccggatcggcgccgttgcgggcggcgaacagcagggcctcggcgaccgcctggatgttcagcgcgacgatgatctggttggccaccttggcggtctggccgtcgccgttgccgccgacgcgggtgatgttcttgcccatcgcctggaacagcggcagggcgcgttcgaagctgttcgggcagccgccgaccatgatgctcagggtcgccgccttggcgccgacctcgccgccggagaccggggcgtccagatactgcgcgccggtagccttgatcttctcggcgaagcccttggtggcggtgggggagatcgaactcatgtcgatcaccaccttgttcgggccgacgccctcggcgataccgtccttgcggaacagcacatcctcgacctgcggggtgtccggcaccatgacgatgatgaactcggcttcctgggccacttccttcgggttggccagggcaatggcgccggcctccagcaggtcggccggagcggcgtcgtggtgggtggaaaggaacaggctgtggccggccttctgcaggttctgcgccatgggcttgcccatgattccggtgccgatgaatccgatcttggccatgagagtgtctcctggttctgtctgtcgagtggctccgcgcagggaggcgggagcgtcttgttcgtgggtgcggatcagacgacgttgtgcgtcttcatccagccgaggccggcttcggtggtggtggccggcttgtactcgcagccgatccagccctggtag

SEQ ID NO: 11175 - DNA, 861 bp, Pseudomonas aeruginosa
gggcaagctggtgctctgccttggccacgagggggcgctcgacctgcgcgaactgctgcgcagccatcccggcgaccgcgagcgcctgagcgcggcactggtggcggcgctgaacctgaagccggagcggcatcacttcgacgcccaggagcaggtccaggtgctgcgtttcatgagcatgaccggcggctgacggtatcctcctggggcgatggcaccaacggcgccatccgccgcttcctctcccatgccacccgggcgaccgtgttccggcacgcaccgctcgctgccccgtcccgggaaaagcgacgcggcgcaacgccgaaacgcggcgaagacgtcatgctgcctgccgcgccagcaaaggaaagcctcccatgcaccgggtcctgttcatctgcagccgcaaccgcctgcgtagtcccagcgccgaacggctctttcgccgactggccgggcctcgagaccgattcccccgggttggcggcggacgccgagaccgcccatggagcgggagcaactggagtgggcgacgctggtcgtcgtcatggagcgccgccaccggcaggcgctgatgcgccggcacgccgcggcgatgaaaggcaagcgcctggtctgcctggatatcccggacgactacgcctacatgcaggcggaattgctgcatctgctggagcgcaaggcggggcctttccttcggcgggactgagtggtgcggaccgcgagcggaaaaaagaagccggacgaagtccggcccgagggaagggcggaccgggagtgtcgccggtccgccagggagtcaggagtgcttgggcgccggcgcgtggctgccgcacaagtggctgcggtcgttgcggctga

SEQ ID NO: 11176 - DNA, 804 bp, Pseudomonas aeruginosa
cccaggcccatgcccatcagcaccgagatgttgacccagaaaccgcgcatgaagcggttgatcaggaggatggtgcagagcaccaggctggagaggaacaggaagtgcagggagccgaagtcttccgcgcccttgccgccgccggcccagttgatcgccaccgggaacaggcacatgccgatcgaggtgatcaccgtgccggtcaccagcggtgggaagaaacgcacgatgcgcgacatgaagggggcgatgagcatgccgaagaaaccggcggcgatggtcgcgccgaagatcccggtgatgcccacgccgggcatcccggccatcgccaccatgctgccgacggcggcgaagctggcgcccatcatcaccggcatgcggatgcccatcgggccgatgcccagcgactggaccagggtggcgatgccggcgaccagcaggtcggcgttgatcaggaaggcgatttcctcgcgcgagaggccggccgcctggccgacgatcagaggcacggcgacggcgccaccgtacatcagcagcacatgctggaagcccaccagcagcagctgcgtcagcggcaggcgctggtctacgggcgagtcggggatgcggcgatcagttaccacggacatgcaacacctcaggcgtttttattgttgtcagtcgcaggcggacaccggaaaaggcaggttccggcggccgggtatttctggccgaacatccaccccaggcttcagggcgatgcggtggggtgttttatatccccgttgtgtgctcgattcaatcgattttttgtatacaaagtaa

SEQ ID NO: 11177 - DNA, 2610 bp, Pseudomonas aeruginosa
cggctccagcgtggcttcgtcgcgcaggacataccggtcatcgaacggtgtcgaatcccaggcgttgaagctggtcgatgcatgagcgggaccgacatgactgtgcttcgccgccttgaccacgaagttgccgggcatgcccagctcgatgttgccgcccttgagggtcaggtaggcgccgccgcacatcagggtgatgtgctccttcgcggtgaccagcacgtgctgctggctggcgctgacctccacgctctgctcggcctccaggcggatgtcgttcttctgcgcctgcagcagcatcggcccctggtgggtgatctggcgcagctcgccgccttgggcgaacaggccgatgtcgctgccggcgttgatcaccaccttctgcccggcggtcacctgctggttctgccgggccacgctgtcgacgtgctcgccggcggccagggtcaggctcgccggcgtcgccgcggcgatccctgccggaccgctcaaggcgatcgccggcttgcctccgttgctcttgccggactcgtcgttggcaccgtggccgaggtcgcgcacggcttcctggagggtttgctgcggcgccgcgtcgtgccccacgccctggtgctccccggcgtagtcgcccagctcgcgggccagctccagcgcggcctccagcacctgcaccacgacgcctcggtcgagatggccggcgccggccctgagctgctcctcggtgctcagcagcagccccttggccgcacgcaccgcgccatgttcgtcggtgcgcagttcgaagccctcgccgcgcggcttgccgccttcgggccgaggatgggtcaggtagcccaggtgcagcgcgctggcaccgtggtcgctcatcagcgccgcactgatctgcgccgtggtgtcgtcgatgcgcagctcgttggcccgactgcccttgtactccttgctcttgatggtgctgaggatcttgtggtcgggcagcgcgtagggcggtcggttggtcgcccggtaggtgcgcccggtgacgatcggctggtcgcagtcgccgtccaggtaatcgacgatcacctcctggccaatccgcgggatcgccatgtgcccccagtcggcacctgcccagttctgcgcgacccgtatccagcaggtactgaattcatcgtgacgtccctcgcgatcccaggggaactggactttcacccgtccccactcgtcgcaatggatctcttcccctgccgggccgactaccgtcgcgatctgcggaccatcgatacgcggccgaggcagcggtgcgggacgccattcgacgtcctcgggtaccagttcggcgcgcaggtcgtagctcacccccagaggggcgtcggcggactcttcctcctggccggcatactgggtgccgcgatggaccacccgcaccggccgccaccaggcgttgaagtcggcacgcggatgaccttccaaggcaaaggcgtggcccgggatcagccgcgggtcgtcgccgctgaccgatgcctcccgcgcatcgcgccggtgccctctgaggcggctttcgctgaaaggccggccggcgccgctccgcttgtagcgaccggggtagtcgtagcgctcgtaggacgagtcctgatgctcgagcgcctcgccagcgagatgatgctcctggtcgtaggtcgggcgcttgaagctgtagtcccgctgggtctgtcgagccgtacgaacattttcgctgtagcggaaagaatgaagcaccggctgcgggttgtcgccctccggctgggcgctgaacagcaccgggccgccggcgatacgctcctggacgtagagccggtcgctgcagaccagggtgtggcggtgttcgtcgaagcggaagtagtagaccaggccttcctcgaaggccagccggtcgtgcaggtagtgatcgctgtcgccggcctgcacgcagtattcgcgcggcaggtgctcgtggtagatacgctgttcgtagtcgagcacccggtgctccttgagcagcgcctggagaatctccggaacactcttctcctggaatatccgccagttgcagcacagctccaggcgcgccaactgcggttccagcagcagttcgtagcgggtccggcgaaaacccgagctgccttgggtgaagtggctgacgatgccatggacgtagcgggccggacggccgtcctgccagagggtgaaggtgcccggctggtcgagtacctgcttgaaatcgatggcgttcttgtcgctggccagcttcaggttcaggcggaaaggctcgcagagcgcttcttccagttcgaactcgacgacatcgaacgcgagtttcccttcgccgacgacgaaggtgaatttcaggtccctttgacgcatggatcgttccttgttcctggcgggcggttcctcccccatccgttggagaagcgagccccacgttactcttgctcagccgctgccgaaagtcttggctcggtgtctatttcgcgaagtagcggacattttcggctcgacggagaaccgatcgcacaggtgtacgaccggtgtgcctgtcaactcaccctgcgaccggcgagcgccagtcgtcggagccggaggtgccggagacttcgtgggtccaggtga

SEQ ID NO: 11178 - DNA, 1785 bp, Pseudomonas aeruginosa
cctgcccgtcgctcgtccggcctttcgcgctgccgggccgccgtggtgccggcgtggcgtttcgtccgcaatccctttcccgcacgagtctttcgtatcctccccgacgcctgccggcggtcgcgttcgtccgcgtccgcccgttgcgcacggtggccggccggtaacggcgacgccgctggcacagggcgcaggaaatggaacaccggggcgctggccctttcgaataaccagcaggcaacactttccggttacaaccgaaccagacaaccaggcacgcggggtagtcgaggtagacccgctgctcacggcattcctcgaaggagacaggtcatgcaactcaaagatgccaagctgttccgtcaacaagcctacgtcgatggcgcctgggtggatgccgacaacggccagaccatcaaggtgaacaacccggccaccggcgagatcatcggcagcgtgccgaagatgggcgccgccgagacccgccgcgccatcgaggctgccgacaaggccctgccggcctggcgtgcgctgaccgccaaggagcgcgccaacaagctgcgccgctggttcgacctgatgatcgagaaccaggacgacctggcccgcctgatgaccatcgagcagggcaagccgctggccgaggccaagggcgagatcgcctacgccgcctccttcctcgaatggttcggcgaagaagccaagcgcatctacggcgacaccattcccggccaccagccggacaagcgcatcatcgtgatcaagcagccgatcggcgtgaccgcggccatcacgccgtggaacttcccctcggcgatgatcacccgcaaggcgggcccggccctggccgccggctgcaccatggtgctcaagcctgcttcgcaaaccccgtattccgcgctggccctggccgaactggcagagcgcgccggtattccgaagggcgtgttcagcgtggtcaccggtagcgccggcgaagtcggcggcgagctgaccagcaacccgatcgtgcgcaagctgaccttcaccggttccaccgaaatcggccgccaactgatggccgagtgcgcccaggacatcaagaaggtgtccctggagctgggcggcaacgcgccgttcatcgtgttcgacgacgccgatctggacgccgccgtcgagggcgcgctgatttccaagtaccgcaataacggccagacctgcgtctgcgccaaccgcctgtacgtgcaggacggcgtgtacgacgccttcgtcgacaagctgaaggccgccgtggccaagctgaacatcggcaacggcctggaagccggcgtgaccaccggtccgctgatcgacgccaaggccgtggccaaggtcgaggaacacatcgccgacgcggtctccaagggcgccaaggtggtttccggcggcaagccgcacgccctcggcggcaccttcttcgagccgaccatcctggtcgacgtgccgaagaacgccctggtgtccaaggacgagaccttcggcccgctggcgccggtgttccgcttcaaggacgaggccgaggtcatcgccatgtccaacgacaccgagttcggcctggcgtcctacttctacgcccgcgacctggcccgcgtgttccgcgtcgccgagcaactggagtacggcatggtcggcatcaacaccggcctgatctccaacgaagtggcgccgttcggcggcatcaaggcctcgggcctgggccgcgaaggttccaagtacgggatcgaggactacctcgagatcaagtacctctgcctgggcggtatctga

SEQ ID NO: 11179 - DNA, 795 bp, Pseudomonas aeruginosa
ggaagccatgagcaagaccaacgaatccctgctgaagcgtcgccaggccgcggtaccccgcggcgtgggccagatccacccggtcgtcgccgagcgcgccgagaactccaccgtctgggacgtggaaggccgcgagtacatcgacttcgccggcggcatcgccgtgctgaacaccggccacctgcatccgaaggtgatcgccgcggtccaggagcaactgggcaagctgtcccacacctgcttccaggtgctggcctacgaaccctacatcgagctggccgaggaaatcgccaagcgcgtgccgggcgacttcccgaagaagaccctgctggtcacctccggctccgaagccgtggagaacgccgtcaagatcgcccgcgccgccaccggccgcgctggcgtgatcgccttcaccggcgcgtaccacggccgcaccatgatgaccctgggcctgaccggcaaggtggtcccgtactccgccggcatgggcctgatgccgggcggcatcttccgcgccctggcgccctgcgagctgcacggcgtgagcgaggacgactccatcgccagcatcgagcgcatcttcaagaacgatgcccagccccaggacatcgccgcgatcatcatcgagccggtgcagggcgagggtggcttctacgtcaactccaagtccttcatgcagcgcctgcgcgccctgtgcgaccagcacggcatcctgctgatcgccgacgaagtgcagaccggcgccggccgtaccggcaccttcttcgctaccgagcaactgggcatcgttcctga

SEQ ID NO: 11180 - DNA, 459 bp, Pseudomonas aeruginosa
cgcggcgcgtcatgcgccgctgggcatggggcgcggttgcaatcgagcctctggccggggagatcggcacctacctgcgcgccgccgagttgccggccgtggatgggcggaagcgcgcctagcgccgcagctcggcgcgcaacaggtccaacgccgggtcgatgtcgtcccgttcgatgcagccgaagccgaagaggaagccggcctgtgccggggtttccgcgtagaagggcggcagggtgccgacctccaggccttgctggcgcaaatgacgggcgatgcgcagcacatccagcggttcgcgacagcgcgccgcgaggtggatcccggccaccgccggcagcgcttcgagccaggggctcaggtcgccgtgcaggcgttccagcaggcgcccgcgacgctgggcgtattcgcgttgcaagcggcgcgtatggcgggcgaagtcgccgcgctggatga

SEQ ID NO: 11181 - DNA, 1140 bp, Pseudomonas aeruginosa
cggtcttgcgcgacacttccaggcgttcggcgaggtatcgcgtggctggcaggcgatcgccggtggccaggcgaccatggaggatcgcgtcgcgcagctggcgatagagctggccgaccaggtcgtggcggccgtcgaggatcagttgcagttccatggcgaaattggctacctggtatttctggtaattggctcttcgtggaagccaaaggcaggcttagtgttaccccatgccgcgccgctttccactctcgcggctgccaatcagccaaggagattcgccatgaccacccgcctcgaatgggccaaagcctcccccgacgcctatgccgccatgctcggcctggaaaaggccctggccaaggccggcctggagcgcccgttgatcgaactggtctacctgcgcacttcgcagatcaacggttgcgcctactgcgtgaacatgcatgccaacgacgcgcgcaaggccggcgagaccgagcagcgtctgcaagcgctctgcgtctggcaggaaaccccctacttcaccccgcgcgagcgcgctgccctggcctggaccgagcaactcgcccgcctcagccagggggcgttgccgcacggcctgctcgacgaactgcgcgagcacttcgacgacaaggagatcgccgaactgaccctggcggtctcggccatcaacgcctggaaccgcttcggcgtcggcatgggcatgcaagcggaatgaggtggacggcgatgaaggccaatcgatcgatcgcctgcctgctgctcgccgcgctgccgacgctggccagcgcccatgttgcggagaaggtggaaaccctgcacgaccaggccctggccgagattcccggccatcgtgggttgatgctgacggtgtcgttcaagcccggccaggtctccgcgccccatgtgcatcccggctcggtgttcgtctacgtgctcgaaggcaccgtgcagacgcaactggaaggcggcccggtggagacctacacggtgggccagagctggtacgagccggcgaacgtgccgcacctgctggcacgcaatcccgatccgatgaagccggccaagttgctggtctgggagttgctcaaggagggcgacccgatcctcaagccactggagcgcggcgcccactga

SEQ ID NO: 11182 - DNA, 318 bp, Pseudomonas aeruginosa
ggcgtcgctcgttcgcccggaggagcgtccgtcatgagcgccagccaggtcatccgtattcgcgcgcgcaacggtcagtcggaacggcttggcctgcgcctgcaacaactggtcgaaccggggctggaggcgccgggttgcctggagtaccaggtgcgcagggacgccctcgagccggatctctggctggtgtgcagccagtggcgggaagcgcagcagatgttcgactacctggccggcggcatccagcaggtattcgccgaagtgctctggcgctccctggcggcgagcctcgaagtgcaggatgacgcaggctag

SEQ ID NO: 11183 - DNA, 534 bp, Pseudomonas aeruginosa
tggcggccatcgtcgagcagtgcatggatacgccgtggcagcatcagcacgaagtcgctgcccgacagcagttgcagggcggcgacgtacctgttggcgcgcgcggcgacctcgcggctgcggccctggcgtcgcagccacgtgtccaccaggttggcgttgctggcgtcgagcggggtcgggaagacgaagcggcgccggcagaactcgtccagttccaggcgctcgtggcgcggctgggcacgatcctgtacgcagagcagctcgtcgctgaacagggcgagcgcctgtagctccggtgccggtcggtggtactcgggaccgaagtcgaagaccaggtcgacctggccgtcgagcaatgcttcggtgggcagttcgggacccaggcggcggatgtccaggccgatcctcgggccgttggcggcgagccgtcgcaggagtgccggaaggatcagcagctcgacgtattccggcgcgcagagggtaaaggtccgcggctcgccacgcgggtcgaagctgccctgggcggcgtga

SEQ ID NO: 11184 - DNA, 1344 bp, Pseudomonas aeruginosa
cccgaccagcaccgggcggcgatcccgcgagcggctggccatggccggcgcgagcaacccggagagcacctccatggccgtcaggaaaccgagcagcagcccggattcctgggcgctccagccctgctccaggtaatagggcgcgagccaggccagcacgcaggtgtagcaggccgtgccgaggccgaagaacaggaccagcagccaggtccgcggatagcgcaggaagctcctgcccggctgcgcgtcgggcaggcgcaggcgggtgccgggttgcagccaccaggccagcagcgcgagcgcggcgagcgccgcccaggcaccgaggccgatccgccagccggcgtgctccgccagggtcggcgcggcgctggcggacagcgccgcgccagccatgatggcggtgacgtagagccccatgcagagcggcgtgcgcgcgccgaaacgggccttgatcagggccggcatcagcgcctggatcagggcgatgccgagaccggcgagcatggcgctgccgagcaggtcgggcaggcctcggctgcccaggcgcatggcgctggcggcgccgatcagcagcagggcgagggccaccgaacgccactcgccgacgcggcgggcgatgcccaggccgaagaacatgccgaggccgagggtcatcaccggcagggcggtcagcagcgagacggcgccgaagctgagcgcgatctcgccgcgcatggcgttcagcagtgggccgacggcggccatggagggccgcaggttgaggccgaccaggacgatggcggccatcagccagagggtgcggccgggtgggttggcagagggcatggcgatctcctttcgggagcaccattgcgcatgcgccagggcgtggcggcaaatcaaaatccgcagggcggattcgaaaaaatgcgctggccagggagtcggggcggacgctggcgcaacgttgcgagtcgcgaggttatccgccccgtgcggcgcgtggcctcactccgcactcaagcgcatcaggctttcgctcagggcacgcgcgtggcggtcgacgatgatcggcgcccagggcctgccggaagcgctgaccagcgcgctgctcttgctgttcaggtcgcgcagggcctggctcaggtactcccagcggttttccagtttcttcagtcccgccgggttggcgctttgcgccaccagcagggcgatgcgccggtcgatcagcgggaccagcacgctctcgtcctggccgagatagtcccggggctgctcgcgggcagtctccagcccgcccaggtaggcgcgcgccaggtattgcagggacaggtactcgacccgcaccggcaactgccatag

SEQ ID NO: 11185 - DNA, 909 bp, Pseudomonas aeruginosa
ctgggtgtggccttcggcgtaggcgtcgtgggtgcgcgcctggccgtcgaacagggcgatctcgccgaaccagtgcggcgcttccaccaggatcagcagcgcctccttgccgttctcgctgaccgcgctgatacggatcgcgccctcgaccacgcagtacagtccgcagggcgcgtcgccgcgggcgaacaggcgctggcccggcggcaactggcgcggttgggcgagtgccagcaggtgcgtctgcaaggcctccggcaaaccctggaaccagcggccggcctggagttgcgaacggtagtcggtacgctcgttcatgtttgtcgtctagctgacagagtggaaaaccggggcggcgcgatgatgcgagaaccctggcgtgagaccacaacaatgaaaaccctagtcgatcaccttgcgcaatacgccgcctaccaccgcgaccggcgcaacatcttcagccatttcatcggcattccgatgatcgtcctctccatcgccgtgttgctggcgcggccggcgctggggttcggcctgtctccggcgctgctgctggcgctcgccgcggcgctgttctacctgcgcctggacctgcgcttcggcgtggccatgacggcgctgctggcgctgacggtgtggggcgctgcgcaattggcggcggggactaccgcggcctggctgggctggggcgtcggcctgttcgtggtcggctggatcatccagttcgtcggtcattactacgaagggcgcaagccggccttcgtcgacgatctcagcgggttgatcgtcggtccgctcttcgtgctggcggaactggcctttctgctggggctgcgcggcgacgtgcagcgcgaggtcgaggagcgcgccggcccgacctgcattcgcgagcacaagcgggcggcgtga

SEQ ID NO: 11186 - DNA, 693 bp, Pseudomonas aeruginosa
ctcgtaggagaaatcgtcggcgtcggattcctgggactgggagaactgcgcgttgaccagcgattcggtgagttcgcccagctgggagccggacagggcggccagcgcgccgctcttcgaggcgccggcggcgccgcgcaccgcggcggccgcgtaggcggtctgggcggccttgcgggtgtggccgagggcgacgtggcccatctcgtggccgagcacgccttcgatctcgttgtcgctcatcagctccatcagcccgctgtagacgcggatgcagccgttggccatggcccaggcgttgacctcctcggtgaggtagaccttgtagttcaccggcacgccgtcgatctggtcgcccagggccttggcgatcttgtccaggcgctggccgtacttgctgttggccggggcgatgcggttttgctggtcggactcggcgcaggcctggtcggcgacctggcggacctcggcgtcgctcagggttgcagccttcaccgccatcatgccgtgctgcatgaggtcaccctggggcaggttctggcagccggccagggtggcgcaggcgagggccagggcggaaagggaaagacgggtcttcatcgtgtgctccttgcgataggtggcgttccgtgccggacgggcgtgttccgcccggtgccgcgcgcccggtggggggcgcgcggcggcggatga

SEQ ID NO: 11187 - DNA, 702 bp, Pseudomonas aeruginosa
agcatgcaattcaatcccggcttcagttcgctggcggcgctgctcgccgatcccggccgcgcgcagatgatctgggcactgatggatggcagcgcccgcccggccagcgagctggcgctgctggcgggcgtctcgccgtcctccgccagcggccacctgggacggctggtcgagggcggcgtgctgagcctggaggcgcgcgggcgcaatcgcttctatcgcctggccgggccggaagtgggacaggcggtggaagcgctggccagcgcctccctggccctgcagccgcagcggcgcagcctgccgccgagccacggcacgccgtcggcgttgcgcgaggcgcggacctgctacgaccacctggccggcgaactcgcggtcggtgtgttcgcacggatgctggatgccggctggatcgagcaggagggcaggacgctgcgcctgagcgcgaccggcgaggccgggctggccaggttgggaatcgacctgtcggaggtccgccgccgccgtcggcagttcgcctgcgcctgccccgactggagcgaacgcaagccgcacctcggcggcgcgctgggggcggcgttgctggaggcctgtctgcgccagggctggttgcggccgcaggacggctcgcgggcgttgcaggtgtcgtcgaagggccgcgcgggactgcgcggcctggcggagcgcacggcgggctga

SEQ ID NO: 11188 - DNA, 498 bp, Pseudomonas aeruginosa
tgtcgcgggccacgccagtgtagtgcagcggcttgcccagggcgtcgcggaggacccggccgcgcgagtggatccagcggtagtcgccgtccttgtggcgcaggcggtagatgtggtcgagattgtcggtcaggccctgcaggaggttgcggtgggcctccagcacggtggcgtactcttcggggagcaggcgcttcttccaggtctcgatggggtcgccgagttcctccggagcgaggccgatcagcgcggcgtagcccggcgagacgaacatccggtcggtcaccaggtcccagtcccagagtccgtcgcgcaccgcttccagggcgcggttcaggcgctgctcgctgccgtgcagttcgtcgtaggcctgggccttgcggcggaactggcgtaccaggtagaggtacacgagccggccggttgcgggcaagaataacagccgttggcggtcatccaaaacaccagttggtcctggtcctggacctggtttggtaa

SEQ ID NO: 11189 - DNA, 885 bp, Pseudomonas aeruginosa
gcaccatgccaagtgcgagaccgtcgaggatccgcacagcccggtgcacaagggcctgttcaccgtcctgcgcgcaggcgcggagctgtacaaggccgaggcgaagaaccaggacaccctgcgcatctacggcaagaactgcccggacgactggatcgagcgcaatctctactcgcgcttcccgatcggcggcgtggtgctgatggcgctcatcgacctggccctgttcggcgcccttggcctgaccgtctgggccgtgcagatggtatggattccgttctgggccgccggcgtggtcaacggcctcggccacgcggtcggctatcgcaacttcgaatgccgcgacgccgccaccaacctggtgccctggggcatcctcatcggcggcgaagagctgcacaacaaccaccacacctacccgaactcggccaagctgtcggtgaagaagtgggaattcgacctgggctgggcctggatcaagctgttcagcttcctgcgcctggccagggtcgcccgggtcgcgccgatcgcccatcgggtcgagggcaagcacagcctggacatggacaccgccatggcgatcctcaacaaccgcttccagatcatggcgcagtaccgcaagctggtgatcgcgccgctggtcaagcaggaagtggccaaggccgacgagtcggtgcgccacctgttccgccgcgccaagcgcctgctgtcgcgcgagaccagcctgctgcaggaccgccaccacgtgcgcatcgactcgatgctcgcccacagccaggcgctgaaggtgatctacgagaagcgcctggcgttgcagcagatctgggccaagaccagcgccaacggccacgacatgctggcggcgatcaaggactgggtgcatga

SEQ ID NO: 11190 - DNA, 2217 bp, Pseudomonas aeruginosa
  unsure (2217): Identity of nucleotide at the above locations are unknown.
ggcggaagccagcggtatccagtcgctgaaggagttcgccgcgcaactgaagacctactcgctgcgtcccgcctgacgcctggcgcgccctcgcgggtgcgtcagccgcctctgcaacgcgccggctcctgccggcgcgttgcgtttcggcgtcgccagtgcgacgccccgccgatacttctcttcctccgcaagtcgacttgcctgatccgggattcagcccgggcggcgcccggcctatcttcggcgtgcccaggcgccacgccgggcgtcacgcagaacaacaagaaaaggagcgcgggcgatgttgctggattacctgatcatgctggtctacgccctggccatgctgggcctgggctggtacggaatgcgcaaggcgaagagccagagcgatttcctcgtcgccggacgccgcctcggccccggcctctacctgggaaccatggccgcggtggtgctcggcggcgcgtcgaccattggtacggtcaagctcggctaccagttcggcctgtccggcttgtggctggtgttcatgctcggcctggggatcatcgtcctcagcctggtgttctcgcggcagatcgcgcgcctgcgggtgttcaccgtgacccaggtgctggagcagcgctaccaggcctcctcgcgcctgatcggcggggtggtcatggtcgcctacgacctgatggtggcggtcaccgcgaccatcgccatcggctcggtcaccgaggtggtattcggcatcccgcggatcccggcgatcctctgcggtggcgggatcgtcatcgtctattcggtgatcggcggcatgtggtcccttacgctgaccgacatcatccagttcgtgatcaagaccgtcggtatcttcctggtcctgctgccgttgtcgatcgacggcgccggtggcctggcgcgcatgcaggaggtgctgccggcgggcttcttcgacctcggccacatcggcctggataccatactcacctacttcctcctgtacttcttcggcgcgctgatcggccaggacatctggcagcgggtgttcaccgcgcgcagcgagacggtggtgcgctacgccgggcttggcgccggcgtctactgcatgctctacggcgccgcctgcgcgctgatcggcgcggcggcgcgggtcctcctgccggacctggcggtgccggagaacgcctacgccgagatcacccgcgaggtactggcgccgggcctgcgcggcctggtggtggcggccgcgctgtcggcgatcatgtccaccgccagcgggtgcctgctggcagcggccaccgtgctgcaggaagacatctacgcgcgcttcctgcgccccggtaccaccagcgacatccgtctgagccgttgcatcaccctgctgatgggcgtggcgatgctggtcctggcgtgcctggtcaacgatgtcatcgcggccctgagcatcgcctacaacctgctggtcggcggcctgctggtgccgatcgtcggcgcgctgctgtggcgccgggccagtccgcagggggcgatcgccagcatcgtcgccggttgcctggcggtgatcgcctgcatggcccgcgacggcctggctcgccaactcgccgatcgtctacggcctgctggccagcctggcgaccttcgtcgcggtcagcctggctacccgtcctgccgccagcctgcgagcccagccggaatgaacccaccgcgccgggcggcgcccggcgctttcttcccgccacacggagacgccccatgtcgaacgaccatccgcagcccctcgacgccgccgatattccacgcttcgccggcatcccgaccttcatgcgcctgccggcgttcaccgacccggcggcgctgcaggtcggcctgatcggcgtgccctgggatggcggcaccaccaaccgcgccggtgcccgccatggcccgcgcgaagtgcgcaacctgtccagcctgatgcgcaaggtgcatcacgtcagccgcatcgcgccctacgacctggtgcgggtcggcgacctcggtgatgcgccggtgaatcccatcgacctgctcgattcgttgcgccgcatcgaaggcttctatcgccaggtccatgccgccggtaccctgccgctgtcggtcggtggcgaccacctggagaccctgccgatctttcgcgccctgggtcgcgagcggccgctgggcatggtgcatttagatgcgcattccgataccaacgaccgttan

SEQ ID NO: 11191 - DNA, 255 bp, Pseudomonas aeruginosa
ttgggagacaacccctacacccacggcacgccattccgcagggccatcgaggaaggtctgctcgacccggtgcgcacggtgcagatcggcattcgcggctcggtgtattcgccggacgacgacgctttcgcccgcgagtgcggcatccgccgtgatccacatggaagagttcgtcgaactgggcgtcgaggcgaccttggccgaagcccggcgggtggtgggcgacgggccgacctatgtgagtttcgacgttga

SEQ ID NO: 11192 - DNA, 669 bp, Pseudomonas aeruginosa
ccgaggaggggcaggagctctacgacgccgcgctcggcctgttcagcgacatcgcccgtttccgcgagcaggtccgcggcctcggcgggcgcgatcgcgaggcgttgcacctgggctgcgtcgatggcgtcatcggccagcattgcctgccgttgccgctggccatccggctgtttcgccagcgcgccccggaggtgctgctcaagctgcacacgcggcgtcccgacgaactcgagcacgcggtgctggaagagcgcctgcaactggcggtgggggcctttcaccaccggttgtccgggctctactaccaacccctgttccgcgaggagcagaacctctattgcggcagcgcgcaccccttcttcgcccgggcggacgacgagccgacactggacgagatctgcgccgccgactatgtcggccgcggctacatggcggaaaaccatcgcccgcacgacctgcgcttcaaccaggggaccgacgcctacaccatggaggccatcgctaccctggtcttcagcggcacctacatcggctacctgccgacgcactatgccgccacctgggtcgccgaagggcgcatgcgggcgatccggccacggcaactggcctacgactcggaattccattgcattacccgtcagggacacgaagaacgaccgaccctga

SEQ ID NO: 11193 - DNA, 1173 bp, Pseudomonas aeruginosa
ccctgttcctgcgctcgctgttcgaggcgcagaaacaactgggcgtgcaggctccggcgaatacgaacggcatcgctcggcaattgtgatcaagcgcactggctggagcctttccctgccgttcggcgggcatttctgtatcgccgcgacccctgcgctaagttggcggtcgaacccgttccgcgagcagagcgacgatccatggacgacctaaccggcattcccgaagacccgcaggaggccgcgctggccttgctgcacagccgtgccgaagtggcccggctgaaggagcgcgagcaactcttcagcgccttgctggccagcgtcaactcggtgctctgggcctacgactggcagaaccggcgaatggtctacgtcagtcccgcctacgagaaaatcttcggccgttccgcggcgctgctgctggcggactacgaggaatggcgcaacagcatctacccggacgacctcgactacgccgacagcagcctgctgcaggtgctcgaacgtggcgccgtggaacaacgcgaataccgcatcgtgcgtggcgacggcgaggtccgctggctcaacgacaagtgcttcgtcagccgccagggcgaggcgggactgccgctgatggtggtgggcatcgccgaggacatcaccgacaagaagcacatggagagcgagctgcaacggctggccaccaccgacgtgctgacccagagcagcaaccgtcgctatttcttcgacagtgccgaggcggccttcaaggagtgtcgccgcgaggggataccgttggcgttcctgctgctggacgtcgatgacttcaagaagatcaacgaccgcttcggccaccaggtcggcgaccaggtcctccagcgtatcgcccagagcggcagtgccgcgctgcgccgtggcgacctgttcgggcggatcggcggcgaggagttcgccgtgctgctgcccggctgcgacgagcagaccgcgcgacagatcggcgcacgcctgcagcgcgaggtgcaacgcctgcgcttccaggagggcgagcacagcttcgggatcaccgtcagccagggcctgacggtcctccaggccgatgacgagggactcggtgccctctacagccgggccgacgccgcgatgtactcggccaagcgccagggcaaggactgcatcgtcgtgggctga

SEQ ID NO: 11194 - DNA, 1761 bp, Pseudomonas aeruginosa
gcggttttctgccgacacccttcggcccgtcagccgggagaagggcaggaagcccgagaggacgcgaaggcggagcccgatggaaagattggcttacaaattgccttcactggcggtgggtcgagacacccgccgcacaataacaagacacgagtacgcccatgcacacgcttccgttcgctgcctccctgcctgcttgcctgccccgtcgttccatcgtcgcgggttgcgccgtttcctgatccatcgaatgccgagtttcgcgcgcgccatcttccgggatggtacggcgctcagtgtttcaacgaccggtcgggcccacgcgttccacttcccccgaccggaagacaattagcaataccaatggggaaaagaccaatgaagagtcgcaagatcaacaagtcacgactggccctggccatcactgccggtaccctcggtgccctggcgcaacaggcggtcgccgccggtttcatcgaggacagcaaggcatcgctgaccctgcgcaacttctacatcaataccgacaaccgcaatggcaccgcctcgccgagcaagcaggaagagtggggccagggcttcatcctgaattaccagtcgggcttcacccagggcaccgtcggcttcggcgtcgacgcgctgggcctgctcggcgtgcgcctggacggcggcggccgtgccggcaagagcggcctggaccgccagccgggcaccgtgttcccgctggaaagcaacggcgagccggtgcacgacttcgccagcctgggcctgaccgccaaggccaaggtgtccaacaccgagttccgctacggcaccctgcagccgaagctgcccgtggtcacctacaacgacggccgcctgctgccggtcaccttcgagggcggccaggtcacctcgaccgacctcaaggacttcaccctggttgccggccaactggagcactccaagggccgtaactccaccgacaaccgcagcctgagcatcgccggcgccaacggcagcagcgccagttcgcgcgacagcaacaagttctactacgcgggtggcgactacaaggtcaacaaggacctgaccctgcagtactactacggcaacctggacgacttctacaagcagcacttcctcggcctgatccacaactggcagattggcccgggcgtcctgaagaccgacctgcgcgccttcgacagcagctccgacggcaagaacggcagccgttccggccgtgccgacggctacgtcagcagcggctactacggcagcggcgtgaccaagggcgaagtcgacaaccgcgccttcagcggcctcttcacctataccgtcagcggccacagcatcggcgccggctaccagatcctcaacggcgacagtgacttcccgttcctgaaccgtggcgatggcgaaggttctaccgcgtacctgatcaccgacgtgcagatcggcaagttccagcgtgccggcgagcgcacctggcaggtccgctacggctacgacttcgccaccgtcggcgtgccgggcctgaccttcaataccatttacctgagcggcgacaagatcaagaccgcccgcggcgaccagagcgagtgggaacgcgatatctccctggcctacgtgatcccggacggcaccttcaagggcctgggcttcacctggaagaacgcctccttccgcagcggcctgccggctgccggttcgagcaacaaccagcgcgaccaggacgagaaccgcctgatcgtcagctacaccctgccgctgctgtaa

SEQ ID NO: 11195 - DNA, 795 bp, Pseudomonas aeruginosa
gctcggccaaaccccataacatctacaaacaacgggtgtctcatgtctcgcctgccgttaatcggcgtcaccgcctgcaccaagcagatcggtcttcatccctaccacattgccggcgacaaatatctgcgtgccgtcgtcaacggcgctggcggtctcccgctgatcattcctgcgctgggcgagtcgatcgaccaggcagccctgctggacagcgtcgacggcttgctcttcactggctcgccgtcgaacgtcgagccccgtcattatagtggaccggcgagcgagcccggcaccctccacgactccgaccgcgacgccaccacgctgccgctggtccgcgccgccatcgacgccggcattccggtcctcggcatctgccgcggtttccaggaaatgaacgtggctttcggcggcagcctgcaccagaaggtgcacgaggtcggaaccttcatggaccaccgcgagccggccaaccagccgctcgaggttcagtacgcgccgcgccatgccatgcatgtgcagccgggcggagtgctcgccggtatcggcttgccgagcgagttccaggtcaattccatccatggccagggcgttgatcgtctggcgccgggccttcgagtagaagcactggcgcctgacgggttggtcgaagccatctccgtagaaggtgcaaaagccttcgctcttggtgtgcaatggcacccggagtggcaggttctgacgaaccccaactatctcgctatcttccaggctttcggtaaggcctgcagcaagagggcggggcaacgttga

SEQ ID NO: 11196 - DNA, 576 bp, Pseudomonas aeruginosa
cctggatacgctgatccacgaggaaggcaccgcgcagatggagatcaacttccgtcatggcgacgccctcgacctggccgaccagatcctggtgttcaagcgcaccatgcgcgaggccgcgctcaagcacaacgtcgccgcgaccttcatggccaagccgatgaccggcgagccgggcagcgcgatgcacctgcaccagagcatcgtcgacgtgaagaccggcaagaacatcttctccaatgccgacggcaccatgagcgagctgttcctgcaccatatcggcggcctgcagaagttcatcccggaagtgctgccgctgttcgcgcccaacgtgaactcgttccgccgcttcctgcccgatacctcggcgccggtgaacgtcgagtggggcgaagagaaccgtaccgtcggcctgcgcgtgccggactccagcccggagaaccgccgggtcgagaaccgtctcgccggcgccgacgccaacccttacctggcgctggctgccagcctgctgtgcggctacatcggcatggtcgaaggcatcaagccgagcgcccaggtcaaaggtcgcggctatga

SEQ ID NO: 11197 - DNA, 1383 bp, Pseudomonas aeruginosa
aagaggtgtgacatgaacagccaaatcaccaacgccaagacccgtgagtggcaggcgttgagccgcgaccaccatctgccgccgttcaccgactacaagcagttgaacgagaagggcgcgcggatcatcaccaaggccgaaggcgtctatatctgggacagcgagggcaacaagatcctcgatgcgatggccggcctctggtgcgtcaacgtcggctacggccgcgaggagttggtccaggccgccacccggcagatgcgcgagttgccgttctacaacctgttcttccagaccgcccacccgccggtggtcgagctggccaaggcgatcgccgacgtcgctccggaaggcatgaaccacgtgttcttcaccggctccggctccgaggccaacgacaccgtgctgcgtatggtccgccactattgggcgaccaagggccagccgcagaagaaagtggtgatcggccgctggaacggctaccacggctccaccgtcgccggcgtcagcctgggcggcatgaaggcgttgcatgagcagggtgatttccccatcccgggcatcgtccacatcgcccagccctactggtacggcgagggcggcgacatgtcgccggacgagttcggcgtctgggccgccgagcagctggagaagaagattctcgaagtgggcgaggaaaacgtcgccgccttcatcgccgagccgatccagggcgccggcggcgtgatcgtcccgccggacacctactggccgaagatccgcgagatcctcgccaagtacgacatcctgttcatcgccgacgaagtgatctgcggcttcggccgtaccggcgagtggttcggcagccagtactacggcaacgccccggacctgatgccgatcgccaagggcctcacctccggctacatccccatgggcggggtggtggtgcgcgacgagatcgtcgaagtgctcaaccagggcggcgagttctaccacggcttcacctattccggtcacccggtggcggccgccgtggccctggagaacatccgcatcctgcgcgaagagaagatcatcgagaaggtgaaggcggaaacggcaccgtatttgcagaaacgctggcaggagctggccgaccacccgttggtgggcgaagcgcgcggggtcggcatggtcgccgccctggagctggtcaagaacaagaagacccgcgagcgtttcaccgacaagggcgtcgggatgctgtgccgggaacattgtttccgcaacggtttgatcatgcgcgcggtgggcgacactatgattatctcgccgccgctggtgatcgatccgtcgcagatcgatgagttgatcaccctggcgcgcaagtgcctcgatcagaccgccgccgccgtcctggcttga

SEQ ID NO: 11198 - DNA, 1110 bp, Pseudomonas aeruginosa
gaccctgctcgccctgaccttggcgggctctgtggccggtatggcgcaggctgcggacaacaaggtgctgcacgtgtacaactggtccgactacatcgcgccggacaccctggagaagttcaccaaggaaactgggatcaaggtcgtctacgacgtctacgacagcaacgaagtgctggaagccaagttgctggcgggcaagtccgggtacgacgtggtggtgccgtccaactccttcctcgccaagcagatcaaggccggggtctaccagaaactcgacaagtccaagctgccgaactggaagaacctgaacaaggacctgatgcacaccctggaagtcagcgacccgggcaacgagcatgcgattccctacatgtggggcaccatcggcatcggctacaacccggacaaggtcaaggcggccttcggcgacaacgcgccggtggattcctgggacctggtattcaagccggagaacatccagaagctgaagcagtgcggcgtcagcttcctcgactcgccgaccgagatcctcccggcggccctgcattatctcggctacaagccggacaccgacaatcccaaggaactcaaggcggccgaagagctgttcctgaagatccgtccctacgtcacctacttccactcgtcgaagtacatttccgacctggccaacggcaacatctgcgtcgccatcggctactccggcgacatctaccaggccaagtcccgcgccgaagaggcgaagaacaaggtcaccgtcaagtacaacattcccaaggaaggcgccggcagcttcttcgacatggtcgccattccgaaggacgccgagaacaccgagggcgccctggccttcgtcaacttcctgatgaagccggaaatcatggccgagatcaccgacgtggttcagttccccaacggcaacgcggcggccaccccgctggtgtccgaggcgatccgcaacgacccgggcatctacccgagcgaagaggtcatgaagaagctgtataccttccccgacctgccggccaagacccagcgggcgatgacccgcagctggaccaagatcaagtccggcaagtgatccgcgaggagcccggcggcgcctga

SEQ ID NO: 11199 - DNA, 462 bp, Pseudomonas aeruginosa
ccgctctggctacggcgatcgcgggccccgtgcaggcggagaagaagagcctgcacatctataactggaccgattacatcgctcccaccaccctcaaggacttcaccaaggagagcgggatcgacgtcagctacgacgtcttcgactccaacgagaccctcgagggcaagctggtctccggccactccggctatgacatcgtggtgccgtcgaacaacttcctcggcaagcagatccaggccggtgccttccagaagctggacaagagcaagctgccgaactggaagaacctcgatccggcgctgctcaagcaactggaggtcagcgacccgggcaaccagtacgcggttccctacctgtggggcaccaacggcatcggttacaacgtggccaaggtcaaggaagtcctcggcgaccagccgatcgactcctgggccatcctcttcgagccggagaacatga

SEQ ID NO: 11200 - DNA, 1146 bp, Pseudomonas aeruginosa
cttcaccagcttctggaagatcaccgtgccgctgtcgaagaacggcatcatcgccggctgcatgctggtgttcatcccggcggtgggcgagttcgtcatcccggaactgctcggcggccccgagaccctgatgatcggcaaggtgctctggcaggagttcttcaacaaccgcgactggccggtggcgtccgccctggcggtggtgatgctggcgatcctgatcatcccgatcatcctgttcaacaagaaccaggccaaagaactggagggcaaggtatgaagcgctggaatttctccaacgtcatgctgatcgtcggcctgctcttcatctacctgccgatgctgatcctggtgatctattcgttcaacgcctccaagctggtgacggtgtggggcggctggtcggtgaagtggtacgtcggcctgctggacaacacccaactggtcagctcggtcggacgctccctggagatcgccttctatacggcgttctcctcggtgctcctcggcaccctggcggccttcgtcctcacccgcatcccgcgcttccgcggtcgtacgctgttcggcggcatggtcaccgcgccgctggtgatgccggaagtgatcaccggcctgtcgctgctgctgttgttcgtggccatggcgcaactgatcggctggccgcaggaacggggtatcgtgaccatctggatcgcccacaccagcttctgctcgtcctacgtggcggtggtggtgtcggcgcgcctgcgtgaactcgacctgtcgatcgaggaagcggcgatggacctgggcgccaagccctggaaggtgttcctgctgatcaccatcccgatgatcgcgccctcgctggcggcgggcggcatgatgtccttcgccctgtcgctggacgacctggtactggccagcttcgtctccggacccggctcgaccaccttgccgatggaagtgttctcggcggtacgcctgggcgtgaagccggagatcaacgcggtggccagcctgatcctgctgagcgtttcgctgttcaccttcttcgcctggtacttcacccgccaggccgaggagcggcgtcgccgggcgatccagcaggcgatggaagagaccgcgaccgactggcagaaaggctcgccgaccccggcctga

SEQ ID NO: 11201 - DNA, 1929 bp, Pseudomonas aeruginosa
cccgttgtatccggcggacaaccaccatgcggctactcgcccgaccccacgccggccggctcagcgcttcggctccagcaccagcacgcccttgctgttcgccttcacctcgttttcctcgtagtgctgcggcaggtagtggccctcgatgtaggcctcggcctggtcgtcgtagtggccgtcgaagggcacgccgctctgcccgaccgggttgatgccgaggctgtgggtcgggtcggcgaagtccaccaggcgccgggtcgatggaccgtaggtgaccgcccagggggccgggccgatcttcgccgacagattgttcggtacctcgtgggtgccgggggcggcgaacggaccgacgttgagaaggcgcttgagcagcgcctgctggcccagggcgtgctcgtgggtcagggtatgcgccttgccccacagccagccggacgggtcgttgccgagggtgctgcgcagatgcgcgagggaggcgttccaagcggtcctgacgatatccgcgcgggtttcccggcgttctgtgcggcggtcgtcccaccagggcgagtcggcgtcggcagccagccgaggcagcgcgctgtcgatggcgcgggtggcgatcaggctgtcgaagaaggcatcgcccagttcgtcgtgcaaggcgccctcggcaatctggaacagcaactggttgaacagcgtggcggcggtcgagtcgaccgggtagtcgcccttccaggccgccagttgctcgaccaggcgcttgccttcggcgtcgtcgaccacctcgcgcaggaccggcagcaagggtgcgagcaggcgcggcgcgtagccggtgcgattgccgagttgcagcgcgcggctgttgtccaggttccatttggtgccgcggtcggccagttgggtatccagccactggccgcggtccgccaggttgtagtagccgggaatcggccggccattggccgggaccggctggaagttggcggagacgatgtagccgcgcgccgggttttcctcctgtgggttgtcggcgaacggatagaagccggacttgtccgcctcgcccttgctgccgtcgaggatgaagctcgggttcaccccctccggccgcttcggcagggccgccgaggcccaccagccgatatcgccggcggcattggcccagaccaggttgagtcccggcgaatggatcttcgaggccgccgcgcgggccttggccagggtatcggcgcgattcagctggtagaaggcgtcgagcaccgggttctcggtctcgaggaaagcccaccacatggcgatcggggtcctgccggagctgacgccgagcgcgtcgttgacgatcggaccgtggggcgagcggcgcagggtgagcttcaccggcgcagcgcccttgaccgcgatttcctgctcctcgctctgcaggtcgacccattcgccctggtaccagacctggttggggttgtccgggttgaccttctcggcgatcaggtcgaggtcgtcgttctggaacatcgtcaggctccagccgaacgcacggttgtggcccaccgaggcgaaggggttgagcgcctggtggtggccatagagttcgaagccgggcgcgctcagctgggcctcgtaccataccgccggcgcggcgaagcggatatgcgggtcgccggccagcaggggcttgccgctggcggtgcggctgccggcgacgacccaggcgttgctgccctcgaactgcggcaggccggcgtcctccagggcctgctggctgagacgggcgagggcgccgaggtccttccagtcgccggcgcccagtgcgccggatggcgtcagcacgcccctgcggatgccaatcgagatcgaagatgcgcaggtagtcgctgcccagttcgtcgcggatgtagatcagcaccggctcgggtgcggaaggcggcggcgaagctgtag

SEQ ID NO: 11202 - DNA, 1125 bp, Pseudomonas aeruginosa
gcggcgagcaggccgccggcccagagcaggccgaccaggctgacgaggagcgtcttgcggcggggagtcatggcattcacacggaaaacgggtgccaagcttgccatgtgttcgcgcgcagctgaatatccctgggtttcgcccgtggcccggccacgaatcgattgcagcccggaaccgccgatgtcagaagccttcaaccccgattacctgcgccagcacctgcgacccttggccgcggccgaggcggacgccgccgtcctcgcctaccaggcctactacggcctggacctgcgctcccgccatccgcgcctgcaagcgcggctcggcagcatggcggtcgacgggcgccgcctggcggtgcaggcctggctgctgccggaagcgcgcggcagcctgttgctgatgcatggctattacgaccacatgggactgtatcggcacgtggtcgactgggcgctgggcatgggcttctcggtgctcgcctgcgacctgccggggcatggcctgtccgaaggcgagcgggccagcatccgcgacttcgccgaataccaggcggtgttcaagggcctgctgggccaggctgccgaactcgacctggcggcgccctggcacctctgcggacaaagcaccgggggggcgatcctgctggactacctgctgcacggcggcgaacgtcccgagctgggcgagacgattctcctggcgccgctggtgcgcccgcgcgcctggggctggtcgaagctcagctaccgcctgctgagccccttcgtcgactcgatcccgcggcgcttctcggagaactccagcgatccgcagttcctcgacttcctccgcgagcacgatccgttgcagccacgcaccctgccgaccgcctgggtcggcgcgctgacccgctgggtgccgcgcatcgagcgggcacctcggcgtgccctgagccccctggtggtgcagggcgagtccgacgagacggtggactggcgccatggcctgaaggtgctgcgggagaaattcgacgagccgcggatactgttgctggaagaggcgcgccatcacctggcgaacgaaagcgaggggctgcggcggcgctatttcgatttcctgagcgacgcgctgggggcctga

SEQ ID NO: 11203 - DNA, 1185 bp, Pseudomonas aeruginosa
accgggtcttcaccgtcgacggcgaggatgtcagcgaagcattcctgctgggtgcggaggcggcagtggagctggtccgccgccatgacatccggatggccgtgctcaaggcgcgcagtccttcctgcggcaacctggagaactacgacgggcgcttcaacggcaaccgggtcgccggcgagggcgttaccgccgccgccctcaagcgcatgggcgtgctggtattcaacgaggatgaactggaccgcgccgcggtctgcctggccggcctcgacgccggcggctgaacgctcagcgccgcagcggcgcggtcaggcggttctccagggctttctgcacacgctcgaagagtgccgaaagcagccagtagatcccggcggcggcgagatagagcggcagcggctggaaggtctcggcgatgacctccttggtcgccagcatcagttcggtcacggtgatcacggagatcagcgaggtgtccttgatcaggctgatcaggctgttcgacaggctcggcaccgccaggcgcagggcctgcggggtgatgatgttccacagggtctggccccaggtcaggccgaccgagagcccggcttcccattgtcccttgtcgatgccgaggatcgccccgcgcatggactccgagagataggccgcgacattcagggtcagcgccaggatgcccgcggtgaccggggtgaactcgatgcctacgctcggcagcccgtagtacaggacgaagatctgcaccagcagtggcgtcccgcggaaggcgctgacgtagaccgcggcgatctgcgagaccaccggcaccttggtcacccggaccaccgcgacgctgaagccgaggatcaggcccaggaccatcgataccgcggcgaacagcacggtatacatcgcgccctggagcaggaagggccaggccatcccgagcagctcgaccaggttggcgagccattcgagcaatttctgcagcgaattcattcaacactccatcgacaaacacgacggccgcgtctctcgggcgcggccgcttcccccgttcgggcgggaactcacttcggcggctggctgacgtccaggccgaaccacttttccgagagcttggcgaagcggccgtcggccttgatcttctccagcgccgcattcagcgcctcgccgaacttcggattgttcttccggtag

SEQ ID NO: 11204 - DNA, 465 bp, Pseudomonas aeruginosa
ttggtgccctggcccgacgccgagcttgaggcccttgaggtcttccagcgacttgaactggcgggtttcgtcggcgcgcacgatcaactgggcgctggagatggtgtatggctcgctgaagtcgaagaccttgcgccgctgctcgttcaccgagacctggttcagcgcgatgtcgtacttgccgctctgcaggccggcgaggatgccgctccattcggtggtgacgaattccggcttgaccgccagttcggcggccagcagttcgcccagttcggtctcgaagccggtgagcttgccgccctgcttgaagttgaacggcggataggtgccctccagggcgatgcgcagggcgccgcgctggtggacgtcgtcgagcagctcggcatgggccagcggagcggccagggataccagcatcagcaggcggggcagaaatcgcatgtagtactcctcgggtgggaatga

SEQ ID NO: 11205 - DNA, 798 bp, Pseudomonas aeruginosa
acgtcggtcgggcctatgctgttcgttcagcttagccgggcccgcgtcctggacaatcgcgaacctactgggttgcatgcggtctttccaggggttgcgggcattgacccggattatgtgcgcgagcgccgctctaacacgggcttcgcagtggaaatcgctgtgccagcgatgcctttccctgattcggaaggcacgaagagtgccggggaaattccgtccagtggtgtttcccgggtgctaacggaagtgaaaacaggagactcccatgagagtgacattgccttgcctcggtctagccgccctgatgttcggcgcatccgccagcctgatggctgccgacctgccccggacgaaggcgcccgaaggggcgaaagtgtatttcatcacgccggccgatggtgcaaccgtcgacaagaccttcaccgtgaaattcggcctgaaaggcatgggcgtggcgccggccggcgtcgacatgccggataccggccaccatcacctgttggtggacctgaaggagcagccggcgatgaacctgccgctgccgatgaccgacaacatccgccacttcggcaagggccagaccgaaaccgagatcaccctgccgccgggcaagcacaccctgcaactgctggtgggcgacaagaaccacgtgccgctggagccgaccgtggagtcggagaagatcaccgttaccgtcaagtgacggaaacgaaaaaaggaggccgctgggcctcctttttcctttccgccggacgctgccttagaacagcacgcggctacggatggtaccgttga

SEQ ID NO: 11206 - DNA, 1590 bp, Pseudomonas aeruginosa
acctgttgtcccggaggaagtggctggaaagcgaactgcgcgaagcgggtccggccggcgctggccggcacccgcaactcggcgcccagaggcactaagcgcggggggcgtatgctagcatgttctcccttttccttgcccggttgcgacctgagttgttctcaggacgaccatgaatcatttgagagttcccgaatgacccgcgaagccctgatcgaatcgctcaagcccctggtcgagcctggcaagctgctcgacgacgccgcctccctggacgcctacggcaaggactggaccaagcatttcgcccctgcgccgctggccatcgtgttccccaagagcgtcgagcaggtccaggcgatcgtccgctgggccaaccagcacaaggtcggtctggtcccgtcgggcggtcgtaccgggctctccgccgcggccgtggcggccaacggcgaagtcgtggtggccttcgactacatgaaccggatactcgacttcaatgccttcgaccgcaccgtagtctgccagccgggcgtggttaccaagcaactgcagaccttcgccgaggaaaacggcctgtactacccggttgacttcgcttcttccggttccagccagatcggcggcaatatcggcaccaatgccggcgggatcaaggtcattcgctacggcatgacccgtaactgggtggccgggatgaaggtcgtcaccggcaagggcgacctgctcgagctgaacaaggacctgatcaagaacgccaccggctacgatatgcgccagctgttcatcggcgccgaaggcaccctgggcttcgtggtcgaggcgaccatgcgcctggagcgcacgccgaagaacctcaccgctatggtcctcggcacgcccgacttcgactcgatcatgccggtgctgcatgccttccagagcaagctcgacctgaccgccttcgagttcttctccgacaaggccctggccaaggtcctggcccgtggcgacgtaccgcgggcgttcgaaaccgactgcccgttctacgccctgctggagttcgaggcgaccaccgaggaagtcgccaacgaggcgctggccaccttcgagcactgcgtcgagcagggctgggtgctggacggggtgatgagccagagcgagcagcagttgcagaacctgtggaagctgcgcgagtacatctccgagaccatctcccactggacgccgtacaagaacgacatctcggtcacggtttcccgggtgcccgccttcctcaaggacatcgacgccatcgtcgaggccaactacccggacttcgaggtggtgtggttcggccacatcggcgacggcaacctgcacctgaacatcctcaagccggaaaacctcggcaaggacgagttcttcgccaagtgcgcgaccgtcaacaagtgggtgttcgagaccgtcgagaagtacaacggctcgatttccgccgagcatggcgtgggcatgaccaagcgcgactacttgacctacacccgctcggaaaccgaaattgcctatatgaaggcactgaaggcggtgttcgaccccaacgggatcatgaatcccggcaagatcttcgccgagtag

SEQ ID NO: 11207 - DNA, 1845 bp, Pseudomonas aeruginosa
caggtgtcgcaacgcagagggccggtcatccggcccttctcgtctgtggcgggcgccacggatgcctttccacccgttcaggagtcggtaaatgagttaccagcatcaatatatcgacggcaccccgatccacttccccctgggcaagctggtctgcgtcgggcgcaactacgccgaacacgccaaggaactgaacaacccggttcccaccgagccgctgctgttcatcaagcccggctcctgcgtggtgccggtgagcggcgggctgagcctgccgcaggagcgcggctcggtacactacgaggcggaaatcgccgtgctgatcggcaagccgctgtcgcgcaagccgaaccgcgaggaggtcctcgacgcgatctccggctatgcgccggcgctggacctgaccttgcgcgaggtccaggcgaaactgaaggaaaagggcctgccctgggagctggcaaagagcttcgatggcgccggcgtgctgtcgccgttcgtgaacgccgaccagtttcccgacccgaccgacatcggcatccgcctgaccatcaacggcgaggtgcgccaggacggcaacagccgcgacatgctcaatccgatcgtgccgctgatccagcacatcgccgggcatttctcgctacaggccggcgatgtggtgctgaccggcacgccgtccggggtcgggccgctgaacagcggcgacgagttgctgctcgaattgccgggcgccagccgtttcgagacccgcgtgctctgaaccgctgcggccgccgggtgcggccggcctccctagcgccggcagcggaaacgactgtcggtcggctggccgacgcttcgattgacaggccgggggcaatgccctttcatggcgacgcccaagaaaacacctggccaaacagtcgagcctcgcccatgtcccttgcctccaagcttccccgtttccgctggctgctgccggcgttcgtcgtgctcgtcggcgtggtgctgaccatcgtcatgcattgggacgatcgcgccggcctttggtggaaggaaagccaggccagccagcagcagcgcgacgaaagcatctggctgccgggctatcgggtggtgatcgacgccaagccgttgcagggcctggaggaggaagaaacctcggacctggcctacaacccggcaaccaggaccctgttcaccgttaccggcaagcggccgctgctggtggagctgtcgctcaccggcgacgtgctgcgcaccatcccgctgctcggcctgagcaatcccgaaggcgtggcggtgctggagaacggcaacgtcgcggtgaccgacgagcgccgcaataccctgaccatcttccatgtcgacccgcagaccgccgagctgagcaccaagagcctggccgaattcccgctgggcaatatcggcaagaagaacaagggcttcgagggcatcgcctgggatccgcgccagcagcgtctgttgctgagcaaggagcgcgatccgatgaccctgttcagctggaagagcgacggcgggccgagcctgagcggggcgatgaccgcgctaccgagcgacgacctgtacatgcgcaacgtctcggccctcagcgtcgacccgcgtaccggccataccctggtgctgtcggccgaatcgcatctgctgctggagctggacgagaagggcgagccggtcagcttcatcagcctgctcggcggcttcaacggcctggacagcaagatcccgcgcgccgaaggggtggccatcgacgacgagggcacgatctacatggtcagcgagccgaacctgttctacgtgttccgcaagaagagcggcgagcgcctggccaccagcgacgccgattaa

SEQ ID NO: 11208 - DNA, 876 bp, Pseudomonas aeruginosa
tggactcctggcgatcttctgttttttcttcgtggaggcaggttctcagcggcggcgttggccgaggtagtacgacagggcgacgaaggcgatggaaatcatgaggatgatcgaggaaatcgcattgatcttcggggatatgcccatgcggatggagctgaagatgtacaccggcagggtggttgcgccggcgccggcgacgaaataggtgatgacgaaatcgtccatcgagatgatgaacgcgagcatcgccccggacagcacgccgggcatcagcagcggcagggtgattttccagaaggccttccacggcgaggcgtagaggtcggcggcggcctccgccaggcgcgggtccaggccctccaggcgggcgcggatcggcaggtaggcgaaggggatgcagaacacgatgtgggcgatgaggatggtgaacaacgacagcttcaggccgatgaaggagaagaacatcagggtcgccaccgcggtgacgatctccggcaccagcagcggcaggccgagaacgccgttcatcagggtctgcccgcggaaggcgcgaccgcgcatgcccagcgcggcgagggtggccaggacggtcgaggccagggtggcgagggtggcgacgagcagcgagttcttcgccgcgcggaggatttccggatcgttggccaccaccgcataccatttcaggctgaagctctcccagagcgtcgccgactggccgctgttgaagctgagcactaccagcaccaggatcgggatgtagaggaaggcgaagaacagccaggcggcctggcgcacgccgctgaaggtccagagtggattgcggccgttcatggctggcctccgccggcgttggcccggaagcgcaggttgtag

SEQ ID NO: 11209 - DNA, 324 bp, Pseudomonas aeruginosa
tcccggtctcgtgctgcaggcgcttcagctcgatctgcatttccttgcgcagcttcaggtccagcgccgacagcgactcgtcgagcagcagcaccttgggccggctggccagcgcgcgggccagggcgatgcgttgctgctggccaccggacaactggtcggcgcggcgcttgccgacctccggcagcttcaccaggtcgagcatgcggctcacggtggcgtcgatctcgctgcgcgggcggccctgcatctccaggccgaagccgatgttgtcggcgacgctcatgtgcgggaacagcgcataactctggaacaccgtgttga

SEQ ID NO: 11210 - DNA, 753 bp, Pseudomonas aeruginosa
agtcatagccgccttccagccgggcgccccaggaccaggccgaggtgtcgcccgacagacgctggtcgagcagcaccggcccgccggcggcctggaggtagaccgaacgcttgctgtcgtagcgggtatgcccgaggttcagctcgccggccagccattccggaccgccgtcgttgtacaggccgaacaggccgagctgccaggtgtcgccctcgatgcgcccgccatggtccagcttgtcgcggctgcgctggaaggccaggctgccgccgagggtcagggcctcgctgtagcggtagtcgccgagcagatgcacgccggcgcgcctggactccggatcgccaggcatgtcgaaaccgctgtccggcgagacctcgccctccgcgcccacctcgccgtcgaagctgcctaccggccggttgctgccgagcagggtcagccagcggcggtcgtgcaggcgggtcagtgcctggtgctggcgctgcaactggtcttccatctgccgcgccagggcgccgccggaggcggtggaggccagcaggtcggcgttggtcagctccagcaccaggcgcgtcagcaggcgggaaaagtcgcgcatgcgttgctcgatgcgctcctggccgagggcgttggtcagtacttccttgttgtcctcggccgggtcgtgccaggttgagccgccgggaatcgccgggttgtcggtctgctcgtagccgtccaggtcgcccagttcccagttggtcgcctcgatga

SEQ ID NO: 11211 - DNA, 924 bp, Pseudomonas aeruginosa
ccgcttttgttgcagtgtcgccccgcaccggtcatcggcctggggcgagcgggctcaggccttgagggtcttgacgccgtcggcggtgccgagcagcagcaggtcggccgggcgggcggcgaacaggccgttggtgaccacgccgacgatggcgttgatcttctcttccagttccaccgggctgtcgatgcgcaggttgtgcacgtcgaggatgatattgccgttgtcggtcagcacgccttcgcggtagaccggatcgccgccgagcttcaccagttggcgggcgacgtggctgcgagccatcgggatgacctccaccggcagcgggaactggccgaggatgggtaccagcttgctggcatcggcgatgcaaatgaaggtcttggccaccgcggcgacgatcttctcgcgggtcagcgcggcaccgccgcccttgatcagctccaggcgctcgttgctttcgtcggcgccgtcgacgtagaactccagctcgctgaccgtgttcagctcgtagaccgggatgccatgttccttcaggcgcttggcggtggcctccgaactggccactgcgccgtcgaactcggccttgtggcgggccagggcatcgatgaagaagttggcggtggagcctgtgccgacgccgacgatgctcttgctgtcgaggtgcggaagaatgtggtcgacggcggcctgtgccactgcctgcttgagctgatcctggttcatcccgggtgcctgtctggttgcctggccggccgtcccggcggcgcaggcggagggtgcgcgcggccggggcggcccggcgggtttccggcacgtcctgtgccgctgcgatacgaagggacgaattatagcggcctggcgtcctccggtcttgccccggatgaccggcagtcgcggtgttttcctgcggcgcgccggtag

SEQ ID NO: 11212 - DNA, 1575 bp, Pseudomonas aeruginosa
  unsure (324): Identity of nucleotide at the above locations are unknown.
tccgcccggcgggcctggagtagactccgggcttccgtgaagtccgccgaaccgcctccgatgctcgaacaatacgtcaagaagatcctcacctcgcgcgtttacgacgtcgcggtggaaacgcccctgcaacccgcccgccagttgtccgaacgcctcggcaaccaggtcctgctcaagcgcgaggacctgcagccggtgttttccttcaagatccgcggcgcctacaacaaggtcgcgcagctcaccgaggaggagaaggcccgcggggtgatcgccgcctcggccggcaatcacgcccagggcctggccctggcggccaancggcaggggatcagggcggtcatcgtgatgcccaagaccacccccgagatcaaggtccaggcggtgcgcgcccacggcgccaaggcggtgctgcacggcgacgccttccccgaggctctggcccacgcgctgaagctggtcgacgagaagggctacaccttcgtccatccctacgacgatccggacaccatcgccggccagggcaccgtggccatggagatcctccgccagcagcccggccgcctcgatgcgatcttcgtcccggtgggcggtggcggactggtcgccggcatcgccgcctacgtcaagtacctgcgtccggagatcaaggtgatcggcgtcgagccggacgagtcgaactgcctgcaggcggccatggccgccggcgagcgggtggtgctgggccaggtcgggctgttcgccgacggcgtggcggtggcgcagatcggccagcacaccttcgacatctgcaaggaccacgtcgacgaagtgatcaccgtcagcaccgacgagatctgtgcggcgatcaaggacatctacgacgacacccgctcgatcaccgagccggccggcgcgctggcggtggccgggatcaagaagtacgtcgagcgcgagcgcgccgaggggcagaccctggtggcgatcgactccggcgccaacgtcaacttcgatcgcctgcggcatgtcgccgaacgcgccgaactgggcgagcgccgcgaagcgatcatcgcggtgaccattcccgagcggccgggcagcttcaaggccttctgcgaggcggtcggcaagcgccagatcaccgagttcaactatcgctaccacagcggcagcgaggcgcacatcttcgtcggcgtgcagacccacccggagaacgacccgcgcgaggcgctggtggcctatctgcgcgagaagggcttcccggtcctcgacctgaccgacaacgaactggccaagctgcacattcgccacatggtcggcggccatgcggtgaaagtcagcgacgagatggtgttccgcttcgaattccccgagcggcccggcgcgctgttcaacttcctcaccaagctcggcgggcgctggaacatctcgatgttccactaccgcaaccatggcgcggccgacggccgggtggtggccgggttgcaggtgccggaagacgagcgccacctgatcccgcagaccctggaggcgatcggctatccgtactgggacgagaccgccaacccggcctaccagctgttcctcggctga

SEQ ID NO: 11213 - DNA, 1806 bp, Pseudomonas aeruginosa
tggtcagcaagccgctctgaaacgccaacgaaatggacttcaccggccttcgccggttctgtaggaacgcatgcgtattctgctggtaggcgcgggaggtttcgtcgggcggcacctgctcccggcgctgctcgccgccggacacgaactgctcctcaccgcgcgccgcccgccggtcgatgcgcctgccggcgtacgctggctggcgctcgacctggagcggcttgcggaaaggccggacagcttcgcctggcccgccggggtcgacctgctgatcaatgccgccggcaccatgagcctcgacgaggcgagcatggctcgcgtccaggacagcggcgcgcgaacactcttcgacctcgctgcagcccatggggcgaaggtcctgcagatttccgcgctgggcgccggtgcgcacccggacgtggccttcctcgccagcaaggcggcggccgaccgccacctgctggaactgggcatcccggcgctggtgctgcgcccgtccctgctgctggggccgggcggcgccagcagcgcctggctggaacgcctgtcgccgctaccgctgattcccttgctggacaatcgcgcgcgcctgcaaccgctgcatgtcgaggacctggtcggcgcggtgctggccttgctgcgccgctggccggagcgggcgcaggtgattccgctggtgggtccgcaggcgctgacccagggcgagctgctggacgagctgcgccgcgcccagggttggccgcgcggccgctatgtggtgccgcccgcggcgcttctcgatgcgttgggcgggcttggccggcgtgctggctggcggacactgagtccatcgatgctgaagctggtgcgccacgacaacctggccgacccggcactcctcgatgcggcctgcggctatcgttgcgcgccgctggccagtcgcctgctcggctggccgcaggcggcacgcagcctggcggcgctgatgcggccgctgatgctggcggccctggtgctgatctggctgggtaccctggtcgcctgcctggggccgggttacggttggggcctgcggatcctcggcgaggccggcatccacggctggccggcgagcctggcggtgatcgccggggccctgctcgacggtgcgctcggcgtcggcctgctgctccgccgctggcgccggcgcgcgctgctggcgcagttctggctgatgcttggctacagcctggcgatcagcctgatcctgccgcactactggtacgacccctacatggcggtcggcaagaacatcgtgctgatggtggccacgctctggctgctgggcgacgaacctcgagccagggaggcccgtggatgaacctttacctgctgctgaaaaccctgcatatcctttcctcgaccattctcttcggcaccggcctggggtcggcctactacgccctgcgcgcctggcgcagcgggcagttgccggtgatcgcggtgaccttccgccacctggtcgccgccgactggctgttcatcgccaccaccgcggtgttccagccgctcagcggcctggccatggtgcatgtcgccggctggtcgctggcccagggctggttgctgtggagcctgggcctctacgtgttcgccgggctctgctggctaccggtggtgtggttgcagatccgcgtacgcgacatggccgaggcggccttgcgcgaggcgcggcccatcgaaccgctggcgtaccgctacatgaacgcctggttcatcctcggctggccggccttcatcgccttcatggtcatcttctacctgatggtcaacaagccggtctga

SEQ ID NO: 11214 - DNA, 1002 bp, Pseudomonas aeruginosa
agcatcgaatcgccggccaggcatagcgcggtgaccagggcgacgatcacgaccggccgcagcgagccgggagcgggggcagtgtggggcatcctgggtccgccgtggcgctgcccgtcggacggcgcgcttgtcagtgggtcaacgcagggaaatgatcggccagccgcgtttttccgcctcggcgcgcaggcgcggatcggggtcgacggccaccggccggctgaccttctccagcagcggcaggtcgttcagcgagtcgctatagaagctggcgccttccaggttcaggccgttctcgtcgagccagcgttgcaggcgaaccaccttgccgccctggaagcagggcacgtcgaaggtctgcccggtgtagcggccgtcgcgcatctcgcactcggtggcgatcagggtctccaccccgagtcgttcggcgatcgggccggtgacgaagcggttggtggcggtgatgatcaccagccggtcgccggcggcgcggtgctcggcgagcagcgcctcgcccttggccagcacgatcggctcgatcacttcctgcatgaattggcggtgccaggtttccagctgggccatctcggtgcgaccgaggatcgcctgggtgaaggcctggtaggcaaggacgtcgagcttgccggccacgtagtcggcatagaaggcgtcgttgcgcgcctggtattcggcggcgtcgaccaggccgcgctggcacagccattcgccccagctatggtcgctgtcgccggcgagcagggtgttgtcgagatcgaaaagggccagacgcacggggtgactccatcggttggcgggtggcgggagggccgcgagagccttttgcgaaggctcccaccgggccttgggaaaacccctagcctaccggcttttgccggccctgtatcctccccgcacgagtcgcaaagccgcgcgttgccgctatcacaagctttatggaacaatgcgggcacatgcgatttcgaggatgtcccagcgtga

SEQ ID NO: 11215 - DNA, 252 bp, Pseudomonas aeruginosa
aggaactggccccgcgccttctggcgcgggactgaacacggagacaaggccccgagcatgctcaacacgctgcgcaagatcgtccaggaagtgaactccgccaaggatctgaaggcggcgctgggcatcatcgtgcagcgggtcaaggaagccatgggtacccaggtctgctcggtgtacctgctcgacaccgagacccagcgtttcgtcccgatggccaccgaaggcgtcaatgcccaccaaaggcaaggc

SEQ ID NO: 11216 - DNA, 1656 bp, Pseudomonas aeruginosa
  unsure (456): Identity of nucleotide at the above locations are unknown.
ccaccgccgactgtgggcgttgctggcggcctacctgctgctcggattgctgtccggtggcctggacgcaccgctggtctggctggccctgctaccgttccagctcatgctcgggctgctggtgttcggccaggtacgcctgagtgggggtggtggaggctcgtcgggaagctccggcggcggttcctcctcctcttcctcctcttcctcctcgtcgtccggcggcttttccgggggcggtggttccagcggcggaggcggtgcctcgggcagttggtaatgggttcccgttcatttcattcggagacaaggatgtctgcaatcacgcgttatctcgccatgcttcgcctgttcggcatgctgctctgcgccgccgcgattccctccgttgccaccgcgacggtgccggtcaccgtcgcggtggcagcgtccgatgtcgaggaggaggccgtggangcatcggcggtcggcgccgaggccgaagcagcgcgcgatgcgggctacgagtccgcggaggttccagcgctggcgcggcgggtgaccgaccttaccgcgaccctcgacgccgccgagcgtgcccgcctggaagcttcgctggccgcgctggatgcccggaaaggtgcccaggtaacgatcctgatggtgcccagcacctatccggacagcattgaggcctatgcgacgcgggtcttcgaggcgtggaagctggggcgcaaggggatcgatgacggcgtcctggtgctggtggcgaaggacgaccggcgcatgcgcatcgaagtcggctatggcctggaaggaacgatcaccgacatcgatgccgggcggatcatccgcgaatacatgacccctgcgttccgtcagcaagactacgccggcggcctggaagcggcggcgcagcgcctggtacgactgatcgacggcgaggcgttgccgccgccgccgcgcgacccgctggagcccggcgcggtacggcagaccctggctatcgcattcctgctcggcgctctcggcggggtggcgctgctggtacgtccgcgcgcctggtactggaccctgggggcggtagtggcgctcgctgcggcgttggcactggggcggcactggccggcaggggcgatggtggcgctggcggagatggtggcggtcctgggcgtcggcttcggcgcgttgctcaagtattcgcgcggtgcccgctggttcttcgccattcttgtgctctatgcgcaggggctgttctgggcctacagccgttatggcctgccggtgctccattacggattggccgtgccgctttcgctgggactgaccctgctgatgctggccggtgcctggcaggggctgcgcagaggacggcgctgggcctacctgccgggcctgctcggcctgctgctgaccctggccctggagtgcctgctgttgctggtggacgacccgctgaacagcatcgaggcgctgatcatcctgcccgccgcttgcctgccgctgctcatcggttgcaatttcagcgccggcggctcggggggagggcgtcgacgcggcggcgattacgctagctcatcgggttcctcgtcgtccagttcgtccagttcgtcttcggactcgttctccggcggcggaggctcgagtggcggcggtggcgcctccggtagttggtga

SEQ ID NO: 11217 - DNA, 2205 bp, Pseudomonas aeruginosa
cccgcccgacgcgcattccggcgtcaaaagtttgttcggcgcccacctacgggcgccatacgcagggcaggggagtcgagagtggatcgcacgcaactgatcagcaatgtgcgcagcaacctggcgggactggggcgcggcagcctcggcgtgccggtcctgctgctggccatgctggcgatgatgaccctgccgatcccgccattcctgctggacgtgctgttcaccttcaacatcgccctgtccatcgtcgtcctgctggtctgcgtgtacgccctgcggccgctggacttcgccgtgttcccgaccatcctgctggtggcgaccctgttgcgcctggcgctgaacgttgcctcgacccgcgtggtgctgctccacggccacgacggccatggcgccgcaggcaaggtgatccaggccttcggcgaagtggtgatcggcggcaactacgtggtcggggtggtggtgttcgcgatcctcatgatcatcaacttcgtggtggtgaccaagggcgccgggcggatttccgaagtcagcgcgcgcttcaccctggatgccatgcccggcaagcagatggccatcgacgccgacctcaacgccggcctgatcgagcaggaggaagccaagaagcgccgcagcgaggtggcccaggaggccgacttctacggttcgatggacggtgccagcaagttcgtccgcggcgacgccatcgccggcctgctgattctcttcatcaacctgatcggcggcgtcgccatcggcatgatccagcattcgatgtccttcggcgacgccggcaaggtctacgccctgctgaccatcggtgacggcctggtggcacaactgccgtcgctgctgctgtcgactgcggcggcgatcatggtgacgcgggtctccagttccgaggacatgggccagcaggtcaaccggcagatgttcgcctcgcccaaggcgctggcgatttccgcggcgatcctgatcgccatgggcgccgtgccgggcatgccgcatgtttccttcatcggcctcggcgccctggccggcgctgccgcctactggatctggcaccggcagaacaaggccaagcaggtcgccgagcaggaggtgcagcgccagcaggagctgctgccggcgcagcgcgcccaggaggtcaaggaactgggttgggacgacgtcaccccggtggacatggtcggcctggaagtcggctaccggctgatcccgctggtcgaccgcaaccagggcgggcaactgctggcgcggatcaagggcgtacgcaagaagctgtcccaggagctgggcttcctgatgccctcggtgcacatccgcgacaacctcgacctgctgcccaacgcctaccgtctgaccctgatgggggtcagcgtggccgaagcggagatctatcccgatcgcgagctggcgatcaaccccggccaggtattcggcagcctcaacggcatcgccggcaaggacccggccttcggcctggaggcggtatggatcgagcccggccagcgcgaccaggcgcagtcgctgggctacaccgtggtggatgcgagcaccgtggtcgccactcacctgaatcaggtgctgcacaagcacgcccacgagctgctgggccatgaagaagtgcaacagctcctgcaattgctcgcgcgcagctcgccgaagctggcggaagagctggtgccggggctgatttccctgtccaccctgctcaaggtcctgcaggcgctgctccaggagcaggtgccggtgcgcgacatccgtaccatcgccgaggccatcgccaacgtcgctccacggagtcaagatcccggcgcgatggtcgccgcggttcgcgtcgcgttgtcccgcgcaatcgtgcaaagcattgtcgggcttgagccggagctgcctgtgatcacgctcgagccgaggttggaacagattttgctgaacagcatgcagaaggccggacaaggctccgaggacggcatgttgctggagccggggatggccgagaagctgcaacgctcgctgatcgagagcgcgcaacgccaggagatgcttggtaagccggcgatcctgctggttgccggaccgatccgctcgatgatgtcgcgcttcgcgcggatggcggtgcccagcatgcatgtgctggcctaccaggaaatcccggacaacaagcaagtcaccatcgtcgcgacggtgggacagaactga

SEQ ID NO: 11218 - DNA, 855 bp, Pseudomonas aeruginosa
agatcacgaagttgctgccgaactccaattgagcctcgaagattactacggcatcctcagcgacacgcagggcagccgcctgtacagcttcgacgacctgttgcaggacggcgaacatggattgccggaagacaccagcctcagtcacaacgaaccgatccacggcctgctcgacgaacgtttccaggcggccctggcggatgccatcgccaagttgccggagcgcgagcgcctggtgctggcgttgtattacgacgaggaactcaacctcaaggagatcggcgaggtactgggcgtcagcgaatcgcgggtcagccagttgcacagccagtgcgccgcgcgtttgcgcgcgcgcctggccgattggcggtcggcctgaaccggcctcgaccgcagcttgtaaccgttaacgcaaaagaatgtgtggcgcgtcccctggggcgcgctctggtctgtacggaggtttacttggacaagaacatgaaaattctcatcgtggacgacttttccacgatgagacgcatcatcaagaacctcttgcgggacttgggcttcaccaataccgccgaggccgacgacggcaccacggcgctgccgatgctgcacagcggcaatttcgactttctcgtcaccgactggaacatgccgggcatgaccggcatcgatctgctgcgcgcggttcgcgccgacgagcgcctcaagcacctgccggtgctgatggtcaccgccgaggccaaacgcgaccagatcatcgaagctgcccaggccggggtcaacggctatgtggtcaaacccttcaccgctcaggtcctgaaggaaaagatcgagaagattttcgagcgggtcaacggctga

SEQ ID NO: 11219 - DNA, 2283 bp, Pseudomonas aeruginosa
cacgtctctgggagcagccgaatgagcttcgacgccgatgaagaaatcctccaggacttcctggttgaggccggcgagattctcgagcaattgtccgagcaactggtcgagctggagagccggccggacgatatggacctgctcaatgccattttccgtgggttccatacggtcaagggcggtgccggcttcctccagctgaacgcgctggtggaatgctgccacattgcggaaaacgtcttcgatatcctgcgcaagggcgagcggcgcgtcagctccgaactgatggatgtggtgctgcaggcgctggatacggtcaacgcgatgttcgaccaggtgcgcgagcagtccgaaccgaccccggcgacgcccgagctgctggcggcccttgcccgcctggccgagcccgagggcgccgagcccgcggaacctgtgcaagcgccgccggcggccgttccgccagccgagcctgcggcgccgccggaagcgcccgcgcagagtgcctccagcgatatcaccgacgacgagttcgagcagttgctggatgctctgcagggcgacgaagcgccggcctccgccgttgcagaagcgcccgcggctcccgctggcgacgagatcagcgacgccgagttcgaggcgttgctcgaccagttgcacggcaagggcaagttcgtcccgccggcggtctcggccgagcctgcgcaagtccccgccgaggcggtcgagccggccgcggctgccgctggtgacgatatcagcgacgacgagttcgaggcgctgctcgacgaactgcacggcaagggcaagttcggcgatgtcccggaagctgccggcacacccgccgcaccggctgccgcggctccagcggctgcgccggcggagcagggcaaggcgccggccgccgcgggcggcgatgagatcagcgacgacgagttcgagtcgctgctcgacgaactgcacggcaagggcaagttcaacggcgcctccgaggccgtggcggccgccgcggcggtagccaagaacatcgcggcgaagagtcccgcggcgaaaccggtcgctccggccaaggccgccgccgcgcgtccggcggcgcccgacaggcccgcggcaagcgaggcggagaccaccgtgcgggtggatacggcgcgtctcgacgagatcatgaacatggtcggcgagctggtgctggtgcgtaaccgcctggtgcgcctgggcctgaacagtggcgacgaggccatggccaaggccgtggccaacctcgacgtggtcaccggcgacctgcagatgtcggtgatgaagacccgcatgcagccgatcaagaaggtcttcggccgcttcccgcgcctggttcgcgacctggcgcggaacatgaagaaagagatcaacctggagctggtgggcgaagagaccgacctcgacaagaacctggtcgaggccctcgccgatccgctggtgcacctggtgcgcaacgccgtcgaccacggcatcgagagtccggaggagcgcgaggccgccggcaagccgcgggtcggccaggtggtgctgtcagcggagcaggagggtgaccacatcctcctgatgatcaccgacgacggcaagggcatggacgccgaggtgctgcgcaacaaggcggtggagaagggcctgctggagcgcgatgcggcggaccgcctgaccgacctggagtgctacaacctgattttcgccccgggtttctcgaccaagaccgagatttccgacgtgtccggccgcggcgtcggcatggacgtggtgaagaccaagatttcccagctcaacggcacggtcaacgtgttctcgcagaaggggtccggctcgaagatcgtcatcaaggtgccgctgaccctggcgatcatgcctacccttatggtgatgctgggcagccaggcgttcgccttcccgctggtcaacgtcaacgaaatcttccatcttgacctgtcgcgcaccaatgtcgtggatggccaggaagtggtgatcgtccgcgacaaggccttgccgctgttctacctcaagcgctggctggtgccgagcgcggcccacgaggagcagggcgaggggcacgtggtgatcctgtcggtcggcacccagcgcatcggtttcgtcgtcgaccagttggtgggacaagaagaagtggtgatcaagccactcggcaagatgttgcagggcacccccggcatggcgggcgccaccatcaccggggacgggcgcatcgccctgatcctcgatgtgccgagcatgctcaagcgttacgcacggcgcatctga

SEQ ID NO: 11220 - DNA, 927 bp, Pseudomonas aeruginosa
tctacgggatgccgatggccgtggtcaaggccaacctggcggacgcggtgtacgggctcgacgacatcggccggcacctggtcgaggcgtgccagtaagcgtgcgtgcaggaatgaggagactgccttcgatggccacccacgtgacgacctgcgcgcgccttcgccgagccgagaggacgcgctgatggatgtgctcagcctggtcgggatcatcctggcgttcgtcgccatcgtcggcggaaactttctcgagggcggccacgcgggggccctgctcaacggtccggcggcgctgatcgtgatcggcggcaccctggccgcggcgctgttgcagaccccggtgaacgtgctcaagcgcggcctgggcatgctcggctgggtgttcttcccgccgcgcgaggatctttccgggggaatcgaccggatcgtctcctggagcatgaccgcgcgcaaggaaggcctgctcggcctggagagcatcgccgacgcggagcccgatccctatgcgcgcaagggcctgcaactgctggtggacggcgccgagccggaagtcatccgcagcatcctcgaggtcgacctgttcacccaggaaagccgcgacctgcaggccgccaaggtgttcgagagcatgggcggctatgcgccgaccatcggcatcatcggcgcggtaatgggcctgatccatgtgatgggcaacctggccaacccggcgcagctcggcagcggcatcgccgtggccttcgtcgccaccatctatggcgtcggcttcgccaacctgctcctgctgccgatcggcaacaagctgaaaaccctggtgctgcgccagtcgcgctaccgcgagatgctcctggagggcctgctgtccatcgccgagggcgagaacccgcgttccatcgagttgaagctgcaaggcttcatggactga

SEQ ID NO: 11221 - DNA, 903 bp, Pseudomonas aeruginosa
ccggagccgagcatgcagcgccgccgtcgccaccaggaggaacacgagaaccacgaacgctggctggtttcctatgccgacttcatcaccctgctgttcgccttcttcgtggtgatgtattcgatttcctcgatcaacgagggcaagtacaagatcctctcggagaccctcaccggcgtgttcaaccagcccgaccgctcgttgaagccgattcccatcggcgacgagcggccgcgcaccaccgagccggagcgcaccagcgtcgaggagcagcccagcgacaacgcggccagcgccgactcgctggagcggatcgccgacagcgtgcgcgatgccttcggcgacttgatcgcctccgaccagttgagcgtgcgcggtaacgagctgtggatcgagatcactcttaattccagcctgctgtttcccagcggcgatgcgctgcccaacgatgccgccttcgatatcgtcgagaaggtcgccaagatcctggcgccctacaagaacccgatccatgtcgagggcttcaccgacgacgtgccgatccatagcccgcgctatcccaccaactgggaactgtcggcggcgcgggcggcgagcatcgtccgcctgctcggcaacgatggggtcgagccgtcgcggatggctgcggtgggctatggtgaatttcagccggtggcggacaatgccagcgccgaggggcgggcgaagaatcgccgggtggtgctggtgatctcgcgcaacctggaggtgcgacgcagcgtcagcggggtcggcagcggcaaggcgcaaccggattcggcgctccgccacgcaggctcggcagctggcacgcaagctgcagatactggcggtacgccggcgcccgcgccggcaaccgtcaattccccgtcgccttcgccatga

SEQ ID NO: 11222 - DNA, 792 bp, Pseudomonas aeruginosa
actttccctgtcgatgcgtggctgtcgccacgctcattccaggagagtcccagcatgcctgacatcacccaagccgccatcgtcaccggcgcctcccgcggcatcggtcgcgccattgcccggcggttggccgccgacggtttcgcggtcgcggtcaactatgccggcaaccagaccatggccgacgaggtcgtggccgaaatcgtcgccgccggcggcacggccatcgccgtacagggcgacgtggccagcccggaggacatggacaagctgttcgaagccaccaggagcgccttcggccgcatcgacgtggtggtcaacagcgccggcacgatgccctacctgaagatcgccgacggcgacctggagggcttcgaccgggtgatccgcaccaacctgcgcggcgccttcatcgtgctcggcctggctgcccggcatgtcgagcgcggcggacggatcattgccctgtccaccagcgtgatcgcccgggcgctgcccagctacggtccgtacatcgcgtccaagtccggggtcgaggggctggtgcacgtgctggccaacgagttgcgcggccaggacatcagggtcaacgcggtggcgcccggcccggtggccaccgagctgttcttcaacggcaagagcgccgaacagatcgaccagatcgccaggctggcgccgctggagcgtctcggcgaaccggacgagatcgccgcggcggtgtccttcctcgccgggccggacgggacctgggtcaattcccaggtgctgcgggtcaacggcggtttcgcctga

SEQ ID NO: 11223 - DNA, 399 bp, Pseudomonas aeruginosa
tcggtggcgccctgcatcaggcgcgcctcgaggaacaggccgctctgctgcagggcctggccgagcagcttggaatcgcccatcttctgcgcctccggcaggccggcgaagaggcgctccacggcctggcgcaggctgtccggcaggtcgttgcggccgttcagcccctgcagggcggcgaacaggccttccagggaagcctggcgggcgctctgcccggccagttgctggcccagcgcaagctggtcgaggcgtccgctgagcggcaggaagtcgatctgctggctgtttttcaccagcgccgtgagcaggctgccgaccggcagcgcctggggcgagtcgaggctcagcttgctgccggcgagcggcgtgttgagcaggttcagcaggacccggtag

SEQ ID NO: 11224 - DNA, 645 bp, Pseudomonas aeruginosa
ccacccaccacagcctgcagcagatgcccgccggctaccgcgagctggacctcggtgcgctcaaggcggccagcggcgcgacggtcgagccggcgctgggcgacccggcatgagcaacgtcttcagcctgctcctggcgcgcgaggcgcgcctgctgttccgccgaccggcggagctggccaatccgctggtgttcttcgccatcgtcatcgccctgttccccctggcggtcgggccggagagccaattgctacaaaccttgtcgcccggcctggtctgggtggcggcgctattggccgtgctgctctcgctggaagggctgttccgcagcgatttcgaggacggttctctggagcagtgggtcctttcgccgcaccccctggctcttctggtgctggccaaggtgctggcacactggctgttttccgggctggccctggtcctgatgtcgccgctgttcgcgctgatgctgggcctgccggcccgttgcataccggtgctgctgctttccctgttgctcggtacgccggtgctgagcctgctcggcgccgtcggcgcggccttgaccgtgggcctcaagcgcggcggcctgttgctggcgctgctgatcctgccgctgtacatcccggtgctgattctcggtag

SEQ ID NO: 11225 - DNA, 819 bp, Pseudomonas aeruginosa
cccgggctggcagcggaaggtctgcccggtatttccaaagagccctgtaaacagagcctgatgatgaattggacatggtttcacaagcttgggtcgcccaagtggttctacgagatcagcggccgctggctgccctggttcgccgtggcggcggcgctgctgatcgtcaccggctgcgtctgggggctggccttcgcgccgccggactaccagcagggcaatagcttccgcatcatctatatccatgtgccggcggccttcctcgcccagtcctgctacgtcatgctggccgtggccggtgccgtcgggctgatctggaagatgaagatcgccgacgtggcggtgcagtgcgccgctcccatcggcgcctggatgaccttcgtcgcgctgcttaccggggccgtatggggcaagccgacctggggcgcctggtgggtctgggacgcacgcctgacggcgatgctgatcctgcttttcctctatttcggcatcatcgccctcggccaggcgatcagtaaccgcgacagcgcggccaaggcctgtgccgtactggccatcgtcggcgtggtgaacatcccgatcatcaagtactcggtggaatggtggaacaccctgcaccagccggccaccttcaccatcaccgagaaaccggcgatgccggtggagatgtggttgccgttgctgatcatggtcctcggcttctattgcttcttcgcggccatgctgctggtgcgcatgcgcctggaagtgctcaagcgcgagtcccgcaccacctgggcgaaagccgaggtgaaggccctggtggagaaggcacgatga

SEQ ID NO: 11226 - DNA, 1683 bp, Pseudomonas aeruginosa
agtgctggccaagcacgacgagaactacatgccgccggaagtcaccaaggcgctcaaggacagcggccaactgaagcactacgagaacggcaaggccgccggcgagacctcgtacaaccaggagggcaagtagatgatccccgaactcggccacctggccctgatcctcgccctctgcctggccctggtgcagtcgagcctgccgctggtcggcgcctggcgcggcgaccgccagtggatgagcctggcgcgcccggcggcctgggggcagttcgccttcctcgccttcgccttcggttgcctgacctgggccttcctgcgcgacgacttctcggtggcctacgtggccggcaactccaacagcgcgctgccctggtactacaagttcagcgccgtttggggcgcccacgaaggttcgctgctgctctgggcgctgatcctcggtggctggaccttcgccgtgtcgatcttctcccggcaactgccggaggtcatgctggcccgcgtgctggcggtgatgggcatgatcagcaccggcttcctgctgttcctgatcatcacctccaacccgttcagccgcctgctgccgcagacccggatggacggcgacgacttcaaccttctgttgcaggacgtcggcctgatcgtccacccgccgatgctatacatgggttacgtcggattttcggtggctttcgcgttcgccatcgccgcagtgctcggcggccgcctggacgccgcatgggcgcgctggtcgcggccgtggacaatggtagcatgggctttcctcggtatcggcatcgtgctcggctcctggtgggcttactacgagctgggctgggggggctggtggttctgggatccggtggaaaacgcttccttcatgccctggctggtcggcactgcactgatccactcgctggcggtgaccgagaagcgcggcgtgttcaagagctggaccgtgcttctggcgatcgccgctttctccctgagcctgctgggcaccttcctggtccgctccggcgtgctcacctcggtgcacgccttcgcctccgacccggagcgcggggtgttcatcctcgccttcctgctgctggtggtcggcggctcgctgaccctgttcgccctgcgcgcgccggtggtcaagagccaggtcggcttcgccctgtggtcgcgcgagaccctgctgctgctgaacaacctggtgctggtggtggcggcctcgatgatcctcctcgggaccctctacccgctgctgctcgatgccctcagcggcgccaagctgtcggtcggcccgccgtacttcaacgccatgttcctgccgctgatggcggcgctgatggcggcgctggcggtcggcgtgctggtgcgctggaaggacaccccgagccgctggctgctcggcatgctgaccccggtgctggtggccagcgcggtcctggcggcggccggttcgatgtacttcggcgatttcaactgggcggtgctggcggtgttcctgctgtccgcctgggtggtcctggccggtttccgcgacttcctcgacaagacccggcacaagggcgtgctggccggcgcccgcagcctgacccgcagctactggggcatgcaactggcgcacctgggcatcgccgtgtgcgccatcggcatcgtcctcagcagccagtacagcgcccagcgtga

SEQ ID NO: 11227 - DNA, 1179 bp, Pseudomonas aeruginosa
cggtgcctgggcggtgcgcgtgcacgtcaagccgttcgtccgctggatctggttcggtggcctgctgatgggcctcgggggcgccctggcggcgctcgaccggcgctaccgggtgaaggtgaaaacacgtgtgcgcgaggccctgggcctccccggtcagggagcctgagtcttgaaacgagcgattctgctgctgccgctggggatcttcctgatcgtcgcggtgttcctcttccgcggcctctggctggaccccagcgagctgccctcggcgctgatcggcaagccgttcccggccttcgacctgcccagcgtgcaggacccggcccggcgcctgaccgaggccgacctcaagggcaagccggcgctggtcaacgtctggggcacctggtgcccgtcgtgccgggtcgagcacccggaactgacccgactggccgagcagggcgtggtgatctacgggatcaactacaaggacgacaacgccgccgccatcaagtggctgaacgagctgcacaatccctacctgctgagcatcagcgacgccgacggcaccctgggcctggacctgggcgtgtacggtgcgccggaaacctacctgatcgacaaacagggcatcatccgccacaagatcgtcggggtggtcgaccagaaagtctggcgcgagcaactggcgccgctgtaccagcaactgctggacgagccggaggcccgatgaagcgtttcctcgccaccgcgctgctcggtctcgccctctgcggcgtggcccgggccgccatcgacacctacgagttcgccagcgacgccgagcgcgaacgcttccgcaacctgacccaggaactgcgctgcccgaagtgccagaaccaggacatcgccgactccaacgcaccgatcgccgccgacctgcgcaagcagatctacggccagttgcagcagggcaagagcgacggcgagatcgtcgactacatggttgcccgctacggtgatttcgttcgctacaagccgccggtcaacgagcgtacctggctgctctggttcggtccgggcgccttgctgctgttcggcgtgctggtgatcggcgtgatcgtcctgcgccgccggcgcaccgctgccaaggtgcaaaccaccctgtccgccgaggagcaagcgcgcctcgccaacctgttgaagaacgacaaatga

SEQ ID NO: 11228 - DNA, 453 bp, Pseudomonas aeruginosa
ggtagtactcgctctgccggaaatggtccggggcgatctcctcgaggcggtacaggccgctggccaggccttcccggcaagcctggtagaaggggtcgagcaggtacagcccgttcaggtaggcgagcatcgaggccggcccggcgtgcggttcggcgtcgtattcctccagggccaccggcacgccgttggcggggtagaagatcgccagggcgttgtcgaacggcaggtgctggcgcagcagcaggatcaattgcttccagaaacggttgccgccgatctgttcgatggcgcggcccaggctggcgtgcatgccgatgtcccggaacagggtgtgcatccgtattcgctccacggtgggttttcgcaggctccggtttgcggcttttccacccgccgcgtcaaggggcgcaaccccaaagggtgattggcccgccggttccgcgctcctag

SEQ ID NO: 11229 - DNA, 1395 bp, Pseudomonas aeruginosa
caatcagaggacaacgacatgagctcttcccccgcgcccgaaagtgcgctgaaacccacgctgggcgtgttcgacgtggtcgccatcaccgtttccgcagtcactcccgccagttccgtcttcgtcatcgcccccttcgccatccagcaggccggcaccggcgctttctgggccttcgccctggccggggtgctggcgctgatgttcgcctggtgctatgccgagctgggcagggcgcacagcaccgccggcggcgagtatgtctacgccaagcgggtgttcggcggcttggccggctacgccaccttcctcacggtgctggcgatgctgctgttcatcccgccggtgctcgccaccggcgcggcgacttacctgaacgctgccctcggcacccacttcgatgcgcagaccgtggccctggcgatcgttgccttcagctacctgctgggcatcctcaacatccgcgtcaacgcctgggtcacgggtacctgcctgctgctggaagtggcggcgctgctggtgatcgtcggcctcggtttcggccatgtacagcaaccggcgagcgtccttctgcagccgcaggtagtcggcgacggcgggctgctggcgatcgcaccctgggcattggtgatcggagcggtcggtaccgcgctgttctcctacaacggtttcggcggcgcggtgctgctcgccgaggacatgaaggacggcggtcacagcgtgcatcgcgcggtgctctggtcgctggcgctggtagtactgatcgagatcgtcccgctcgccgcgctgctgatcggcgcgccgtcgctcccggcgatgctcgccagccccgacccgatcggctacctgttgaacagccatggcaacgagacgctgtcgcgcctggtcagcgccgggatcttcctctcggtgttcaacgccatcgtcgccatcgtcatccagagcgcccgggtgatcttcagcagcggtcgcgacgcgctctggatgccggcgttgaaccgtgccttcacccgtatccatccgcgctgggaatcgccctggctggccacgctgttcctcgccattccctcggcggcgctgagcttcagctccaacctggccgaactgacctcgttcaccgtgttgctgatcgtcatggtctacctgatcgtcgccctctgcgcgctgttcagccgggtgctgcggcgcgaccgcgagcatccctaccggatgccgctgtggccgctgccggcgctgccggcgctgctggcggtgagcggcgcgggatacctgctgctcaacctgttcctggcggcctcggccagggacgtgatgatcattgtcggactgctggcggtgtcggtgattctctactgcacctacggcaagctcagtccggcgttccagaagctttga

SEQ ID NO: 11230 - DNA, 555 bp, Pseudomonas aeruginosa
aacaggagtccgcatgcgcgctcgacaacttggcatcaccctcggcctgggcactcccggcccgttcaacgcgatcaccgacgttcccggcgtgcgcgtcggccacagcaccctgaaccagcggatcgacggcaggcaggttcgcaccggcgtcaccctggtccagccgcgcgccggtgcggcgcgcctgcaaccctgcttcgccggctgccatgtgctcaacggcaacggcgacgccacgggcctggagtggatccgcgaagccggcctgctgaccaccccgatcgccatcaccaatacccacagcgtcggcgcggtgcgcgacgcgctgatcgccgaggagcgcgccgaactcggcgacagcgggctgtactggtgcatgccggtggtgatggagaccttcgacggcctgctcaacgatatctggggccagcatgtcggcgcccgccaggtcggcgaggcgctggcctgcgccgagtccggaccggtccgcgaaggttcggtgggcggcggcaccgggatgatctgccacgagttcaagggtggcatcggtag

SEQ ID NO: 11231 - DNA, 690 bp, Pseudomonas aeruginosa
cgcatcgcggcggctgccggcggagcagggcggctggacggtgggcgcgctggtccaggccaaccacggccagcgtcgcgagctgcgggtcgatggctatccggtcggccgccggctgggcgacatcccctcgccgttcagcgaggaaggcaccccgggcatgggctccatcgtggtgatcctggccaccgacgcgccgctgctgccgcaccagtgccagcgcctggcgcagcgcgcctcgatcggcatcgctcgcaccggcggtggcaccgaggactccagcggcgacgtgttcctcgccttcgccaccggcaaccaggacctgccgccagccgactatgcgcgcaaggacctgccgcagagcacgccgctgcggatgctcaacaacgaccacatctcgccgttgttcgccgcggcggcggaggcggtggaagaagccatcgtcaacgtgctgctggccggcgaggacatgcgcaccgaggacggccggctggtgcccgcgctgaagggggagacgctcctggcggcgctgcgcgagaccggctggccgggacgctgaaagcggctcagcgccagccgcgggtgcgcgccaccgcttcgctgaaacgcacctgccagcgccgggcggtgccggcgtcgacccgcggctggaactccgtgcgggtattgcgcggctccgccagctcgtag

SEQ ID NO: 11232 - DNA, 993 bp, Pseudomonas aeruginosa
aagagaaacagtcaatcgattaatcgacgggcagccaccggcacagccccggtctgtctccggggctgcccgcgaggggagtcaggcctgcggggtgcgcaggggggcttcgtggacttccacccgcgcctgttgcagggcttcccagagttccccggtaggcttgcggtcgaccaccaggcggttgatccggctcagcgggaagacctggaacagggcgcgccggccgagcttcgaggagtcggcgataaccgtcagttggcgggcctgggcgatcatggcacgggcgatctcggcttcctcgatggaaaaatccatggcgccatcgccgttcagcgcgccgacggtgatcaccgcatgctcggcgttgaaccgggcgatctgctcgatggccagggcgccgacgttctgttcggattccgggcggtactcgccgccgatcatgaatgcacggttgccggaggcgccgacgctgccggcgatcaacagcgagttggtgatcaccgtcagatggctctggcgcgccagttcgcgggcgaacagcagggtggtggtgccggtgtcgatgaagatgctgtcaccgggcccgaacaggccggcggcgtagcgggcgactgcgcgtttttcctgggcgtgctcgttcattcgcgtctggaaggcgttctcgtgctcgccgctgggcggcagggcggcccctccgtggaatttgctgaccaggccttgttcggccagcgcggcgaggtcgcggcgaatggtttcctgagaggtggaaagggtccgcgccagttcgtccaccgagatccgctcgcgctggcgcagcaattcgagaatgtggcggcggcgttcctcggggcgcatcgtgttctcccatgggccgcatcctggtgcggcgattgttaccgtgaatcgcccggtagcgcctggcggcgctgggcggaagggggcggggcgaggctttgcgcaggcccggcggaaaatcccacaggtccgtaa

SEQ ID NO: 11233 - DNA, 1413 bp, Pseudomonas aeruginosa
ggcaggtacgctcttggattggccgcctacttgaccgtatgggtgaccaatttaggtaaaacgaaccttcaaatcaacacgaaaaccaaattgtggcacgcgaaatgcgagtgttcgcttcggcggagcgaccggcgtggccggcctcccgaccagacaaccagaagaacgcatcccgctacgggagcctgccgaggggagaacgacgcagatggccgagttcggaaactatgtgatttacctgatcatgctgggtgcggtacttggcgcgctggcttccatcctgcgcccggaaagcggtctgggccgcgagttcgtcaacggcatccacgccatcggtccggtgttcctcgcccaggccggcatcatggtagccattccctatctgtcgaaggcgatttcccatgccctcggcccgttcttccagaccctcggttccgacgtatccatcgccgcgctgtcgatcatcgcggtggacatgggcggctaccagttggccgatgccctgaccgccaaccgcgacatgtggattaccgccatgctggtgggctacacctccggcgcgaccatcgtctacctgatcccggtcggcctgaccatgctcgagcgcaaggaccacaagtacctggcgctgggggcgatggccgggttgatcagcattccgttcgcggtgctggcggcgttgctgctgattaccctcaaccacatcccggtgcgcgaactggtatcgaccggttcgccggccctgcactacctgtcgctggacttcctcgacatgcttcggctgctggcgccgctgttcgtcttctgcttcctgctggccgccggcctgaagtaccgggcgacggcgatggtcaccgggttcctggtattcggcaaggtgatggacgcgttcatcaagatggccctggcgctttccatcgtccagcacttcaccggagtcttcaccaaggtcttcggcggctggggcttcgacccgatgttcgccgacgagaaagagttgttccgcgccatcgagatcgctggctacatcggcatcatgctggccgggaccttccccatctgctacctgttccagcgctactgcaagcgcccgatggcggtcctcggccgttacctggggctgtcccagccgggcgccaccgcctttgtcatggtactggcgaacatcatcgccacctaccacctgttcaaatacatgaatgctcgcgacaaggtgctttgcgtggccctgggcgtctgcgcccaggccaccatcggcgatcacctggcattcaccgccaacttccagccgacgctgatcctgccgatcctgctcggcaaattgttcggcggcctgctggcggtattcatcgccatccgcatctcggtgcctgccgccgagcgctatgcccggcaggagcaggagcatga

SEQ ID NO: 11234 - DNA, 450 bp, Pseudomonas aeruginosa
cgaggcggaaaaaagcgccctgcacgcagcctgaaacatcccccgacgagcgccgcgagccatcgcggcgtcgctttccgcaacgaggtaaccatgcgcaagatattcctagcctgtccctacagccatgccgacgccgaggtggtcgagcagcgcttccgtgcctgcaacgaggtcgcggcgaccatcgtccgcgccggccacgtggtattcagccaggtttccatgtcccacccgatcaacctgtgcctggccgatctcgaccgcgcggcgatcggcaggttgtgggcgccggtggacgccttctacatggatcacctggaagagctgatcgtcctcgacctgccgggctggcgagacagcgccggcatccgccgcgagatggagttcttcgaggccggcggacagcgggtgagcctctggtccgaggtggagcacgagtttcgctga

SEQ ID NO: 11235 - DNA, 1092 bp, Pseudomonas aeruginosa
actgcaagccgaatgaaaaagccggaagcgcgagcgcttccggctttttcgtcgagcggcgagggatcagttggggctgtagatctggtcgaatacgccgccgtcgatgaagtgggtcttctgcacgctgcgccagtcgccaaaggtcttctccaccgagaagaagtcgactttcgggaagcggtcggcgaacttggcgaggatctccgggttgcgcgggcgcaggtagttgttggcggcgatggtctggccttcgtccgaccacaggtacttcaggtaggcctcggcctgggcgcggctgcctttcttctcgaccaccttgtcgaccaccgccaccggaggctcggcctcggcggacacgctcgggtagaccacctcgaagccgcctcggccgaattcgcgggcgatcatctcggcttcgttctcgaaggtcaccagtacgtcgccgatctggttctgcatgaaggtagtggtggcggcgcggccgccggtgtcgagcaccggtacctgcttgaacagtttgccgacgaactccttggccttgttctcgtcaccgccgttcttcagcacgtagccccaggcggagagataggtatagcggccgttgccggaggtcttggggttcggcaccactacctggacgccgtccttgagcaggtccggccagtccttcagggccttggggttgcccttgcgaacgatgaacacggtggccgaggtgaacggcgcgctgttgttcggcaggcgggtcgcccagtccttcggcaccaggccgccgttgtcggcgagggcgtcgatgtcggtggcctggttcatggtgatgacgtcggcgggcagaccgtcgatcaccgagcgcgcctgcttgctggaaccgccatgggacatctggatggtgatgttctcgcctttctccgctttccagtatttctggaaggccgggttgtattccttgtagaagtcgcgcatcacgtcgtaggagacgttgagcaggggctgggcggcgtgagcggcgccgccgagcgccaggccggcggccagcagggaggcgctgaacagtcgtttcacagggcagttcctttgagcatgttgtag

SEQ ID NO: 11236 - DNA, 498 bp, Pseudomonas aeruginosa
accggaggccttgaatgtccatggcctgcatgggagtgcgcgagggaggccatggtccgacaagaaggtctttcccggatggatggagacgcggccccgtatttccggccccatccatccgagagagacaagggtggcccgacccgcatgcccggggggacggcgcgagccggaccgaactcgttgcttcagagatctcccagcggcggcgccacggtctcgatgcgcagcatgttggtcgagccggggcaaccgaacggcacgccggcggtgaccaccacggtgtcgccgcggcgcgccatgcgctgggccagggcgatgtcgagggcggtcgagcagatctcgtcgacgtgcgccagttgctcgttgaccaccgaatacacgccccaggctacggtcagtcgccgcgcggtgcgcaggttcggggtcaggctgaggatcggcgccttgggccgctcgcgggcggcgcgcagggtcgagttgcccgactcggtgtag

SEQ ID NO: 11237 - DNA, 828 bp, Pseudomonas aeruginosa
tccggctcggcctccacctggcggacgatcttcgccatcatctctaccgcctcgcgagggtattgtccggaagcggtttccgccgagagcatcaccgcgtcggcgccggcgcccaccgcggtggctacgtcggtcacctcggcgcgggtcggggcgggggagaagcgcatcgactcgagcatctgggtggccaccaccaccggcttgccgagctggcggcagacctggacgatgcgtttctggatgcctggcacgctctccgccggcacctctacgccgaggtcgccgcgcgccaccatgatcgcgtcggcgcgctcggcgatcgcctcgatggcgctcaccgcgctgggcttctcgatcttggccatgaggaaggccttgtcgccgatcagcccacgggcctcgtcgatgtcctccgggcgttgcacgaaggacagcgccacccagtcgacccccagttccaggccgaaggccaggtcgcggcggtccttgtcggtcagcgggctgagttgcaggaccgcttccggcacgttgacgcccttgcgatcggacagctcgccacccaccgccacgcgggtctcgatggcgtcgctgtggcagttgaccacttccaggcggatcttgccgtcgtccagcagcaggctcatgcccggttccagggcatggatgatctccggatgcggcaggttgacccgccgctcgtcgccgggggcgtcgctgaggtcgagagtgaaggtctgcccacgctgcaattgcacggcaccggcggcgaagcggccgacccgcagcttcggaccctgcaggtccatgagcacgccgatcgggtag

SEQ ID NO: 11238 - DNA, 1668 bp, Pseudomonas aeruginosa
tcgccgtggctgaagttcaggcggaacaggttggcgccggcctccaccagggcacggatatcgtcgcggctgcgggtggccgggccgagggtggcaaggatcttggctttcttgtcggctgtcatgtcaggactcgaggatgagaatggcgcggaagtcgttcacgttggtgcgggtcggtccggtcaccagcaggtcgccgagggcctggaaatagccgtagccgttgttgtcgtcgagctcgtcgcggatcttcagcccggccttttcgccgcgggcatgggagcagggcgtcatcagcgcgccggcgttgtcttccgagccgtcgatgccgtcggtgtcgccggccagggcccagatgttcggttcgcccttgagctcggcggtgaggctgaggaggaactcggcgttgcgtccgccgcgaccgttgccgcgcacggtgacggtggtctcgccgccggagaggatcacgcagggcgccgccagcggctggccgtgcttgcggatctgccgggcgatgccggcgtggaccttggcgacttcccgcgcctcgccctccaggtcgccgaggatcagcgtcgagaagccggccgcgcggcacttcaccgctgctgcgtcgagggcgttctgtggcgtggcgatcaactggaagtggctgcgcgccaggcacgggtcgtcgggcttgacggtttccgagcgcgggtcggcgagccagtcgaggacgttctgcggcacgtcgatggcgtagcgcctgaggatcgccagggcgtcggcggaggtggtcgggtcgccgacgctggggccggaggcgatcaccgtggcctcgtcgccgggaacgtcggaaatcgcgtaggtaaagacgctggccggccagcaggccttggccaggcgaccgcccttgatcgccgagaggtgcttgcgcacgcagttcatctcgccgatggcggcgccggacttgagcagcgccttgttcaccgcctgcttgtccgccaggccaatgccttcggcaggcagcgaaagcagtgcggagccgccgccggagagaaggaagatcacccggtcgctctcgttcaggccgctgatcagttccagcacgcgacgggcgacgcgctcgccggcgtcgtcgggcaccggatgggaggcttccaccacctcgatgcgactgcattgcgcgccgtagcggtaaggcgccactaccaggccctggatctcgccctgccagtgcttctccaccacttcggccatggctccggcggccttgccggcaccgatgacgatggcgcgcccgctgcgatcttccggcaggtggtcggccagcacctggtagggatggccggctgccaccgcggtattgaacagctcggtgagaaaggcgcgtggatcggtactcatgacaggctccgaatttcttgttgtcgtgccgccggtcggaccggcggtcgcagcgtcgtcgacgcttccattccgcagcacccgcgccggcgggaactggggaatggaagcgaggcgcccggacgcagaggccgtgaatctcccggccgggcgttcgcttcctttaccccgccttgtgggcggggaaggaagagggcggcggcgaacaccggagttcgccgaccgttcctctccccgagcccttcgaaaaggggttcgtcgctccgcgcggggtga

SEQ ID NO: 11239 - DNA, 1113 bp, Pseudomonas aeruginosa
cggcccgcgcggactgcggatcactcgtcgcggatcgagaagttggccatgtgctccaggcccttgatcagcgccgagtggtcccagttactgccgccgatggccgcgcaggtgctgaacacctgctgggcgttggcggtgttgggtaggttcaggttcagctcgcgggcgccggccagggccaggtttaggtccttctggtgcaggctgatgcggaagcccgggtcgaaggtgcccttgaccatgcgttcgccgtgtacctcgaggatccgcgaggaggcgaagccacccatcagcgcctcgcgcaccttggccggatcggcgccgttgcgggcggcgaacagcagggcctcggcgaccgcctggatgttcagcgcgacgatgatctggttggccaccttggcggtctggccgtcgccgttgccgccgacgcgggtgatgttcttgcccatcgcctggaacagcggcagggcgcgttcgaagctgttcgggcagccgccgaccatgatgctcagggtcgccgccttggcgccgacctcgccgccggagaccggggcgtccagatactgcgcgccggtagccttgatcttctcggcgaagcccttggtggcggtgggggagatcgaactcatgtcgatcaccaccttgttcgggccgacgccctcggcgataccgtccttgcggaacagcacatcctcgacctgcggggtgtccggcaccatgacgatgatgaactcggcttcctgggccacttccttcgggttggccagggcaatggcgccggcctccagcaggtcggccggagcggcgtcgtggtgggtggaaaggaacaggctgtggccggccttctgcaggttctgcgccatgggcttgcccatgattccggtgccgatgaatccgatcttggccatgagagtgtctcctggttctgtctgtcgagtggctccgcgcagggaggcgggagcgtcttgttcgtgggtgcggatcagacgacgttgtgcgtcttcatccagccgaggccggcttcggtggtggtggccggcttgtactcgcagccgatccagccctggtagccgatgcggtccaggtgctcgaagaggaagcggtagttga

SEQ ID NO: 11240 - DNA, 1959 bp, Pseudomonas aeruginosa
acagcatggacaggttggcgcagaaacggggcatgtcttgctcctatcgttcggtcaaacgttcgggaggcctttcgccgggggcggggtgccgcacgcaccgtccgcgcctccgggaaaggccggcgatcagtcgagcagcgagatggcggtcggcgcgtcggcgcctttctcggccagttcctcgaactcgttgatggcgttgatctcggtacccatggagatgttggtgacgcgctccaggatcacctcgaccaccaccggcacctggtgctgttgcatcagttcgcgggccttggccagggcggcgccgatctcgttcgggtcgaacacccggatcgccttgcagcccaggccctcgaccaccgcgacgtggtcgacgccgtagccttccagctcgggggcgttgatgttgtcgaaggccagctgcacgcaatagtccatgtcgaagccgcgctgcgcctggcggatcaggcccaggtaggagttgttcaccagtacgtggatatagggcagcttgaactgcgcgccgaccgccagttcctcgatcatgaactggaagtcgtagtcgccggagagcgccaccacctggcggctcgggtcggccttgaccacccccagcgcggcgggaatggtccagcccagcgggccggcctggccgcagttgatccagtggcgcggttggtagacatggaggaactgtgcgccggcgatctgcgacaggccgatggtgctgacgtagcaggcatccttgccgaagaactcgttcatctcttcgtagacgcgctgcggtttcaccggcacgttgtcgaagtgggtcttgcgctgcagcgtgcgtttgcgctgctggcagctttccagccaggcggcgcgcgacttcagcttgccggcggccttccattcgcgggccacttcgaggaatgcgtcgagggcggcgccggcgtcggagacgatgcccaggtcgggcatgaacacccggccgatctgggtcggttcgatgtcgacatggatgaagcggcgaccttcggtatagacctcgacgctgccggtgtggcggttggcccagcggttgccgatgccgagcaccaggtcggattccagcagggtggcgttgccgtagcggtgcgaggtctgcaggccgaccatgccggccatctgcgggtggtcgtcggggattacgccccagcccatcagggtcgggatcaccgggatgccggtcagctcggcgaattcgcggaagcgctcggcggcgtcggcgttgaagatgccgccgccggccaccagcagcgggcgctcggcttcgtcgagcatggccaggaccttctcggcctggacccgggtggccttcggcttgctcaccgggaggggctcgtaggcgtcgatgtcgaactcgatctcggccatctgtacgtcgaacggcaggtcgatcagtaccgggccgggccggtcgctgcgcatcagctggaaggccttctggaatacataggggacctgggccggttccagcacggtggtcgcccacttggccaccggcgcggcgatgctggagatgtcgaccgcctggaagtcttccttgtgcaggcgggcgcgcggtgcctggccggtaatgcagagaatcgggatggagtcggcggaggcggagtagaggccggtgatcatgtcggtgccggcagggccggaggtgccgatgcagacgccgatgttgccggccttggtacgggtgtagccctcggccatgtgcgaggcgccttcgacgtgacgggccaggacatggtcgatgccgccgatcttcttcagcgcggcgtacatggggttgatcgcggcaccggggacgccgaacgcggtatccacgccttcgcggcgcatcaccagtacggcggcttcgattgctctcattctggccatcgttttgttcctcgttcttatactaattgtgtacaaaagttggaacgattctag

SEQ ID NO: 11241 - DNA, 654 bp, Pseudomonas aeruginosa
caactcgagaggaacgaccatgaccaccatcagtctggaaaccgcgctgggcattacccgccaggcgctggcggtggggcgcgagctgtccaccgcgcccctgaccatcgcggtgctcgatgctggcggccacctggtggcgctgcagcgcgaggacggcgccagcatgctgcgaccgcagatcgccatcggcaaggcctggggcgccgtggccctgggcaagtcgtcgcggctgctggcggcggatgcgcagcagcggccttcgttcatttccgcggtgaacaccctggcccatggcaatctggttccggcgccgggcggggtgctgattcgcaacgacaaggcagaggtggtcggcgcggtcggtatcagcggcgatacctcggatatcgacgagcaatgcgcgatccagggcgtgctggcggtcgggctggtgcccgacgccggttgagcttgcggcccgctcaccaggaccgggccttcgctcccttcttcaggtggcgtacgccgccatccaccaggatctccgtgccatacctgcagcggggctcgttcgaggccaggaatagcgcggcactggcgatctccagcggctcccccaggcgtcccggccaatcttctccctcagcgcctgggtggcctcgagatcggtag

SEQ ID NO: 11242 - DNA, 717 bp, Pseudomonas aeruginosa
gcgcgccgcggcgggtcagagcggcagcggccgaagccggccggtgctcttgccggattgcccgtcgggcgtgcagcctttcaggaccaggcgggtgatggtttccaccgcagcgtcgtagtcggcgtcgctgagctgttccttgccggtgacgatggaaatctgccaatcgaagtcggcataggtctgggtcgccgcccagatggcgaagagcaggtgatgcgggtccaccggggcgagctggccacggtcgatccaggtctgcaggcaggtgacgttgcgctgggcctgggcgttcagttcgtcgaggtattccttcggcaggtgcggcgcgccgtgcatgatctcgctggcgaagaccttggaggcatgcggcagctcgcgggagatgcggatcttcgagcggatgtaggcgggcagggcgagcagcgggtcgtcttccacgcggaacggcgccgacgcttgcagcagcggctcgacgatgctttccagcacgcagcgatagaggttttccttggactggaagtagtagtagacgttgggcttgggcaggccggcgcgggcggcgatgtcgctggtcttggtcgccgcgaagcccttgtcggcgaattcctcgctggcggcgcggaggatcaggcgcttgttgcgctcgcggatgctggtcatcagtccttgttcttcattgctgcaacggcggcaggaagccgaggatggtag

SEQ ID NO: 11243 - DNA, 1179 bp, Pseudomonas aeruginosa
cacccgcccggagcgcccctcaagcaaggtgcgagcgaggcggaggcccgggaaatcctgacccgccggttcatttgccctatacattttccggtatttggagtattcgttaggggtatcgagtcgcccgctcgcactcacccaccgagcgccgggcgagcccccggaacagaacgagtcactatgtccgattcccgtctggtcgatcccttcggccgtcgcatcacctacctgcgcctgtcggtgacggatcgctgcgacttccgctgcacctactgcatgagcgaagacatgcagttccttccccgcgaccaggtcctcagcctggaggaactttacgcggtggccgacgccttcatcggcctcggcgtgcggcgcattcgtatcaccggcggcgagccgctggtgcgcaagggcatcaccggcctgctggcacgcctggggcagcgtgcggaactggaagacctggcgatcaccaccaacggttcgcaactgcgcgagcgcgccgccgagctgaaggccgccggcgtccgccgcctcaacgtcagcctcgactcgctgcagcgcgaacgcttcgccgccttcacccgtagcgatcgcctggagcaggtgctggacggcatccaggcggcgcgcgaagccggtttcgagcggatcaagctgaactgcgtggtacagaagggccgcaacgacgacgagatcctcaacctggtcgagtacgccctggccaaccagttggacatcagtttcatcgaggaaatgccgctgggcagcatcaccagccaccgtcgcgagctgacgctctgcaccagcgacgaagtccgcgcgatcatcgagcgccgctggccgctgaccccgagcctggcgcgcagcggcgggccgtcgcggtattaccagatcggcgacgagcccagccggatcggcttcatttcacctcatagcaataatttctgcggcgactgcaaccgcgtgcgcgtcaccgctgagggcaagctggtgctctgccttggccacgagggggcgctcgacctgcgcgaactgctgcgcagccatcccggcgaccgcgagcgcctgagcgcggcactggtggcggcgctgaacctgaagccggagcggcatcacttcgacgcccaggagcaggtccaggtgctgcgtttcatgagcatgaccggcggctga

SEQ ID NO: 11244 - DNA, 288 bp, Pseudomonas aeruginosa
tcccagcgccgaacggctctttcgccgactggccgggcctcgagaccgattcccccgggttggcggcggacgccgagaccgcccatggagcgggagcaactggagtgggcgacgctggtcgtcgtcatggagcgccgccaccggcaggcgctgatgcgccggcacgccgcggcgatgaaaggcaagcgcctggtctgcctggatatcccggacgactacgcctacatgcaggcggaattgctgcatctgctggagcgcaaggcggggcctttccttcggcgggactga

SEQ ID NO: 11245 - DNA, 759 bp, Pseudomonas aeruginosa
gtggtgcggaccgcgagcggaaaaaagaagccggacgaagtccggcccgagggaagggcggaccgggagtgtcgccggtccgccagggagtcaggagtgcttgggcgccggcgcgtggctgccgcacaagtggctgcggtcgttgcggctgaggatgttgaacagcaggttcagcaccaccgcccagatcgcggtcatggcgatgccgctatgggtgatcggctccatccagaccggcaggcgggcaaagaagtccgggcgcaccaccggcaccatgcccatgccgatgcttaccgccaccagcaactggttgcggcggtcggtgatgttggcctcgtggaggatctggatgccgctggcggcgaccatgccgaacatggcgatgccggcgccgccgagtaccgccggcgggatcgaggcgaccaggaaggcggccttgggcagcatgctgaggaggatcaggaaaccggcggcggccaccgtgacgtagcggctgcgcaccccggtcatctgcaccaggccgatgttctgggcgaacgaggaatgggtgaaggtgttcaggaaaccggcgaagaacgaggcgccggcgtcgcagagcaggccgcggcgcagttcggtcggggtgatctcgcggccggtgatcttgcccagggcgaggaacatgccggtggactcgacgaagatgatcactaccaccagggcacatcgacaggatcggcgccaggtcgaaggtcggcgcgccgaagtgcagcggggtga

SEQ ID NO: 11246 - DNA, 450 bp, Pseudomonas aeruginosa
gcgccgccgcacatcagggtgatgtgctccttcgcggtgaccagcacgtgctgctggctggcgctgacctccacgctctgctcggcctccaggcggatgtcgttcttctgcgcctgcagcagcatcggcccctggtgggtgatctggcgcagctcgccgccttgggcgaacaggccgatgtcgctgccggcgttgatcaccaccttctgcccggcggtcacctgctggttctgccgggccacgctgtcgacgtgctcgccggcggccagggtcaggctcgccggcgtcgccgcggcgatccctgccggaccgctcaaggcgatcgccggcttgcctccgttgctcttgccggactcgtcgttggcaccgtggccgaggtcgcgcacggcttcctggagggtttgctgcggcgccgcgtcgtgccccacgccctggtgctccccggcgtag

SEQ ID NO: 11247 - DNA, 726 bp, Pseudomonas aeruginosa
cgcatggatcgttccttgttcctggcgggcggttcctcccccatccgttggagaagcgagccccacgttactcttgctcagccgctgccgaaagtcttggctcggtgtctatttcgcgaagtagcggacattttcggctcgacggagaaccgatcgcacaggtgtacgaccggtgtgcctgtcaactcaccctgcgaccggcgagcgccagtcgtcggagccggaggtgccggagacttcgtgggtccaggtgatcttgcggtaggtgaagtgcacgtcttccaggtgggtgaagtgggcgttgcccgggtcctggcagttgtgcatgtagtccttgatgtcgacgatgatcgcgtcttccaggacggtggtgtagtagtgctcctgggtgccggcggcggaggtgcggtaccactggatctcgaccttggtcaggcgctcgccggaggtcagggcggccagcagcagcggcgaggccttgtcgaagaccttggtgatgaccaccggcttgtgcacgcgctggccggtcggctggccggactgcgggtcgcgcgggatgatcacttcgtggttgaagccctggaccatcacctggtcctcgtggccttcctggtaggtgttgccgaccgaatcctcggtgaaggcgccggcggtgatcaggccctgcttggtgccggtgatggacatataggcgggggttgccatggatacgttccttgtcgttga

SEQ ID NO: 11248 - DNA, 291 bp, Pseudomonas aeruginosa
gttacggcctcgggcattaacgttggagcaacgttggctaacggtggactaacgttgatcgcgttaccgggaagggggcgcatttcaagtgcgccccttggcgcgaccagcgatggctccgaactgagccatgggctaacgcggcgctatctcacaaccaccaatgggggaagtgaggagaatcccaccttgcctgaccaatcgccaggggatcgaacttaccgggagcgacgcaggccacccggttgccctgctggaactgacgacagacatttgagctggccggcataa

SEQ ID NO: 11249 - DNA, 1299 bp, Pseudomonas aeruginosa
gcggccactgaggaagccatgagcaagaccaacgaatccctgctgaagcgtcgccaggccgcggtaccccgcggcgtgggccagatccacccggtcgtcgccgagcgcgccgagaactccaccgtctgggacgtggaaggccgcgagtacatcgacttcgccggcggcatcgccgtgctgaacaccggccacctgcatccgaaggtgatcgccgcggtccaggagcaactgggcaagctgtcccacacctgcttccaggtgctggcctacgaaccctacatcgagctggccgaggaaatcgccaagcgcgtgccgggcgacttcccgaagaagaccctgctggtcacctccggctccgaagccgtggagaacgccgtcaagatcgcccgcgccgccaccggccgcgctggcgtgatcgccttcaccggcgcgtaccacggccgcaccatgatgaccctgggcctgaccggcaaggtggtcccgtactccgccggcatgggcctgatgccgggcggcatcttccgcgccctggcgccctgcgagctgcacggcgtgagcgaggacgactccatcgccagcatcgagcgcatcttcaagaacgatgcccagccccaggacatcgccgcgatcatcatcgagccggtgcagggcgagggtggcttctacgtcaactccaagtccttcatgcagcgcctgcgcgccctgtgcgaccagcacggcatcctgctgatcgccgacgaagtgcagaccggcgccggccgtaccggcaccttcttcgctaccgagcaactgggcatcgttcctgacctgaccaccttcgccaagtcggtcggcggcggcttcccgatctccggcgtggccggcaaggccgagatcatggacgtcatcgcgcccggcggcctgggcggcacctatgccggcagcccgatcgcctgcgccgcggcactggccgtgctgaaggtgttcgaggaagagaagctgctggaacgttcgcaagccgtcggcgagcgtctcaaggccggcctgcgcgagatccaggccaagcacaaggtgatcggcgacgttcgtggcctgggttcgatggtggccatcgagctgttcgagggcggcgatacccacaagccggccgccgagctggtcagcaagatcgtcgtccgtgcgcgcgagaagggcctgatcctgctctcctgcggcacctactacaacgtcatccgcttcctcatgcccgtcaccatccccgacgcgcaactggagaagggcctggccatcctggccgagtgcttcgacgaactcgcttaa

SEQ ID NO: 11250 - DNA, 1806 bp, Pseudomonas aeruginosa
gttcggccgcgatccgcagatcaccgctggcctgatcgccgccgccaacagcgccgcccggcacgtcggtccggcctgccagaccctgggccaggccctgcggcggctgggactcgggcacagcctgaacctggtgctcggtttcagcctgcagcgggccatccagctcggcgagccgctgctggccgagcgcgccatgcacttctgggatctttcgcaacgttgcgcggacatcgcctgggaactggccgacgccctcggcgcggacgtcgagcgctgctataccgcagggctgctgcatcgcctgggcgacctggcgctgctgcggacattgcaggattggtgcgatggcggcggcgcgctggacgaggcgcggctcgacgagctgctggggcgtttcggcgccagcttcggctcggccctgcgggcgcgttggcggctgccgctggagctgcgccggctgatcgctgcggcgtaccagttcggtggcgtgctttcccgcgaagagctgatcctcagcctggcgacccaggccgccagcctgcccgaggacaacgcggagcaactggccgagagcaaggctgcccgcatgctcggcctggacggcgaacgactggcgaaactgctgcagccctgagccgtcctcgccgtgcctttgcaaggggcggcgcctcccgtagggcgggtaacgcggcgcgtcatgcgccgctgggcatggggcgcggttgcaatcgagcctctggccggggagatcggcacctacctgcgcgccgccgagttgccggccgtggatgggcggaagcgcgcctagcgccgcagctcggcgcgcaacaggtccaacgccgggtcgatgtcgtcccgttcgatgcagccgaagccgaagaggaagccggcctgtgccggggtttccgcgtagaagggcggcagggtgccgacctccaggccttgctggcgcaaatgacgggcgatgcgcagcacatccagcggttcgcgacagcgcgccgcgaggtggatcccggccaccgccggcagcgcttcgagccaggggctcaggtcgccgtgcaggcgttccagcaggcgcccgcgacgctgggcgtattcgcgttgcaagcggcgcgtatggcgggcgaagtcgccgcgctggatgaacagcgcgagggcgcgttgctgcaaggtctcgctgtgccggtcgaccagcttgcgcgccgccagcaccgcttcgcgcaggcttgccggcggcagcaggtagccgaggcgcagctcggggaagagggtcttggaaaaggtcccgaggtaggccacctggccgttccggtcgaggctgcgcagcgactccagcgaacgcccgtcgaagcggtactcgctgtcgtagtcgtcctcgatgatcagcgcccggtggcgctgcgcccagtccagcaactgcaggcgccgctccaggctcatcggcatgcccagcgggaactggtgcgacggggtgacgtagaccagcttggcgttgtccggcagcaggtcgacgcgcagcccctcggcgtccaccggcactccgcgcacctcggcgccggtggccagcaggctggcgcgggccggcggataaccgggttcctcgaccaccgccaggtcgccggggtcgagcatcacccgggccagcaggtcgagtccctgctgggcgccctgggtgaccatcagggcgttccagtcgcactgcacggcgcggttgatcgccaggtagcgggagatcgccaggcgcagctcggggtcgccttcggtttccttgtagaacgccggcgagcgctgttgcaggcgtag

SEQ ID NO: 11251 - DNA, 987 bp, Pseudomonas aeruginosa
cgcctggagcacgcaggtacgccaggtatcgaagggaaagcggcgcttgtcggtcgtgccgccggcgaagctgtagcggagcggtgctcgctggtccatcagaccggactgcggttcgatgcgtgcccagcgcgcggccggccgcaacggaccgtcggcgcgctgcggcggcgcttccccggcgggcccgcgggcgacgaaggtgccgctgccgacccggccttcgaggaagccctcgctggcgaggcgctcgtaggcttcgctgacggtcttgcgcgacacttccaggcgttcggcgaggtatcgcgtggctggcaggcgatcgccggtggccaggcgaccatggaggatcgcgtcgcgcagctggcgatagagctggccgaccaggtcgtggcggccgtcgaggatcagttgcagttccatggcgaaattggctacctggtatttctggtaattggctcttcgtggaagccaaaggcaggcttagtgttaccccatgccgcgccgctttccactctcgcggctgccaatcagccaaggagattcgccatgaccacccgcctcgaatgggccaaagcctcccccgacgcctatgccgccatgctcggcctggaaaaggccctggccaaggccggcctggagcgcccgttgatcgaactggtctacctgcgcacttcgcagatcaacggttgcgcctactgcgtgaacatgcatgccaacgacgcgcgcaaggccggcgagaccgagcagcgtctgcaagcgctctgcgtctggcaggaaaccccctacttcaccccgcgcgagcgcgctgccctggcctggaccgagcaactcgcccgcctcagccagggggcgttgccgcacggcctgctcgacgaactgcgcgagcacttcgacgacaaggagatcgccgaactgaccctggcggtctcggccatcaacgcctggaaccgcttcggcgtcggcatgggcatgcaagcggaatga

SEQ ID NO: 11252 - DNA, 690 bp, Pseudomonas aeruginosa
gcgccagccaggtcatccgtattcgcgcgcgcaacggtcagtcggaacggcttggcctgcgcctgcaacaactggtcgaaccggggctggaggcgccgggttgcctggagtaccaggtgcgcagggacgccctcgagccggatctctggctggtgtgcagccagtggcgggaagcgcagcagatgttcgactacctggccggcggcatccagcaggtattcgccgaagtgctctggcgctccctggcggcgagcctcgaagtgcaggatgacgcaggctagagcaaacccagctcggcgcagacgatcagtacctgctcgcgcagccagaggttcgccgggtcctggtcggcggcgcggctccatgacaggtgcagggcgaacggcggcagcccgggcggtgcgaggcaggcgtgatggcggccatcgtcgagcagtgcatggatacgccgtggcagcatcagcacgaagtcgctgcccgacagcagttgcagggcggcgacgtacctgttggcgcgcgcggcgacctcgcggctgcggccctggcgtcgcagccacgtgtccaccaggttggcgttgctggcgtcgagcggggtcgggaagacgaagcggcgccggcagaactcgtccagttccaggcgctcgtggcgcggctgggcacgatcctgtacgcagagcagctcgtcgctga

SEQ ID NO: 11253 - DNA, 834 bp, Pseudomonas aeruginosa
agccccatgcagagcggcgtgcgcgcgccgaaacgggccttgatcagggccggcatcagcgcctggatcagggcgatgccgagaccggcgagcatggcgctgccgagcaggtcgggcaggcctcggctgcccaggcgcatggcgctggcggcgccgatcagcagcagggcgagggccaccgaacgccactcgccgacgcggcgggcgatgcccaggccgaagaacatgccgaggccgagggtcatcaccggcagggcggtcagcagcgagacggcgccgaagctgagcgcgatctcgccgcgcatggcgttcagcagtgggccgacggcggccatggagggccgcaggttgaggccgaccaggacgatggcggccatcagccagagggtgcggccgggtgggttggcagagggcatggcgatctcctttcgggagcaccattgcgcatgcgccagggcgtggcggcaaatcaaaatccgcagggcggattcgaaaaaatgcgctggccagggagtcggggcggacgctggcgcaacgttgcgagtcgcgaggttatccgccccgtgcggcgcgtggcctcactccgcactcaagcgcatcaggctttcgctcagggcacgcgcgtggcggtcgacgatgatcggcgcccagggcctgccggaagcgctgaccagcgcgctgctcttgctgttcaggtcgcgcagggcctggctcaggtactcccagcggttttccagtttcttcagtcccgccgggttggcgctttgcgccaccagcagggcgatgcgccggtcgatcagcgggaccagcacgctctcgtcctggccgagatag

SEQ ID NO: 11254 - DNA, 2178 bp, Pseudomonas aeruginosa
gcgcgaccggcgaggccgggctggccaggttgggaatcgacctgtcggaggtccgccgccgccgtcggcagttcgcctgcgcctgccccgactggagcgaacgcaagccgcacctcggcggcgcgctgggggcggcgttgctggaggcctgtctgcgccagggctggttgcggccgcaggacggctcgcgggcgttgcaggtgtcgtcgaagggccgcgcgggactgcgcggcctggcggagcgcacggcgggctgaacccgccgcgggatcagagattggccaccggctggaaggccttcggcttgaagtagagggtctcgccgcgggccaggccggccaggctgtcgtggtccttcaccacttcggcttcgatcagttcgtcctggccgtcgaccttcagcgttacccgggtgatagcccccagcggacggatgtcgcggacctcggcggcgcggtgctcggccacctcggaacgcgacagcgacacttcgtgggggcggaacagcaggtgctggtcgttgcccagttgcaggcggttggagtcgccgaggaagtggtagacgaaatcgctggccgggttctcgtagacctcgccgggcgagccgatctgctcgatcacgcccttgttcatcaccacgatgcggtcggccacttccatcgcttcttcctggtcgtgggtgacgaacaccgaggtcaggttgatctcctcgtgcaggcgcgccagccagcggcgcagctccttgcgtaccttggcgtcgagggcgccgaagggttcgtcgaggagcaggatcttcggctccaccgccagcgcgcgggccagggcgatacgctgccgctggccgccggagagttgctctggatagcggtcggcgagccagtcgagctgcaccatgttgagcagctcgtggaccttggccttgatcgcggactcgcccggccgctcgcccttgggcttcatgcgcaggccgaaggcgacgttgtcgaacaccgtcatgtggcggaacagcgcgtagtgctggaagacgaagccgacgttgcggtcgcgcacgtcgtgctgcgagacgtcctcgccatggaacacgatgttgccggcgtccggggtttccagcccggcgatgatccgcagcagggtggtctttccgcacccggaggggccgagcagggccaccagttcgccgctctggatatccaggttgatgttgtccagggccttgaaggcgttgaagttcttgctgacgttacggatttcgatgctcatggttcattcctcgtcagcattgcttttcagtcgggacatgcgggattcgctccactgcttgagcagaaggatgaccagcgccatcagcagcaacaggctggcgacgctgaaggcggcgacatggttgtattcgttgtagaggatctcgacgtgcagcggcagggtgttggtgacaccgcggatatgcccggaaaccaccgacaccgcgccgaactcgcccatcgcccgcgcggtgcagagcaccacgccgtagatcaggccccacttgatgttcggcagggtcacgtgccagaacatctgccagccgttggcgccgagcaggcgggcggcttcctcctcctgggtgccctgctcctgcatcagcgggatcagttcgcgggcgacgaagggcacggtgacgaagagggtcgccaggacgattccgggcaccgcgaagacgatctggatgtcgtggtcgctcagccattcgccgaagtagccctgggcgccgaacaacagcacgtagatcaggccggcgatcaccggcgagaccgagaacggcaggtcgatcagggtcaccaggatgctcttgccgcgaaactcgaacttgctcacgcaccaggcggcggcgacaccgaacagcaggttgagcggcaccgagatggccaccgcgatcagggtcagcttcagcgcggccagcgcgtcgggttcgaggatcgcctcgaagaaggtgccgaaaccctgcttcagcgcctcgctcaggaccacgtagagcggcagcaggaggaacagggcgaagaccagccaggccaggacgatcagggccaggcggccgccggcgttgccgcggcgggaggcgctggcggtggcagcggaaatgcttgcactggacatggcgccctccttacggggtttcgatgcgacgctgcagcaggttga

SEQ ID NO: 11255 - DNA, 1287 bp, Pseudomonas aeruginosa
gttctgcgcggcgatgcgctggccttcctcgctgtacaggtattgcaggtacgcctcggcgaccttgcgggtgcctttcttctcgaccaccttgtcgaccaccgcgaccggcggttcggcaaggatggagatggagggtacgacgatctcgaagttttccccgccctgttccttcttcgccaggaacgcctcgttctcccaggccagcagcacgtcgccgatctggttgttgacgaaggtgatggtcgagccgcgggcgccagtgtcgagtaccggtacgtgcttgtacagcgcctgcacgtagtccttggccttctcgtcgctgccgtactgcttcttcgcccaggcccaggcggcgaggaagttccagcgcgcgccgccggaggtcttcgggttcggcgtgatgacttccacgccttccttggtcaggtcgccccagtccttgattcccttggggttgcccttgcgcaccaggaacacgatggtcgaggtgtagggggtgctgttgtccggcaggcgtgcctgccagtcggccggcagcagcttgccgagcttgtgcagttcgtcgatgtcgccggccagggccagggtcaccacgtcggccttgagcccgtcgatcaccgcgcgggcctgcttgccggagccgccgtgggactgctggacggtcaggtcctcgccgccctgggccttccagtgcttgatgaaggccgcgttgtaggcctggtacagctcgcgggtcgggtcgtaggaaacgttcagcagttgcgtggctgcggcaaccgggccggagaccagggcgctggcgagtgcggccagggcgaaacgacgaagggacatgtgcagctcctaggtgtgtgctgtttcgattgttctaatggggtgttggcggaacgacgggaacacggggcgtcaggcgcgcattcgcggccgacagctgcagtaccggtgcggatggggtatcgaacggatgttcatggcgagacgcctccggtggtccagtcgggtcgtgtgcttcaggcctgcttgacggccggttgctgcagacggaatttttccttgcgctcgatctgcaccacctggccgttgtgcacggtgatctcgacggcgccgaagcgcaggccgcgcagggcactctggatttcacgcaggatggtggcttcgtcctggccatccaggcttctgagggttgcgctcatgggtctctgctcctgtggctcgaggtgccgcgttgctcgacgaagtggaggcggcgtgaggcgcatagtaagcagtgggcaatattcttaa

SEQ ID NO: 11256 - DNA, 2211 bp, Pseudomonas aeruginosa
aaatattgtttaagaatctttataggtaaagtggttataagacggcgaagcggcccggcttcgccgccaggctcagtcttccggcagcgccacgggcggcaggtcgaagcgcagcgcttccgccggttgcggccgtccgtaccagtagccttggccgaagtcgcagccatgttcgcgcaggaacagcgcctggtcctgatgctcgatgccctcggcaaccacccgcagccccatgctttgcgccagggcaacgatcgcccgggcgatcgcggcgtcgtccaccgcgccgggcaggccggcgacgaagccctggtcgatcttcagcttgtgcaccggcagccgcttgaggcgcatcagcgaggaatagccggtgccgaagtcgtcgatggccaggttcacgccgaggatacgcaggcggcagagcaggttgagggactgctcgaagtcctccatcaccgcgctttcggtgacttccagctccaggtagcggggctccagtccggactcttccagggcattggcgatcctttcctccaggccgccgcggttgaacagccggctggagacgttgaccgcgacgaactccagctcgacgccgcgctgttgccactcgcgcatctgccggcaggcacgcttgagcacccagttgtccagcgcggcgatcagcccgcattcctccgccaccgggacgaactcgcctggcggcaccaggccgcgctcgggatgctgccagcgcaccagcgactcgacgccgacgatccgcccgctggccaggtcgtgcaccggctggtagtggacgcgcagttcgtcgtgatccagcgcatggcgcagggccgattccacctggacatgggcgcgggcccgggcggtcagcacgcgggtgtagaaggcgtaggcgttacgcccgctgtccttggcctggaacagcgcggcgtcggcgtgttgcatcaggtggtcgacgtcgctggcgtcttccgggtagaggctgacaccgaggcttgcgctgatatagatcggctggcagtggatgtcgaacggcgcgttgaaaccgtcgaggatgcgctgcgagaggcgcgcgacggcttccgggtcgtcgttctcgacgaggatggcgaattcgtcgccgcccagtcgcgacagcaggcagcgctcgtcgagctggtgttgcaggcgcttgctgacctccttgaggagcatgtcgccagttgtatggccgaggctgtcgttgatgtgcttgaagtggtcgaggtcgatcagcagcagggccccggccaccgtccggtccttgccgttctccagcgcctgctcgatgcgctcgcgcagcagcacgcggttgggcaggccggtcagcgagtcgtggtgggcgaggaagtccagctcgttctccgagcgcttgatgctgctcaggtcggagaacaccccgacgtagtgggtcagctggccctggtcgttgcgcaccacgcggatgtgcagccactgcgggtagatctcgccgctcttgcgccggttccagatttctccgctccagacgtcctgctcgcgcagggccagccacaggcgctggtagaacgcctggtcctggcggccggagcggaggatcgccggggtcttgccgagcacgtcttcggagcggtagccggtgatgcgctcgaaggaagggttgacgtgcacgatcaccgcctgggcatcggtgaccagaacgccctcgcgggtgctgtcgaataccgccgcggcctggcgcaggtggtcttccttgagccgttgcagggtgatgtcgcgggccacgccagtgtagtgcagcggcttgcccagggcgtcgcggaggacccggccgcgcgagtggatccagcggtagtcgccgtccttgtggcgcaggcggtagatgtggtcgagattgtcggtcaggccctgcaggaggttgcggtgggcctccagcacggtggcgtactcttcggggagcaggcgcttcttccaggtctcgatggggtcgccgagttcctccggagcgaggccgatcagcgcggcgtagcccggcgagacgaacatccggtcggtcaccaggtcccagtcccagagtccgtcgcgcaccgcttccagggcgcggttcaggcgctgctcgctgccgtgcagttcgtcgtaggcctgggccttgcggcggaactggcgtaccaggtagaggtacacgagccggccggttgcgggcaagaataa

SEQ ID NO: 11257 - DNA, 1245 bp, Pseudomonas aeruginosa
tgcccccaggttttgtcagacaaggccctcatcactcccaagtccccccgaggttcagtaccgcctatgtggttcaacggttttctcgacctgtcgccgtggcaactggtggcagttaccctggtgctgacgcatatcaccatcgtcagcgtgaccgtctacctgcatcgctattccgcccaccgtgcactcgacctgcaccccgcgctgcagcacttcttccgtttctggttgtggttgaccacagggatgaacacgcgcgaatggaccgcgatccaccgtaagcaccatgccaagtgcgagaccgtcgaggatccgcacagcccggtgcacaagggcctgttcaccgtcctgcgcgcaggcgcggagctgtacaaggccgaggcgaagaaccaggacaccctgcgcatctacggcaagaactgcccggacgactggatcgagcgcaatctctactcgcgcttcccgatcggcggcgtggtgctgatggcgctcatcgacctggccctgttcggcgcccttggcctgaccgtctgggccgtgcagatggtatggattccgttctgggccgccggcgtggtcaacggcctcggccacgcggtcggctatcgcaacttcgaatgccgcgacgccgccaccaacctggtgccctggggcatcctcatcggcggcgaagagctgcacaacaaccaccacacctacccgaactcggccaagctgtcggtgaagaagtgggaattcgacctgggctgggcctggatcaagctgttcagcttcctgcgcctggccagggtcgcccgggtcgcgccgatcgcccatcgggtcgagggcaagcacagcctggacatggacaccgccatggcgatcctcaacaaccgcttccagatcatggcgcagtaccgcaagctggtgatcgcgccgctggtcaagcaggaagtggccaaggccgacgagtcggtgcgccacctgttccgccgcgccaagcgcctgctgtcgcgcgagaccagcctgctgcaggaccgccaccacgtgcgcatcgactcgatgctcgcccacagccaggcgctgaaggtgatctacgagaagcgcctggcgttgcagcagatctgggccaagaccagcgccaacggccacgacatgctggcggcgatcaaggactgggtgcatgaggcggaagccagcggtatccagtcgctgaaggagttcgccgcgcaactgaagacctactcgctgcgtcccgcctga

SEQ ID NO: 11258 - DNA, 1656 bp, Pseudomonas aeruginosa
tccgggattcagcccgggcggcgcccggcctatcttcggcgtgcccaggcgccacgccgggcgtcacgcagaacaacaagaaaaggagcgcgggcgatgttgctggattacctgatcatgctggtctacgccctggccatgctgggcctgggctggtacggaatgcgcaaggcgaagagccagagcgatttcctcgtcgccggacgccgcctcggccccggcctctacctgggaaccatggccgcggtggtgctcggcggcgcgtcgaccattggtacggtcaagctcggctaccagttcggcctgtccggcttgtggctggtgttcatgctcggcctggggatcatcgtcctcagcctggtgttctcgcggcagatcgcgcgcctgcgggtgttcaccgtgacccaggtgctggagcagcgctaccaggcctcctcgcgcctgatcggcggggtggtcatggtcgcctacgacctgatggtggcggtcaccgcgaccatcgccatcggctcggtcaccgaggtggtattcggcatcccgcggatcccggcgatcctctgcggtggcgggatcgtcatcgtctattcggtgatcggcggcatgtggtcccttacgctgaccgacatcatccagttcgtgatcaagaccgtcggtatcttcctggtcctgctgccgttgtcgatcgacggcgccggtggcctggcgcgcatgcaggaggtgctgccggcgggcttcttcgacctcggccacatcggcctggataccatactcacctacttcctcctgtacttcttcggcgcgctgatcggccaggacatctggcagcgggtgttcaccgcgcgcagcgagacggtggtgcgctacgccgggcttggcgccggcgtctactgcatgctctacggcgccgcctgcgcgctgatcggcgcggcggcgcgggtcctcctgccggacctggcggtgccggagaacgcctacgccgagatcacccgcgaggtactggcgccgggcctgcgcggcctggtggtggcggccgcgctgtcggcgatcatgtccaccgccagcgggtgcctgctggcagcggccaccgtgctgcaggaagacatctacgcgcgcttcctgcgccccggtaccaccagcgacatccgtctgagccgttgcatcaccctgctgatgggcgtggcgatgctggtcctggcgtgcctggtcaacgatgtcatcgcggccctgagcatcgcctacaacctgctggtcggcggcctgctggtgccgatcgtcggcgcgctgctgtggcgccgggccagtccgcagggggcgatcgccagcatcgtcgccggttgcctggcggtgatcgcctgcatggcccgcgacggcctggctcgccaactcgccgatcgtctacggcctgctggccagcctggcgaccttcgtcgcggtcagcctggctacccgtcctgccgccagcctgcgagcccagccggaatgaacccaccgcgccgggcggcgcccggcgctttcttcccgccacacggagacgccccatgtcgaacgaccatccgcagcccctcgacgccgccgatattccacgcttcgccggcatcccgaccttcatgcgcctgccggcgttcaccgacccggcggcgctgcaggtcggcctga

SEQ ID NO: 11259 - DNA, 516 bp, Pseudomonas aeruginosa
  unsure (29): Identity of nucleotide at the above locations are unknown.
atgcgcattccgataccaacgaccgttanttgggagacaacccctacacccacggcacgccattccgcagggccatcgaggaaggtctgctcgacccggtgcgcacggtgcagatcggcattcgcggctcggtgtattcgccggacgacgacgctttcgcccgcgagtgcggcatccgccgtgatccacatggaagagttcgtcgaactgggcgtcgaggcgaccttggccgaagcccggcgggtggtgggcgacgggccgacctatgtgagtttcgacgttgacgtgttcgacccggctttcgcgcgtggcaccggcaccccggagatcggcggcatgaccagcctccaggcccagcaactggtccgcggcctgcgcgggctggacctggtcggcgccgacgtggtggaagtctcgccgccgttcgatgtcggcggcgccacggcgttggtgggggcgaccatgatgttcgaactgatatgcatgattgccgagtcggccgcgcgaagcgcctga

SEQ ID NO: 11260 - DNA, 1128 bp, Pseudomonas aeruginosa
cttcggccaggccgtggctggcgagaatcagttggcgggccgccgcgtcgcgggcgtagaccgccagcatgcgctcctcgacgatccgcgacaggtcgcgccagcagcgcaggcctgcatgttccaccggctgttcgaggcacgcgcggaaggcggcgtggacctcgccggtcagcccctggagcagggccggcacgctggggaagaagtggtagaccgacgatggtggcatttccgcgcgttcggccacgctgtagatggacaggccgccgatgccttcgtcggcgagcaggtcgcgggcggcgtcgaggatcgcggcgatccgggcctggctgctggcgcggggcttgcgggtgggcgaggtgggctgcatgtggcgggtctccgggcgtgagcggctattggacgccagctcacgcgaccggggcaagccgctcactggctggcgccgcggaaggccttccagatctcgtcgaccaccggccggagtttttccggcggcgtttccagggcgaacaggcggcggctggtgtcgcggtccggatacaggccgggttgctggcgcagggcgggatcgaggaagccggcggcgtcggcgttgccgctggggtagagggtggcggcggtgatctgtgcggcgatcttcggttgcatcaggtagtcgatgaaacggtgcgcctcgcgtggatgctgggcgccggccgggatcaccaggttgtcgatgaacagcaccgagccttcctgcggtacctcgaaacttaccggctggcccgccttggccgcgcgcagggcgtcgccgacccaggccatggccaggcagaggcgaccgccttcgaggtcggcgatgtagcgctcgctgtcgacgtagcgcaggttcggtcgcagtccgtgcagcgcctcggcggcgcggcgtacctggctcggcgcagtacgaccgaggttgcggccctggtagttgaggaggatcgccagggtttcgtccggcgcgtccagcaggctgatgccgcagcttttcaggcgctggctctggctggcgtcgaacagcaggctccagctgttgggcagcggcccgccataggcggcttcggcctgcggggtattgatggccaggcctacggcaccccatag

SEQ ID NO: 11261 - DNA, 1185 bp, Pseudomonas aeruginosa
caggtaggggttggcgtcggcgccggccacgcggtgttccaggcgtaccgcgtccgggctgccggtgggcacgcgcagggccacggtgcggttgtccaggccccagctcggcgcgttcggcacgtagaactgcgaaccgaagcggcggtaggagttgacgttcgggcagaggaaggccatggaggccggcagggtctcgagcacaccgccgatcgcatggcgcaatgcggcgttctgctcgggatcctcgctggtgaagatgttgttgccatgcttgtcgagcagcgagatatgcacgtgcagtccgttcccggcctggcccggatagggcttggccatgaaggtggtgtccatctcgtggtcgtaggcgatgttcttgaccaggcgcttgagcagcaccgcgtggtcgcaggccttgagggcgtcgttgacgtggttgaggttgacctcgaactgcgccggtgcggattcggcgacgatggcgtcggccgggatgccctgggcgcgggcgccgtcgatgatgtcctggaggcactcgacgtattcgtcgaggtcgtcgatggagtacacctgcaccgactgcggacgcttgccggagatcggcgagcgaggcggctgcggccggccgttcacgttctcctggtcgatcaggtagaactccagctcgaaggcggcgacgatggtcagttccatctcggtgaacctggccaccacctggcgcaggacttcgcgggggtcggcgaagaacggctcgccttccagttcgtgcatggtcatcagcagttgcgcggtcgggcgcttctgccagggttccatggagagggtgccggggatcgggtagcagatccggtcggcgtcgccgatgtcgagacccaggccggtactctctacggtggagccggtgatatcgagggcgaacagggaagcggggagattgatacctttttcgaagactttgttcagactgttgcgttcgatccgcttgccgcgaaccacgccattcatgtctgcaataaggaggtcgacgaactggacctcgggatgttccttgaggaactcgctcggttcagtgagctgaacggcacgctggggtaccgacatgatgcaacaccttttttgttaaaaatttcaatcatgcggggggtaggctatgagtcaatccgaaagcctgtgggatgtcaatag

SEQ ID NO: 11262 - DNA, 1470 bp, Pseudomonas aeruginosa
cgaaccccaactatctcgctatcttccaggctttcggtaaggcctgcagcaagagggcggggcaacgttgagtccggctgttggggccggactctcaaccctgaggtctttatgactaccaagttagaccagctgaccagctggctgaaggaacgcaagatcaccgaagtggaatgcctgatttccgatctgacaggcatcgcccgcggcaagatctcgccgaccaacaaattcatcgcggaaaagggcatgcgcctgccggagagcgttctgctgcagaccgtcaccggcgactacgtggaagacgacatttactacgacctgctcgacccggccgacatcgatatggtctgccgcccggacgagaatgccgtgttcctcgtcccctgggccatcgagcccaccgcgatggtgatccacgacaccttcgacaagctcggcaatcccatcgagctgtcgccgcgcaacatcctcaagcgcgtgttgaagatgtatgccgataagggctggcggccgatcgtggcgccagagatggagttctacctgaccaagcgcagcgacgaccccgactatccgttgcaggccccggtgggccgctccggacgccaggaaaccgggcgtcagtcgttctccatcgacgccgccaacgagttcgacccgctgttcgaggacatgtacgactggtgcgaggcccagggccttgacctggatacgctgatccacgaggaaggcaccgcgcagatggagatcaacttccgtcatggcgacgccctcgacctggccgaccagatcctggtgttcaagcgcaccatgcgcgaggccgcgctcaagcacaacgtcgccgcgaccttcatggccaagccgatgaccggcgagccgggcagcgcgatgcacctgcaccagagcatcgtcgacgtgaagaccggcaagaacatcttctccaatgccgacggcaccatgagcgagctgttcctgcaccatatcggcggcctgcagaagttcatcccggaagtgctgccgctgttcgcgcccaacgtgaactcgttccgccgcttcctgcccgatacctcggcgccggtgaacgtcgagtggggcgaagagaaccgtaccgtcggcctgcgcgtgccggactccagcccggagaaccgccgggtcgagaaccgtctcgccggcgccgacgccaacccttacctggcgctggctgccagcctgctgtgcggctacatcggcatggtcgaaggcatcaagccgagcgcccaggtcaaaggtcgcggctatgaacgccgcaacctgcgcctgccgctgacgatcgaagcggcgctggagcgcatggagaactgcaagcccctcgagcagtatctcggcagcaagttcatcagcggctacgtcgcggtgaagcgtgcggagcacgagaatttcaagcgggtaatcagctcctgggagcgggaattcctcctgctttccgtttga

SEQ ID NO: 11263 - DNA, 1158 bp, Pseudomonas aeruginosa
cgcgatcggttgcgccaccgcccggatacttcaacaaaaatggagctaccccgcatgatgaaacgtttcggtaagaccctgctcgccctgaccttggcgggctctgtggccggtatggcgcaggctgcggacaacaaggtgctgcacgtgtacaactggtccgactacatcgcgccggacaccctggagaagttcaccaaggaaactgggatcaaggtcgtctacgacgtctacgacagcaacgaagtgctggaagccaagttgctggcgggcaagtccgggtacgacgtggtggtgccgtccaactccttcctcgccaagcagatcaaggccggggtctaccagaaactcgacaagtccaagctgccgaactggaagaacctgaacaaggacctgatgcacaccctggaagtcagcgacccgggcaacgagcatgcgattccctacatgtggggcaccatcggcatcggctacaacccggacaaggtcaaggcggccttcggcgacaacgcgccggtggattcctgggacctggtattcaagccggagaacatccagaagctgaagcagtgcggcgtcagcttcctcgactcgccgaccgagatcctcccggcggccctgcattatctcggctacaagccggacaccgacaatcccaaggaactcaaggcggccgaagagctgttcctgaagatccgtccctacgtcacctacttccactcgtcgaagtacatttccgacctggccaacggcaacatctgcgtcgccatcggctactccggcgacatctaccaggccaagtcccgcgccgaagaggcgaagaacaaggtcaccgtcaagtacaacattcccaaggaaggcgccggcagcttcttcgacatggtcgccattccgaaggacgccgagaacaccgagggcgccctggccttcgtcaacttcctgatgaagccggaaatcatggccgagatcaccgacgtggttcagttccccaacggcaacgcggcggccaccccgctggtgtccgaggcgatccgcaacgacccgggcatctacccgagcgaagaggtcatgaagaagctgtataccttccccgacctgccggccaagacccagcgggcgatgacccgcagctggaccaagatcaagtccggcaagtga

SEQ ID NO: 11264 - DNA, 1881 bp, Pseudomonas aeruginosa
atccaccctgttgcgcatgctcgccggtttcgagcggcccaccgaggggcggatcttcctcgatggccaggacatcaccgacctgccgccctacgagcggccgatcaatatgatgttccagtcctatgcgctgttcccgcacatgagcgtggcgcagaacatcgccttcggcctcaagcaggacggcctgcccaaggccgagatcgacgagcgcgtggccgagatgctcaagctggtgcacatgacccagtacgccaagcgcaagccgcaccagctctccggcggccagcgccagcgggtggccctggcccgttcgctggccaagcggccgaagctgctgctgctcgacgagccgatgggcgcgctggacaagaagctgcgctcgcagatgcaactggaactggtggagatcatcgagcgcgtcggcgtgacctgcgtgatggtgacccacgaccaggaagaggccatgaccatggcccagcgcatcgccatcatgcacctgggctgcatcgagcagatcggcagcccgatggacatctacgagaccccggcgagccgcctggtctgcgagttcatcggcaacgtcaacctgttcgacggcgtgctggtggaggacgtgcaggaccatgcggtgatcgcctgtccgcagctggagaacccgatctacatcggccacggcatcagcacccgcgccgaggacaagcgcatcacctacgcgctgcggccggagaaagtgatgatcagcgcgcagaagccggacaacctggaacacgccgggcacaactgggcccagggcaccgtctacgacatcgcctaccttggcggccactcggtgtactacatcaagctggcctccgggatgatcgtccaggccttcatggccaacgccgagcgccacgtcacccggccgacctgggaccagtcggtgtacatcagctggtacgacgacagcggcgtggtactgcagtcatgaaattcgccaacagcctgaaaaagcgcatgcccaccgggcggcatgcggtcatcggggtgccgttcctgtggctcttcctgttcttcctgctgcccttcgccatcgtgctgaagatcagcctggcggaagcggacgtggccatcccgccctacaccgagatcttcgcctacgcggaccagcagttgcaggtgctcctcaacctcggcaactacctgatgctgaccgatgacccgctctacatcgatgcctacctcggctcgctgaagatggccttcatcagtaccctgatctgcctgctggtgggctacccgatggcctacgccatcgcccgctccagccagtcctcgcagaccgtcctgctgctgctgatcatgatgccgacctggacggcgatcctgatccgggtctatgcctggatgggcatcctttccaacaacggcctgctcaacagcgtactgatggggctggggctcatcagcgagccgctgaccatcctcaataccaacatcgcggtgtacatcggcatcgtctattcctacctgccgttcatgatcctgccgctctacgccaacctggtgaagcacgacccgagcctgctggaggccgcttccgacctgggcgcgcgtaacttcaccagcttctggaagatcaccgtgccgctgtcgaagaacggcatcatcgccggctgcatgctggtgttcatcccggcggtgggcgagttcgtcatcccggaactgctcggcggccccgagaccctgatgatcggcaaggtgctctggcaggagttcttcaacaaccgcgactggccggtggcgtccgccctggcggtggtgatgctggcgatcctgatcatcccgatcatcctgttcaacaagaaccaggccaaagaactggagggcaaggtatga

SEQ ID NO: 11265 - DNA, 474 bp, Pseudomonas aeruginosa
ccccgtccaggtaggcctccagcactttccagggctgcgactgcttgtcctggcgggcgctgtattcggcggcgtggtcgcggatgcgcagggtgcggaacagacggtcggtatccaccagcttgggtccgagcacttcggccagctcgccgcgcgccaggcgccgcagcatttccatctggaacaggcggtcctgggcgtgcacgtagccgagggcgcggtagaggtcggtctggttctgcgcatacaggtgcggaaccccgcgctcgtcgtagcgcacgtcgaccggcgcctgcaggtgggccacggcgagcgagccgttgcggagcggctgcttggcatggaggtaccaggcgccgccggcagccgcggcggcgaccgccacggcgatcacggtcagggtgcgtttcatcgatcctttctccttgttgtagtgccgagcattctgcggatgccgtcggcccgcggcattga

SEQ ID NO: 11266 - DNA, 1101 bp, Pseudomonas aeruginosa
ccgaatgctcggaccctggaagtctttggtcaatcgcgaggagccgccatgcaggacgacccgtctaccagccccctgacccattccgccacgttgcggcgtctgttgtatgaagccctggacgccctcgggctcgaccccacccgcgtctaccgcagcgtctaccggcgtatcccgctgccgccgccgaccctgggcggccgcctggtgcatgacaacgccccgttgttctggaccgagctggcggcggtgaccggcgatgccgacatcggcctgcacctgggcgaggcaatgaagccgcgcctgctcgatgtggtcggctacctgctgctgtccgcgcgcgacctggaggaggcgctgcgcagcttcgtgcgtttccagcacattctctccggcggtttcgccgcgcgcctcgaggtcgaaggggaaacggcaaggctgatcctcgacatcaactacctgggctatgcctcgctgcgccagcagatcgaatgcctgatgctgctgttcctcaagctgctggcgctgatcagcgacgacgagttcgtcgccgagcgcatcgagttccgccaccgagccccgccgcggctgggcgaacaccgccggttgttcggcaggctgccgctgttctcgcggccgcacgatgccctggtgttttccgccgccttgctgcggcgtccttcgcgcaacgccaatccggacatgcatgacgtgctgacccgccacgcggaagaacagtcccgcgaactcagcgagaaccgcttgctcaatcgcgtgcgctacctgatcgagctgcgcctcggggagggctatggcttgcgccagtgcgcggcggagctgggccttggcagcggtgccttgcagcgtgcgctggccgctgggggagcgagtttccggcaggttcgcgatgaggttcgccggcagcgggcgagcgagatgctgttggccggtcgcgccatccgcgaggtggccaaggcttgcgggttcgccgagctgtcgccgttctaccgggcctttcgccgctggcacgccgcgcccccggagcaatacagggcgcggctggcgaagcgggaagagggttactcgaccagcggtacctga

SEQ ID NO: 11267 - DNA, 744 bp, Pseudomonas aeruginosa
tactcctttggcggcgaaagcctcgtcgttcgggtggtgccgtccatggggcgctattgtcgacatgcggcggaccgcttgtcgagacaccggggcggcacgctacaatggacaatgcacatcaacgtcaatcatcccctcctgcatcgcatcgtcgatgaactggtcgaccagggctggtcgcaccagagcatcttcatgcctgagcgtctgaccaccagattggccgaagagtgccgcacccgtgcggtcgcgggcgacctgaccccggcggcgatcggccgcggcgacggccaggtgatccgcgaaggcatccgcggcgacctcacgcaatggctggagcccggagaatccgaggcctgcgacgaatacctgggggtgatggacagcttgcgccaggcgctcaacgcctcgctgttcctcggcctcgaggatttcgagtgccacttcgcgctgtacccgccgggcgcctattaccagaagcatgtcgatcgtttccgcgacgacgacgcacgcaccgtctccgcggttctctacctcaacgatgcctggttgcccgagcatggcggcgcgctgcgcctgcacctgccgcagcggcaggtggacatccagccgacgggcggtagcctggtggtgttcatgtccgccggcaccgagcacgaagtcctgcccgccagccgcgaccggctgtcgctgaccggctggttccgccggcgcaacgaatccctcctgcaactctcctga

SEQ ID NO: 11268 - DNA, 453 bp, Pseudomonas aeruginosa
aaacaggagactcccatgagagtgacattgccttgcctcggtctagccgccctgatgttcggcgcatccgccagcctgatggctgccgacctgccccggacgaaggcgcccgaaggggcgaaagtgtatttcatcacgccggccgatggtgcaaccgtcgacaagaccttcaccgtgaaattcggcctgaaaggcatgggcgtggcgccggccggcgtcgacatgccggataccggccaccatcacctgttggtggacctgaaggagcagccggcgatgaacctgccgctgccgatgaccgacaacatccgccacttcggcaagggccagaccgaaaccgagatcaccctgccgccgggcaagcacaccctgcaactgctggtgggcgacaagaaccacgtgccgctggagccgaccgtggagtcggagaagatcaccgttaccgtcaagtga

SEQ ID NO: 11269 - DNA, 1413 bp, Pseudomonas aeruginosa
cggaaacgaaaaaaggaggccgctgggcctcctttttcctttccgccggacgctgccttagaacagcacgcggctacggatggtaccgttgacctgctggagtttctccagggccaggtccgagtactcggcatcgacgtcgatcactacgtagccgaccttctcgttggtttgcaggtactggccggaaacgttgatgccgttgtcggcgaagaccttgttgatctcgctcatcacgccggggatgttggcgtggatgtgcagcaggcggtgcttgcccgggtgcgacggcagggcgacttcggggaagttgaccgaggacaccgaggtgccgttgtcgctgtacttgaccagcttctccgccacttccaggccgatgttggcctgtgcctcggcggtggagccgccgatgtgcggggtcaggatcacccggtccaggccacgcagcgggctggcgaattcctcgtcgttggatttcggctcgaccgggaacacgtcgatggcggcgccgatcaggtgctcgtccttgatcgcggcggccaggtggtccagctcgaccactgtgccgcgcgcggcgttgatcaggatgccgcccttcttcatcgcgcggatttccttctcgccgatcatccactgggtggagggcagttcgggaacgtgcagcgagacgatgtcggacatgcccagcagctcgtgcaggctgccgatctgcaccgcgttgcccagcggcagcttggtcacggtgtcgtagaagaacacctgcatgcccagggcctcggcgagtaccgagagctgggtgccgatcgagccgtagccgacgatgccgagcttcttgccacggatctcgaaggaattcgccgcgctcttgatccagccgccgcgatggcaggaggcgttcttttccgggatgccgcgcagcagcaggatcgcctcggccagtaccagctcagccacagagcgggtgttcgagtagggcgcgttgaacacggcgataccgcgttcgcgggcggcgttgaggtcgacctggttggtgccgatgcagaagcagccgaccgcgatcagtttcttcgcgcagtcgaagacctcttcggtcagctgggtgcgggagcgaatgccgatgaagtgcgcatcggcgatcctttccttcagctcgtcgccggaaagcgcggtcttgaggtactcgatgttggtgtagccggcggccttcagcgtgtccacggcgttctggtggacaccttcgagaagaaggaacttgatcttgctcttgtcgagagaggtcttgctcatctgcgtaaacctgttgtcccggaggaagtggctggaaagcgaactgcgcgaagcgggtccggccggcgctggccggcacccgcaactcggcgcccagaggcactaagcgcggggggcgtatgctag

SEQ ID NO: 11270 - DNA, 666 bp, Pseudomonas aeruginosa
atgagttaccagcatcaatatatcgacggcaccccgatccacttccccctgggcaagctggtctgcgtcgggcgcaactacgccgaacacgccaaggaactgaacaacccggttcccaccgagccgctgctgttcatcaagcccggctcctgcgtggtgccggtgagcggcgggctgagcctgccgcaggagcgcggctcggtacactacgaggcggaaatcgccgtgctgatcggcaagccgctgtcgcgcaagccgaaccgcgaggaggtcctcgacgcgatctccggctatgcgccggcgctggacctgaccttgcgcgaggtccaggcgaaactgaaggaaaagggcctgccctgggagctggcaaagagcttcgatggcgccggcgtgctgtcgccgttcgtgaacgccgaccagtttcccgacccgaccgacatcggcatccgcctgaccatcaacggcgaggtgcgccaggacggcaacagccgcgacatgctcaatccgatcgtgccgctgatccagcacatcgccgggcatttctcgctacaggccggcgatgtggtgctgaccggcacgccgtccggggtcgggccgctgaacagcggcgacgagttgctgctcgaattgccgggcgccagccgtttcgagacccgcgtgctctga

SEQ ID NO: 11271 - DNA, 2547 bp, Pseudomonas aeruginosa
cacgttcaccgcgttgatcccgatttcctccaccgcgtagcctccctccatcacgaacagcgtggccaggccgagcttgccgatggcttcgcccatgcgcaggtagtcggggctgtccaggcggaactgggaaatcgggtcctccttgaaggtatccacccccagagaaacgatcaggatgtccgccgcataggcctggatctgccggatcgccgcctgcagcgcctggctccaggtcgcccagtcgctgccggccgccagtgggtagttgaagttgtagccggtgccgacgccgttgcccttctcgtcggcgtagccgaggaaataggggtattcgaagcgcggatcgccgtggatcgaggtgaacagcacatcggcgcggtcgtagaagatgtcctgggtgccgttgccatggtggtagtcgacgtcgaggatcgccacccgcccggcgccccggtcgaggaaggcctgggcggcgatggcggcattgttgaagaagcaatagccgcccatgtagtcggccgcggcgtggtggcccggcgggcgacagagcgaaaataccgagcgcgcgccgttggcgagttcggactggccgctgagggcgacgttggccgaactggtgatcgcctgccaggtcccggcggtgatcggcgcgcctgcgtcgaaggagtagtagccgaggcgaccgtcgatgttgtccggctccgtctgccgcaggcgccgggtcggccaggcgatcggcagcatgtcgtggctgcggccggtggccagccagtcctgccaggcgttctgcaggaaacgcacgaaaccctcgctgtgcacccggcggatcggttccaggccgaagtcgcgcggtgcgcggacttcgccgaggccgacggccttcacgcggtcgaggaccatgtcggcgcggctgggtttttcgaagcagggggtgaactggccgccgatcagttcgtgccggccgtggtgcaggcgatggtcgtcgctgtagatggtcagcatgtcgggctcccgggctcagttctgttcggagaaggtcacggtcggcgccttgcggcggaaaccgccggtatgcaacgccaggtaggcgaggccggcggcgaaccaggtcaggccgatcaccagggtcagcgccgagaggctggtccacagccacagggtcaggcccaggccgatggccggcaccagcccgtagcgcagcaggtcgcgcggggcgcggcggccgtcgagcagcaggtagctgcggatcaccgccaggttcaccgcggagaacgccaccagcgcgccgaagctgatcatcgaggccagggtggtgaggtcgatgaccaccgccagcagggaaatcaccgagaccaccaggatcgcgatcactggcgtcttgaagcgctccgagaggctgccgaacacgcgccgcggcaggatgccgtcgcggcccatgctgtagaggatgcgcgacaccgaggcctgcgaggccagcgccgagccggcggcgccggcgacgtaggcggcggtgaagaagctggcgaggaacttgccgccggccgccagcatcacttcgttggccgccgactcggcgtcctggaatacgctgccggggaacaccagttggctgaagaccgccagcacggtgaacagcaggccggcgccgaccgtggtgatgacgatggcgcgcgggatgtcgcgttgcgggtcgcgggtttcctcggccagggtcgagaccgcgtcgaagccgaggaacgacaggcacagcaccgccgcgccggccatcaacggggcgaagcccggctggctgccgtcgccgacgaagggcaggctcaggtccagcgaggggatgccggccaggtgcttgaccgccatggcgacgaacaccacggcgaagacgaactgggcgccgacgatcacgttgctcatgccggccaccgagctgatgccgatcacgttgagcacggtgaccaggccgatcgccgcgagcacgaagacccaggccggcaccatcgggaaggcgatgttgaggaacaggccgatgagcaggtagttgatcatcggcaggaacaggtagtcgagcagcagcgaccagccggcgaggaagccgacgcaggggccgaagctgaggctggtataggaataggccgagccggcgatgggatatttcttcaccatgaagctgtaggaaaaggcggtgaagagcatcgccgccagggtgaccaggtaggcgctggcggtacgaccgccggtgatctcggtgactaccccgtaggtggtgaacatggtcagcggaaccatgtagaccagcccgaagaagaccagggcgggaagcccgaggatgcgccgcaggccggtgccctgggcgctgtggacgtactcggggcgcttgccgccgatgaggatgccgttgttgcgttcgctggccatgttccgctcctcgcgaaatgccgtatcgatcccgcaggcggccgcttgggcggacctttcctgcgccgggtgaatggacgggctagtggaaaaccgctggggtttccgccgggtcggtggaaatggcagtga

SEQ ID NO: 11272 - DNA, 1125 bp, Pseudomonas aeruginosa
ctcgcggtcgcgaggttcccttgggctctgccggcgccgtttccgcggctccgggcgacccctcgaggagggcgcggttcgactctagcaatccggtttcgccggggagaaccctgtagacggtcaaaaagggatcgaaatggccaagctggctggccggccagcgctggcgcgagctggccgccagcgccgcgtcgatcatttcttaagcttggtccagaccttgctgcgcaacgccagggctttcggcgagcagagcttgaacggcttcaggcggtcgagcttgtcctgcggggtgttgatcgccgggtcgtcgaacagtgctttctccatgaatttctccgagccgacgatggcgttgttgtacttggcgaagttggaggcggcggcgatgttctccgggcgcatcatccagtcgatgaagacgtgggcttccttgacgttgctggcgtcgcgcggaatcgcgaagttgtcgatgaacagccggatgccttccttcggatagacgtattcgaggctggcgcgttgggcgtgggcgcggtggaaggcgccgttccactgctggtgcatggcgacctcgccggcggccatgcgctcgatggtgccgtcgctgttgtacatggccagcgccggcttttgcctgagcagcaggtcgaggaccttctgcgcttccctggcgtcctcggtgcattcgtcgatgccgaggtagtaggtggcgggaatgaacagttcctcgatggagttcagagccaccaccttgcctttcagctcggctggtggttcgaagaacggcttccagctttcttccagcctgccgcccggcaccttcgccgtatcgtagctgtagccggtggtgccccagagatagggaatgctgtagtcgtggccgggatcgaagccaagggtccggaagttttccttcagattgcccaggctcggcaactggctcttgtcgagcttttgcagcagcccctccttgacgaatatttctatgaaactgtccgacggcaccaccacgtcgtaggcgccgccaccggccttgagcttggccagcagcgtctcgttgctgtcgtaggcgtcgagggtggccttgatcccggtgtccttctcgaacttcttcagtaa

SEQ ID NO: 11273 - DNA, 1179 bp, Pseudomonas aeruginosa
gtcggccggcggtgctcattcggcgagcacccggatggcggcggcgggaatccgcacccgcaccttcgcccccggactgtgcgggcagcgtgcgccgtcgcggttctgctggcgcacgcggaagcccggctgtccggccacgttcaggtggtagacggtatcggtgccgacatagacgatgttttccagcacgccttccaactggccgtcggcggccagttcggtgcgctccgggcggatcgccaaggtcacagcgccgctgcccggggtcgtcgcggccagccgctggccgtccgccaggcgcacgccgtcggcgtcggcctggccctcgaggaagttggtttcgccgatgaagtcggcgaccgcccggttcagcggcgcctcgtagatgtcgctgggcgtgccgacctgcaacaccttgcccttgctcatcaccgcgatgcggtcggacatggtcagcgcttcctcctggtcgtgggtgacgaagatgaaggtgatcccggtctcgtgctgcaggcgcttcagctcgatctgcatttccttgcgcagcttcaggtccagcgccgacagcgactcgtcgagcagcagcaccttgggccggctggccagcgcgcgggccagggcgatgcgttgctgctggccaccggacaactggtcggcgcggcgcttgccgacctccggcagcttcaccaggtcgagcatgcggctcacggtggcgtcgatctcgctgcgcgggcggccctgcatctccaggccgaagccgatgttgtcggcgacgctcatgtgcgggaacagcgcataactctggaacaccgtgttgaccgggcggcggaacggcggcaggccttccatgtgttcgccatagaggcggatgctgccggaactgggctgttcgaagccggcgatgaggcggaggagggtggtcttgccgcagccggaagggccgaggagggtgaagaattcgttggcgtggatatccagggacacatcgtcaagggccttcaggccttggccgggggtaccgaattccatgcagatccgctcgatggctatcgcgctggtcatgctgaattccatgcagtcaagcagttgttattgttgaggttttgcggtttctggggcccgcttcacctgctgcggttcgataatgaccggggcgccgcgggcgcagaacgatag

SEQ ID NO: 11274 - DNA, 1014 bp, Pseudomonas aeruginosa
gaaaggtcgggcgcagcccgtttccatacagcgtacaggctctatgctatgactatccacgcccaaactcccgagccgttttccatgtcccgagctttcacgcctcgccgtctgctgctggccgtcctgctggtcgcgctgtccgcgctggtccttctcggccagagcttccgggtcttcgaccgggcctggttcgccgtccaggagtggcgtcacgccgatgcctggaaagagcgctcgatatggctgccggactaccgcgtgcggatcgaggcgcagcccatcgaggggttgaacgacgacgtttccgcgctgaccttcgatcccgaccggcgcaccctgttcaccgtgaccaaccagccggcgcagatcatcgagctgtccttgcagggcaaggtactgcggaccatcccgctgaccggcttcggcgacgccgaggccatcgagtacatcagccgcggcgtctacgtgatcaccgacgagcgccagcaacgcctggtcaaggtgcgcctggaggacgacacgcgcttcatcgacgctgccgatgcccagcagctttcgctgggtatcggcctcaacggcaacaagggtttcgaagggctagcttacgacgccgagggcaagcgcctgttcgtcgccaaggagcgtgacccggtgcgcatctacgagatccacggtttcccccacacccaggcggacaaaccgttcgccgtgcacgtggtggacgaccccgggcgcgacaagcgcctgttcgtccgcgacctgtccagcctgcagttcgacgagggcaccgggcacctgctggcgttgtccgacgagtcgcgtctggtagtcgagctggacaccgacggcgagccggtcagcaccctgtcgctgctgcgcggcatgcacggcctgaagcgcagcgtgccgcaggccgagggcgtggcgatggacgaccgtggcgtgctctacctggtcagcgagccgaacctgttctacgtgttcagcaaggacgagccggcgcagccctga

SEQ ID NO: 11275 - DNA, 807 bp, Pseudomonas aeruginosa
gccgccgggaatcgccgggttgtcggtctgctcgtagccgtccaggtcgcccagttcccagttggtcgcctcgatgaacaacaccgggatgtccatcccgttgaagctttcgccgtcgctgcagcagccggtacccgccgggtattcggcgttcaggccggggttggtgaacagcgggatgtccagctcgcgggcgatgcgcaggatctgttcgcggtaggcgccgagggccgggttggacacgctgttggagccggcatgggcgtacatcttgtcgccggtgaccaggctgtcgaggttgatcattcccagcaggttggcgcgctggctggcgtcgagggactcgacgtaggcacgcgaaccgcgcaggccttcctcctcggcgccgaaaccgaccacctcgaggccgttctccagggcgatgccgccgaggttgcgggcgatctcggtgagcaccgccgcgcccgaggcgttatcgtccaggccctgcagggtcgggcgaccgtagtaggtgtcgtagtgcgcgccgagtaccaggaacttcccgctgctgccgggcgccgaggcgatgacgttctgcgaactgcggttgccggcccaggtgaagtcctggcgactggtctggtagccgaagcccaggcgcgactgcatcagttcgctggcgccggcgaagctggcggtgccgcgatagcggcccgggtagtcggtgatcaggcgctccagggtctccccggcgtattccccgtattgataggcgttggcacccaacgacagcgcagcacatcccaggcctacagcgacagctaa

SEQ ID NO: 11276 - DNA, 600 bp, Pseudomonas aeruginosa
gcttcacgggcaggtgatctccttcctcgggaactgagcccgcccccggcccctcaaacgggccgggaacacggacaaggatgcgctgatggaacattttctccagatcaagattctccacggagtcgccaccgtgctgctgttcggcggcctgctcggcctggcgttctacgcctggcgcagctggcggacgggcgacgcggctcgggtcgcgcgcggtttcaagcgggtccgcctgatcggctggccgctgctggggctcagcctgctggccctgccggtcagcggctggtggctggtgcacctggccggctggccgttgggccagagctggctgctgttcggcgcctgcctctatctgctcggctgcatcttctggctggtcctcgccggccgcctggcgcgggtccagcaccaggccggcgccgccgagacggcgggggccgcgctgggcgagcagaccctgcgcgagatcaaggtgggcctggtcatggccctgctcggtgcggccagcttcatcgcggtggcggtactgatggtcagcaagccgctctgaaacgccaacgaaatggacttcaccggccttcgccggttctgtag

SEQ ID NO: 11277 - DNA, 1278 bp, Pseudomonas aeruginosa
gaacgcatgcgtattctgctggtaggcgcgggaggtttcgtcgggcggcacctgctcccggcgctgctcgccgccggacacgaactgctcctcaccgcgcgccgcccgccggtcgatgcgcctgccggcgtacgctggctggcgctcgacctggagcggcttgcggaaaggccggacagcttcgcctggcccgccggggtcgacctgctgatcaatgccgccggcaccatgagcctcgacgaggcgagcatggctcgcgtccaggacagcggcgcgcgaacactcttcgacctcgctgcagcccatggggcgaaggtcctgcagatttccgcgctgggcgccggtgcgcacccggacgtggccttcctcgccagcaaggcggcggccgaccgccacctgctggaactgggcatcccggcgctggtgctgcgcccgtccctgctgctggggccgggcggcgccagcagcgcctggctggaacgcctgtcgccgctaccgctgattcccttgctggacaatcgcgcgcgcctgcaaccgctgcatgtcgaggacctggtcggcgcggtgctggccttgctgcgccgctggccggagcgggcgcaggtgattccgctggtgggtccgcaggcgctgacccagggcgagctgctggacgagctgcgccgcgcccagggttggccgcgcggccgctatgtggtgccgcccgcggcgcttctcgatgcgttgggcgggcttggccggcgtgctggctggcggacactgagtccatcgatgctgaagctggtgcgccacgacaacctggccgacccggcactcctcgatgcggcctgcggctatcgttgcgcgccgctggccagtcgcctgctcggctggccgcaggcggcacgcagcctggcggcgctgatgcggccgctgatgctggcggccctggtgctgatctggctgggtaccctggtcgcctgcctggggccgggttacggttggggcctgcggatcctcggcgaggccggcatccacggctggccggcgagcctggcggtgatcgccggggccctgctcgacggtgcgctcggcgtcggcctgctgctccgccgctggcgccggcgcgcgctgctggcgcagttctggctgatgcttggctacagcctggcgatcagcctgatcctgccgcactactggtacgacccctacatggcggtcggcaagaacatcgtgctgatggtggccacgctctggctgctgggcgacgaacctcgagccagggaggcccgtggatga

SEQ ID NO: 11278 - DNA, 1227 bp, Pseudomonas aeruginosa
aatggagcgcggccaggccgggcccctacgtacgccagcgcgcggcctggattcgccagcagatgtggcagttgggcggcgacgactacctgctgcgcctggagcgctgaaagctcaacgcggcggtttttccagggcctggcgcggcaccgcgagcatcagtcgcaagtcgtcgtccggcaggtgcgcggtcaggcccagttgcggatagacccaggcctcgccctgggccagttgcaggcgcaggcgcggctggccgagactggccagcagccgctcggcaccgaccctgccttcgggaatcatgctcagcgccacgatcggcttgtcgcccaactgtccttccaatccggcgctcaatggctgcggcgcgctgccaggctgcaacgcagatgcccgctgcaggctcagttgctcctcggcgctcaggcccagctcgccttccacctgccaggggccgccgtcgcccagcaggcggccacggaaggccaggcgcacgccatccaggcgcgggtccacccacaactcgccatccaccgcgtcgtgcagctggcgcagggtcaaggcgttgtccgccaacggcgccagcacctgctcctgccagtcggccagccacggcaacggtcgcgccggttccggcgtacggaccagccaggcgccgacgacgaaggtcaggaccgccagcgacaagtagaacagccagcgggtattgcgcggcatgggattcctccgggcagaaaaaaaccgcacccttgcggggtgcggttttcgcgaggcgcggcgatcaggcgagaatccgccctttcagcttgctcatggcgttcttttccagctgccggatacgctcggcggaaacgttgtacttttccgccaggtcgtgcagcgtggccttctcctcggacagccagcgctgctggagaatgtcgcggctgcgctcgtcgaggccttccagcgcctcgtgcaggttggcgctggagctgtcgctccagtcggcgtcttccaactggcgcgccgggtcgtagcggtggtcttcgaggtaatgcgccggcgactggtaggcgctctcgtcgtccgcgtcggcggccgggtcgaacgccatgtcctggccggtcaggcggctttccatctcgcgcacttcgcggggctcgacccccaggctctcggcgacgcgatggacttcctcgttgttcaaccaggccaggcgcttcttctggctgcgcaggttga

SEQ ID NO: 11279 - DNA, 1506 bp, Pseudomonas aeruginosa
aaggttgaccaccgaaccgttcagccagttcagcgaataggccagcagcgcccaggacaggatgcccgcgcccaggccgtacaacgcgcccatgtacaggaatggccggcgcacgtaaccgtccgtcccgccgaccagcttgatcacctcgatttcgttacggcgattttcgatgtgcaggcggatggtgttgcccaccaccagcaagagggtcagcaccagcaggatggtcaggccgaagacgaagcgttcgccgagcttgaggatcgcgctcaggcgctcgacccataccaggtcgagctgcgcctgctgcacatgaggcagctccgcgagctgctggcgcagtgcctccaggccagcccggtcgatctgcttgggcgtgaccgagatcaccggcggcagcgggttctccggcagctccttgagcgcttcgcccaggccggactgttcctgcaattcgctgagcgcctgctcgcggctgatcaattgggcctcgatcacgtccggcaggcgctcgatctgctcgcgcaggtcctggccctgattttcgctggtcttcaggtcgaggaacagggatatctgcgccgcccgctgccaggagccgccgagccgttcgacattgttcagcagcagcgagaggcccatcggcaggctcagggtgatacccatcaccaggcaggtgaagaagctgccgaacgggtggccgaacaaccggcgcaggctgtccaccaggctggcgcgatggctttccaggtaggcgctgaacgagccgctccagtcggtctgctcctggctcggtttctcgcgggtcttgcgttccggtgcgccctcttcggggccacggggaagatcgttggcgctcatcaggcctcatcctcacggtcagcgatgatccggccacgctgcagggtcagcatgcgatggcgcatacgggcgatcagggccaggtcgtggctggcgatcagtacggtggtgcccaggcgattgatatcctcgaacacacccatgatttccgaggcgagtcgcgggtcgaggttgccggtgggttcgtccgccagcagcagggccggctggtggacgatggcgcgggcaatgccgacccgctgctgctggccggtggaaaggtcggaaggcaacgcctcgcccttttccttcaggttcacccgctccagggccgaggccacgcgcttggcgatctccggcttgggcatgccgaggatctgcagcggcagggcgatgttgtccgccaccgtacgatcggtgagcagttggtggttctggaacaccacgccgatctgccggcgcaggaaagggatctgcgcggtagtgatgcgccccaggtcctggccgccgagcaacagcttgccgctggtcggtcgctccatcgccaggatgaggcgcagcagggtgctcttgccggcgccggagtggccggtgacgaagaggatctcgccacggtgcacgcggaaggacacctcgtgcaggcctacgtggccgttgggatag

SEQ ID NO: 11280 - DNA, 420 bp, Pseudomonas aeruginosa
ccttcttgccctcgagttgcagcttcttcgccagcttgccgatggtggtggtcttgcccacgccgttcaccccaaccaccaggatcacatagggctcgcgcgcgacgtcgacctgcaacggctgctccaccgggcgcagcaggctggccagctcttcctgcagcgccttgtacagcgcgccgctgtcggccagctccttgcgcgccacgcgcttggtcaggttctgcacgatcagggtggtggcctcgacgccgacgtcggcggtcagcaggcgcgtctcgatgtcgtcgagcaggtcgtcgtcgatttccttgcggccgaggaacaggctggccatgccttcgccgatgctggcgctggtcttggacagtccctgccggaggcgggcgaagaagcccggcctggtcgccggctcgctga

SEQ ID NO: 11281 - DNA, 819 bp, Pseudomonas aeruginosa
agctggtccaggacatcgtccgcgactacctggccaacggcccgacccagaaggaactggacgacgccaagcgcgaactggccggcagcttcccgctgtccaccgcgagcaacgccgacatcgtcggccagctcggcgccatcggtttctacggcctgccgctggactacctggaaagcttcctcaagcaggtcgagggactcagcgtcgaacaggtcaggagcgccatggccaagcacctggacgccgacgccttcgtcatcgtcagcgccggcccgagcgtgccgcagaaacccctgccgccacccaccgccaagccggcccagcaacccagcggcgttccggagcattgatgagcaaacctactgcgaaagcccccggccgccacggcggccagggacagctgcggatcatcggtggcgaatggcgcagccggcgtttcgtctttcccgacgggcccggcctgcgaccgaccccggaccgggttccgcgagaccctgttcaactggctggcaccctatgtcgaaggcgcacgggtgctcgatcccttcgccggcagcggcgcgctgttcctcgaggcgttgtcgcgcggcgcccgcgaagggctggccctggataccaacggcgaagcggtggcggccctgcgcaaccacctcgacgcgctcaagtgcggcaccgcccaactggtcctcggcgatgccgtgcgctacctgggaaaccaggctccgagcgccttcgacctggtgttcctcgacccgccgttccatcagaacctgctgcaggacgcctgccgcctgctcgaaacccgcggctggctga

SEQ ID NO: 11282 - DNA, 1479 bp, Pseudomonas aeruginosa
cctgcgcatgaccgcgtccccgaccttccagcccgcctggtggctgcccaatccgcacctgcagaccctgtggagcccgttcttccgccgcgggccgaccctggaacggcagcgcgaacgcctgtggctggccgatggcgacttcatcgacctcgactgggccggcccgcacgatgccgagaccccgctggtgctggcgctgcacggcctcaccgggtcatcctcgtcgcactacatcctcggtctgcagcgcgccctgctggagcgcggctgggccagcgtggcgctgaactggcgcggttgctcgggggagccgaaccgcctgccgcgcggctaccattccggggtcagcgacaacctcgccgaggtggtcgcgcacctgcgcgccaggcgcccgcaagcgccgctgtacgcggtcggctattcgctgggcggcaacgtgctgctcaagtacctgggcgaaaccgctggggactgcccgctgctcggcggcgtcgcggtgtcggtgccgttccgcctggacgagtgcgccgaccgcatcggcctgggcttttcccgggtctaccaggcgcacttcatgaaggccatgctggcctacgtgcaggacaagcagcggctgttcggcgagcagggccaggcggaaggcctggccgccctgcaacgcctcggtccgctggagggcatgcgcaccttctgggacttcgacggccgggtcaccgcgccgctgcacggcttcgccgacgccagggattactatcggcgcgcgtccagccgctactacctgccggacatccgcacgccgagcctgatcatccattccagcgacgaccccttcgtgttcgcccgcagcctgcccgatcgcagcgaactggcaccctgcaccgagctggagctgcacgcccgcggcggtcacgtcggcttcgtcgacggctctccgcgccagcccacctactacctggaacgacgcatccccgactggctggaggcccgcctgcggcagcactgagctggccggcgtccggcgacgggcggcagaataggaacaggctgaaggaaaaaggggggcgaatggaactgacgctgcggcacaacccgatgctcgacgacgccgactgcgaggcgatcctggcgatccacgcggcggtcggctgggaccggcgcatgccgcctgccgagctacgcacgctgtaccagcattccgggtattccctgctggccgaacgcgacggccgcctggtcggcctgctgcgcgccgaggaagaaacaccgattcgcgtctggctggcggaaatcgccgtgctgcccggcgcacagagcagcggcgtcggcgcagccctgctgcggcgcttcgccgaggatcaccgcggcgcctacctgttcaccgacgccaccctcggtaccgaagccttcttccgccgccacggcatccacatccagcaggtgctggagaaaaccctgcgcgatcagagcggcacgtag

SEQ ID NO: 11283 - DNA, 1140 bp, Pseudomonas aeruginosa
agcccgcgcgccgcgcggtcggcctgcaattccagcccggcctcggcccaggtggtgtaccagccgctgggcgtggtcggggtgatcgtgccttggaactatccgctgttcttctccatcggcccgctgaccggggccttcgccgccggcaaccgggtgatgatcaagatgagcgagtcgaccccggccaccgggcgcctgctcaaggacctgctggcgcggatcttccccgaggaccaggtcgccgtggtgctcggcgaggtggacgtcggcgtggccttttccaagctgccgttcgaccacctgctgttcaccggcgccaccagcgtcggcaagcacgtgatgcgcgccgccgccgagaacctgaccccggtcaccctggagctgggcggcaagtcgccggcgatcgtctccgacagcgtgccgatgaaggacgccgccgagcggatcgccttcggcaagagcctcaacgccgggcagacctgcgtcgcgcccgactacgtgctggtaccgagccggcgcgtcgaggaattcgtcagccagtacaaggaggtggtccagggcttcttcccgcgtctttcggacaaccccgactacaccgcgatcatcaacgagcgccagctcggccgcctccggggctatctcgacgacgcccgcgagaagggcgcgaccctcgtcccgctgttcgccgaaggccagcaacggcgcctgccgcagacgctgctgctgaacgtcagcgacgacatgaaagtgatgcaggaggaaatcttcggcccgctgctgccggtgatcccctacgagcgcctggaagacgccctggcctacgtcaaccagcgcccgcgaccgctggccctgtactacttcggctacgacaaggcgcagcagcagcgcgtgctgcacgagacccactcaggcggtgtgtgtctgaacgacaccctgctgcatgtcgcccaggacgacatcccgttcggtggcgtcggtccctccggcatgggccactaccatggccacgaaggcttcctcaccttcagcaaggccaagggcgtgttcagcaagccgcgcttcaacgccgcgcgaatgatctaccccccctacggcaagtcgatccagaagctcgtctacaagctgttcgtgcgctga

SEQ ID NO: 11284 - DNA, 603 bp, Pseudomonas aeruginosa
accggggcgcgtgcggcgccccctcattcctacgctgcaggtgacataacaacaatgagcgacaccacccttgaaagcgccggcctgtcccgacgcagcctgatgaaagtcggcctgatcggcggcgccttcctcgccaccgcgggcgtcaccgccagcctcaccggctgttcggcggagaaaccggcgagcggcctggaaaaggtccgcgaatccgacctgccgttcctccgtgcgctgctgccggtgatgctgctcggcgcggtttccgccgagcagatgccgaaagccgtggagggcgcgatccagagcctcgaccacaacctggcgcggctctccccggagatgttcaagctcacccagcaactcttcgacgtgctcgccctgccgctcacccgtggcccgctcaccggtatctggggcagttgggagaacgccagcggcgacgacgtgcgggcattcctttcgcgctgggaaaacagcttcatcggcctgttgcggatgggccacagttcgctgatgcaactggcgatgatggcctggtacgcccgccccgaggcgtgggcccattgtggctaccccggaccgccgaagatcgcttga

SEQ ID NO: 11285 - DNA, 747 bp, Pseudomonas aeruginosa
gagtgcattcatgcctgtacccgatctgttcgccgagggcctcgcccgcggctggaaaacctacaacggctcgcgcctggacgacgacctggagctggaggccgacgtggtcgtggtcggcaccggcgccggcggcggcaccaccgcggaaatcctcagcgccgccggcctgaaggtgctgctggtggaagaaggcccgctgaagaccagcagcgatttcaagatgcaggaggccgacgcctaccccgagctgtaccaggaaggcatcggccggatgagcaaggacggcgccatcaccatcctccagggccgcgccgtgggcggcaccaccctgatcaactggaccagcagcttccgcaccccggaaccgaccctgcagcactgggcccaggtctacggggtcaagggccacagcgcggaggacatggcgccctggttcgagaaaatggagcagcgcctgcacgtggcgccctgggcgctgccgccgaatgccaacaacgacgtgatccgcctgggctgcgagaagctcggctatcactggaaggtcatcccgcgcaacgtcctcggttgctggaacctcggctactgcggcatgggctgcccggtcaacgccaagcagtcgatgctggtcaccaccatcccggcgaccctcgacaagggtggcgagctgctctacctagcgcgcgccaaccggctgctgctggacggcgacaaggtgacgggcctcgaatgcctgggcatggatga

SEQ ID NO: 11286 - DNA, 1740 bp, Pseudomonas aeruginosa
gccgccatgtccttcctgaacctgcccgtccgtaccctggtcgccgcctgcggcctgtccctgctcagcctcgcggcgcatgccgacagctttcgcggcaacgcccacgcaccgcagcaggccgccgtcgccacgccacatccggccgcgaccgtcgccggcctggaaaccctggccaatggcggcaacgccttcgacgctgcggcggccatcgccgctgccctggcggtagccgagccttacggctcgggactcggcggcggtggattcttccttctgcgccaggccggtgcgcagccgacctatcgcttcctcgacgcccgcgagcgcgcgccgaaggccgcctacgccgacatgtaccggcgcaatggcaaggtcgaccccaggctgtccgtcgacggcccgctggcggcggcgatccccggcctgccggcggcgctggtcgaattgagcagccgctacggacgcaagcccctggccgacaatctggtgccggcgatccgcctggcggtggatggcgtatccgtcgaccggatctaccgtgaccgcgccgccatgcgcctggaagcgatgcgcaaggacccggaaaccgcgcggatcttcctcgacaagggcggaatccccgacgaatggaacctgctccgccaaccgcagctggcacgtaccctggaacgcctcgggcgctacgggcggatcggtttctacgaaggcgagacagcggacaagctgctcaccggggtccgcgccggcggcggcatctggagcgcggccgacctgcgcgactaccgggtgatcgaacgccgcccgctggaggtgaagctggccaacggccgcgaactgatcagcgcaccgccgccctcggccggcggcgtcgccctggcgcagagcctgcagatgctggaacagctgccgtggcagaaggccgagccggtacagcgcgcccattacgtgctggaggtcctgcgccgtgcctaccgcgatcgaggcctgctcggcgacccggacttcgtcgccaacccgctgcccagtttgctggcgccggactacctgaagcgccttgccgccggcatcgacccgcgccgcgccacgcccagctcggcgctgccggaggcgccggcctggcgcgaaggcgaccacaccacccacttcgcggtgatcgatgcccagggcaacgcggtggccgccaccctctcggtgaacctgccgttcggcgccgccttcaccgttcccgataccggcgtggtgctgaacaacgagatggacgatttcgccgccgacacccagggcgccaacagctacggcctggccggcagccaggcgaacgcggtggcggccggcaagcgcccgctgtcgagcatgagcccgagcttcctggaaagcccgaccgacttcgccgccttcggcacccctggcggcagccgcatcccgagcatggtgctgatctccatgctgcagtacttcgacggccgcccggtcggccaatgggtcgccgcgccgcgctaccaccaccagtacaagccggacgtcgtcgagtacgaaccgcgcgccttcagcgatgccgaggccgccgaactgcgccggcgcggctatcagctcaaacgcctggagcgcagctacggcaaccagcaggtgctctactgggacaagcgcagcggccgcgtcgacgccgccagcgacccgcgcgggatcggctactcgtctctgtccctggaggcgcaagcgcagcctcggccgcactga

SEQ ID NO: 11287 - DNA, 846 bp, Pseudomonas aeruginosa
tatcgggagacatgccatgacccaatccctgcacggcaaggtcgtcgccgccctggtgaccgacggtttcgaacaggtcgaactgaccggtccgaaaaaagccctggaagacgccggcgccacggtaaggattctttccgacaaggccggcgaggtgcgcggctggaaccatcaccagccagccgaggccttccgcgtcgacggcaccttcgaagacgccagcctggacgactacgacgccctgctgctgcccggcggggtgatcaattccgaccagatccgcagcctggccaaggcccaggaactggcgatccgcgccgaacaggcgagcaagccggtggcggtgatctgccacggcgcctggctgctgatctccgccggactggtgcagggtcgtaccctgaccagttggccgtcgctcaaggacgacatcaacaacgccggcggccactgggtggaccaggaggtagcggtggacggcaagctggtgagcagccgcaaacccgaagacatcccggccttcaaccgtcgattcatcgaaatcctcgccggctgaacggcccgcgttcgcgcagcggcgaatcccgtcgctgcgctataatcgcgctcttttgccggagcctttcccatgaccctgcccagcttgcgtctcaaagccaacgccgagcgccgcctgcgcgccggccacctgtgggtctacagcaacgaggtggatgtcgccgcgacgccgctgaatgccttcgccgccggcgaccaggcggtgctggaaatggccaacggcaagccgctgggcatcgtcgcgctgagcccgaacaatctcatctgcggccgcctcatttcccgtga

SEQ ID NO: 11288 - DNA, 867 bp, Pseudomonas aeruginosa
taccaagcacgttctcgacaaatcgctgctggttcatcgcatcaacatcgccctcagcctgcgcgagcggcttttcgacaagccgttctaccggctggtctacggcgattccgacctgctgcccggcctggtggtcgatcgctttggcgacgtgctggtggtgcaactggcgtccgcagccatggaactgcgcaaggacgaggtgctcgccgccctgctgcaggtgctcaagcccgccgccgtgctctggaagaacgactccagcgcgcgcgacgccgagggcctggagcgctacgtggccaatgcctacggcgaagtgccggagtgggtcgccctggaagagaacggcgtgaagttcgaggcgccggtgctggccgggcagaagaccggctggttctacgaccaccgcatgaaccgtgcgcgcctggcgccctacgtgcggggcaagcgggtcctcgacctgttcagctatatcggtggctggggcatccaggccgccgccttcggcgccagcgaagtgatgtgcgtggacgcgtccgccttcgccctcgacggcgtcgagcgcaacgcggcactgaacggcgtggcggagaaggtcgcctgcgtcgagggcgacgtgttcgaggccctgcgcgagctgaaggccgccgacgaacgcttcgacgtggtgatcgccgacccgccggccttcatcaagcgcaagaaggacctgaagaacggcgaggccgcctaccgccgtctcaacgaacaggccatgcgcctgctgagcaaggacggcatcctggtcagcgcctcctgctcaatgcacctgcccgaggacgacctgcagaacatcctgatcggcagcgcccgccatctcgaccgtaa

SEQ ID NO: 11289 - DNA, 1935 bp, Pseudomonas aeruginosa
ttagccgcaggaaatcgtcatgcccgattaccgctcgaaaacctccacccacggccgcaacatggccggcgcccgcgccctctggcgcgccaccgggatgaaggacgaagacttcaagaagccgatcatcgccatcgccaactccttcacccagttcgtgcccggccacgtgcacctgaaggacctcggccaactggtcgcccgcgagatcgagaaggccggcggcgtggccaaggaattcaacaccatcgccgtcgacgacggcatcgccatgggccacgacggcatgctctattcgctgccgagccgggagatcatcgccgactccgtggaatacatggtcaacgcccactgcgccgacgccatcgtctgcatctccaactgcgacaagatcacccccggcatgctgatggccgcgctgcgcctgaacatcccggtagtgttcgtctccggcgggccgatggaagccggcaagaccaagctggccagccacggcctggacctggtcgatgccatggtggtggccgccgacgactcctgctccgacgagaaggtcgccgagtacgagcgcagcgcctgcccgacctgcggctcctgctccggcatgttcaccgccaactcgatgaactgcctgaccgaggcgctcggcctgtcgctgccgggcaacggctcgaccctggccacccacgccgaccgcgagcaactgttcctgcgcgccgggcgcctggccgtggaactctgccagcgctattacggcgaaggcgacgacagcgtgctgccgcgcaacatcgccaacttcaaggccttcgagaacgccatgaccctggacatcgccatgggcggctcgaccaataccatcctgcacctgctggccgccgcccaggaggccgaggtgccgttcgacctgcgcgacatcgaccgcctgtcgcgcaaggtgccgcaactgtgcaaggtggcgccgaacatccagaagtaccacatggaagacgtgcatcgcgccggcggcatcttctccatcctcggcgaactggcccgcggtggcctgctgcacaccgacgtccccaccgtgcacagcccgagcatggccgacgccatcgcccagtgggacatcacccagacccgcgacgaagccgtgcacaccttcttcaaggccggtccggcgggcatcccgacccagaccgcgttcagccagaacacccgctggccgagcctggacgacgaccgcgccgagggctgcatccgcagcgtcgagcatgcctattccaaggaaggcgggctggccgtgctctacggcaacatcgctctcgacggctgcgtggtgaagaccgccggggtcgacgagtcgatccacgtgttcgaaggcagcgcgaagatcttcgaaagccaggacgccgcggtgaaaggcatcctcggcgacgaggtgaaggccggcgacatcgtgatcatccgctacgaaggaccgaagggcgggccgggcatgcaggaaatgctctatccgaccagctacctgaagtccaagggcctgggcaagcagtgcgccctgctcaccgacggacgcttctccggcggcacctcgggcctgtccatcggtcacgcctccccggaagccgccgccggcggcgccatcggcctggtgcaggacggcgacaaggtgctgatcgacattcccaatcgctcgatcaacctgctggtcagcgacgaagaactcgccgcacgccgcgccgaacaggacaagaagggctggaagccggccgcgccgcgtgcccgccgcgtcagcaccgcgctcaaggcctacgccctgctcgccaccagcgccgacaagggcgcggtacgcaacaaggcgctgctggacggctgaatcgtcccgcgacgaaaaaagcccggtcccgcgccgggctttttcattcacgcgtacgcgcgccgaatggcggataa

SEQ ID NO: 11290 - DNA, 291 bp, Pseudomonas aeruginosa
tcagcatgggcggcggcttctcggcgatgtccaacggcaccttcgccaacggcgagaacctgctgctgtccggtgtggtgctgggcatcatcgtggtgctcaaccgcatcccggtggtatggatgcgcagttgcgccatcgtcatcgccctggccgtcggctacgcgctggccggctacctcggtcgcctggacttcaccggcatgcaccaggccgagctgttccaggtaccgaccccgctgcacttcggcctggacttctcctggccgctgttcatcccgatgctggtga

SEQ ID NO: 11291 - DNA, 555 bp, Pseudomonas aeruginosa
cctctatgtgctgcacgacctcaagcgactcgacctcgacccggccgccgaaggcatcgacgtggtggtcgccggacattcgcacaagccgctgaaggaagagcgcgacggcgtgctctacctcaacccgggcagcgccgggccgcggcgcttcagcttgccgatcgggatcggcgtgctggaagtggcggggaagaagatcgaggcggagctgatcaccctctgaccccgcctggaaccgtcagcggcgctcccatacctcgaaggcgtaggcaggcgcatcgtcagccgcggcgtgttcgatgctcgacgccaggcgccaggccgcaccatcgatctcggggaaaaaggcgtcgccctccggcgccaggccaacccgggtcaggtagagacgcgcggcgcgcggcaaggcctcggcatagagctgggcgccgccgatcagcatcagttcgtcggcgtcctccgcctgcgcccacgcctcggcgcgcgccagcgcggcgtccaggctggcgaacacttccgcaccctccagtgccaggccggcctggcggctga

SEQ ID NO: 11292 - DNA, 522 bp, Pseudomonas aeruginosa
gcagcacctcgccctccatcacctggaaatgcatgtcctgcggacggtcgaattccaccggctggccggcccggttcggcaccatccagcccttcacctcgggcacgtggaaaccgatgttgccgcgcaggtacatgtccacgttgcgcagcagtatgccgacgccatcctggccggaatccgccggcccggccgtacgcatgggcagcggcaccggcgccggcgggacctgccggtaccagccctcgcgcagcagggccagttcgcgctgctgccggtcgatggcgctttcggcctgagccgcgctggccgccaacaggcaacagccaagcagtacgccccacggacgccggctcacagccgtgcctccagcggcgccggcgccttcaccggcgacacggcgatctgcaccatgccgtcctcgcgcatgcggatcacgccgttctgcagttgccgccggtagtcgtaggaggattgaacagcagcggctgccccgggctgaggctggtgaacagggcatag

SEQ ID NO: 11293 - DNA, 2334 bp, Pseudomonas aeruginosa
ctgtccggcgcccgtaatgccggccattgcaggtcggccagggagtcgccgagggcgagttgcatgccgccgtcggccagggccaggcgactgacgcggaagtccaggcgcggcggcgggaacaatccgtcgaggtcgacgcggatgcggttgccgaccaattccatgtgccgggtcttcagcttcagcacctcggacatctcgatcgaggccgccgccagcgacgaagtgacctcgaccccgtcgacgaaaatccgccggggtaccagggtcacctccagcggaccgctcagctcgatctcggtgagcatccgcagcggccgccagcgccccttgcgcaacaactcgccacgcacttcctggccgtccttgcgggtgttcatactgaggttgcgcacggccgcgcgggacgcagcgaggtcctggttgagcagggtcgccagggtggcgtcgctgacgaatatctcgccggcctggatccgcgccaccatcgccgtcggatcgtcgagcgacaagggcgcgccgggacgagtcggctccatgcggatcagcatgcgctggatgaagaaaccgatgtcgtcgtgcaggcggaagtcggtatcggcgatccacagtcgcgaactcgccgatcccgagccgcgggcgccgacgctcgcctccagcgtgcgcggcggcacggcgctcatcaggctgtccggctggcgtccccagtcatcggtagcggccgtcggcacacgcgcttcgacacgggccggcggcgccacggcctggccgccgccgtgggcatcgaaggccagccaggcgcccagcaacaggcaggccagttgcaacgacaggcagggaaacgcggaggcaggttgcgcggaagccatcaccgatcctcttattgttatgcgagcgccgtcaccctataccctgccccggccgtccgcccctttcgttggattggccgggaaaacgccgacgtcgtcacgctggcggcgattgtcacgggaatgtcgcgaaacgggcaaagaagtatcacctggctgcgtcaatctgctggactggaacactcccgaaccgccgacgaggacccgtcatgcaaccagccttcctgcgccgccacctcggcgccgcctgcctgatgctcgccgctggcctggccagcgccgcccacgccgacaccggcaacgtacaacgcgccatcgactgggcccagggccaggcctccgttcgccacccggccggccacgaacgctcgccgctggtcatcgcccaccgtggcgccagcggttacgtaccggaacacaccctgggcgcctacgccctggcggtgatgatgggcgccgactacgtcgagccggacctggtgatgacccgcgacggcaagctggtcgcccgccacgacaacgagctgggcctgaccaccgatgtcgcccagcacccggaattcgccgaccgcaagcgcacgcagaaagtcgacggagtggaactcaccggctggttcagcgaagacttcaccctcgccgaactgaagaccctgcgcgccatcgagcgcatccccacgatccgcccgggcaatgcgcgcctggacggcaccttcgagatccccaccctgcaggagatcatcgacctggtgaaaagcctgcagatcagccagcaacgcaccatcggcctgtaccccgagatcaagcacggcacccacttccagcgcctcggcctggccatggaacgcccactggtgaagaccctgcaccgcaacggctacctcggtccgcgcgcgccggtattcatccagtccttcgaggtgaacaacctgaaggaactcaagcgcctcaccggcatccgcctggtccagctctacggcagcggccagccctacgaccagcaggctgccggcggcagcctgacctacgccgagatggccaccgccaagggcctgcgccaggtggcgcgctacgcctacggggtcggtccggacaagagctacgtgattccccgcgatgccaacggcaacctcggccagccgacccgcttcgtcggcgacgcccacgccgccgggctgaaggtgcatccctacaccttccgcgcggaaaacagcttccttccggcggagttccgcagcgccgacggcaacccgcagtcgcgcggcgacctggccggcgagatcagggcctacctcgacgccggcatcgacggcctgttcagcgaccagccggacgtcgccgtgcgcctgcgcgagcagcgctgacgcagcccgaccggcgctcgtacgcgggcgccggcctcatggacactcgatgtagccgtcgaagggctgtgccttgcctttctccagtgcctgccgcctga

SEQ ID NO: 11294 - DNA, 501 bp, Pseudomonas aeruginosa
tcagacgccgttggccgggcacgattcacgctcggcagggaaatcgacacaggaggtgacttgagtcacacgacgcatcccggcctcgacgccctctggctgaccgaggccgttcgcctgcgcgaggagcaggccggtccgctggaagacagcgaggcggttcgccaggcgctggcccagggcggttccctgccgcgccgtattctcacccgcgcccactggctgggccgccgcgagggcctgctcgacgcccagcggacctggcgccagggttcgcggctggcgctggccctgctgttggtgctggccctggccagcggcgccggactggcattcgccgcgctcggcgatggccagcgcccggtcaacgtgttgtgggcgctggccagcctactaggcctgcacctgctgaccctgctcggctggggccctcggcctgctcgccggcggcgaggccgcgggcgcgctcgaccgggtccgtgtcccaccacgaaaggctca

SEQ ID NO: 11295 - DNA, 912 bp, Pseudomonas aeruginosa
tcggtatcagtcgatcaggccgtccagcggcgacgaggcgctggcatacagcttgcgcggcatgcgtccggccaggtaggcgagacgaccggcgacgatcgcgtgcttcatggcctcggccatcatcaccgggtccttggcatgggcgatggcggtgttcatcagcaccgcctcgcaacccagctccatggcgatcgctgcatcggaagcggtgccaacgccggcgtcgaccagcaccgggaccttggcttcctcgaggatgatgcgcaggttgtaggggttgcagatgcccaggccggagccgatcaggccggccagcggcatcaccgcgatgcagccgatctcggccagttggcgggcgatgatcgggtcgtcgctggtgtacaccatcacgtcgaagccgtccttcaccagttgctcggcggccttgagggtctcgacgacgttggggaacagggtcttctggtcggcgaggacttccagcttgaccaggttgtgcccgtccagcagctcgcgggccagacggcaggtgcgcacggcctcgaccgcgtcatagcagccggcggtgttcggcaggatggtgtagcgatccggcgggatcacatccagcaggttcggctcgtcgggattctgcccgatgttggtgcgccgcaccgccaccgtgacgatctccgctccggaggcctcgatggcccggcgggtctcgtccaggtccttgtacttgccggtccccaccagcaggcgcgagccataggtacggccggcgatgacgaagggggtatcggtactggatgcttggctcatcggatgactcctggatggaaaggcttgcggggccgatggaagggttcgggggccaggcctagccgccgccgatggcgtggacgatctccacgcggtcgccatccttga

SEQ ID NO: 11296 - DNA, 981 bp, Pseudomonas aeruginosa
aacagccagcgggtattgcgcggcatgggattcctccgggcagaaaaaaaccgcacccttgcggggtgcggttttcgcgaggcgcggcgatcaggcgagaatccgccctttcagcttgctcatggcgttcttttccagctgccggatacgctcggcggaaacgttgtacttttccgccaggtcgtgcagcgtggccttctcctcggacagccagcgctgctggagaatgtcgcggctgcgctcgtcgaggccttccagcgcctcgtgcaggttggcgctggagctgtcgctccagtcggcgtcttccaactggcgcgccgggtcgtagcggtggtcttcgaggtaatgcgccggcgactggtaggcgctctcgtcgtccgcgtcggcggccgggtcgaacgccatgtcctggccggtcaggcggctttccatctcgcgcacttcgcggggctcgacccccaggctctcggcgacgcgatggacttcctcgttgttcaaccaggccaggcgcttcttctggctgcgcaggttgaagaacagcttgcgctgcgccttggtggtggcgaccttgacgatccgccagttgcgcaggatgaactcgtggatctccgccttgatccagtgcacggcgaaggacaccaggcgaacgcccatttccgggttgaaacgcttcacggccttcatcaggccgacgttgccttcctggatcaggtcggcctgggccaggccgtaccccgaataactcttggcgatatgaacaacgaagcgcaggtgcgccaacaccatctgccgcgccgcttccaggtcttgctgatagaagaggcgttcggccagttcacgctcctgttccggcgacaacagcggaatgctgttcaccgagtgcacgtaggcttccaggtttgcgcctggaaccaaggcatgtacaggttgcaaagaagtggtcatgcgaatcctccgattcacgaaactcgcgcagtgtag

SEQ ID NO: 11297 - DNA, 1566 bp, Pseudomonas aeruginosa
cgaagaggatctcgccacggtgcacgcggaaggacacctcgtgcaggcctacgtggccgttgggatagcgtttgccgacctgctcgaagcggatcatgcgttctcccgctctgcgaagagtgcctggacgaaggcgtcggcctcgaaggtacggagatcgtcgatcccctcgccgacaccgatatagcggatcggcaggccgaactgcttggccagggcgaagatcaccccgcccttggcggtgccgtccagtttggtcagggccaggccggtcagctccaccgcgaggttgaactgcttggcctgattgatggcgttctgcccggtgccggcgtcgagcaccagcaggacctcatggggcgccgtctcgtccagcttgccgatcacccggcgcaccttcttcagctcctccatcaggttgtccttggtatgcaggcgtccggcggtatcggcgatcagcacgtcgatgccgcgggccttggcggcctgcaccgcgtcgaagatcaccgaggcggagtcggcgccggtgtgctgggcgatcaccgggatgcggttgcgctcgccccagacctgcaactgctccacggcggcggcgcggaaggtgtcgccggcggccagcatgaccttcttgccctcgagttgcagcttcttcgccagcttgccgatggtggtggtcttgcccacgccgttcaccccaaccaccaggatcacatagggctcgcgcgcgacgtcgacctgcaacggctgctccaccgggcgcagcaggctggccagctcttcctgcagcgccttgtacagcgcgccgctgtcggccagctccttgcgcgccacgcgcttggtcaggttctgcacgatcagggtggtggcctcgacgccgacgtcggcggtcagcaggcgcgtctcgatgtcgtcgagcaggtcgtcgtcgatttccttgcggccgaggaacaggctggccatgccttcgccgatgctggcgctggtcttggacagtccctgccggaggcgggcgaagaagcccggcctggtcgccggctcgctgactgccggagcggcggccagcggcgcaacgggctcgggctcgggctcgggctcgggctcgggctcgggctcgggctcggcagccaggataggctcgggttgcgcgacgggcgcctcgggccggggcgaatgctcctcggccgacgctggctcgtcactggcgagcggtgcttcggcaaccggcgccggctcggccggctcggcagcggagggctgctgccgacctggctgttctgtcagggattgcgccacgtcatcggcaggcgcgcgctgctcggcggccgctgtctcggagaccggctcgacaggctgatcggcaggctgctcgccggcttgcggctttttccgccaccagccgaacagacctttcttttccccgccctgcggggccttcttgtcgtcgttggaaccaaacatgaatgcttgtatctcaagggagcggcacgggacgtggccgcccggaaaacggatgggtatcctagcatctcctcgcccgacggggctaagggtcctgccccgcagtga

SEQ ID NO: 11298 - DNA, 1410 bp, Pseudomonas aeruginosa
cctgagaccccggtggcggcacgaaaggtccagatcaccatgaaaaccccagctcgccgccgcgtcggcctgctcctagccagcctttgtctcccgcttttcgcccaggcggcggaaacccagcccacccacgagttcagcctcgacaacggcctgaaggtcatagtgcgtgaagaccaccgcgccccggtggtggtttcccagctctggtacaggatcggctccagctacgagacacccgggctcaccggcctgtcccacgccctcgaacacatgatgttcaagggcagccgcaagctcggcccgggcgaagcctcgcgggtgctgcgcgacctgggtgcggaagagaacgccttcaccaccgacgactacaccgcctattaccaggtcctggcccgcgaccgtctgccggtggcgctggagatggaagccgaccgcatggcccacttgagcctgccggccgaccagttcaagagcgagatcgaggtgatcaaggaggagcgccgcctgcgcaccgacgacaatcccaacgccctcgccttcgagcgcttcaaggccgccgcctacccggccagcggctaccacaccccgaccatcggctggatggccgacctgcagcgcatgaccatcgacgacctgcgccactggtacgaatcctggtacgcgccgaacaacgccaccctggtagtggtcggcgacgtcaccgccgacgaggtcaagaccctcgccaagcgctacttcggcgagatcccctggcgccagctgccgccggcgcgcaagccgctggaactggccgagcccggcgagcgccggctcaagctgtacgtacgcacccagctgccgaacctgatcatgggcttcaacgtgcccagcctgggcagcagcgagaaccctcgcgaagtcaacgccctgcgcctgatcggcgcgctgctcgatggcggctacagcgcccgcctggcctcgcgcctggagcgcggcgaggagctggtcgccggcgcctccacctactatgacgcgttcaaccgcggcgacagcctgttcgtcctctcggccacgccgaacgtgcagaagggcaagaccctcgagcaggtcgaggccggtctgtggaagcagctcgatgacctcaagcagaacccgcccagcgccgcggagatcgagcgcgtgcgcgcgcagatgatcgccgggatggtctacgagaaggactccatcgccgcccaggccagcagcatcggccagctggaaagcgtcggcctgtcctggaagctgatcgaccaggacctggaggccctcaaggcagtgactccggacgatatccagaaagccgcccgcacctatttcaccccgtcgcgcctgaccctggcgcaagtgctgcctgtgaaggccgaggaaaaggaggcccgtcatgagtga

SEQ ID NO: 11299 - DNA, 2406 bp, Pseudomonas aeruginosa
actgccgatgttcgacctgcgcctgaccttcgccgccggcagcagccaggacgccggcacccccggcctgtcgatgctgaccaacgccatgctcaacgaaggcgtgccgggcaaggacaccactgccatcgccgccggcttcgaggacctcggcgcctcgttcagcaacggctcctaccgcgacatggcggtggccggcctgcgcagcctgtccgatgccgacaagcggacccaggcgctgaagctgttcgaacaggtgatcggccagccgaccttccccgaggacgctctggcacgcatcaagaaccaggtcctggccggtttcgagtaccagaagcagaaccccggcaagctggccggcctggagctgttcaagcgcctctatggcgagcatccctacgcgcactccagcgacggcgacgaaaagtccgttccaccgatcagccgcgaacagttgcaggcgttccacaagaaggcctacgccgccggcaacgtggtcatcgcgctggtcggcgacctctcgcggcaggaggccgaagcgatcgccgcggaagtctccaaggcgctgccccagggcccggcgctggccaagaccgtccagccggaaacgcccaagcccggcctgacgcacatcgacttcccctccgagcagacccacctgatgctcgcccagcttggcatcgaccgccaggatcccgactacgcggcgctctacctgggcaaccagatcctcggcggcggcggcttcggcacccgcctgatggaccaggtgcgagaaaagcgcggcctgacctacggcatctattccggcttcaccgccatgcaggcacgcggtccgttcatgatcaacttccagacccgcgccgaactcagcgagggggcgctgaagctggtccaggacatcgtccgcgactacctggccaacggcccgacccagaaggaactggacgacgccaagcgcgaactggccggcagcttcccgctgtccaccgcgagcaacgccgacatcgtcggccagctcggcgccatcggtttctacggcctgccgctggactacctggaaagcttcctcaagcaggtcgagggactcagcgtcgaacaggtcaggagcgccatggccaagcacctggacgccgacgccttcgtcatcgtcagcgccggcccgagcgtgccgcagaaacccctgccgccacccaccgccaagccggcccagcaacccagcggcgttccggagcattgatgagcaaacctactgcgaaagcccccggccgccacggcggccagggacagctgcggatcatcggtggcgaatggcgcagccggcgtttcgtctttcccgacgggcccggcctgcgaccgaccccggaccgggttccgcgagaccctgttcaactggctggcaccctatgtcgaaggcgcacgggtgctcgatcccttcgccggcagcggcgcgctgttcctcgaggcgttgtcgcgcggcgcccgcgaagggctggccctggataccaacggcgaagcggtggcggccctgcgcaaccacctcgacgcgctcaagtgcggcaccgcccaactggtcctcggcgatgccgtgcgctacctgggaaaccaggctccgagcgccttcgacctggtgttcctcgacccgccgttccatcagaacctgctgcaggacgcctgccgcctgctcgaaacccgcggctggctgaaccccgacgcctggatctataccgagagcgagagcgtcccctcgtccctcggcctgcccggaaactggcggctgcaccgggaaaagaaagccggcaacgtacattacgcgctctggcagcggggagcctgaggatgagcccggcttccgcgagcattcgccaacgcctgctggcgcttggcgagccttgcgcggcgcaacccgccgccgactggcagggcgatatcgccctgcccgccgagctggagcgtttctaccgcgaggtcggcccactcgactgcaccctggagagtgccggcaacccatttttcctgccgtccctggcccgcctctggcagcgccaggccggctatcgctggcacggcatcagcggcgagcgcctgtccggctggcaggacgactggctggtggtggccgaccagggcgccgacccgttcatcctcgagaccggcagcgggcgcatactcttcgacctgcatggcggcaggggctgggacccggccccgtgcttcgacgacctgtggcagatggcggccagcctggtctgcttcggcgaggtctggagcggcgccggcgaggacatcctgctggacgactgcagcgtcgcgccccgctatcggcagcagctcgtcgacgaactgcaaccgatcctcggttcgcgccagcgggcggaggacctcgccgacgagttcggctggtaa

SEQ ID NO: 11300 - DNA, 1035 bp, Pseudomonas aeruginosa
gctggtggccacaccaccaccgcccatgacctgcgcatgaccgcgtccccgaccttccagcccgcctggtggctgcccaatccgcacctgcagaccctgtggagcccgttcttccgccgcgggccgaccctggaacggcagcgcgaacgcctgtggctggccgatggcgacttcatcgacctcgactgggccggcccgcacgatgccgagaccccgctggtgctggcgctgcacggcctcaccgggtcatcctcgtcgcactacatcctcggtctgcagcgcgccctgctggagcgcggctgggccagcgtggcgctgaactggcgcggttgctcgggggagccgaaccgcctgccgcgcggctaccattccggggtcagcgacaacctcgccgaggtggtcgcgcacctgcgcgccaggcgcccgcaagcgccgctgtacgcggtcggctattcgctgggcggcaacgtgctgctcaagtacctgggcgaaaccgctggggactgcccgctgctcggcggcgtcgcggtgtcggtgccgttccgcctggacgagtgcgccgaccgcatcggcctgggcttttcccgggtctaccaggcgcacttcatgaaggccatgctggcctacgtgcaggacaagcagcggctgttcggcgagcagggccaggcggaaggcctggccgccctgcaacgcctcggtccgctggagggcatgcgcaccttctgggacttcgacggccgggtcaccgcgccgctgcacggcttcgccgacgccagggattactatcggcgcgcgtccagccgctactacctgccggacatccgcacgccgagcctgatcatccattccagcgacgaccccttcgtgttcgcccgcagcctgcccgatcgcagcgaactggcaccctgcaccgagctggagctgcacgcccgcggcggtcacgtcggcttcgtcgacggctctccgcgccagcccacctactacctggaacgacgcatccccgactggctggaggcccgcctgcggcagcactga

SEQ ID NO: 11301 - DNA, 507 bp, Pseudomonas aeruginosa
cgctgcggcacaacccgatgctcgacgacgccgactgcgaggcgatcctggcgatccacgcggcggtcggctgggaccggcgcatgccgcctgccgagctacgcacgctgtaccagcattccgggtattccctgctggccgaacgcgacggccgcctggtcggcctgctgcgcgccgaggaagaaacaccgattcgcgtctggctggcggaaatcgccgtgctgcccggcgcacagagcagcggcgtcggcgcagccctgctgcggcgcttcgccgaggatcaccgcggcgcctacctgttcaccgacgccaccctcggtaccgaagccttcttccgccgccacggcatccacatccagcaggtgctggagaaaaccctgcgcgatcagagcggcacgtagagccgctcggaaatcccgtccaccgcatcctgggcctgcgcctcgatgtgcccgctctccagcgccagcacctggtagatgccgcgacgcagttgcgcctcgctga

SEQ ID NO: 11302 - DNA, 1611 bp, Pseudomonas aeruginosa
cctgagagtgcattcatgcctgtacccgatctgttcgccgagggcctcgcccgcggctggaaaacctacaacggctcgcgcctggacgacgacctggagctggaggccgacgtggtcgtggtcggcaccggcgccggcggcggcaccaccgcggaaatcctcagcgccgccggcctgaaggtgctgctggtggaagaaggcccgctgaagaccagcagcgatttcaagatgcaggaggccgacgcctaccccgagctgtaccaggaaggcatcggccggatgagcaaggacggcgccatcaccatcctccagggccgcgccgtgggcggcaccaccctgatcaactggaccagcagcttccgcaccccggaaccgaccctgcagcactgggcccaggtctacggggtcaagggccacagcgcggaggacatggcgccctggttcgagaaaatggagcagcgcctgcacgtggcgccctgggcgctgccgccgaatgccaacaacgacgtgatccgcctgggctgcgagaagctcggctatcactggaaggtcatcccgcgcaacgtcctcggttgctggaacctcggctactgcggcatgggctgcccggtcaacgccaagcagtcgatgctggtcaccaccatcccggcgaccctcgacaagggtggcgagctgctctacctagcgcgcgccaaccggctgctgctggacggcgacaaggtgacgggcctcgaatgcctgggcatggatgagcgctgcgtggcgcccaacggccgccggatcagggtccgggccaggcactacgtgctctccggcggcggcatcaacaccccggcgattcttctccgctcgaaggcgcctgatccgagccagcgggtcggcaagcgcaccttcctgcacacggtgaatttcagcgcggggctgttcgaccgggtgatcaaccccttctacggcgcaccgcagtcgatctactccgaccatttccaatgggacgacggtgtcaccggacgcatgtcctacaaactggaggtgccgccgctgcaaccgtcgctggcctcggtgctgctcggcggcttcggcagcgacaacgccctgcgcatggaacagctaccgcataccaacatgatgctcgccctgctccgcgacggcttccacccggacagcgcggagggctcggtcggcctgcgcggcgacgacaccccagtgctcgactaccggatgaccgactacacctgggacggtatccgccgtgccttccataccatggcggagatccagttcgccgccggcgcccgggaagtgcggccggtgcacagcgacgcgcgtagcgcgaagaacctgcaggaggcgcgcgggatcatcgacggcctgcgcctggagatctaccgcacgcgcctgggcagcgcccacgtcatgggcggctgcgccatgggcgaagacccggccgtggcggtggccgacagcctcggccgccatcaccacctgcggaacctgtcgatccacgacggctcgctgttccccaccagcatcggcgccaacccgcagctctcggtctacggtcttaccgcgcaactggccagcgcgctggccgaacgcctggccagggcctga

SEQ ID NO: 11303 - DNA, 516 bp, Pseudomonas aeruginosa
actgggcacgggcatctccctgggtcgcagccttgcagaaccactggaaggccttttcccggctgccggcataacggtccagcagggcggcttcctcgtctgaagtggcggaatagacgccttgcgagtcgtccaggtagaaccatcccagattggtttcggcgtcttcgctaccgctggccgccgcgcgttcgaaccaggtcccggccttcacccggtcctggtcgaccccttcgcctctccagtagagaacgcccatttcattctgggcggcggcatccccctgctccgcggccttccggaaccagcgtgccgcctcggtcttgtcctgtggcccgccgtcaccatcgcgatagagcatggccagttggatctgcgcgcggaccatccccgcagcggccgccttgccccaccattcgcgcgcgctggcgtagttctgttgctggtagaagtaggcgccgaaatcgaacagagcctgcggctcccccgtctcggcggcctggcggaggcgggtga

SEQ ID NO: 11304 - DNA, 759 bp, Pseudomonas aeruginosa
gcggatctcgcgcagggtgctgccgcagaccttgcagaactccccgccacggccatagacgaacaattcctgctggaagtaaccgggctggccgtcgccgccgacgaaatcgcgcagggtggtgccgccgcgctcgatggcgatcgccaggatccgcttgatctcctccgccaggcgcaggtagcgcgccttggagatgcttccggcgggcttgcgcggatcgatgccggcggcgaacagcgcttcgctggcgtagatgttgccgaccccgaccaccaccgcgttgtccatgatgaacggcttgaccgccatgctccgcccgcgcgacagctcgaacagacgctggccggcgaaagcgtcggtcagcggttccgggccgaggttgcgcagcagctcgtgttccagtggcgccaggctccagagcatggcgccgaagcgccgcggatcggtgtagcgcagggccatgcccgaggccagctcgatgtcgacgtgctcgtggcgactggccggggtaccgctctccaccagcctcaggctgccggacatgcccaggtggctgatcagcgtaccggactcggcgcccagcagcaggtacttggcgcggcgctcgacgctgacgatgcgttgtccggacaggcgcacgtccaggtcttcgggaatcggccagcgcaggcgccgctcgcgcacgatcacgcgctcgacgcgctggccttcgaggtagggggcgatgccccggcgggtggtttcgacttcgggtag

SEQ ID NO: 11305 - DNA, 699 bp, Pseudomonas aeruginosa
ggacggaggcgaaagttgacggtgcgcgcagtttacccggagaaccccgccatggggcgggcttctaccggaaaagcggcgccaggcaacggacatggaacttttcccgcagccgccagggtcggaatgaataccccttctgatatcgggagacatgccatgacccaatccctgcacggcaaggtcgtcgccgccctggtgaccgacggtttcgaacaggtcgaactgaccggtccgaaaaaagccctggaagacgccggcgccacggtaaggattctttccgacaaggccggcgaggtgcgcggctggaaccatcaccagccagccgaggccttccgcgtcgacggcaccttcgaagacgccagcctggacgactacgacgccctgctgctgcccggcggggtgatcaattccgaccagatccgcagcctggccaaggcccaggaactggcgatccgcgccgaacaggcgagcaagccggtggcggtgatctgccacggcgcctggctgctgatctccgccggactggtgcagggtcgtaccctgaccagttggccgtcgctcaaggacgacatcaacaacgccggcggccactgggtggaccaggaggtagcggtggacggcaagctggtgagcagccgcaaacccgaagacatcccggccttcaaccgtcgattcatcgaaatcctcgccggctga

SEQ ID NO: 11306 - DNA, 1224 bp, Pseudomonas aeruginosa
tcgcgctcttttgccggagcctttcccatgaccctgcccagcttgcgtctcaaagccaacgccgagcgccgcctgcgcgccggccacctgtgggtctacagcaacgaggtggatgtcgccgcgacgccgctgaatgccttcgccgccggcgaccaggcggtgctggaaatggccaacggcaagccgctgggcatcgtcgcgctgagcccgaacaatctcatctgcggccgcctcatttcccgtgataccaagcacgttctcgacaaatcgctgctggttcatcgcatcaacatcgccctcagcctgcgcgagcggcttttcgacaagccgttctaccggctggtctacggcgattccgacctgctgcccggcctggtggtcgatcgctttggcgacgtgctggtggtgcaactggcgtccgcagccatggaactgcgcaaggacgaggtgctcgccgccctgctgcaggtgctcaagcccgccgccgtgctctggaagaacgactccagcgcgcgcgacgccgagggcctggagcgctacgtggccaatgcctacggcgaagtgccggagtgggtcgccctggaagagaacggcgtgaagttcgaggcgccggtgctggccgggcagaagaccggctggttctacgaccaccgcatgaaccgtgcgcgcctggcgccctacgtgcggggcaagcgggtcctcgacctgttcagctatatcggtggctggggcatccaggccgccgccttcggcgccagcgaagtgatgtgcgtggacgcgtccgccttcgccctcgacggcgtcgagcgcaacgcggcactgaacggcgtggcggagaaggtcgcctgcgtcgagggcgacgtgttcgaggccctgcgcgagctgaaggccgccgacgaacgcttcgacgtggtgatcgccgacccgccggccttcatcaagcgcaagaaggacctgaagaacggcgaggccgcctaccgccgtctcaacgaacaggccatgcgcctgctgagcaaggacggcatcctggtcagcgcctcctgctcaatgcacctgcccgaggacgacctgcagaacatcctgatcggcagcgcccgccatctcgaccgtaacatccagctgctcgagcgcggcggccagggccccgaccatccggtgcacctggcgatcgcggaaacccgctacatcaagagcctgacctgccggctgctgcccaacggctga

SEQ ID NO: 11307 - DNA, 1854 bp, Pseudomonas aeruginosa
ccgcaggaaatcgtcatgcccgattaccgctcgaaaacctccacccacggccgcaacatggccggcgcccgcgccctctggcgcgccaccgggatgaaggacgaagacttcaagaagccgatcatcgccatcgccaactccttcacccagttcgtgcccggccacgtgcacctgaaggacctcggccaactggtcgcccgcgagatcgagaaggccggcggcgtggccaaggaattcaacaccatcgccgtcgacgacggcatcgccatgggccacgacggcatgctctattcgctgccgagccgggagatcatcgccgactccgtggaatacatggtcaacgcccactgcgccgacgccatcgtctgcatctccaactgcgacaagatcacccccggcatgctgatggccgcgctgcgcctgaacatcccggtagtgttcgtctccggcgggccgatggaagccggcaagaccaagctggccagccacggcctggacctggtcgatgccatggtggtggccgccgacgactcctgctccgacgagaaggtcgccgagtacgagcgcagcgcctgcccgacctgcggctcctgctccggcatgttcaccgccaactcgatgaactgcctgaccgaggcgctcggcctgtcgctgccgggcaacggctcgaccctggccacccacgccgaccgcgagcaactgttcctgcgcgccgggcgcctggccgtggaactctgccagcgctattacggcgaaggcgacgacagcgtgctgccgcgcaacatcgccaacttcaaggccttcgagaacgccatgaccctggacatcgccatgggcggctcgaccaataccatcctgcacctgctggccgccgcccaggaggccgaggtgccgttcgacctgcgcgacatcgaccgcctgtcgcgcaaggtgccgcaactgtgcaaggtggcgccgaacatccagaagtaccacatggaagacgtgcatcgcgccggcggcatcttctccatcctcggcgaactggcccgcggtggcctgctgcacaccgacgtccccaccgtgcacagcccgagcatggccgacgccatcgcccagtgggacatcacccagacccgcgacgaagccgtgcacaccttcttcaaggccggtccggcgggcatcccgacccagaccgcgttcagccagaacacccgctggccgagcctggacgacgaccgcgccgagggctgcatccgcagcgtcgagcatgcctattccaaggaaggcgggctggccgtgctctacggcaacatcgctctcgacggctgcgtggtgaagaccgccggggtcgacgagtcgatccacgtgttcgaaggcagcgcgaagatcttcgaaagccaggacgccgcggtgaaaggcatcctcggcgacgaggtgaaggccggcgacatcgtgatcatccgctacgaaggaccgaagggcgggccgggcatgcaggaaatgctctatccgaccagctacctgaagtccaagggcctgggcaagcagtgcgccctgctcaccgacggacgcttctccggcggcacctcgggcctgtccatcggtcacgcctccccggaagccgccgccggcggcgccatcggcctggtgcaggacggcgacaaggtgctgatcgacattcccaatcgctcgatcaacctgctggtcagcgacgaagaactcgccgcacgccgcgccgaacaggacaagaagggctggaagccggccgcgccgcgtgcccgccgcgtcagcaccgcgctcaaggcctacgccctgctcgccaccagcgccgacaagggcgcggtacgcaacaaggcgctgctggacggctga

SEQ ID NO: 11308 - DNA, 1098 bp, Pseudomonas aeruginosa
atcgtcccgcgacgaaaaaagcccggtcccgcgccgggctttttcattcacgcgtacgcgcgccgaatggcggataatcgcaagcggtcattcgccctaccgctcacccacgctccaaccgcagggcgcatacgccaccggcgttatccgccgacatgcggcgcagccaggcctgggcgagaccgtgttcgcccagtaaaatcgcgctctttttccccggaccgccaccatgagttccctgcaaagcccgtcggacgccagcgcccgcaacgacctggtctatggcctggacgaccgtcccagcgctcccatcgccctgctcgccgccctccagcacctgctggcgatcatcgtgccgatcgttacccccggcctgctgatctgccaggcgctgggcgtatcgccgcgcgacaccaatctgatcgtgtcgatgtcgctggtgatctccggcatcgccaccttcgtccagtgcaagcgcttcggcccgttcggcgccggactgttgatcgtccagggcaccagcttcaacttcgtcggcccgctgatcgccggcggggcgctgatggtcaagcagggcacgccggtggaaagcgtgatggcggcgatcttcggcgtggtcatcgccggctccttcgtcgagatgggcatctcgcgcatactgccgttcgtcaagcggctgatcacgccgctggtgaccggcatcgtcgtgctgatgatcggcctgaccctgatcaaggtcggcctgatcagcatgggcggcggcttctcggcgatgtccaacggcaccttcgccaacggcgagaacctgctgctgtccggtgtggtgctgggcatcatcgtggtgctcaaccgcatcccggtggtatggatgcgcagttgcgccatcgtcatcgccctggccgtcggctacgcgctggccggctacctcggtcgcctggacttcaccggcatgcaccaggccgagctgttccaggtaccgaccccgctgcacttcggcctggacttctcctggccgctgttcatcccgatgctggtgatctacctggtcacctccctggaagccatcggcgacgtcaccgccaccagcaaggtgtctaa

SEQ ID NO: 11309 - DNA, 594 bp, Pseudomonas aeruginosa
gcaaccggtggaaggcccgctgtggatgcagcggatcaagggcggcgtgctggtcaacggcgccaactcgttcctcgccggtatcttcaataccttccccagctcagtgttcgcccagaacaacggggtgatccagctcaccggcgtggccagccgctacgtcggcctctggatcgccgccatgctggtcctgctcggcctgttcccgagcgtcgccggggtcatccaggcggtgccggaaccggtactgggcggcgcggcgatggtgatgttcggcgcggtggccgcttcgggcatcaacatcctcgccggcatccagctggaccgccgtgccctgctgatcatcgccgtatccctggccctcggcctgggcgtttcgcaggtgccggagttcctcgcgcacatgcccgcggcgctgcgcaacgtgctggagtccggggtcgccaccggcggcatctgcgccctgctgctgaactggttcctgccggaaagcccggtccagaaggccggacactgataggcgcggcgccacctccgggtggcgtcgcggttttcgccgaagggttttcgtacccggccaatggttgggtatga

SEQ ID NO: 11310 - DNA, 534 bp, Pseudomonas aeruginosa
tcgacggcatggccatgcccgtcggccaccctcttccgtcccgcaacccggacccgcgcccatgccccagtcccgccgcccgttgcgcatcggcctgatcgccgacacccatggcctgctccggcccgaggcgctggaacggttgcgcggctgcgaccagttgatccatgccggcgacatcggcaagccggaaatcctcgccgagctggaacgcctggcgccgctctcggtggtgcgcggcaacaacgacacccaggactgggcggcggacatccccgagcgcgtgctgctgaagatcggccggctgacctctatgtgctgcacgacctcaagcgactcgacctcgacccggccgccgaaggcatcgacgtggtggtcgccggacattcgcacaagccgctgaaggaagagcgcgacggcgtgctctacctcaacccgggcagcgccgggccgcggcgcttcagcttgccgatcgggatcggcgtgctggaagtggcggggaagaagatcgaggcggagctgatcaccctctga

SEQ ID NO: 11311 - DNA, 1512 bp, Pseudomonas aeruginosa
cggccgtcggcacacgcgcttcgacacgggccggcggcgccacggcctggccgccgccgtgggcatcgaaggccagccaggcgcccagcaacaggcaggccagttgcaacgacaggcagggaaacgcggaggcaggttgcgcggaagccatcaccgatcctcttattgttatgcgagcgccgtcaccctataccctgccccggccgtccgcccctttcgttggattggccgggaaaacgccgacgtcgtcacgctggcggcgattgtcacgggaatgtcgcgaaacgggcaaagaagtatcacctggctgcgtcaatctgctggactggaacactcccgaaccgccgacgaggacccgtcatgcaaccagccttcctgcgccgccacctcggcgccgcctgcctgatgctcgccgctggcctggccagcgccgcccacgccgacaccggcaacgtacaacgcgccatcgactgggcccagggccaggcctccgttcgccacccggccggccacgaacgctcgccgctggtcatcgcccaccgtggcgccagcggttacgtaccggaacacaccctgggcgcctacgccctggcggtgatgatgggcgccgactacgtcgagccggacctggtgatgacccgcgacggcaagctggtcgcccgccacgacaacgagctgggcctgaccaccgatgtcgcccagcacccggaattcgccgaccgcaagcgcacgcagaaagtcgacggagtggaactcaccggctggttcagcgaagacttcaccctcgccgaactgaagaccctgcgcgccatcgagcgcatccccacgatccgcccgggcaatgcgcgcctggacggcaccttcgagatccccaccctgcaggagatcatcgacctggtgaaaagcctgcagatcagccagcaacgcaccatcggcctgtaccccgagatcaagcacggcacccacttccagcgcctcggcctggccatggaacgcccactggtgaagaccctgcaccgcaacggctacctcggtccgcgcgcgccggtattcatccagtccttcgaggtgaacaacctgaaggaactcaagcgcctcaccggcatccgcctggtccagctctacggcagcggccagccctacgaccagcaggctgccggcggcagcctgacctacgccgagatggccaccgccaagggcctgcgccaggtggcgcgctacgcctacggggtcggtccggacaagagctacgtgattccccgcgatgccaacggcaacctcggccagccgacccgcttcgtcggcgacgcccacgccgccgggctgaaggtgcatccctacaccttccgcgcggaaaacagcttccttccggcggagttccgcagcgccgacggcaacccgcagtcgcgcggcgacctggccggcgagatcagggcctacctcgacgccggcatcgacggcctgttcagcgaccagccggacgtcgccgtgcgcctgcgcgagcagcgctga

SEQ ID NO: 11312 - DNA, 1500 bp, Pseudomonas aeruginosa
ctcctggatggaaaggcttgcggggccgatggaagggttcgggggccaggcctagccgccgccgatggcgtggacgatctccacgcggtcgccatccttgagcgcggtgctggcgtgctggctgcgcggcacgatatccaggttcagctcgacggccacgcggcggccgccaagctccaggcgggccagcaggtccgcgacgctctgcgcgtcgggcagctcgaagggctcgccgttcagttgaatctgcatggctggacggtcacgaaagtgaaagggagcggcattctagcccgatccaccccgatgaccaaggcgccttgtcgacaagtgcgccgcctgaggcaaccggtctcaggcgttgcccaggcgccaggcggccagccccaggcacagccagccggcgaggaaggagacgccgccgaacggggtgacgatgccgagcttgccgatgccactgagggtcagcaggtagaggctgccggagaacagcaggatgcccagcgtgaacaggccacccgccgcgctcaccaggcggccgtccaggcgggtggcgagcagcgccacgccgaacagcgccagggcgtggatcaactggtagtgcacgccggtctggaataccgccaggtactcggcgctgagctgcttcttcaggccgtgggcggcgaacgccccgagggccacgccggtgaaaccgaaaaatgccgccaacaacaggaagggacgaagcatggacaagactccggtgatagcatccagcccgctataatggccgcccccttcttccaagccaagccgcgcatgttgcgatccctgttccgccgcctgttcaagtacctgctctggttcatggccgccagcgtcgtgctggtcgcggtcctgcgctgggtgccgccaccggggaccatggtcatggtcgaacgcaaggtcggctcctgggtcgacggccagcccatcgacctgcagcgcgactggcgctcctgggagcagttgccggacagcctgaaggtcgcggtgatcgccggcgaggaccagcacttcgccgagcaccacggcttcgacctgccggccatccagcaggccctcgcgcacaacgagcgcggcggcagtatccgcggcgccagtacgctcagccagcaggtggcgaagaacgtcttcctctggtccgggcgcagttggctgcgcaagggcctggaggcctggttcaccctgctgatcgagacgctctggaccaagcaacggattctcgaggtctacctgaacagcgccgaatggggcccgggcgtcttcggcgcgcaggctgcggcacgctatcacttcggcctcgacgccgagcgcctgagccgcacccaggccagccagctcgccgcggtgctgcccagcccgctgaaatggagcgcggccaggccgggcccctacgtacgccagcgcgcggcctggattcgccagcagatgtggcagttgggcggcgacgactacctgctgcgcctggagcgctga

SEQ ID NO: 11313 - DNA, 912 bp, Pseudomonas aeruginosa
aagctcaacgcggcggtttttccagggcctggcgcggcaccgcgagcatcagtcgcaagtcgtcgtccggcaggtgcgcggtcaggcccagttgcggatagacccaggcctcgccctgggccagttgcaggcgcaggcgcggctggccgagactggccagcagccgctcggcaccgaccctgccttcgggaatcatgctcagcgccacgatcggcttgtcgcccaactgtccttccaatccggcgctcaatggctgcggcgcgctgccaggctgcaacgcagatgcccgctgcaggctcagttgctcctcggcgctcaggcccagctcgccttccacctgccaggggccgccgtcgcccagcaggcggccacggaaggccaggcgcacgccatccaggcgcgggtccacccacaactcgccatccaccgcgtcgtgcagctggcgcagggtcaaggcgttgtccgccaacggcgccagcacctgctcctgccagtcggccagccacggcaacggtcgcgccggttccggcgtacggaccagccaggcgccgacgacgaaggtcaggaccgccagcgacaagtagaacagccagcgggtattgcgcggcatgggattcctccgggcagaaaaaaaccgcacccttgcggggtgcggttttcgcgaggcgcggcgatcaggcgagaatccgccctttcagcttgctcatggcgttcttttccagctgccggatacgctcggcggaaacgttgtacttttccgccaggtcgtgcagcgtggccttctcctcggacagccagcgctgctggagaatgtcgcggctgcgctcgtcgaggccttccagcgcctcgtgcaggttggcgctggagctgtcgctccagtcggcgtcttccaactggcgcgccgggtcgtag

SEQ ID NO: 11314 - DNA, 861 bp, Pseudomonas aeruginosa
acgagccgctccagtcggtctgctcctggctcggtttctcgcgggtcttgcgttccggtgcgccctcttcggggccacggggaagatcgttggcgctcatcaggcctcatcctcacggtcagcgatgatccggccacgctgcagggtcagcatgcgatggcgcatacgggcgatcagggccaggtcgtggctggcgatcagtacggtggtgcccaggcgattgatatcctcgaacacacccatgatttccgaggcgagtcgcgggtcgaggttgccggtgggttcgtccgccagcagcagggccggctggtggacgatggcgcgggcaatgccgacccgctgctgctggccggtggaaaggtcggaaggcaacgcctcgcccttttccttcaggttcacccgctccagggccgaggccacgcgcttggcgatctccggcttgggcatgccgaggatctgcagcggcagggcgatgttgtccgccaccgtacgatcggtgagcagttggtggttctggaacaccacgccgatctgccggcgcaggaaagggatctgcgcggtagtgatgcgccccaggtcctggccgccgagcaacagcttgccgctggtcggtcgctccatcgccaggatgaggcgcagcagggtgctcttgccggcgccggagtggccggtgacgaagaggatctcgccacggtgcacgcggaaggacacctcgtgcaggcctacgtggccgttgggatagcgtttgccgacctgctcgaagcggatcatgcgttctcccgctctgcgaagagtgcctggacgaaggcgtcggcctcgaaggtacggagatcgtcgatcccctcgccgacaccgatatag

SEQ ID NO: 11315 - DNA, 408 bp, Pseudomonas aeruginosa
ttgatggcgttctgcccggtgccggcgtcgagcaccagcaggacctcatggggcgccgtctcgtccagcttgccgatcacccggcgcaccttcttcagctcctccatcaggttgtccttggtatgcaggcgtccggcggtatcggcgatcagcacgtcgatgccgcgggccttggcggcctgcaccgcgtcgaagatcaccgaggcggagtcggcgccggtgtgctgggcgatcaccgggatgcggttgcgctcgccccagacctgcaactgctccacggcggcggcgcggaaggtgtcgccggcggccagcatgaccttcttgccctcgagttgcagcttcttcgccagcttgccgatggtggtggtcttgcccacgccgttcaccccaaccaccaggatcacatag

SEQ ID NO: 11316 - DNA, 639 bp, Pseudomonas aeruginosa
ggctcgcgcgcgacgtcgacctgcaacggctgctccaccgggcgcagcaggctggccagctcttcctgcagcgccttgtacagcgcgccgctgtcggccagctccttgcgcgccacgcgcttggtcaggttctgcacgatcagggtggtggcctcgacgccgacgtcggcggtcagcaggcgcgtctcgatgtcgtcgagcaggtcgtcgtcgatttccttgcggccgaggaacaggctggccatgccttcgccgatgctggcgctggtcttggacagtccctgccggaggcgggcgaagaagcccggcctggtcgccggctcgctgactgccggagcggcggccagcggcgcaacgggctcgggctcgggctcgggctcgggctcgggctcgggctcgggctcggcagccaggataggctcgggttgcgcgacgggcgcctcgggccggggcgaatgctcctcggccgacgctggctcgtcactggcgagcggtgcttcggcaaccggcgccggctcggccggctcggcagcggagggctgctgccgacctggctgttctgtcagggattgcgccacgtcatcggcaggcgcgcgctgctcggcggccgctgtctcggagaccggctcgacaggctga

SEQ ID NO: 11317 - DNA, 1512 bp, Pseudomonas aeruginosa
aggccgaggaaaaggaggcccgtcatgagtgagcgcacagggctgcgttatggcctgctcggcctgatcgtcatcgcgttgctggccgcgctggcctatttcgtcgcgcgtcccccccagaccccggcggcggcccatgccgcggcggtcgaggaaaaccagttgcagtcgctgaaggacatcgccaagcaggcgccggtccatcgcaagctggacatccaggaatggaagaccgccgaaggtgccaaggtgctgttcgtcgaagcccatgaactgccgatgttcgacctgcgcctgaccttcgccgccggcagcagccaggacgccggcacccccggcctgtcgatgctgaccaacgccatgctcaacgaaggcgtgccgggcaaggacaccactgccatcgccgccggcttcgaggacctcggcgcctcgttcagcaacggctcctaccgcgacatggcggtggccggcctgcgcagcctgtccgatgccgacaagcggacccaggcgctgaagctgttcgaacaggtgatcggccagccgaccttccccgaggacgctctggcacgcatcaagaaccaggtcctggccggtttcgagtaccagaagcagaaccccggcaagctggccggcctggagctgttcaagcgcctctatggcgagcatccctacgcgcactccagcgacggcgacgaaaagtccgttccaccgatcagccgcgaacagttgcaggcgttccacaagaaggcctacgccgccggcaacgtggtcatcgcgctggtcggcgacctctcgcggcaggaggccgaagcgatcgccgcggaagtctccaaggcgctgccccagggcccggcgctggccaagaccgtccagccggaaacgcccaagcccggcctgacgcacatcgacttcccctccgagcagacccacctgatgctcgcccagcttggcatcgaccgccaggatcccgactacgcggcgctctacctgggcaaccagatcctcggcggcggcggcttcggcacccgcctgatggaccaggtgcgagaaaagcgcggcctgacctacggcatctattccggcttcaccgccatgcaggcacgcggtccgttcatgatcaacttccagacccgcgccgaactcagcgagggggcgctgaagctggtccaggacatcgtccgcgactacctggccaacggcccgacccagaaggaactggacgacgccaagcgcgaactggccggcagcttcccgctgtccaccgcgagcaacgccgacatcgtcggccagctcggcgccatcggtttctacggcctgccgctggactacctggaaagcttcctcaagcaggtcgagggactcagcgtcgaacaggtcaggagcgccatggccaagcacctggacgccgacgccttcgtcatcgtcagcgccggcccgagcgtgccgcagaaacccctgccgccacccaccgccaagccggcccagcaacccagcggcgttccggagcattga

SEQ ID NO: 11318 - DNA, 594 bp, Pseudomonas aeruginosa
gcaaacctactgcgaaagcccccggccgccacggcggccagggacagctgcggatcatcggtggcgaatggcgcagccggcgtttcgtctttcccgacgggcccggcctgcgaccgaccccggaccgggttccgcgagaccctgttcaactggctggcaccctatgtcgaaggcgcacgggtgctcgatcccttcgccggcagcggcgcgctgttcctcgaggcgttgtcgcgcggcgcccgcgaagggctggccctggataccaacggcgaagcggtggcggccctgcgcaaccacctcgacgcgctcaagtgcggcaccgcccaactggtcctcggcgatgccgtgcgctacctgggaaaccaggctccgagcgccttcgacctggtgttcctcgacccgccgttccatcagaacctgctgcaggacgcctgccgcctgctcgaaacccgcggctggctgaaccccgacgcctggatctataccgagagcgagagcgtcccctcgtccctcggcctgcccggaaactggcggctgcaccgggaaaagaaagccggcaacgtacattacgcgctctggcagcggggagcctga

SEQ ID NO: 11319 - DNA, 603 bp, Pseudomonas aeruginosa
gcccggcttccgcgagcattcgccaacgcctgctggcgcttggcgagccttgcgcggcgcaacccgccgccgactggcagggcgatatcgccctgcccgccgagctggagcgtttctaccgcgaggtcggcccactcgactgcaccctggagagtgccggcaacccatttttcctgccgtccctggcccgcctctggcagcgccaggccggctatcgctggcacggcatcagcggcgagcgcctgtccggctggcaggacgactggctggtggtggccgaccagggcgccgacccgttcatcctcgagaccggcagcgggcgcatactcttcgacctgcatggcggcaggggctgggacccggccccgtgcttcgacgacctgtggcagatggcggccagcctggtctgcttcggcgaggtctggagcggcgccggcgaggacatcctgctggacgactgcagcgtcgcgccccgctatcggcagcagctcgtcgacgaactgcaaccgatcctcggttcgcgccagcgggcggaggacctcgccgacgagttcggctggtaagctggtggccacaccaccaccgcccatgacctgcgcatga

SEQ ID NO: 11320 - DNA, 807 bp, Pseudomonas aeruginosa
gaacaggctgaaggaaaaaggggggcgaatggaactgacgctgcggcacaacccgatgctcgacgacgccgactgcgaggcgatcctggcgatccacgcggcggtcggctgggaccggcgcatgccgcctgccgagctacgcacgctgtaccagcattccgggtattccctgctggccgaacgcgacggccgcctggtcggcctgctgcgcgccgaggaagaaacaccgattcgcgtctggctggcggaaatcgccgtgctgcccggcgcacagagcagcggcgtcggcgcagccctgctgcggcgcttcgccgaggatcaccgcggcgcctacctgttcaccgacgccaccctcggtaccgaagccttcttccgccgccacggcatccacatccagcaggtgctggagaaaaccctgcgcgatcagagcggcacgtagagccgctcggaaatcccgtccaccgcatcctgggcctgcgcctcgatgtgcccgctctccagcgccagcacctggtagatgccgcgacgcagttgcgcctcgctgaggtcgccgtcgagatcgagggtggtgcagaggaagcgcacccaggaggtgaggatgatccaggcgttgagggtcagggcctccagctgggtctcgttcatccgcaggatgccggcctcggtgaagccccggtagatcgccttggcgttgaccaggcaacgctgggcgaaggcgcggtagcgcgccgccagctccgggtcgctttccagcaggtgctcgaggtcgcgatggaggaagcggtagcgccacatcgcggccagtag

SEQ ID NO: 11321 - DNA, 1527 bp, Pseudomonas aeruginosa
cgacagacgcgcggccacgcagccgcccacgcttcgccgaggagccagcccatggtcgccgatatcgcctacctgcagcagagccagcaggaaatcaaccagctcgaagccctcttcgcccgccagcgcgccgcctacctggcgcagccgatgcccgacgccacgcagcgcgtgcagtggctgaaggccctgcgcgacctgctgttcaaggaacagcaggcactgatcgaggccatcgaccgggacttcagcgcgcgctccgccgacgagaccctgctcgccgagatcatgcccagcctgcacggcatccaatacgccgccaagcgcgtgaagaaatggatgaagcccgcgcgccgcgcggtcggcctgcaattccagcccggcctcggcccaggtggtgtaccagccgctgggcgtggtcggggtgatcgtgccttggaactatccgctgttcttctccatcggcccgctgaccggggccttcgccgccggcaaccgggtgatgatcaagatgagcgagtcgaccccggccaccgggcgcctgctcaaggacctgctggcgcggatcttccccgaggaccaggtcgccgtggtgctcggcgaggtggacgtcggcgtggccttttccaagctgccgttcgaccacctgctgttcaccggcgccaccagcgtcggcaagcacgtgatgcgcgccgccgccgagaacctgaccccggtcaccctggagctgggcggcaagtcgccggcgatcgtctccgacagcgtgccgatgaaggacgccgccgagcggatcgccttcggcaagagcctcaacgccgggcagacctgcgtcgcgcccgactacgtgctggtaccgagccggcgcgtcgaggaattcgtcagccagtacaaggaggtggtccagggcttcttcccgcgtctttcggacaaccccgactacaccgcgatcatcaacgagcgccagctcggccgcctccggggctatctcgacgacgcccgcgagaagggcgcgaccctcgtcccgctgttcgccgaaggccagcaacggcgcctgccgcagacgctgctgctgaacgtcagcgacgacatgaaagtgatgcaggaggaaatcttcggcccgctgctgccggtgatcccctacgagcgcctggaagacgccctggcctacgtcaaccagcgcccgcgaccgctggccctgtactacttcggctacgacaaggcgcagcagcagcgcgtgctgcacgagacccactcaggcggtgtgtgtctgaacgacaccctgctgcatgtcgcccaggacgacatcccgttcggtggcgtcggtccctccggcatgggccactaccatggccacgaaggcttcctcaccttcagcaaggccaagggcgtgttcagcaagccgcgcttcaacgccgcgcgaatgatctaccccccctacggcaagtcgatccagaagctcgtctacaagctgttcgtgcgctgaaccggggcgcgtgcggcgccccctcattcctacgctgcaggtga

SEQ ID NO: 11322 - DNA, 1017 bp, Pseudomonas aeruginosa
ccgactacacctgggacggtatccgccgtgccttccataccatggcggagatccagttcgccgccggcgcccgggaagtgcggccggtgcacagcgacgcgcgtagcgcgaagaacctgcaggaggcgcgcgggatcatcgacggcctgcgcctggagatctaccgcacgcgcctgggcagcgcccacgtcatgggcggctgcgccatgggcgaagacccggccgtggcggtggccgacagcctcggccgccatcaccacctgcggaacctgtcgatccacgacggctcgctgttccccaccagcatcggcgccaacccgcagctctcggtctacggtcttaccgcgcaactggccagcgcgctggccgaacgcctggccagggcctgaaccgccgccgggccggccgcgcgccgcggcagccggcccggcgccatcagacctatgggctaaaggccgatggcccgtgcgtcttggccgcacgggcatccctgcgctaccatccgattcccttacgaaaccctgccaggacgtagcgatgaaccgagtgctgtacccaggcaccttcgatcccatcaccaagggtcacggcgatctgatcgaacgtgcttcacggcttttcgaccatgtgatcatcgcggtcgccgccagccccaagaagaaccccctgttcagcctggaacagcgggttgcgctggcccaggaggtcaccaagcacctgccgaacgtcgaggtggtgggcttctccaccctgctggcgcacttcgtcaaggagcagaaggcgaatgtcttcctccgcggcctgcgcgcggtttccgacttcgagtacgagttccagctggccaacatgaaccgccagctcgcccccgacgtggaaagcatgttcctcaccccgtcggagaagtattccttcatttcctcgacgctggtccgggaaatcgccgctctcggcggggatatcagcaagttcgtgcatccggccgtggcagacgccctggcggaacgtttcaagcgctga

SEQ ID NO: 11323 - DNA, 252 bp, Pseudomonas aeruginosa
atgtccctgaaaatcactgacgattgcatcaattgcgacgtctgcgaacccgaatgcccgaacggcgcgatctcgcaaggcgaagaaatctatgtgatcgatcccaatctctgcaccgagtgcgtcggccactacgacgagccgcagtgccagcaggtctgtccggtggactgcattccccttgacgacgccaatgtcgagagcaaggaccagttgatggagaaataccggaagatcaccggcaaggcctga

SEQ ID NO: 11324 - DNA, 1245 bp, Pseudomonas aeruginosa
ccgcgccgccatgcgcctggaagcgatgcgcaaggacccggaaaccgcgcggatcttcctcgacaagggcggaatccccgacgaatggaacctgctccgccaaccgcagctggcacgtaccctggaacgcctcgggcgctacgggcggatcggtttctacgaaggcgagacagcggacaagctgctcaccggggtccgcgccggcggcggcatctggagcgcggccgacctgcgcgactaccgggtgatcgaacgccgcccgctggaggtgaagctggccaacggccgcgaactgatcagcgcaccgccgccctcggccggcggcgtcgccctggcgcagagcctgcagatgctggaacagctgccgtggcagaaggccgagccggtacagcgcgcccattacgtgctggaggtcctgcgccgtgcctaccgcgatcgaggcctgctcggcgacccggacttcgtcgccaacccgctgcccagtttgctggcgccggactacctgaagcgccttgccgccggcatcgacccgcgccgcgccacgcccagctcggcgctgccggaggcgccggcctggcgcgaaggcgaccacaccacccacttcgcggtgatcgatgcccagggcaacgcggtggccgccaccctctcggtgaacctgccgttcggcgccgccttcaccgttcccgataccggcgtggtgctgaacaacgagatggacgatttcgccgccgacacccagggcgccaacagctacggcctggccggcagccaggcgaacgcggtggcggccggcaagcgcccgctgtcgagcatgagcccgagcttcctggaaagcccgaccgacttcgccgccttcggcacccctggcggcagccgcatcccgagcatggtgctgatctccatgctgcagtacttcgacggccgcccggtcggccaatgggtcgccgcgccgcgctaccaccaccagtacaagccggacgtcgtcgagtacgaaccgcgcgccttcagcgatgccgaggccgccgaactgcgccggcgcggctatcagctcaaacgcctggagcgcagctacggcaaccagcaggtgctctactgggacaagcgcagcggccgcgtcgacgccgccagcgacccgcgcgggatcggctactcgtctctgtccctggaggcgcaagcgcagcctcggccgcactgaacaaacgagagacagcgctcaaaaaatgttcgacgatctcacccagatag

SEQ ID NO: 11325 - DNA, 501 bp, Pseudomonas aeruginosa
ccctggacatcgccatgggcggctcgaccaataccatcctgcacctgctggccgccgcccaggaggccgaggtgccgttcgacctgcgcgacatcgaccgcctgtcgcgcaaggtgccgcaactgtgcaaggtggcgccgaacatccagaagtaccacatggaagacgtgcatcgcgccggcggcatcttctccatcctcggcgaactggcccgcggtggcctgctgcacaccgacgtccccaccgtgcacagcccgagcatggccgacgccatcgcccagtgggacatcacccagacccgcgacgaagccgtgcacaccttcttcaaggccggtccggcgggcatcccgacccagaccgcgttcagccagaacacccgctggccgagcctggacgacgaccgcgccgagggctgcatccgcagcgtcgagcatgcctattccaaggaaggcgggctggccgtgctctacggcaacatcgctctcgacggctgcgtggtga

SEQ ID NO: 11326 - DNA, 1416 bp, Pseudomonas aeruginosa
aatcgcgctctttttccccggaccgccaccatgagttccctgcaaagcccgtcggacgccagcgcccgcaacgacctggtctatggcctggacgaccgtcccagcgctcccatcgccctgctcgccgccctccagcacctgctggcgatcatcgtgccgatcgttacccccggcctgctgatctgccaggcgctgggcgtatcgccgcgcgacaccaatctgatcgtgtcgatgtcgctggtgatctccggcatcgccaccttcgtccagtgcaagcgcttcggcccgttcggcgccggactgttgatcgtccagggcaccagcttcaacttcgtcggcccgctgatcgccggcggggcgctgatggtcaagcagggcacgccggtggaaagcgtgatggcggcgatcttcggcgtggtcatcgccggctccttcgtcgagatgggcatctcgcgcatactgccgttcgtcaagcggctgatcacgccgctggtgaccggcatcgtcgtgctgatgatcggcctgaccctgatcaaggtcggcctgatcagcatgggcggcggcttctcggcgatgtccaacggcaccttcgccaacggcgagaacctgctgctgtccggtgtggtgctgggcatcatcgtggtgctcaaccgcatcccggtggtatggatgcgcagttgcgccatcgtcatcgccctggccgtcggctacgcgctggccggctacctcggtcgcctggacttcaccggcatgcaccaggccgagctgttccaggtaccgaccccgctgcacttcggcctggacttctcctggccgctgttcatcccgatgctggtgatctacctggtcacctccctggaagccatcggcgacgtcaccgccaccagcaaggtgtctaagcaaccggtggaaggcccgctgtggatgcagcggatcaagggcggcgtgctggtcaacggcgccaactcgttcctcgccggtatcttcaataccttccccagctcagtgttcgcccagaacaacggggtgatccagctcaccggcgtggccagccgctacgtcggcctctggatcgccgccatgctggtcctgctcggcctgttcccgagcgtcgccggggtcatccaggcggtgccggaaccggtactgggcggcgcggcgatggtgatgttcggcgcggtggccgcttcgggcatcaacatcctcgccggcatccagctggaccgccgtgccctgctgatcatcgccgtatccctggccctcggcctgggcgtttcgcaggtgccggagttcctcgcgcacatgcccgcggcgctgcgcaacgtgctggagtccggggtcgccaccggcggcatctgcgccctgctgctgaactggttcctgccggaaagcccggtccagaaggccggacactga

SEQ ID NO: 11327 - DNA, 477 bp, Pseudomonas aeruginosa
gcgcggcgccacctccgggtggcgtcgcggttttcgccgaagggttttcgtacccggccaatggttgggtatgatcgacggcatggccatgcccgtcggccaccctcttccgtcccgcaacccggacccgcgcccatgccccagtcccgccgcccgttgcgcatcggcctgatcgccgacacccatggcctgctccggcccgaggcgctggaacggttgcgcggctgcgaccagttgatccatgccggcgacatcggcaagccggaaatcctcgccgagctggaacgcctggcgccgctctcggtggtgcgcggcaacaacgacacccaggactgggcggcggacatccccgagcgcgtgctgctgaagatcggccggctgacctctatgtgctgcacgacctcaagcgactcgacctcgacccggccgccgaaggcatcgacgtggtggtcgccggacattcgcacaagccgctga

SEQ ID NO: 11328 - DNA, 444 bp, Pseudomonas aeruginosa
cttgagtcacacgacgcatcccggcctcgacgccctctggctgaccgaggccgttcgcctgcgcgaggagcaggccggtccgctggaagacagcgaggcggttcgccaggcgctggcccagggcggttccctgccgcgccgtattctcacccgcgcccactggctgggccgccgcgagggcctgctcgacgcccagcggacctggcgccagggttcgcggctggcgctggccctgctgttggtgctggccctggccagcggcgccggactggcattcgccgcgctcggcgatggccagcgcccggtcaacgtgttgtgggcgctggccagcctactaggcctgcacctgctgaccctgctcggctggggccctcggcctgctcgccggcggcgaggccgcgggcgcgctcgaccgggtccgtgtcccaccacgaaaggctcagc

SEQ ID NO: 11329 - DNA, 507 bp, Pseudomonas aeruginosa
gcatgctcgacgctgcggatgcagccctcggcgcggtcgtcgtccaggctcggccagcgggtgttctggctgaacgcggtctgggtcgggatgcccgccggaccggccttgaagaaggtgtgcacggcttcgtcgcgggtctgggtgatgtcccactgggcgatggcgtcggccatgctcgggctgtgcacggtggggacgtcggtgtgcagcaggccaccgcgggccagttcgccgaggatggagaagatgccgccggcgcgatgcacgtcttccatgtggtacttctggatgttcggcgccaccttgcacagttgcggcaccttgcgcgacaggcggtcgatgtcgcgcaggtcgaacggcacctcggcctcctgggcggcggccagcaggtgcaggatggtattggtcgagccgcccatggcgatgtccagggtcatggcgttctcgaaggccttgaagttggcgatgttgcgcggcagcacgctgtcgtcgccttcgccgtaa

SEQ ID NO: 11330 - DNA, 456 bp, Pseudomonas aeruginosa
cgctggcagagttccacggccaggcgcccggcgcgcaggaacagttgctcgcggtcggcgtgggtggccagggtcgagccgttgcccggcagcgacaggccgagcgcctcggtcaggcagttcatcgagttggcggtgaacatgccggagcaggagccgcaggtcgggcaggcgctgcgctcgtactcggcgaccttctcgtcggagcaggagtcgtcggcggccaccaccatggcatcgaccaggtccaggccgtggctggccagcttggtcttgccggcttccatcggcccgccggagacgaacactaccgggatgttcaggcgcagcgcggccatcagcatgccgggggtgatcttgtcgcagttggagatgcagacgatggcgtcggcgcagtgggcgttgaccatgtattccacggagtcggcgatgatctcccggctcggcagcgaatag

SEQ ID NO: 11331 - DNA, 1896 bp, Pseudomonas aeruginosa
gcgctgtctctcgtttgttcagtgcggccgaggctgcgcttgcgcctccagggacagagacgagtagccgatcccgcgcgggtcgctggcggcgtcgacgcggccgctgcgcttgtcccagtagagcacctgctggttgccgtagctgcgctccaggcgtttgagctgatagccgcgccggcgcagttcggcggcctcggcatcgctgaaggcgcgcggttcgtactcgacgacgtccggcttgtactggtggtggtagcgcggcgcggcgacccattggccgaccgggcggccgtcgaagtactgcagcatggagatcagcaccatgctcgggatgcggctgccgccaggggtgccgaaggcggcgaagtcggtcgggctttccaggaagctcgggctcatgctcgacagcgggcgcttgccggccgccaccgcgttcgcctggctgccggccaggccgtagctgttggcgccctgggtgtcggcggcgaaatcgtccatctcgttgttcagcaccacgccggtatcgggaacggtgaaggcggcgccgaacggcaggttcaccgagagggtggcggccaccgcgttgccctgggcatcgatcaccgcgaagtgggtggtgtggtcgccttcgcgccaggccggcgcctccggcagcgccgagctgggcgtggcgcggcgcgggtcgatgccggcggcaaggcgcttcaggtagtccggcgccagcaaactgggcagcgggttggcgacgaagtccgggtcgccgagcaggcctcgatcgcggtaggcacggcgcaggacctccagcacgtaatgggcgcgctgtaccggctcggccttctgccacggcagctgttccagcatctgcaggctctgcgccagggcgacgccgccggccgagggcggcggtgcgctgatcagttcgcggccgttggccagcttcacctccagcgggcggcgttcgatcacccggtagtcgcgcaggtcggccgcgctccagatgccgccgccggcgcggaccccggtgagcagcttgtccgctgtctcgccttcgtagaaaccgatccgcccgtagcgcccgaggcgttccagggtacgtgccagctgcggttggcggagcaggttccattcgtcggggattccgcccttgtcgaggaagatccgcgcggtttccgggtccttgcgcatcgcttccaggcgcatggcggcgcggtcacggtagatccggtcgacggatacgccatccaccgccaggcggatcgccggcaccagattgtcggccaggggcttgcgtccgtagcggctgctcaattcgaccagcgccgccggcaggccggggatcgccgccgccagcgggccgtcgacggacagcctggggtcgaccttgccattgcgccggtacatgtcggcgtaggcggccttcggcgcgcgctcgcgggcgtcgaggaagcgataggtcggctgcgcaccggcctggcgcagaaggaagaatccaccgccgccgagtcccgagccgtaaggctcggctaccgccagggcagcggcgatggccgccgcagcgtcgaaggcgttgccgccattggccagggtttccaggccggcgacggtcgcggccggatgtggcgtggcgacggcggcctgctgcggtgcgtgggcgttgccgcgaaagctgtcggcatgcgccgcgaggctgagcagggacaggccgcaggcggcgaccagggtacggacgggcaggttcaggaaggacatggcggctcactgttcagcggcgttcgcgggacggggccgcgaacgcctcagactggattgccaaggatagccaaaagcgcgtcggacggggcgcgaaccgtccctgaaggacaggcgccggcggggatcaggccttgccggtga

SEQ ID NO: 11332 - DNA, 966 bp, Pseudomonas aeruginosa
gtgggtctcgtgcagcacgcgctgctgctgcgccttgtcgtagccgaagtagtacagggccagcggtcgcgggcgctggttgacgtaggccagggcgtcttccaggcgctcgtaggggatcaccggcagcagcgggccgaagatttcctcctgcatcactttcatgtcgtcgctgacgttcagcagcagcgtctgcggcaggcgccgttgctggccttcggcgaacagcgggacgagggtcgcgcccttctcgcgggcgtcgtcgagatagccccggaggcggccgagctggcgctcgttgatgatcgcggtgtagtcggggttgtccgaaagacgcgggaagaagccctggaccacctccttgtactggctgacgaattcctcgacgcgccggctcggtaccagcacgtagtcgggcgcgacgcaggtctgcccggcgttgaggctcttgccgaaggcgatccgctcggcggcgtccttcatcggcacgctgtcggagacgatcgccggcgacttgccgcccagctccagggtgaccggggtcaggttctcggcggcggcgcgcatcacgtgcttgccgacgctggtggcgccggtgaacagcaggtggtcgaacggcagcttggaaaaggccacgccgacgtccacctcgccgagcaccacggcgacctggtcctcggggaagatccgcgccagcaggtccttgagcaggcgcccggtggccggggtcgactcgctcatcttgatcatcacccggttgccggcggcgaaggccccggtcagcgggccgatggagaagaacagcggatagttccaaggcacgatcaccccgaccacgcccagcggctggtacaccacctgggccgaggccgggctggaattgcaggccgaccgcgcggcgcgcgggcttcatccatttcttcacgcgcttggcggcgtattggatgccgtgcaggctgggcatga

SEQ ID NO: 11333 - DNA, 408 bp, Pseudomonas aeruginosa
aaacgctccagctcggcgggcagggcgatatcgccctgccagtcggcggcgggttgcgccgcgcaaggctcgccaagcgccagcaggcgttggcgaatgctcgcggaagccgggctcatcctcaggctccccgctgccagagcgcgtaatgtacgttgccggctttcttttcccggtgcagccgccagtttccgggcaggccgagggacgaggggacgctctcgctctcggtatagatccaggcgtcggggttcagccagccgcgggtttcgagcaggcggcaggcgtcctgcagcaggttctgatggaacggcgggtcgaggaacaccaggtcgaaggcgctcggagcctggtttcccaggtagcgcacggcatcgccgaggaccagttgggcggtgccgcacttga

SEQ ID NO: 11334 - DNA, 780 bp, Pseudomonas aeruginosa
tcttcgccctggccaagcagttcggcctgccgatccgctatatcggtgtcggcgaggggatcgacgatctccgtaccttcgaggccgacgccttcgtccaggcactcttcgcagagcgggagaacgcatgatccgcttcgagcaggtcggcaaacgctatcccaacggccacgtaggcctgcacgaggtgtccttccgcgtgcaccgtggcgagatcctcttcgtcaccggccactccggcgccggcaagagcaccctgctgcgcctcatcctggcgatggagcgaccgaccagcggcaagctgttgctcggcggccaggacctggggcgcatcactaccgcgcagatccctttcctgcgccggcagatcggcgtggtgttccagaaccaccaactgctcaccgatcgtacggtggcggacaacatcgccctgccgctgcagatcctcggcatgcccaagccggagatcgccaagcgcgtggcctcggccctggagcgggtgaacctgaaggaaaagggcgaggcgttgccttccgacctttccaccggccagcagcagcgggtcggcattgcccgcgccatcgtccaccagccggccctgctgctggcggacgaacccaccggcaacctcgacccgcgactcgcctcggaaatcatgggtgtgttcgaggatatcaatcgcctgggcaccaccgtactgatcgccagccacgacctggccctgatcgcccgtatgcgccatcgcatgctgaccctgcagcgtggccggatcatcgctga

SEQ ID NO: 11335 - DNA, 1014 bp, Pseudomonas aeruginosa
ggcctgatgagcgccaacgatcttccccgtggccccgaagagggcgcaccggaacgcaagacccgcgagaaaccgagccaggagcagaccgactggagcggctcgttcagcgcctacctggaaagccatcgcgccagcctggtggacagcctgcgccggttgttcggccacccgttcggcagcttcttcacctgcctggtgatgggtatcaccctgagcctgccgatgggcctctcgctgctgctgaacaatgtcgaacggctcggcggctcctggcagcgggcggcgcagatatccctgttcctcgacctgaagaccagcgaaaatcagggccaggacctgcgcgagcagatcgagcgcctgccggacgtgatcgaggcccaattgatcagccgcgagcaggcgctcagcgaattgcaggaacagtccggcctgggcgaagcgctcaaggagctgccggagaacccgctgccgccggtgatctcggtcacgcccaagcagatcgaccgggctggcctggaggcactgcgccagcagctcgcggagctgcctcatgtgcagcaggcgcagctcgacctggtatgggtcgagcgcctgagcgcgatcctcaagctcggcgaacgcttcgtcttcggcctgaccatcctgctggtgctgaccctcttgctggtggtgggcaacaccatccgcctgcacatcgaaaatcgccgtaacgaaatcgaggtgatcaagctggtcggcgggacggacggttacgtgcgccggccattcctgtacatgggcgcgttgtacggcctgggcgcgggcatcctgtcctgggcgctgctggcctattcgctgaactggctgaacggttcggtggtcaacctttcagggctgtacggcagcgacttcggcctgcagggcgtgccgctggacgacggcctgtcgctgaccgtgggcgcggtgctgcttggctgggtcggcgcctggctggccgtggcccgccacctgcgcgagctggcgccgcgctga

SEQ ID NO: 11336 - DNA, 690 bp, Pseudomonas aeruginosa
aagggcggattctcgcctgatcgccgcgcctcgcgaaaaccgcaccccgcaagggtgcggtttttttctgcccggaggaatcccatgccgcgcaatacccgctggctgttctacttgtcgctggcggtcctgaccttcgtcgtcggcgcctggctggtccgtacgccggaaccggcgcgaccgttgccgtggctggccgactggcaggagcaggtgctggcgccgttggcggacaacgccttgaccctgcgccagctgcacgacgcggtggatggcgagttgtgggtggacccgcgcctggatggcgtgcgcctggccttccgtggccgcctgctgggcgacggcggcccctggcaggtggaaggcgagctgggcctgagcgccgaggagcaactgagcctgcagcgggcatctgcgttgcagcctggcagcgcgccgcagccattgagcgccggattggaaggacagttgggcgacaagccgatcgtggcgctgagcatgattcccgaaggcagggtcggtgccgagcggctgctggccagtctcggccagccgcgcctgcgcctgcaactggcccagggcgaggcctgggtctatccgcaactgggcctgaccgcgcacctgccggacgacgacttgcgactgatgctcgcggtgccgcgccaggccctggaaaaaccgccgcgttga

SEQ ID NO: 11337 - DNA, 1053 bp, Pseudomonas aeruginosa
ggtgacggcgctcgcataacaataagaggatcggtgatggcttccgcgcaacctgcctccgcgtttccctgcctgtcgttgcaactggcctgcctgttgctgggcgcctggctggccttcgatgcccacggcggcggccaggccgtggcgccgccggcccgtgtcgaagcgcgtgtgccgacggccgctaccgatgactggggacgccagccggacagcctgatgagcgccgtgccgccgcgcacgctggaggcgagcgtcggcgcccgcggctcgggatcggcgagttcgcgactgtggatcgccgataccgacttccgcctgcacgacgacatcggtttcttcatccagcgcatgctgatccgcatggagccgactcgtcccggcgcgcccttgtcgctcgacgatccgacggcgatggtggcgcggatccaggccggcgagatattcgtcagcgacgccaccctggcgaccctgctcaaccaggacctcgctgcgtcccgcgcggccgtgcgcaacctcagtatgaacacccgcaaggacggccaggaagtgcgtggcgagttgttgcgcaaggggcgctggcggccgctgcggatgctcaccgagatcgagctgagcggtccgctggaggtgaccctggtaccccggcggattttcgtcgacggggtcgaggtcacttcgtcgctggcggcggcctcgatcgagatgtccgaggtgctgaagctgaagacccggcacatggaattggtcggcaaccgcatccgcgtcgacctcgacggattgttcccgccgccgcgcctggacttccgcgtcagtcgcctggccctggccgacggcggcatgcaactcgccctcggcgactccctggccgacctgcaatggccggcattacgggcgccggacagctacatgttcatcgagggcggcgatatcaagatggcgcgcaccgtgctggtcaaggcctatgccctgttcaccagcctcagcccggggcagccgctgctgttcaatcctcctacgactaccggcggcaactgcagaacggcgtga

SEQ ID NO: 11338 - DNA, 894 bp, Pseudomonas aeruginosa
aggcgccggcgccgctggaggcacggctgtgagccggcgtccgtggggcgtactgcttggctgttgcctgttggcggccagcgcggctcaggccgaaagcgccatcgaccggcagcagcgcgaactggccctgctgcgcgagggctggtaccggcaggtcccgccggcgccggtgccgctgcccatgcgtacggccgggccggcggattccggccaggatggcgtcggcatactgctgcgcaacgtggacatgtacctgcgcggcaacatcggtttccacgtgcccgaggtgaagggctggatggtgccgaaccgggccggccagccggtggaattcgaccgtccgcaggacatgcatttccaggtgatggagggcgaggtgctgctcagcccgcggcaactggccaacctgttcaacgagcacatcctcgcctacgacgggaccatgttgaaggacttccgcatgagcagtgcggcgggacgcctggaggtggaggggcgggtgcgtccgctcggcgtagggccctggctgccgctgcggctgggcggcggcgtggaggtggacgcggccagcggcgcgctggtctatcggcccgaccagttgagggtgatcggtctgccgctgtacggggcgatgagcctggtcggcctgccgatgtcggcgctggtcagcctcgatcggccgggggcgagcctggtgggcagcgccatgcgcctggactaccgcaaggtcttcccgctgctgggcatcgacggccacgtacaggaggcctggctcgaccaccaggggctgcacctgcgtttctcccaggcgcccggccagccgtcgccggtgttcagcccgccggccgcggagggccccatccttcctctggctacactcgggcgacctga

SEQ ID NO: 11339 - DNA, 468 bp, Pseudomonas aeruginosa
ccccatggcacgaccgctggcgatgatcgccgcccttggcgagaaccgcgcgatcggcatcgacaaccgcctgccctggcgcctgccggccgacctcaagcatttcaaggcgatgaccctcggcaagccggtgatcatggggcgcaagacctgggactcgctgggtcggccgctgccgggccggctaaacctggtggtcagccgccaggccggcctggcactggagggtgcggaagtgttcgccagcctggacgccgcgctggcgcgcgccgaggcgtgggcgcaggcggaggacgccgacgaactgatgctgatcggcggcgcccagctctatgccgaggccttgccgcgcgccgcgcgtctctacctgacccgggttggcctggcgccggagggcgacgcctttttccccgagatcgatggtgcggcctggcgcctggcgtcgagcatcgaacacgccgcggctga

SEQ ID NO: 11340 - DNA, 819 bp, Pseudomonas aeruginosa
ggtcgtgcagcacatagaggtcagccggccgatcttcagcagcacgcgctcggggatgtccgccgcccagtcctgggtgtcgttgttgccgcgcaccaccgagagcggcgccaggcgttccagctcggcgaggatttccggcttgccgatgtcgccggcatggatcaactggtcgcagccgcgcaaccgttccagcgcctcgggccggagcaggccatgggtgtcggcgatcaggccgatgcgcaacgggcggcgggactggggcatgggcgcgggtccgggttgcgggacggaagagggtggccgacgggcatggccatgccgtcgatcatacccaaccattggccgggtacgaaaacccttcggcgaaaaccgcgacgccacccggaggtggcgccgcgcctatcagtgtccggccttctggaccgggctttccggcaggaaccagttcagcagcagggcgcagatgccgccggtggcgaccccggactccagcacgttgcgcagcgccgcgggcatgtgcgcgaggaactccggcacctgcgaaacgcccaggccgagggccagggatacggcgatgatcagcagggcacggcggtccagctggatgccggcgaggatgttgatgcccgaagcggccaccgcgccgaacatcaccatcgccgcgccgcccagtaccggttccggcaccgcctggatgaccccggcgacgctcgggaacaggccgagcaggaccagcatggcggcgatccagaggccgacgtagcggctggccacgccggtgagctggatcaccccgttgttctgggcgaacactga

SEQ ID NO: 11341 - DNA, 1098 bp, Pseudomonas aeruginosa
gctggggaaggtattgaagataccggcgaggaacgagttggcgccgttgaccagcacgccgcccttgatccgctgcatccacagcgggccttccaccggttgcttagacaccttgctggtggcggtgacgtcgccgatggcttccagggaggtgaccaggtagatcaccagcatcgggatgaacagcggccaggagaagtccaggccgaagtgcagcggggtcggtacctggaacagctcggcctggtgcatgccggtgaagtccaggcgaccgaggtagccggccagcgcgtagccgacggccagggcgatgacgatggcgcaactgcgcatccataccaccgggatgcggttgagcaccacgatgatgcccagcaccacaccggacagcagcaggttctcgccgttggcgaaggtgccgttggacatcgccgagaagccgccgcccatgctgatcaggccgaccttgatcagggtcaggccgatcatcagcacgacgatgccggtcaccagcggcgtgatcagccgcttgacgaacggcagtatgcgcgagatgcccatctcgacgaaggagccggcgatgaccacgccgaagatcgccgccatcacgctttccaccggcgtgccctgcttgaccatcagcgccccgccggcgatcagcgggccgacgaagttgaagctggtgccctggacgatcaacagtccggcgccgaacgggccgaagcgcttgcactggacgaaggtggcgatgccggagatcaccagcgacatcgacacgatcagattggtgtcgcgcggcgatacgcccagcgcctggcagatcagcaggccgggggtaacgatcggcacgatgatcgccagcaggtgctggagggcggcgagcagggcgatgggagcgctgggacggtcgtccaggccatagaccaggtcgttgcgggcgctggcgtccgacgggctttgcagggaactcatggtggcggtccggggaaaaagagcgcgattttactgggcgaacacggtctcgcccaggcctggctgcgccgcatgtcggcggataacgccggtggcgtatgcgccctgcggttggagcgtgggtga

SEQ ID NO: 11342 - DNA, 945 bp, Pseudomonas aeruginosa
aagcccgccccatggcggggttctccgggtaaactgcgcgcaccgtcaactttcgcctccgtcctcatggtccaagaactcaccgccgagcagatccgccaggccctgcaaggcatcagcgtgccgccgcaaccccagatcatggtcgacctgcagatggagcaggtcatgcccaatccggacctgaagaacattgccaggctgatcagccaggacccgggcctttccggggctctcctgaaactggtgaactcgccgttcttcggcctggccaatcgcatcacttcgatccagcgcgcggtgaacctgctgggcagtcgttcggtgatcaacctgatcaacgcccagtcgatcaagggtgagatgagcgacgacaccatcgtcaccctcaaccgtttctgggacaccgcccaggacgtggccatgagctgcctgagcctggccaagcggatcggctacgaatcggtggacgaagcctacgctctcggcctgttccacaattgcggcatcccgctgatgctcaagcgcttcccgcactacatggcggtgctggaagaggcctacgccgccgccagcgacgaacgccgggtggtggacaccgagaaccgcgtgctgaacaccaaccatgcggtggtcggctactacaccgcgcgctcctggcgcctgccggagcacgtctgcgaggcgatcgccaaccaccacaacgcgttgtcgatcttcggcgacgaatcggcacgcgatacccaactgaagaacctgctggcgatcctgaagatggccgagcacatctgcggttcgcaccgggtcctcggcaaccagccggaagaccatgaatggaacagcatcggtgcgctggtgctggactacgtcgggctcaccgactacgacttcgagaacctcaagggctcgatcctcgagctgggcgtcggccagggcagctactga

SEQ ID NO: 11343 - DNA, 930 bp, Pseudomonas aeruginosa
ctggccgcgccgcggcgcttcctgctaaggtgccgcggtcaaccggattgctgccgccatgcccgaactacccgaagtcgaaaccacccgccggggcatcgccccctacctcgaaggccagcgcgtcgagcgcgtgatcgtgcgcgagcggcgcctgcgctggccgattcccgaagacctggacgtgcgcctgtccggacaacgcatcgtcagcgtcgagcgccgcgccaagtacctgctgctgggcgccgagtccggtacgctgatcagccacctgggcatgtccggcagcctgaggctggtggagagcggtaccccggccagtcgccacgagcacgtcgacatcgagctggcctcgggcatggccctgcgctacaccgatccgcggcgcttcggcgccatgctctggagcctggcgccactggaacacgagctgctgcgcaacctcggcccggaaccgctgaccgacgctttcgccggccagcgtctgttcgagctgtcgcgcgggcggagcatggcggtcaagccgttcatcatggacaacgcggtggtggtcggggtcggcaacatctacgccagcgaagcgctgttcgccgccggcatcgatccgcgcaagcccgccggaagcatctccaaggcgcgctacctgcgcctggcggaggagatcaagcggatcctggcgatcgccatcgagcgcggcggcaccaccctgcgcgatttcgtcggcggcgacggccagcccggttacttccagcaggaattgttcgtctatggccgtggcggggagttctgcaaggtctgcggcagcaccctgcgcgagatccgcctaggccagcgcgccagcgtgtactgcccgcgctgccaacgctgaagcgccgcgcatactctaccgccacaagaagggccgccacggtgagcggcctgccataa

SEQ ID NO: 11344 - DNA, 591 bp, Pseudomonas aeruginosa
gaaaggtgcacgatgtccggcaattacctgcctcgcaacaccctggtcgagtcgctcggccatgccatgctgaaactctccggctggaagatcgagggccagttgcccgcgctcgacaagttcgtggtgatcggcgcccaccacacctcgaactgggacttcgtggccttccttgccgccaagttcgtcctgcgcctgaacgcccgctggttcggcaagcacaccctgttcaacggcccgctgggcggcctgatgcggcgctggggtggcatcccgatccagcgccacctgaagctgaataccgtggaccaggcgatccaggccttccgcgagcaccgcgagttcatgctgatcatcgctccggaaggcacgcgcaagaaggtcgaccgctggcgcatgggcttctaccacatcgcccgtggcgccggcgtaccggtggtgccggcggcgctggactacgaaaaccggcggatcgtcatcggcgaacccttctggccgaccggcaacgaggacgccgacctgtgcagcctgatcggcttataccggccgttcatcccgaaaaagccgcactacgcattcctcggcgattga

SEQ ID NO: 11345 - DNA, 1065 bp, Pseudomonas aeruginosa
cagtgtcctgctgaccagcaaggtcacaaggtcgaccaggggtggccgaccgactcaaccaagataaggatttcgcgtatgttcagtcagtgggtgttcctgtccgtccttgctcttgccgtaccctcgttcgcctgggcggaggatgcggtgtccgacctcgccaaggagcagtccaaggccgagcagggcgacaagcgcggcgatgaactgttcgccgaattcacccgcctccgccaggccgccgagacgggggagccgcaggctctgttcgatttcggcgcctacttctaccagcaacagaactacgccagcgcgcgcgaatggtggggcaaggcggccgctgcggggatggtccgcgcgcagatccaactggccatgctctatcgcgatggtgacggcgggccacaggacaagaccgaggcggcacgctggttccggaaggccgcggagcagggggatgccgccgcccagaatgaaatgggcgttctctactggagaggcgaaggggtcgaccaggaccgggtgaaggccgggacctggttcgaacgcgcggcggccagcggtagcgaagacgccgaaaccaatctgggatggttctacctggacgactcgcaaggcgtctattccgccacttcagacgaggaagccgccctgctggaccgttatgccggcagccgggaaaaggccttccagtggttctgcaaggctgcgacccagggagatgcccgtgcccagttcaaggtgggcgaggcctactggaacggttcaggtgccgggatgaacaagctgcaagcacggctctggctggaaaaggccgcacagcagcaggatgcggatgccattgcctggctggagagcgccgcgaacgcagcctggtacacccgcctggaaaactggattcatgctgcgctggatggagagctgtccggtgtcgccgactgctccggtgccgccgatcgccggcactccggccgaggcatggagggcgccccgtctgacccggaggcggtggaagccagtgcggaggatgcgcagcaggcggttgaagcggcgagccagtga

SEQ ID NO: 11346 - DNA, 837 bp, Pseudomonas aeruginosa
ccaaaagcgcgtcggacggggcgcgaaccgtccctgaaggacaggcgccggcggggatcaggccttgccggtgatcttccggtatttctccatcaactggtccttgctctcgacattggcgtcgtcaaggggaatgcagtccaccggacagacctgctggcactgcggctcgtcgtagtggccgacgcactcggtgcagagattgggatcgatcacatagatttcttcgccttgcgagatcgcgccgttcgggcattcgggttcgcagacgtcgcaattgatgcaatcgtcagtgattttcagggacatctaacaactccaaccgcgacggacagccacggcatcggtaacgggaatagcggaattgtgccgcatcggcgcccgcagtgcacgcgggacgccgacgggaggccggcggagagacgcggatcagcgcttgaaacgttccgccagggcgtctgccacggccggatgcacgaacttgctgatatccccgccgagagcggcgatttcccggaccagcgtcgaggaaatgaaggaatacttctccgacggggtgaggaacatgctttccacgtcgggggcgagctggcggttcatgttggccagctggaactcgtactcgaagtcggaaaccgcgcgcaggccgcggaggaagacattcgccttctgctccttgacgaagtgcgccagcagggtggagaagcccaccacctcgacgttcggcaggtgcttggtgacctcctgggccagcgcaacccgctgttccaggctgaacagggggttcttcttggggctggcggcgaccgcgatgatcacatggtcgaaaagccgtga

SEQ ID NO: 11347 - DNA, 732 bp, Pseudomonas aeruginosa
cccgggcggccggctttgtgtaccttctacgctgtcacggcggggcgcgccccgcactgttacccgaacgagcccgtcgtccccatggcaccacgcatcaagacccgcgatcgcatcgcccaggccagcctggaactgttcaacgcccagggcgagcgcagcgtcaccaccaaccatatcgccacccacctgggtatatcgcctgggaacctctactaccactacccgaacaagcaggcgatcatcgccgagctgttcgccgagtacgaaagccacgtcgagagcttcctgcgcctgcccgaagggcggggtctgacggtggacgacaagaccttctacctggaagcgctactggccgcgatgtggcgctaccgcttcctccatcgcgacctcgagcacctgctggaaagcgacccggagctggcggcgcgctaccgcgccttcgcccagcgttgcctggtcaacgccaaggcgatctaccggggcttcaccgaggccggcatcctgcggatgaacgagacccagctggaggccctgaccctcaacgcctggatcatcctcacctcctgggtgcgcttcctctgcaccaccctcgatctcgacggcgacctcagcgaggcgcaactgcgtcgcggcatctaccaggtgctggcgctggagagcgggcacatcgaggcgcaggcccaggatgcggtggacgggatttccgagcggctctacgtgccgctctga

SEQ ID NO: 11348 - DNA, 1563 bp, Pseudomonas aeruginosa
gtttgctcatcaatgctccggaacgccgctgggttgctgggccggcttggcggtgggtggcggcaggggtttctgcggcacgctcgggccggcgctgacgatgacgaaggcgtcggcgtccaggtgcttggccatggcgctcctgacctgttcgacgctgagtccctcgacctgcttgaggaagctttccaggtagtccagcggcaggccgtagaaaccgatggcgccgagctggccgacgatgtcggcgttgctcgcggtggacagcgggaagctgccggccagttcgcgcttggcgtcgtccagttccttctgggtcgggccgttggccaggtagtcgcggacgatgtcctggaccagcttcagcgccccctcgctgagttcggcgcgggtctggaagttgatcatgaacggaccgcgtgcctgcatggcggtgaagccggaatagatgccgtaggtcaggccgcgcttttctcgcacctggtccatcaggcgggtgccgaagccgccgccgccgaggatctggttgcccaggtagagcgccgcgtagtcgggatcctggcggtcgatgccaagctgggcgagcatcaggtgggtctgctcggaggggaagtcgatgtgcgtcaggccgggcttgggcgtttccggctggacggtcttggccagcgccgggccctggggcagcgccttggagacttccgcggcgatcgcttcggcctcctgccgcgagaggtcgccgaccagcgcgatgaccacgttgccggcggcgtaggccttcttgtggaacgcctgcaactgttcgcggctgatcggtggaacggacttttcgtcgccgtcgctggagtgcgcgtagggatgctcgccatagaggcgcttgaacagctccaggccggccagcttgccggggttctgcttctggtactcgaaaccggccaggacctggttcttgatgcgtgccagagcgtcctcggggaaggtcggctggccgatcacctgttcgaacagcttcagcgcctgggtccgcttgtcggcatcggacaggctgcgcaggccggccaccgccatgtcgcggtaggagccgttgctgaacgaggcgccgaggtcctcgaagccggcggcgatggcagtggtgtccttgcccggcacgccttcgttgagcatggcgttggtcagcatcgacaggccgggggtgccggcgtcctggctgctgccggcggcgaaggtcaggcgcaggtcgaacatcggcagttcatgggcttcgacgaacagcaccttggcaccttcggcggtcttccattcctggatgtccagcttgcgatggaccggcgcctgcttggcgatgtccttcagcgactgcaactggttttcctcgaccgccgcggcatgggccgccgccggggtctgggggggacgcgcgacgaaataggccagcgcggccagcaacgcgatgacgatcaggccgagcaggccataacgcagccctgtgcgctcactcatgacgggcctccttttcctcggccttcacaggcagcacttgcgccagggtcaggcgcgacggggtga

SEQ ID NO: 11349 - DNA, 843 bp, Pseudomonas aeruginosa
cgagccagcgtcggccgaggagcattcgccccggcccgaggcgcccgtcgcgcaacccgagcctatcctggctgccgagcccgagcccgagcccgagcccgagcccgagcccgagcccgagcccgttgcgccgctggccgccgctccggcagtcagcgagccggcgaccaggccgggcttcttcgcccgcctccggcagggactgtccaagaccagcgccagcatcggcgaaggcatggccagcctgttcctcggccgcaaggaaatcgacgacgacctgctcgacgacatcgagacgcgcctgctgaccgccgacgtcggcgtcgaggccaccaccctgatcgtgcagaacctgaccaagcgcgtggcgcgcaaggagctggccgacagcggcgcgctgtacaaggcgctgcaggaagagctggccagcctgctgcgcccggtggagcagccgttgcaggtcgacgtcgcgcgcgagccctatgtgatcctggtggttggggtgaacggcgtgggcaagaccaccaccatcggcaagctggcgaagaagctgcaactcgagggcaagaaggtcatgctggccgccggcgacaccttccgcgccgccgccgtggagcagttgcaggtctggggcgagcgcaaccgcatcccggtgatcgcccagcacaccggcgccgactccgcctcggtgatcttcgacgcggtgcaggccgccaaggcccgcggcatcgacgtgctgatcgccgataccgccggacgcctgcataccaaggacaacctgatggaggagctgaagaaggtgcgccgggtgatcggcaagctggacgagacggcgccccatga

SEQ ID NO: 11350 - DNA, 927 bp, Pseudomonas aeruginosa
ggtcctgctggtgctcgacgccggcaccgggcagaacgccatcaatcaggccaagcagttcaacctcgcggtggagctgaccggcctggccctgaccaaactggacggcaccgccaagggcggggtgatcttcgccctggccaagcagttcggcctgccgatccgctatatcggtgtcggcgaggggatcgacgatctccgtaccttcgaggccgacgccttcgtccaggcactcttcgcagagcgggagaacgcatgatccgcttcgagcaggtcggcaaacgctatcccaacggccacgtaggcctgcacgaggtgtccttccgcgtgcaccgtggcgagatcctcttcgtcaccggccactccggcgccggcaagagcaccctgctgcgcctcatcctggcgatggagcgaccgaccagcggcaagctgttgctcggcggccaggacctggggcgcatcactaccgcgcagatccctttcctgcgccggcagatcggcgtggtgttccagaaccaccaactgctcaccgatcgtacggtggcggacaacatcgccctgccgctgcagatcctcggcatgcccaagccggagatcgccaagcgcgtggcctcggccctggagcgggtgaacctgaaggaaaagggcgaggcgttgccttccgacctttccaccggccagcagcagcgggtcggcattgcccgcgccatcgtccaccagccggccctgctgctggcggacgaacccaccggcaacctcgacccgcgactcgcctcggaaatcatgggtgtgttcgaggatatcaatcgcctgggcaccaccgtactgatcgccagccacgacctggccctgatcgcccgtatgcgccatcgcatgctgaccctgcagcgtggccggatcatcgctgaccgtgaggatgaggcctga

SEQ ID NO: 11351 - DNA, 858 bp, Pseudomonas aeruginosa
actggccgaacgcctcttctatcagcaagacctggaagcggcgcggcagatggtgttggcgcacctgcgcttcgttgttcatatcgccaagagttattcggggtacggcctggcccaggccgacctgatccaggaaggcaacgtcggcctgatgaaggccgtgaagcgtttcaacccggaaatgggcgttcgcctggtgtccttcgccgtgcactggatcaaggcggagatccacgagttcatcctgcgcaactggcggatcgtcaaggtcgccaccaccaaggcgcagcgcaagctgttcttcaacctgcgcagccagaagaagcgcctggcctggttgaacaacgaggaagtccatcgcgtcgccgagagcctgggggtcgagccccgcgaagtgcgcgagatggaaagccgcctgaccggccaggacatggcgttcgacccggccgccgacgcggacgacgagagcgcctaccagtcgccggcgcattacctcgaagaccaccgctacgacccggcgcgccagttggaagacgccgactggagcgacagctccagcgccaacctgcacgaggcgctggaaggcctcgacgagcgcagccgcgacattctccagcagcgctggctgtccgaggagaaggccacgctgcacgacctggcggaaaagtacaacgtttccgccgagcgtatccggcagctggaaaagaacgccatgagcaagctgaaagggcggattctcgcctgatcgccgcgcctcgcgaaaaccgcaccccgcaagggtgcggtttttttctgcccggaggaatcccatgccgcgcaatacccgctggctgttctacttgtcgctggcggtcctga

SEQ ID NO: 11352 - DNA, 1194 bp, Pseudomonas aeruginosa
tgctcgcggtgccgcgccaggccctggaaaaaccgccgcgttgagctttcagcgctccaggcgcagcaggtagtcgtcgccgcccaactgccacatctgctggcgaatccaggccgcgcgctggcgtacgtaggggcccggcctggccgcgctccatttcagcgggctgggcagcaccgcggcgagctggctggcctgggtgcggctcaggcgctcggcgtcgaggccgaagtgatagcgtgccgcagcctgcgcgccgaagacgcccgggccccattcggcgctgttcaggtagacctcgagaatccgttgcttggtccagagcgtctcgatcagcagggtgaaccaggcctccaggcccttgcgcagccaactgcgcccggaccagaggaagacgttcttcgccacctgctggctgagcgtactggcgccgcggatactgccgccgcgctcgttgtgcgcgagggcctgctggatggccggcaggtcgaagccgtggtgctcggcgaagtgctggtcctcgccggcgatcaccgcgaccttcaggctgtccggcaactgctcccaggagcgccagtcgcgctgcaggtcgatgggctggccgtcgacccaggagccgaccttgcgttcgaccatgaccatggtccccggtggcggcacccagcgcaggaccgcgaccagcacgacgctggcggccatgaaccagagcaggtacttgaacaggcggcggaacagggatcgcaacatgcgcggcttggcttggaagaagggggcggccattatagcgggctggatgctatcaccggagtcttgtccatgcttcgtcccttcctgttgttggcggcatttttcggtttcaccggcgtggccctcggggcgttcgccgcccacggcctgaagaagcagctcagcgccgagtacctggcggtattccagaccggcgtgcactaccagttgatccacgccctggcgctgttcggcgtggcgctgctcgccacccgcctggacggccgcctggtgagcgcggcgggtggcctgttcacgctgggcatcctgctgttctccggcagcctctacctgctgaccctcagtggcatcggcaagctcggcatcgtcaccccgttcggcggcgtctccttcctcgccggctggctgtgcctggggctggccgcctggcgcctgggcaacgcctga

SEQ ID NO: 11353 - DNA, 237 bp, Pseudomonas aeruginosa
aatgccgctccctttcactttcgtgaccgtccagccatgcagattcaactgaacggcgagcccttcgagctgcccgacgcgcagagcgtcgcggacctgctggcccgcctggagcttggcggccgccgcgtggccgtcgagctgaacctggatatcgtgccgcgcagccagcacgccagcaccgcgctcaaggatggcgaccgcgtggagatcgtccacgccatcggcggcggctag

SEQ ID NO: 11354 - DNA, 630 bp, Pseudomonas aeruginosa
  unsure (565),(567),(570),(571),(572),(573),(574): Identity of nucleotide at the above locations are unknown.
cgcggtcgaggccgtgcgcacctgccgtctggcccgcgagctgctggacgggcacaacctggtcaagctggaagtcctcgccgaccagaagaccctgttccccaacgtcgtcgagaccctcaaggccgccgagcaactggtgaaggacggcttcgacgtgatggtgtacaccagcgacgacccgatcatcgcccgccaactggccgagatcggctgcatcgcggtgatgccgctggccggcctgatcggctccggcctgggcatctgcaacccctacaacctgcgcatcatcctcgaggaagccaaggtcccggtgctggtcgacgccggcgttggcaccgcttccgatgcagcgatcgccatggagctgggttgcgaggcggtgctgatgaacaccgccatcgcccatgccaaggacccggtgatgatggccgaggccatgaagcacgcgatcgtcgccggtcgtctcgcctacctggccggacgcatgccgcgcaagctgtatgccagcgcctcgtcgccgctggacggcctgatcgactgataccgactacctggggcgggntnttnnnnncatttcttaatttgtctattcgaatatcacccatgtttgtccctgtatttttctaa

SEQ ID NO: 11355 - DNA, 519 bp, Pseudomonas aeruginosa
atcgtgcccggccaacggcgtctgatcagcgccaaacatagcaaaaagcgccccggcggctcatgctggcttgccagccggctggcggcggggtgtggggttttgactggcgccgtggcgaaagcgttcggcgccggtagcgagaggaacactgagatgaaggtagtacgccgataccccctggcgctgttgctggggatggcgggcgcgctggccgacgagttgcccgatggctccttgctgcaacgctatggcgtgcaggccgaccagttgccgaccctggcggcggatccgccgtcgcgcaaggaggagaaggaaacgccgtcgcgcttccgggtggagccggagcagcccttggtgacctttggcgtcaaggaccacaagggcatggaacccactggcaacccgtcgatcgacgccatgcacgagcgcgatcggcggatctgccggaacatcaggcggcaggcactggagaaaggcaaggcacagcccttcgacggctacatcgagtgtccatga

SEQ ID NO: 11356 - DNA, 1236 bp, Pseudomonas aeruginosa
ggccggcgcccgcgtacgagcgccggtcgggctgcgtcagcgctgctcgcgcaggcgcacggcgacgtccggctggtcgctgaacaggccgtcgatgccggcgtcgaggtaggccctgatctcgccggccaggtcgccgcgcgactgcgggttgccgtcggcgctgcggaactccgccggaaggaagctgttttccgcgcggaaggtgtagggatgcaccttcagcccggcggcgtgggcgtcgccgacgaagcgggtcggctggccgaggttgccgttggcatcgcggggaatcacgtagctcttgtccggaccgaccccgtaggcgtagcgcgccacctggcgcaggcccttggcggtggccatctcggcgtaggtcaggctgccgccggcagcctgctggtcgtagggctggccgctgccgtagagctggaccaggcggatgccggtgaggcgcttgagttccttcaggttgttcacctcgaaggactggatgaataccggcgcgcgcggaccgaggtagccgttgcggtgcagggtcttcaccagtgggcgttccatggccaggccgaggcgctggaagtgggtgccgtgcttgatctcggggtacaggccgatggtgcgttgctggctgatctgcaggcttttcaccaggtcgatgatctcctgcagggtggggatctcgaaggtgccgtccaggcgcgcattgcccgggcggatcgtggggatgcgctcgatggcgcgcagggtcttcagttcggcgagggtgaagtcttcgctgaaccagccggtgagttccactccgtcgactttctgcgtgcgcttgcggtcggcgaattccgggtgctgggcgacatcggtggtcaggcccagctcgttgtcgtggcgggcgaccagcttgccgtcgcgggtcatcaccaggtccggctcgacgtagtcggcgcccatcatcaccgccagggcgtaggcgcccagggtgtgttccggtacgtaaccgctggcgccacggtgggcgatgaccagcggcgagcgttcgtggccggccgggtggcgaacggaggcctggccctgggcccagtcgatggcgcgttgtacgttgccggtgtcggcgtgggcggcgctggccaggccagcggcgagcatcaggcaggcggcgccgaggtggcggcgcaggaaggctggttgcatgacgggtcctcgtcggcggttcgggagtgttccagtccagcagattga

SEQ ID NO: 11357 - DNA, 1335 bp, Pseudomonas aeruginosa
agacccggcacatggaattggtcggcaaccgcatccgcgtcgacctcgacggattgttcccgccgccgcgcctggacttccgcgtcagtcgcctggccctggccgacggcggcatgcaactcgccctcggcgactccctggccgacctgcaatggccggcattacgggcgccggacagctacatgttcatcgagggcggcgatatcaagatggcgcgcaccgtgctggtcaaggcctatgccctgttcaccagcctcagcccggggcagccgctgctgttcaatcctcctacgactaccggcggcaactgcagaacggcgtgatccgcatgcgcgaggacggcatggtgcagatcgccgtgtcgccggtgaaggcgccggcgccgctggaggcacggctgtgagccggcgtccgtggggcgtactgcttggctgttgcctgttggcggccagcgcggctcaggccgaaagcgccatcgaccggcagcagcgcgaactggccctgctgcgcgagggctggtaccggcaggtcccgccggcgccggtgccgctgcccatgcgtacggccgggccggcggattccggccaggatggcgtcggcatactgctgcgcaacgtggacatgtacctgcgcggcaacatcggtttccacgtgcccgaggtgaagggctggatggtgccgaaccgggccggccagccggtggaattcgaccgtccgcaggacatgcatttccaggtgatggagggcgaggtgctgctcagcccgcggcaactggccaacctgttcaacgagcacatcctcgcctacgacgggaccatgttgaaggacttccgcatgagcagtgcggcgggacgcctggaggtggaggggcgggtgcgtccgctcggcgtagggccctggctgccgctgcggctgggcggcggcgtggaggtggacgcggccagcggcgcgctggtctatcggcccgaccagttgagggtgatcggtctgccgctgtacggggcgatgagcctggtcggcctgccgatgtcggcgctggtcagcctcgatcggccgggggcgagcctggtgggcagcgccatgcgcctggactaccgcaaggtcttcccgctgctgggcatcgacggccacgtacaggaggcctggctcgaccaccaggggctgcacctgcgtttctcccaggcgcccggccagccgtcgccggtgttcagcccgccggccgcggagggccccatccttcctctggctacactcgggcgacctgaagatcttcgaaatcctcatcacctacgcccaggtgctgctgaagaccgagaaccccggaccaggtgctga

SEQ ID NO: 11358 - DNA, 516 bp, Pseudomonas aeruginosa
ggtaaccccatggcacgaccgctggcgatgatcgccgcccttggcgagaaccgcgcgatcggcatcgacaaccgcctgccctggcgcctgccggccgacctcaagcatttcaaggcgatgaccctcggcaagccggtgatcatggggcgcaagacctgggactcgctgggtcggccgctgccgggccggctaaacctggtggtcagccgccaggccggcctggcactggagggtgcggaagtgttcgccagcctggacgccgcgctggcgcgcgccgaggcgtgggcgcaggcggaggacgccgacgaactgatgctgatcggcggcgcccagctctatgccgaggccttgccgcgcgccgcgcgtctctacctgacccgggttggcctggcgccggagggcgacgcctttttccccgagatcgatggtgcggcctggcgcctggcgtcgagcatcgaacacgccgcggctgacgatgcgcctgcctacgccttcgaggtatgggagcgccgctga

SEQ ID NO: 11359 - DNA, 987 bp, Pseudomonas aeruginosa
cggttccaggcggggtcagagggtgatcagctccgcctcgatcttcttccccgccacttccagcacgccgatcccgatcggcaagctgaagcgccgcggcccggcgctgcccgggttgaggtagagcacgccgtcgcgctcttccttcagcggcttgtgcgaatgtccggcgaccaccacgtcgatgccttcggcggccgggtcgaggtcgagtcgcttgaggtcgtgcagcacatagaggtcagccggccgatcttcagcagcacgcgctcggggatgtccgccgcccagtcctgggtgtcgttgttgccgcgcaccaccgagagcggcgccaggcgttccagctcggcgaggatttccggcttgccgatgtcgccggcatggatcaactggtcgcagccgcgcaaccgttccagcgcctcgggccggagcaggccatgggtgtcggcgatcaggccgatgcgcaacgggcggcgggactggggcatgggcgcgggtccgggttgcgggacggaagagggtggccgacgggcatggccatgccgtcgatcatacccaaccattggccgggtacgaaaacccttcggcgaaaaccgcgacgccacccggaggtggcgccgcgcctatcagtgtccggccttctggaccgggctttccggcaggaaccagttcagcagcagggcgcagatgccgccggtggcgaccccggactccagcacgttgcgcagcgccgcgggcatgtgcgcgaggaactccggcacctgcgaaacgcccaggccgagggccagggatacggcgatgatcagcagggcacggcggtccagctggatgccggcgaggatgttgatgcccgaagcggccaccgcgccgaacatcaccatcgccgcgccgcccagtaccggttccggcaccgcctggatgaccccggcgacgctcgggaacaggccgagcaggaccagcatggcggcgatccagaggccgacgtag

SEQ ID NO: 11360 - DNA, 627 bp, Pseudomonas aeruginosa
ccgacggccagggcgatgacgatggcgcaactgcgcatccataccaccgggatgcggttgagcaccacgatgatgcccagcaccacaccggacagcagcaggttctcgccgttggcgaaggtgccgttggacatcgccgagaagccgccgcccatgctgatcaggccgaccttgatcagggtcaggccgatcatcagcacgacgatgccggtcaccagcggcgtgatcagccgcttgacgaacggcagtatgcgcgagatgcccatctcgacgaaggagccggcgatgaccacgccgaagatcgccgccatcacgctttccaccggcgtgccctgcttgaccatcagcgccccgccggcgatcagcgggccgacgaagttgaagctggtgccctggacgatcaacagtccggcgccgaacgggccgaagcgcttgcactggacgaaggtggcgatgccggagatcaccagcgacatcgacacgatcagattggtgtcgcgcggcgatacgcccagcgcctggcagatcagcaggccgggggtaacgatcggcacgatgatcgccagcaggtgctggagggcggcgagcagggcgatgggagcgctgggacggtcgtccaggccatag

SEQ ID NO: 11361 - DNA, 1962 bp, Pseudomonas aeruginosa
ccgcttgcgattatccgccattcggcgcgcgtacgcgtgaatgaaaaagcccggcgcgggaccgggcttttttcgtcgcgggacgattcagccgtccagcagcgccttgttgcgtaccgcgcccttgtcggcgctggtggcgagcagggcgtaggccttgagcgcggtgctgacgcggcgggcacgcggcgcggccggcttccagcccttcttgtcctgttcggcgcggcgtgcggcgagttcttcgtcgctgaccagcaggttgatcgagcgattgggaatgtcgatcagcaccttgtcgccgtcctgcaccaggccgatggcgccgccggcggcggcttccggggaggcgtgaccgatggacaggcccgaggtgccgccggagaagcgtccgtcggtgagcagggcgcactgcttgcccaggcccttggacttcaggtagctggtcggatagagcatttcctgcatgcccggcccgcccttcggtccttcgtagcggatgatcacgatgtcgccggccttcacctcgtcgccgaggatgcctttcaccgcggcgtcctggctttcgaagatcttcgcgctgccttcgaacacgtggatcgactcgtcgaccccggcggtcttcaccacgcagccgtcgagagcgatgttgccgtagagcacggccagcccgccttccttggaataggcatgctcgacgctgcggatgcagccctcggcgcggtcgtcgtccaggctcggccagcgggtgttctggctgaacgcggtctgggtcgggatgcccgccggaccggccttgaagaaggtgtgcacggcttcgtcgcgggtctgggtgatgtcccactgggcgatggcgtcggccatgctcgggctgtgcacggtggggacgtcggtgtgcagcaggccaccgcgggccagttcgccgaggatggagaagatgccgccggcgcgatgcacgtcttccatgtggtacttctggatgttcggcgccaccttgcacagttgcggcaccttgcgcgacaggcggtcgatgtcgcgcaggtcgaacggcacctcggcctcctgggcggcggccagcaggtgcaggatggtattggtcgagccgcccatggcgatgtccagggtcatggcgttctcgaaggccttgaagttggcgatgttgcgcggcagcacgctgtcgtcgccttcgccgtaatagcgctggcagagttccacggccaggcgcccggcgcgcaggaacagttgctcgcggtcggcgtgggtggccagggtcgagccgttgcccggcagcgacaggccgagcgcctcggtcaggcagttcatcgagttggcggtgaacatgccggagcaggagccgcaggtcgggcaggcgctgcgctcgtactcggcgaccttctcgtcggagcaggagtcgtcggcggccaccaccatggcatcgaccaggtccaggccgtggctggccagcttggtcttgccggcttccatcggcccgccggagacgaacactaccgggatgttcaggcgcagcgcggccatcagcatgccgggggtgatcttgtcgcagttggagatgcagacgatggcgtcggcgcagtgggcgttgaccatgtattccacggagtcggcgatgatctcccggctcggcagcgaatagagcatgccgtcgtggcccatggcgatgccgtcgtcgacggcgatggtgttgaattccttggccacgccgccggccttctcgatctcgcgggcgaccagttggccgaggtccttcaggtgcacgtggccgggcacgaactgggtgaaggagttggcgatggcgatgatcggcttcttgaagtcttcgtccttcatcccggtggcgcgccagagggcgcgggcgccggccatgttgcggccgtgggtggaggttttcgagcggtaatcgggcatgacgatttcctgcggctaatcaggttcgggttatga

SEQ ID NO: 11362 - DNA, 1050 bp, Pseudomonas aeruginosa
gcaggaggcgctgaccaggatgccgtccttgctcagcaggcgcatggcctgttcgttgagacggcggtaggcggcctcgccgttcttcaggtccttcttgcgcttgatgaaggccggcgggtcggcgatcaccacgtcgaagcgttcgtcggcggccttcagctcgcgcagggcctcgaacacgtcgccctcgacgcaggcgaccttctccgccacgccgttcagtgccgcgttgcgctcgacgccgtcgagggcgaaggcggacgcgtccacgcacatcacttcgctggcgccgaaggcggcggcctggatgccccagccaccgatatagctgaacaggtcgaggacccgcttgccccgcacgtagggcgccaggcgcgcacggttcatgcggtggtcgtagaaccagccggtcttctgcccggccagcaccggcgcctcgaacttcacgccgttctcttccagggcgacccactccggcacttcgccgtaggcattggccacgtagcgctccaggccctcggcgtcgcgcgcgctggagtcgttcttccagagcacggcggcgggcttgagcacctgcagcagggcggcgagcacctcgtccttgcgcagttccatggctgcggacgccagttgcaccaccagcacgtcgccaaagcgatcgaccaccaggccgggcagcaggtcggaatcgccgtagaccagccggtagaacggcttgtcgaaaagccgctcgcgcaggctgagggcgatgttgatgcgatgaaccagcagcgatttgtcgagaacgtgcttggtatcacgggaaatgaggcggccgcagatgagattgttcgggctcagcgcgacgatgcccagcggcttgccgttggccatttccagcaccgcctggtcgccggcggcgaaggcattcagcggcgtcgcggcgacatccacctcgttgctgtagacccacaggtggccggcgcgcaggcggcgctcggcgttggctttgagacgcaagctgggcagggtcatgggaaaggctccggcaaaagagcgcgattatag

SEQ ID NO: 11363 - DNA, 843 bp, Pseudomonas aeruginosa
ggtgccgcggtcaaccggattgctgccgccatgcccgaactacccgaagtcgaaaccacccgccggggcatcgccccctacctcgaaggccagcgcgtcgagcgcgtgatcgtgcgcgagcggcgcctgcgctggccgattcccgaagacctggacgtgcgcctgtccggacaacgcatcgtcagcgtcgagcgccgcgccaagtacctgctgctgggcgccgagtccggtacgctgatcagccacctgggcatgtccggcagcctgaggctggtggagagcggtaccccggccagtcgccacgagcacgtcgacatcgagctggcctcgggcatggccctgcgctacaccgatccgcggcgcttcggcgccatgctctggagcctggcgccactggaacacgagctgctgcgcaacctcggcccggaaccgctgaccgacgctttcgccggccagcgtctgttcgagctgtcgcgcgggcggagcatggcggtcaagccgttcatcatggacaacgcggtggtggtcggggtcggcaacatctacgccagcgaagcgctgttcgccgccggcatcgatccgcgcaagcccgccggaagcatctccaaggcgcgctacctgcgcctggcggaggagatcaagcggatcctggcgatcgccatcgagcgcggcggcaccaccctgcgcgatttcgtcggcggcgacggccagcccggttacttccagcaggaattgttcgtctatggccgtggcggggagttctgcaaggtctgcggcagcaccctgcgcgagatccgcctaggccagcgcgccagcgtgtactgcccgcgctgccaacgctga

SEQ ID NO: 11364 - DNA, 486 bp, Pseudomonas aeruginosa
tcggcttataccggccgttcatcccgaaaaagccgcactacgcattcctcggcgattgaaggcggtcacgctggcactacccgcagcgctgttatagttaggcgatatctgcccaaccaaaaaccagaaaggaccgcctccatgaacctgtttcgcaccaccgcgctcgtgctggcgctgaccaccgggctctcgtccatgcccgcgctggcggatgccgtgcaggaaaacgccagcggcgacccgatgtacaccgtcgaagcgccccccgcgtacgccatgatcggcgatctgctcatcgcccgtcccttcctgatcgccgccacggccgtcggggcggtggccttcgtggtcagcctgccgttcaccgcggccagcggcagcgtcggcaaggccggccaggcgctggtggtcgatccgggcaaggaagccttcgtccgttgcctgggctgcaccaccagcggctataaccacgacgaaagctga

SEQ ID NO: 11365 - DNA, 378 bp, Pseudomonas aeruginosa
aggcggcgccgaacggcaggttcaccgagagggtggcggccaccgcgttgccctgggcatcgatcaccgcgaagtgggtggtgtggtcgccttcgcgccaggccggcgcctccggcagcgccgagctgggcgtggcgcggcgcgggtcgatgccggcggcaaggcgcttcaggtagtccggcgccagcaaactgggcagcgggttggcgacgaagtccgggtcgccgagcaggcctcgatcgcggtaggcacggcgcaggacctccagcacgtaatgggcgcgctgtaccggctcggccttctgccacggcagctgttccagcatctgcaggctctgcgccagggcgacgccgccggccgagggcggcggtgcgctga

SEQ ID NO: 11366 - DNA, 666 bp, Pseudomonas aeruginosa
gcagcttgtccgctgtctcgccttcgtagaaaccgatccgcccgtagcgcccgaggcgttccagggtacgtgccagctgcggttggcggagcaggttccattcgtcggggattccgcccttgtcgaggaagatccgcgcggtttccgggtccttgcgcatcgcttccaggcgcatggcggcgcggtcacggtagatccggtcgacggatacgccatccaccgccaggcggatcgccggcaccagattgtcggccaggggcttgcgtccgtagcggctgctcaattcgaccagcgccgccggcaggccggggatcgccgccgccagcgggccgtcgacggacagcctggggtcgaccttgccattgcgccggtacatgtcggcgtaggcggccttcggcgcgcgctcgcgggcgtcgaggaagcgataggtcggctgcgcaccggcctggcgcagaaggaagaatccaccgccgccgagtcccgagccgtaaggctcggctaccgccagggcagcggcgatggccgccgcagcgtcgaaggcgttgccgccattggccagggtttccaggccggcgacggtcgcggccggatgtggcgtggcgacggcggcctgctgcggtgcgtgggcgttgccgcgaaagctgtcggcatgcgccgcgaggctga

SEQ ID NO: 11367 - DNA, 699 bp, Pseudomonas aeruginosa
cccttggtgatgggatcgaaggtgcctgggtacagcactcggttcatcgctacgtcctggcagggtttcgtaagggaatcggatggtagcgcagggatgcccgtgcggccaagacgcacgggccatcggcctttagcccataggtctgatggcgccgggccggctgccgcggcgcgcggccggcccggcggcggttcaggccctggccaggcgttcggccagcgcgctggccagttgcgcggtaagaccgtagaccgagagctgcgggttggcgccgatgctggtggggaacagcgagccgtcgtggatcgacaggttccgcaggtggtgatggcggccgaggctgtcggccaccgccacggccgggtcttcgcccatggcgcagccgcccatgacgtgggcgctgcccaggcgcgtgcggtagatctccaggcgcaggccgtcgatgatcccgcgcgcctcctgcaggttcttcgcgctacgcgcgtcgctgtgcaccggccgcacttcccgggcgccggcggcgaactggatctccgccatggtatggaaggcacggcggataccgtcccaggtgtagtcggtcatccggtagtcgagcactggggtgtcgtcgccgcgcaggccgaccgagccctccgcgctgtccgggtggaagccgtcgcggagcagggcgagcatcatgttggtatgcggtag

SEQ ID NO: 11368 - DNA, 441 bp, Pseudomonas aeruginosa
atttcgctgcgtcgctggatttctagagtaaatactctaaagtgtcaaacagcatgcctgccagcccggcgcttgcgtacccaacgaaaggcgggccggtcgccggccgccaccccgggggctgacccgggcggccggctttgtgtaccttctacgctgtcacggcggggcgcgccccgcactgttacccgaacgagcccgtcgtccccatggcaccacgcatcaagacccgcgatcgcatcgcccaggccagcctggaactgttcaacgcccagggcgagcgcagcgtcaccaccaaccatatcgccacccacctgggtatatcgcctgggaacctctactaccactacccgaacaagcaggcgatcatcgccgagctgttcgccgagtacgaaagccacgtcgagagcttcctgcgcctgcccgaagggcggggtctga

SEQ ID NO: 11369 - DNA, 1161 bp, Pseudomonas aeruginosa
acaggtaggcgccgcggtgatcctcggcgaagcgccgcagcagggctgcgccgacgccgctgctctgtgcgccgggcagcacggcgatttccgccagccagacgcgaatcggtgtttcttcctcggcgcgcagcaggccgaccaggcggccgtcgcgttcggccagcagggaatacccggaatgctggtacagcgtgcgtagctcggcaggcggcatgcgccggtcccagccgaccgccgcgtggatcgccaggatcgcctcgcagtcggcgtcgtcgagcatcgggttgtgccgcagcgtcagttccattcgcccccctttttccttcagcctgttcctattctgccgcccgtcgccggacgccggccagctcagtgctgccgcaggcgggcctccagccagtcggggatgcgtcgttccaggtagtaggtgggctggcgcggagagccgtcgacgaagccgacgtgaccgccgcgggcgtgcagctccagctcggtgcagggtgccagttcgctgcgatcgggcaggctgcgggcgaacacgaaggggtcgtcgctggaatggatgatcaggctcggcgtgcggatgtccggcaggtagtagcggctggacgcgcgccgatagtaatccctggcgtcggcgaagccgtgcagcggcgcggtgacccggccgtcgaagtcccagaaggtgcgcatgccctccagcggaccgaggcgttgcagggcggccaggccttccgcctggccctgctcgccgaacagccgctgcttgtcctgcacgtaggccagcatggccttcatgaagtgcgcctggtagacccgggaaaagcccaggccgatgcggtcggcgcactcgtccaggcggaacggcaccgacaccgcgacgccgccgagcagcgggcagtccccagcggtttcgcccaggtacttgagcagcacgttgccgcccagcgaatagccgaccgcgtacagcggcgcttgcgggcgcctggcgcgcaggtgcgcgaccacctcggcgaggttgtcgctgaccccggaatggtagccgcgcggcaggcggttcggctcccccgagcaaccgcgccagttcagcgccacgctggcccagccgcgctccagcagggcgcgctgcagaccgaggatgtagtgcgacgaggatga

SEQ ID NO: 11370 - DNA, 1350 bp, Pseudomonas aeruginosa
cgcagccctgtgcgctcactcatgacgggcctccttttcctcggccttcacaggcagcacttgcgccagggtcaggcgcgacggggtgaaataggtgcgggcggctttctggatatcgtccggagtcactgccttgagggcctccaggtcctggtcgatcagcttccaggacaggccgacgctttccagctggccgatgctgctggcctgggcggcgatggagtccttctcgtagaccatcccggcgatcatctgcgcgcgcacgcgctcgatctccgcggcgctgggcgggttctgcttgaggtcatcgagctgcttccacagaccggcctcgacctgctcgagggtcttgcccttctgcacgttcggcgtggccgagaggacgaacaggctgtcgccgcggttgaacgcgtcatagtaggtggaggcgccggcgaccagctcctcgccgcgctccaggcgcgaggccaggcgggcgctgtagccgccatcgagcagcgcgccgatcaggcgcagggcgttgacttcgcgagggttctcgctgctgcccaggctgggcacgttgaagcccatgatcaggttcggcagctgggtgcgtacgtacagcttgagccggcgctcgccgggctcggccagttccagcggcttgcgcgccggcggcagctggcgccaggggatctcgccgaagtagcgcttggcgagggtcttgacctcgtcggcggtgacgtcgccgaccactaccagggtggcgttgttcggcgcgtaccaggattcgtaccagtggcgcaggtcgtcgatggtcatgcgctgcaggtcggccatccagccgatggtcggggtgtggtagccgctggccgggtaggcggcggccttgaagcgctcgaaggcgagggcgttgggattgtcgtcggtgcgcaggcggcgctcctccttgatcacctcgatctcgctcttgaactggtcggccggcaggctcaagtgggccatgcggtcggcttccatctccagcgccaccggcagacggtcgcgggccaggacctggtaataggcggtgtagtcgtcggtggtgaaggcgttctcttccgcacccaggtcgcgcagcacccgcgaggcttcgcccgggccgagcttgcggctgcccttgaacatcatgtgttcgagggcgtgggacaggccggtgagcccgggtgtctcgtagctggagccgatcctgtaccagagctgggaaaccaccaccggggcgcggtggtcttcacgcactatgaccttcaggccgttgtcgaggctgaactcgtgggtgggctgggtttccgccgcctgggcgaaaagcgggagacaaaggctggctag

SEQ ID NO: 11371 - DNA, 1548 bp, Pseudomonas aeruginosa
gagcaggccgacgcggcggcgagctggggttttcatggtgatctggacctttcgtgccgccaccggggtctcaggtcactgcggggcaggacccttagccccgtcgggcgaggagatgctaggatacccatccgttttccgggcggccacgtcccgtgccgctcccttgagatacaagcattcatgtttggttccaacgacgacaagaaggccccgcagggcggggaaaagaaaggtctgttcggctggtggcggaaaaagccgcaagccggcgagcagcctgccgatcagcctgtcgagccggtctccgagacagcggccgccgagcagcgcgcgcctgccgatgacgtggcgcaatccctgacagaacagccaggtcggcagcagccctccgctgccgagccggccgagccggcgccggttgccgaagcaccgctcgccagtgacgagccagcgtcggccgaggagcattcgccccggcccgaggcgcccgtcgcgcaacccgagcctatcctggctgccgagcccgagcccgagcccgagcccgagcccgagcccgagcccgagcccgttgcgccgctggccgccgctccggcagtcagcgagccggcgaccaggccgggcttcttcgcccgcctccggcagggactgtccaagaccagcgccagcatcggcgaaggcatggccagcctgttcctcggccgcaaggaaatcgacgacgacctgctcgacgacatcgagacgcgcctgctgaccgccgacgtcggcgtcgaggccaccaccctgatcgtgcagaacctgaccaagcgcgtggcgcgcaaggagctggccgacagcggcgcgctgtacaaggcgctgcaggaagagctggccagcctgctgcgcccggtggagcagccgttgcaggtcgacgtcgcgcgcgagccctatgtgatcctggtggttggggtgaacggcgtgggcaagaccaccaccatcggcaagctggcgaagaagctgcaactcgagggcaagaaggtcatgctggccgccggcgacaccttccgcgccgccgccgtggagcagttgcaggtctggggcgagcgcaaccgcatcccggtgatcgcccagcacaccggcgccgactccgcctcggtgatcttcgacgcggtgcaggccgccaaggcccgcggcatcgacgtgctgatcgccgataccgccggacgcctgcataccaaggacaacctgatggaggagctgaagaaggtgcgccgggtgatcggcaagctggacgagacggcgccccatgaggtcctgctggtgctcgacgccggcaccgggcagaacgccatcaatcaggccaagcagttcaacctcgcggtggagctgaccggcctggccctgaccaaactggacggcaccgccaagggcggggtgatcttcgccctggccaagcagttcggcctgccgatccgctatatcggtgtcggcgaggggatcgacgatctccgtaccttcgaggccgacgccttcgtccaggcactcttcgcagagcgggagaacgcatga

SEQ ID NO: 11372 - DNA, 753 bp, Pseudomonas aeruginosa
ccctgcagcgtggccggatcatcgctgaccgtgaggatgaggcctgatgagcgccaacgatcttccccgtggccccgaagagggcgcaccggaacgcaagacccgcgagaaaccgagccaggagcagaccgactggagcggctcgttcagcgcctacctggaaagccatcgcgccagcctggtggacagcctgcgccggttgttcggccacccgttcggcagcttcttcacctgcctggtgatgggtatcaccctgagcctgccgatgggcctctcgctgctgctgaacaatgtcgaacggctcggcggctcctggcagcgggcggcgcagatatccctgttcctcgacctgaagaccagcgaaaatcagggccaggacctgcgcgagcagatcgagcgcctgccggacgtgatcgaggcccaattgatcagccgcgagcaggcgctcagcgaattgcaggaacagtccggcctgggcgaagcgctcaaggagctgccggagaacccgctgccgccggtgatctcggtcacgcccaagcagatcgaccgggctggcctggaggcactgcgccagcagctcgcggagctgcctcatgtgcagcaggcgcagctcgacctggtatgggtcgagcgcctgagcgcgatcctcaagctcggcgaacgcttcgtcttcggcctgaccatcctgctggtgctgaccctcttgctggtggtgggcaacaccatccgcctgcacatcgaaaatcgccgtaa

SEQ ID NO: 11373 - DNA, 930 bp, Pseudomonas aeruginosa
aggaacttatacacccgcttgcagtcagatatccgagtgctacactgcgcgagtttcgtgaatcggaggattcgcatgaccacttctttgcaacctgtacatgccttggttccaggcgcaaacctggaagcctacgtgcactcggtgaacagcattccgctgttgtcgccggaacaggagcgtgaactggccgaacgcctcttctatcagcaagacctggaagcggcgcggcagatggtgttggcgcacctgcgcttcgttgttcatatcgccaagagttattcggggtacggcctggcccaggccgacctgatccaggaaggcaacgtcggcctgatgaaggccgtgaagcgtttcaacccggaaatgggcgttcgcctggtgtccttcgccgtgcactggatcaaggcggagatccacgagttcatcctgcgcaactggcggatcgtcaaggtcgccaccaccaaggcgcagcgcaagctgttcttcaacctgcgcagccagaagaagcgcctggcctggttgaacaacgaggaagtccatcgcgtcgccgagagcctgggggtcgagccccgcgaagtgcgcgagatggaaagccgcctgaccggccaggacatggcgttcgacccggccgccgacgcggacgacgagagcgcctaccagtcgccggcgcattacctcgaagaccaccgctacgacccggcgcgccagttggaagacgccgactggagcgacagctccagcgccaacctgcacgaggcgctggaaggcctcgacgagcgcagccgcgacattctccagcagcgctggctgtccgaggagaaggccacgctgcacgacctggcggaaaagtacaacgtttccgccgagcgtatccggcagctggaaaagaacgccatgagcaagctgaaagggcggattctcgcctga

SEQ ID NO: 11374 - DNA, 948 bp, Pseudomonas aeruginosa
acctggatatcgtgccgcgcagccagcacgccagcaccgcgctcaaggatggcgaccgcgtggagatcgtccacgccatcggcggcggctaggcctggcccccgaacccttccatcggccccgcaagcctttccatccaggagtcatccgatgagccaagcatccagtaccgatacccccttcgtcatcgccggccgtacctatggctcgcgcctgctggtggggaccggcaagtacaaggacctggacgagacccgccgggccatcgaggcctccggagcggagatcgtcacggtggcggtgcggcgcaccaacatcgggcagaatcccgacgagccgaacctgctggatgtgatcccgccggatcgctacaccatcctgccgaacaccgccggctgctatgacgcggtcgaggccgtgcgcacctgccgtctggcccgcgagctgctggacgggcacaacctggtcaagctggaagtcctcgccgaccagaagaccctgttccccaacgtcgtcgagaccctcaaggccgccgagcaactggtgaaggacggcttcgacgtgatggtgtacaccagcgacgacccgatcatcgcccgccaactggccgagatcggctgcatcgcggtgatgccgctggccggcctgatcggctccggcctgggcatctgcaacccctacaacctgcgcatcatcctcgaggaagccaaggtcccggtgctggtcgacgccggcgttggcaccgcttccgatgcagcgatcgccatggagctgggttgcgaggcggtgctgatgaacaccgccatcgcccatgccaaggacccggtgatgatggccgaggccatgaagcacgcgatcgtcgccggtcgtctcgcctacctggccggacgcatgccgcgcaagctgtatgccagcgcctcgtcgccgctggacggcctgatcgactga

SEQ ID NO: 11375 - DNA, 204 bp, Pseudomonas aeruginosa
aaatttcaatcatgcgggggctggagccagagtcaatcggaaagccaatttgttgtcaatagccctctcatcgccctcgcggccggcgaaatggccgtagacagggccttccagcgcatcgcgaaagcggccaaagccaggccaggcaaggtgttcaacctggtgcagcagatattttacaggctccgttgtacgaaaaattga

SEQ ID NO: 11376 - DNA, 1038 bp, Pseudomonas aeruginosa
acaaggctaagctgtgccaaccctacaacagcaataaaccgggtgttccatgtcctaccagccgtccctcggcgccaagttccgcggccacaagatcggtcagcatccgcgttagctccgctccggttcttctctccctcgattcttcgcagcgccctcaagcggccctcgctcgtccgccgcctgccctgcccgtcctccttatataaggaaggacaccggccgctttcgcctgcgtggataacggataagaagagcaagatcgttcaagccagcccgatgcgcctgctggcatgctggaccgacgttcaccaccgccatgcccccatgactgcccacgacctgccccgccaagcctttctccgcggcgccgtcgccatcctcccattgtccctggccgtcgcgccctgggggctgctggcgggatcgatggccatcgaagccaacctcaccccggccgagggccagggcctgtccgccatcgtcttcgccggcgccgcccagttggtggcgatcggcatgctcaagggcggtgccgggttcttttcgatcatcttcaccaccctcctcctgacctcgcagcacctgctctacggcatgagcttgcggccggtcctgtcacctctgccgggacgctggcggatcggcctgggcttcctgctcaccgacgagttcttcgccctcgccagccagcacgaccggcgcaacttcaaccgctggtacgccctcggcgtcggtctgaccttctatatcgcctggaacctgttcaccctcgccggcatcctgcttggccgcagcattcccggtctcgaacacctgggcctggatttctccatcgccgccaccttcatcgcgctggtcgcgccgctggtgcgcaacgtaccgacactggtctgcgtggccacctcgctgttctgctcggtgctgttcagccactggcaatggagttcggcgctggtcctcgccggtctcgccgggatggccgccggtttcatctgcaacaagctgtatcgggaggcgccatggtctgggcagtga

SEQ ID NO: 11377 - DNA, 933 bp, Pseudomonas aeruginosa
aggagacccgttgcgatgacgctccagtccccttctcgtccagatgaagcgctgaaaggggcctcctccgcaacgaagaacgagggttcatgcgccacgggaatgaactcgcgaagaaaggtcgcttggcgctggcgcgctttgggccgaatatcggggcaaccacaacgtgcgcagcgaggccctcatgtccgactcccttccccagcgcaacggcgggcagatcctggtagaggcattgcggcgcaatgccgtcgataccgtctactgcatccccggggaaagctacctgccggtgctcgatgcgctgcacgacgccaacggcatccgcaccatcgtcacccgccacgagggtgccgcctcgaacatggccgatgcctacggcaagctgaccggccgaccaggcatctgcttcgtcacccgcggccccggtgccacccatgcggcgaatggcgtgcacacggcgcagcaggactcgacgccgatgatcctgttcgtcggccaggtggaaagcgccttcaagggccgcgaggcgttccaggaagtcgactacgtgcagatgttctcgggcctggccaagtgggccgtggaaatcgaccgtatcgaacgcatcccggagatcgtcggccgcgccttcagcgtcgccacctcgggccgaccgggcccggtcgtggtcgccctgcccgaggaaatcctcttcggtttcgcgcaggtcgccgatgcgccggagccaagggtgcttccggggcggccgggcgccacggcgatggcggaactgcgcgaactgctggcgaacgccaggcgccccctgctggtacttggcggcagcggctgggacagtgccgccaggaaacggctaggcgccttcgtcgaggccaatggcctgccggtggccacctcgttccgtcgccaggacctgttcgacaaccgtga

SEQ ID NO: 11378 - DNA, 558 bp, Pseudomonas aeruginosa
cggctgggcaggacgaagccggtgtcttccagcagttcgccgaggcgctgctcggacaacggatcgaaatcctcgcgcaagcgttgcagcatgccgtcgctgtcctccggggaaagcccggccaagcggcaggcctcggcctgcaccggacgttcgaaggcgtcccgggcttccatcaggttggccagcagcaacggcgccgctggcgccagacgctcggcgaccgcctcgagaaagcgccgcttggcctggtcgccgcgcaggaaatgcagcaccagcaggaccagcgccgcatcgcaaggcggcgcaggcggtagcccggcgacgtcgccgcagtgcagctcgatccgctccagcaggccgagcctggcgcagcgctggcgggccagggcgagcatgtcggccgacaggtccgccgcgacgaaacgccagcctggacgcaacccggccagctccgccagttcgccgccggcgccgcagccgacgctgagcaggcgcgcccgttccggcagacgggccagcaactgcgcgcgactgagcaggtgcagcaactcgtag

SEQ ID NO: 11379 - DNA, 807 bp, Pseudomonas aeruginosa
ccgtccgcctgtttcccgacgaagcggcccatcagtcgaacaccttgcccaggcgccaatagcccatcagggtcagatgacgcttgtcgataccgcgctcctgcaccaggtagcgccggatcgccatcaccgccgccgactcgccggcgacccaggcgtagaaactgccgctctcggggctcgccagttcccagaggatctcctcgtcgatatcgatgtcctccagttcctgggccgcaccacccgccacctcgcgttccggcagccgcgcctggcgcgccgcctcgatcatccgctcgccgttgcgcgaatggataccggcctggtggcgcggcagccagtgcaggcgcgcagcgggaatcgccggcaggtcgaggatgtcggcttctcccggcacttcgagaaaggcctcgaccaccggcggctcggtttcgccggccagctcctcgagaattcccgccaccgcgggcaaggcggtttcgtcggcgatcagcaggatatggcggacgccagccggcggtttccattcgtagccgccggggtcatcgccgtattgccggttgggcgcggccagttgcaggcggtcgccgatccgcgcgtgggtcgcccaggccgaggccgggccgttctcgccgtggaggacgaactccacgtcgacctcttcctgctcggcgcgcagcgcacggatggtgtaggtacgcatcggcggccggcgggccggctcgacgctgcgataggcctggtaccactcgctgccgccgggcaggctgggcggctggccgctggcatcggggaagaagatcttga

SEQ ID NO: 11380 - DNA, 1677 bp, Pseudomonas aeruginosa
caaacaatgcgaatgattagcatttgctatttgcgcaatcgtcgactgcgtcgaaagcacgactgtcgctcaggcctcgcaaggctccagcagctcgcaagcgctctcccctactcgcctgaccgcctgctcgatggccggggtcggcaacgccgcgtagttcatccgcaggcagttccgatacttgccggaagcggaaaagatgcagcccaccgcgacttgtacgccgcggttgcgcaaggccttgtccaggcgcagggtgtcgaacgcctcgtccagttcgacccagagcaggaaaccgccctggggccggctggcgcgggtgccctccgggaaatagcgcgccacccagtcgatcatcaggtcgcgtccgcgctggtactgggcgcgcatgcgccgcaagtgcggctcgtagtggccgttgccgatgaattcggcgatcgccagttgcggttgcagggcgctggcgccggtactgatgtacttcatgtgcagcacgcggtcggcgtagcgcccgggtaccatccagccgatccgcaggcccggcgccaggaccttggagaacgacccgcagagcagcacccggccatcgtcgtcgtacgacttgatggtgcgcgggcgcggataggtgtaggccaggtcgccatagacatcgtcctcgatgatcgccacgtcgtagcgctgggccagggccagcagcgcccgcttgcgcgactcgggcatgatgtagccgagcgggttgttgcagttcggggtcacctggatggccttgatcggccactgttccagcgccagttcgagggcttccaggctgatgccgttgaccggatcggtggggatctccagggccttcatgccgaggcctttcagcgattgcatggcgccatggaagctcggcgactccaccgcgacgatgtcgcccggttcgcacaccgcgcggatgctcaccgacagggcctcgtggcagccggtggtgatcaccacgtcgctggcggtggctcgacagccggagtccaccaacaggcgggcgacttcctcgcgcagcaacggcgagccgtggatcccgtcgtaggccagcgcacgggcgtcggcgtggcggttgagccgggccaggctgcgggtcagcggtttcagcgaagggctggagatgtccggcatgccgcggccgagctggaccacgtccggccgcggtaccgtgctgaccagggccagcacctgctcccattgcgagatttccaccggccgctgggccaggcgggcgatcgccggcagcggcggcatctgtcgcgcgaccggtacgaaatagccggacttcggccgcggctcggccagcccgcgatcttccagcagcctgtatgcctgttgcacggtgctcaggctgacgccgtgctcgatgctcatggcccgcaccgagggcagccggtcgcccggacggtagaggccctgttcgatgcgcgaaccgagggtctcggcgagttgcagataaagggtcatgagcgggactccagggtgagcgaaagcgggaccggtacagatggtggcgaaatccaccattcaggccggggagcgcttgatctgtatgcagtcaacccaccttttctggacctgtacggaacagcgcgcgatggccattctatctccgtcgtccagccgatcaatatggagtacgcagcatga

SEQ ID NO: 11381 - DNA, 492 bp, Pseudomonas aeruginosa
tggtctgcgcggtgctcgcgcaacgctacgccaggcgccgcgacgacgcagcggcggcgctggccgaggccccctcgcgctgagcgcgaaaatgaaagaagccggcccaggggccggcttcttcgttcagacgcggctcagcgcgtcggcgtgcgcagggtgacgaactcttccgccgcggtcgggtggatgccgatggtctcgtcgaacgcctgcttggtcgccccggccttcatcgccaccgcgataccctggaggatctcgccggcctcggcgccgaccatgtggcagcccagcaccctgtcgtcgtgggcatccacgaccagcttcatcagggtcttttcctggtcgtcggtaagggtcagcttcatcggccggaagcggctctcgaagatcttcaccttgtgcccggcgctcagcgcctcctcctcggtcaggccgacggtgccgatgttgggcaggctgaacaccgcggtgggaatcaacttgtag

SEQ ID NO: 11382 - DNA, 1356 bp, Pseudomonas aeruginosa
tcaggctgcgctcgccttacaatgcccggcccttggacgtcctatgccctggtagatgaagcccagttccgccatccgcgccggtgcgtagagattccgaccgtcgaccaacaggggagttcgcatggatccacggattttctggaagtccggctggcggaactgtttccactcggtcaccagcaccagggcatcggcgccctcgacggcggcgtagggcgagtcgtggagcgtcaatcgggcgcaggccacagcttccggatagcgtgccgcgaccccggcgttggccaccggatcatgggccctgacccgcaccccgtggcgcagcagcgcctccagcaggaccaggctcggcgcctcgcgcaggtcgtcggtacccggcttgaaggccagcccccagagcgccaccgtgcgcccttgccagcgtccctggaacagctcgccgagggtctcgaagagcagctccttctgccgcgcgttgcgcgcttccaccgcgcgcagtatctggctgtcgtagccctgctgctcggcgctgcggatcagcgcgcggacgtccttgggaaagcacgagccgccgtagccgcagccggcgtagatgaaatgggtgccgatgcgcttgtcgctacccatgccgcggcgcacgtcctcgatgtcgacgccggtgagggcgcacagcccggccatctcgttcatgaaggaaatcttggtggcgaggaaggcattggccgcgtacttgctgaactcggcctcgcgacgccccatcagcaggacccgctcgtgattgcgcaggaacggcgcgtagagctggcgcagggtttccccggcctgcgcctcggcgctgccgatgatgacccggtccgggcgcctgaaatcgtccaccgccgagccttccttgaggaactccggattgctcgccaccgctacccggaagcgcttgcgccggcgcgccaggcccaggcggatgatctcttcgacccgttcggcggtgcccaccggcacggtcgacttgttgaccacgatgcaggcctggcgcagttgcgcgccaagttgctcggcgaccgccagcacgtggctgaggtcggccgagccgtcctcgccgcacggcgtgccgacggcgatgaacaccacttcggcgtcggccaggccttccgccaggctggcggtgaaggtcaggcgggcggcgtccagctgatcgcgcaggatgctttccaggcccggttcgtagatcggcatctcgccgcgtctcagccgcgcgacccgctcgcggtcacgctccacgcaacgcacctggttgcccatctcggcgaaacaggccgccgtcaccagtcccacatagcccgcaccaatcacgcatag

SEQ ID NO: 11383 - DNA, 285 bp, Pseudomonas aeruginosa
cagaacccgcgcggatgcccggggtccacccaaggtaggcggaaaaaacaggaggctcccatgtccatcgacatcgattcggaacaaggcgtctgcagcgtggagatcgaaggcagccggcatcgcgcgccggtcgacagcctgcgcatcggtaccgacgccgaggcgcgcctgtcggtgctctacatcgacggcaagcgcctgcacatcagcgaggaagacgcccagcggctggtggtcgccggcgccgaggaccagcgcaggcacctgatggcggacgattga

SEQ ID NO: 11384 - DNA, 1026 bp, Pseudomonas aeruginosa
agtgcgggcgcgcgtcgccggcatcgtcacccgtcgcctgtacgaggaaggccaggacgtccgcgccggcaccgtgctgttccagatcgaccctgcgcccttgaaggcggccctggacatcagccgcggcgccctggcccgggccgaggccagccacgcggcggcggccgacaagctcaagcgctacgccgacctgatcaaggaccgcgccatcagcgaacgcgagtacaccgaagcgcagaccgacgcgcgccaggccctggcgcagatcgcctcggccaaggccgaactggagcaggcccgcctgcgcctgggctacgccacggtcaccgcgccgatcgacggccgcgcgcggcgcgcgctggtcaccgaaggcgcgctggtcggcgaggactcgccgacacctctgacccgcgtcgagcagatcgatccgatctacgtgaacttctcccagccggccggcgaagtcgccgccatgcagcgggcgatccgcgaaggccaggtgaagggtgtcgccgacaaggacatcgccgtgcgcctggtcctggccgacggcagcgagtacccgctggccggcgagctgctgttctccgacctggcggtcgaccccggcaccgacaccatcgccatgcgtgccctgttccgcaatccgcatcgcgaattgctgcccggcggctacgtgcaggtgcgcctgcagcgcgcggtgaacccgcaggcgatcaccgtcccgcgcgacgcgctgatccgtaccgcccagtccgccgtggtcaaggtggtcaacccacagggcttggtggaagacgtggaggtccgcgccgacaccctgcagggccgcgactggatcatcagcagcgggctcaagggcggcgagcgtgtgatcgtcgagaacgccgcccagcatgccgccggctccagcgtccaggcggtggtccgccagccggccagcgccgacgccccctcaccgctggccgcctcgccggcgggccagtgacggagaacgctacgaatggctcgtttcttcattga

SEQ ID NO: 11385 - DNA, 960 bp, Pseudomonas aeruginosa
ccggccggtcttcgcctgggtgatctccctgctgatcgtgctcgccggggtcctggcgatccgcttcctgccggtcgcccagtacccggacatcgcgccgccggtggtcaacgtcagcgccagctatcccggcgcctcggccaaggtggtcgaggaagcggtgaccgcgatcatcgagcgcgagatgaacggcgcgcccggcctgctctacaccaaggccaccagcagcaccggccaggcctcgctgaccctgaccttccgccagggcgtgaacgccgacctcgccgcggtggaagtgcagaaccgcctgaagatcgtcgagtcgcgcctgcccgaatcggtgcggcgcgacggcatctacgtggagaaggcggcggacagcatccagctgatcgttacccttacctcctccagcggccgctacgacgccatggacctgggcgagatcgcctcgtccaacgtgttgcaggcgctgcgccgggtggagggcgtgggcaaggtcgagacctggggcgccgagtacgccatgcgcatctggcccgacccggccaagctgacctcgatgaacctcagcgccagcgacctggtcaacgccgtgcgccggcacaacgcccgcctcaccgtgggcgacatcggcaacctcggggtccccgactcggcgccgatcagcgccacggtgaaggtcgacgacaccctggtgacgcccgagcagttcggcgaaattccgctgcgcatccgcgccgacggcggcgcgatccgcctgcgcgacgtggcccgcgtcgagttcggccagagcgagtacggcttcgtctcgcgggtcaaccagatgaccgccaccggcctggcggtgaagatggcgcccggctccaacgcggtggccaccgccaagcgcatccgcgccaccctcgacgagctgtcgcgctacttcccggagggcgtgagctacaacatcccctatga

SEQ ID NO: 11386 - DNA, 534 bp, Pseudomonas aeruginosa
cacctcggcgttcgtcgagatctcgatcaggaaggtggtcagcaccctgctcgaggcgatgctgctggtgttcgccgtgatgtacctgttcatgcagaacttccgcgccaccctgatcccgacactggtggtgccggtggccctgctgggcaccttcacggtgatgctcggcctgggcttctcgatcaacgtgctgaccatgttcggcatggtcctggcgatcggcatcctggtggacgacgcgatcatcgtggtggagaacgtcgagcggctgatggccgaggaaggcctgtcgccgcacgacgccacggtcaaggcgatgcgccagatcagcggggccatcgtcggcatcaccgtggtgctggtctcggtgttcgtgccgatggcgttcttcagcggcgcggtgggcaacatctaccgccagttcgcggtgaccctggcggtctccatcggcttctcggcgttcctcgcgctgtcgctgaccccggccctgtgcgccaccctgctgcgcccgatcgacgccgaccaccatga

SEQ ID NO: 11387 - DNA, 1398 bp, Pseudomonas aeruginosa
gaagcgcggcttcttcggctggttcaaccgcgccttcctgcgcctgaccggacgctaccgcaacgcggtggccggcatcctcgcccggccgatccgctggatgctggtctacgccctggtcatcggcgtggtcgccctgctcttcgtgcgcctgccgcaggcgttcctgccggaagaggaccagggcgacttcatgatcatggtgatgcagcccgaaggcacgccgatggcggagaccatggccaacgtcggcgacgtcgagcgctacctggcggagcacgaaccggtggcctacgcctatgcggtcggcggcttcagcctgtacggcgacggcaccagctcggcgatgatcttcgccaccctgaaggactggtcggaacgccgggaggccagccagcacgtcggcgccatcgtcgagcgcatcaaccagcgcttcgccggcctgcccaaccgtacggtgtatgcgatgaactcgccgccgctgccggacctgggttccaccagcggcttcgacttccgcctgcaggaccgtggcggggttggctacgaggccctggtcaaggcccgcgaccagttgctggcgcgcgccgccgaggacccgcgtctggccaacgtgatgttcgccggccagggcgaggcgccgcagatccgcctggacatcgaccggcgcaaggcggagaccctcggcgtgagcatggacgagatcaacaccaccctggcggtgatgttcggctcggactacatcggcgacttcatgcacggcagccaggtgcgcaaggtggtggtccaggccgacggcgccaagcgcctgggcatcgacgacatcggccggcttcacgtgcgcaacgagcagggcgagatggtgccgctggcgacgttcgccaaggccgcctggaccctcggcccgccgcaactgacccgctacaacggatatccctcgttcaacctcgagggccaggccgcgccgggctacagcagcggcgaagccatgcaggcgatggagcaattgatgcagggactgcccgagggcatcgcccacgagtggtccggccagtccttcgaagaacgcctgtccggcgcccaggcgccggcgctgttcgccctctcggtgttgatcgtgttcctcgccctggccgccctctacgaaagctggtcgatcccgctggcggtgatcctggtggtgccgttgggcgtactcggcgcactgctcggggtgagcctgcgcggtctgcccaacgacatgtacttcaaggtcggcctgatcaccatcatcggcctctcggcgaagaacgccatcctcatcatcgaggtggccaaggaccattaccaggaaggcatgagcctgctgcaggcgacccctggaggccgcgcgcctgcgcctgcgaccgatcgtcatga

SEQ ID NO: 11388 - DNA, 423 bp, Pseudomonas aeruginosa
acaagcaggtgccagcgcatgtccatcacctacaccatctccgatctcgcccgcgaactggacatcaccacccgcgccatccgcttctacgaggagcaaggcctgctctcccccgagcgacgcggccaggaacgcatctattcgccgcgcgacaaggtcagcctgaagctgatcctgcgcggcaagcgcatcggtttttccctcgccgaatgccgcgaactgatcgagctctacgacccggacccgagcagcggcaaccagaagcagttgaacaccatgctggagaagatcgccgagcgccgcgcccagctggaacaacagttgctggacatcgaacagatgcagctggaactggatactgccgaggagcgctgtcgagcggcgcttatcaaaagctataacaaacatacagttgaaacataa

SEQ ID NO: 11389 - DNA, 1212 bp, Pseudomonas aeruginosa
acctcattcaaagctttaaaccggacaagcacaattacaggtgaaagcatgacctatcccagcctcaacttcgccctcggcgaaaccatcgacatgctccgcgaccaggtgcgcggcttcgtcgccgccgaactgcagccgcgcgccgcgcagatcgaccaggacaatcagttccccatggacatgtggcgcaagttcggcgagatgggcctgctcggcatcaccgtcgacgaggagtacggcggttcggcgctgggctacctggcccacgccgtggtcatggaagagatcagccgggcctcggcctcggtggcgctctcctatggcgcgcattccaacctctgcgtcaaccagatcaagcgcaacggcaacgccgaacagaaggcccgctacctgccggccctggtatccggcgaacacatcggtgcgctggcgatgagcgaacccaacgccggctccgacgtggtctcgatgaagctgcgcgcggaccgggtcggcgaccgcttcgttctcaacggcagcaagatgtggatcaccaacggtcccgatgcccatacctatgtgatctacgccaagaccgacgcggacaagggcgcgcacgggatcaccgcgttcatcgtcgagcgcgactggaaaggcttcagtcgcgggccgaagctggacaagctgggcatgcgcggctcgaacacctgcgaactgatcttccaggacgtcgaggtacccgaggagaacgtcctcggcgcggtcaacggcggggtcaaggtactgatgagcggcctcgactacgagcgcgtggtgctttccggcggcccggtgggaatcatgcaggcgtgcatggacgtggtggtgccgtacatccatgaccgccgccagttcggccagagcatcggcgaattccagctggtccagggcaaggtggccgacatgtacaccgccctcaacgccagccgcgcctacctgtacgccgtggccgccgcctgcgaccgcggcgagacgacccgcaaggacgccgccggggtgatcctctacagcgccgagcgcgccacccagatggccctggacgcgatccagatcctcggcggcaacggctacatcaacgagtttcccaccggccgcctgttgcgcgacgccaagctctacgagatcggcgccggcaccagcgagatccgccgcatgctgatcggccgcgagctgttcaacgaaacccgctga

SEQ ID NO: 11390 - DNA, 435 bp, Pseudomonas aeruginosa
agcctcgctcttcccggcccttttccgccagggagagggcattccattgcatcgacaggcgcatcgccaggtcgggagcgggcgccaaccgcttccgcccacctcgacacggagccaccgccatggccatcctgcacacccagatcaatccacgctccgccgagttcgcggccaacgccgcgaccatgctggaacaggtcaacgccctgcgcaccctcctcggccgcatccacgaaggcggcggtagcgccgcccaggcccggcacagcgcgcgcggcaagctgctggtgcgcgaacgcatcaaccgcctgctcgaccccggctcgccgttcctcgagctttccgccctcgccgcccacgaagtctacggcgaagaggtcgccgccgccggcatcgtcgccgggatcggccgggtcgaaggggtggaatgcatga

SEQ ID NO: 11391 - DNA, 909 bp, Pseudomonas aeruginosa
tcgatccggcgcagacccgcgaggtgctcgccctggcgctttccgccgccctcaacgcccccatcgagccgaccgccttcggcgtgttccgcatgtgacgagcagaccagcatgagcgaattccagaccatccagcttgagatcgacccgcgcggcgtagccaccctgtggctagaccgggcggaaaagaacaacgccttcaatgccgtcgtgatcgacgaactgttgcaggccatcgatcgcgtcggcagcgacccgcaggtccgcctgctggtgctgcgcggccgtggccggcacttttgcggcggtgccgacctggcctggatgcagcagtcggtggacctcgactaccagggcaacctggccgacgcccagcgcatcgccgaactcatgacccatctctacaacctgcccaagccgaccctggcggtggtccagggcgcggtgttcggcggcggggtcggcctggtcagttgctgcgatatggccatcggcagcgacgacgcgaccttctgcctgtccgaggtacgcatcggcctgatcccggcgaccatcgccccgttcgtggtcaaggccatcggccagcgcgccgcgcggcgctattcgctgaccgccgagcgcttcgacggacgccgcgccagcgaactgggcctgctcagcgaaagctgtcccgccgccgaactggaaagccaggccgaggcctggatcgccaacctgctgcaaaacagcccgcgcgccctggtcgcctgcaaggcgctctaccatgaggtcgaggccgccgagctgagcccggcgctgcgccgctacaccgaggcggccatcgcccgcatccgcatcagcccggaaggccaggaaggcctgcgcgccttcctggagaaacgcacgcccgcctggagaaacgacgcatga

SEQ ID NO: 11392 - DNA, 810 bp, Pseudomonas aeruginosa
cctgagcgccgccggcctggactacatcgaagtgggcagcttcgtctcgcccaagtgggtgccgcagatggccggctcggccgaggtattcgccggcatccgccagcgtcccggcgtgacctacgcggcgctggcgccgaacctgaaaggcttcgaggcggcgctggagtcgggagtgaaggaagtggcggtgttcgccgccgcgtcggaagccttctcccagcgcaacatcaactgctcgatcaaggacagcctggagcgcttcgtaccggtgctggaggcggcgcgccagcaccaggtgcgggtgcgcggctacatttcctgcgtgctcggctgtccctacgacggcgatgtcgatccgcgccaggtcgcctgggtcgcccgcgaactgcagcagatgggctgctacgaggtgtccctgggcgacaccatcggcgtcggcaccgccggcgccacccgccggctgatcgaggcggtggccagcgaggttccccgcgagcgcctcgccgggcacttccacgacacctacgggcaagccctggcgaacatctacgccagcctgctggaaggcatcgcggtattcgacagctcggtggccggcctcggcggttgtccctacgccaagggcgccaccggcaacgtcgccagcgaagacgtcctctacctgctgaacggcctggagatccataccggggtcgacatgcacgccctggtcgacgccggccagcgtatctgcgcggtgctcggcaagagcaacgggtcgcgagcggcgaaagcgttgctggccaaggcctgagaagcggcggataa

SEQ ID NO: 11393 - DNA, 447 bp, Pseudomonas aeruginosa
ccgcgagcggttatccgccctacccgacgtcgcgcccaggctcggagactgcgtcatccaccctgggtgccgtcataccccatccgccaactgatagcccgagtcgtcgcaagcagccgttccgccgctggcccctgctcctcggcctggaagatgctcgccgggccgaccaccgtgagcaccgccgccacccgcccgcgggcgtcgaacaccggtgccgagagcgcctccaccccaggcatcagcagcccatggatcgcatgcaggccgcgcgcgcggatgcctccaggagcaccgcgtaggccgccgggtcggccagcggatggtcggcacgcccggccaactcttcctcgcgcagctcggccacctcgcgttccggcaggaacgcggcgaacaccaggccggtggacgaaccgagcagcggcagcaccgagccgacctgggtga

SEQ ID NO: 11394 - DNA, 2148 bp, Pseudomonas aeruginosa
gcgcccacggcccggacgcggaaagctgcgacaaggccatcgccgccgacctcaagccgcacaggatcgaccagaccatggccttcatgttcgagaccagccaggtcctccggccgagccgtgccgccctcgagacgccggccctgcagaatgactacgatgcctgctgggcgtcgctcgtatccaccttcaacccgcaacggagataaccccatgaaccagccaacccccactcgtagctgggtcgcctccgccaatgggcatgccgactttcccctgcaaaacctgccgctgggcatcttcagccgtgccggcctgagcccgcgttgcggcgtggccatcggcgactcgatcctagacctggacgcggcgctggccgccgggctgttcgagggtgccgccggcgaagccgccgaagccacccgcggcggcgcgctgaacgccttcttcgccctcggcaagccggcccgcgtggcgctgcgccagcgcctgctggagctgctcggcgaaggcgccgcggagcgcccggaactgctccatccggccgccgagtgccaaatgcacctaccggccaggatcggcgactacaccgacttctacgtcggcatccgccatgccgagaacgtcggcaagctgttccgcccggacaacccgctgctgcccaactacaagcacgtgcccatcggctaccacggccgcgcctcgaccgtgcgcgtctccggcagcgaagtgcgccggcccaacggccagaccctgccggccggcgccagcgagccggtgttcggtccctgtgcgcgtctggactacgaactggagctaggcatctggatcggccagggcaacgccctcggcgaagccatcccggtttcccgcgccgccgagcacatcgccggcttctgtctgctcaacgactggtcggcgcgcgacatccaggcctgggaataccagccgctcggcccgttcctgtcgaagagcttcatcaccagcgtttcgccctgggtggtcaccgccgaagccctggagccgttccgccgcgcccagccagcgcgccccgaaggcgacccgcggccgctgccgtatctttacgacgacaacgaccaggcccacggcgccttcgacatcgagctggaggtcctgctgctcaccgagggcctgcgcgagaaaggcctgccgccgcagcgcctgaccctgagcaacagcctgagcatgtactggacggtggcgcagatggtcgcccaccacagcgtcaatggctgccagttgcagcccggcgacctgttcggctccggcaccctgtccggcgccgagcccggccagttcggctcgctgctggagatcaccgctggcggcaagcagccggtgcaactgcctcccggcgagacccggcgtttcttggaggacggagacgaggtcatcctccggcccccgctgcaagcgcgagggacatgtttcgatcggtttcggcgaatgtcgcggcaaagtgctcgcggcccatccgggggcgcgcggatgaagctctatacctactaccgttccacctcctcctaccgggtgcgcatcgccctggcgctgaaggggctggactaccagtcgctgccggtcaacctggtccgcgacggcggcgaacaccgccaacccgcctacctggcgctcaacccgcagggccgcgtaccggccctgcaggtcgacgagggcgagctgctgatccagtcgccggcgatcatcgagtacctcgaggagcgctacccgcaccccgccctgctctccagcgatccgctgcgccgcgcccacgagcgcggagtcgcggcgctggtcggctgcgacatccacccgttgcacaacgccagcgtgctcaacctgctgcgccagtggggacacgacgaagagcaggtccggcagtggatcggccactgggtcggccagggtctcgccgccgtcgagcaactgatcggcgaccaggattggtgcttcggcgaccggccaggcctggccgacgtctacctggtcccgcagctctacgccgccgagcgcttcggcgtggcgctggacgcctggccacggatccgccgggtcgccgacctggccgccgcccatccggcgttccgccaggcccatccggccaaccagccggacaccccggccgcctga

SEQ ID NO: 11395 - DNA, 1407 bp, Pseudomonas aeruginosa
aggggggcgtccgccggacgccccatcaccaataagaacctcaggtaccttgcgatgcacaaccagatcgccagctttcgcgcggcgctcgacgcgcgccccgtgtcccgctaccagtggctgttgctgctgctcctcgccctgttgctggtcaccgatggctacgatgcccaggtgctcggctacgtggtgccgaccctggcccaggaatggggcctggacaaggccgcgttcggcccggtgttcagcgccaacctgttcggcctgaccgtcggttcgctgctggtgacgccgctggcggaccgcttcggcatccgccgagtgctgctctgctgcgtgctgatctacgccagcctgaccgtcctgatggtcttcgccggttccctggaaagcctgatgctggcgcgcttcgtctgcggcatcggaatgggcggggcgatgcccagcgccatggcgctgatggccgagtattcgccaccgcgcctgcgtaccctgatggtcaccctggcggcctgcggtttctccttcggcggcgccgccggcggtttcgtcgccgccgccttcatggacggcttcggctggcaggcggtgttcctcgccggcggcgtcaccccgttgctgctgttccccttcctcctcctgttcctgccggagtcgctgccgcgcctgctccgcgacgcaccgccctatgcccgcctacgccagctcagcgagcgcatggcgccgggctggcagccgccgccggcacaagccgacgccgagccggcggcgagcctgaccgtgctggagctgttccgccacggttacgcgcggccgaccctgctgctctgggcgaccttcttcgtcagcctgatcctgctctacttcatggtcagctggctgccctcgctgctccaggaaagcggcctgacacgcaatgcggcgaacctggcgacctcgatgttcctcttcgccggcaccctcggcgcgatgctcctggcctggctcgccgaccgcctgcgcagcaaggtccgcctgctggcggcgattctcgccggcgccgcgctgttcaccctgctcctcggcctcaaccacgaccagccgcgctggctgctggcgttcgtcttcgccgccggcttctgcatcatcggcgggcagttgaccctgaacgccttcgccagcaacttctacccggcccaggtacgcgccaccggcaccggctgggcgctgggcgtgggccgcttcggttcgatcctcggcccactgttcggcagcctgctgctgggcatgcacatatccgtggagaacatcttcatgcttgcggcgattcccgccgggctcgccgcgctactgatcctccaggtccgctcgcccgccgcccaggcgcagcgggaaagcgccgccgcgctggccgtcgaggaatcctga

SEQ ID NO: 11396 - DNA, 225 bp, Pseudomonas aeruginosa
acgccgcggcgatcccggaaagcctgctggaggccgaattgttcggtaccgccccgggggccttcaccggtgccgagcgcaagggccggccaggcaagttgcaggtggcccagggcggcacgttgttcctcgacgagatcggcgacatgccgctggccttgcaaggcaagctgttgcgcgtgctacaggagaaagagttcgaagcggtgggttccaacgaagtga

SEQ ID NO: 11397 - DNA, 1665 bp, Pseudomonas aeruginosa
agacgaactgagatctgcatagccacggaactttcgctcgattacgtctccattttgagacaacgctattccccacgctccccttcgtctcgccgcagcccgcgaaaaccgcgattctggggcctggcacggttatcgcaatgtgcctttccgacggccctgccccgttccaggccgtcacgccggtgcccgcaccgttcgacaacaagaaacaggcccggagcgcccttccccatgcggagcgcgccccgcagcgccgtggagatatgcccgatgagcgtgatcatcgcccttgccgccctgggcctgctgatgctggccgcctaccgcggctacagcgtcatcctgttcgcccccctcgccgccctcggcgccgtcctgctcaccgatcccagcgcggtcgcgccgaccttcaccggggtgttcatggagaagatggtcggtttcatcaagctctacttcccggttttcctgcttggcgcggtgttcggcaagctgatcgagctggccggcttctcccgctccatcgtcgcggcggcgatccgcctgctcggcacccgccaggcgatgctggcgatcgtactggtctgcgcgctgctcacctacggcggcgtctcgctgttcgtggtggtgttcgcggtctacccgttcgccgcggagatgttccgccagagcgacatccccaagcgattgattccggcgaccatcgccctcggcgcgttttccttcaccatggacgcgctgcccggcaccccgcagatccagaacatcatcccctcgaccttcttcggcacccacgcctgggccgcgccctggctcgggaccctcggcgcgctgttcgtcttcgccgtgggcctgctctacctgcgacgccaggcgaacaaggcgcggcgcaacggcgaaggctacggcagcgacctgcgcaacgagccggagaccgccgatgacctgcgcctgccgaatccctggctggcgctctcgccgctggtgctggtcggggtcgccaacctgctgttcacccactggatcccgcaatggtacggccaggtccataccctgcaactggccggcatggccacgccgttgcagaccgaggtcggcaagctcaccgcgatctgggcagtgcaggcggccctgctgctgggcatcctgctggtgctggcgagcggtttcgcggcgatccgcagccgcctcgccgaaggcacccgcagcgcggtggccggctcgctgctggcggcgatgaacaccgcctcggaatacggcttcggcgcggtgatcgcctcgctgccgggtttcctggtgctggccgacgcgctcaagagcattcccaatccgctggtcaaggaagcgatcaccgtcaccctgctggccggcatcaccggttccgcgtcgggcggcatgagcatcgccctggcggcgatgtccgataccttcatcgccgccgccaacgccgcgcagatccccctggaagtcctccaccgggtcgccgccatggccagcggagggatggataccctgccgcacaacggcgcggtgatcaccctcctggcggtcaccggcctgacccatcgggaggcgtacaaggacattttcggtattaccctgatcaagaccctggcggtgttcttcgtcatcgggctgttctacgccaccggcctggtctga

SEQ ID NO: 11398 - DNA, 888 bp, Pseudomonas aeruginosa
tccgcccttttttcatccagcgggagaaacagcatgaccctgaaaggcaagaccgccctggtcaccggttccaccagcggcatcggcctgggcatcgccctgagcctggccgaggccggcgccgacctgctcctcaacggcttcggcgaggtcgacgcggcgctggcgcaggtccgcgcccgcggcgtgcgcgcagagcaccacccggccgacctctccagcccggagcagatcggcgaactgatggccttcgccgagcggaccttcggcggcgtcgacatcctcgtcaacaacgccggcatccagtacgtggcgccggtgcaggaattccccacggaacgctgggacgcgatcatcgcgatcaacctgtcccccgtgttccataccacccgcctggccctgccgggcatgctcgcgcgcggctgggggcggatcgtcaacatcgcctcgacccacggcctggtcgccttcgcgccgggaagagcgcatacgtcgccgccaagcatggcgtgcctccggcctgaccaagagtgtggcgctggaaacggcgcgcacgccggtgacctgcaacgccatctgccccggctgggtgctgaccccgctggtgcagaagcagatcgacgcgcgcatcgccgagggcgtctcgcccgaacaggcggaacacgacctgctggcggaaaagcaaccctcgctggccttcgtcacccccgagcaactcggcggactgacgctgttcctttgcagcgaagccgccgaccaggtgcgcggcgcggcctggaacatggatggcggctgggtggcgcagtagccggggcggccagcctctccccagaccctctccctgaagggagagggaaccatccggagttcgcccgccccattgcgtag

SEQ ID NO: 11399 - DNA, 1740 bp, Pseudomonas aeruginosa
actcgcgaagaaaggtcgcttggcgctggcgcgctttgggccgaatatcggggcaaccacaacgtgcgcagcgaggccctcatgtccgactcccttccccagcgcaacggcgggcagatcctggtagaggcattgcggcgcaatgccgtcgataccgtctactgcatccccggggaaagctacctgccggtgctcgatgcgctgcacgacgccaacggcatccgcaccatcgtcacccgccacgagggtgccgcctcgaacatggccgatgcctacggcaagctgaccggccgaccaggcatctgcttcgtcacccgcggccccggtgccacccatgcggcgaatggcgtgcacacggcgcagcaggactcgacgccgatgatcctgttcgtcggccaggtggaaagcgccttcaagggccgcgaggcgttccaggaagtcgactacgtgcagatgttctcgggcctggccaagtgggccgtggaaatcgaccgtatcgaacgcatcccggagatcgtcggccgcgccttcagcgtcgccacctcgggccgaccgggcccggtcgtggtcgccctgcccgaggaaatcctcttcggtttcgcgcaggtcgccgatgcgccggagccaagggtgcttccggggcggccgggcgccacggcgatggcggaactgcgcgaactgctggcgaacgccaggcgccccctgctggtacttggcggcagcggctgggacagtgccgccaggaaacggctaggcgccttcgtcgaggccaatggcctgccggtggccacctcgttccgtcgccaggacctgttcgacaaccgtgacccgcactacgccggacaactgggcttcggcgcggcgccggcgctattggagcggctgcgccaggccgacctgctgctggtggtcggggcgcgcctgggcgaaacgccgagcgctggctacagcctggtgcgtagtccggcccccgcgcagacgctgatccacgtgcatccggacagcgcggaactgaaccgcgtctacctggcgcgactgccgatccaggccaccccgtgtgccttcgccgaggccctggccgacctcgcgccgttgccctcgagcacctggcaggactggcgcgaagccgcccatgccgattacctggcctactcgaccccggccgcgagcgaccccgccgtccagggcgtcgacctggcgtccgtggtcgcgtacctcagcgaaaacctgccggacgacgcggtgatcgccaacggtgccggcaactatgccgtctgggtgcatcgcttctaccgctatcgccaggcccgcacgcagttggcgccgaccaacggcgccatgggctacggcctgcccgccgcgatcgccgccagcctgcgcgatccgcagcgcagcgtggtgtgcttcgccggcgacggctgtttcatgatgtatccgcaggagctggcgaccgccgcgcagttcggcgcgacgccggtggtgatcgtggtcaacaacggcatgctcggcaccatccgcatgcatcaggagcgcgaatatcccgggcgggtatccgccacccgcctggacaaccccgacttcgtcgccctggcgcgagccttcggcgcccacgccgaacgagtggaatgcagcgccgacttccccgccgcattccgccgcgcccgcgaaagcggacgcccggcgctgctggagctgctgaccgacccacgccagatcacgccgcaggcgcgcctcgcctga

SEQ ID NO: 11400 - DNA, 549 bp, Pseudomonas aeruginosa
ggcatcctcagccggcgcggaaggcgatccaggcctggtagcccacggcctggaaatagcggctgggcaggacgaagccggtgtcttccagcagttcgccgaggcgctgctcggacaacggatcgaaatcctcgcgcaagcgttgcagcatgccgtcgctgtcctccggggaaagcccggccaagcggcaggcctcggcctgcaccggacgttcgaaggcgtcccgggcttccatcaggttggccagcagcaacggcgccgctggcgccagacgctcggcgaccgcctcgagaaagcgccgcttggcctggtcgccgcgcaggaaatgcagcaccagcaggaccagcgccgcatcgcaaggcggcgcaggcggtagcccggcgacgtcgccgcagtgcagctcgatccgctccagcaggccgagcctggcgcagcgctggcgggccagggcgagcatgtcggccgacaggtccgccgcgacgaaacgccagcctggacgcaacccggccagctccgccagttcgccgccggcgccgcagccgacgctga

SEQ ID NO: 11401 - DNA, 669 bp, Pseudomonas aeruginosa
gcgaaagcgggaccggtacagatggtggcgaaatccaccattcaggccggggagcgcttgatctgtatgcagtcaacccaccttttctggacctgtacggaacagcgcgcgatggccattctatctccgtcgtccagccgatcaatatggagtacgcagcatgacgcgactcagtgcgaaatccgagcgccgccaacgcctcgatggccccttcccactcgccgcgatggacaacctggcgcaggccctgcgtcgcggctatcgcctggcccggcaacgccagctgacccggcgcgcgctgctggacctggaagcggcggaactgaaggatatcggcctgagcgccgagcaggcccacgaggaagcctcgctggcgttctggcaggcaggaaaatccggcgggaggaaggcatgatccgctgtcgcaactgtggcgaacgcccagccagcgaagggcatatctgtatggtctgcaagcgccgatccgacatcgacccatacaaggcgctgatcgccatggccctgctggtctactgcggcgtcagcctggcggcctacctcaagccgcatatgccggcaccgccgcctaccgccggcagcagcgtccagcccgccgaggagctggcccagcgcgcccgccaggccaccctggaacagcgcggcatctga

SEQ ID NO: 11402 - DNA, 1053 bp, Pseudomonas aeruginosa
cttcaccctggcgctgatcgccaccgtccttctcgccactttcctgccctgcagcggccagaccgccgtggtcttcgaatgggtgaccaacatcggcatcggcctgctgttcttcctccacggcgccaagctgtcgcgccaggcgatcatcgccggcatgacccactggcgcctgcacctgctggtgttcgcctgcaccttcgtgatgttcccgctgctcggcctggcgctgaaaccggcactgtcgccgatggtcaccccggagctgtacctcggcatcctgttcctctgcgccctgccggccacggtgcaatcctccatcgccttcacctcgctggcgcgcggcaacgtgccggcagcggtatgcagcgcttccgtgtcgagcctgctcggcgtattccttaccccgctgctggtcaagctgctgctcggcgccgaaggcgagaccggcaacgcgctggacgccatcggcaagatcaccctgcaactgctggtacccttcatcgctggccaggtcctgcggcgctggatcggcacctgggtggagcgcaacaagccggtgctgcgctatgtcgaccagggctcgatcctgctggtggtctacaccgccttcagcgccgcggtgatccagggcctgtggcacgaagtaccctggctggcgctgctcggcctgaccgtcgcctgctgcgtgatcctcgccctggccctggtgctgaccacggtgctggcgcgacgcctgggcttcagcaaggaagacgagatcaccatcgtcttctgcggttcgaagaagagcctggccaccggcgtgcccatggccaaggtgctgttcgccaccagtgcggtggggccgatggtgttgcctctgatgctgttccaccagatccagctgatggtctgcgcggtgctcgcgcaacgctacgccaggcgccgcgacgacgcagcggcggcgctggccgaggccccctcgcgctgagcgcgaaaatgaaagaagccggcccaggggccggcttcttcgttcagacgcggctcagcgcgtcggcgtgcgcagggtga

SEQ ID NO: 11403 - DNA, 1653 bp, Pseudomonas aeruginosa
cccattcaccagcgtcggctcccgccggatcgacgcagaaacctgtcgaaacggctcagcgcagggcctggcaggcgatgggctatgcttgtccgtggaggtaagcgcgatgtcccccaccctcacccacctggcgctgcacgtccccgacctcgacgcctgcatcgccttctacgaaaccttctgcggcatgcgggtgatccaccggcgccccggcaaaggctcgcagatcgtctggatggccgaacccggccaggaacaacgcttcatcttcgtcatcatgcccggcggccagccgcgcaacctggccagcgacgattacagtcatttcggcttcgccctctccagccgcgccgcggtagacgatctggcgcgccgcgccgaggccgccggctgcctggtctgggcgccgcgcgacgagccctatccggtcggctactactgcggcctgcgcgatcccgcgggcaactatgtggagttcagctacggccagccgctgggcccgggttccgaggcgctgccgattccctgaccgggcacggaggcgccgcgtggcccgggccaggctggcggggttattcgcccgacgccaacaacgccacgcccgccgacagttcaggtagggcggatacccccatggccgttcgccccatacgaaaaacgccgcgcccccatcggggacgcggcgttcttcatcgggaacggcgaggctcagtgagccttgccggtcttgtagaggttttcgtagcagaagttggtcgcctcgatgtagccctcggcgctgccgcagtcgaaacgcttgcccttgaacttgtaggccagcacgcagccgtcctgggcctgcttcatcagggcatcggtgatctggatctcgccgcccttgcccggttcagtctgctcgatcaggtcgaagatgtccggggtcaggatgtagcggccgatgatcgccaggttcgacggcgcctcttccggcttcggcttctcgaccatggtgttcacccggaagatatcgtcgcggatcatctcgccggcgatcacgccgtacttgttggtctcttccggcggcacttcctggatcgccacgatggagcagcggaactggttgtacagcttgaccatctgcttcagcacgctgtcgccttcgaggttcaggcacaggtcgtcggccaggaccacggcgaacggctcgtcgccgatcagcggacgaccggtgaggatggcgtggccgaggcccttcatctccacctggcgggtgtaggcgaaggtgcactcgtcgatcagccgacggatgccgaccaggtacttttccttgtcggtgttgcggatctggtgttccagctcgtagctgatgtcgaagtggtcttccagcgaacgcttgccgcggccggtgacgatgccgatctcggaaaggccggcttccagcgcctcctccaccgcgtactggatcagcggcttgttcaccaccggcagcatttccttgggcatggccttggtggccgggaggaaacgagtgccgtaaccggcggccgggaaaagacatttcttgatcatgagaatccttcgacatggacgaagtatgcggatggcgcgcagtctaatcaggctgcgctcgccttacaatgcccggcccttggacgtcctatgccctggtag

SEQ ID NO: 11404 - DNA, 1245 bp, Pseudomonas aeruginosa
gttgcggtgccctttcccgggcaagctcgcgagttcacgaatcgagggacacccatgcacatccaatggaccggctcgctgcgcgggctgctggcggccctggtcgccctattcctgctgggctgcgaagaagcagcggacgccgggaagactgcggaggcccccgccgaggtcggcgtgatcgtcgccaggccggcgcctatcggcatcaccagcgagctgcccggacgcctggaagcgtaccgccaggctgaagtgcgggcgcgcgtcgccggcatcgtcacccgtcgcctgtacgaggaaggccaggacgtccgcgccggcaccgtgctgttccagatcgaccctgcgcccttgaaggcggccctggacatcagccgcggcgccctggcccgggccgaggccagccacgcggcggcggccgacaagctcaagcgctacgccgacctgatcaaggaccgcgccatcagcgaacgcgagtacaccgaagcgcagaccgacgcgcgccaggccctggcgcagatcgcctcggccaaggccgaactggagcaggcccgcctgcgcctgggctacgccacggtcaccgcgccgatcgacggccgcgcgcggcgcgcgctggtcaccgaaggcgcgctggtcggcgaggactcgccgacacctctgacccgcgtcgagcagatcgatccgatctacgtgaacttctcccagccggccggcgaagtcgccgccatgcagcgggcgatccgcgaaggccaggtgaagggtgtcgccgacaaggacatcgccgtgcgcctggtcctggccgacggcagcgagtacccgctggccggcgagctgctgttctccgacctggcggtcgaccccggcaccgacaccatcgccatgcgtgccctgttccgcaatccgcatcgcgaattgctgcccggcggctacgtgcaggtgcgcctgcagcgcgcggtgaacccgcaggcgatcaccgtcccgcgcgacgcgctgatccgtaccgcccagtccgccgtggtcaaggtggtcaacccacagggcttggtggaagacgtggaggtccgcgccgacaccctgcagggccgcgactggatcatcagcagcgggctcaagggcggcgagcgtgtgatcgtcgagaacgccgcccagcatgccgccggctccagcgtccaggcggtggtccgccagccggccagcgccgacgccccctcaccgctggccgcctcgccggcgggccagtga

SEQ ID NO: 11405 - DNA, 3372 bp, Pseudomonas aeruginosa
cggagaacgctacgaatggctcgtttcttcattgaccggccggtcttcgcctgggtgatctccctgctgatcgtgctcgccggggtcctggcgatccgcttcctgccggtcgcccagtacccggacatcgcgccgccggtggtcaacgtcagcgccagctatcccggcgcctcggccaaggtggtcgaggaagcggtgaccgcgatcatcgagcgcgagatgaacggcgcgcccggcctgctctacaccaaggccaccagcagcaccggccaggcctcgctgaccctgaccttccgccagggcgtgaacgccgacctcgccgcggtggaagtgcagaaccgcctgaagatcgtcgagtcgcgcctgcccgaatcggtgcggcgcgacggcatctacgtggagaaggcggcggacagcatccagctgatcgttacccttacctcctccagcggccgctacgacgccatggacctgggcgagatcgcctcgtccaacgtgttgcaggcgctgcgccgggtggagggcgtgggcaaggtcgagacctggggcgccgagtacgccatgcgcatctggcccgacccggccaagctgacctcgatgaacctcagcgccagcgacctggtcaacgccgtgcgccggcacaacgcccgcctcaccgtgggcgacatcggcaacctcggggtccccgactcggcgccgatcagcgccacggtgaaggtcgacgacaccctggtgacgcccgagcagttcggcgaaattccgctgcgcatccgcgccgacggcggcgcgatccgcctgcgcgacgtggcccgcgtcgagttcggccagagcgagtacggcttcgtctcgcgggtcaaccagatgaccgccaccggcctggcggtgaagatggcgcccggctccaacgcggtggccaccgccaagcgcatccgcgccaccctcgacgagctgtcgcgctacttcccggagggcgtgagctacaacatcccctatgacacctcggcgttcgtcgagatctcgatcaggaaggtggtcagcaccctgctcgaggcgatgctgctggtgttcgccgtgatgtacctgttcatgcagaacttccgcgccaccctgatcccgacactggtggtgccggtggccctgctgggcaccttcacggtgatgctcggcctgggcttctcgatcaacgtgctgaccatgttcggcatggtcctggcgatcggcatcctggtggacgacgcgatcatcgtggtggagaacgtcgagcggctgatggccgaggaaggcctgtcgccgcacgacgccacggtcaaggcgatgcgccagatcagcggggccatcgtcggcatcaccgtggtgctggtctcggtgttcgtgccgatggcgttcttcagcggcgcggtgggcaacatctaccgccagttcgcggtgaccctggcggtctccatcggcttctcggcgttcctcgcgctgtcgctgaccccggccctgtgcgccaccctgctgcgcccgatcgacgccgaccaccatgagaagcgcggcttcttcggctggttcaaccgcgccttcctgcgcctgaccggacgctaccgcaacgcggtggccggcatcctcgcccggccgatccgctggatgctggtctacgccctggtcatcggcgtggtcgccctgctcttcgtgcgcctgccgcaggcgttcctgccggaagaggaccagggcgacttcatgatcatggtgatgcagcccgaaggcacgccgatggcggagaccatggccaacgtcggcgacgtcgagcgctacctggcggagcacgaaccggtggcctacgcctatgcggtcggcggcttcagcctgtacggcgacggcaccagctcggcgatgatcttcgccaccctgaaggactggtcggaacgccgggaggccagccagcacgtcggcgccatcgtcgagcgcatcaaccagcgcttcgccggcctgcccaaccgtacggtgtatgcgatgaactcgccgccgctgccggacctgggttccaccagcggcttcgacttccgcctgcaggaccgtggcggggttggctacgaggccctggtcaaggcccgcgaccagttgctggcgcgcgccgccgaggacccgcgtctggccaacgtgatgttcgccggccagggcgaggcgccgcagatccgcctggacatcgaccggcgcaaggcggagaccctcggcgtgagcatggacgagatcaacaccaccctggcggtgatgttcggctcggactacatcggcgacttcatgcacggcagccaggtgcgcaaggtggtggtccaggccgacggcgccaagcgcctgggcatcgacgacatcggccggcttcacgtgcgcaacgagcagggcgagatggtgccgctggcgacgttcgccaaggccgcctggaccctcggcccgccgcaactgacccgctacaacggatatccctcgttcaacctcgagggccaggccgcgccgggctacagcagcggcgaagccatgcaggcgatggagcaattgatgcagggactgcccgagggcatcgcccacgagtggtccggccagtccttcgaagaacgcctgtccggcgcccaggcgccggcgctgttcgccctctcggtgttgatcgtgttcctcgccctggccgccctctacgaaagctggtcgatcccgctggcggtgatcctggtggtgccgttgggcgtactcggcgcactgctcggggtgagcctgcgcggtctgcccaacgacatgtacttcaaggtcggcctgatcaccatcatcggcctctcggcgaagaacgccatcctcatcatcgaggtggccaaggaccattaccaggaaggcatgagcctgctgcaggcgacccctggaggccgcgcgcctgcgcctgcgaccgatcgtcatgacctcgctggcgttcggtttcggcgtggtcccgctggcgctctccagcggcgccggttccggcgcccaggtcgccatcggcaccggggtgctcggcgggatcgtcaccgccacggtactcgcggtgttcctggtaccgctgttcttcctggtggtcgggcgcctgttccggttgcgcaaggcgccgcgcaccggcaactcgccccagatccccacggagcaagcctgatgcccctagcgaaactctcgctccccaccctggcactgtgcgtcgggctgctcggcgcctgctcgccgacgcctcgccagccgcgcgcggcccccatcgttccggccaacggccccgaccttcggggcaagctggacgactggcaacagcagttcaccgacccgctgctgcgacagatgatcggctacgcgccggcgctatccggcgcgcaagcctga

SEQ ID NO: 11406 - DNA, 387 bp, Pseudomonas aeruginosa
cctatcccagcctcaacttcgccctcggcgaaaccatcgacatgctccgcgaccaggtgcgcggcttcgtcgccgccgaactgcagccgcgcgccgcgcagatcgaccaggacaatcagttccccatggacatgtggcgcaagttcggcgagatgggcctgctcggcatcaccgtcgacgaggagtacggcggttcggcgctgggctacctggcccacgccgtggtcatggaagagatcagccgggcctcggcctcggtggcgctctcctatggcgcgcattccaacctctgcgtcaaccagatcaagcgcaacggcaacgccgaacagaaggcccgctacctgccggccctggtatccggcgaacacatcggtgcgctggcgatga

SEQ ID NO: 11407 - DNA, 633 bp, Pseudomonas aeruginosa
cgccgcccaggcccggcacagcgcgcgcggcaagctgctggtgcgcgaacgcatcaaccgcctgctcgaccccggctcgccgttcctcgagctttccgccctcgccgcccacgaagtctacggcgaagaggtcgccgccgccggcatcgtcgccgggatcggccgggtcgaaggggtggaatgcatgatcgtcggcaacgatgccacggtgaagggcggcacctactatccgctgaccgtgaagaagcacctgcgggcccaggccatcgccctggagaaccgcctgccatgcatctacctggtggactctggcggcgccaacctgccgcgccaggacgaggtgttccccgaccgcgagcacttcggccggatcttcttcaaccaggccaacatgagtgcccgcggcatcccgcagatcgccgtggtcatgggctcctgcaccgccggcggggcctacgtgccggcgatgtccgacgaaaccgtgatggtgcgcgaacaggccaccatcttcctcgccgggccgccgctggtgaaggccgctaccggcgaggtggtcagcgccgaggaacttggcggcgccgacgtgcactgcaaggtctcaggggtcgccgaccactatgccgaggacgatga

SEQ ID NO: 11408 - DNA, 867 bp, Pseudomonas aeruginosa
ccatgccctggccatcgcccgccgctgcgtcgccaacctcaactggcgcaagcagggccagctgcaatgccgtgcaccgcgcgcgccgctgtaccccgccgaggagctgtacggggtgattcccgccgacagcaagcagccctacgacgtgcgcgaagtgatcgcacggctggtggacggctccgagttcgacgaattcaaggcgctgttcggcaccaccctggtctgcggcttcgcccacctgcacggctatccgatcgccatcctggccaacaacgggatcctcttcgccgaggccgcgcagaaaggcgcgcacttcatcgagttggcctgccagcgtggcatcccgctgctgttcctgcagaacatcaccggtttcatggtcggccagaagtacgaggctggcggcatcgccaagcacggcgccaagctggtgaccgcggtggcctgcgcgcgggtgccgaagttcaccgtgctgatcggcggcagcttcggcgccggcaactacggcatgtgcggacgcgcctacgacccgcgcttcctgtggatgtggccgaacgcgaggatcggcgtgatgggcggcgaacaggccgccggggtgctcgcccaggtcaagcgcgagcaggccgagcgcgccggccagcagctcggcgtcgaagaggaggcgaagatcaaggcgccgatcctcgagcagtacgagcaccagggccatccctactactccagcgcgcgactgtgggacgacggcgtgatcgatccggcgcagacccgcgaggtgctcgccctggcgctttccgccgccctcaacgcccccatcgagccgaccgccttcggcgtgttccgcatgtgacgagcagaccagcatga

SEQ ID NO: 11409 - DNA, 3009 bp, Pseudomonas aeruginosa
gcccggcgctgcgccgctacaccgaggcggccatcgcccgcatccgcatcagcccggaaggccaggaaggcctgcgcgccttcctggagaaacgcacgcccgcctggagaaacgacgcatgaacccggactaccgcagcatccagcgcctcctggtcgccaaccgcggcgagatcgcctgccgggtgatgcgcagcgcgcgcgccctcggcatcggcagcgtcgccgtgcacagcgacatcgaccgccacgcccgccacgtcgccgaagccgacatcgccgtcgacctgggcggcgccaagcccgccgacagctacctgcgcggcgacaggatcatcgcagctgccctcgccagcggcgcccaggcgatccaccccggctacggcttcctctcggagaacgccgacttcgcccgcgcctgcgaggaagccggcctgctcttcctcggaccgccggcggcggccatcgacgccatgggcagcaagtcggccgccaaggcgctgatggaagaagccggcgtgccgctggtgcccggctatcacggcgaagcccaggacctcgagactttccgccgggaagccgggcgcatcggctacccggtgctgctcaaggccgccgctggcggcggcggcaagggcatgaaggtggtggagcgcgaggccgagctggccgaggccctttcctccgcccagcgcgaggccaaggccgccttcggcgacgcgcgtatgctggtggagaaatacctgctgaagccgcgccacgtggagatccaggtattcgccgaccgccatggccactgcctgtacctcaacgaacgcgactgttcgatccagcgccgccaccagaaggtcgtcgaggaagcccccgcccccggtctcggcgcggaactgcgccgggccatgggcgaggccgcggtacgcgcggcgcaggcgatcggctacgtcggcgccggtaccgtcgaattcctcctcgacgaacgcggccagttcttcttcatggaaatgaacacccgcctgcaggtggaacacccggtcaccgaggccatcaccggcctcgacctggtcgcctggcagatccgcgtcgctcgcggcgaggcgctaccgctgacgcaggaacaggtaccgctgaacggccacgccatcgaagtacggctctatgcggaagaccccgagggcgacttcctccccgccagcggccgcctgatgctataccgcgaagcggccgccggccccggccggcgggtcgacagcggggtacgcgaaggcgacgaggtctcgccgttctacgacccgatgctggccaagctgatcgcctggggcgaaacccgcgaggaagcccgccagcgcctgctggcgatgctggcggaaacctcggtcggcggcctgcgcaccaacctggcgttcctccgccgcatcctcggccatccggcgttcgccgccgccgaactggacaccgggttcatcgcgcgccaccaagacgacctgctgccggcgccgcaagcgctgccggagcatttctggcaagccgccgccgaagcctggctgcagagcgaaccgggccaccgtcgcgacgacgacccgcattcgccgtggagccgcaacgacggctggcgcagcgccctggcgcgggagtccgacctgatgctgcgctgccgcgacgaacgccgctgcgtccgcctgcgccacgccagccccagccagtatcgcctcgacggcgacgacctggtcagccgggtggacggtgtcacccgtcgctcggcggcgttgcgccgcggacgccaattgttcctcgaatgggagggcgaactgctggccatcgaagccgtcgacccgatcgccgaggccgaggccgcccatgcccaccagggcggtttgagcgcgccgatgaacggcagtatcgtgcgggtcctggtcgagcccggccagacggtcgaagccggcgccaccctggtggtgctggaggcgatgaagatggaacacagcatccgcgcgccccacgccggggtagtgaaggcgctgtattgcagcgagggcgaactggtcgaggaaggcacgccgctggtggagctggacgagaaccaggcctgacagccaagacgaggaacagcatgaacctgccgaagaaggtccgcctggtggaggtcggtccgcgcgacggactgcagaacgagaaacagccgatcgaggtggccgacaagatccgcctggtcgatgacctgagcgccgccggcctggactacatcgaagtgggcagcttcgtctcgcccaagtgggtgccgcagatggccggctcggccgaggtattcgccggcatccgccagcgtcccggcgtgacctacgcggcgctggcgccgaacctgaaaggcttcgaggcggcgctggagtcgggagtgaaggaagtggcggtgttcgccgccgcgtcggaagccttctcccagcgcaacatcaactgctcgatcaaggacagcctggagcgcttcgtaccggtgctggaggcggcgcgccagcaccaggtgcgggtgcgcggctacatttcctgcgtgctcggctgtccctacgacggcgatgtcgatccgcgccaggtcgcctgggtcgcccgcgaactgcagcagatgggctgctacgaggtgtccctgggcgacaccatcggcgtcggcaccgccggcgccacccgccggctgatcgaggcggtggccagcgaggttccccgcgagcgcctcgccgggcacttccacgacacctacgggcaagccctggcgaacatctacgccagcctgctggaaggcatcgcggtattcgacagctcggtggccggcctcggcggttgtccctacgccaagggcgccaccggcaacgtcgccagcgaagacgtcctctacctgctgaacggcctggagatccataccggggtcgacatgcacgccctggtcgacgccggccagcgtatctgcgcggtgctcggcaagagcaacgggtcgcgagcggcgaaagcgttgctggccaaggcctga

SEQ ID NO: 11410 - DNA, 381 bp, Pseudomonas aeruginosa
acgccttcttcgccctcggcaagccggcccgcgtggcgctgcgccagcgcctgctggagctgctcggcgaaggcgccgcggagcgcccggaactgctccatccggccgccgagtgccaaatgcacctaccggccaggatcggcgactacaccgacttctacgtcggcatccgccatgccgagaacgtcggcaagctgttccgcccggacaacccgctgctgcccaactacaagcacgtgcccatcggctaccacggccgcgcctcgaccgtgcgcgtctccggcagcgaagtgcgccggcccaacggccagaccctgccggccggcgccagcgagccggtgttcggtccctgtgcgcgtctggactacgaactggagctag

SEQ ID NO: 11411 - DNA, 366 bp, Pseudomonas aeruginosa
gcatctggatcggccagggcaacgccctcggcgaagccatcccggtttcccgcgccgccgagcacatcgccggcttctgtctgctcaacgactggtcggcgcgcgacatccaggcctgggaataccagccgctcggcccgttcctgtcgaagagcttcatcaccagcgtttcgccctgggtggtcaccgccgaagccctggagccgttccgccgcgcccagccagcgcgccccgaaggcgacccgcggccgctgccgtatctttacgacgacaacgaccaggcccacggcgccttcgacatcgagctggaggtcctgctgctcaccgagggcctgcgcgagaaaggcctgccgccgcagcgcctga

SEQ ID NO: 11412 - DNA, 498 bp, Pseudomonas aeruginosa
tcggcgaccaggattggtgcttcggcgaccggccaggcctggccgacgtctacctggtcccgcagctctacgccgccgagcgcttcggcgtggcgctggacgcctggccacggatccgccgggtcgccgacctggccgccgcccatccggcgttccgccaggcccatccggccaaccagccggacaccccggccgcctgagggaccgcagagtcccgctcctgaagataaaggggggcgtccgccggacgccccatcaccaataagaacctcaggtaccttgcgatgcacaaccagatcgccagctttcgcgcggcgctcgacgcgcgccccgtgtcccgctaccagtggctgttgctgctgctcctcgccctgttgctggtcaccgatggctacgatgcccaggtgctcggctacgtggtgccgaccctggcccaggaatggggcctggacaaggccgcgttcggcccggtgttcagcgccaacctgttcggcctga

SEQ ID NO: 11413 - DNA, 471 bp, Pseudomonas aeruginosa
cctctactaccgactgaacgtcctgccgatcgagatcccgccgttgcgccagcgcctggacgacctcccggcgctctgcgagtcgatcctcgacagcctcgaccacggccgtctccacgaactcggcggcgacgccctggcgctgctcgcccggcatgcctggccgggcaacgtccgcgaactgcgcaacgtgctggaacgcgcgctgctgctggccgaccaaccgttgctggacgccgccgccctcggcgcggcgctgggccccctgcaaccgctgccggagctgcctcgagcggcggacgacaggccggtcggggatttccaacaggcccgcgaagccttcgagcgcgacctgatcggacgggccctggcgcagagtgccggcaatgtggtggaagcggcgaaacgcctgggcctgggtcgctcgaccctgtacaagaagatcatggcgctgggcatgcgtctcgataa

SEQ ID NO: 11414 - DNA, 549 bp, Pseudomonas aeruginosa
ttccggcgaccatcgccctcggcgcgttttccttcaccatggacgcgctgcccggcaccccgcagatccagaacatcatcccctcgaccttcttcggcacccacgcctgggccgcgccctggctcgggaccctcggcgcgctgttcgtcttcgccgtgggcctgctctacctgcgacgccaggcgaacaaggcgcggcgcaacggcgaaggctacggcagcgacctgcgcaacgagccggagaccgccgatgacctgcgcctgccgaatccctggctggcgctctcgccgctggtgctggtcggggtcgccaacctgctgttcacccactggatcccgcaatggtacggccaggtccataccctgcaactggccggcatggccacgccgttgcagaccgaggtcggcaagctcaccgcgatctgggcagtgcaggcggccctgctgctgggcatcctgctggtgctggcgagcggtttcgcggcgatccgcagccgcctcgccgaaggcacccgcagcgcggtggccggctcgctgctggcggcgatga

SEQ ID NO: 11415 - DNA, 564 bp, Pseudomonas aeruginosa
tggccttcgccgagcggaccttcggcggcgtcgacatcctcgtcaacaacgccggcatccagtacgtggcgccggtgcaggaattccccacggaacgctgggacgcgatcatcgcgatcaacctgtcccccgtgttccataccacccgcctggccctgccgggcatgctcgcgcgcggctgggggcggatcgtcaacatcgcctcgacccacggcctggtcgccttcgcgccgggaagagcgcatacgtcgccgccaagcatggcgtgcctccggcctgaccaagagtgtggcgctggaaacggcgcgcacgccggtgacctgcaacgccatctgccccggctgggtgctgaccccgctggtgcagaagcagatcgacgcgcgcatcgccgagggcgtctcgcccgaacaggcggaacacgacctgctggcggaaaagcaaccctcgctggccttcgtcacccccgagcaactcggcggactgacgctgttcctttgcagcgaagccgccgaccaggtgcgcggcgcggcctggaacatggatggcggctgggtggcgcagtag

SEQ ID NO: 11416 - DNA, 2028 bp, Pseudomonas aeruginosa
cggtcatcgcggattctctcggttttattgttattcggcgactacggggccgcctgtgtgtgctacggctccctgggcacccggccgtcccgaggggcggaacggtacggggccggtcggacggtcaaggccgtccgccgctcgttccctggacacgagcgcgccatgcccccgcgaaaggacatggcgcgatcacgccgcgagcggcaggtcgatggatcagtcgcgggccagggtcagggcgacgccctgcccgccgccgatgcacagggtggcgaggcccttcttcgcgtcgcgacggatcatctcgtgcagcagggtcaccagcacccggcagccggacgcgccgatcgggtggccaagggcgatggcgccgccgttgacgttgaccctggcggcatcccagcccagttcccggcccaccgccagggactgcgcggcgaaggcctcgttggcctcgatcaggtccagttgctccaggctccagccggccttgtcgagcgcgcgacgggtggcggagaccgggccgatgcccatgatcgccgggtcgaccccggcgctggcgtagctggcgatccgcgccagcaccggcaggcccagggccttggccttggccgcgctcatcagcaataccgcggcggcgccgtcgttgaggctggaggcgttgccggcggtgacgctgccgtccttcctgaaggccggcttgagcttggccagggcctcgacggtggtgccggcgcgcggctgctcgtcggtatcgaagctcagcggctcgcccttgcgctgcgggacctggatcggcgtgatctcgtcgcggaagcgcccgccctcgatggcggcgatggccttctgctgcgaagcggcggcgaaggcgtcctgctcctcgcgggtcaggccgtacttctccgccaggttctcggcggtgatgcccatgtggtagtcgttgaaggcgtcccacaggccgtcctcgatcatgctgtcgaccagcttcgcatggcccatgcgcaggccggtgcgggcgccgggcatgacgtagggcgccaggctcatgttctcctggccgccggcgacgatcacctcggcgtcgccgcagcggatcgcctgggcgcccaggtgcagggccttgaggccggagccgcagaccttgttcagggtcatggccggcacgccgaccggcaggccggccttgatcgccgcctggcgcgccgggttctgcccggacccggcggtgagcacctggccgaggatcacttcgtcgacctggccggcatcgagaccggtctgttcgagcaggcggcggatcaccgcggcgcccagctcgggggcgggaatgccggccagcgagccctggaagctgccgacggcggtacgggtagcggcgacgatgacgacgtcttgcatggatggttctcctggattcgcccgtggccgggccgaatcgctgcgggtggacgtagacggtgcgacagcctcctatcctacgccctctggaaaggacggtccgcgcgagtctactggctgatccccatctaccccacccggatgacccaacgtccccccctcggccggatcttccctcggttactgggattcgccgcgcactattgcactcgttattcccccctacctctccggcggcaagcctcgttcatcctagccctgcttttctccaagctccctcggctcccctccccatgtttactcttcccctctttcctcctcggcctcccctttgacccgcgccgcccgctttcttctttcctctcccctcccgcttacccttctcctcttccccgccttctccctctctctccttggtcattcccgtgtctcatccctcttgcccccggatatttcccgctccttcttctcttcccgtcctctactaccccgctccctctttctccctacgggtccgtctctccacctccttctttcctctctccatcctccctctctactcctggcgtctctcgtcctctcctcttctctcctccttcccttctctctcggtgcgggatagtgtag

SEQ ID NO: 11417 - DNA, 1452 bp, Pseudomonas aeruginosa
aaagggcagggcgatcggaagcaagcgctacgggagcacggggccacgggggaagccccggtgggcggccagggcggacgccggagctacgcgagagagctgcgctcccacaagccgcgaaagcgggggaggggagagcggaagggggaaggagccgccccatgctcacacggtgtgcaggtaccagttgtactcgaggtcggagatcgagtactcgaactcctccagctcgctttccttgcaggcgacgaagatgtcgatgtacttcggatcgatgtacttcgccaggatctcgctgtcgtccagttcgcgcagggcgtcgcgcaggttgttcggcaggctcggctccaactgctcgtaggagttgccttcgatcggggcacccggctcgaccttgttggtcagcccgtggtgcaccccggcaagcaccgaggccagcagcaggtaggggttggcgtcggcgccggcgacgcgatgttccaggcgtaccgcgtccgggctgccggtgggcacgcgcagggccacggtgcggttgtccaggccccagctcggcgcgttcggcacgtagaactgcgaaccgaagcggcggtaggagttgacgttcgggcagaggaaggccatggaggccggcagggtctcgagcacgccgccgatcgcatggcgcaatgcggcgttctgctcgggatcctcgctggtgaagatgttgttgccgtgcttgtcgagcagcgagatgtgtacgtgcagtccgttccctgcctggcccggatagggcttggccatgaaggtggtgtccatctcgtggtcgtaggcgatgttcttgatcaggcgcttgagcagcaccgcatagtcgcaggccttcatcgggtcggcgacgtgatgcaggttgacctcgaactgcgccggtgcggattcggcgacgatggcgtcggccgggatgccctgggcgcgggcgccgtcgatgatgtcctggaggcactcgacgtattcgtcgaggtcgtcgatggagtacacctgcaccgactgcggacgcttgccggagatcggcgagcgcggcggctgcggccggccgttcacgttctcctggtcgatcaggtagaactccagctcgaaggcggcgacgatggtcagttccatctcggtgaacctggccaccacctggcgcaggacttcgcgggggtcggcgaagaagggatcaccttccagctcatgcatggtcatcagcagttgcgcggtcggccgcttctgccagggttccatggagagggtgccggggatcgggtagcagatccggtcggcgtcgccgatgtcgagacccaggccggtactctctacggtggagccggtgatatcgagggcgaacagggaagcgggaaggttgatacctttttcgaagactttgggcagactgttgcgttcgattcgcttgccgcgaaccacgccattcatgtctga

SEQ ID NO: 11418 - DNA, 1086 bp, Pseudomonas aeruginosa
gaagagcaagatcgttcaagccagcccgatgcgcctgctggcatgctggaccgacgttcaccaccgccatgcccccatgactgcccacgacctgccccgccaagcctttctccgcggcgccgtcgccatcctcccattgtccctggccgtcgcgccctgggggctgctggcgggatcgatggccatcgaagccaacctcaccccggccgagggccagggcctgtccgccatcgtcttcgccggcgccgcccagttggtggcgatcggcatgctcaagggcggtgccgggttcttttcgatcatcttcaccaccctcctcctgacctcgcagcacctgctctacggcatgagcttgcggccggtcctgtcacctctgccgggacgctggcggatcggcctgggcttcctgctcaccgacgagttcttcgccctcgccagccagcacgaccggcgcaacttcaaccgctggtacgccctcggcgtcggtctgaccttctatatcgcctggaacctgttcaccctcgccggcatcctgcttggccgcagcattcccggtctcgaacacctgggcctggatttctccatcgccgccaccttcatcgcgctggtcgcgccgctggtgcgcaacgtaccgacactggtctgcgtggccacctcgctgttctgctcggtgctgttcagccactggcaatggagttcggcgctggtcctcgccggtctcgccgggatggccgccggtttcatctgcaacaagctgtatcgggaggcgccatggtctgggcagtgatcttcgggatgggctcgatcgtcttcctcaaccgctacctgttcctcgaaccgcgcctgccgatccgcctcggcagcaacctgcggcagttcctcggtttcgccgtgccgggaatgctcacggcgatctgcggccccatcgtgttcatgcccgagggccgcatcgacctcggctacgacaatccctacctgatcagcggcgcagtcaccgtggcgctggtgctctatacccgcaataccctggcgagcatgctgctgggcatggcgttcttcttcctgttcaagtggtggctgatttga

SEQ ID NO: 11419 - DNA, 309 bp, Pseudomonas aeruginosa
ccgcctgctcgatggccggggtcggcaacgccgcgtagttcatccgcaggcagttccgatacttgccggaagcggaaaagatgcagcccaccgcgacttgtacgccgcggttgcgcaaggccttgtccaggcgcagggtgtcgaacgcctcgtccagttcgacccagagcaggaaaccgccctggggccggctggcgcgggtgccctccgggaaatagcgcgccacccagtcgatcatcaggtcgcgtccgcgctggtactgggcgcgcatgcgccgcaagtgcggctcgtagtggccgttgccgatga

SEQ ID NO: 11420 - DNA, 354 bp, Pseudomonas aeruginosa
tctgtatgcagtcaacccaccttttctggacctgtacggaacagcgcgcgatggccattctatctccgtcgtccagccgatcaatatggagtacgcagcatgacgcgactcagtgcgaaatccgagcgccgccaacgcctcgatggccccttcccactcgccgcgatggacaacctggcgcaggccctgcgtcgcggctatcgcctggcccggcaacgccagctgacccggcgcgcgctgctggacctggaagcggcggaactgaaggatatcggcctgagcgccgagcaggcccacgaggaagcctcgctggcgttctggcaggcaggaaaatccggcgggaggaaggcatga

SEQ ID NO: 11421 - DNA, 477 bp, Pseudomonas aeruginosa
cgcaaaatcacgcaaaaacaggagaaaaaatccggcacgcctctgggagaatttctctcgtcgaaacactgcctggagcgtcacatgtcaaccctcgccccccttttcctggccaaacaccctgacggcgaagaacgccaggtgatccgcccgaacgtctgggaaacctcctgcgcagataccgagaccctgtcgatcttccatatcgagggcatggccgatccggacctgctgtgccgggtgctcaacctgttcgccgtgcaatccttcaccccggagcgggttcgcgccgaccgcgaggaccacaagatccgcctgctgctgaccttccccggcctcagccagcaccgcgccagcgtgatcgcggagaagctgcgctcgctggtcaccgtgctcgccgtccgcctggagttctctccccatgccggcaaggtccgtcccagcgtcagcgagccgctgctggccagcgtcgtctga

SEQ ID NO: 11422 - DNA, 1089 bp, Pseudomonas aeruginosa
ccggtcgcccagcccatggctacagtgcaggttcgccaggcagccagaagactgccatgtgttcccccgatcctgcagagcgtgcccatgtcccgaccgcgtttccttccggataacttcaccctggcgctgatcgccaccgtccttctcgccactttcctgccctgcagcggccagaccgccgtggtcttcgaatgggtgaccaacatcggcatcggcctgctgttcttcctccacggcgccaagctgtcgcgccaggcgatcatcgccggcatgacccactggcgcctgcacctgctggtgttcgcctgcaccttcgtgatgttcccgctgctcggcctggcgctgaaaccggcactgtcgccgatggtcaccccggagctgtacctcggcatcctgttcctctgcgccctgccggccacggtgcaatcctccatcgccttcacctcgctggcgcgcggcaacgtgccggcagcggtatgcagcgcttccgtgtcgagcctgctcggcgtattccttaccccgctgctggtcaagctgctgctcggcgccgaaggcgagaccggcaacgcgctggacgccatcggcaagatcaccctgcaactgctggtacccttcatcgctggccaggtcctgcggcgctggatcggcacctgggtggagcgcaacaagccggtgctgcgctatgtcgaccagggctcgatcctgctggtggtctacaccgccttcagcgccgcggtgatccagggcctgtggcacgaagtaccctggctggcgctgctcggcctgaccgtcgcctgctgcgtgatcctcgccctggccctggtgctgaccacggtgctggcgcgacgcctgggcttcagcaaggaagacgagatcaccatcgtcttctgcggttcgaagaagagcctggccaccggcgtgcccatggccaaggtgctgttcgccaccagtgcggtggggccgatggtgttgcctctgatgctgttccaccagatccagctgatggtctgcgcggtgctcgcgcaacgctacgccaggcgccgcgacgacgcagcggcggcgctggccgaggccccctcgcgctga

SEQ ID NO: 11423 - DNA, 1359 bp, Pseudomonas aeruginosa
aagaagccggcccaggggccggcttcttcgttcagacgcggctcagcgcgtcggcgtgcgcagggtgacgaactcttccgccgcggtcgggtggatgccgatggtctcgtcgaacgcctgcttggtcgccccggccttcatcgccaccgcgataccctggaggatctcgccggcctcggcgccgaccatgtggcagcccagcaccctgtcgtcgtgggcatccacgaccagcttcatcagggtcttttcctggtcgtcggtaagggtcagcttcatcggccggaagcggctctcgaagatcttcaccttgtgcccggcgctcagcgcctcctcctcggtcaggccgacggtgccgatgttgggcaggctgaacaccgcggtgggaatcaacttgtagtccaccgggcgatactcctccggcttgaacaatcgccgtgccaccgccataccctcggccagcgccacgggggtcaactggacgcgaccgatcacgtcaccgagggcgaggatcgacggctcgctggtctggtagtgctcgtcgaccgcgatgaagcccttgtcggtcagcttcacagctgtgttttccaggcccaggtcgtccagcatcggccgccgcccggtggcgtagaacacgcagtccgcctccagcacccggccgtccttgagggtcgcggccaggctgccatcggcctgtttgtcgatacgggcgatgtcgctgttgaactgcaggtccaggcccttcttgcccaattcgtcgcgcagatgctcgcggacgctgcggtcgaagccgcgcaggaacaggtcgcgacggtagagcaaggtggtctcggcgccgagcccgttgaagatcgaggcgaactcgacggcgatgtagccgccgccgaccaccagcatgcggcgcggcaggcgctcgaggaagaacgcttcgttggaggtgatcgcgtgttccttgccgggaatgtccggcacctgcggccagccaccggtggcgacgagaatgtgcttggcgctgaagcgctggccgtccacctcgacgctgtgcgcatcgagcagacgggcgtgaccttcgagcaaggtcaccccgctgttcaccagcaggttgcggtagatcccgttgagccgctggatctcgcggttcttgttgccgatcagggtcgcccagtcgaactgcgcctcgccggcgctccagccataggcccgggcctgctcgaagtcctcgctgaaatgcgcgccatagaccagcagcttcttcggcacgcagccgacgttgacgcaggtgccacccaggtagcgactctccgccaccgcgacacgggcaccgaagccggcggcgaagcgggcggcgcgtacgccccctga

SEQ ID NO: 11424 - DNA, 606 bp, Pseudomonas aeruginosa
gccggcgccgatgacgaacagatcgaaatcgaaagacatgttcctactcctggatcagatgcgttccagcataacccattcaccagcgtcggctcccgccggatcgacgcagaaacctgtcgaaacggctcagcgcagggcctggcaggcgatgggctatgcttgtccgtggaggtaagcgcgatgtcccccaccctcacccacctggcgctgcacgtccccgacctcgacgcctgcatcgccttctacgaaaccttctgcggcatgcgggtgatccaccggcgccccggcaaaggctcgcagatcgtctggatggccgaacccggccaggaacaacgcttcatcttcgtcatcatgcccggcggccagccgcgcaacctggccagcgacgattacagtcatttcggcttcgccctctccagccgcgccgcggtagacgatctggcgcgccgcgccgaggccgccggctgcctggtctgggcgccgcgcgacgagccctatccggtcggctactactgcggcctgcgcgatcccgcgggcaactatgtggagttcagctacggccagccgctgggcccgggttccgaggcgctgccgattccctga

SEQ ID NO: 11425 - DNA, 285 bp, Pseudomonas aeruginosa
gcctgctgcaggcgacccctggaggccgcgcgcctgcgcctgcgaccgatcgtcatgacctcgctggcgttcggtttcggcgtggtcccgctggcgctctccagcggcgccggttccggcgcccaggtcgccatcggcaccggggtgctcggcgggatcgtcaccgccacggtactcgcggtgttcctggtaccgctgttcttcctggtggtcgggcgcctgttccggttgcgcaaggcgccgcgcaccggcaactcgccccagatccccacggagcaagcctga

SEQ ID NO: 11426 - DNA, 2079 bp, Pseudomonas aeruginosa
ccgccgccagttcggccagagcatcggcgaattccagctggtccagggcaaggtggccgacatgtacaccgccctcaacgccagccgcgcctacctgtacgccgtggccgccgcctgcgaccgcggcgagacgacccgcaaggacgccgccggggtgatcctctacagcgccgagcgcgccacccagatggccctggacgcgatccagatcctcggcggcaacggctacatcaacgagtttcccaccggccgcctgttgcgcgacgccaagctctacgagatcggcgccggcaccagcgagatccgccgcatgctgatcggccgcgagctgttcaacgaaacccgctgaagcctcgctcttcccggcccttttccgccagggagagggcattccattgcatcgacaggcgcatcgccaggtcgggagcgggcgccaaccgcttccgcccacctcgacacggagccaccgccatggccatcctgcacacccagatcaatccacgctccgccgagttcgcggccaacgccgcgaccatgctggaacaggtcaacgccctgcgcaccctcctcggccgcatccacgaaggcggcggtagcgccgcccaggcccggcacagcgcgcgcggcaagctgctggtgcgcgaacgcatcaaccgcctgctcgaccccggctcgccgttcctcgagctttccgccctcgccgcccacgaagtctacggcgaagaggtcgccgccgccggcatcgtcgccgggatcggccgggtcgaaggggtggaatgcatgatcgtcggcaacgatgccacggtgaagggcggcacctactatccgctgaccgtgaagaagcacctgcgggcccaggccatcgccctggagaaccgcctgccatgcatctacctggtggactctggcggcgccaacctgccgcgccaggacgaggtgttccccgaccgcgagcacttcggccggatcttcttcaaccaggccaacatgagtgcccgcggcatcccgcagatcgccgtggtcatgggctcctgcaccgccggcggggcctacgtgccggcgatgtccgacgaaaccgtgatggtgcgcgaacaggccaccatcttcctcgccgggccgccgctggtgaaggccgctaccggcgaggtggtcagcgccgaggaacttggcggcgccgacgtgcactgcaaggtctcaggggtcgccgaccactatgccgaggacgatgaccatgccctggccatcgcccgccgctgcgtcgccaacctcaactggcgcaagcagggccagctgcaatgccgtgcaccgcgcgcgccgctgtaccccgccgaggagctgtacggggtgattcccgccgacagcaagcagccctacgacgtgcgcgaagtgatcgcacggctggtggacggctccgagttcgacgaattcaaggcgctgttcggcaccaccctggtctgcggcttcgcccacctgcacggctatccgatcgccatcctggccaacaacgggatcctcttcgccgaggccgcgcagaaaggcgcgcacttcatcgagttggcctgccagcgtggcatcccgctgctgttcctgcagaacatcaccggtttcatggtcggccagaagtacgaggctggcggcatcgccaagcacggcgccaagctggtgaccgcggtggcctgcgcgcgggtgccgaagttcaccgtgctgatcggcggcagcttcggcgccggcaactacggcatgtgcggacgcgcctacgacccgcgcttcctgtggatgtggccgaacgcgaggatcggcgtgatgggcggcgaacaggccgccggggtgctcgcccaggtcaagcgcgagcaggccgagcgcgccggccagcagctcggcgtcgaagaggaggcgaagatcaaggcgccgatcctcgagcagtacgagcaccagggccatccctactactccagcgcgcgactgtgggacgacggcgtgatcgatccggcgcagacccgcgaggtgctcgccctggcgctttccgccgccctcaacgcccccatcgagccgaccgccttcggcgtgttccgcatgtga

SEQ ID NO: 11427 - DNA, 627 bp, Pseudomonas aeruginosa
gatcgacccgcgcggcgtagccaccctgtggctagaccgggcggaaaagaacaacgccttcaatgccgtcgtgatcgacgaactgttgcaggccatcgatcgcgtcggcagcgacccgcaggtccgcctgctggtgctgcgcggccgtggccggcacttttgcggcggtgccgacctggcctggatgcagcagtcggtggacctcgactaccagggcaacctggccgacgcccagcgcatcgccgaactcatgacccatctctacaacctgcccaagccgaccctggcggtggtccagggcgcggtgttcggcggcggggtcggcctggtcagttgctgcgatatggccatcggcagcgacgacgcgaccttctgcctgtccgaggtacgcatcggcctgatcccggcgaccatcgccccgttcgtggtcaaggccatcggccagcgcgccgcgcggcgctattcgctgaccgccgagcgcttcgacggacgccgcgccagcgaactgggcctgctcagcgaaagctgtcccgccgccgaactggaaagccaggccgaggcctggatcgccaacctgctgcaaaacagcccgcgcgccctggtcgcctgcaaggcgctctaccatga

SEQ ID NO: 11428 - DNA, 2106 bp, Pseudomonas aeruginosa
ggtcgaggccgccgagctgagcccggcgctgcgccgctacaccgaggcggccatcgcccgcatccgcatcagcccggaaggccaggaaggcctgcgcgccttcctggagaaacgcacgcccgcctggagaaacgacgcatgaacccggactaccgcagcatccagcgcctcctggtcgccaaccgcggcgagatcgcctgccgggtgatgcgcagcgcgcgcgccctcggcatcggcagcgtcgccgtgcacagcgacatcgaccgccacgcccgccacgtcgccgaagccgacatcgccgtcgacctgggcggcgccaagcccgccgacagctacctgcgcggcgacaggatcatcgcagctgccctcgccagcggcgcccaggcgatccaccccggctacggcttcctctcggagaacgccgacttcgcccgcgcctgcgaggaagccggcctgctcttcctcggaccgccggcggcggccatcgacgccatgggcagcaagtcggccgccaaggcgctgatggaagaagccggcgtgccgctggtgcccggctatcacggcgaagcccaggacctcgagactttccgccgggaagccgggcgcatcggctacccggtgctgctcaaggccgccgctggcggcggcggcaagggcatgaaggtggtggagcgcgaggccgagctggccgaggccctttcctccgcccagcgcgaggccaaggccgccttcggcgacgcgcgtatgctggtggagaaatacctgctgaagccgcgccacgtggagatccaggtattcgccgaccgccatggccactgcctgtacctcaacgaacgcgactgttcgatccagcgccgccaccagaaggtcgtcgaggaagcccccgcccccggtctcggcgcggaactgcgccgggccatgggcgaggccgcggtacgcgcggcgcaggcgatcggctacgtcggcgccggtaccgtcgaattcctcctcgacgaacgcggccagttcttcttcatggaaatgaacacccgcctgcaggtggaacacccggtcaccgaggccatcaccggcctcgacctggtcgcctggcagatccgcgtcgctcgcggcgaggcgctaccgctgacgcaggaacaggtaccgctgaacggccacgccatcgaagtacggctctatgcggaagaccccgagggcgacttcctccccgccagcggccgcctgatgctataccgcgaagcggccgccggccccggccggcgggtcgacagcggggtacgcgaaggcgacgaggtctcgccgttctacgacccgatgctggccaagctgatcgcctggggcgaaacccgcgaggaagcccgccagcgcctgctggcgatgctggcggaaacctcggtcggcggcctgcgcaccaacctggcgttcctccgccgcatcctcggccatccggcgttcgccgccgccgaactggacaccgggttcatcgcgcgccaccaagacgacctgctgccggcgccgcaagcgctgccggagcatttctggcaagccgccgccgaagcctggctgcagagcgaaccgggccaccgtcgcgacgacgacccgcattcgccgtggagccgcaacgacggctggcgcagcgccctggcgcgggagtccgacctgatgctgcgctgccgcgacgaacgccgctgcgtccgcctgcgccacgccagccccagccagtatcgcctcgacggcgacgacctggtcagccgggtggacggtgtcacccgtcgctcggcggcgttgcgccgcggacgccaattgttcctcgaatgggagggcgaactgctggccatcgaagccgtcgacccgatcgccgaggccgaggccgcccatgcccaccagggcggtttgagcgcgccgatgaacggcagtatcgtgcgggtcctggtcgagcccggccagacggtcgaagccggcgccaccctggtggtgctggaggcgatgaagatggaacacagcatccgcgcgccccacgccggggtagtgaaggcgctgtattgcagcgagggcgaactggtcgaggaaggcacgccgctggtggagctggacgagaaccaggcctga

SEQ ID NO: 11429 - DNA, 1365 bp, Pseudomonas aeruginosa
cgcagccagcgtgccaggtccccggcggatcggcggcaagctgcccccactccccggaggcctcagatgaacctcgactccactgccctcgcctatcaatcgggcttcggcaacgaattcagcagcgaagcgctccccggcgccctgccggtcggccagaactccccgcagaaagcgccctacggcctgtacgccgaactgctctccggcaccgccttcaccatggctcgcagcgaggcccggcgcacctggctgtaccgcatcacgccgtcggccaagcatccgccgttccgccgcctggaacgacagatcgccggtgccgaactggatgcgccgactcccaaccgcctgcgctgggacccgctggcactgcccgagcagcccaccgacttcctcgacggcctgctgcgcatggccgccaacgcgcccggcgacaagcccgccggcgtgagcatctaccagtacctggccaaccgctcgatggagcgttgcttctacgacgccgatggcgaactgctgctggtcccgcaattgggccgtctgcgcctgtgcaccgaactcggcgcgctgcaagtcgaaccgctggagatcgcggtgatcccgcgcgggatgaagttccgcgtcgagctgctcgacggcgaggcacgcggctatatcgccgagaaccacggcgcgccgctgcgcctgcccgacctcggcccgatcggcagcaatggcctggccaatccgcgcgacttcctgaccccggtggcgcgctacgaggacagccgccagccgctgcaactggtgcagaaatacctcggcgagctgtgggcctgcgagcttgaccactcgccgctggacgtggtcgcctggcacggcaacaacgtgccctacaagtacgacctgcgccgcttcaacaccatcggcacggtcagcttcgaccacccagacccgtcgatcttcaccgtgctgacctcccccaccagcgtccccggcctggccaacatcgacttcgtgatcttcccgccgcgctggatggtggccgagaacaccttccgtccgccatggttccaccgcaacctgatgaacgaattcatgggcctgatccagggcgcctatgacgccaaggccggcggcttcgtgcccggcggcgcctcgctgcacagttgcatgagcgcccacggcccggacgcggaaagctgcgacaaggccatcgccgccgacctcaagccgcacaggatcgaccagaccatggccttcatgttcgagaccagccaggtcctccggccgagccgtgccgccctcgagacgccggccctgcagaatgactacgatgcctgctgggcgtcgctcgtatccaccttcaacccgcaacggagataa

SEQ ID NO: 11430 - DNA, 1974 bp, Pseudomonas aeruginosa
ctgggtcgcctccgccaatgggcatgccgactttcccctgcaaaacctgccgctgggcatcttcagccgtgccggcctgagcccgcgttgcggcgtggccatcggcgactcgatcctagacctggacgcggcgctggccgccgggctgttcgagggtgccgccggcgaagccgccgaagccacccgcggcggcgcgctgaacgccttcttcgccctcggcaagccggcccgcgtggcgctgcgccagcgcctgctggagctgctcggcgaaggcgccgcggagcgcccggaactgctccatccggccgccgagtgccaaatgcacctaccggccaggatcggcgactacaccgacttctacgtcggcatccgccatgccgagaacgtcggcaagctgttccgcccggacaacccgctgctgcccaactacaagcacgtgcccatcggctaccacggccgcgcctcgaccgtgcgcgtctccggcagcgaagtgcgccggcccaacggccagaccctgccggccggcgccagcgagccggtgttcggtccctgtgcgcgtctggactacgaactggagctaggcatctggatcggccagggcaacgccctcggcgaagccatcccggtttcccgcgccgccgagcacatcgccggcttctgtctgctcaacgactggtcggcgcgcgacatccaggcctgggaataccagccgctcggcccgttcctgtcgaagagcttcatcaccagcgtttcgccctgggtggtcaccgccgaagccctggagccgttccgccgcgcccagccagcgcgccccgaaggcgacccgcggccgctgccgtatctttacgacgacaacgaccaggcccacggcgccttcgacatcgagctggaggtcctgctgctcaccgagggcctgcgcgagaaaggcctgccgccgcagcgcctgaccctgagcaacagcctgagcatgtactggacggtggcgcagatggtcgcccaccacagcgtcaatggctgccagttgcagcccggcgacctgttcggctccggcaccctgtccggcgccgagcccggccagttcggctcgctgctggagatcaccgctggcggcaagcagccggtgcaactgcctcccggcgagacccggcgtttcttggaggacggagacgaggtcatcctccggcccccgctgcaagcgcgagggacatgtttcgatcggtttcggcgaatgtcgcggcaaagtgctcgcggcccatccgggggcgcgcggatgaagctctatacctactaccgttccacctcctcctaccgggtgcgcatcgccctggcgctgaaggggctggactaccagtcgctgccggtcaacctggtccgcgacggcggcgaacaccgccaacccgcctacctggcgctcaacccgcagggccgcgtaccggccctgcaggtcgacgagggcgagctgctgatccagtcgccggcgatcatcgagtacctcgaggagcgctacccgcaccccgccctgctctccagcgatccgctgcgccgcgcccacgagcgcggagtcgcggcgctggtcggctgcgacatccacccgttgcacaacgccagcgtgctcaacctgctgcgccagtggggacacgacgaagagcaggtccggcagtggatcggccactgggtcggccagggtctcgccgccgtcgagcaactgatcggcgaccaggattggtgcttcggcgaccggccaggcctggccgacgtctacctggtcccgcagctctacgccgccgagcgcttcggcgtggcgctggacgcctggccacggatccgccgggtcgccgacctggccgccgcccatccggcgttccgccaggcccatccggccaaccagccggacaccccggccgcctgagggaccgcagagtcccgctcctgaagataaaggggggcgtccgccggacgccccatcaccaataa

SEQ ID NO: 11431 - DNA, 2871 bp, Pseudomonas aeruginosa
gaacctcaggtaccttgcgatgcacaaccagatcgccagctttcgcgcggcgctcgacgcgcgccccgtgtcccgctaccagtggctgttgctgctgctcctcgccctgttgctggtcaccgatggctacgatgcccaggtgctcggctacgtggtgccgaccctggcccaggaatggggcctggacaaggccgcgttcggcccggtgttcagcgccaacctgttcggcctgaccgtcggttcgctgctggtgacgccgctggcggaccgcttcggcatccgccgagtgctgctctgctgcgtgctgatctacgccagcctgaccgtcctgatggtcttcgccggttccctggaaagcctgatgctggcgcgcttcgtctgcggcatcggaatgggcggggcgatgcccagcgccatggcgctgatggccgagtattcgccaccgcgcctgcgtaccctgatggtcaccctggcggcctgcggtttctccttcggcggcgccgccggcggtttcgtcgccgccgccttcatggacggcttcggctggcaggcggtgttcctcgccggcggcgtcaccccgttgctgctgttccccttcctcctcctgttcctgccggagtcgctgccgcgcctgctccgcgacgcaccgccctatgcccgcctacgccagctcagcgagcgcatggcgccgggctggcagccgccgccggcacaagccgacgccgagccggcggcgagcctgaccgtgctggagctgttccgccacggttacgcgcggccgaccctgctgctctgggcgaccttcttcgtcagcctgatcctgctctacttcatggtcagctggctgccctcgctgctccaggaaagcggcctgacacgcaatgcggcgaacctggcgacctcgatgttcctcttcgccggcaccctcggcgcgatgctcctggcctggctcgccgaccgcctgcgcagcaaggtccgcctgctggcggcgattctcgccggcgccgcgctgttcaccctgctcctcggcctcaaccacgaccagccgcgctggctgctggcgttcgtcttcgccgccggcttctgcatcatcggcgggcagttgaccctgaacgccttcgccagcaacttctacccggcccaggtacgcgccaccggcaccggctgggcgctgggcgtgggccgcttcggttcgatcctcggcccactgttcggcagcctgctgctgggcatgcacatatccgtggagaacatcttcatgcttgcggcgattcccgccgggctcgccgcgctactgatcctccaggtccgctcgcccgccgcccaggcgcagcgggaaagcgccgccgcgctggccgtcgaggaatcctgagccttcaccgcgagcggcttcccggctacagtggcggcccgtttcgccgtccgccgcaggagccgccgatgaacgacgccgacagcctccaggattaccaacgcgtacgccagcaggcgatccgttcgctgttcgagatcgtcgaaggctccagcgaaggcacggtgatcgtcgaccgcgaggcccgcatcgtctggatcaaccagcgctacgcccagcgtttcggcctcgccgacccggcgcaggctatcggccggccctgcgaaagcgtgatccccggtagcctgctgcgcgaggtggtaggcagcggcaagccgatcctgctggacatgatggatagcgcgaaggacccgctggtggtgatgcgcctgccgatccacgacgacgccggcgaagtgatcggcgccatcggcttcgccctgctcgacgaactgcgttcgctgtcgccgctggtgacccgctacctgagcatgcagcgcgaactggcctcgacccgctcgcaattgcaggcgcgccaggccaagtacagcttcagccacttcgtcggtaccagtccggccagcctggaagtcaagcgccgcgcccgtcgtggcgcggccagcgaagcgccggtgctgttgctcggcgagaccggcaccggcaaggaactgctcgcccacgccatccacagcgcttcgccgcgggcgcacaaggccttcgtcagcgtgaacgccgcggcgatcccggaaagcctgctggaggccgaattgttcggtaccgccccgggggccttcaccggtgccgagcgcaagggccggccaggcaagttgcaggtggcccagggcggcacgttgttcctcgacgagatcggcgacatgccgctggccttgcaaggcaagctgttgcgcgtgctacaggagaaagagttcgaagcggtgggttccaacgaagtgatccgcagcgacatccgcctggtcgccgccacttccatcgacctgcagcaggcgatgcgcgaaggccgtttccgcgctgacctctactaccgactgaacgtcctgccgatcgagatcccgccgttgcgccagcgcctggacgacctcccggcgctctgcgagtcgatcctcgacagcctcgaccacggccgtctccacgaactcggcggcgacgccctggcgctgctcgcccggcatgcctggccgggcaacgtccgcgaactgcgcaacgtgctggaacgcgcgctgctgctggccgaccaaccgttgctggacgccgccgccctcggcgcggcgctgggccccctgcaaccgctgccggagctgcctcgagcggcggacgacaggccggtcggggatttccaacaggcccgcgaagccttcgagcgcgacctgatcggacgggccctggcgcagagtgccggcaatgtggtggaagcggcgaaacgcctgggcctgggtcgctcgaccctgtacaagaagatcatggcgctgggcatgcgtctcgataacgggacccatctctaa

SEQ ID NO: 11432 - DNA, 936 bp, Pseudomonas aeruginosa
gatctgcatagccacggaactttcgctcgattacgtctccattttgagacaacgctattccccacgctccccttcgtctcgccgcagcccgcgaaaaccgcgattctggggcctggcacggttatcgcaatgtgcctttccgacggccctgccccgttccaggccgtcacgccggtgcccgcaccgttcgacaacaagaaacaggcccggagcgcccttccccatgcggagcgcgccccgcagcgccgtggagatatgcccgatgagcgtgatcatcgcccttgccgccctgggcctgctgatgctggccgcctaccgcggctacagcgtcatcctgttcgcccccctcgccgccctcggcgccgtcctgctcaccgatcccagcgcggtcgcgccgaccttcaccggggtgttcatggagaagatggtcggtttcatcaagctctacttcccggttttcctgcttggcgcggtgttcggcaagctgatcgagctggccggcttctcccgctccatcgtcgcggcggcgatccgcctgctcggcacccgccaggcgatgctggcgatcgtactggtctgcgcgctgctcacctacggcggcgtctcgctgttcgtggtggtgttcgcggtctacccgttcgccgcggagatgttccgccagagcgacatccccaagcgattgattccggcgaccatcgccctcggcgcgttttccttcaccatggacgcgctgcccggcaccccgcagatccagaacatcatcccctcgaccttcttcggcacccacgcctgggccgcgccctggctcgggaccctcggcgcgctgttcgtcttcgccgtgggcctgctctacctgcgacgccaggcgaacaaggcgcggcgcaacggcgaaggctacggcagcgacctgcgcaacgagccggagaccgccgatga

SEQ ID NO: 11433 - DNA, 1242 bp, Pseudomonas aeruginosa
cctgcgcctgccgaatccctggctggcgctctcgccgctggtgctggtcggggtcgccaacctgctgttcacccactggatcccgcaatggtacggccaggtccataccctgcaactggccggcatggccacgccgttgcagaccgaggtcggcaagctcaccgcgatctgggcagtgcaggcggccctgctgctgggcatcctgctggtgctggcgagcggtttcgcggcgatccgcagccgcctcgccgaaggcacccgcagcgcggtggccggctcgctgctggcggcgatgaacaccgcctcggaatacggcttcggcgcggtgatcgcctcgctgccgggtttcctggtgctggccgacgcgctcaagagcattcccaatccgctggtcaaggaagcgatcaccgtcaccctgctggccggcatcaccggttccgcgtcgggcggcatgagcatcgccctggcggcgatgtccgataccttcatcgccgccgccaacgccgcgcagatccccctggaagtcctccaccgggtcgccgccatggccagcggagggatggataccctgccgcacaacggcgcggtgatcaccctcctggcggtcaccggcctgacccatcgggaggcgtacaaggacattttcggtattaccctgatcaagaccctggcggtgttcttcgtcatcgggctgttctacgccaccggcctggtctgatccgcccttttttcatccagcgggagaaacagcatgaccctgaaaggcaagaccgccctggtcaccggttccaccagcggcatcggcctgggcatcgccctgagcctggccgaggccggcgccgacctgctcctcaacggcttcggcgaggtcgacgcggcgctggcgcaggtccgcgcccgcggcgtgcgcgcagagcaccacccggccgacctctccagcccggagcagatcggcgaactgatggccttcgccgagcggaccttcggcggcgtcgacatcctcgtcaacaacgccggcatccagtacgtggcgccggtgcaggaattccccacggaacgctgggacgcgatcatcgcgatcaacctgtcccccgtgttccataccacccgcctggccctgccgggcatgctcgcgcgcggctgggggcggatcgtcaacatcgcctcgacccacggcctggtcgccttcgcgccgggaagagcgcatacgtcgccgccaagcatggcgtgcctccggcctga

SEQ ID NO: 11434 - DNA, 816 bp, Pseudomonas aeruginosa
actggccaccacatagccgccgatgaccacgaaggccatctgcatggtgaacgggatcaggctccagaaaccgtcgccgaaggctttcgccgtggcggtcggtccggcgcccatggccagcgcggccaggctgacgatgaggatggccagggcggcgaacacccaggagtcgggaaaccagcgctcggcccagttcgagcaacgcatggcgaagcgcgcggagcggctttcttggatgggaaggatagcggtcatcgcggattctctcggttttattgttattcggcgactacggggccgcctgtgtgtgctacggctccctgggcacccggccgtcccgaggggcggaacggtacggggccggtcggacggtcaaggccgtccgccgctcgttccctggacacgagcgcgccatgcccccgcgaaaggacatggcgcgatcacgccgcgagcggcaggtcgatggatcagtcgcgggccagggtcagggcgacgccctgcccgccgccgatgcacagggtggcgaggcccttcttcgcgtcgcgacggatcatctcgtgcagcagggtcaccagcacccggcagccggacgcgccgatcgggtggccaagggcgatggcgccgccgttgacgttgaccctggcggcatcccagcccagttcccggcccaccgccagggactgcgcggcgaaggcctcgttggcctcgatcaggtccagttgctccaggctccagccggccttgtcgagcgcgcgacgggtggcggagaccgggccgatgcccatgatcgccgggtcgaccccggcgctggcgtag

SEQ ID NO: 11435 - DNA, 486 bp, Pseudomonas aeruginosa
ggcgccaggctcatgttctcctggccgccggcgacgatcacctcggcgtcgccgcagcggatcgcctgggcgcccaggtgcagggccttgaggccggagccgcagaccttgttcagggtcatggccggcacgccgaccggcaggccggccttgatcgccgcctggcgcgccgggttctgcccggacccggcggtgagcacctggccgaggatcacttcgtcgacctggccggcatcgagaccggtctgttcgagcaggcggcggatcaccgcggcgcccagctcgggggcgggaatgccggccagcgagccctggaagctgccgacggcggtacgggtagcggcgacgatgacgacgtcttgcatggatggttctcctggattcgcccgtggccgggccgaatcgctgcgggtggacgtagacggtgcgacagcctcctatcctacgccctctggaaaggacggtccgcgcgagtctactggctga

SEQ ID NO: 11436 - DNA, 333 bp, Pseudomonas aeruginosa
ccgcgccgagcgccgccagcgcccgcgacgccaaggattgcggggttgaaggtgagcttcaccgctccggccaggctggcgccgacccggcccggcgagtggctggagcacagcccgttgctgatcatcctgctggtactgctggccggcggctggctggtacacgagttctcgaccaagccggcgatcctggcgatctccgggttgaacacctataacctgctgttcctgatgctcggcgcgttgctgcactggcgcccgcgcagcttcctcgacgcggtggcgcgcgcggtgccgaccaccaccggggtggtgatccagttcccgctgtaa

SEQ ID NO: 11437 - DNA, 438 bp, Pseudomonas aeruginosa
ggatcgatcgcggcgatcatgaccacggtcaacggcagcgacggcgagaccctggctcaccatatctggaccttgttcggacagatcgcctcccacgacacctacgcgctgctgatgggcgtgtactcggcggtgatggggtttttcattccctccggcggcggcaagtggatcatcgaggcgccgtacgtgatgcaggtggccaacgagctgcaataccacctcggctgggcggtgcagatctacaacgccgccgaggcgctgccgaacctgatcaacccgttctacatgctgccgttgctcggcgtgctggggctgaaggcgcgcgacctgatcggcttctcgttcgtccagttgctggtgcacatcccgctggtgctggtgctgctctgggccctgggcagcaccctggcgtacatcccaccggtgatgccgtag

SEQ ID NO: 11438 - DNA, 906 bp, Pseudomonas aeruginosa
cggcggataacgcctgtggcgttatccgccctacgcaatggggcgggcgaactccggatggttccctctcccttcagggagagggtctggggagaggctggccgccccggctactgcgccacccagccgccatccatgttccaggccgcgccgcgcacctggtcggcggcttcgctgcaaaggaacagcgtcagtccgccgagttgctcgggggtgacgaaggccagcgagggttgcttttccgccagcaggtcgtgttccgcctgttcgggcgagacgccctcggcgatgcgcgcgtcgatctgcttctgcaccagcggggtcagcacccagccggggcagatggcgttgcaggtcaccggcgtgcgcgccgtttccagcgccacactcttggtcaggccggaggcacgccatgcttggcggcgacgtatgcgctcttcccggcgcgaaggcgaccaggccgtgggtcgaggcgatgttgacgatccgcccccagccgcgcgcgagcatgcccggcagggccaggcgggtggtatggaacacgggggacaggttgatcgcgatgatcgcgtcccagcgttccgtggggaattcctgcaccggcgccacgtactggatgccggcgttgttgacgaggatgtcgacgccgccgaaggtccgctcggcgaaggccatcagttcgccgatctgctccgggctggagaggtcggccgggtggtgctctgcgcgcacgccgcgggcgcggacctgcgccagcgccgcgtcgacctcgccgaagccgttgaggagcaggtcggcgccggcctcggccaggctcagggcgatgcccaggccgatgccgctggtggaaccggtgaccagggcggtcttgcctttcagggtcatgctgtttctcccgctggatga

SEQ ID NO: 11439 - DNA, 1500 bp, Pseudomonas aeruginosa
aaaaagggcggatcagaccaggccggtggcgtagaacagcccgatgacgaagaacaccgccagggtcttgatcagggtaataccgaaaatgtccttgtacgcctcccgatgggtcaggccggtgaccgccaggagggtgatcaccgcgccgttgtgcggcagggtatccatccctccgctggccatggcggcgacccggtggaggacttccagggggatctgcgcggcgttggcggcggcgatgaaggtatcggacatcgccgccagggcgatgctcatgccgcccgacgcggaaccggtgatgccggccagcagggtgacggtgatcgcttccttgaccagcggattgggaatgctcttgagcgcgtcggccagcaccaggaaacccggcagcgaggcgatcaccgcgccgaagccgtattccgaggcggtgttcatcgccgccagcagcgagccggccaccgcgctgcgggtgccttcggcgaggcggctgcggatcgccgcgaaaccgctcgccagcaccagcaggatgcccagcagcagggccgcctgcactgcccagatcgcggtgagcttgccgacctcggtctgcaacggcgtggccatgccggccagttgcagggtatggacctggccgtaccattgcgggatccagtgggtgaacagcaggttggcgaccccgaccagcaccagcggcgagagcgccagccagggattcggcaggcgcaggtcatcggcggtctccggctcgttgcgcaggtcgctgccgtagccttcgccgttgcgccgcgccttgttcgcctggcgtcgcaggtagagcaggcccacggcgaagacgaacagcgcgccgagggtcccgagccagggcgcggcccaggcgtgggtgccgaagaaggtcgaggggatgatgttctggatctgcggggtgccgggcagcgcgtccatggtgaaggaaaacgcgccgagggcgatggtcgccggaatcaatcgcttggggatgtcgctctggcggaacatctccgcggcgaacgggtagaccgcgaacaccaccacgaacagcgagacgccgccgtaggtgagcagcgcgcagaccagtacgatcgccagcatcgcctggcgggtgccgagcaggcggatcgccgccgcgacgatggagcgggagaagccggccagctcgatcagcttgccgaacaccgcgccaagcaggaaaaccgggaagtagagcttgatgaaaccgaccatcttctccatgaacaccccggtgaaggtcggcgcgaccgcgctgggatcggtgagcaggacggcgccgagggcggcgaggggggcgaacaggatgacgctgtagccgcggtaggcggccagcatcagcaggcccagggcggcaagggcgatgatcacgctcatcgggcatatctccacggcgctgcggggcgcgctccgcatggggaagggcgctccgggcctgtttcttgttgtcgaacggtgcgggcaccggcgtga

SEQ ID NO: 11440 - DNA, 684 bp, Pseudomonas aeruginosa
tcttcttgtacagggtcgagcgacccaggcccaggcgtttcgccgcttccaccacattgccggcactctgcgccagggcccgtccgatcaggtcgcgctcgaaggcttcgcgggcctgttggaaatccccgaccggcctgtcgtccgccgctcgaggcagctccggcagcggttgcagggggcccagcgccgcgccgagggcggcggcgtccagcaacggttggtcggccagcagcagcgcgcgttccagcacgttgcgcagttcgcggacgttgcccggccaggcatgccgggcgagcagcgccagggcgtcgccgccgagttcgtggagacggccgtggtcgaggctgtcgaggatcgactcgcagagcgccgggaggtcgtccaggcgctggcgcaacggcgggatctcgatcggcaggacgttcagtcggtagtagaggtcagcgcggaaacggccttcgcgcatcgcctgctgcaggtcgatggaagtggcggcgaccaggcggatgtcgctgcggatcacttcgttggaacccaccgcttcgaactctttctcctgtagcacgcgcaacagcttgccttgcaaggccagcggcatgtcgccgatctcgtcgaggaacaacgtgccgccctgggccacctgcaacttgcctggccggcccttgcgctcggcaccggtga

SEQ ID NO: 11441 - DNA, 630 bp, Pseudomonas aeruginosa
cgcggcgagcccggcgggaatcgccgcaagcatgaagatgttctccacggatatgtgcatgcccagcagcaggctgccgaacagtgggccgaggatcgaaccgaagcggcccacgcccagcgcccagccggtgccggtggcgcgtacctgggccgggtagaagttgctggcgaaggcgttcagggtcaactgcccgccgatgatgcagaagccggcggcgaagacgaacgccagcagccagcgcggctggtcgtggttgaggccgaggagcagggtgaacagcgcggcgccggcgagaatcgccgccagcaggcggaccttgctgcgcaggcggtcggcgagccaggccaggagcatcgcgccgagggtgccggcgaagaggaacatcgaggtcgccaggttcgccgcattgcgtgtcaggccgctttcctggagcagcgagggcagccagctgaccatgaagtagagcaggatcaggctgacgaagaaggtcgcccagagcagcagggtcggccgcgcgtaaccgtggcggaacagctccagcacggtcaggctcgccgccggctcggcgtcggcttgtgccggcggcggctgccagcccggcgccatgcgctcgctgagctggcgtag

SEQ ID NO: 11442 - DNA, 2058 bp, Pseudomonas aeruginosa
gcgggcatagggcggtgcgtcgcggagcaggcgcggcagcgactccggcaggaacaggaggaggaaggggaacagcagcaacggggtgacgccgccggcgaggaacaccgcctgccagccgaagccgtccatgaaggcggcggcgacgaaaccgccggcggcgccgccgaaggagaaaccgcaggccgccagggtgaccatcagggtacgcaggcgcggtggcgaatactcggccatcagcgccatggcgctgggcatcgccccgcccattccgatgccgcagacgaagcgcgccagcatcaggctttccagggaaccggcgaagaccatcaggacggtcaggctggcgtagatcagcacgcagcagagcagcactcggcggatgccgaagcggtccgccagcggcgtcaccagcagcgaaccgacggtcaggccgaacaggttggcgctgaacaccgggccgaacgcggccttgtccaggccccattcctgggccagggtcggcaccacgtagccgagcacctgggcatcgtagccatcggtgaccagcaacagggcgaggagcagcagcaacagccactggtagcgggacacggggcgcgcgtcgagcgccgcgcgaaagctggcgatctggttgtgcatcgcaaggtacctgaggttcttattggtgatggggcgtccggcggacgcccccctttatcttcaggagcgggactctgcggtccctcaggcggccggggtgtccggctggttggccggatgggcctggcggaacgccggatgggcggcggccaggtcggcgacccggcggatccgtggccaggcgtccagcgccacgccgaagcgctcggcggcgtagagctgcgggaccaggtagacgtcggccaggcctggccggtcgccgaagcaccaatcctggtcgccgatcagttgctcgacggcggcgagaccctggccgacccagtggccgatccactgccggacctgctcttcgtcgtgtccccactggcgcagcaggttgagcacgctggcgttgtgcaacgggtggatgtcgcagccgaccagcgccgcgactccgcgctcgtgggcgcggcgcagcggatcgctggagagcagggcggggtgcgggtagcgctcctcgaggtactcgatgatcgccggcgactggatcagcagctcgccctcgtcgacctgcagggccggtacgcggccctgcgggttgagcgccaggtaggcgggttggcggtgttcgccgccgtcgcggaccaggttgaccggcagcgactggtagtccagccccttcagcgccagggcgatgcgcacccggtaggaggaggtggaacggtagtaggtatagagcttcatccgcgcgcccccggatgggccgcgagcactttgccgcgacattcgccgaaaccgatcgaaacatgtccctcgcgcttgcagcgggggccggaggatgacctcgtctccgtcctccaagaaacgccgggtctcgccgggaggcagttgcaccggctgcttgccgccagcggtgatctccagcagcgagccgaactggccgggctcggcgccggacagggtgccggagccgaacaggtcgccgggctgcaactggcagccattgacgctgtggtgggcgaccatctgcgccaccgtccagtacatgctcaggctgttgctcagggtcaggcgctgcggcggcaggcctttctcgcgcaggccctcggtgagcagcaggacctccagctcgatgtcgaaggcgccgtgggcctggtcgttgtcgtcgtaaagatacggcagcggccgcgggtcgccttcggggcgcgctggctgggcgcggcggaacggctccagggcttcggcggtgaccacccagggcgaaacgctggtgatgaagctcttcgacaggaacgggccgagcggctggtattcccaggcctggatgtcgcgcgccgaccagtcgttgagcagacagaagccggcgatgtgctcggcggcgcgggaaaccgggatggcttcgccgagggcgttgccctggccgatccagatgcctag

SEQ ID NO: 11443 - DNA, 633 bp, Pseudomonas aeruginosa
agcggcgcaggtcgtacttgtagggcacgttgttgccgtgccaggcgaccacgtccagcggcgagtggtcaagctcgcaggcccacagctcgccgaggtatttctgcaccagttgcagcggctggcggctgtcctcgtagcgcgccaccggggtcaggaagtcgcgcggattggccaggccattgctgccgatcgggccgaggtcgggcaggcgcagcggcgcgccgtggttctcggcgatatagccgcgtgcctcgccgtcgagcagctcgacgcggaacttcatcccgcgcgggatcaccgcgatctccagcggttcgacttgcagcgcgccgagttcggtgcacaggcgcagacggcccaattgcgggaccagcagcagttcgccatcggcgtcgtagaagcaacgctccatcgagcggttggccaggtactggtagatgctcacgccggcgggcttgtcgccgggcgcgttggcggccatgcgcagcaggccgtcgaggaagtcggtgggctgctcgggcagtgccagcgggtcccagcgcaggcggttgggagtcggcgcatccagttcggcaccggcgatctgtcgttccaggcggcggaacggcggatgcttggccgacggcgtga

SEQ ID NO: 11444 - DNA, 492 bp, Pseudomonas aeruginosa
tccaggccggcggcgctcaggtcatcgaccaggcggatcttgtcggccacctcgatcggctgtttctcgttctgcagtccgtcgcgcggaccgacctccaccaggcggaccttcttcggcaggttcatgctgttcctcgtcttggctgtcaggcctggttctcgtccagctccaccagcggcgtgccttcctcgaccagttcgccctcgctgcaatacagcgccttcactaccccggcgtggggcgcgcggatgctgtgttccatcttcatcgcctccagcaccaccagggtggcgccggcttcgaccgtctggccgggctcgaccaggacccgcacgatactgccgttcatcggcgcgctcaaaccgccctggtgggcatgggcggcctcggcctcggcgatcgggtcgacggcttcgatggccagcagttcgccctcccattcgaggaacaattggcgtccgcggcgcaacgccgccgagcgacgggtga

SEQ ID NO: 11445 - DNA, 948 bp, Pseudomonas aeruginosa
tcctgtcgccgcgcaggtagctgtcggcgggcttggcgccgcccaggtcgacggcgatgtcggcttcggcgacgtggcgggcgtggcggtcgatgtcgctgtgcacggcgacgctgccgatgccgagggcgcgcgcgctgcgcatcacccggcaggcgatctcgccgcggttggcgaccaggaggcgctggatgctgcggtagtccgggttcatgcgtcgtttctccaggcgggcgtgcgtttctccaggaaggcgcgcaggccttcctggccttccgggctgatgcggatgcgggcgatggccgcctcggtgtagcggcgcagcgccgggctcagctcggcggcctcgacctcatggtagagcgccttgcaggcgaccagggcgcgcgggctgttttgcagcaggttggcgatccaggcctcggcctggctttccagttcggcggcgggacagctttcgctgagcaggcccagttcgctggcgcggcgtccgtcgaagcgctcggcggtcagcgaatagcgccgcgcggcgcgctggccgatggccttgaccacgaacggggcgatggtcgccgggatcaggccgatgcgtacctcggacaggcagaaggtcgcgtcgtcgctgccgatggccatatcgcagcaactgaccaggccgaccccgccgccgaacaccgcgccctggaccaccgccagggtcggcttgggcaggttgtagagatgggtcatgagttcggcgatgcgctgggcgtcggccaggttgccctggtagtcgaggtccaccgactgctgcatccaggccaggtcggcaccgccgcaaaagtgccggccacggccgcgcagcaccagcaggcggacctgcgggtcgctgccgacgcgatcgatggcctgcaacagttcgtcgatcacgacggcattgaaggcgttgttcttttccgcccggtctag

SEQ ID NO: 11446 - DNA, 1341 bp, Pseudomonas aeruginosa
tctgggtgtgcaggatggccatggcggtggctccgtgtcgaggtgggcggaagcggttggcgcccgctcccgacctggcgatgcgcctgtcgatgcaatggaatgccctctccctggcggaaaagggccgggaagagcgaggcttcagcgggtttcgttgaacagctcgcggccgatcagcatgcggcggatctcgctggtgccggcgccgatctcgtagagcttggcgtcgcgcaacaggcggccggtgggaaactcgttgatgtagccgttgccgccgaggatctggatcgcgtccagggccatctgggtggcgcgctcggcgctgtagaggatcaccccggcggcgtccttgcgggtcgtctcgccgcggtcgcaggcggcggccacggcgtacaggtaggcgcggctggcgttgagggcggtgtacatgtcggccaccttgccctggaccagctggaattcgccgatgctctggccgaactggcggcggtcatggatgtacggcaccaccacgtccatgcacgcctgcatgattcccaccgggccgccggaaagcaccacgcgctcgtagtcgaggccgctcatcagtaccttgaccccgccgttgaccgcgccgaggacgttctcctcgggtacctcgacgtcctggaagatcagttcgcaggtgttcgagccgcgcatgcccagcttgtccagcttcggcccgcgactgaagcctttccagtcgcgctcgacgatgaacgcggtgatcccgtgcgcgcccttgtccgcgtcggtcttggcgtagatcacataggtatgggcatcgggaccgttggtgatccacatcttgctgccgttgagaacgaagcggtcgccgacccggtccgcgcgcagcttcatcgagaccacgtcggagccggcgttgggttcgctcatcgccagcgcaccgatgtgttcgccggataccagggccggcaggtagcgggccttctgttcggcgttgccgttgcgcttgatctggttgacgcagaggttggaatgcgcgccataggagagcgccaccgaggccgaggcccggctgatctcttccatgaccacggcgtgggccaggtagcccagcgccgaaccgccgtactcctcgtcgacggtgatgccgagcaggcccatctcgccgaacttgcgccacatgtccatggggaactgattgtcctggtcgatctgcgcggcgcgcggctgcagttcggcggcgacgaagccgcgcacctggtcgcggagcatgtcgatggtttcgccgagggcgaagttgaggctgggataggtcatgctttcacctgtaattgtgcttgtccggtttaa

SEQ ID NO: 11447 - DNA, 420 bp, Pseudomonas aeruginosa
atgttgcccaccgcgccgctgaagaacgccatcggcacgaacaccgagaccagcaccacggtgatgccgacgatggccccgctgatctggcgcatcgccttgaccgtggcgtcgtgcggcgacaggccttcctcggccatcagccgctcgacgttctccaccacgatgatcgcgtcgtccaccaggatgccgatcgccaggaccatgccgaacatggtcagcacgttgatcgagaagcccaggccgagcatcaccgtgaaggtgcccagcagggccaccggcaccaccagtgtcgggatcagggtggcgcggaagttctgcatgaacaggtacatcacggcgaacaccagcagcatcgcctcgagcagggtgctgaccaccttcctgatcgagatctcgacgaacgccgaggtgtcatag

SEQ ID NO: 11448 - DNA, 465 bp, Pseudomonas aeruginosa
cgcttgagcttgtcggccgccgccgcgtggctggcctcggcccgggccagggcgccgcggctgatgtccagggccgccttcaagggcgcagggtcgatctggaacagcacggtgccggcgcggacgtcctggccttcctcgtacaggcgacgggtgacgatgccggcgacgcgcgcccgcacttcagcctggcggtacgcttccaggcgtccgggcagctcgctggtgatgccgataggcgccggcctggcgacgatcacgccgacctcggcgggggcctccgcagtcttcccggcgtccgctgcttcttcgcagcccagcaggaatagggcgaccagggccgccagcagcccgcgcagcgagccggtccattggatgtgcatgggtgtccctcgattcgtgaactcgcgagcttgcccgggaaagggcaccgcaactcacgagcggcgcgacagtagcatataa

SEQ ID NO: 11449 - DNA, 1446 bp, Pseudomonas aeruginosa
cttcacgccagcgtcacgcgcctgccaccgcgcttggctgcaatcgtccgcagagagagggcgaggccagcggaggacgacgccatgcggctatgcgtgattggtgcgggctatgtgggactggtgacggcggcctgtttcgccgagatgggcaaccaggtgcgttgcgtggagcgtgaccgcgagcgggtcgcgcggctgagacgcggcgagatgccgatctacgaaccgggcctggaaagcatcctgcgcgatcagctggacgccgcccgcctgaccttcaccgccagcctggcggaaggcctggccgacgccgaagtggtgttcatcgccgtcggcacgccgtgcggcgaggacggctcggccgacctcagccacgtgctggcggtcgccgagcaacttggcgcgcaactgcgccaggcctgcatcgtggtcaacaagtcgaccgtgccggtgggcaccgccgaacgggtcgaagagatcatccgcctgggcctggcgcgccggcgcaagcgcttccgggtagcggtggcgagcaatccggagttcctcaaggaaggctcggcggtggacgatttcaggcgcccggaccgggtcatcatcggcagcgccgaggcgcaggccggggaaaccctgcgccagctctacgcgccgttcctgcgcaatcacgagcgggtcctgctgatggggcgtcgcgaggccgagttcagcaagtacgcggccaatgccttcctcgccaccaagatttccttcatgaacgagatggccgggctgtgcgccctcaccggcgtcgacatcgaggacgtgcgccgcggcatgggtagcgacaagcgcatcggcacccatttcatctacgccggctgcggctacggcggctcgtgctttcccaaggacgtccgcgcgctgatccgcagcgccgagcagcagggctacgacagccagatactgcgcgcggtggaagcgcgcaacgcgcggcagaaggagctgctcttcgagaccctcggcgagctgttccagggacgctggcaagggcgcacggtggcgctctgggggctggccttcaagccgggtaccgacgacctgcgcgaggcgccgagcctggtcctgctggaggcgctgctgcgccacggggtgcgggtcagggcccatgatccggtggccaacgccggggtcgcggcacgctatccggaagctgtggcctgcgcccgattgacgctccacgactcgccctacgccgccgtcgagggcgccgatgccctggtgctggtgaccgagtggaaacagttccgccagccggacttccagaaaatccgtggatccatgcgaactcccctgttggtcgacggtcggaatctctacgcaccggcgcggatggcggaactgggcttcatctaccagggcataggacgtccaagggccgggcattgtaaggcgagcgcagcctga

SEQ ID NO: 11450 - DNA, 852 bp, Pseudomonas aeruginosa
ttttgcgctacatgtgcatacttgattcctatatttttctttgtagggaatatttatgtccattccattggatatctacgatcagcgtattcttgcgttgctacaggaggaatcctcgctttccaccgccgagatcgccgagcgcatcggactttcccagtcgccctgctggcggcgcatccagcgcctgaaggaggagggggtgatccgcaagcaggtgaccctgctcgaccgcaagaagatcggcctgaatacccaggtattcgcccagatcaagctcaacgcccatgggcgcaagaacctcaccgatttcgccgaggcgatgcaccagtttcccgaggtgctggagtgccacgtactgatgggcgcggtggacttcatgctgcgtatcgtcacccgcgatatcgaatcctacgaacgctttttcttcgagaaactgtcggcggtgccgggcatccaggaagtgaactccatcgtcgccttgtcggaaatcaaatccaccactaccttgcccctgctcgctccctgagccttcccggagaacgcctgcccatgaccatcagcaagaccaagtccagcttctaccgccgcctctacgtcgcctacctgatcgacagcggcaccgccagcgtgccggagatcatggccgccaccggcatgccccggcgtaccgcacaggacaccatcgccgcgctggaggaactggacatcgtctgcgagttcgagcagcgggagggtgcgcgcaaccaccagggcggctatgtcatccgcgactggggggcggtacggcgggagtgggtggtcgagcagcatcggcgaatcgcggcggcgctggagtatccggcggaatga

SEQ ID NO: 11451 - DNA, 1485 bp, Pseudomonas aeruginosa
atggtggatttcgccaccatctgtaccggtcccgctttcgctcaccctggagtcccgctcatgaccctttatctgcaactcgccgagaccctcggttcgcgcatcgaacagggcctctaccgtccgggcgaccggctgccctcggtgcgggccatgagcatcgagcacggcgtcagcctgagcaccgtgcaacaggcatacaggctgctggaagatcgcgggctggccgagccgcggccgaagtccggctatttcgtaccggtcgcgcgacagatgccgccgctgccggcgatcgcccgcctggcccagcggccggtggaaatctcgcaatgggagcaggtgctggccctggtcagcacggtaccgcggccggacgtggtccagctcggccgcggcatgccggacatctccagcccttcgctgaaaccgctgacccgcagcctggcccggctcaaccgccacgccgacgcccgtgcgctggcctacgacgggatccacggctcgccgttgctgcgcgaggaagtcgcccgcctgttggtggactccggctgtcgagccaccgccagcgacgtggtgatcaccaccggctgccacgaggccctgtcggtgagcatccgcgcggtgtgcgaaccgggcgacatcgtcgcggtggagtcgccgagcttccatggcgccatgcaatcgctgaaaggcctcggcatgaaggccctggagatccccaccgatccggtcaacggcatcagcctggaagccctcgaactggcgctggaacagtggccgatcaaggccatccaggtgaccccgaactgcaacaacccgctcggctacatcatgcccgagtcgcgcaagcgggcgctgctggccctggcccagcgctacgacgtggcgatcatcgaggacgatgtctatggcgacctggcctacacctatccgcgcccgcgcaccatcaagtcgtacgacgacgatggccgggtgctgctctgcgggtcgttctccaaggtcctggcgccgggcctgcggatcggctggatggtacccgggcgctacgccgaccgcgtgctgcacatgaagtacatcagtaccggcgccagcgccctgcaaccgcaactggcgatcgccgaattcatcggcaacggccactacgagccgcacttgcggcgcatgcgcgcccagtaccagcgcggacgcgacctgatgatcgactgggtggcgcgctatttcccggagggcacccgcgccagccggccccagggcggtttcctgctctgggtcgaactggacgaggcgttcgacaccctgcgcctggacaaggccttgcgcaaccgcggcgtacaagtcgcggtgggctgcatcttttccgcttccggcaagtatcggaactgcctgcggatgaactacgcggcgttgccgaccccggccatcgagcaggcggtcaggcgagtaggggagagcgcttgcgagctgctggagccttgcgaggcctga

SEQ ID NO: 11452 - DNA, 933 bp, Pseudomonas aeruginosa
tgggctattggcgcctgggcaaggtgttcgactgatgggccgcttcgtcgggaaacaggcggacggctacgagacgcggatcggccgcctgttgccgggctacgagttgctgcacctgctcagtcgcgcgcagttgctggcccgtctgccggaacgggcgcgcctgctcagcgtcggctgcggcgccggcggcgaactggcggagctggccgggttgcgtccaggctggcgtttcgtcgcggcggacctgtcggccgacatgctcgccctggcccgccagcgctgcgccaggctcggcctgctggagcggatcgagctgcactgcggcgacgtcgccgggctaccgcctgcgccgccttgcgatgcggcgctggtcctgctggtgctgcatttcctgcgcggcgaccaggccaagcggcgctttctcgaggcggtcgccgagcgtctggcgccagcggcgccgttgctgctggccaacctgatggaagcccgggacgccttcgaacgtccggtgcaggccgaggcctgccgcttggccgggctttccccggaggacagcgacggcatgctgcaacgcttgcgcgaggatttcgatccgttgtccgagcagcgcctcggcgaactgctggaagacaccggcttcgtcctgcccagccgctatttccaggccgtgggctaccaggcctggatcgccttccgcgccggctgaggatgcctcaggcgaggcgcgcctgcggcgtgatctggcgtgggtcggtcagcagctccagcagcgccgggcgtccgctttcgcgggcgcggcggaatgcggcggggaagtcggcgctgcattccactcgttcggcgtgggcgccgaaggctcgcgccagggcgacgaagtcggggttgtccaggcgggtggcggatacccgcccgggatattcgcgctcctga

SEQ ID NO: 11453 - DNA, 1482 bp, Pseudomonas aeruginosa
aatattatgaaagggattttcatgaagaagtctatgatttcttgtttgtgttttgtgcttcttctgcactttttattggtttcgaaagttgcggcggaagtcttttgtgagtcttgtctacaggtgcgggtggagcgcccgctagtagttaggggtgggtctcacgagcctggcctggatactaagttttatgtaataaagctctctgaaaatttattcagaggctacagttccggaggtggtgatgcttacgcaataaccgggccggaggcctggtctatgggctggcctgccaataaggtgttaagtaaaggtgccgcagggtcctacagcgagtgtggagtatggataaattctccggttaagatcggagatgtctatgttgcagccgtgcatcaggagcaaaagtgcgactacatcaatggtgggcagacgcacaagtcaatgggggtatcgttttcttatgatggtctatcttgggttaatccaattactgtgttgaccagccctgaggcaccgaagatggggacccaatctggggagggtgattgttcactggttcgggcccccgatgaaggctacctctatatgtattgtttcaggccggggcgatgggataatatcgtggcgcgtgctccggaggcatcttatatgttcccgtcaagctggaggaaattatataaaggaaattggagtgagcctgcggttggtggtatggcagatagtttgggtactatagggagtagtgttgggtattggcgggctggacgtaaagttattgcgcttgatctcgatccatggtttggcgggataaagctgtcattgtcctcggattataagaatttttttactcttaaggatcctcttgttccgtttgttaaaaatgattgggatcgaaatttaatcgggaagtcaactgacttaatcgcatatgtgggggtcgtgaatctacttggcggtgggaatcgagttgataattctggatggggtatcacctatacttatataccgcatggaggaacgctaaaggaaaagtatctcgtctttcaaggggttaacatgaaggtggttagtgaacctcaacaggcttccgtaggtttggctcttacccgctgggagcacaggagtgggaaatacagagttactactctgcctgtggtgagacaatccgagtacaccgagcgtaatcgtatcgcatatctcctgactcgtcctgtcgttggtattgaaacgcttgaggtggaggagtgtgtgaatagacaggatcccgatgattatctcgtgactgatgcaggaggatgtgacgggagcggacatgatcgaatcgccactatcggctgggtgtataaatacccacaaaaaaatacggtccctatttatcgctgttactctccgcttggcgaaaatcattttctatcatcgaatgcagggtgtgatgatttgggaagcttggaatggaagcttggatatggtttgaagtaa

SEQ ID NO: 11454 - DNA, 1359 bp, Pseudomonas aeruginosa
tcccttcttcgccgacccccgcgaagtcctgcgccaggtggtggccaggttcaccgagatggaactgaccatcgtcgccgccttcgagctggagttctacctgatcgaccaggagaacgtgaacggccggccgcagccgccgcgctcgccgatctccggcaagcgtccgcagtcggtgcaggtgtactccatcgacgacctcgacgaatacgtcgagtgcctccaggacatcatcgacggcgcccgcgcccagggcatcccggccgacgccatcgtcgccgaatccgcaccggcgcagttcgaggtcaacctgcatcacgtcgccgacccgatgaaggcctgcgactatgcggtgctgctcaagcgcctgatcaagaacatcgcctacgaccacgagatggacaccaccttcatggccaagccctatccgggccaggcagggaacggactgcacgtacacatctcgctgctcgacaagcacggcaacaacatcttcaccagcgaggatcccgagcagaacgccgcattgcgccatgcgatcggcggcgtgctcgagaccctgccggcctccatggccttcctctgcccgaacgtcaactcctaccgccgcttcggttcgcagttctacgtgccgaacgcgccgagctggggcctggacaaccgcaccgtggccctgcgcgtgcccaccggcagcccggacgcggtacgcctggaacatcgcgtcgccggcgccgacgccaacccctacctgctgctggcctcggtgcttgccggggtgcaccacgggctgaccaacaaggtcgagccgggtgccccgatcgaaggcaactcctacgagcagttggagccgagcctgccgaacaacctgcgcgacgccctgcgcgaactggacgacagcgagatcctggcgaagtacatcgatccgaagtacatcgacatcttcgtcgcctgcaaggaaagcgagctggaggagttcgagtactcgatctccgacctcgagtacaactggtacctgcacaccgtgtgagcatggggcggctccttcccccttccgctctcccctcccccgctttcgcggcttgtgggagcgcagctctctcgcgtagctccggcgtccgccctggccgcccaccggggcttcccccgtggccccgtgctcccgtagcgcttgcttccgatcgccctgcccttttcagtctgcgcggtgacggccttctggcggtgtaccggctttgctttgcctcccccgctcgtgcgactgcccggctggcgtgcccccccctcatgctgcgcgctccgccaggagggctctgtcttgggatcggcgtatcgccgcgtcagctcgtgttcctctcgctg

SEQ ID NO: 11455 - DNA, 1524 bp, Pseudomonas aeruginosa
acgaggcttgccgccggagaggtaggggggaataacgagtgcaatagtgcgcggcgaatcccagtaaccgagggaagatccggccgagggggggacgttgggtcatccgggtggggtagatggggatcagccagtagactcgcgcggaccgtcctttccagagggcgtaggataggaggctgtcgcaccgtctacgtccacccgcagcgattcggcccggccacgggcgaatccaggagaaccatccatgcaagacgtcgtcatcgtcgccgctacccgtaccgccgtcggcagcttccagggctcgctggccggcattcccgcccccgagctgggcgccgcggtgatccgccgcctgctcgaacagaccggtctcgatgccggccaggtcgacgaagtgatcctcggccaggtgctcaccgccgggtccgggcagaacccggcgcgccaggcggcgatcaaggccggcctgccggtcggcgtgccggccatgaccctgaacaaggtctgcggctccggcctcaaggccctgcacctgggcgcccaggcgatccgctgcggcgacgccgaggtgatcgtcgccggcggccaggagaacatgagcctggcgccctacgtcatgcccggcgcccgcaccggcctgcgcatgggccatgcgaagctggtcgacagcatgatcgaggacggcctgtgggacgccttcaacgactaccacatgggcatcaccgccgagaacctggcggagaagtacggcctgacccgcgaggagcaggacgccttcgccgccgcttcgcagcagaaggccatcgccgccatcgagggcgggcgcttccgcgacgagatcacgccgatccaggtcccgcagcgcaagggcgagccgctgagcttcgataccgacgagcagccgcgcgccggcaccaccgtcgaggccctggccaagctcaagccggccttcaggaaggacggcagcgtcaccgccggcaacgcctccagcctcaacgacggcgccgccgcggtattgctgatgagcgcggccaaggccaaggccctgggcctgccggtgctggcgcggatcgccagctacgccagcgccggggtcgacccggcgatcatgggcatcggcccggtctccgccacccgtcgcgcgctcgacaaggccggctggagcctggagcaactggacctgatcgaggccaacgaggccttcgccgcgcagtccctggcggtgggccgggaactgggctgggatgccgccagggtcaacgtcaacggcggcgccatcgcccttggccacccgatcggcgcgtccggctgccgggtgctggtgaccctgctgcacgagatgatccgtcgcgacgcgaagaagggcctcgccaccctgtgcatcggcggcgggcagggcgtcgccctgaccctggcccgcgactgatccatcgacctgccgctcgcggcgtgatcgcgccatgtcctttcgcgggggcatggcgcgctcgtgtccagggaacgagcggcggacggccttga

SEQ ID NO: 11456 - DNA, 822 bp, Pseudomonas aeruginosa
ccgtccgaccggccccgtaccgttccgcccctcgggacggccgggtgcccagggagccgtagcacacacaggcggccccgtagtcgccgaataacaataaaaccgagagaatccgcgatgaccgctatccttcccatccaagaaagccgctccgcgcgcttcgccatgcgttgctcgaactgggccgagcgctggtttcccgactcctgggtgttcgccgccctggccatcctcatcgtcagcctggccgcgctggccatgggcgccggaccgaccgccacggcgaaagccttcggcgacggtttctggagcctgatcccgttcaccatgcagatggccttcgtggtcatcggcggctatgtggtggccagttcaggccccgcctcgcgtctcatcgacctgctcgcgcgggtgccgaagaatggccgctcggcggtctgctgggtggcgctggtgtcgatgctcgcctcgctgctcaactggggcctcagtctggtccttcggcggcctgctggtacgcgccctggcgcgccgcagcgacctgcgcatggattaccgcgccgccggcgccgcggcatacctcgggctgggcgcggtgtgggcgctgggcctgtcgtcgtcggccgcgcagttgcaggccaacccggccagcctgccaccgtcgatcctggcgatcaccggggtgatcccgttcaccgagaccatcttcctctggcagtccggggtcatgctgctggcgctgatcctggtctcgctggtgatcgcctacatgaccgcgccgagcgccgccagcgcccgcgacgccaaggattgcggggttga

SEQ ID NO: 11457 - DNA, 723 bp, Pseudomonas aeruginosa
cgaaggccagcgagggttgcttttccgccagcaggtcgtgttccgcctgttcgggcgagacgccctcggcgatgcgcgcgtcgatctgcttctgcaccagcggggtcagcacccagccggggcagatggcgttgcaggtcaccggcgtgcgcgccgtttccagcgccacactcttggtcaggccggaggcacgccatgcttggcggcgacgtatgcgctcttcccggcgcgaaggcgaccaggccgtgggtcgaggcgatgttgacgatccgcccccagccgcgcgcgagcatgcccggcagggccaggcgggtggtatggaacacgggggacaggttgatcgcgatgatcgcgtcccagcgttccgtggggaattcctgcaccggcgccacgtactggatgccggcgttgttgacgaggatgtcgacgccgccgaaggtccgctcggcgaaggccatcagttcgccgatctgctccgggctggagaggtcggccgggtggtgctctgcgcgcacgccgcgggcgcggacctgcgccagcgccgcgtcgacctcgccgaagccgttgaggagcaggtcggcgccggcctcggccaggctcagggcgatgcccaggccgatgccgctggtggaaccggtgaccagggcggtcttgcctttcagggtcatgctgtttctcccgctggatgaaaaaagggcggatcagaccaggccggtggcgtag

SEQ ID NO: 11458 - DNA, 738 bp, Pseudomonas aeruginosa
aacagcccgatgacgaagaacaccgccagggtcttgatcagggtaataccgaaaatgtccttgtacgcctcccgatgggtcaggccggtgaccgccaggagggtgatcaccgcgccgttgtgcggcagggtatccatccctccgctggccatggcggcgacccggtggaggacttccagggggatctgcgcggcgttggcggcggcgatgaaggtatcggacatcgccgccagggcgatgctcatgccgcccgacgcggaaccggtgatgccggccagcagggtgacggtgatcgcttccttgaccagcggattgggaatgctcttgagcgcgtcggccagcaccaggaaacccggcagcgaggcgatcaccgcgccgaagccgtattccgaggcggtgttcatcgccgccagcagcgagccggccaccgcgctgcgggtgccttcggcgaggcggctgcggatcgccgcgaaaccgctcgccagcaccagcaggatgcccagcagcagggccgcctgcactgcccagatcgcggtgagcttgccgacctcggtctgcaacggcgtggccatgccggccagttgcagggtatggacctggccgtaccattgcgggatccagtgggtgaacagcaggttggcgaccccgaccagcaccagcggcgagagcgccagccagggattcggcaggcgcaggtcatcggcggtctccggctcgttgcgcaggtcgctgccgtag

SEQ ID NO: 11459 - DNA, 654 bp, Pseudomonas aeruginosa
tcgagcgaaagttccgtggctatgcagatctcagttcgtctctatttagagatgggtcccgttatcgagacgcatgcccagcgccatgatcttcttgtacagggtcgagcgacccaggcccaggcgtttcgccgcttccaccacattgccggcactctgcgccagggcccgtccgatcaggtcgcgctcgaaggcttcgcgggcctgttggaaatccccgaccggcctgtcgtccgccgctcgaggcagctccggcagcggttgcagggggcccagcgccgcgccgagggcggcggcgtccagcaacggttggtcggccagcagcagcgcgcgttccagcacgttgcgcagttcgcggacgttgcccggccaggcatgccgggcgagcagcgccagggcgtcgccgccgagttcgtggagacggccgtggtcgaggctgtcgaggatcgactcgcagagcgccgggaggtcgtccaggcgctggcgcaacggcgggatctcgatcggcaggacgttcagtcggtagtagaggtcagcgcggaaacggccttcgcgcatcgcctgctgcaggtcgatggaagtggcggcgaccaggcggatgtcgctgcggatcacttcgttggaacccaccgcttcgaactctttctcctgtag

SEQ ID NO: 11460 - DNA, 1131 bp, Pseudomonas aeruginosa
cacgcgcaacagcttgccttgcaaggccagcggcatgtcgccgatctcgtcgaggaacaacgtgccgccctgggccacctgcaacttgcctggccggcccttgcgctcggcaccggtgaaggcccccggggcggtaccgaacaattcggcctccagcaggctttccgggatcgccgcggcgttcacgctgacgaaggccttgtgcgcccgcggcgaagcgctgtggatggcgtgggcgagcagttccttgccggtgccggtctcgccgagcaacagcaccggcgcttcgctggccgcgccacgacgggcgcggcgcttgacttccaggctggccggactggtaccgacgaagtggctgaagctgtacttggcctggcgcgcctgcaattgcgagcgggtcgaggccagttcgcgctgcatgctcaggtagcgggtcaccagcggcgacagcgaacgcagttcgtcgagcagggcgaagccgatggcgccgatcacttcgccggcgtcgtcgtggatcggcaggcgcatcaccaccagcgggtccttcgcgctatccatcatgtccagcaggatcggcttgccgctgcctaccacctcgcgcagcaggctaccggggatcacgctttcgcagggccggccgatagcctgcgccgggtcggcgaggccgaaacgctgggcgtagcgctggttgatccagacgatgcgggcctcgcggtcgacgatcaccgtgccttcgctggagccttcgacgatctcgaacagcgaacggatcgcctgctggcgtacgcgttggtaatcctggaggctgtcggcgtcgttcatcggcggctcctgcggcggacggcgaaacgggccgccactgtagccgggaagccgctcgcggtgaaggctcaggattcctcgacggccagcgcggcggcgctttcccgctgcgcctgggcggcgggcgagcggacctggaggatcagtagcgcggcgagcccggcgggaatcgccgcaagcatgaagatgttctccacggatatgtgcatgcccagcagcaggctgccgaacagtgggccgaggatcgaaccgaagcggcccacgcccagcgcccagccggtgccggtggcgcgtacctgggccgggtag

SEQ ID NO: 11461 - DNA, 1755 bp, Pseudomonas aeruginosa
tcgccgatcctggccggtaggtgcatttggcactcggcggccggatggagcagttccgggcgctccgcggcgccttcgccgagcagctccagcaggcgctggcgcagcgccacgcgggccggcttgccgagggcgaagaaggcgttcagcgcgccgccgcgggtggcttcggcggcttcgccggcggcaccctcgaacagcccggcggccagcgccgcgtccaggtctaggatcgagtcgccgatggccacgccgcaacgcgggctcaggccggcacggctgaagatgcccagcggcaggttttgcaggggaaagtcggcatgcccattggcggaggcgacccagctacgagtgggggttggctggttcatggggttatctccgttgcgggttgaaggtggatacgagcgacgcccagcaggcatcgtagtcattctgcagggccggcgtctcgagggcggcacggctcggccggaggacctggctggtctcgaacatgaaggccatggtctggtcgatcctgtgcggcttgaggtcggcggcgatggccttgtcgcagctttccgcgtccgggccgtgggcgctcatgcaactgtgcagcgaggcgccgccgggcacgaagccgccggccttggcgtcataggcgccctggatcaggcccatgaattcgttcatcaggttgcggtggaaccatggcggacggaaggtgttctcggccaccatccagcgcggcgggaagatcacgaagtcgatgttggccaggccggggacgctggtgggggaggtcagcacggtgaagatcgacgggtctgggtggtcgaagctgaccgtgccgatggtgttgaagcggcgcaggtcgtacttgtagggcacgttgttgccgtgccaggcgaccacgtccagcggcgagtggtcaagctcgcaggcccacagctcgccgaggtatttctgcaccagttgcagcggctggcggctgtcctcgtagcgcgccaccggggtcaggaagtcgcgcggattggccaggccattgctgccgatcgggccgaggtcgggcaggcgcagcggcgcgccgtggttctcggcgatatagccgcgtgcctcgccgtcgagcagctcgacgcggaacttcatcccgcgcgggatcaccgcgatctccagcggttcgacttgcagcgcgccgagttcggtgcacaggcgcagacggcccaattgcgggaccagcagcagttcgccatcggcgtcgtagaagcaacgctccatcgagcggttggccaggtactggtagatgctcacgccggcgggcttgtcgccgggcgcgttggcggccatgcgcagcaggccgtcgaggaagtcggtgggctgctcgggcagtgccagcgggtcccagcgcaggcggttgggagtcggcgcatccagttcggcaccggcgatctgtcgttccaggcggcggaacggcggatgcttggccgacggcgtgatgcggtacagccaggtgcgccgggcctcgctgcgagccatggtgaaggcggtgccggagagcagttcggcgtacaggccgtagggcgctttctgcggggagttctggccgaccggcagggcgccggggagcgcttcgctgctgaattcgttgccgaagcccgattgataggcgagggcagtggagtcgaggttcatctgaggcctccggggagtgggggcagcttgccgccgatccgccggggacctggcacgctggctgcgttatttttatcgtaa

SEQ ID NO: 11462 - DNA, 867 bp, Pseudomonas aeruginosa
cgtaatttgagtggaaggcagcgtcaagctataacgtcggccccgcccgcaggaacccgcgtccatggaaaagaacagcagtcccgccgaaacctccggcaagcagaaggtccgctccgccgaagtcggtaccgatatcctcaaggccctcgccgaactctccccggcgacctcgctgtcgcgcctggcggagcatgtggggatgccggcgagcaaggtccatcgctatctgcaggcattgatcgccagcggcttcgcggtccaggacgcctccaccaatcattactcgctggggcgcgaggcgctgcgcgtgggcctggcggcgctggacagcatggacgtgctgaagagcgccgccgcgccgctggccgagctgcgcgacgtgctcaacgagacctgcttcctcgccgtctggggcaaccgtggcgccaccgtggtacaggtggaacaggcggtgcgcgcggtgacggtggtcacccaggtcggctcggtgctgccgctgctcggttcgtccaccggcctggtgttcgccgcgttcctgccggaacgcgaggtggccgagctgcgcgaggaagagttggccgggcgtgccgaccatccgctggccgacccggcggcctacgcggtgctcctggaggcatccgcgcgcgcggcctgcatgcgatccatgggctgctgatgcctggggtggaggcgctctcggcaccggtgttcgacgcccgcgggcgggtggcggcggtgctcacggtggtcggcccggcgagcatcttccaggccgaggagcaggggccagcggcggaacggctgcttgcgacgactcgggctatcagttggcggatggggtatgacggcacccagggtggatga

SEQ ID NO: 11463 - DNA, 1239 bp, Pseudomonas aeruginosa
tgttgcgctgggagaaggcttccgacgcggcggcgaacaccgccacttccttcactcccgactccagcgccgcctcgaagcctttcaggttcggcgccagcgccgcgtaggtcacgccgggacgctggcggatgccggcgaatacctcggccgagccggccatctgcggcacccacttgggcgagacgaagctgcccacttcgatgtagtccaggccggcggcgctcaggtcatcgaccaggcggatcttgtcggccacctcgatcggctgtttctcgttctgcagtccgtcgcgcggaccgacctccaccaggcggaccttcttcggcaggttcatgctgttcctcgtcttggctgtcaggcctggttctcgtccagctccaccagcggcgtgccttcctcgaccagttcgccctcgctgcaatacagcgccttcactaccccggcgtggggcgcgcggatgctgtgttccatcttcatcgcctccagcaccaccagggtggcgccggcttcgaccgtctggccgggctcgaccaggacccgcacgatactgccgttcatcggcgcgctcaaaccgccctggtgggcatgggcggcctcggcctcggcgatcgggtcgacggcttcgatggccagcagttcgccctcccattcgaggaacaattggcgtccgcggcgcaacgccgccgagcgacgggtgacaccgtccacccggctgaccaggtcgtcgccgtcgaggcgatactggctggggctggcgtggcgcaggcggacgcagcggcgttcgtcgcggcagcgcagcatcaggtcggactcccgcgccagggcgctgcgccagccgtcgttgcggctccacggcgaatgcgggtcgtcgtcgcgacggtggcccggttcgctctgcagccaggcttcggcggcggcttgccagaaatgctccggcagcgcttgcggcgccggcagcaggtcgtcttggtggcgcgcgatgaacccggtgtccagttcggcggcggcgaacgccggatggccgaggatgcggcggaggaacgccaggttggtgcgcaggccgccgaccgaggtttccgccagcatcgccagcaggcgctggcgggcttcctcgcgggtttcgccccaggcgatcagcttggccagcatcgggtcgtagaacggcgagacctcgtcgccttcgcgtaccccgctgtcgacccgccggccggggccggcggccgcttcgcggtatag

SEQ ID NO: 11464 - DNA, 1080 bp, Pseudomonas aeruginosa
cgcctcgccgcgagcgacgcggatctgccaggcgaccaggtcgaggccggtgatggcctcggtgaccgggtgttccacctgcaggcgggtgttcatttccatgaagaagaactggccgcgttcgtcgaggaggaattcgacggtaccggcgccgacgtagccgatcgcctgcgccgcgcgtaccgcggcctcgcccatggcccggcgcagttccgcgccgagaccgggggcgggggcttcctcgacgaccttctggtggcggcgctggatcgaacagtcgcgttcgttgaggtacaggcagtggccatggcggtcggcgaatacctggatctccacgtggcgcggcttcagcaggtatttctccaccagcatacgcgcgtcgccgaaggcggccttggcctcgcgctgggcggaggaaagggcctcggccagctcggcctcgcgctccaccaccttcatgcccttgccgccgccgccagcggcggccttgagcagcaccgggtagccgatgcgcccggcttcccggcggaaagtctcgaggtcctgggcttcgccgtgatagccgggcaccagcggcacgccggcttcttccatcagcgccttggcggccgacttgctgcccatggcgtcgatggccgccgccggcggtccgaggaagagcaggccggcttcctcgcaggcgcgggcgaagtcggcgttctccgagaggaagccgtagccggggtggatcgcctgggcgccgctggcgagggcagctgcgatgatcctgtcgccgcgcaggtagctgtcggcgggcttggcgccgcccaggtcgacggcgatgtcggcttcggcgacgtggcgggcgtggcggtcgatgtcgctgtgcacggcgacgctgccgatgccgagggcgcgcgcgctgcgcatcacccggcaggcgatctcgccgcggttggcgaccaggaggcgctggatgctgcggtagtccgggttcatgcgtcgtttctccaggcgggcgtgcgtttctccaggaaggcgcgcaggccttcctggccttccgggctgatgcggatgcgggcgatggccgcctcggtgtag

SEQ ID NO: 11465 - DNA, 921 bp, Pseudomonas aeruginosa
gaccttgcagtgcacgtcggcgccgccaagttcctcggcgctgaccacctcgccggtagcggccttcaccagcggcggcccggcgaggaagatggtggcctgttcgcgcaccatcacggtttcgtcggacatcgccggcacgtaggccccgccggcggtgcaggagcccatgaccacggcgatctgcgggatgccgcgggcactcatgttggcctggttgaagaagatccggccgaagtgctcgcggtcggggaacacctcgtcctggcgcggcaggttggcgccgccagagtccaccaggtagatgcatggcaggcggttctccagggcgatggcctgggcccgcaggtgcttcttcacggtcagcggatagtaggtgccgcccttcaccgtggcatcgttgccgacgatcatgcattccaccccttcgacccggccgatcccggcgacgatgccggcggcggcgacctcttcgccgtagacttcgtgggcggcgagggcggaaagctcgaggaacggcgagccggggtcgagcaggcggttgatgcgttcgcgcaccagcagcttgccgcgcgcgctgtgccgggcctgggcggcgctaccgccgccttcgtggatgcggccgaggagggtgcgcagggcgttgacctgttccagcatggtcgcggcgttggccgcgaactcggcggagcgtggattgatctgggtgtgcaggatggccatggcggtggctccgtgtcgaggtgggcggaagcggttggcgcccgctcccgacctggcgatgcgcctgtcgatgcaatggaatgccctctccctggcggaaaagggccgggaagagcgaggcttcagcgggtttcgttgaacagctcgcggccgatcagcatgcggcggatctcgctggtgccggcgccgatctcgtag

SEQ ID NO: 11466 - DNA, 1134 bp, Pseudomonas aeruginosa
gtgatggacatgcgctggcacctgcttgtttacctttacgttaacgtaaggctgcgccgaaatcctgtcaacgcctggaacggggggaaaaatgacagccgtgaaagatgcttgtcagaaagatttaatcggcgcctcatgaaagggcgcggatggctctgttctgcttcgccgaacactgtgtttctcggaggagtcgtaacgatgagtcggctgatgacctacaggacgctgctggcttgcctgctcgccgcgttgcttgcgctgctggtggcgggccagcagcagcgcgcgttcgagcgaatctggttcaagctggagcagcgctacggcggcgatgttgcgcgcgagaacgccctgcgcctggccgactatcgggtcgatatcgaagcccgcgtgctgggcgcggagtccaacgtgtcggcgctgtccttcgaccccagccggcgcagcctggtcagcgtgaccaaccaggacccgcatttcctcgagctgtcgctggacggcgaattgctgcgacgcatccccctgcgcggtttccaggatccggaggctatcgagtacatccggcccggcgtctacgtggtcgccgaggagcgtcgccaacgcctggtggagatccatgtcgacgccgacacccgggtgatcgacatcgacgatccgcgcaacgcccggaagttctccctgggcagtgcaaacaagcgcaacaagggcttcgaggggttggcctacgacccgctgcgcgagcgcctgttcgtggcccgggaaaaggcgccggtgggcatcatcgaggtaaacggcttcttcaacgaccgcggcgaggcgctcgacctgagcgtcggcggcgacccgcagcgcgatcgcgggttgttcctcaccgatctgtcgagcctctactacgacaaggccagcgatcacctgctggtgctttccgacgagtcgcgggtggtcatcgaactggatcgcgccggggatccgctcggcagcctgaccctgcgtggcggcaaccatggcctgacggacgacgtgccgcaggccgaagggttggcgatggacgaccggggcagcctgtacgtggtcagcgagccgaacctgttctaccgcttcagccgagcgctgccagcggccgactag

SEQ ID NO: 11467 - DNA, 477 bp, Pseudomonas aeruginosa
actgctgttgccagtcgtccagcttgccccgaaggtcggggccgttggccggaacgatgggggccgcgcgcggctggcgaggcgtcggcgagcaggcgccgagcagcccgacgcacagtgccagggtggggagcgagagtttcgctaggggcatcaggcttgctccgtggggatctggggcgagttgccggtgcgcggcgccttgcgcaaccggaacaggcgcccgaccaccaggaagaacagcggtaccaggaacaccgcgagtaccgtggcggtgacgatcccgccgagcaccccggtgccgatggcgacctgggcgccggaaccggcgccgctggagagcgccagcgggaccacgccgaaaccgaacgccagcgaggtcatgacgatcggtcgcaggcgcaggcgcgcggcctccaggggtcgcctgcagcaggctcatgccttcctggtaatggtccttggccacctcgatga

SEQ ID NO: 11468 - DNA, 642 bp, Pseudomonas aeruginosa
ggacgttcagtggccaggaaaaccaaagaggaatcccagaaaacccgcgacggcatactcgatgccgccgagcgggttttcctggaaaagggcgtgggcactactgccatggccgacctggcggacgccgccggggtttctcgcggtgcggtctacggccactacaagaacaagatcgaggtctgcctggcgatgtgcgaccgcgccttcggccagatcgaggtacccgacgaaaacgccagggtgccggcgctggatatcctcctgcgcgccggcatgggctttctccgccagtgctgcgagcccggttcggtgcagcgggtgctggagatcctctacctcaagtgcgaacgcagcgacgagaacgagccgctgttgcgccgccgcgagctgctcgagaagcaggggcaacgcttcggcctccggcagatccgccgggcggtggagcgcggcgaactgccggcgcggctggacgtcgagctggccagcatctatctgcaatcgctctgggacggcatctgcggcaccctggcctggaccgagcgcctgcgcgacgatccctggaaccgcgccgaacgcatgttccgcgccggcctcgacagcctgcgcagttctccctacctgttgctggcggacgcctga

SEQ ID NO: 11469 - DNA, 705 bp, Pseudomonas aeruginosa
actgcgcgccatccgcatacttcgtccatgtcgaaggattctcatgatcaagaaatgtcttttcccggccgccggttacggcactcgtttcctcccggccaccaaggccatgcccaaggaaatgctgccggtggtgaacaagccgctgatccagtacgcggtggaggaggcgctggaagccggcctttccgagatcggcatcgtcaccggccgcggcaagcgttcgctggaagaccacttcgacatcagctacgagctggaacaccagatccgcaacaccgacaaggaaaagtacctggtcggcatccgtcggctgatcgacgagtgcaccttcgcctacacccgccaggtggagatgaagggcctcggccacgccatcctcaccggtcgtccgctgatcggcgacgagccgttcgccgtggtcctggccgacgacctgtgcctgaacctcgaaggcgacagcgtgctgaagcagatggtcaagctgtacaaccagttccgctgctccatcgtggcgatccaggaagtgccgccggaagagaccaacaagtacggcgtgatcgccggcgagatgatccgcgacgatatcttccgggtgaacaccatggtcgagaagccgaagccggaagaggcgccgtcgaacctggcgatcatcggccgctacatcctgaccccggacatcttcgacctgatcgagcagactga

SEQ ID NO: 11470 - DNA, 1371 bp, Pseudomonas aeruginosa
tccaggagtaggaacatgtctttcgatttcgatctgttcgtcatcggcgccggctcagggggcgtacgcgccgcccgcttcgccgccggcttcggtgcccgtgtcgcggtggcggagagtcgctacctgggtggcacctgcgtcaacgtcggctgcgtgccgaagaagctgctggtctatggcgcgcatttcagcgaggacttcgagcaggcccgggcctatggctggagcgccggcgaggcgcagttcgactgggcgaccctgatcggcaacaagaaccgcgagatccagcggctcaacgggatctaccgcaacctgctggtgaacagcggggtgaccttgctcgaaggtcacgcccgtctgctcgatgcgcacagcgtcgaggtggacggccagcgcttcagcgccaagcacattctcgtcgccaccggtggctggccgcaggtgccggacattcccggcaaggaacacgcgatcacctccaacgaagcgttcttcctcgagcgcctgccgcgccgcatgctggtggtcggcggcggctacatcgccgtcgagttcgcctcgatcttcaacgggctcggcgccgagaccaccttgctctaccgtcgcgacctgttcctgcgcggcttcgaccgcagcgtccgcgagcatctgcgcgacgaattgggcaagaagggcctggacctgcagttcaacagcgacatcgcccgtatcgacaaacaggccgatggcagcctggccgcgaccctcaaggacggccgggtgctggaggcggactgcgtgttctacgccaccgggcggcggccgatgctggacgacctgggcctggaaaacacagctgtgaagctgaccgacaagggcttcatcgcggtcgacgagcactaccagaccagcgagccgtcgatcctcgccctcggtgacgtgatcggtcgcgtccagttgacccccgtggcgctggccgagggtatggcggtggcacggcgattgttcaagccggaggagtatcgcccggtggactacaagttgattcccaccgcggtgttcagcctgcccaacatcggcaccgtcggcctgaccgaggaggaggcgctgagcgccgggcacaaggtgaagatcttcgagagccgcttccggccgatgaagctgacccttaccgacgaccaggaaaagaccctgatgaagctggtcgtggatgcccacgacgacagggtgctgggctgccacatggtcggcgccgaggccggcgagatcctccagggtatcgcggtggcgatgaaggccggggcgaccaagcaggcgttcgacgagaccatcggcatccacccgaccgcggcggaagagttcgtcaccctgcgcacgccgacgcgctga

SEQ ID NO: 11471 - DNA, 1599 bp, Pseudomonas aeruginosa
gccgcgtctgaacgaagaagccggcccctgggccggcttctttcattttcgcgctcagcgcgagggggcctcggccagcgccgccgctgcgtcgtcgcggcgcctggcgtagcgttgcgcgagcaccgcgcagaccatcagctggatctggtggaacagcatcagaggcaacaccatcggccccaccgcactggtggcgaacagcaccttggccatgggcacgccggtggccaggctcttcttcgaaccgcagaagacgatggtgatctcgtcttccttgctgaagcccaggcgtcgcgccagcaccgtggtcagcaccagggccagggcgaggatcacgcagcaggcgacggtcaggccgagcagcgccagccagggtacttcgtgccacaggccctggatcaccgcggcgctgaaggcggtgtagaccaccagcaggatcgagccctggtcgacatagcgcagcaccggcttgttgcgctccacccaggtgccgatccagcgccgcaggacctggccagcgatgaagggtaccagcagttgcagggtgatcttgccgatggcgtccagcgcgttgccggtctcgccttcggcgccgagcagcagcttgaccagcagcggggtaaggaatacgccgagcaggctcgacacggaagcgctgcataccgctgccggcacgttgccgcgcgccagcgaggtgaaggcgatggaggattgcaccgtggccggcagggcgcagaggaacaggatgccgaggtacagctccggggtgaccatcggcgacagtgccggtttcagcgccaggccgagcagcgggaacatcacgaaggtgcaggcgaacaccagcaggtgcaggcgccagtgggtcatgccggcgatgatcgcctggcgcgacagcttggcgccgtggaggaagaacagcaggccgatgccgatgttggtcacccattcgaagaccacggcggtctggccgctgcagggcaggaaagtggcgagaaggacggtggcgatcagcgccagggtgaagttatccggaaggaaacgcggtcgggacatgggcacgctctgcaggatcgggggaacacatggcagtcttctggctgcctggcgaacctgcactgtagccatgggctgggcgaccggctaacgccagaaggccagccgatgacgccgaatggacagggcggccgccgcgccgccccgaggggctcagacgacgctggccagcagcggctcgctgacgctgggacggaccttgccggcatggggagagaactccaggcggacggcgagcacggtgaccagcgagcgcagcttctccgcgatcacgctggcgcggtgctggctgaggccggggaaggtcagcagcaggcggatcttgtggtcctcgcggtcggcgcgaacccgctccggggtgaaggattgcacggcgaacaggttgagcacccggcacagcaggtccggatcggccatgccctcgatatggaagatcgacagggtctcggtatctgcgcaggaggtttcccagacgttcgggcggatcacctggcgttcttcgccgtcagggtgtttggccaggaaaaggggggcgagggttga

SEQ ID NO: 11472 - DNA, 483 bp, Pseudomonas aeruginosa
ggaatatttatgtccattccattggatatctacgatcagcgtattcttgcgttgctacaggaggaatcctcgctttccaccgccgagatcgccgagcgcatcggactttcccagtcgccctgctggcggcgcatccagcgcctgaaggaggagggggtgatccgcaagcaggtgaccctgctcgaccgcaagaagatcggcctgaatacccaggtattcgcccagatcaagctcaacgcccatgggcgcaagaacctcaccgatttcgccgaggcgatgcaccagtttcccgaggtgctggagtgccacgtactgatgggcgcggtggacttcatgctgcgtatcgtcacccgcgatatcgaatcctacgaacgctttttcttcgagaaactgtcggcggtgccgggcatccaggaagtgaactccatcgtcgccttgtcggaaatcaaatccaccactaccttgcccctgctcgctccctga

SEQ ID NO: 11473 - DNA, 270 bp, Pseudomonas aeruginosa
ccccgaactgcaacaacccgctcggctacatcatgcccgagtcgcgcaagcgggcgctgctggccctggcccagcgctacgacgtggcgatcatcgaggacgatgtctatggcgacctggcctacacctatccgcgcccgcgcaccatcaagtcgtacgacgacgatggccgggtgctgctctgcgggtcgttctccaaggtcctggcgccgggcctgcggatcggctggatggtacccgggcgctacgccgaccgcgtgctgcacatga

SEQ ID NO: 11474 - DNA, 1185 bp, Pseudomonas aeruginosa
ccccggcggctacgaatggaaaccgccggctggcgtccgccatatcctgctgatcgccgacgaaaccgccttgcccgcggtggcgggaattctcgaggagctggccggcgaaaccgagccgccggtggtcgaggcctttctcgaagtgccgggagaagccgacatcctcgacctgccggcgattcccgctgcgcgcctgcactggctgccgcgccaccaggccggtatccattcgcgcaacggcgagcggatgatcgaggcggcgcgccaggcgcggctgccggaacgcgaggtggcgggtggtgcggcccaggaactggaggacatcgatatcgacgaggagatcctctgggaactggcgagccccgagagcggcagtttctacgcctgggtcgccggcgagtcggcggcggtgatggcgatccggcgctacctggtgcaggagcgcggtatcgacaagcgtcatctgaccctgatgggctattggcgcctgggcaaggtgttcgactgatgggccgcttcgtcgggaaacaggcggacggctacgagacgcggatcggccgcctgttgccgggctacgagttgctgcacctgctcagtcgcgcgcagttgctggcccgtctgccggaacgggcgcgcctgctcagcgtcggctgcggcgccggcggcgaactggcggagctggccgggttgcgtccaggctggcgtttcgtcgcggcggacctgtcggccgacatgctcgccctggcccgccagcgctgcgccaggctcggcctgctggagcggatcgagctgcactgcggcgacgtcgccgggctaccgcctgcgccgccttgcgatgcggcgctggtcctgctggtgctgcatttcctgcgcggcgaccaggccaagcggcgctttctcgaggcggtcgccgagcgtctggcgccagcggcgccgttgctgctggccaacctgatggaagcccgggacgccttcgaacgtccggtgcaggccgaggcctgccgcttggccgggctttccccggaggacagcgacggcatgctgcaacgcttgcgcgaggatttcgatccgttgtccgagcagcgcctcggcgaactgctggaagacaccggcttcgtcctgcccagccgctatttccaggccgtgggctaccaggcctggatcgccttccgcgccggctga

SEQ ID NO: 11475 - DNA, 849 bp, Pseudomonas aeruginosa
gtttcggctttttgtcttttagtccgatgggcaagggtaccaatgagcagggaggtttttagggtgaaatttttatccggtttctgggagcgccgtcgtgcgaatggcactcctctagtgtgtatcgaagagcgtggcagtggtgcaggcgaattctcgtcggtgtcccgtagggttgaaactgctcctgacgtacgtagcgttgcgtctgcagattcggagcagtggatacattcccaggagtacgagctttctttctggaaggataaatggccctatcgccatctgtctgtcgaggaactacaagaggcccggcataaggatgcaatgtggtttcttgggaagatggggttcacgtacggctcctcgcattatcgctacgaaggttttgaaggtaaggttttggaagtaggtagtgggccgatcggctttttcgagaaggtcgaaggcgtgacagtgactgcccaggactcattgatggggctgtatgcagagaatcttccattctcgattctcggggaaagaggttcttcttgttatataagggatggtgttgccgatatagagagtgcgttcgatttcgtcgtttgctcaaatgtgcttgaccatacggccgactggatccaattcctgattgactgtgtgggcaggttgaggacgggcggtgagttactgttggtgactgactctcgcggagttccagcaatcgggcatacacagatattcagccatgatcaactggttcgtgtcttggagttgctgggagcaaagcagttcaaggtgaaagccgtcgagcgggaggatggcgttcactgtgactatcgtcattattttcgggtggttttctga

SEQ ID NO: 11476 - DNA, 192 bp, Pseudomonas aeruginosa
ctgatgcaggaggatgtgacgggagcggacatgatcgaatcgccactatcggctgggtgtataaatacccacaaaaaaatacggtccctatttatcgctgttactctccgcttggcgaaaatcattttctatcatcgaatgcagggtgtgatgatttgggaagcttggaatggaagcttggatatggtttga

SEQ ID NO: 11477 - DNA, 1395 bp, Pseudomonas aeruginosa
caaaaaaggtgttgcatcatgtcggtacccctgcgtgccgttcagctcactgagccgagcctgttccttcaggaacatcccgaggtccagttcgtcgaccttctgatttcagacatgaatggcgtggttcgcggcaagcgaatcgaacgcaacagtctgcccaaagtcttcgaaaaaggtatcaaccttcccgcttccctgttcgccctcgatatcaccggctccaccgtagagagtaccggcctgggtctcgacatcggcgacgccgaccggatctgctacccgatccccggcaccctctccatggaaccctggcagaagcggccgaccgcgcaactgctgatgaccatgcatgagctggaaggtgatcccttcttcgccgacccccgcgaagtcctgcgccaggtggtggccaggttcaccgagatggaactgaccatcgtcgccgccttcgagctggagttctacctgatcgaccaggagaacgtgaacggccggccgcagccgccgcgctcgccgatctccggcaagcgtccgcagtcggtgcaggtgtactccatcgacgacctcgacgaatacgtcgagtgcctccaggacatcatcgacggcgcccgcgcccagggcatcccggccgacgccatcgtcgccgaatccgcaccggcgcagttcgaggtcaacctgcatcacgtcgccgacccgatgaaggcctgcgactatgcggtgctgctcaagcgcctgatcaagaacatcgcctacgaccacgagatggacaccaccttcatggccaagccctatccgggccaggcagggaacggactgcacgtacacatctcgctgctcgacaagcacggcaacaacatcttcaccagcgaggatcccgagcagaacgccgcattgcgccatgcgatcggcggcgtgctcgagaccctgccggcctccatggccttcctctgcccgaacgtcaactcctaccgccgcttcggttcgcagttctacgtgccgaacgcgccgagctggggcctggacaaccgcaccgtggccctgcgcgtgcccaccggcagcccggacgcggtacgcctggaacatcgcgtcgccggcgccgacgccaacccctacctgctgctggcctcggtgcttgccggggtgcaccacgggctgaccaacaaggtcgagccgggtgccccgatcgaaggcaactcctacgagcagttggagccgagcctgccgaacaacctgcgcgacgccctgcgcgaactggacgacagcgagatcctggcgaagtacatcgatccgaagtacatcgacatcttcgtcgcctgcaaggaaagcgagctggaggagttcgagtactcgatctccgacctcgagtacaactggtacctgcacaccgtgtga

SEQ ID NO: 11478 - DNA, 1254 bp, Pseudomonas aeruginosa
gaggctgtcgcaccgtctacgtccacccgcagcgattcggcccggccacgggcgaatccaggagaaccatccatgcaagacgtcgtcatcgtcgccgctacccgtaccgccgtcggcagcttccagggctcgctggccggcattcccgcccccgagctgggcgccgcggtgatccgccgcctgctcgaacagaccggtctcgatgccggccaggtcgacgaagtgatcctcggccaggtgctcaccgccgggtccgggcagaacccggcgcgccaggcggcgatcaaggccggcctgccggtcggcgtgccggccatgaccctgaacaaggtctgcggctccggcctcaaggccctgcacctgggcgcccaggcgatccgctgcggcgacgccgaggtgatcgtcgccggcggccaggagaacatgagcctggcgccctacgtcatgcccggcgcccgcaccggcctgcgcatgggccatgcgaagctggtcgacagcatgatcgaggacggcctgtgggacgccttcaacgactaccacatgggcatcaccgccgagaacctggcggagaagtacggcctgacccgcgaggagcaggacgccttcgccgccgcttcgcagcagaaggccatcgccgccatcgagggcgggcgcttccgcgacgagatcacgccgatccaggtcccgcagcgcaagggcgagccgctgagcttcgataccgacgagcagccgcgcgccggcaccaccgtcgaggccctggccaagctcaagccggccttcaggaaggacggcagcgtcaccgccggcaacgcctccagcctcaacgacggcgccgccgcggtattgctgatgagcgcggccaaggccaaggccctgggcctgccggtgctggcgcggatcgccagctacgccagcgccggggtcgacccggcgatcatgggcatcggcccggtctccgccacccgtcgcgcgctcgacaaggccggctggagcctggagcaactggacctgatcgaggccaacgaggccttcgccgcgcagtccctggcggtgggccgggaactgggctgggatgccgccagggtcaacgtcaacggcggcgccatcgcccttggccacccgatcggcgcgtccggctgccgggtgctggtgaccctgctgcacgagatgatccgtcgcgacgcgaagaagggcctcgccaccctgtgcatcggcggcgggcagggcgtcgccctgaccctggcccgcgactga

SEQ ID NO: 11479 - DNA, 675 bp, Pseudomonas aeruginosa
tcccgttcaccatgcagatggccttcgtggtcatcggcggctatgtggtggccagttcaggccccgcctcgcgtctcatcgacctgctcgcgcgggtgccgaagaatggccgctcggcggtctgctgggtggcgctggtgtcgatgctcgcctcgctgctcaactggggcctcagtctggtccttcggcggcctgctggtacgcgccctggcgcgccgcagcgacctgcgcatggattaccgcgccgccggcgccgcggcatacctcgggctgggcgcggtgtgggcgctgggcctgtcgtcgtcggccgcgcagttgcaggccaacccggccagcctgccaccgtcgatcctggcgatcaccggggtgatcccgttcaccgagaccatcttcctctggcagtccggggtcatgctgctggcgctgatcctggtctcgctggtgatcgcctacatgaccgcgccgagcgccgccagcgcccgcgacgccaaggattgcggggttgaaggtgagcttcaccgctccggccaggctggcgccgacccggcccggcgagtggctggagcacagcccgttgctgatcatcctgctggtactgctggccggcggctggctggtacacgagttctcgaccaagccggcgatcctggcgatctccgggttgaacacctataa

SEQ ID NO: 11480 - DNA, 528 bp, Pseudomonas aeruginosa
agggagaaggttggggagagggtagccgcgccgggaaacgaggtaacggcggataacgcctgtggcgttatccgccctacgcaatggggcgggcgaactccggatggttccctctcccttcagggagagggtctggggagaggctggccgccccggctactgcgccacccagccgccatccatgttccaggccgcgccgcgcacctggtcggcggcttcgctgcaaaggaacagcgtcagtccgccgagttgctcgggggtgacgaaggccagcgagggttgcttttccgccagcaggtcgtgttccgcctgttcgggcgagacgccctcggcgatgcgcgcgtcgatctgcttctgcaccagcggggtcagcacccagccggggcagatggcgttgcaggtcaccggcgtgcgcgccgtttccagcgccacactcttggtcaggccggaggcacgccatgcttggcggcgacgtatgcgctcttcccggcgcgaaggcgaccaggccgtgggtcgaggcgatgttga

SEQ ID NO: 11481 - DNA, 477 bp, Pseudomonas aeruginosa
agatgggtcccgttatcgagacgcatgcccagcgccatgatcttcttgtacagggtcgagcgacccaggcccaggcgtttcgccgcttccaccacattgccggcactctgcgccagggcccgtccgatcaggtcgcgctcgaaggcttcgcgggcctgttggaaatccccgaccggcctgtcgtccgccgctcgaggcagctccggcagcggttgcagggggcccagcgccgcgccgagggcggcggcgtccagcaacggttggtcggccagcagcagcgcgcgttccagcacgttgcgcagttcgcggacgttgcccggccaggcatgccgggcgagcagcgccagggcgtcgccgccgagttcgtggagacggccgtggtcgaggctgtcgaggatcgactcgcagagcgccgggaggtcgtccaggcgctggcgcaacggcgggatctcgatcggcaggacgttcagtcggtag

SEQ ID NO: 11482 - DNA, 555 bp, Pseudomonas aeruginosa
aggtcagcgcggaaacggccttcgcgcatcgcctgctgcaggtcgatggaagtggcggcgaccaggcggatgtcgctgcggatcacttcgttggaacccaccgcttcgaactctttctcctgtagcacgcgcaacagcttgccttgcaaggccagcggcatgtcgccgatctcgtcgaggaacaacgtgccgccctgggccacctgcaacttgcctggccggcccttgcgctcggcaccggtgaaggcccccggggcggtaccgaacaattcggcctccagcaggctttccgggatcgccgcggcgttcacgctgacgaaggccttgtgcgcccgcggcgaagcgctgtggatggcgtgggcgagcagttccttgccggtgccggtctcgccgagcaacagcaccggcgcttcgctggccgcgccacgacgggcgcggcgcttgacttccaggctggccggactggtaccgacgaagtggctgaagctgtacttggcctggcgcgcctgcaattgcgagcgggtcgaggccagttcgcgctgcatgctcaggtag

SEQ ID NO: 11483 - DNA, 603 bp, Pseudomonas aeruginosa
gcagacagaagccggcgatgtgctcggcggcgcgggaaaccgggatggcttcgccgagggcgttgccctggccgatccagatgcctagctccagttcgtagtccagacgcgcacagggaccgaacaccggctcgctggcgccggccggcagggtctggccgttgggccggcgcacttcgctgccggagacgcgcacggtcgaggcgcggccgtggtagccgatgggcacgtgcttgtagttgggcagcagcgggttgtccgggcggaacagcttgccgacgttctcggcatggcggatgccgacgtagaagtcggtgtagtcgccgatcctggccggtaggtgcatttggcactcggcggccggatggagcagttccgggcgctccgcggcgccttcgccgagcagctccagcaggcgctggcgcagcgccacgcgggccggcttgccgagggcgaagaaggcgttcagcgcgccgccgcgggtggcttcggcggcttcgccggcggcaccctcgaacagcccggcggccagcgccgcgtccaggtctaggatcgagtcgccgatggccacgccgcaacgcgggctcaggccggcacggctga

SEQ ID NO: 11484 - DNA, 645 bp, Pseudomonas aeruginosa
cgtcggccccgcccgcaggaacccgcgtccatggaaaagaacagcagtcccgccgaaacctccggcaagcagaaggtccgctccgccgaagtcggtaccgatatcctcaaggccctcgccgaactctccccggcgacctcgctgtcgcgcctggcggagcatgtggggatgccggcgagcaaggtccatcgctatctgcaggcattgatcgccagcggcttcgcggtccaggacgcctccaccaatcattactcgctggggcgcgaggcgctgcgcgtgggcctggcggcgctggacagcatggacgtgctgaagagcgccgccgcgccgctggccgagctgcgcgacgtgctcaacgagacctgcttcctcgccgtctggggcaaccgtggcgccaccgtggtacaggtggaacaggcggtgcgcgcggtgacggtggtcacccaggtcggctcggtgctgccgctgctcggttcgtccaccggcctggtgttcgccgcgttcctgccggaacgcgaggtggccgagctgcgcgaggaagagttggccgggcgtgccgaccatccgctggccgacccggcggcctacgcggtgctcctggaggcatccgcgcgcgcggcctgcatgcgatccatgggctgctga

SEQ ID NO: 11485 - DNA, 1752 bp, Pseudomonas aeruginosa
ccgctcgcggttatccgccgcttctcaggccttggccagcaacgctttcgccgctcgcgacccgttgctcttgccgagcaccgcgcagatacgctggccggcgtcgaccagggcgtgcatgtcgaccccggtatggatctccaggccgttcagcaggtagaggacgtcttcgctggcgacgttgccggtggcgcccttggcgtagggacaaccgccgaggccggccaccgagctgtcgaataccgcgatgccttccagcaggctggcgtagatgttcgccagggcttgcccgtaggtgtcgtggaagtgcccggcgaggcgctcgcggggaacctcgctggccaccgcctcgatcagccggcgggtggcgccggcggtgccgacgccgatggtgtcgcccagggacacctcgtagcagcccatctgctgcagttcgcgggcgacccaggcgacctggcgcggatcgacatcgccgtcgtagggacagccgagcacgcaggaaatgtagccgcgcacccgcacctggtgctggcgcgccgcctccagcaccggtacgaagcgctccaggctgtccttgatcgagcagttgatgttgcgctgggagaaggcttccgacgcggcggcgaacaccgccacttccttcactcccgactccagcgccgcctcgaagcctttcaggttcggcgccagcgccgcgtaggtcacgccgggacgctggcggatgccggcgaatacctcggccgagccggccatctgcggcacccacttgggcgagacgaagctgcccacttcgatgtagtccaggccggcggcgctcaggtcatcgaccaggcggatcttgtcggccacctcgatcggctgtttctcgttctgcagtccgtcgcgcggaccgacctccaccaggcggaccttcttcggcaggttcatgctgttcctcgtcttggctgtcaggcctggttctcgtccagctccaccagcggcgtgccttcctcgaccagttcgccctcgctgcaatacagcgccttcactaccccggcgtggggcgcgcggatgctgtgttccatcttcatcgcctccagcaccaccagggtggcgccggcttcgaccgtctggccgggctcgaccaggacccgcacgatactgccgttcatcggcgcgctcaaaccgccctggtgggcatgggcggcctcggcctcggcgatcgggtcgacggcttcgatggccagcagttcgccctcccattcgaggaacaattggcgtccgcggcgcaacgccgccgagcgacgggtgacaccgtccacccggctgaccaggtcgtcgccgtcgaggcgatactggctggggctggcgtggcgcaggcggacgcagcggcgttcgtcgcggcagcgcagcatcaggtcggactcccgcgccagggcgctgcgccagccgtcgttgcggctccacggcgaatgcgggtcgtcgtcgcgacggtggcccggttcgctctgcagccaggcttcggcggcggcttgccagaaatgctccggcagcgcttgcggcgccggcagcaggtcgtcttggtggcgcgcgatgaacccggtgtccagttcggcggcggcgaacgccggatggccgaggatgcggcggaggaacgccaggttggtgcgcaggccgccgaccgaggtttccgccagcatcgccagcaggcgctggcgggcttcctcgcgggtttcgccccaggcgatcagcttggccagcatcgggtcgtag

SEQ ID NO: 11486 - DNA, 216 bp, Pseudomonas aeruginosa
agccgtacttcgatggcgtggccgttcagcggtacctgttcctgcgtcagcggtagcgcctcgccgcgagcgacgcggatctgccaggcgaccaggtcgaggccggtgatggcctcggtgaccgggtgttccacctgcaggcgggtgttcatttccatgaagaagaactggccgcgttcgtcgaggaggaattcgacggtaccggcgccgacgtag

SEQ ID NO: 11487 - DNA, 3150 bp, Pseudomonas aeruginosa
gggcatcaggcttgctccgtggggatctggggcgagttgccggtgcgcggcgccttgcgcaaccggaacaggcgcccgaccaccaggaagaacagcggtaccaggaacaccgcgagtaccgtggcggtgacgatcccgccgagcaccccggtgccgatggcgacctgggcgccggaaccggcgccgctggagagcgccagcgggaccacgccgaaaccgaacgccagcgaggtcatgacgatcggtcgcaggcgcaggcgcgcggcctccaggggtcgcctgcagcaggctcatgccttcctggtaatggtccttggccacctcgatgatgaggatggcgttcttcgccgagaggccgatgatggtgatcaggccgaccttgaagtacatgtcgttgggcagaccgcgcaggctcaccccgagcagtgcgccgagtacgcccaacggcaccaccaggatcaccgccagcgggatcgaccagctttcgtagagggcggccagggcgaggaacacgatcaacaccgagagggcgaacagcgccggcgcctgggcgccggacaggcgttcttcgaaggactggccggaccactcgtgggcgatgccctcgggcagtccctgcatcaattgctccatcgcctgcatggcttcgccgctgctgtagcccggcgcggcctggccctcgaggttgaacgagggatatccgttgtagcgggtcagttgcggcgggccgagggtccaggcggccttggcgaacgtcgccagcggcaccatctcgccctgctcgttgcgcacgtgaagccggccgatgtcgtcgatgcccaggcgcttggcgccgtcggcctggaccaccaccttgcgcacctggctgccgtgcatgaagtcgccgatgtagtccgagccgaacatcaccgccagggtggtgttgatctcgtccatgctcacgccgagggtctccgccttgcgccggtcgatgtccaggcggatctgcggcgcctcgccctggccggcgaacatcacgttggccagacgcgggtcctcggcggcgcgcgccagcaactggtcgcgggccttgaccagggcctcgtagccaaccccgccacggtcctgcaggcggaagtcgaagccgctggtggaacccaggtccggcagcggcggcgagttcatcgcatacaccgtacggttgggcaggccggcgaagcgctggttgatgcgctcgacgatggcgccgacgtgctggctggcctcccggcgttccgaccagtccttcagggtggcgaagatcatcgccgagctggtgccgtcgccgtacaggctgaagccgccgaccgcataggcgtaggccaccggttcgtgctccgccaggtagcgctcgacgtcgccgacgttggccatggtctccgccatcggcgtgccttcgggctgcatcaccatgatcatgaagtcgccctggtcctcttccggcaggaacgcctgcggcaggcgcacgaagagcagggcgaccacgccgatgaccagggcgtagaccagcatccagcggatcggccgggcgaggatgccggccaccgcgttgcggtagcgtccggtcaggcgcaggaaggcgcggttgaaccagccgaagaagccgcgcttctcatggtggtcggcgtcgatcgggcgcagcagggtggcgcacagggccggggtcagcgacagcgcgaggaacgccgagaagccgatggagaccgccagggtcaccgcgaactggcggtagatgttgcccaccgcgccgctgaagaacgccatcggcacgaacaccgagaccagcaccacggtgatgccgacgatggccccgctgatctggcgcatcgccttgaccgtggcgtcgtgcggcgacaggccttcctcggccatcagccgctcgacgttctccaccacgatgatcgcgtcgtccaccaggatgccgatcgccaggaccatgccgaacatggtcagcacgttgatcgagaagcccaggccgagcatcaccgtgaaggtgcccagcagggccaccggcaccaccagtgtcgggatcagggtggcgcggaagttctgcatgaacaggtacatcacggcgaacaccagcagcatcgcctcgagcagggtgctgaccaccttcctgatcgagatctcgacgaacgccgaggtgtcataggggatgttgtagctcacgccctccgggaagtagcgcgacagctcgtcgagggtggcgcggatgcgcttggcggtggccaccgcgttggagccgggcgccatcttcaccgccaggccggtggcggtcatctggttgacccgcgagacgaagccgtactcgctctggccgaactcgacgcgggccacgtcgcgcaggcggatcgcgccgccgtcggcgcggatgcgcagcggaatttcgccgaactgctcgggcgtcaccagggtgtcgtcgaccttcaccgtggcgctgatcggcgccgagtcggggaccccgaggttgccgatgtcgcccacggtgaggcgggcgttgtgccggcgcacggcgttgaccaggtcgctggcgctgaggttcatcgaggtcagcttggccgggtcgggccagatgcgcatggcgtactcggcgccccaggtctcgaccttgcccacgccctccacccggcgcagcgcctgcaacacgttggacgaggcgatctcgcccaggtccatggcgtcgtagcggccgctggaggaggtaagggtaacgatcagctggatgctgtccgccgccttctccacgtagatgccgtcgcgccgcaccgattcgggcaggcgcgactcgacgatcttcaggcggttctgcacttccaccgcggcgaggtcggcgttcacgccctggcggaaggtcagggtcagcgaggcctggccggtgctgctggtggccttggtgtagagcaggccgggcgcgccgttcatctcgcgctcgatgatcgcggtcaccgcttcctcgaccaccttggccgaggcgccgggatagctggcgctgacgttgaccaccggcggcgcgatgtccgggtactgggcgaccggcaggaagcggatcgccaggaccccggcgagcacgatcagcagggagatcacccaggcgaagaccggccggtcaatgaagaaacgagccattcgtag

SEQ ID NO: 11488 - DNA, 1104 bp, Pseudomonas aeruginosa
gggggcgtcggcgctggccggctggcggaccaccgcctggacgctggagccggcggcatgctgggcggcgttctcgacgatcacacgctcgccgcccttgagcccgctgctgatgatccagtcgcggccctgcagggtgtcggcgcggacctccacgtcttccaccaagccctgtgggttgaccaccttgaccacggcggactgggcggtacggatcagcgcgtcgcgcgggacggtgatcgcctgcgggttcaccgcgcgctgcaggcgcacctgcacgtagccgccgggcagcaattcgcgatgcggattgcggaacagggcacgcatggcgatggtgtcggtgccggggtcgaccgccaggtcggagaacagcagctcgccggccagcgggtactcgctgccgtcggccaggaccaggcgcacggcgatgtccttgtcggcgacacccttcacctggccttcgcggatcgcccgctgcatggcggcgacttcgccggccggctgggagaagttcacgtagatcggatcgatctgctcgacgcgggtcagaggtgtcggcgagtcctcgccgaccagcgcgccttcggtgaccagcgcgcgccgcgcgcggccgtcgatcggcgcggtgaccgtggcgtagcccaggcgcaggcgggcctgctccagttcggccttggccgaggcgatctgcgccagggcctggcgcgcgtcggtctgcgcttcggtgtactcgcgttcgctgatggcgcggtccttgatcaggtcggcgtagcgcttgagcttgtcggccgccgccgcgtggctggcctcggcccgggccagggcgccgcggctgatgtccagggccgccttcaagggcgcagggtcgatctggaacagcacggtgccggcgcggacgtcctggccttcctcgtacaggcgacgggtgacgatgccggcgacgcgcgcccgcacttcagcctggcggtacgcttccaggcgtccgggcagctcgctggtgatgccgataggcgccggcctggcgacgatcacgccgacctcggcgggggcctccgcagtcttcccggcgtccgctgcttcttcgcagcccagcaggaatag

SEQ ID NO: 11489 - DNA, 747 bp, Pseudomonas aeruginosa
tctgcggcgcctttcccttgtgaggacgttcagtggccaggaaaaccaaagaggaatcccagaaaacccgcgacggcatactcgatgccgccgagcgggttttcctggaaaagggcgtgggcactactgccatggccgacctggcggacgccgccggggtttctcgcggtgcggtctacggccactacaagaacaagatcgaggtctgcctggcgatgtgcgaccgcgccttcggccagatcgaggtacccgacgaaaacgccagggtgccggcgctggatatcctcctgcgcgccggcatgggctttctccgccagtgctgcgagcccggttcggtgcagcgggtgctggagatcctctacctcaagtgcgaacgcagcgacgagaacgagccgctgttgcgccgccgcgagctgctcgagaagcaggggcaacgcttcggcctccggcagatccgccgggcggtggagcgcggcgaactgccggcgcggctggacgtcgagctggccagcatctatctgcaatcgctctgggacggcatctgcggcaccctggcctggaccgagcgcctgcgcgacgatccctggaaccgcgccgaacgcatgttccgcgccggcctcgacagcctgcgcagttctccctacctgttgctggcggacgcctgagggcgtcaatcgtccgccatcaggtgcctgcgctggtcctcggcgccggcgaccaccagccgctgggcgtcttcctcgctga

SEQ ID NO: 11490 - DNA, 645 bp, Pseudomonas aeruginosa
ccgcgagcgggtcgcgcggctgagacgcggcgagatgccgatctacgaaccgggcctggaaagcatcctgcgcgatcagctggacgccgcccgcctgaccttcaccgccagcctggcggaaggcctggccgacgccgaagtggtgttcatcgccgtcggcacgccgtgcggcgaggacggctcggccgacctcagccacgtgctggcggtcgccgagcaacttggcgcgcaactgcgccaggcctgcatcgtggtcaacaagtcgaccgtgccggtgggcaccgccgaacgggtcgaagagatcatccgcctgggcctggcgcgccggcgcaagcgcttccgggtagcggtggcgagcaatccggagttcctcaaggaaggctcggcggtggacgatttcaggcgcccggaccgggtcatcatcggcagcgccgaggcgcaggccggggaaaccctgcgccagctctacgcgccgttcctgcgcaatcacgagcgggtcctgctgatggggcgtcgcgaggccgagttcagcaagtacgcggccaatgccttcctcgccaccaagatttccttcatgaacgagatggccgggctgtgcgccctcaccggcgtcgacatcgaggacgtgcgccgcggcatgggtag

SEQ ID NO: 11491 - DNA, 327 bp, Pseudomonas aeruginosa
cgacaagcgcatcggcacccatttcatctacgccggctgcggctacggcggctcgtgctttcccaaggacgtccgcgcgctgatccgcagcgccgagcagcagggctacgacagccagatactgcgcgcggtggaagcgcgcaacgcgcggcagaaggagctgctcttcgagaccctcggcgagctgttccagggacgctggcaagggcgcacggtggcgctctgggggctggccttcaagccgggtaccgacgacctgcgcgaggcgccgagcctggtcctgctggaggcgctgctgcgccacggggtgcgggtcagggcccatga

SEQ ID NO: 11492 - DNA, 903 bp, Pseudomonas aeruginosa
ggcgagcgcagcctgattagactgcgcgccatccgcatacttcgtccatgtcgaaggattctcatgatcaagaaatgtcttttcccggccgccggttacggcactcgtttcctcccggccaccaaggccatgcccaaggaaatgctgccggtggtgaacaagccgctgatccagtacgcggtggaggaggcgctggaagccggcctttccgagatcggcatcgtcaccggccgcggcaagcgttcgctggaagaccacttcgacatcagctacgagctggaacaccagatccgcaacaccgacaaggaaaagtacctggtcggcatccgtcggctgatcgacgagtgcaccttcgcctacacccgccaggtggagatgaagggcctcggccacgccatcctcaccggtcgtccgctgatcggcgacgagccgttcgccgtggtcctggccgacgacctgtgcctgaacctcgaaggcgacagcgtgctgaagcagatggtcaagctgtacaaccagttccgctgctccatcgtggcgatccaggaagtgccgccggaagagaccaacaagtacggcgtgatcgccggcgagatgatccgcgacgatatcttccgggtgaacaccatggtcgagaagccgaagccggaagaggcgccgtcgaacctggcgatcatcggccgctacatcctgaccccggacatcttcgacctgatcgagcagactgaaccgggcaagggcggcgagatccagatcaccgatgccctgatgaagcaggcccaggacggctgcgtgctggcctacaagttcaagggcaagcgtttcgactgcggcagcgccgagggctacatcgaggcgaccaacttctgctacgaaaacctctacaagaccggcaaggctcactga

SEQ ID NO: 11493 - DNA, 507 bp, Pseudomonas aeruginosa
ccttgctcgaaggtcacgcccgtctgctcgatgcgcacagcgtcgaggtggacggccagcgcttcagcgccaagcacattctcgtcgccaccggtggctggccgcaggtgccggacattcccggcaaggaacacgcgatcacctccaacgaagcgttcttcctcgagcgcctgccgcgccgcatgctggtggtcggcggcggctacatcgccgtcgagttcgcctcgatcttcaacgggctcggcgccgagaccaccttgctctaccgtcgcgacctgttcctgcgcggcttcgaccgcagcgtccgcgagcatctgcgcgacgaattgggcaagaagggcctggacctgcagttcaacagcgacatcgcccgtatcgacaaacaggccgatggcagcctggccgcgaccctcaaggacggccgggtgctggaggcggactgcgtgttctacgccaccgggcggcggccgatgctggacgacctgggcctggaaaacacagctgtga

SEQ ID NO: 11494 - DNA, 1569 bp, Pseudomonas aeruginosa
ctgcatacagatcaagcgctccccggcctgaatggtggatttcgccaccatctgtaccggtcccgctttcgctcaccctggagtcccgctcatgaccctttatctgcaactcgccgagaccctcggttcgcgcatcgaacagggcctctaccgtccgggcgaccggctgccctcggtgcgggccatgagcatcgagcacggcgtcagcctgagcaccgtgcaacaggcatacaggctgctggaagatcgcgggctggccgagccgcggccgaagtccggctatttcgtaccggtcgcgcgacagatgccgccgctgccggcgatcgcccgcctggcccagcggccggtggaaatctcgcaatgggagcaggtgctggccctggtcagcacggtaccgcggccggacgtggtccagctcggccgcggcatgccggacatctccagcccttcgctgaaaccgctgacccgcagcctggcccggctcaaccgccacgccgacgcccgtgcgctggcctacgacgggatccacggctcgccgttgctgcgcgaggaagtcgcccgcctgttggtggactccggctgtcgagccaccgccagcgacgtggtgatcaccaccggctgccacgaggccctgtcggtgagcatccgcgcggtgtgcgaaccgggcgacatcgtcgcggtggagtcgccgagcttccatggcgccatgcaatcgctgaaaggcctcggcatgaaggccctggagatccccaccgatccggtcaacggcatcagcctggaagccctcgaactggcgctggaacagtggccgatcaaggccatccaggtgaccccgaactgcaacaacccgctcggctacatcatgcccgagtcgcgcaagcgggcgctgctggccctggcccagcgctacgacgtggcgatcatcgaggacgatgtctatggcgacctggcctacacctatccgcgcccgcgcaccatcaagtcgtacgacgacgatggccgggtgctgctctgcgggtcgttctccaaggtcctggcgccgggcctgcggatcggctggatggtacccgggcgctacgccgaccgcgtgctgcacatgaagtacatcagtaccggcgccagcgccctgcaaccgcaactggcgatcgccgaattcatcggcaacggccactacgagccgcacttgcggcgcatgcgcgcccagtaccagcgcggacgcgacctgatgatcgactgggtggcgcgctatttcccggagggcacccgcgccagccggccccagggcggtttcctgctctgggtcgaactggacgaggcgttcgacaccctgcgcctggacaaggccttgcgcaaccgcggcgtacaagtcgcggtgggctgcatcttttccgcttccggcaagtatcggaactgcctgcggatgaactacgcggcgttgccgaccccggccatcgagcaggcggtcaggcgagtaggggagagcgcttgcgagctgctggagccttgcgaggcctgagcgacagtcgtgctttcgacgcagtcgacgattgcgcaaatagcaaatgctaa

SEQ ID NO: 11495 - DNA, 960 bp, Pseudomonas aeruginosa
cgcatgcatccgccggctccactggacgccggtcaccaggagaccatcgtcatgtcgcaacccgcctatcgtctgttcaatgtcgaactcaagcgccgtgagcaactcagcccggcgctgacccgcttcgtcttcggcggtccggaggtcgccgagatgaagacccttgccgccgaccagcggatcaagatcttcttccccgatgccagcggccagccgcccagcctgcccggcggcagcgagtggtaccaggcctatcgcagcgtcgagccggcccgccggccgccgatgcgtacctacaccatccgtgcgctgcgcgccgagcaggaagaggtcgacgtggagttcgtcctccacggcgagaacggcccggcctcggcctgggcgacccacgcgcggatcggcgaccgcctgcaactggccgcgcccaaccggcaatacggcgatgaccccggcggctacgaatggaaaccgccggctggcgtccgccatatcctgctgatcgccgacgaaaccgccttgcccgcggtggcgggaattctcgaggagctggccggcgaaaccgagccgccggtggtcgaggcctttctcgaagtgccgggagaagccgacatcctcgacctgccggcgattcccgctgcgcgcctgcactggctgccgcgccaccaggccggtatccattcgcgcaacggcgagcggatgatcgaggcggcgcgccaggcgcggctgccggaacgcgaggtggcgggtggtgcggcccaggaactggaggacatcgatatcgacgaggagatcctctgggaactggcgagccccgagagcggcagtttctacgcctgggtcgccggcgagtcggcggcggtgatggcgatccggcgctacctggtgcaggagcgcggtatcgacaagcgtcatctgaccctgatgggctattggcgcctgggcaaggtgttcgactga

SEQ ID NO: 11496 - DNA, 1104 bp, Pseudomonas aeruginosa
tggaagcccgggacgccttcgaacgtccggtgcaggccgaggcctgccgcttggccgggctttccccggaggacagcgacggcatgctgcaacgcttgcgcgaggatttcgatccgttgtccgagcagcgcctcggcgaactgctggaagacaccggcttcgtcctgcccagccgctatttccaggccgtgggctaccaggcctggatcgccttccgcgccggctgaggatgcctcaggcgaggcgcgcctgcggcgtgatctggcgtgggtcggtcagcagctccagcagcgccgggcgtccgctttcgcgggcgcggcggaatgcggcggggaagtcggcgctgcattccactcgttcggcgtgggcgccgaaggctcgcgccagggcgacgaagtcggggttgtccaggcgggtggcggatacccgcccgggatattcgcgctcctgatgcatgcggatggtgccgagcatgccgttgttgaccacgatcaccaccggcgtcgcgccgaactgcgcggcggtcgccagctcctgcggatacatcatgaaacagccgtcgccggcgaagcacaccacgctgcgctgcggatcgcgcaggctggcggcgatcgcggcgggcaggccgtagcccatggcgccgttggtcggcgccaactgcgtgcgggcctggcgatagcggtagaagcgatgcacccagacggcatagttgccggcaccgttggcgatcaccgcgtcgtccggcaggttttcgctgaggtacgcgaccacggacgccaggtcgacgccctggacggcggggtcgctcgcggccggggtcgagtaggccaggtaatcggcatgggcggcttcgcgccagtcctgccaggtgctcgagggcaacggcgcgaggtcggccagggcctcggcgaaggcacacggggtggcctggatcggcagtcgcgccaggtagacgcggttcagttccgcgctgtccggatgcacgtggatcagcgtctgcgcgggggccggactacgcaccaggctgtagccagcgctcggcgtttcgcccaggcgcgccccgaccaccagcagcaggtcggcctggcgcagccgctccaatag

SEQ ID NO: 11497 - DNA, 936 bp, Pseudomonas aeruginosa
ccgtttcctggcggcactgtcccagccgctgccgccaagtaccagcagggggcgcctggcgttcgccagcagttcgcgcagttccgccatcgccgtggcgcccggccgccccggaagcacccttggctccggcgcatcggcgacctgcgcgaaaccgaagaggatttcctcgggcagggcgaccacgaccgggcccggtcggcccgaggtggcgacgctgaaggcgcggccgacgatctccgggatgcgttcgatacggtcgatttccacggcccacttggccaggcccgagaacatctgcacgtagtcgacttcctggaacgcctcgcggcccttgaaggcgctttccacctggccgacgaacaggatcatcggcgtcgagtcctgctgcgccgtgtgcacgccattcgccgcatgggtggcaccggggccgcgggtgacgaagcagatgcctggtcggccggtcagcttgccgtaggcatcggccatgttcgaggcggcaccctcgtggcgggtgacgatggtgcggatgccgttggcgtcgtgcagcgcatcgagcaccggcaggtagctttccccggggatgcagtagacggtatcgacggcattgcgccgcaatgcctctaccaggatctgcccgccgttgcgctggggaagggagtcggacatgagggcctcgctgcgcacgttgtggttgccccgatattcggcccaaagcgcgccagcgccaagcgacctttcttcgcgagttcattcccgtggcgcatgaaccctcgttcttcgttgcggaggaggcccctttcagcgcttcatctggacgagaaggggactggagcgtcatcgcaacgggtctcctctaggcggatcggagagcgcggttttccgctcgtttctccatcttctcctcaattatgtctatgtaactatttcctctag

SEQ ID NO: 11498 - DNA, 420 bp, Pseudomonas aeruginosa
tcaagaacatcgcctacgaccacgagatggacaccaccttcatggccaagccctatccgggccaggcagggaacggactgcacgtacacatctcgctgctcgacaagcacggcaacaacatcttcaccagcgaggatcccgagcagaacgccgcattgcgccatgcgatcggcggcgtgctcgagaccctgccggcctccatggccttcctctgcccgaacgtcaactcctaccgccgcttcggttcgcagttctacgtgccgaacgcgccgagctggggcctggacaaccgcaccgtggccctgcgcgtgcccaccggcagcccggacgcggtacgcctggaacatcgcgtcgccggcgccgacgccaacccctacctgctgctggcctcggtgcttgccggggtgcaccacgggctga

SEQ ID NO: 11499 - DNA, 1416 bp, Pseudomonas aeruginosa
acgaggtcgcggcgcgaggatttcccggacggcgaacttgcatccgcgtgcacggcggtgtcgtctggaccgaaaggcgaagaagaggagggcgagcgtgcctgcgagtgcatcgaggattcaggtcggaagcggcgaaggacgcctgttgctgctgttgtcggcgctggtggcgttcggcccgctgtcgatcgacatgtatttgccgagcctgccggcgatcgccgccgatctcggcgccagcgatgcccaggtgcagcggagcatcagcggcttcctggtcggcttctgcttcggcatgctgttctacggccccttgtccgaccgtttcggccggcgcccggtgctgctggccggtatcgccttgtacctgttcagcagcctggcctgcgtgctggccgacagcgcggggcaactggtcctgctgagggtgctccaggccctcggcggcggcgccgcgtcggtgctggcgcgggccatggtgcgcgacctctatccgttgggcgaggccgcccggatgctggcattgatgcacatggtgaccatgctggcaccgctggccgcgccgctgctcggcggctacctgatgctctgggccggctggcgcgcgttgttcgtggtcctggcgctgttcgccgggctctgcctgctggcggtctggcgggtcgccgaaagccacccgccggagcgccgcggcggcagcctggcccaggcctttctcgcctatgggcggctgctcggcgaccgtcgcgcgctgggctacgtgctgtgcatggggctggcgttcgccgggatgttcgcctacatcagcgccgcgccattcgtgttcatcgagcatttcggcgtgcgcgcggagcgcttcggctggttcttcggcctgaacatcctcggcgtgatgctcgccacctggtgcagcgcgcgcctggtgcgccgccacggtccgcggccgctgctgcgggccggcagcctgctggcctgcgtgtccgggctgttcctcctcggctatgcggcgctcggcgagcggggcgggttgtgggcgctggtgcccggcctgctgtgcttcgtcagcgtcaccggcctgctcggcgccaactgcatcgccagcctgctggcgttgtatcccggacaggccggggcggcttcggcggtggcggtgtccgggcagttcggcctcggctgcctggccagcctggcggtcggctggctggcgctgcccggcgtgctgccgatggcgctggtgatggccgtctgcggcgtcggcagcctgctcgcgctgggcttggccctgcacggcggaaaccgttgatttccttctgcatacccgcatgcagcctgtgttttttccgctactcttctgcactttcgaaaccagtcatccaagctcggaccctatgtcaacgccaagaccctccctga

SEQ ID NO: 11500 - DNA, 1638 bp, Pseudomonas aeruginosa
ccgcgcgcggttatccgccctacgccggggtggctttccgtctgcggggcgtcatcccgccagcgactgggcgatccgcccgagtgtctccatcgccttctcctgccgcgcgctccacgggtgcccgtagttgagccgggcgcaatgggcgaagcggcgggtggcggagaagatcggccccggggcgaggctgatgccctgggccagggccagttggaacaggcgcagcgagtcgaccgcctcgggcaactccagccagaggaagtagccgccgctgggacggctgacccgggtctgctcggggaagtaacgcgccaccgccgcgagcatggcgttctgctgggtctccagggcgtagcgcagcttgcgcaggtggcggtcgtagccgccgtgctggagatagtcggcgatggccgcctgggccgggatcgacgccgacaggctggtcatcagcttcagtcgctcgatctgctcggcgtagcgtccgccggccacccagccgacccggtagcccggcgccaggctcttggagaaggaactgcagtgcatcaccaggccttcctggtcgtaggccttgaccggtttcggcgcctgctggccgaagtacagttcggcgtacacgtcgtcctcgatcatcggcacctggtggcgcgccagcagctcggcgagggcgcgtttcttctcgtcgtccatgctcgcgcccatcgggttctggaagttgctcatgaaccagcaggccttgatcggcaggcgctccaggctgtcggcgagcacttccaggtcgatgccttcacgcggatgcacggggatttccaccgccttcagcttcaaccgttccagcacctgcagggtggcgtagaacgccggcgcctcgatggccaccaggtcgccgggacgggtgaccacctgcaggcagaggttgagtgcctccagcgcgccgttgctgatgaccagttcttccaccggcagcagcaggccgccgaccatgtagcgcagggcgatctgccggcgcaggccatggttgcccggcgtcatgtcggcgaccaccgactgcgggtccatgtcgcgcaccgcgtgggccatcgagcgcgccaggcgcggcaggggaaacagttgcgggctggggaacgccgagccgaagggcacggtgtccgggtccttgatcgaactgagtacggagaacaccagctcgctgacgtcgacctcggtggcgtcggcctggcgcgggctgatctccggttccggcagcggccgctgcacgtgctggcagacgaagtagccggagcgtgcgcgggccatgatcagcccacggctttccagcaggtagtaggcctggaacacggtggaagcgctgaccccgtaggtacgactggcgtgccgtaccgagggcaccttctgcccgggggcgaggacgccggtgcggatcagctcggcaatctcgtcggcgaatttctcgtagcgcttcatcttgtcctggccgctgtcctggctggccgtgggcacggccgctggcgcccactctatgcgtgccgggaccgtgttgtcatgcctcatcgcggcctcctcagcgcgccggcgaaacgaaggtgctggtgctgccgaccgccaggctcgggtcgtcgatgccgcgcaggctga

SEQ ID NO: 11501 - DNA, 1230 bp, Pseudomonas aeruginosa
gggctttgcgatgtaccagtacgacgaatacgaccaggcgctggtgagcgagcgggtggcgcagttccgcgaccagatcgcccgccgcctcgacggcgaactgagcgaggaggagttcctcccgctgcgcctgcagaacggcctgtacctgcagaagcacgcctacatgctgcgcgtggcgattccctacggcaccctctcgtcgccgcaactgcgcgccttggcgcacgtcgcccggcactacgaccgcggctacgggcatttcaccacgcggcagaacatccagttcaactggatcgaactggagcaggtcggcgatatcctcgaacacctcgccggcgcgcagatgcatgcgatccagacctccggcaactgcgtgcgcaacatcaccaccgaagccttcgccggggtcgccgcggacgaatggaccgacccccggccgctggccgagatcctgcgccagtggtcgacggtgaacccggagttcctgttcctcccgcgcaagttcaagatcgccctcagttcggcggtggaagaccgcgccgcggtgcagatgcacgacatcggcctgtacctttaccgccaccccgacgccggcgagttgcgcctgcgggtcctggtcggcggcggcctgggacgcacgccgatgctcggccaggtgatccgcgacgacctgccctggcagcacctgctgtcctacgtcgaggcgatcctgcgggtctacaaccgccacggccggcgcgacaacaagtacaaggcgcggatcaagatcctagtcaaggcgctgggcatcgaggctttcgcccgcgaggtggaggaagagtggcagcacctgcgcgacggcccggcacaactgactgccgaggagtgccagcgggtcgccgagcgcttcgtattgccgcgctacctgccgccggccgacggcgagctggcctacggcagcgcccgtgcggccgatccgaccttcgcccgctgggcctcgcgcaacgtccaggcgcacaaggtgccgggctacgcctcggtggtgctgtcgaccaagcccggcgccagcgcgccgccgggcgacgtcaccgcggagcagatggaacgcgtcgccgattgggccgagcgctacggtttcggcgagatccgtgtggcccacgaacagaacctggtgctccccgacgtgcgcctggagaacctccacgcgctgtggcacgaggcctgcgcagccggcctcggcacgcctaa

SEQ ID NO: 11502 - DNA, 798 bp, Pseudomonas aeruginosa
cctgaacatctccggctgcatgaacgcctgcggccaccaccacatcggcaacatcggcatcctcggcgtcgacaagaacggcagcgagtggtaccaggtcaccctcggcggcgcccagggcaaggacagcgcgctgggcaaggtgatcgggccatcgttcagcgctgccgaggtgccggcggtgatcgaacggatcgtcgaaaccttcaccgacctgcgggtcggcccggaacgtttcatcgacaccttcaaccgggtcggcctggagccgttcaaggcccgggtctacgccaggatggaggaaccggcatgaacaacctgatccgtttgcgcgatggcgtcgccgaggtctgccgcgacgatccctggcaactcctgcgcgagttgcccgacgcgctgccgccggggccgttgctgctgcctctggcggcctggctggagcgccgcggcgaggccggagccgccgcgccctggctggcgccggacgatgaggtggaggccttgctgccgcacttcgccgagctgccgctgatcgccgtcgacttccccagcttccgcgacggtcgtggctacagcctggcctacctgctgcgcgtgcgcctggggtggagcggcgagttgcgcgcagtgggcgacgtgttgcgcgaccagctcagccatatgcgccagtgcggcttcgatgccttcgcggtgcgcgaggacaagaacgtcgaggatgcgctcaaggggctggcgggtttgagcgtgctctacggccgctcggcgatcgagccgcgaccgttgttccgccgacgctag

SEQ ID NO: 11503 - DNA, 1686 bp, Pseudomonas aeruginosa
cccctctcccgcagcgggagcggggcgcacccctcagccgtagaccgaggaactggcggacggcgccggcgcgccgcccttgaagcgccccgccagctcgcgcagcgaacgcatcagcaggctggtgtccacgcccaccgcgacgaacgcgcagcccagctccaggtagcgccgcgccagtgtctcgtcggcggagaggatgccggcggccttgccggccgtgcggatgcggtggatggcgtcctctatggccgcctgcacctcgggatggcctggattgccgcgatggcccatggctgcgctgaggtcggccggaccgatgaacacgccgtcgacgccctcgacggcggcgatcgcgtcgaggttggccaggccctccaggttttccacctggaccagcaggcacatctgctcgtcggcgtggttcaggtactccgccacgctgttccagcgcgaggcccgggccagcgcactgccgaccccgcgtacgcccgccggcggatagcgcacggcgcgcaccagcccttcggcctgggcggcgctgtcgaccatcggtaccagcagggtctgcgcgccgatgtcgagcaattgcttgatcagcgcggtgtcgccctgcaccgggcggatcaccggctggccggggtagggcgccagcgcctgcaactggccgagcaggctgcgcaggtcgttgggcgcgtgctcgccgtccagcagcagccagtcgaagccggcgttggcggccagctccgcgcagtagggatcggccaggccgagccacaggccgatctgcgcctcgccgctgcgcaggcgttgcttgaagcgattgacgggcaggtccatggaaatgcctcctcagacgaaacggcaggagatgctgccgagcaggtcgtagtcgacgtggaaggtgtcccccggcgcggccgccaccgggcgggtgaaggagccgccgaggatcacctggccggcctccaggcagacgccgtagggcgccagcttgttggccagccaggcgacgcccttggccgggtggttgagcaccgcggcggagacgccagactcctcgatcacgccattgcggtagaggattgccggtacccgccgcaggtcgatatcgcctggccgtacggcccggccgcccatcaccacgccggcgttggcggcgttgtcggagatggtgtcgaagaccttgcgcgtgactttcgtttgcgggtcgacctgctggatgcgcgcatcgatgatctccagcgccgggatcacccactcggtggcctcgagcacgtcgaacagggtgcagcccggtcccttcagcggcttgccgaggatgaacgccagctccacctcgacccgcggcacgatgaagcgctggaaggggatgtcgctgccctcctcgaagaacatgtcgtcgagcaaggcgccgtagtccggctcgctgatgttcgacgagacctgcatggcgcgcgaggtcaggccgatcttgtggcccttgagcacgcgcccgtcggcgatcttgcgctcgacccaggcgcgctggatggcgtaggcgtcctcgatggcgatgtccgggtagtcgagggagaactgccttacctgctggcgcgagcgttcggcggcgtcgaggcggttggcggcttcctggatcagacggggatcgagcatggtcggggtctctcggttcagcgtgggtag

SEQ ID NO: 11504 - DNA, 894 bp, Pseudomonas aeruginosa
tcattctgcgtgctcctgtgcgcgggcgcggaagaattcggcctcgctgacgattcggttgaccaggcgaccgacgccttccacctccaccaccacttcgtcgccggggaccacgtcggacaggccttccggggtgccggtggcgatcatgtcgcccggctgcagggtcatgaagctggagaagtattcgatcaggtagggaatgtcgaagatcatgtccgcggtgctgccttcctggcgcagctcgccgttgacccaggtgcgcagggtcagccggttcggctcgggaacctcggccgcatcgacgatccacggccccaccggggtggtggcgtcgcggttcttcacccgcaggttgggccggtagtagttctccaggtagtcgcggatcgcgtagtcgttgcacaccgtgtagccggccaggtagccgagggcgtcctcgcggcggacgttgcgcgccggcttgccgatcaccgccaccagttcgcactcgtagtgcatgtagtcgacgttgtccggacgccagctgacctggcggtggccggtgtaggtgcccggcgacttgatgaacgccagcggttcgctgggcgccttgaacgacagttcggcggcatggtcggcgtagttcaggccgagggcgaacatgctcccggtggccggcggcagccactccacccggtcctcggcgagcagggtgccgtcggccaggcggacggcgttggcgtcttccacggtgacctggtgaacccggccctggtagcggatgcgtgcgtgtttcatggtcggttcctcattccgcgacgatgctgttggcgaggcggccgaggccgtcgatctcgacctcgacgcggtcgccgggatgcacgtcgactcgcccttcgggggtgccggtga

SEQ ID NO: 11505 - DNA, 1125 bp, Pseudomonas aeruginosa
tgtgttaacgttatatttaacatgttaatgatcgtcaaccccggttgctgcgccattcgtcccggggaggtggcaagaggcgccgtctgcggtatacggaagcccgcgacggcttgcgtgcgcagccgggaagaacaacaaagagaagatcgccatgccagagcgccagccgatccccaacatcaacatcgggcaggtctacgaccagcgctatgccgacgccgaggtgcactacgatgcgctgggcaacctggccggattcttcggtcgcaacatgccggtgcaccggcacgaccgtttcttccaggtgcactacgtgaagaacggcgcggtgcgggtctatctcgacgagcgccagtacctggagtcggggccgatgttcttcctcaccccgccgaccgtgccgcacgccttcgtcaccgaggcggacgccgatggccatgtgctgaccgtgcgccagcaactggtgtggagcctcaccgaggccgagccgggcctggcgcccggcccgcaggtggcgccggcctgcgtggcgctgggcaacctggagggcggcgcggccgaggaggcggcgcgcctggcgctgctcttcgagcagttgcgcagcgagtcgatggccagccgtcccggccgccagcagatgctgctggcgctgacccggctggtcatgatcagcctgctgcgtctctcggccaattcggtggctgcgcggccgatgcgccacgaagacctgcagatcttccagcgcttcaacgcgctgatcgaggagcgctatgccgagcactggccgctgtcgctctacgccagccggatcggcgtcaccgaggcgcgcctcaacgacgtctgccggcgcatcgccgacctgccgtcgaagcgcctggtgtacgaacggcttatgcaggagtccaagcgcctgctgctgttcaccggcggctcggtgaacgagatctgctaccagctcggcttcaaggacccggcctacttcagtcgtttcttcgtgcgttacgcggggctcacccccagcgcttaccgccagcgacaggccgacggggagtcccgtcgctgagcgggtgggcgggtatactcgcgctcccactcgaacaggaagcgtttctccatgcatga

SEQ ID NO: 11506 - DNA, 804 bp, Pseudomonas aeruginosa
tgcagccacctccatgccgccgcaggctccctccacctgggccgactaccttgccggctaccgctggcgagggcagggcgaaggatgttccgcggccactgtccaccgcctggaggttgcgcggcggccgaccctgttcgtcaagcaggaagtgctgtccgcacatgccgagctgcccgccgaaatcgcccgcctgcgctggctgcacggtgccggcatcgattgcccgcaggtgctgaacgaaacccagagcgacggccggcaatggctgctgatgagcgccgtgccgggggacacgctgtccgcgctggcgcagcgcggcgagctggagcccgagcgcctggtgcgcctggtggccgccgccctgcgccggctgcacgatctcgatccggccgcctgtcccttcgatcatcgcctggaacggcgcctggacaccgtgcgccagcgggtcgaggccgggctggtggacgaggcggacttcgacgacgaccatcgcggtcgcagcgccacggagctgtaccgcctgctgctcgaccggcgtccggcggtcgaagacctggtggtcgcccatggcgacgcctgcctgccaaatctgctggcggaggggcggcgcttcagcggcttcatcgattgcgggcggctcggcgtcgccgaccggcaccaggacctggccctggccgcgcgggacatcgaggccgaactcggcgcggcctgggccgaggccttcctcgtcgaatacggcggcgatatcgacggcgaacggctggcgtacttcaggctattggacgagttcttctagagtag

SEQ ID NO: 11507 - DNA, 2289 bp, Pseudomonas aeruginosa
gcagcgtttcgtagtcgcccggcgcgatctcctccgagacgcggaccgtcagcacccgccccatgctcttgtgttgcagcgaatgcacttcgaccctggccagtgcgggagtcgcgcagaacacggcgaggcaggcgaggacggtccggaggcggaggcggggcatggaacggggcgatcctgtcagacggcgatggctgccgaagatacctgcaagcgttgcattgtgcacggtcctcgtcgtcaggacgaggagccggtctccgcctggcgcaccggcaggcgcaggcagaaggtgatgacgtcgtcgcggcagtccacgtcgatacgcccctggtgggcctgggcgatggcctgggagatgtacaggccgataccgaggccgttgcggttgcgctggttgtccgccgactcgcgcttgaacggttcgaacaggttggccagctgcgcttcggagaggccgctggtttcgttgagcacgctcaggcacacctcgtcgccctggcgggtcagggttaccagcaccggccggccgggcaggccgtgatgacgggcgttgctcagcaggttggcggcgacctgggcgtagcggtccgggtcgaccacggcacgaacctgcgggtcgatggcgatctcgatcaccaggccgggataggcgacgtcggtttcgcagacgatctgccgcaccagttgcgagacgtcggtgtcgaccgggttcacggtgaggccgatgcccgattgcaggcggctcatgtcgaggatctggctgaccagccgttccatgcggctgctggacgcggaaatgtgttggcgcagttcggtggtgcgggtgtcgctggaggacagcagggccgccgccatggagatcgactgcaacgggttgcgcaggtcgtggccgagcaccgcgatcaggcgctggcgcatgcggtcgacctcggccgcatggttgaggcacagttccatcaggtccaggcgcagcttttcggcgatcgccaggtcggtttcgctccagggcgtggagtggccgcggaccacttcctcccaggcctcgaacgagccgcgcggggtcagccgcgggccggaggggccgatggtcaacagcttttccggcttgccgccccagcggatgcggtgcacttcctcgtggcggaaccagaagatccagcccgattcctggcggtggaaacggatcgccagcacaccgcagcagtcgccgccgtccggagagtcctcgctgggctgcggccagttgtcggtgtggtagatgtcccgttccgggtcgcgctgcaggcgttgcaggacattcccggcctggcgctcgaagtcgccgcggatgctcagggtgcggccgccgagcatgaccagggcgccgtcgcagggaatcagtgcggcgatgccatcgtccgggtgggccagtgcgccgaacaggtcgtcggcgtcccgcgcgcggcgagccagggccagcctgcgctcggtggacacgcgcagcagttcggcgatacgcccctgctccaggcgctcgacgatggcgctgcagacctgggagaagatctggaacgacatgcgcaccgggtagggaatcagcttgggcgacatgtgatggcaggaaaacagtccccagagcttgccgccgaccacgatggagatgctcatcgaggcgcgcacgcccatgttggtcaggtattcgcagtggatcggcgaaacgctgcgcagcacgctgtagctgagatcgaacgattcgttggtctccgggttcagcgcgggaaacacgcgcatcggcgtataggccacgtcggcgatcagcctgatcgggttctggatgtacaggcgacgcgcctgggccgggatgtccgaggccgggtagcgttgccccaggtagctttcgaggtcttcgcgacggctctcggcgaccacctcgccggagtcgtcatgacggaaacggtaggccatcacccggtcgtagccggtcatccggcgcagttcgtcggtgacgttgctgagcaggctggcggtgtcgttgtgcaactggacctgggcgatgatgcgctgggcgttgagggtgaaggaggtgatcgacagcgtgtccgcggtgcggatctcgaactccaggtagaacacttccttgtagctgtggccgatcacgtcgaacaggtgttcgccgatccgcgtctcgacgctgttcgaccatgggccgttgccggtcagtccctcttcgagcatgcgcaggacctccggccccacctgctcctgcgtcaggtaggaacccggcgaggcgacgaaacccagtag

SEQ ID NO: 11508 - DNA, 1464 bp, Pseudomonas aeruginosa
atgggcatccccgcgcgcggcgcagggatgccggagcgggcgcgctcaggccgcctcggtctgcaccacccggtagcaggggacgtaggccgcgccgccgggcagcttcatccggtgctgcttgacgaaggcctgcagcaggcggtccagcggcagcatcaccgccgggtcgccgtggatctcgtagggcccgtattgctcgatcatgcggatgccgttgtccttgacgttgccggcgacgatcccggaaaacgcgcggcgcaggttggccgccaactcgtggggcggcaggctgcggctgagctggaggctggccatgttctcgtgggtcggctcgaacgggcgctggaagctttcatcgatcttcagcatccagttgaagtggaaggcgtcgttgcgctcgcggcggaactgcttcacttccttcaggccctgggccatctgcttggccacctcggccgggtcgtcgatgacgatccggtagtggcgctgcgccgcatggccgagggtcgccccgacgaattcatggagctgctgcaggtaggcttcggcgctgcggggaccggtgaggatgaccgggaagggcaggtcctggttgtccgggtgcatgaggatgcccagcaggtagaggaactcctccgcggtcccggcgccgccggggaagatgatgaccccgtggccgacgcggacgaaggcttccaggcgcttctcgatgtccggcaggatcaccagttcgttgacgatcgggttcggcgcctcggcggcgatgatccccggctcggtcaggcccaggtagcggccgccgacgatgcgctgcttggcgtggctgatggtggcgcccttcatcggccccttcatcacccccggtccgcagccggtgcagacatccaggctgcgcaggccgagttcgtggccgaccctcttggtgtacttgtattcctcgctgctgatcgagtggccgccccagcacacgacgatcttcggctcgacgccggggcgcagcgtacgggcgttgcgcagcagctggaagacgtagtcggtgaggccctgggagctgtccaggtcgacgtgctggctgtccagcccgctctgggtatagacgatgtcgcgcagggcgctgaacagcatctcgcgagtactggcgatcatctcgccatcgacgaaggcgtcggccggcgcgttgatcagctccaggcgcacgccgcggtcctgctggtggatacgcacctcgaagtccttgtaggcgtcgaggatggtcttggcgttgtcgctgtgggcgccggtattgaggatcgccagggcgcactggcggaacagttggtaggtcttgccgttggcggtttcgctcagttgttgcacttcgcgttgggagagggtttccagcgtgcctttcggactgaccgaggcgttgatcacagggcgatgagacatgtgcgattccatgcaggggatgcggcggcgtag

SEQ ID NO: 11509 - DNA, 456 bp, Pseudomonas aeruginosa
aggtcgcccgccaccaggcgcacttcgtcgcttccaacctctattcgctggcccagagccgcttcctgccggggttccgcgcggtcggcatccaccacggcgggcgcatggtcggcttcgcccctctacggccccgacgccgacgacggccactactggctctaccgcctgatgatcgaccgccgctaccagggcaaggggcatggccgcgccgccctgcaacggatcatcgccagcgtgcgccggacgaggcggcgcagcgatcgcctgatggtcgcctacgccgtcgacaacgatgtggcccgccagctttatcgggatgccggtttcgtcgaacagggcctcgcgccctggggcgagacgatggcctgcctgatgctgccggagccgtcccatcgctccgggaaggtcgccggagcgccgggcgggcgtgcagcgcacggcgtcccggcgtag

SEQ ID NO: 11510 - DNA, 1344 bp, Pseudomonas aeruginosa
aatcgcgggattcggcagttccctccaatacctataacgaccatccaacgcacatcgccgccccggacccttgcgtccggggcgttttccgtcgtgcgtggcgagggtcgcgggacctgcccgtccgccccctgctccggaaccgaacgccccatggacagcacctccgaaacccgcagcggcagctggctgagcgtgatcgccctggccctggccgccttcatctacaacaccacggagttcgtcccggtcggcctgctcagcgacatcggccacagcttcgagatgcccacctcgcaggtcggcctgatgttgaccatctatgcctgggtggtgtcgctggcctcgttgccgatgatgctgctgacccgcaatatcgagcggcgcaagctgctggtcggggtattcctgctgttcatcgccagccacgtgctgtccgggctggcctggagcttccaggtgctgatgctcagccggatcggcattgccttcgcccacgcggtgttctgggccatcaccgcttcgctggcggtgcgcgtggcgccgccgggacagcaggccaaggcgctagggctgctggccaccggcaccaccctggcgatggtcctgggcatcccgctggggcgggtggtcggcgaggccctgggctggcgtaccaccttcatggccatcgccggactctcggtgctgaccctgctctacctggcgcgctccctgccgctgctgccaagccagaactccggttccctgcgcagcctgccgatgctgttccgacgcccggcgctggtctgcctgtacgtgctgaccgtggtggtgatcagcgcccagttcaccgcgaacagctacatcgagccgttccccaagcaggtggcgcggatgagcggcgaggcgaccaccctgctgctgctgttgttcggcggcgccgggatcttcggttcgatcttcttcagccgatacagcgaggctttcccgcgaggcttcatgctggccgcgatcctagtcttgggcagcagcctggcgctgctgttgccgctgtccgcgcagccgacctggctgatggcgctcagcctgctctggggcatgtcgatcatgtgcttcggcctggcccagcagtcccgcgtcctgcgcctcgcctcggacgccaccgacgtggccatggcgctgttctccggcctgtacaacgtcggcatcggcgccggcgcgctgctcggcagcgtggtcagcgaacgcatgggcctggcctcgatcggcaacgtcggcgccgtgctggcgctggccggcctgctgctcgccctgttcgccgcactgcgctacgcggaggcgctgaaaagcacgtcgttgtga

SEQ ID NO: 11511 - DNA, 945 bp, Pseudomonas aeruginosa
gtttcccggcgcccgcggcttcggcttcatacgccgggtggcggccgccgacgaggccgggttcctgcgccaggcgcgggccgacggccagccggagttccgcatccagcaactgactccgcacgatggcgagcgctacgtcatccagtacatcgagccggtggcgcgcaacggccaggcgctgggcctggacatcgcctcggaagccaatcgccgggaggccgcccgcgccgccctggagaccgggcaggtgcgcctgacggggccgatcaccctggtccaggccagcggcttgcgccagcaatcgttcctcatcctgatgccgatctaccgcagcggcatcactccaccgccggggccccagcgcgaactcgaaggcttcggctggagctatgcgccgctgctgaccggcgaggtgctggccgggttgcccatcgacaacgcggctatccacctcgaactcagcgacgtcaccggcgacggcgctgccgtgcccttcttcgtcaacggcgccgcggcgccggctcaacgcctgttcggccacatgctgcggcgggagatctacggtcggcactggcagatggcgttcagcgcactgccgctgttcgtccagcgcctgcaccagccttcgccgcgcatcctgttcctggccggcagcctggtcagcctgttgctggcggcgctggtcaacgccagcgccctcggccgcctgcgccggcgtcgggaggcggcgacccaggcgcggctggcggcgatcgtcggcaattcggcggacggcatcatcggcgtcggcctcgacggcgtcatcagcgactggaatcgcggggccgaggcgttgttcggctaccgcgaggagcaggcggtcgggcggcgggtggtggacctgctggtgccgccatccaaggagaacgaggaactcgacatcctcgcccgcatcgcccgtaa

SEQ ID NO: 11512 - DNA, 1674 bp, Pseudomonas aeruginosa
agaacaggtggtcagcttcgataccgtgcgccggcaccaggatggccacctgctcgacgtggcggtgaccgtctcgccgatcctcggtccggacggcggcgtggtcggcgcctcgaagaccgtacgcgacatctccgcgcagaaggccgccgaggcccgcatccgcgagctcaataccggcctggagcaccagatcgccgagcgtaccgccgaactgcgtcggttgaacgtactgctcggcagcgtgctgcaggcggcgtccgaggtgtcgatcatcaccctcgaccgcgatggcatcatcagcggcttcaatctcggtgccgagcggatgctcggctaccgcgccgacgaggtggtcggcaaggcctcgccgaccctgctgcacagcgagcgggagttgctcgcccgcggccaggagctgggcgaggagggtttccgcgtgctggtggcgcgggccgaacaggagggcgccgagacccgcgaatggacctatctgcgcaaggacggctcgccgctcagcgtgacgctttcggttaccgtcctgcgcgacgaggctggggcgatcaacggctacctgggcatcgccgtcgatgtcaccgaatggcgcaacgccgagcgcgagatggccgcggcgcgcgaccagttgcaaatggccgccgacgtggcgcgcctgggcatctggcgctggaacctggccgacgacagcctgcagtggaacgagcgcatgtgcgagctgtatggccagccgctggcgttgcgcgacggcggcctggtctacgagcattggcgcagccgcctgcatccggaagacctcgagcgcaccgaggccagcctgcgcgcggcggtggaggggcgcggcaactacgatgtgatcttccgcgtggtgctgcccgacggcggcatccgcttcatccaggccggcgcgcaggtcgagcgcgacgccgacggcaacccgctgcaggtcaccgggatcaatatcgatatcaccagcgaccagcaactgcaggcgcgcctgcgcgaggccaaggagcaggcggacgccgccagcgcggcgaagtcgtcgttcctggcgaacatgagccacgagatccgcacgccgatgaatgccgtgctgggcatgctgcaactggcccggcagaccgatctcaacgaacgccagcgcgactacctggacaaggccagctcggcggcaacctcgttgctcggcctgctcaacgacatcctcgactactcgaagatcgaggccggcaaactggtcctggaaatgctccccttcgagctggagccgctgatgcaggacctggccgtggtgctctccggcaaccagggcgacaaggacgtcgaggtgatcttcgacatcgatcccgagctgcccagcgcggtggtcggcgaccgcctgcgcctgcagcagatcctcatcaacctggccggcaacgcactgaagttcaccgcccgcgggcacgtcctggtgagcttgcggcgtctggcgcacgacgcccacctggtgcgcctgcgggtgctggtggcggacaccggcatcggcatcagcgcggaacagcagcagcgcatcttcgaaggtttcacccaggccgaggcgtccacctcgcgacgcttcggcggcaccggcctcggcctgttcatatgcaaacgcctggtcgacctgatgggcggtga

SEQ ID NO: 11513 - DNA, 1425 bp, Pseudomonas aeruginosa
ccggttctggttcgacctggacctcgacgtcgcccacgaccaaccgctgcgtgcggcctgccccggggccggcgaaccgctgcggctgctggtggcggacgacaacctggtggccggcgagctgctcgaacgcacggtcggcgccctcggctggcgcgccgactgcgtcggcagcggcagcgaggcggtggcgcgggtccaggcggcgatggccgagggccgtcgctacgacgtggtgctgatggattggcgcatgcccgatctcgacggcctcagcgcggcgcaactgatccgccagttgcagggcgacctgccgccgcccatggtgatcatgatcaccgcctatggccgcgaggtgctggccgatgcgcgcgaccacagcgcgccgcccttcgtcgattttctcaccaagccggtcacgcccaagcaactggccgactcggtgctgcatgcgttgcacggcgaacagggcgccccggccaacccgccgccgcgcccggtggagcgcacccagcggttgcggggcgtgcgtctgctggtagtggaggacaacgcgctgaaccgccaggtcgccgccgagctgttgagcagcgagggcgcccgggtggccctcgccgacggcgggctggcgggcgttcagcaggtgctggaggcgagcgtgccgttcgacgcggtgctgatggacatgcagatgccggatatcgatggtctcgaggcgacccggagaatccgcgccgacgggcgcttcgccgggctgccgatcctggccatgaccgccaacgcctcgctggccgaccgcgaagcctgcctggcggcgggcatgaacgaccatgtggcgaagccgatcgacaaggagcgcctggtgctttgcctgctcggtcatctcggcaggagcggcgccaggggcgcgccggcaacggcagcggacgcgggcgaactggtcgaggcgcggggcgatatcgtcgggcgtttcggcggcagcctggagctgatcgtccaggtgttgcggcgcttcgttccggacatgcaggacctcttcgcccagctcgaacgccagctcggcgagggcgatgtccagggcagcgccgcgaccctgcataccatcaagggcagcgcttccaccgttggcgccagcgccctggccggccgtgccagcgagctggagcaggccctgcgccgcgccgatccgctgcgcggcatggaaatcctcgccggcatccgcctcgacgaactgcgcaccctgtgcgatgcctgcctgctccgcctgcaggcgatgttcggcgacgtgcaggcggagtcggcgagctgaaccccggcgcggtggccagtcccgccaaggattcaggcggacccggggctcgccctgcatccgatgcggcctgtagggcggataacgccatgggcgttatccgccgatactcctga

SEQ ID NO: 11514 - DNA, 309 bp, Pseudomonas aeruginosa
cccacgagggcgagagcctgctgccggtactgtgtgactccttcgaccgcatcgccggcctgctggaacgtttcgagggtggccactaccgggacgtgctcaccgtcggcgcggtcggaaccttcacggtcggttggctgctgccgcggctggaggacttccaggcgcgccatcccttcatcgatctgcgcctgtccacccacaacaaccgcgtcgacatcgccgccgaggggctcgactacgcgatccgcttcggcggcggcgcctggcacggcaccgaggcgctggcgttgttcgaggcgccgctga

SEQ ID NO: 11515 - DNA, 1140 bp, Pseudomonas aeruginosa
ccgagatgggccggcgggagtgagagatgcccggcacttcgtcggcatgcccgcgctcgattgcgtatcgctttgtatccatgcgcggtttcgatacctccggcgtacaaatccaagtgtcgggcgatacacccccgatacatctcccaggcgaaatggccacatccgaaccgcggcgcccgggacgaccccagaaggtcccgccgcccggttcgtaccggcgcccaccagcgccgcgcctgcggcccggccgcgtttactgtggagaagaagcatgtccgttttcgattcgcgtcaaaagacttccgccagcctgctcggtgccgtactggtggggggaatgctgctcggccgttcggcgttcgccgtccagccgttggggcatgggctgcaactggcggcggcgatcgcccgcgaatgcccatgcggagaaaggcaagtgtggtagcggcggctccgcgaagaccccggccaaggccggcgccgagggcaagtgcggggagggcaagtgcggcgacgcctcctttgcccgaaccgacaccgatcacgatggcaaggtctcgcgcgccgagttcctcgcggtggccaaggaccgtgccggtgagttcgacagcatcgatagcgaccatgacggcttcatttccgaagccgaggcctacgaacacctgcgcaagacctacgaggccaacggcaagccgatgcccgccgggctgttcagcaagctggagcaaggccggcactgagcctttccacaccctggcggcgccctctctttcccctgggaaagcgggggcgtcgccgtttccggagctatcccatgaccctgatcgacaacgccgccggcctcggcctgaggcgcggcctgcttccgcaactgctggcgatggcgcccggcgcggtggacttcctcgaatgcgcgccggacaactggatcggcgtcggcggtgccttcggtgccgacctggagcgcctggtggagcgctttccactgacctgccacggtctctcgctgtccctcggcggctccacaccgctggatgccgccttcatcgagcagacccgacgcttcctcgtccgccaccgggtcgcgttgtacagcgagcacctcagttactgttccgacgatggccatctctatga

SEQ ID NO: 11516 - DNA, 1020 bp, Pseudomonas aeruginosa
tctgttgccgctgccgttcaccgaggccgcggtgcgtcacgtcgcggcgcgcatccgcgaggcgcaggagcgcctggagcggcgcatcgcggtggagaacatttcctactatgcagcgccgtaccgggagatgagcgagatcgagttcgtcaacgcggtactcgacgaggccgactgcgacctgttgctggacgtcaacaacctgttcgtcaacgcctgcaaccacggctacgacgccctcgacttcctcgtccggctgccgcccgggcgggtcgccgcctaccatgtggcggggcactacgacgaggcgccggacctgaagatcgacacccacggcgccgccgtgaagcccggcgtctgggccttgctcggagccgcctatcgtcgtttcggcgtgcgcccgaccctgctcgagcgggacttcaactatccgccgctgggcgaactgctgctggaagtggagcagatccgccaatggcaacgcgacgagggacgccgtcatggatgagcgcctgcgccaacagcagttcagcctcgcccggcacctgcgcgacccgcttggcaatgcgccgccgccggacatcgaagaacgtcgcctgcgggtctaccgcgagctgttctacaacgccatcgaaggcctccttgccagcggcttcccgcgcttgcgcgggctgcttggcgagcagcagtggcatggcctggtgcgcgagttctatcgcgaggagagaagccatacccccctgttcacccgtatcgccggggtcttcgtcgactacctgcggcagcggggcgagtatcggccggcgtggcaagccgagttggcccacttcgaatggagcgaaacgcgcctctacctggccgagcccgacgatccgccgtatcggcgtgaaggcgacctgctcgacggggtgccgctgctgtcgagcctggcgctgccgctgggctatcgctggccggtgcatcggctcgaagaggacgtcgcgctcgccgaagcgcctgcggaaccgaccctgctgttga

SEQ ID NO: 11517 - DNA, 990 bp, Pseudomonas aeruginosa
gcttcatggatgggcctcgaccagtcgcaccggcagcgagaacacatagccctcgctgcgcacggtcttgatgtactccggttcgcgggcgtcgtcgccgaggcgttggcgcaggcggctgaccagcaggtcgatggaacggtcgaagatgtccgcctcgcggccctgggtcaggttgagcaactggtcgcggctgagtacccgttgcggatgatcgaggaacacccgcagcaggcggtactcggcgccgctgagggcgaccacggtgccggcgtcgtcgagcaggtggcgggcgctggtgtccagttgccactggccgaagccgatcagccggctgctctcgctcacggtgaggttcggcggcagcatccgcgtacgccgcagcacggcgttgatccgggcaagcagttcgcgggcggagaagggcttggtcaggtagtcgtcggcgcccatctccaggccgatgatgcggtcggtctcgtcgttgcgcgcggtgagcatcagcaccggcgtggccttgtgcttgccgacgcgcagctcgcggcagagcagcaggccgtcgtcgccgggcatcatgatgtcgaggacgatcaggtccaccgtgttggcttcgaggaacgcgcgcatctgccggccatcggcgacgatggtggtgcgcaggccgttcttcttcaggtagttgcctaccagctcgcgaatctcgcggtcatcgtcgacgatcaggatgtgatcgacatgctccattgcctggctcccgtggcggttggtgtgcttgcaagcagtgtatccgcgcccgcggcgcttgcctgccggggtttgtattgcactgtatccggagccggggcgaataccggggcgtgcaaaaaagcccggttgtcgctgtcgcgaacgggggagacgacggatggcgccgggcgcgattcgtccggcgggagcggggcggcgaatgtacggccatgtatcggccggcagcggcgatacagcggctga

SEQ ID NO: 11518 - DNA, 558 bp, Pseudomonas aeruginosa
ccgagcttggcctcggtgcggtacatcagcacgatgtcctggtggtcctgcaggttctcgccgaccccaggcaactcatggcgctggacgatgccgtggcgcgccagttccgccgccgggccgatgccggagagcaacaggagctgcggcgagttgatcgagccggcgctgaggatcacttcgcggcgtgcctgcaattgcacgacctcgccagcctggctgatctccacgccggtggcgcgggtaccttccagcagcacgcgcagggtcagcgccgagctgagcacggtgaggttgggccgcgccagggccgggtgcaggaaggcgcgcgccgcgctacagcgttcgccgttgacctgggtgacgtggaacgggccgatgccttcctggcgctcgccgttgaagtcggcgttgtacggccagcccatttcctcggcggcctggaagaacacctggttgatcgggcccgggctgcgctgcgcggcgacgttcaattcgccgccgcgcccgtgccagggcgattcgcccggctcgaaatgttccgagcggcgaaagtag

SEQ ID NO: 11519 - DNA, 2322 bp, Pseudomonas aeruginosa
ccgaggctgccaggcggcgcgctacagccccagcagcgagcccatgtcgaccatcagttgcaggccgacgacgaaaccgtctccgctcagttcgcgagcgccggggttgtagtagttgtccgggttgaagatgtactgcaccgacggctccagcgcgatgtgcggggtcagtgcgatgtgcgcattggtttccagggcgtacacgtcgcgctggccgagtttcgcatcgccgccagcggcgatccgcgcctggcgctggaactccagctggtgatcgttcaggcgcaggtagctggccttgaggttgagcttgtcccgcgtgcggtcgaagggcgcatggtaggtcaggcccagctcggcgaaatgacggaacggctgcttgtcgtcggccgataccgacagcgagccgaacagccccagcgccctcggcgaatcgaggcggccgccgtcggcgcgccagaacagctgctggaacttgaagaagccgccggcgctgccgtggtcgctggcgccggtgagcgggtcgacctggttggcggtgttcaggtaggcgttgagttcatagtgcgagcggtagggatcgaggctttcctcgcgcttgtcgccgatccccagcagcaggctggtgccgctggcgtcgtcggtgccgaaatcgaggccatggcgcttcttcaggtaatccaccgggttggactcgaaggccccggcgtgcaggtacagggtcggggtcgcccggtacttcaagtagccgccccaggcgccgtagggcggcggcaggatgccggtggaggcgtcgatgatcgggtcgttgcaggtgaccacggtctcgcagttgtagatcaggaaatagcgccgcgcattggtccgtccgagatggctgtcgaggcgtccgcccagccactgctgctgccaggtgagcaggctcagctggttggcgccgatgtcgttgtgcagcggcgcgccgccgaagtagctgcccaccgcgccctgccagctcggcccggtgggctgaccggtgccgcggtcgaggatgaacagggtttcctcgatgtgcagcgaggcgccgtccaggccggcgagggtggcgaggtcgaggtcggcgccgaggaacaggtcgccgctgttgccgaagctgtgctggcgcgggccggtgtcgaggttcttcagcgacaggctccagaactgcgcgtgggtcttcacgccgtggcgctggagtcgttcgccgaacccggccagcgggccgctgcggctgtcttcggcggcctgcgcggagagaccgaggaaaccggcgcagagcagcgccggcaaggtgcggagggttttcatggcaaggcactcgtcttgttgttgttctgtcgtgcgaatcgctgtccgccccaagcggacaggtgcatccggagcgaaggcggctcaggcgcagagatagccgccgtccaccgccagcacggcgccggtgacgaagctggcgccgggaccgcagaggaaggccgcggcgctggccacctcgggcgcctcgccccagcgcgccagcggcgtgcgctgcatgatccggcgggtggcctcgacgtcggccttgagcccggcgcccagcggcgtgtcgatccagccgggggcgatggcgttgacccggatgcgctcggcggcatactcgcaggccagggaacgggtgagctggacgatggcgcccttgctggcgctgtaggccgggcggtcggcggaaccgaaggtgctgtacatcgaggcgatgttgaggatgctgccgccgcgctgcgccagcagcggccgggccagttggctggcgagcatggcggcgctcaggttgaggcgcagcacccgttcgaaggtagccaggtcgtattcctcgcggtcgcggctgatgccggcgttgttcaccagcacatccaggcgcggcagcgcttcgaacagccgttgcaggcgctggctgtcggtgatgtccagttcttcccggcgaatccgcggatgacgcggtgcgtgcacgccgtcggcgtccaggccgagggcgacgacttcggcgccgagttcggcgaactgcatggcgatggccgcgccgatgccggagctgccgccagtgaccagcacctgctggccggcgtagatatcgtgttggaaaaccatcggcgatcgttccttcaggcgtcggccagggccgggttgggattgaccagcaccttgacctgcgacttgtcgcgcagcagggcctcgaaaccgtgctcgacggcctgctccaggggcacgctgcgggtcactgcgcgggccaggtcgaggcggccgtcggcgagcagggcgatcagctccgggtag

SEQ ID NO: 11520 - DNA, 468 bp, Pseudomonas aeruginosa
ccgacgctgccgagcaggcgcagttcgcggttgaccaggtcgaaggcgtccagccggacctcgcccatcaggctcaccagcaccagctcgccacccttgcgcaggctggccagggcggcgtcgaggctggcctggctgccggcggcctcgaaggcgcagtcgagcgcgccgccctcgcgcaggcgcgccgccgtgtcgccgtcgcgggcgtcgagcgcccggctggcgccgaactccccggccagggcgaggcgctcgggactgacgtcgatcgcgacgatgtcctcgattccgcgcaggtgggcgagcatcaccagcagcaggccgatcgggccgagcccgaacaccgcgcagcgctggcccggcgccaggctgctgcggcgcagcgcgtgcagggccacggcggccggttcgagcacggcggcctggcggaagcccaccgcgtccggcaggcggtgcagcatgtag

SEQ ID NO: 11521 - DNA, 1995 bp, Pseudomonas aeruginosa
agggaaacaggaaggacagcgccaggcggtcgaagaagacgaagccgaaggtcaggaacagcacgcagagcaggacgttttcgtaactggcggaattgttgttatgcgccatgtcggtctccaggccgggcgggccggccggcgggggaggcgcgcgtccgccagggcggcgcgcgcccggggtcagcggaacagggagtcgatgtaggcggcgccgacgccgatcttgtcgtagtgctcacggcacatcgcgatgtagtcgtggacgtcgaagatgccgtccgcgttgcccttctcgtcgagccagaccagcggtcccttgacgatgaagaatgcacgcatcggctgctcgtgctcgtaggccaccagggtgtggccctcgccgggcgtctcgtagacgaagtcgccggcggtggcggtccagtcgtgctccaggtagccccacttgccgctgatggtgtaggcgaacacctcgtgcgggtggtagtggcggttgaccaggccggcgctcgttgccatcaggatgtcgcaccagcggttttcgcttggcgagatccacagcggacgcgacttcacggtctcggtgaagggcacgtagaggcgctcgtcctcggtcggcgcgttgcgcaggtagacctcgggcttggcgtccggcttgaagcagtcgggaatcggttgcaggtctttccagaattcacgggtggcgagttcgggcatggggcggcctctgtcgttgttatcgtcgagccgactctagccatgggcgggcctccgggtttgaccctggcggccaggaagcttgcgcttttcggacatggcctggcgcgacccgcgacgcgccgccaagctggcctgcccagcgtcggagccggctggagggcgattgacggaggaaaggattcagatgttaatgacggggtgccaggcgcctcgccgaccgaccgcgacaggtcggcggagcggcccggcgcctggccccggaggccttgcctgaggtccgggaggtccacgcagcgttcgacgagaagaataaaaatgcccgcacatgccttgctcgaaacccggcgggccagcacccaggacattcccctggagcagcggctggcgttctgggaggactacaacgcttccatcctggttggcctgaaatgttcgtcgtattcccaggccggcttcgccgcgacccaggacaacctctgcctcgaacgcctgcggctggcccgcatcggcggcaacgagcacgtggtggagcgcgaccgctcgatgatccgcgcagtgcccaaggagtcgatcttcgtctctctggtgcagggcagccagtcgttcttctaccaggacaacggctgcaacctcctgcaaccgggcgagctggttatctaccggaccgacaagccctacctgttcggtttttccggaccgatgcggcagttcatcttcgacattccccaggacgatttcgccgagcgctgcctgcgcgacttcaagggaccgctgaagatcggcgcggaaagcccggtgcagcgcctgctggtgcggaccctcggcgagcgtacccgggatttcctcgacagcccccatggcgaggatgccgagcgctaccaggaggaagcctacgacctgctggcgagcatcatcagcgaccatgccggcgagcaccgtgccagcgccctgggcgcgtcctacctgctggcgggcaagcagtacatccagcagcacctcgacgaacccgccctgagctgcgagcgggtggccgccgccactggcgtctccagccggcacctggcgcggctgttcgcccaggaaggcagctcgcccgggcgctacctgcaggagcggcgcttggagcgggcccgccagttgctcgcttcgccccagggccggcgcctggatgtcgccgaggtcgcctatcgccacggcttctccagccaggcgcatttcgcccgggccttcaaggcgcgctacgggatgacgccgagcgaggcgcgtggccgctag

SEQ ID NO: 11522 - DNA, 741 bp, Pseudomonas aeruginosa
aaacctaccgcaaccgcgcctttgcccgcctggacatccattttcgcagccagcttttcgccctggtgcagggctgaggagggccggacgccgcctgtggggcggctccggagagaggggtcaggcggctcggcaggctcgctgcaggcgatggaagctgcggctgaagtagaccaggccgtcgccctgttcgaggacctggatgtcctccagctccagcaacagcaccgaatgggtgccgatctcctggacctcggcgatgcgtccctgcaggttggccagggcgccgtgcagcaccggcaacccggcgaggccctcgcgccagtcgtggagggcgaagcggcgttccatcgggacctcggtcatgccggcgaagtggcgggccacctcttcatgttcgccgctgaggacgttcacgcagagtcgaccgttggccttgaacaccgtgttcatctcgctgttgcggttgatgcagagcatcagcgtcggcgggctgtcggtgaccgagcagaccgcggtggcggtgatcccgcagcgtccggccgggccgttgctggtgatcacgttgaccgccgccgaaagatgcgccatggcgttgcggaaggcttgttgcctgggttcgagctgggacatgggaataacctccggacgcgacgcgggcgtcattggcggatgcggtcgagcacgttgatgtcgtccgggttgtgcaggtgcggcacggtccagccgttctcgtcgtag

SEQ ID NO: 11523 - DNA, 768 bp, Pseudomonas aeruginosa
tatttgggtctgcgtttatcagggcgcaatcttcggctgtcgcgtaatggtcggaggcgctctaggcggccgtcccggttgcgcgcaaaggcttggctaccttggccggttcgtactgcatcggctctccagggagcagccaggatgttccacaactccaaaggaaatcagatgaacaagttcaaacgtgcaattcttgcgcccctcgttgcgtcgggcacccttctcgcgctgatgtcccccgtggcccatgcggtcgatgggatcgtcaacttctcgggcaacatcaccgacgtcgcgtgcgatatcaacggccaggcgccgggtgcgggcaacgtcaccaacgtcgacctgggtatcgtggcgccgacccatttcaccgccgtcggaaccaactccactttccaggagttcgatctggtcctctccggtgccggctgcaccaatgacaagaaggtttccatcgccttcgatacggtcaccaacgtcgaccgtatcagcggcaacctgatgctgatggggccgtcgaaagccaagggcgtgcagatccagatcttcaacaattcggcggccaacaccacgaagatcccgctgggcttggtcgatgccgccccgcagaaaggcaaccatcgacaagaacacggcgaccctgaagtacaaggcctcctatgtgtccaccgagaagaccgtgatcgcgggtaccggcctgtcccatatccgctacctcctggcgtacgagtaagcggcggtcgacggacgaagaggtga

SEQ ID NO: 11524 - DNA, 1104 bp, Pseudomonas aeruginosa
  unsure (608),(765): Identity of nucleotide at the above locations are unknown.
tcgattcaaatcagcggggggacgtcaatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaaggcaatccgcggtgtctgtcggcagttcgtggtgctgtgccagcagcttggcctgttctctgaagcgctggtggccatcgacggcagcaagttcaaggcggtcaacaaccgggaccgcaatttcaccagcgccaagcttcaacggcgaatggaggagatcgagtccagcatcaatcgatacttgagcgcaatggataccgttattgttcaggaacttgccgtggcgcaggtcanagccgaacgcctccaagacaagatcgcgaccttgaaagcgaagctgcaggagctcaaggagatcgaggttcagctcaacgaaataccggataaacagatctccctgaccgatcccgatgctcgttcgatgaaaacgcgtggcaccggaatggtcgtntactacgtgcaggcagcggtcgatgcgaagcaccacctgatcgtgacgcacgaggtcacgaacgacggagtcgatcgagaccagctgagcgccatggccaagcaggcgcgagaggccatgggtgtcgaggaactctcggcggtcgcagacagagggtatttcaaaggcgaagaaatcctcgcctgtcatgaggctggaatcactgttttcgtgcccaaaacgctgacctcgggcgcgacagcggcgggccgcttcggcaaaggtgatttcatctatgacgcagcaaagaacgagtaccgatgccctgctgggcaaagcctgatctggcgtttctactag

SEQ ID NO: 11525 - DNA, 1020 bp, Pseudomonas aeruginosa
cgcaggtcgttggcggacatcgcgagcttggccggcatggcgtcagtagacgtagtgcagcaggctgatggcgacgatctgcgcgcgaccgagcagatggctcaggccgtcgccgggatagagctgcacggtggccttggcaccggtgggcagcaggccttcgggaagttcgtcgagcaccacgtgcaggcgctggcgctgggcgtcgcgaacccagcggtcggaggtgaccggcgcggcgaggtcgccgttggcgtccagctggccctccttgaccccggcgtcgatggccgccacccgcgcgccgaacacttcgccgggacgcgcgtcgaacaccaccgccgcacggtcgccagggcgcacgtagcgcagcgatttctcgcggaagtcggcgacgatgtcgatacggtcgtccaccagcgccgccaccggcgttccggccggaacgtaggtgcccggggtcagttgcaggttgctcagggtcccggcgcggtcggcccggacgctgctgtattgcagttgcagacgagcctgggccagggcattgcgcgcctggcgcaggcgcaggttgtcctcgccggccgtgccgcgtcgcgcggtcagctcgccgatccgcgcctgggccgcggcgacccgggcacgggcggcctgggcctgggcgctgacctgctcgtgcatctgctgcgacacatggtggcgctgcaccagttgggcggtgcggcgcgcctcgctgtccagctcgccggcgctgctgcgcgcggccaggaggtcggccttggccgaggcgatggcggcatccagctcgcggttggtgcgctcggcttcctccagtgccagttcggcctggcgcacggccagtcggaaaggctcgggatcgaggcggaacaatacttcgccgggctgcacgtggccgttgttggacaccagcacctcggcgacctgaccgctgacacgcggcgcgacgcgcaccaccggccgggtcaactgggcctgcggggtgggtcggcgaccaggaagtag

SEQ ID NO: 11526 - DNA, 381 bp, Pseudomonas aeruginosa
aaaggcaggccaggtattcagtggagatacaccatggcaacacaaggagtgttcacccttcccgccaacacccggttcggcgtcaccgccttcgccaactcgtccggaacccagacggtgaacgtgctggtcaacaacgagacggccgcgaccttcagcgggcaaagcaccaataacgccgtcatcggcacccaggtgctcaactccggcagcagtggcaaggtacaggtccaggtcagcgtcaacggccgcccctcggatctggtctcggcacaggtaatcctgaccaacgagctgaacttcgccctggtcggctctgaagacggcaccgacaacgactacaacgacgccgtcgtggtgatcaactggccgctcggctag

SEQ ID NO: 11527 - DNA, 471 bp, Pseudomonas aeruginosa
atgttgtccgagccgatgaacaccacccgcttcccgttattggcgaatcaggtacgccgccagcggcgcactgttctggttcggcgccggaccgccgtaaacgatgttcggcgaatactcgaagccctcgtagggggtcgggtagcagagcagcgcgtcggcgcgctcgaccaccggcatcaccgccttgcgcgtgtgcgacatgtagcagcccacgaggaaccgtaccccccggttgcgaatgaagtcctcggcgcacagccgatagcggtccgggtcgccgccggggtcctgggacagcgtttcgatcgggcgaccgccgacgccgccctcgcggttcagttgctcgaccgcaagcaatgcgccatagcgctgcgagcgctcgatatcggcggtgacgccggtttcggagaacagcaggccgatcagcgaccgctcctggtgcgatcccatccgtttcctctcctgtga

SEQ ID NO: 11528 - DNA, 684 bp, Pseudomonas aeruginosa
cgtcctgcacatcggtgcgcggaccgtcggcgcgctcgatcaggccgagggcgttgtagctgtagctccaggcgcgctcggccgcctgcgcgggcagggccagggcgcaagccagggcgagggcgccgagacgggggaagtatggggggatgcgcatgggtgtcgtccttgtcagcgggtggtgacggtctcgccggtcttgcgtccctcggcgtcgtactggtagcgggtgatccggccgggctcgctgacctgcaccgggaggaacagggtcgggtgccaatcggttgtgatggtgcgcgcctgcgcagtgccggcggcctcggtgcgcgaggtctccaggccacgggcgttgtactggtaggtggtcaggttgccgttgttgtcgcgtttgctggtgagcaggccctggtcatcgtaggtgaaggtggaattgctgctggggcagttgggcgagggttcgccttcgatggcgacgatgcgtctgctgccattgactatttggaaataatagatggcctgcttgccgtattcgttggtgacggtggtggaggcgtcatcgttgtaggcgagggagaccttttcggcgccgttggcgtgttcgctggagatggcgcggccttggttgtcgtaggcccaggtggcgaagcggcgattattgttatcctggatgcctgtaagtag

SEQ ID NO: 11529 - DNA, 321 bp, Pseudomonas aeruginosa
ttttatgttcctcgggtcgtcatagaggtactgtgttttcgtgttgtattgcccatctgttcgtgttaccgaagtgagtcgctgttccttgtcgtatgtgtactcaatggatataccccctatctgagcgcgaaggagttgatggttggctccctccgagagaacgagtttgttgccacgttcgtcgctaatcgtaagattagcgcctcgctctacacgatactttcgaccctccttggtcttgagcctggcgagttttccatacgggtcaaactctatagtttcgttgagctccgaggtatagaaaaatcttcctgctag

SEQ ID NO: 11530 - DNA, 249 bp, Pseudomonas aeruginosa
caaagaactggcccgggagaagcgatgtgcggtaagtgcccgatatatttggcgtcccggagaggggtcgaacctccaaccttccccttaggagggggatgctctatccaattgagctaccgggacacgccggacatggcgagcggtgcgccgcgtccgggcggcatgttaacggcagagaaagcgtttgtcatgccactgccaccaaggctgcgcataattttccgcaaccctggaggtgcagcatga

SEQ ID NO: 11531 - DNA, 1221 bp, Pseudomonas aeruginosa
aaccatgtcacgatccgccgtcattcttctgttcgtagtgatcgccagcgcgatcctggcgctgagcctgccgcccgaggccaccctcctcgcctggtgcgcctggggtctgctgggcatttccggcgcatggctgctgtttgcactggtggtaggtcggcgaatccgcttcgatccaagcctggactgatttcgcccgcagcgctttgccgggcgctacagcgtcgctcacagcggcaggcacacgccgtcgcgcgccagttccaccccttcgggcaacgcagcggggtggtccagcagccaggcgtccagcgtatgcccgacgtgagtcaacacggcccgccggggacgcagcgattcgatgcactccaatgcccgcgtgaggtcgttgtggttgcgcggcggctgctcctgcggcggcatcgagcagtccagcaccagcaggtccagcggcgccgcgagcaatcgcgaggcgctgtccgccggcagcccgacggtatcggtgaggtaggccaggcgccgtatcgttccctcctcggaagccccctccagcaagtagccgaaggttggcttcgagtggaccagcggcaacgcggtcgccgccagcgcgccccactggcgccgctcgaaggcgccgaagggctggctgaaatcgaggatgcccggatgcttgtagaggtcggcgaggccctccgggtcggccgggccgtgcaccgggatcaccagaccctggccccagcgcaggtgcagcaggccctgggcgtggtcggcgtggtaatgggtctggaggatgccatcgaggctatggggcgggaagcgctcgcagagatcgaccaggccgctgtcgatcagccaacgctggccggcgcactccagcagcgcgctacagggacggcgacgcaggccggcgtcggcgcgggcgttgcgacaggccgggcaatcgcaaccgtagaccggcacctggcgggcgtcgccggtgccgagcagggtcaggcgcatgcgcggtcgctgccgagacgggccaggagggtgcgtagcgtgtcgtcgagatcaccggagttgtccagttggaacagcgggccctccaggccggcggcgaactcggcgttacgcgccaggcgcgcctcgatttcctcggggctttcccggccgcgcgccagcaggcgctggcgcagcacctcgggtttcaccccgagcaggaccgcgagcagatccggatag

SEQ ID NO: 11532 - DNA, 417 bp, Pseudomonas aeruginosa
ccatcgccaccgcgcgcggcaggtcgtagcggatcgcatcatactcgctgtgctcgccggcgagcagcaaggccgcatgcagcaggctggccggatagtagtcgctggaaaggatatccagcacgccgattcccgccagttgcgccgccgccacgttgcccgagtgggaaccgccgcggaccacgttgggcgcgcccatcagcacctgcaggccgtgctcgtggctggccctggcggcctccacggtggtcgggaactcggcgatggccatgccgtagccggccgactcgcggacatgcgcgagggtcgcgtcgtcatggctggccaccgacaggccgcgtccctggcagacatcgacgatggccgcacgggcggcgtcgctgtagcgctcggagttggctacctgctcgacgatga

SEQ ID NO: 11533 - DNA, 1083 bp, Pseudomonas aeruginosa
agcgtgcgcagcagggtgctcttgccggcgccggagcgtccgtggagcaccaggcattcgccgccggcgacattgaagttgagcccgcgcagcacattgagcactacgccctgttgctggtgcagggtgaaggtcttgctgaggtcgcggacctcgatcaggttgttcatcgctacttctccgggcgcccgtcgcgcggaccggcgccgacgcttcggctcagggttgcaggaccgacgacaccagcaattgcgtgtacggatgctgcgggtcgtcgagaatctggtcggtgagaccggcttccaccacccgcgaacggcgcatgaccatcaggcggtcggcgagcaggcgcgccaccgccaggtcgtgggtgacgatcaccaccgccaggtccagctcgcgcaccaggccgcgcagcaggtcgagcaggcgcgcctgcaccgacacgtcgaggccgccggtgggttcgtccatgaacaccaggcgtggcgccgagaccaggttgcgggcgatctgcagacgctgctgcatgccgccggaaaaggttcgcggcaggtcgtcgatgcgcagcggatcgatctccacctgttccagccagtccagcccggcctggcgcagccgaccgtagtggcgcacgccctgggccatcagccgttcgccgatgttggcgccggcggacacgcccatgcgcaggccgtcgcgcgggttctgctcgacgaagccccactcggtgcgcagcagggtgcgccgctcggcttcgctggcggcgtagaggtccagccagcggtcgccgtcgtcgcggtaggcgaccgtgccggcgtccggcggacagcgcccggagagcaacgagagcagggtcgacttgcccgagccggactcaccgacgatgcccagcacctcgccggggtagagatcgaagtcgacctcctggcagcccttttccggcccgtacaggcgggtcaggccacgcaccgagagcagcggccggtcgcgcgcgtcgaggttcgcatcgatggattcgcagaccgcgttcattgcgcgtcctccccttcttcctggcaggcacgccgctgcgtgcagtaa

SEQ ID NO: 11534 - DNA, 1128 bp, Pseudomonas aeruginosa
ccggtctgctggctcatgtccttgaggaagggttcccagatgctcttgaggttctgcgacgactcggtggagatgatcccgaaattgatcaccggctggtcggcgtgcgccatcccggcaagggagccggcgagcagggcggaagccgcgagcacacgactgaagcgtttcaacatggagagaactcctgggcagggtttggcgggtttttatgcggttcgaatgacgtcaggcgcgcgcgagggtcagttccggctggctctccgccccgcgccgggaacggtcggaaaacagcagcggggtgtccccttcggcgccgtagagttcgttgaggaagccttcggaaaggtgctcgctgctgccgtcgaagaggatccggccgcccttcagggccaccgcgcgcgggcaatagcgcaacgcgtagtcgacctgatgcagggtcaccaccacggtcttgccgtcgtggcggttgatatcggcgaggatgtccatcaccttgcgcgccgactccgggtcgagcgaggcgatcggttcgtcggcgagaatcacctcggccttctgggtcagggcgcgggcgatggccacgcgctgctgctggccgccggaaagggtcgaggcgcgctgcccggcgaaatcggccaggccgacccgtgccagcgcttccagggcctggcgcttctgctcggcgctgaacagccccagcgaaccgcgccagcgcggcatgcgaccgaggaagccgagcaggacgttgtccagcacgctgaggcggttgaccaggttgaactgctggaagatgtagccgatgtcggcgcgcaggcgacgcacttcgccgctcaggcggccggacgcctggaggcggcgacccagcacgtcgatgctgccgccgttgtcgcggtcgcagcgggcaagcccggcgacgtgacgcaggagcgtggatttgccggagccggatgcaccgatcaacgccaccatctcgcccgcctggatctccagcctcaggttgaaaagcgcctgcttgcgggcaaaggtcttgttcaggctgtcgacacggatcaccgcgctcatcgttctccctccaatcggttgcacgaagacgccagcggcgccatctggtgtagaccaagatag

SEQ ID NO: 11535 - DNA, 372 bp, Pseudomonas aeruginosa
acgcttcctcggcaccgcttttccctgactctacaggttcaatgtatgcgcccactgaaacaggcaactcctacctactccagccgtaccgctgacaaattcgtcgttcgtctgcctgagggcatgcgtgagcagatcgcagaagtcgctcgcagccatcaccgcagcatgaactccgagatcatcgcccgactcgagcagagcctgctccaggaaggggcgctgcaagacaatctcggtgttcgcctggacagcccggaactcagcctgcacgagcgcgagctgctgcagcgtttccgccagctgacccaccgtcagcagaacgcgctggtcgccctgatcgcacacgatgcggagctggcccaggcctga

SEQ ID NO: 11536 - DNA, 405 bp, Pseudomonas aeruginosa
cggtggcgttatccctccaacgccacgagggagagccgaatgagctatcgcctggccgccgatgccctggtctggctgcacctgggcttcatcctgttcgtcctgttcggcggcctgctgccgttgcgctggccacgcctggcctggctgcacctgccggcggtggcctggggctgcgcggtggagtttctcggcctgccctgtccgctgaccccgctggagaattgtttgcgccgggccgccggggacgccggctacagcggcggcttcgtcgagcactacctgttgccgctgatctatcccgccggcctgaccccggcggtgcagtggatccttggcgccatcgttctgctggtcaacctgatcgcctacctgtatctgtggcatcgccgcagtagccgctga

SEQ ID NO: 11537 - DNA, 453 bp, Pseudomonas aeruginosa
atttataaaattattgtatacaaaaaaggaagcaaacccatgtccgaccgccctgcccgcccctcccgcctcaacggcctgcgtcacctcgccctgctggtgcccaacctggaagaatgcgagcgcttctatgtcgacgtactgggcatggaagtgctgaaccgcgccaacgaagacctggtgtatctcacctgcggcaacgacaacctttcccttggccgcgcccacgctgccagcaacggcctgcagaccatggatcactacggcttcgtcgtcgacagcgtggaggaactggaggcctggtaccgttacctgaaagcgctgggcgtgaccctgctcgaccaacccttcgaccacggcgacggcgcgcgcagcttccacctgctcgacccggcgggcaacaaggtgcagccgctgtaccatccagcggtatccgggcaacgcctggcctga

SEQ ID NO: 11538 - DNA, 510 bp, Pseudomonas aeruginosa
agccaggcgaatacgccttcgtcgtgctcggcgacggcgagtattccttcaagggttccggctacgtgcgcggtggcatcttcgatcgggtccaactgcgccagttcggcgacatcatcagcttccgcgacctcgactaccagcgcctgtcggacgtctacgccgaaggcatgccggagttccgcgagatggcgatcttcgtcgcccgcgccagccagcgtttcgatccgggctcgccctggaccctggagttgctcgtgcggcgccagaccggcccggtggcgggggtattcaccagcttcgagctggcctgccagacgcccgaggaatacctggagcggccgcagccaacggccgaggaactggccgccctggaagaggctgcccggccgctgtggctgcgggtctggtaccagaagagtttccaggtcggggtcctctgtaccgccctcgtcctgctcctggcgatcctcttcctccaggaccgcctggtgcgacggccgcgcctga

SEQ ID NO: 11539 - DNA, 609 bp, Pseudomonas aeruginosa
ccttcgtccacgcgctgttcgaaggcttccgctgggagctgttcctcagcgacccgctgctgttcatcctctggacattcaccgcagccagcctgctgctctggggccgcggcgtgttctgcggctggctgtgcccgttcggtgcgctacaggaactgctcaacgaactcgcgcgcaagctccgcgtgccgcagttccaggtgccgttcgccgtgcacgagcggctctgggcgatcaagtacatcatcctgctggtgctcttcggtctctccctggaatccctggcgctggccgagcaggccgcggaggtggagccgttcaagaccaccatcaccctcggcttcgaccgccagtggtggttcgtcgcctacgccgtcgcgctgctggtggtcaacctgttcacccgcaaggtctattgccgctacctctgcccgctgggcgcggccctggcgatcccggccaaggcgcgcctgttcgactggctcaagcgccgcgcggaatgcggcaggccctgccagctctgtgcccgcgaatgcgagatccaggcgatccatcccgacggccgcatcgaggccaacgaatgccactactgcctcgactgccagatga

SEQ ID NO: 11540 - DNA, 1428 bp, Pseudomonas aeruginosa
aatgcgaccgcatcgtcaccattcccaacgtccaggcgatccacggcctgcgcctgcaaaaggtgccgcatacccgctacgtgttctggcaacgccgagttcatcatcccccatcccaacgacggctcgaccttcgacctgtccggcgacaacgccttcaccctgtacaacgccatcgacgccgagaccatggaagtggcctggcaggtgatcgtcgacggcaacctcgacaacaccgacatggactacagcggcaggttcgccgcctccacctgctacaactcggagaaggccgtcgacctcggcggcatgatgcgcaacgagcgcgactgggtggtggtgttcgacatcccgcgcatcgaggccgagatcaaggccaggcgcttcgtcaccctcggcgactcgaaggtgccggtggtcgacggccggcgcaaggacggcaaggacagcccggtgacccgctacatcccggtaccgaagaacccccacgggctgaacacctcgccggacggcaagtacttcatcgccaacggcaagctctcgccgacctgcaccatgatcgccatcgagcgcctcggcgacctgttcgccggcaagctggccgacccgcgcgacgtggtggtgggcgagccggaactgggcctcggcccgctgcacaccaccttcgatggccgaggcaacgcctataccacgctgttcatcgacagccagttggtgaagtggaacctggccgacgcggtgcgcgcctacaagggcgtgaaggtcgactacatccgccagaaactcgacgtgcagtaccagccggggcacaaccacgccaccctgtgcgagaccagcgaagccgacggcaagtggatcgtggtgctcagcaagttctccaaggaccgcttcctgcccaccggtccgctgcacccggagaacgaccagttgatcgacatttccggcgaggaaatgaagctggtccacgacggcccgaccttcgccgaaccgcacgattgcatcctcgcccgccgcgaccagatcaagacccgcaagatctgggaccgcaaggacccgttcttcgccgagacggtcaagcgcgcggaaaaggacggcatcgacctgatgaaggacaacaaggtcatccgcgagggcaacaaggtccgcgtctacatggtctcgatggcgccctccttcggcctcaccgagttcaaggtgaagcagggcgacgaagtcaccgtgaccatcaccaacctcgacgagatcgaggacgtgacccacggcttcgtcatggtcaaccacggcgtctgcatggagatcagcccgcaacagacctcgtcgatcaccttcgtcgccgataagcccggggtgcactggtactactgcagctggttctgccacgccctgcacatggaaatgtgcgggcggatgctggtggaaaaggcttga

SEQ ID NO: 11541 - DNA, 723 bp, Pseudomonas aeruginosa
tgcggatgcccgccgcggagccgaggccgtgagcctggtcgagatcgacggcgcgaccctgcgctacggcgccctcaccgccctgagcgggctcgacctgcgcctggagcccggcgaggtgctcggcctgctcggccacaacggcgccggcaagaccaccaccatcaagctggtcctcggcctgctggcccccagcgaaggccgcgtgcgggtcctcggccacgatgcgaggagcctggaggcgcgccgccagctcggctacctgccggagaacgtgaccttctacccgcagctcagcggcgcggaaaccctgcgccacttcgcccgcctcaagggcgtggcgccggccgaagccgcgcgcctgctggaacaggtcggcctcggccatgcagccaggcggcgcctgaaaacctactcgaagggcatgcgccagcgcctcggcctggcccaggcgctgctcggcgaaccgcgcctgctgctgctcgacgaaccgacggtgggcctcgacccgctggccaccgtcgagctctaccaattgctcgaccgcctgcgcggccagggcaccgggatcgtcctttgctcccatgtgctgcccggcgtcgagacgcacatcgaccgcgccgcgattctcgccggcggccgcctgcaagtggccggcagcctcgccgaattgcgccgcaaggcggctctgccgacccgcgtgcgcctggccagcccgcataa

SEQ ID NO: 11542 - DNA, 1038 bp, Pseudomonas aeruginosa
cccgcagtggctcgaacgctggcaccgggccggcctggcggcgcggagactggacgaccagcgcatcgaggtactgctggacgatgccgagcgcgacggcgtgctggaagcgctgctggccgcgtgcgagttcgacctggaaatcctgccgccgtcgctggaggacctctatcgccaccacatgtcccccgcccccgccggagccacgccatgcccgtagtttggaccatcgcccgcaaggaactggccgacggcctgcgcaatcgctggctgctggcgatcagcctgctgttcgccctgctctcggtgggcatcgcctggttcggcgccgccgcggccggccaggtcggcttcacctcggtgccggcgacggtcgccagcctgaccagcctggccaccttcctgatgccgctgatcgccctgctgctggcctacgacgccatcgtcggcgaggaggaaggcggcaccctgctgctgctcctgacctacccgctggggcgcggccagttgctgctcggcaagttcctcggtcacggcctgatcctcgccctggccaccctgatcggcttcggcagcgcggcgctggcgatcctcgcgctggtgccggaggtcgaggcggccatcctgctgggcgccttcggccgcttcatgggttcctcgctgctgctcggctgcgtgttcctcgccctggcctacgccctgagcagccgcgccagcgagaaatccagcgccgccgggcaggcgctcggcctgtggttcttcttcgtcctgctgttcgacctggccctgctggcgatcctggtcctcagccagggtcacctgagcccgcggctgctgccctggctgttgctgctcaacccgaccgacctctaccggctgatcaacctgtccggcttcgacgcagccgccgccggcggggtggttcccctggccagcgacctgccggtgtccgccagcgccctctggctggccctggccctctgggccggcgctgccctggcgctggcccacggcctgttccgccgccgccccatctga

SEQ ID NO: 11543 - DNA, 1407 bp, Pseudomonas aeruginosa
ctatctgatggcagcggcgacctgcgcgcgtccttcgccggcaccgaaataggcagccagcaccgccaggtcgcggtcttccagcacccccgccagctggcgcaggcgcagccaggcgttgaggtaggcgtagcgcgcttccgccaggtcgcggcgggcgccgttgaactgctgttcggcgtccagcacgtcgcgattgacccgctccccgccggcgacgctgcgccgcgtcgctgtcacctgttcgcgcgccgccgccaccgccatctcgtaggcacgcaccttggccaggctgctggcggtcaggtcgaactggctgtgcaggtcattgatcacactggccacctgggcatccagctcggcctgggcctgggcgtacttgtcgccggcctggcgggtcgctgccgacacccgcccgccctcgaacagcggcaggctgagacgcaggccgacactgtcggtgtcgtatttctgctcgtaggtgctttccgaagccgagtgcgtcttgctgctgctggcgtagaggctgagcctgggcaagtggccggcacgattgcgctccacctcgtaggctgccgcctccagcgcatggcgctgggcgcccagctcggcgctgcgttgcagggccacctggcgccagccttcgaaggtcgccggttgcaggcgcagcgccgggaagcgctcgatgggcgcggccagttcgcgatcctccagtgcctgcccgagcatcgcctccagcgtacgccgcgccgccgccgcgcgatcgctggcggcgatctcctcggcgcgggtcaggctcagccgggcgcgggtctccagcaggtcggtgcgggtgccctcgccttcctcgaaggcacgctggttgaacgccagctgggtttccagggcgcgccgctgggcctcggccaggaccacctgctcgcgggcgaacagggtttcgctgtaggcggcgaacaggcgcaccgccagttcctggctgcgcccgcggaactgttcgtcggcgaacagcgcctgggcctcgccctggcggtagcgcgcgtaggcctcgtagtcgaacagcggctgctccaggctgagggtcgaggcgtagctgcgatagtcgcgctcgacgcgggcgtcgccctggctgacggtggagtcgttgcgcgccttgttgtagtcgtagcgcaggctcggcagcaggccggcacggccgatggcgcggttttcgctgccagcgcggcgctcgtggagcgccgcctggaaggtcgggtcgtggcgcaccgccagttggtaggcgtccagcaggcccagcgcctgggccgaagaggccgaaagcagcgcggaggacagcaggcaggctcgcaggcgattcattcttcccccagcgccaggtgggtacggtcggccagcggcttgaacaggtag

SEQ ID NO: 11544 - DNA, 852 bp, Pseudomonas aeruginosa
ccctcgctggccagttggcgcaggccgcgcaactgttcctcgagggcggcgcgctgctgctccttgctgcgcagcgcggcttgcaggccgtccagttgcgcctggctgccggcgaccgtctcggcgagaccatcgagttccaggcgcagcgcccgccgacggctgtcgtgcaactgccgctgctgttccagcagggtcggcaggcgcgggtcgtccagcgccagcagctcggcgggaaactcgatccgcgccttttcatcgcgctcggcgctcagccgcgccagactcgccagcgccgccaggtactgggcgaacaggccatcggcctgggcccgggcctgggtagcgtccatctccagcagcacctgtcctgcctccacccgctcgccttcgtgcacgcggatgtgcctgaccaggccgccggtagggtgctgcacggccttgcggctaccggccaccatcaccgtgccggagaccccgacacccttgtccagcggggccaacccggcccacaggagaaagccgacgaagccgagcagcaccagcccccagccgagccgggaaaaacgcttctcgtccagttccagcgccgcgccgccggcgccgacttcgcgcaaccgcgcctgcccgctcatcgcgccgctcctcccggcacaccgccgaccggcatccccggtcccggccggtagccgaaaccgaacgccggcgtcggccgtgtcggcgccggggccgcagcggccggcggcgaggcgctggcaagcacctcggcggtcgcgccgaaacgctgcaggcgcccgccatgcagcaacaacagcttgtcggtcagcgccagcaccgccggcttgtgggtga

SEQ ID NO: 11545 - DNA, 714 bp, Pseudomonas aeruginosa
ccagcaccaggctgctgccgtgccggcgcatcgccgcgatggcctcggccagggccgcctcacccgcctcgtcgaggctggcattgggttcgtcgagcacgatcagcgccggtcgcccgtacagcgcgcgggccaggccgatgcgctggcgctggccgccggagagtccggcgccgccgtcgccaaggcgcgtgtcgtagccctgcggcaggcgcagcaccaggtcgtgcacgccggccaggcgcgccgccgccaccaccttctcggcatccacctcggcgaagcgcgcgatgttctcggcgatgctgccggcgaacagttgcacgtcctgggccaggtagccgatgtgcggccccagtgccgccgcgctccagtgccgcaggtcggcgccgtccaggcgcaccgcgccggacagcggctgccaggcgcccaccagcaagcgcgccagggtcgacttgccggaaccggacggcccgatcacgccgagcgcttcgccaggttccagggcgaaaccgaggtcctgcaacaatgcctgctcgcgtcccggcgcggccgcgcagagccgctcgacgcgcaacgcgccgcgcggcgccggtagcggcatgcccagggcggccggcggattctcctcgagcagccgcgccagtcgctggtaggcctgccgcgcgccgctccactggcgccagaccgcgatcaactggtcgatggggctga

SEQ ID NO: 11546 - DNA, 510 bp, Pseudomonas aeruginosa
acagcgcgacgctgcgcagcgccgggcggaagcggccgagggtggcgaggatttcattgcgcggcgaggccggccggagcttcatcggagtcgggtcctgtgggtgtccgggccgcgagcgggcccggaggacattgcggcagtctccacttgccgggcacggccggcggaggaacaatccgggggccgccgtcgccacgggtgcgaggcgcagcgacggcggttcgtgcgccggagaggagcgccaactcctctccggcctttagcgcaagcagtccacgaacgctatcgtggacagttgctcaggccgccagggccaggtcgtgcggcagttcctgcacgccgaccacgccgacctccgccgctgccgcagccggggtggcatgggcgacgccggccgcggccaactggtcgaaggtggagttgatcgacaggctcgggtcgaccgctttcagcagcgcgtcaatctgcccctgcagggcgctgctgtcgccgctcatcaggccgtaa

SEQ ID NO: 11547 - DNA, 2640 bp, Pseudomonas aeruginosa
atgccggagcgcacgaatgcccgctccggttttgcccttcactgggcaaaacgggggtcagaactggtattcgagggtgccttgcagggtccgcccgcgaccgagggtgaaggccagcacgtcgcccagcggcaccaggtaggcgcggtcggtgacgttctccatggccaggcgcagggtcagttcgtcgctcacccggtagctgccgtacaggtcgtagacggtgtattccttccagtccgccgggtacacgccggcctgcgacaccgtggcgccgccagccaccgagtagccttcgctgtagcgggcacgggcgccgacgtccagcctgcggtcgaagaagcgcatgcccagggtcagcgagccgcggtccatcggcatgtgttcggcggagccgagcaccgcgctgcaatgggtggcggcgttggcctgctcgtccggccgcatgtcgatcaccggcgggcggcgaccgctgcccttcaccgtctgggtgacgccgccgagccaggcggtcttcgaacagaagtcgttgctgccgatcatgtgcgtgtaggagagctgcccgtaggccagcccggcatcgtagtcgagctggtactcgacgccacggaagcgcgtgctgtcgaggttgttgacgtaggcgctgttgccgatcccggccatgccgtagcccggcggctgcatgcccatgcccatgaagatgaagtcgtcgacccgggtgtcgaagtaggcgaccttcaggcccaggcggtcgtcgctgaaccagaggttctccttcagcacgttgaaaccgacttcccaggccttcgagcgctccggactgaggaacgggttggggtacatgttttccgcgccgccgccgtgggggcggccggtgatcaggctctcggtcaccgccggcgggcgccagcccttgccgtaggtggcgaacaactgcaaccagtcgacgccgggcttgaccgacaggccgaaggtcggcgagaagcgcccctcctcgcggtcgacggcgtattgcagcggcatgtcggtctgccgggtggtgccaaggatgaaggtgcgcgcgttgaagccggtgtcgccgcgcaggcggtagcggtcgtaacgcagcccggcgttgaggttgagccagtcgtcgtagtcgtagtcgagacgggcgaacaggctaccgagggcgcggtcgcccttgggggtcatgccttcggccgcagggaagccgaccgccgaggtgctcgcccgcggctggctggagtccggccgcaccttgtcgtagaagaactccaggccatagttggcgcgcagcgtggagagatcgtcgagagcgaaggtcgaggtgttctgcgcctgcgcgccgtaggtgtcggtctggtaggtgatcgagtagccgggggtgataccgcgttgcagggtctgctggcggttgcggttgtcgacgtagtagagcttggccttgaagtccaccaacgggttgtccggcgcgtagccgtagtcgatggcgaagttctgcgcacgcacgtcgctgctgccgagcttttcccagagcgcctggttctcggtgttgagcatgttggcgtcgtcgtaggacacctgggtggtcaggtagctgaactgcaggcgctggtcctgcggcagggcgacgccaagcttggccagtcgcgagcgcatcacgtagccggagtaggccaccggcgaatgcttgacccgctgcccggcctcgggattgaaccaggcgccggtgcgcagctcgccaatgctgcccttggtccccgggtcgtagtcgcccaggtggcgctcgctggcggcgaccagcatgtcccagacctcggtgccgatggcgaaggccgcgctgccgatgaagtgggtgccattggcgtcgccgcccaggccgctggtgaggcgcacccggccaccgacctgcttgcccggcctgaccaggtcgcgggcctccacggtgcggaagttggcgatcccgccgatcaccccggcgccgcccatggccgagctggcgcccttgtcgatgaccacctcgctgagcagctcgggatcgacgtagagcgtcccgttgcgctgctggtggccgctctgctggtagttctggcgcatgccgtcgaccgacatgttgacccgcccgtagtcctggatgccacggatgttcaccgacaggccggggtcctgctggctcaccgaggagtacaccccgggggtttcctcgagcatgtcggcggcatgccgcggcgggttgcgctcgatctgctcgcggccgatcacgctgaccgaatgcggcgtctggtagacccagtcgtccggacgcgcggcggaaatcaccgagggcgacatctgcaccaggtcgtcctggctgacgcggatcaggctcaattggtccttgccggagaagcggtattccaccgggctgccctggagcatctggctcaggccgtcggccagcacgtattcgccgtgcaccgccgcgctgccgagaccggcgaaacgctggctgtcgaagaacacctggaccccggcctgctcggcgaatcgcagcagggcgcggttcaccggttgtgccgggatgtccagccggacccggcgcagcgcggtctgctgctggctcgccgagtccgccccgtcttgcgcatgcagcggtag

SEQ ID NO: 11548 - DNA, 267 bp, Pseudomonas aeruginosa
atggccgtcgaagtggtgtaccgcagcagccgggatcaggagcgtttgttcatggacaaggctgaagccgatcgttacgacaagatgctggagctggcggaaacgctggccgaggtgctgcagaaggcggtgccgtcgctgaaggaggaacaggtggaagaactcggcatcttcatggcgaagaaccgcgacgccttcgcccgcgccttcaagaaccagccggacgccctcaacgaactgttcgaggaaaacgccgcggacgaatga

SEQ ID NO: 11549 - DNA, 651 bp, Pseudomonas aeruginosa
tcgctcgctacgccgagggtcattacctcgcccaccgcctgctcgaaggcaacgagatgggcgcggacgagggcgaacggctcgaccttccgcgacaggttcgcctgctcttcggagccctgccgctggacggcctgcccgacgccgagcgcgagcgtctccaggcgcagcgccaggccctcggcctgtgcgaccggcgcgccagcgtcagccgctaccgcgtggccggcaccgaggtctatcgcctgcgcggcagccaggccggcaagccctaccacgcgctctacctgctcgacggtccccaggtgcactacctcgacagctccggcagcgacgccttcgtcgaacaactgctcgccagcctgcgacgccgctgagtccgcgcggcgcttgtccgacccgcgcccggcttgccggaaactggcgcttgccgtacaacgcccggcagccccatcgaccaggaaggtcccatgcccgctctccccgcctcccccgtccgctcccgacgctggcgcctggaccggcgcagcctgctgctggcactgctgctgttcggcctgctggtcctgctcgccaccctgggccggcattggggctggatacgcagcttcggcggcgacctgctggcgttggtctggctctactacctga

SEQ ID NO: 11550 - DNA, 432 bp, Pseudomonas aeruginosa
ggcgcagggatgtccaccagcgccttggcggtttccaccgaaaccaggcgctggtcggcgcgcacgctgtcgccggccttgacgtgccattcgacgatttccgcttcctgcaggccctcgcccaggtcgggcagcttgaagtgcttcatggtcgtctccccttggctcaggcgtagccgagcacggtgtcgcaggccgccaggatgtcctccacggcgggcatgtacagcgcttccaggcggtacagcggcggcgggatatcggccgcggcgacccgctggatcggcgcccgcaggtcgaacaggacacgctcgtagaggctcgcggcgatttccccgccgaggccgccactcttcggcgcctcatggacgatcacgcagcgaccggtcttgcgcaccgaggcttcgagggtgtcgaggtcgagcggcttga

SEQ ID NO: 11551 - DNA, 990 bp, Pseudomonas aeruginosa
gcaggcgtcggcgaaacgcccgcaaggccgacgaccaggcggcggcgctcgccgagccgggtactggacgaagcttcggcggacggttacaaccttggggtccgcccgctcgaaaccggccccggcgtgctccgaacggcccgtccgcagcgatccaggcgcaccaggaggaaagccatggacccgcgtcaagcctgcctcgattgtctcgcccaggaaccgccagcgctgttcgaggcggccctgtggatcgccgcggagcacctcccggcgtattcgcccgcccacaccctgcgcgaactcgacgaactcgtccggcagatcggcgccagcctggacgaccgcgcctcggccagcgagcgcgcccaggggttgctgcggcgaatgagcgaacagggtttctgcgaggacgacgacttccccctgcaaccgcgctcggccctgctcccgctggtgttgcagcggcgccagggacagccgttgtcgctggcgctggtggccatggaactggcgcggcggctggacattccgctggtcggagtgaacttcccgggacgcttcctgctgcgcgtgccgcaggccgaccatctgctcgacccggccaccggacggcgcctctatcccaccgactgccgcgaactgctgctgcgcctgcaggggccgaagagcgaactgcaggccgcctacctgaagcaggcctctcccggggaaatcctccagcgtctgtcgcgcaacctgcgacaactgcacagcgccgccggcgagccgctggccgcgctgaaggatgcccagcgggtgatcgaactcggcccggtgggcgccgccgaccacgaggcccgcgccggcctctatcggcaactggattgcccgcaggcggaacgctacgacctggaacgcgcgctcttgctcagcgacgatcccaccgagcaactgcgcctcggccagcgcctgggcgaactcgccccgccgaccggccgcgccctgcactga

SEQ ID NO: 11552 - DNA, 429 bp, Pseudomonas aeruginosa
gcccctcctcttcttcccccggcagggcggcgaacagttgcggctggcgatcccgcagtcgccgctgcggcagttgcaggcctagccgctccgccagctccaggccgctgcgcagggtctgctgggcctggggcaattgtccggagaggaactggcactcggcgatacccatgcgcacttcgcaaagcagcgtctgccgcccctgcgcctcgagaatggcgagcagcccgcgcagccgcgcttcggcggcggctgcctcgccgctgtagagttcggccagtgccaattggtgctctacccgcgcttccagctccggttcggagggcggcgacaggcgcgcccgtcccggctggaagtaggcgcggacccgcagcaggatctcccgcgcctgcgccggccgtccctgctgcagggtcagggcggagctga

SEQ ID NO: 11553 - DNA, 756 bp, Pseudomonas aeruginosa
acgccgcgtccaggtcgccctgcccggcctccagcaaggccagtcccaggtagccgtagagcgcccagggatcgagattctcccgtgcctgctccagccccagccgataccagtgcccggcctcgacctcgcggccctgctgcaggcacaggcgcgcgcggcgcagggcgatccggccgagcatcgggctgccctgctggccgaggtcctccaggtagcgctgggcgcgatcgaggacgccttccgcgcgcagcagttcgccgcgctgctccagccactgcgcccgctccagttcgatcagcgcctcgaagatcaggctgtcgtgctcgcgcgccaggcgcaaggcatcgcggccgatcaaccgcgcctggtccatccgcccctcgattatcgccagttgcatcagcgccgagcggcagatcagtccctgcgaccaggcgtcctccggcagttgctccagcgcctcgcgcaggtagtcggcggcgccgcgctcgccgcggcagtgcaggaggatcccgaacaagccctgccattgcgccagcagcacccgctggcgggacgccgagggcatcggcaggaagcgcgccaactggccgatgcagtcctcggcttcggccaggcgtccggcgtagagcagcgtccaggcattcaggatcaccaggcgcggcgtgctggccagcagcgccgccggcagttcgtcgcgcagggccaggaccatgccgatgttgtggccgtgcagcaattgctcctcggtga

SEQ ID NO: 11554 - DNA, 1086 bp, Pseudomonas aeruginosa
gcttctgcaacaatccggcggcggtttccggttcgtcggcggccagcgcctggtcgaccgcctcgcgggtctcgccgtgttcggcgaaccattcgcaggcttcccggtggaagtcccgctgcgggcgctgcggcgcttcgcgccaggcctcgcggatcgccggtggcaggctgtagcgctggttcgcatcggccagcagggggaagccccgcgccaacaggtcgtccagcccgtggggcagctcctcgaacagccggcggaacagctccggaccgacttgcggcagccaggccagggcacgcgcggcgtcggccagcggcggcggcagctcgtcgagcaactcgtgctggaggtattcctgcaacaacggtccggccgtctcttcgccgaccagcaggcgcaagcgcaacgcggcgcaccaaccgccgctgcgttccagcagcgccccggtcgcagcggcatcggcgctgcgaccgtgcaggcggagcagttcggcgacctcgtcggcatcgaacgccagcaggccgccgtcgacctccagcaactccccttccagcagcaaccgcgccaggttgcactgcggccgccgccggctcgccagccaccagcccacccgtggcgaggccgcgctcaacaagcaatcgaggcaggcgtcaaaggcggggtcggggtgccgtgggtaatcgtcgagcagcagccacagcgcggatgcgttgcgcaaccgccggcacagctgcgcttcgtcgctttcctcgggcaagccgagggcgccggccaggcggcggcggaaggtcgcggggtccagcgcttccccgcccagcgccagccagaccacctgcacgccaggcggcgcccgccgcgcgcattctccgaggaggacggtcttgccgctgccagcgggcgcgcagagcagtcgcaggcggcattcgccgcgcagcagcggctggtgcaaacggggccgcggcaggtgctgcggcggcagccgcggcaaggcggcgggcagctcggtcggctcggtcatggcagtgctcttgttctgtcgaagcgccttgccgggagcctagaccgcgcctgccccgctgctga

SEQ ID NO: 11555 - DNA, 1536 bp, Pseudomonas aeruginosa
cgcacgagcgcgtcggcacaagccgacgcgctcgtcgcgactggccgggactcagcgtaccccggcgttgcgcagggcggccggcgtgtagtcggcggacgaggccttgaagccgaactcgtagccgcgcttctcctcgttgttcatgcccagcgccaggtagcgaccggcgatcacgtcgtagagcgcctccagggtgtagccggcgaccttctggtcgtagtggtactgcgcgtggccctcgccgacccgccagagctggccgcgaccgtcgtagtggtcgaccagggcgatctgccagctgtcctcgtcgatgtacatgtggcgcttggcgtagatgtgccgctcgcccggcttcaccgtgccgaccacttcccacacccggtgcagctcgtagcgggtcaggtcctggttgatgtgcccggccttgatgatgtcgccgtacttcagggtcgggtcgttgagcttgtaggcgttgtaggggatgtacatctcgagcttgccgaccagcttccagtcgtagcggtccggggcgccggagaacatgtcgaagttatccgaggtgcgcaggccgtcggcggcggtgcccgggccatcgtaggccacctgcggggcgcgccgcacgcggcgctggccggcgttgtagacccaggccaggcgcggctccttgacctggtcgagggtctcgtggaccagcagcacgttgcccgccaggcgcgccggcgcggtcacctgctgcttgaagaaggtgaggatgttggccgccttgctctggtcgaggtcgggcatgttctgcgggaatgccaccgactcctcgaagcggatcggcgtgaagctgccgttggtctgcggggtggcctggacgatggtgcgcttgaggttgccgccgcggtagcgggtgatgtggttccagagcacttcgacaccgttcttcgggatcgggaaggcgtagtagcggctcttctcgaaattcgacaggccgttgccgtcgttgatcggctgcacgttcagcgcgctctgcctgaccgcctcgtcgatctcggccggcagggccaccgtgcgatgggtcttgtacaccgggatccggtaggtttccgggtagcgcttgaacatcgccaactggccgtcggagagcttgtccttgtattgctcgacgttctgcgcggtgatggtgaacagcggcttctcgtcggcaaagggatcggaaaggaagcccttgccatcgaccttgccggcgctggccgcgaggccgccggtccaggccgggatgctgccgtcggcgttgccttccttctgcgcgccgatgggggtcaggctgctgccgagcttggcggcctcgtcgggcgaaaccgccgccgtcaccgaaccggccagcaggctgagggccagcgccccggaggacaggagtcgtgctgttttcatgcgtcgttatccttgttcgtatccgcgaaagcggccgccccgaggggcggcggacctcagaagttcaccccgaagctcaccgcgaggaagtcgcggtcgttgatcgggttgtag

SEQ ID NO: 11556 - DNA, 1548 bp, Pseudomonas aeruginosa
cagggtcgaggtgggtacaccctacccagcggcccgaacggcggtaagcgcaccaaggaggtattccggctgtcgcccgaaagagtgaacaggggccctggaaagcgcctcggcgaacgccatatgcaggatggatacgccgtcatccagtgcatggatgacagcgcggcactgttccgccggcggcggcgatggcatccttcgctgcatgcagcccgaacagaccattcccgccgaccgcgatctcgccgacgccacccgcgagacggtcatgcgttatcacctcagctggaagcaccgcgacatcgacgcggtgatggcgctctatcatcccgaggtcgaatacaacgacttcttccagaaccgccggatgcgcctggccgatctccgcgagtacgtcgaggcgaccatgcccaagggccccgacgagtcgctggagcacaccgaccgtatccgcttcgacggcgataccgccttcatccagtaccgcctgcgggtgaccctcagcggccgcctggcttcgttccgcgccagcgaggcgatcaccgtgcgcgacggcctgatctggcgcatcaacgaatacgcctcgctggtccacgaaagcggcggcggagcccaggccggcggcgacggccggccgccggccagccgcctggggctttcggccaagcagctgagcctgctggcacgcgacctggagcactacttccagcaggcccagccctatctcgatccggacctggacctgacccaggtggccaatgccaccggctatacgcgcaaccagatttcctacctgctcaaccaggtgctcggcctgagcttctaccagtacgtcaaccagacccgcctgcaacacctgctcggccagctttccggcgagctgcccggacgggtcgacgaactggccttcgccgccggcttcaattcgctgtcggccttctaccgctgcttccgccagcacaccggccagtctccgcgcgaatacctgaagcgcctgtcgtcgcgccgctgagatttcccagcggacccgcgcgcacgacaggcgcacggcatcttcctactctcgccgcattcccccttccctctcgctatggagccctctatgtcggcctggcgccacctcagcctgtggatgaatcaactggacgatccgctcgaagcgcgcccgtccctggaagaatccctcgaggtcgacgtggccatcgtcggcgccggctacaccggcctctggaccgcctattacctgaagcgccgggcgccgcagttgcgcgtcgccatcgtcgaggcagaaaccgccggcttcggcgcctcggggcgcaacggcggctggctgatgggcaacctgctcggcgaggacggcctgctcgccggcttgccgccggagcggcgccgggccggctacgacctgctgcacgggattcccgacgaagtcgcgcgggtgctgcaagaggaaggcatcgactgcgactaccgcaagggcggcgtgctctactgcgcggcgcgctacccggaacaggaacgccgcctgcgcgcctatctgcatga

SEQ ID NO: 11557 - DNA, 1125 bp, Pseudomonas aeruginosa
tcatccaccgctagcccgggcggcgcgacggcgtcactcgaagcgcccgtggcgcccctcgccgtccttgaagcgctgcgcgccctccagggtctcgccgctctcgatcaccgccagcccgccctggaattcgttggccagggccacgtcgaaggacagttcccactgcgcatatacgctggcgcggtcggcgagcatgcaggtctgcgggaaggcggcgagttccgccgccagctcctcggcctcggctcgcgccgaaccgctcggcaccacccggttggccaggccgatctgcaacgcttcgtcggccttcaccggacgcccggtgaggatcaggtcgagcgcccggccctgcccgacgatccgcggcaggcgcacgctgccgccatcgatcagcggcaccccgaaacgccggcagaacactccgcagatggcgtcctcggccatcacccgcaggtcggcgagcagcgccagctccagcccgccggccaccgcatagccttcgatggcggcgatcagcggcttgccgagctgcatgcggctcggccccatcggtccgtcgccctccgcctccaggcgattgcgccgctcgccatcctcggccaccgccgccaggtcggcgccggcgcagaaattgccgccgctgccggtgagtaccgcgacccgcgccgtatcgtccgcttcgaactcgcgcagggcgtcggccagggcctgggcggtcggccggtccaccgcattgcgccgctcagggcgagcgatgaccagggtggtgaccgggccgttgcgttcgacgatgacactcatgacagactccctgcggaaaaagcgaaaaaagacaccggccggatggcagaagaccggcgtcagccggtcttcaccttagtccttttgccgcggccgcgccgcatccgccgggcgtctcagagcgcgtgcttctgcaggttggccatcatttcacggagcgcctcgacgttgtccgccgggtgcgcggcgttctcgaagtcgcagatctgctgccagtgcgcggccacgtcctcggcgtcgaagccggccttcggatcgaagccgaagcccaggctgcgttcccagcgtaccttgccgatccagccaccgccgacctcatag

SEQ ID NO: 11558 - DNA, 378 bp, Pseudomonas aeruginosa
accaggtcccagtcggcgtcctccatcttgtggaaggtcttgtcacgcaggatgccggcattgttgaccaccacgtcgacgcgaccgaaggcgtccagcgcgttctccacgatcctgccgccgtccgtgaccgagtcgtggttggccaccgcggtgccgccggcggcacggatctccgccactaccttgtccgccgccgaggcactggcgccttcgccatgggtgctgccgccgaggtcgttgaccaccacccgggcgccatgcttcgcgaacagcagggcgtgggcgcggccaaggccgccgccggctccggtgacgatcacgacttggtcgtcgaaacgcagggcatcgctcatgttcgggactccagggcagtag

SEQ ID NO: 11559 - DNA, 987 bp, Pseudomonas aeruginosa
agatcaggtcgtcccaaccgtgcagggcgaccagccggtagcaggcagcgagatcgacgcgggtctgccattcggcggcggagacctgggcttgcacatcggcgggcagggagtgaacggcggtcacggcggcatcctcttttgtcgttatcggatgcccgcagtctagccccgccctcctccggcgactgtcgccgggcttacactcgcgcgccggctgaatggcggaggattcagccggcctatgcgcgcaggctacaggcagtgggcgaccaggggcgcgaccagcaggttgaacagcccggtgagaaccatcagcagaccggccgccgaaccttcctcgccgccgaactcgtaggcccgactggtgccggcgccgtgcgcgccgacgccgaacagcgcgccgcgggccagcggcgtgcgcaagcgcaggacgcgcagcagggtgccgccgatcaccgcgccgaacaccccggtgatcatcacgaaggcggcggtcagttccggcacgccacccaggtcgtgggacatctccatggcgaacggcgtggtgatcgagcgcggcagcaacgacagcgtgacctggccgtccagcgccagggcctgggccagcgcccaggagctgccgatggccaccgcggtgccggcgaacatcccggccagcagcgccggccagtggcgcatcagcagctcgcgctgctgccagatcgggatggcgaaggccaccgtcgccggaccgagcagcgccaccagccaattggtgtcgcgggcgtagtcggcgtagcgggtatgggtgggaatcgccagggcgtagagcagcaccgggacgaacacgatgggcgacagccagtaccacttcacccggcggtacagctggcggctcaggaggtagccgccgacggtcgccgccaaccagaacagggcttgcttatcgagactcatggcgcgccctccagcggcacatccactccaccgacaccgcggtga

SEQ ID NO: 11560 - DNA, 1044 bp, Pseudomonas aeruginosa
gtaccgccagttcggcggcaaggcgggacagacggcggacgagcgggggcaacatgggaaaggccttggctgggaaatcggggatggagaaaggataaggcccggcctatcatccccaaagcgaattgtccgcatgagagccattccagaatggaattccgtcaactccgcagcttcgtcgaagtggtccgccagggcagcttcacccaggcggctcaggtccgccacgccagccagtcgaccatcagcaagcaggtcgcccaactggagcagagccttggcgtgcaggtattggaacgcaacgggccgcacgtgcgcctgaccgacgccggcgccgtggtgtttcgccgcgccgaggagatgctgcggctgcgccgcgacctgctcagcgaattggacgacctcagccagctcaaccgcggcgaactgcgcctgggcctgccgttgctcggtgccgacgcgctgttcgcccaacgcttcgccgaataccggcggcgctatccgaacatcgccgtgcacctggtggagggcggcagcaagaccatggagcaggcggtgctggccggcgagctggaattggccggcagcctcaccccggcagacgacggcttcgactaccagccgttctgcaacgaaccgctggacgtgctgctgccggccgggcatcccaaggccgctgccgccagcgtcgccctcggcgaactggcggacagcccgttcctgctctaccagcagagcttcaccctcaacgaccgcctgctgcgcgcctgcctggaggccggcttcagcccgcgcgaaggcggccgcagcggccaggccgacttcctcggcgcgctggtggcggccaaccagggagtggtgctgctaccacgagtgatcgctcgcgagatcgaacgcccgggagtggtgcgggtcctgctcagggagccggacctgcgctgggacatcgccttcatctggcgccgtggcggctacctgtcgcgggcggcgcaggcctggctggagctgctgcgcgagcagccgctggaggaaagcccggcgtag

SEQ ID NO: 11561 - DNA, 1002 bp, Pseudomonas aeruginosa
gcgccgccagctccgcgacctgccgcgaggcggccaggctgcgctgggcggcgagggcgtcgtagtaggcctgggcggcgagggcgaaggtgttctgcagggtcgcgtcctggctggcgttggccgccagcagcaactgctgggcgttgcgcagggcggcgctgcggcggccgaagtcgaacagcacccagctcaattggaggctggcgccacgccggtggcgatggccgtcgccggagaggtagggggcatcgcgataatccatgtcgctgtagccgcgactggcgtcgagacggccgtccaggcgcggcaggtaggcggacttgccgatcccgacctgggccgccttggcattggcccaggcgaggcgggtctgtgggtcgtggcagaggatccgctcgatggcttcctccaggctcagctcggtcggtggcggcccgccgcggcagggcaaaccgctgccgccgaggtcgtagaccgcctggccggcgacctggccgacggtgccgaacacgtccggctcgtaggcggcggcgccgggaaccaggccgagcaggccgcacaacaggccggcgagggcacgcatcaggcctgctcccgcgccgcggcggcctggcgttcggccaggcgcgcggtgctttcgtcgaggcttaccttgccctggccgaggactatcacgcggtccgccgaggcgatggtctcgggccgatgggcgaccatgacgcgggtgatgcgcagcgcgcgaatggcggcgttgacccgctgttcacagtgtacgtcgaggtggctggtggcttcgtcgaggaacaggatgcgcggcttcttgtacagcgcccgggccagcatcacccgctgcttctggccgccggagagcaccgtgcccatgtcgccgaccagggtgttgtagcccatcggcatggcctggatgtcatcgtggatggcagccatctgcgcgcactggcgccagccagggcatgtccggttgcgggtcaaaaaaactga

SEQ ID NO: 11562 - DNA, 1734 bp, Pseudomonas aeruginosa
cgactgcgccaccaactggtcgaccaccgtcggctcgtcccaggcggcggcggggctgtagccccagcccttgctccactccacccgcagcgaggcgtagtcgccgctgaagtggtcgaacagccaggcctcgaactcgtggtagaaggcattggcctgcggggtaccgggcaggctgaggatgtccagccagatcgccgtgtcccactccggttggtcggggcgcggacggatcgccgacaggctgggcacctgggcgccgggaacgatcgactcgccgggctggtcgagcccgctgacgcgaatctccaccgggccgttcatggggtagtggccgttggcgcggtaggcggcgaccatcgtctggtactgcaggtagaactcgttgatcacccgctgcacgtcgcgacgccgggtcagcaccgcgtagccgttggcggtgacgcgcagggtgctgggcttgatgtacagcagcaggtccttgctccagccccacaggtcgtagcccagggtcagcgccatgccgcccactaccaggtcgtactgcagcttgccgagcagcggggtgagttccgggtggccggtgttgatcgccgccagcaggtcggacagcgccttgggaatgttgtcggagaaggggtagttgaacgggccgttgaccgcgcgggcgccgaacgggcagcgcggggtcggcgtccagaccttcagccagggcttgtcggtgaaggggaaccagatggcctcggcgcgtccgcttttctgcaggaagctgtcgaaggtccttccgccgctgccggccgcggcgaacatctcgctcgccgggatgttcacgtagctctggcagcgcatgcgcttgttgaccccggcctggagggtcgcctcgacgatgaaggcgcgtccgaggtggacgaggaacggcgcgcaggccggatcgtcgcggcggaaggtcttcagcacgtattgtccggcggcgccgtcccagaccaccgcggtcagcgccacgatgctgttgctcagggagccgtagctctgccccggcaggcggctttcgccctgcgccgggatgccggtgccgtggccgtcgatggcgagcaccccgccgagggtcaggtcacccggcgccggcgtggcgacgaagccgagcttgacccgctccagttgtttcagcagggcttccatggtgacgccggtctgcgcgctgaacaggccgaactcgccctgggcgtcgatccgtacgcgggtcaggtaacggctggtttccaccagcacgatgcggctctcgcagttctcgccgcctttcagcagcagcggggaccagttgtgacccatgccgcgcgggcgcaccttgaagccgttctgccaggcccagttgaccaccgcgagaacctcttcgttggtgcgcggggcgcagctccagaggtcgtcggcggcgatttcccccgaccaattgcggaacgcccgccgataaagttcgaggccggccggaaagcctgccggcgccggacaactgctggcggcggcttcggcgggctggatgacgaaggccggggtccagccggccaccaggccgaccgcgccgagcgtggcactcttgccgaggaagctgcggcgcgacaggccgccggattcctggtcgggatcgccgacgaaggcgtcggcgtgctggatgaggtcgtgcatggcggttctcctgatcggggcgctggtcgccccttcccggttgccgggtcctag

SEQ ID NO: 11563 - DNA, 1353 bp, Pseudomonas aeruginosa
cgttgtcggcccgcgaaaggagccaggcccgcgcgctgccagggtgaacgaggtcgcggcgcgaggatttcccggacggcgaacttgcatccgcgtgcacggcggtgtcgtctggaccgaaaggcgaagaagaggagggcgagcgtgcctgcgagtgcatcgaggattcaggtcggaagcggcgaaggacgcctgttgctgctgttgtcggcgctggtggcgttcggcccgctgtcgatcgacatgtatttgccgagcctgccggcgatcgccgccgatctcggcgccagcgatgcccaggtgcagcggagcatcagcggcttcctggtcggcttctgcttcggcatgctgttctacggccccttgtccgaccgtttcggccggcgcccggtgctgctggccggtatcgccttgtacctgttcagcagcctggcctgcgtgctggccgacagcgcggggcaactggtcctgctgagggtgctccaggccctcggcggcggcgccgcgtcggtgctggcgcgggccatggtgcgcgacctctatccgttgggcgaggccgcccggatgctggcattgatgcacatggtgaccatgctggcaccgctggccgcgccgctgctcggcggctacctgatgctctgggccggctggcgcgcgttgttcgtggtcctggcgctgttcgccgggctctgcctgctggcggtctggcgggtcgccgaaagccacccgccggagcgccgcggcggcagcctggcccaggcctttctcgcctatgggcggctgctcggcgaccgtcgcgcgctgggctacgtgctgtgcatggggctggcgttcgccgggatgttcgcctacatcagcgccgcgccattcgtgttcatcgagcatttcggcgtgcgcgcggagcgcttcggctggttcttcggcctgaacatcctcggcgtgatgctcgccacctggtgcagcgcgcgcctggtgcgccgccacggtccgcggccgctgctgcgggccggcagcctgctggcctgcgtgtccgggctgttcctcctcggctatgcggcgctcggcgagcggggcgggttgtgggcgctggtgcccggcctgctgtgcttcgtcagcgtcaccggcctgctcggcgccaactgcatcgccagcctgctggcgttgtatcccggacaggccggggcggcttcggcggtggcggtgtccgggcagttcggcctcggctgcctggccagcctggcggtcggctggctggcgctgcccggcgtgctgccgatggcgctggtgatggccgtctgcggcgtcggcagcctgctcgcgctgggcttggccctgcacggcggaaaccgttga

SEQ ID NO: 11564 - DNA, 1848 bp, Pseudomonas aeruginosa
ttctcctcgtcggctgtcgagccttgcccgcagcgtggcgggcgaggctcgggaagggaagggacgcgctgtcgcggctcaggccatgcgggccgccgcgaggattccttccgggcgcgcctggcgtaccgtgcgccaggtgttgtagctcatcagcagcatgccggtgaggaagaacccgccaccgaccaggcgcacgatgaagcccggatggctggccaccagcgactcgacgaaggagtaggtcagcgtgccgtcctcgttgaccgcgcgccacatcaggccctgggtaatgccgttgacccacagcgaggcgatgtacagcacggtgccgatggtggccagccagaagtgcgcattgatcaggccgacgctgtgcatcttctcgaccccgtagaccttgggaatcaggtggtagagcgagccgatggtgatcatcgcgacccagccgagggcgccggcgtggacgtggccgatggtccagtcggtgtagtgggagagggcgttgacggtcttgatcgccatcatcgggccttcgaaggtggacatgccgtagaacgccagggacaccaccaggaagcgcaggatcgggtcgtcgcgcagcttatgccaggccccggagagggtcatcatgccgttgatcatgccgccccagctcggcgccaggaggatcagcgacatcaccatgcccagcgactgcgcccagtccggcagcgcggtgtagtgcaggtggtgcgggccggcccagatgtacagggtgatcagcgcccagaagtggacgatggacagccggtaggagtagaccgggcgcccggcttgcttgggcacgaagtagtacatcatgccgaggaagccggtggtcaggaagaagcctacggcgttgtgcccgtaccaccactggaccatggcatcggtggcgccggagtacatcgagtaggacttgaaccagctcaccggcagcgacatgtggttgacgatgtgcagcatcgcggtggtcaggatgaacgagccgaagaaccagttgccgacatagatgtgcttgaccttgcgcttgatcagggtgccgaagaacaccaccgcgtaggcgacccagacgatcgccagccagatcgcgccggtgaactcgatctcggcgtattccttggtggtggtgttgcccagcggcaggctgaccagcaggatcaccgccaccgcctgccagccccagaaggtgaaggcggccagggtgtcggagaacagtcgcacctggcaggtacgctgcaccgtgtagtagctggtggcgaacagcgcgcagccgccgaaggcgaagatcaccaggttggtatgcagcggccgcaggcggccgaagctggtccagggcaggtcgaagttcatctggggccagaccagttgcgaggcgatcagtacgcccaaccccatgccgatcacgccccataccacggtcatgatggcgaactggcgaaccaccttgtagttgtaggcaggttccgtcgttgctttgttcatctgtacagtcccgaaagaaatgaacagccggcgaccgccgtcgaggggggagacggggcgccggccggagcctgcaatctaagggctggggcgggggtaaaacagcttcaggtcgatatggaatttgggtatcagatggggcgggggaaggcgttcgtgcagggcggcggcgcataccgggatgggggacgcgagccgatcatggcggatgaccgcgcgcggttatccgccctacgccggggtggctttccgtctgcggggcgtcatcccgccagcgactgggcgatccgcccgagtgtctccatcgccttctcctgccgcgcgctccacgggtgcccgtag

SEQ ID NO: 11565 - DNA, 1545 bp, Pseudomonas aeruginosa
cgcttcatcttgtcctggccgctgtcctggctggccgtgggcacggccgctggcgcccactctatgcgtgccgggaccgtgttgtcatgcctcatcgcggcctcctcagcgcgccggcgaaacgaaggtgctggtgctgccgaccgccaggctcgggtcgtcgatgccgcgcaggctgaacgccagcggttgcgagccggccctggcgcgttcggcggtagaggccaccgacaccgggaagtcgaggatctcgccgggcttcaggctcagggtgtgctcgccctgcaggcggaactccggcgcgtcgtcgagttgcaggcgatagcgctgcggctgctgggtcttgttgatgaccttgagggtgtagatgttctcgatctgcccggcggcgttctcgcggaacagcccacggtcgcgggtcacgtccagcgaggccagcgggcgggcattcagggcgacgacgaaggcgccgatcatcgccagcatcaccgccgcgtagccgaccaggcgtggacgcaggaagcgggtctggccaccttccagggcgcgttccgaggtgtagcgcaccaggccgcgttcatagcccatcttgtccatgatcgagtcgcaggcgtcgacgcaggcggcgcagccgatgcaggcgatctgcaggccgtcgcggatgtcgatgccggtggggcagacctgcacgcactgctggcagtcgatgcagtcgccgagcccttgggcgcgcggatcgctgcctttcttgcgggcgccgcgggactcgccgcgggcggcgtcgtaggacacgatcagggtgtccttgtcgaacatcacgctctggaagcgcgagtaggggcacatgtggatgcacacctgctcgcgcagccagccggcgttgacataggtggcggcggtgaagaacagcacccagaacaggctttccaggtccagctggaagctgaacaggtcggccaccagcggccgcaccggagtgaagtagccgatgaaggtgatcgccgtgaccaggctcacacccagccacagcgcgtgcttggccgttttgcgcaagagcttggcggcgctcgccggaccctggtcgagcttgatccgcgcattgcggtcgccctcggtgaccttctcgcaccacatgaacacccaggtccacacgctctgcgggcaggtatagccgcaccagacgcggccggcgaacacggtgatgaagaacaggccgaaggcggcgatgatcagcagcgccgagagcaggatgaagtcctgcggccagaaggtcgcgccgaaaatgtagaacttgcgttcgggcaggtcccagagcaccgcctggcggccgttccagttcagccacagggtgccgaagaacagcaggaacagcaggccgccgccgaggcggcggaagttgcggaacagaccggtgaagctgcgggtgtagatcgggccgttcaccgccgacggcagcttgccgggcgcgggcggctgtttcgacggagcggccggtgcggcgggctcgacctggatcgcgggaattctttcgctcatttttcgtag

SEQ ID NO: 11566 - DNA, 1851 bp, Pseudomonas aeruginosa
tgtgtttttttcggcggaatctgccgctgtttcgctgtctgtacgcgggcgatagtgggtgccagtgaacaccggcccatcctgtcgccagaaacaggggcgcagccggtccccggtttcttcgccacgcaccctgcccgtcatcggtggagaaaccctgtcgatgagggctttgcgatgtaccagtacgacgaatacgaccaggcgctggtgagcgagcgggtggcgcagttccgcgaccagatcgcccgccgcctcgacggcgaactgagcgaggaggagttcctcccgctgcgcctgcagaacggcctgtacctgcagaagcacgcctacatgctgcgcgtggcgattccctacggcaccctctcgtcgccgcaactgcgcgccttggcgcacgtcgcccggcactacgaccgcggctacgggcatttcaccacgcggcagaacatccagttcaactggatcgaactggagcaggtcggcgatatcctcgaacacctcgccggcgcgcagatgcatgcgatccagacctccggcaactgcgtgcgcaacatcaccaccgaagccttcgccggggtcgccgcggacgaatggaccgacccccggccgctggccgagatcctgcgccagtggtcgacggtgaacccggagttcctgttcctcccgcgcaagttcaagatcgccctcagttcggcggtggaagaccgcgccgcggtgcagatgcacgacatcggcctgtacctttaccgccaccccgacgccggcgagttgcgcctgcgggtcctggtcggcggcggcctgggacgcacgccgatgctcggccaggtgatccgcgacgacctgccctggcagcacctgctgtcctacgtcgaggcgatcctgcgggtctacaaccgccacggccggcgcgacaacaagtacaaggcgcggatcaagatcctagtcaaggcgctgggcatcgaggctttcgcccgcgaggtggaggaagagtggcagcacctgcgcgacggcccggcacaactgactgccgaggagtgccagcgggtcgccgagcgcttcgtattgccgcgctacctgccgccggccgacggcgagctggcctacggcagcgcccgtgcggccgatccgaccttcgcccgctgggcctcgcgcaacgtccaggcgcacaaggtgccgggctacgcctcggtggtgctgtcgaccaagcccggcgccagcgcgccgccgggcgacgtcaccgcggagcagatggaacgcgtcgccgattgggccgagcgctacggtttcggcgagatccgtgtggcccacgaacagaacctggtgctccccgacgtgcgcctggagaacctccacgcgctgtggcacgaggcctgcgcagccggcctcggcacgcctaaccaaggcctgctcagcgacatcatcgcctgtcccggcggcgactactgcgcgctggccaacgccaagtcgatccccatcgcccagggtatccagcagcgcttcgaggacctcgaccacctgcacgacatcggcgagcttagcctgaacatctccggctgcatgaacgcctgcggccaccaccacatcggcaacatcggcatcctcggcgtcgacaagaacggcagcgagtggtaccaggtcaccctcggcggcgcccagggcaaggacagcgcgctgggcaaggtgatcgggccatcgttcagcgctgccgaggtgccggcggtgatcgaacggatcgtcgaaaccttcaccgacctgcgggtcggcccggaacgtttcatcgacaccttcaaccgggtcggcctggagccgttcaaggcccgggtctacgccaggatggaggaaccggcatga

SEQ ID NO: 11567 - DNA, 573 bp, Pseudomonas aeruginosa
tcttgtactttttgtgagcgcccggacgtcccggcgacctgtcggtggccgggaggcgagctgggtgagtgcagcgttatggcgggccggtcagtccgccgggttgttcaggaattcatgcacgttgttgcgcttgtagttcagctccgcgtccagttcggtgagttcgaaggacagcgccagcaggcgtcgcgcctggagctcggcgaagtgcgcggtgatcacctcgaaaagtgcctcggcgacttgccggcgagtctccaggtcgcgaccggcgccgactttcagggtcatgtggacgaaggcgtagtcgtgcttgccgtcggccatgcgccaggtgtccaggcgcacgccgcggctgcggatgccgccgagcgggaaaacgccgctggcgccaaggcaggcgtggaccttctcgaacaggccgggcaggtcggcttcggcttcgatgttgtcggtgtattcggcgatgaagtgcggcatggtggcgtcctcagaggcggctggcgcaactggcgccggccgggttgccggcctgggcggcggggatcgccgagccgtcctgggcggtga

SEQ ID NO: 11568 - DNA, 1785 bp, Pseudomonas aeruginosa
cgattctcctggtggcccgttgggcctggcagcgggcgcggccgttggcggctggcccggattcttctgattgtgtctgcacgccggcgctgctggcggcctcggggggccgctctgcacgagcgcgccctacacgccccagcgggggatgtgatggctgcccatggatatacacacgttcttgatctcggcgaatacctcgaagctgtattccccgccttcgcgtccggtgcccgaggccttcaccccgccgaacggctggcgcaggtcgcgcacgttctggctgttgatgaagaccatcccggcctcgatgccgcgtgccaggcgatgggccttgccgatgtcctgggtccagatgtaggaggccaggccgtattccacgtcgttggccaggcgcagcgcctcggcttcgtccttgaacgggatcaggcagaccaccgggccgaagatctcctcctgggcgatgcgcatgcggttgtccacgtcggcgaacaccgtgggctggatgaactgccccttgctcaggtgcgccggcaggccggccggacgctccaggccgccggccaccagggtggcgccttcctcgaggccgatgcggatgtagccggtgaccttgtcgtagtgggcctgggtgatcatcgagccgacctgggtcttcgggtcctgcggatcgccgacgatcaggcgcctggcgcgtgcggcgaactcggcgacgaactgcgggtagacgctttcctggacgaagatgcgactgccggcggtgcagcgctcgccgttcagcgagaagatggtgaacagagcggcgtccagcgcccgctcgaggtcggcgtcttcgaagaccagcaccggcgacttgccgcccagttccatcgagtatttcttgatcccggccgcctccatgatccgtcgcccggtggcggtgccgccggtgaaggacaccgcgcgcacgtcgcggtggcgaaccagcgcgtcgccggcgctggcgccgtagccctggaccacgttgaacacccccggcggaatgcccgcctcgtgcaccaggcggcccagctcgttggcggtcagcggcgacagctcggacatcttcagcaccgccgtgttgcccagcgccaggcacggcgcggtcttccaggtggcggtcatgaacggtacgttccacggcgagaccaggccgcagacgcccaccggctggtacagggtgtagttgagcatctggtcgtcgaccggatagctgtgcccgttcatccgcgtgcagacttcggcgaagaactcgaagttgtgcgaggcgcgcgggatcagcacgttcttcgtctggtggatcggcaggccggtgtcgagggtctcaagttccgccaggtgcggcacgttccggtcgatcagctcgccgagccggcgcatcaggcgcgcgcgctccttggccggggtattggcccatttcgggaaggcttcccgggccgccgccaccgccgcgtcgatttccgccgcgccgccgctggcaacctcgccgatcagctcgccggtggccgggttgtagttctcgaagacgtccttgctttcgacctcgcggccattgatccagtgtttgatcattctgcgtgctcctgtgcgcgggcgcggaagaattcggcctcgctgacgattcggttgaccaggcgaccgacgccttccacctccaccaccacttcgtcgccggggaccacgtcggacaggccttccggggtgccggtggcgatcatgtcgcccggctgcagggtcatgaagctggagaagtattcgatcaggtag

SEQ ID NO: 11569 - DNA, 783 bp, Pseudomonas aeruginosa
cggatgcgtgcgtgtttcatggtcggttcctcattccgcgacgatgctgttggcgaggcggccgaggccgtcgatctcgacctcgacgcggtcgccgggatgcacgtcgactcgcccttcgggggtgccggtgatcagcacgtcgccggcgtgcagggtcatgaactcgctgatctcggcgatcagccgcgggatgtcgcgcaccaggttggcggtgttgttgcgttggcgcagttcgccgttgacgtacagcttcagctccagcgcatggggatcggcgatctcctgcgtcggcaccagttgcggaccgaacgggcagaagccgtcgcggcacttggctttcaccgccgggcggtagtagctgtcttccggcaggctgaactcgttgacgatcacgtagccggcgacatgcgccatggcctcttcctccttcacccggctggcgtcgcgagcgatcaccacgcccagcgccgggcccggttgcaggcgctcgacgccgcgcgggaagagcaccggggcgtcgtgctcgttgcgggtattcggtgtcttgatgaacaacaccggcttcactggcggcttctggtagggcggctgctggaactccggcaggcggctgtcgagcaggcccttgtagttcagcgcgacgccgaacagggtgccggcggcgacgtcattcagtgcgcggctcattgtggtggtgtctcctggcgcgataagcgaacggcgagggggccgtcctggcgaaaactcgttaatgtgttaacgttatatttaacatgttaa

SEQ ID NO: 11570 - DNA, 1035 bp, Pseudomonas aeruginosa
tcgtcaaccccggttgctgcgccattcgtcccggggaggtggcaagaggcgccgtctgcggtatacggaagcccgcgacggcttgcgtgcgcagccgggaagaacaacaaagagaagatcgccatgccagagcgccagccgatccccaacatcaacatcgggcaggtctacgaccagcgctatgccgacgccgaggtgcactacgatgcgctgggcaacctggccggattcttcggtcgcaacatgccggtgcaccggcacgaccgtttcttccaggtgcactacgtgaagaacggcgcggtgcgggtctatctcgacgagcgccagtacctggagtcggggccgatgttcttcctcaccccgccgaccgtgccgcacgccttcgtcaccgaggcggacgccgatggccatgtgctgaccgtgcgccagcaactggtgtggagcctcaccgaggccgagccgggcctggcgcccggcccgcaggtggcgccggcctgcgtggcgctgggcaacctggagggcggcgcggccgaggaggcggcgcgcctggcgctgctcttcgagcagttgcgcagcgagtcgatggccagccgtcccggccgccagcagatgctgctggcgctgacccggctggtcatgatcagcctgctgcgtctctcggccaattcggtggctgcgcggccgatgcgccacgaagacctgcagatcttccagcgcttcaacgcgctgatcgaggagcgctatgccgagcactggccgctgtcgctctacgccagccggatcggcgtcaccgaggcgcgcctcaacgacgtctgccggcgcatcgccgacctgccgtcgaagcgcctggtgtacgaacggcttatgcaggagtccaagcgcctgctgctgttcaccggcggctcggtgaacgagatctgctaccagctcggcttcaaggacccggcctacttcagtcgtttcttcgtgcgttacgcggggctcacccccagcgcttaccgccagcgacaggccgacggggagtcccgtcgctga

SEQ ID NO: 11571 - DNA, 858 bp, Pseudomonas aeruginosa
gcgggtgggcgggtatactcgcgctcccactcgaacaggaagcgtttctccatgcatgatgcagccacctccatgccgccgcaggctccctccacctgggccgactaccttgccggctaccgctggcgagggcagggcgaaggatgttccgcggccactgtccaccgcctggaggttgcgcggcggccgaccctgttcgtcaagcaggaagtgctgtccgcacatgccgagctgcccgccgaaatcgcccgcctgcgctggctgcacggtgccggcatcgattgcccgcaggtgctgaacgaaacccagagcgacggccggcaatggctgctgatgagcgccgtgccgggggacacgctgtccgcgctggcgcagcgcggcgagctggagcccgagcgcctggtgcgcctggtggccgccgccctgcgccggctgcacgatctcgatccggccgcctgtcccttcgatcatcgcctggaacggcgcctggacaccgtgcgccagcgggtcgaggccgggctggtggacgaggcggacttcgacgacgaccatcgcggtcgcagcgccacggagctgtaccgcctgctgctcgaccggcgtccggcggtcgaagacctggtggtcgcccatggcgacgcctgcctgccaaatctgctggcggaggggcggcgcttcagcggcttcatcgattgcgggcggctcggcgtcgccgaccggcaccaggacctggccctggccgcgcgggacatcgaggccgaactcggcgcggcctgggccgaggccttcctcgtcgaatacggcggcgatatcgacggcgaacggctggcgtacttcaggctattggacgagttcttctag

SEQ ID NO: 11572 - DNA, 4326 bp, Pseudomonas aeruginosa
tcttctgggacgaaaaggcgcagggagtgcgggattgccccgcgccggggcggcgcagggacggaatatcgggtgaacgtacaacagagcaagttcaggctgagccgctgggcgggcgcgacactggcactcggactgctgctgtccgggctgggcgcctgggggctggcgctggtcaacgagcaacaggcgcggatggcgctggaacgcgaggcggaactgctggccgaggcggtgacccgccgcgtggaactctaccagtatggcttgcgcggggtgcgcggtgccttgctgacggcgggcgaggcgcacatcgaccgcgaactgttccgccgctacagcctgacccgcgacatcgaccgtgagtttcccggcgcccgcggcttcggcttcatacgccgggtggcggccgccgacgaggccgggttcctgcgccaggcgcgggccgacggccagccggagttccgcatccagcaactgactccgcacgatggcgagcgctacgtcatccagtacatcgagccggtggcgcgcaacggccaggcgctgggcctggacatcgcctcggaagccaatcgccgggaggccgcccgcgccgccctggagaccgggcaggtgcgcctgacggggccgatcaccctggtccaggccagcggcttgcgccagcaatcgttcctcatcctgatgccgatctaccgcagcggcatcactccaccgccggggccccagcgcgaactcgaaggcttcggctggagctatgcgccgctgctgaccggcgaggtgctggccgggttgcccatcgacaacgcggctatccacctcgaactcagcgacgtcaccggcgacggcgctgccgtgcccttcttcgtcaacggcgccgcggcgccggctcaacgcctgttcggccacatgctgcggcgggagatctacggtcggcactggcagatggcgttcagcgcactgccgctgttcgtccagcgcctgcaccagccttcgccgcgcatcctgttcctggccggcagcctggtcagcctgttgctggcggcgctggtcaacgccagcgccctcggccgcctgcgccggcgtcgggaggcggcgacccaggcgcggctggcggcgatcgtcggcaattcggcggacggcatcatcggcgtcggcctcgacggcgtcatcagcgactggaatcgcggggccgaggcgttgttcggctaccgcgaggagcaggcggtcgggcggcgggtggtggacctgctggtgccgccatccaaggagaacgaggaactcgacatcctcgcccgcatcgcccgtaaagaacaggtggtcagcttcgataccgtgcgccggcaccaggatggccacctgctcgacgtggcggtgaccgtctcgccgatcctcggtccggacggcggcgtggtcggcgcctcgaagaccgtacgcgacatctccgcgcagaaggccgccgaggcccgcatccgcgagctcaataccggcctggagcaccagatcgccgagcgtaccgccgaactgcgtcggttgaacgtactgctcggcagcgtgctgcaggcggcgtccgaggtgtcgatcatcaccctcgaccgcgatggcatcatcagcggcttcaatctcggtgccgagcggatgctcggctaccgcgccgacgaggtggtcggcaaggcctcgccgaccctgctgcacagcgagcgggagttgctcgcccgcggccaggagctgggcgaggagggtttccgcgtgctggtggcgcgggccgaacaggagggcgccgagacccgcgaatggacctatctgcgcaaggacggctcgccgctcagcgtgacgctttcggttaccgtcctgcgcgacgaggctggggcgatcaacggctacctgggcatcgccgtcgatgtcaccgaatggcgcaacgccgagcgcgagatggccgcggcgcgcgaccagttgcaaatggccgccgacgtggcgcgcctgggcatctggcgctggaacctggccgacgacagcctgcagtggaacgagcgcatgtgcgagctgtatggccagccgctggcgttgcgcgacggcggcctggtctacgagcattggcgcagccgcctgcatccggaagacctcgagcgcaccgaggccagcctgcgcgcggcggtggaggggcgcggcaactacgatgtgatcttccgcgtggtgctgcccgacggcggcatccgcttcatccaggccggcgcgcaggtcgagcgcgacgccgacggcaacccgctgcaggtcaccgggatcaatatcgatatcaccagcgaccagcaactgcaggcgcgcctgcgcgaggccaaggagcaggcggacgccgccagcgcggcgaagtcgtcgttcctggcgaacatgagccacgagatccgcacgccgatgaatgccgtgctgggcatgctgcaactggcccggcagaccgatctcaacgaacgccagcgcgactacctggacaaggccagctcggcggcaacctcgttgctcggcctgctcaacgacatcctcgactactcgaagatcgaggccggcaaactggtcctggaaatgctccccttcgagctggagccgctgatgcaggacctggccgtggtgctctccggcaaccagggcgacaaggacgtcgaggtgatcttcgacatcgatcccgagctgcccagcgcggtggtcggcgaccgcctgcgcctgcagcagatcctcatcaacctggccggcaacgcactgaagttcaccgcccgcgggcacgtcctggtgagcttgcggcgtctggcgcacgacgcccacctggtgcgcctgcgggtgctggtggcggacaccggcatcggcatcagcgcggaacagcagcagcgcatcttcgaaggtttcacccaggccgaggcgtccacctcgcgacgcttcggcggcaccggcctcggcctgttcatatgcaaacgcctggtcgacctgatgggcggtgaattgcgggtcgagagcgcgccgggcagcggtagccggttctggttcgacctggacctcgacgtcgcccacgaccaaccgctgcgtgcggcctgccccggggccggcgaaccgctgcggctgctggtggcggacgacaacctggtggccggcgagctgctcgaacgcacggtcggcgccctcggctggcgcgccgactgcgtcggcagcggcagcgaggcggtggcgcgggtccaggcggcgatggccgagggccgtcgctacgacgtggtgctgatggattggcgcatgcccgatctcgacggcctcagcgcggcgcaactgatccgccagttgcagggcgacctgccgccgcccatggtgatcatgatcaccgcctatggccgcgaggtgctggccgatgcgcgcgaccacagcgcgccgcccttcgtcgattttctcaccaagccggtcacgcccaagcaactggccgactcggtgctgcatgcgttgcacggcgaacagggcgccccggccaacccgccgccgcgcccggtggagcgcacccagcggttgcggggcgtgcgtctgctggtagtggaggacaacgcgctgaaccgccaggtcgccgccgagctgttgagcagcgagggcgcccgggtggccctcgccgacggcgggctggcgggcgttcagcaggtgctggaggcgagcgtgccgttcgacgcggtgctgatggacatgcagatgccggatatcgatggtctcgaggcgacccggagaatccgcgccgacgggcgcttcgccgggctgccgatcctggccatgaccgccaacgcctcgctggccgaccgcgaagcctgcctggcggcgggcatgaacgaccatgtggcgaagccgatcgacaaggagcgcctggtgctttgcctgctcggtcatctcggcaggagcggcgccaggggcgcgccggcaacggcagcggacgcgggcgaactggtcgaggcgcggggcgatatcgtcgggcgtttcggcggcagcctggagctgatcgtccaggtgttgcggcgcttcgttccggacatgcaggacctcttcgcccagctcgaacgccagctcggcgagggcgatgtccagggcagcgccgcgaccctgcataccatcaagggcagcgcttccaccgttggcgccagcgccctggccggccgtgccagcgagctggagcaggccctgcgccgcgccgatccgctgcgcggcatggaaatcctcgccggcatccgcctcgacgaactgcgcaccctgtgcgatgcctgcctgctccgcctgcaggcgatgttcggcgacgtgcaggcggagtcggcgagctga

SEQ ID NO: 11573 - DNA, 1017 bp, Pseudomonas aeruginosa
cggcttcatttccgaagccgaggcctacgaacacctgcgcaagacctacgaggccaacggcaagccgatgcccgccgggctgttcagcaagctggagcaaggccggcactgagcctttccacaccctggcggcgccctctctttcccctgggaaagcgggggcgtcgccgtttccggagctatcccatgaccctgatcgacaacgccgccggcctcggcctgaggcgcggcctgcttccgcaactgctggcgatggcgcccggcgcggtggacttcctcgaatgcgcgccggacaactggatcggcgtcggcggtgccttcggtgccgacctggagcgcctggtggagcgctttccactgacctgccacggtctctcgctgtccctcggcggctccacaccgctggatgccgccttcatcgagcagacccgacgcttcctcgtccgccaccgggtcgcgttgtacagcgagcacctcagttactgttccgacgatggccatctctatgatctgttgccgctgccgttcaccgaggccgcggtgcgtcacgtcgcggcgcgcatccgcgaggcgcaggagcgcctggagcggcgcatcgcggtggagaacatttcctactatgcagcgccgtaccgggagatgagcgagatcgagttcgtcaacgcggtactcgacgaggccgactgcgacctgttgctggacgtcaacaacctgttcgtcaacgcctgcaaccacggctacgacgccctcgacttcctcgtccggctgccgcccgggcgggtcgccgcctaccatgtggcggggcactacgacgaggcgccggacctgaagatcgacacccacggcgccgccgtgaagcccggcgtctgggccttgctcggagccgcctatcgtcgtttcggcgtgcgcccgaccctgctcgagcgggacttcaactatccgccgctgggcgaactgctgctggaagtggagcagatccgccaatggcaacgcgacgagggacgccgtcatggatga

SEQ ID NO: 11574 - DNA, 2505 bp, Pseudomonas aeruginosa
ccgcgggccagttccgccaggctcgaccactccgccggccagtgtacggcggcggtcgccaccagggtgacgacgatcagcaccagggcggtcaggcgggtaccgaggccgagcaggaggagcagcgcgccgagcagttcggcccacagcgacagttcccagttgaaggcggcgggcaggcggtcgaagggaaaggggaaagccgactggatatcgccgaaccagttctcgccgttccacttttcccaaccggactcgaagaactcccaggccaggaacagtcgcagggacaggtcggcgctccagccgccgcagcggtcgagcagggcgaagggtcggcgccaggcgcgcaggtcggatgcttgcatgatcgatgtctcgttgagggcggtggatgggtcaggccggctgtacgtcgcgacgacgcaagcgcacggcgagcttggcggtgagcttgaggacgatggcggagaagatcgtggcgaacgccagtacgtaccagccgcccatggggatgcgtttgaagaacgacaggcagaagatgcccgccagcacccaggtgccggtcgagtgcagggctttccaggcgcgtgggccgagcagtcgggccggggtgcggaaggaggtgagggtgagcagcaggatgaacaggtagccgatcgagccggggatgttcgccgcgaccgagcggccgctccagaatgtctcggggaacagcttccagtaggccaggatcagcaaggcgtgtactgcgtgggagaaggcgaaggccaggcccaggtagcgcctttcacggagcagcgcgcgggtccccgggccgggcaccagggtcgccagcgaggacgcgaggaaagcggcgaggaacagcgcgaaggaactgcgcgcggtggcgcggatggcgctgcgcaggccctccaccggttgcgcctggagagccaggacgagggcggtcatgcacagcacggcgacggcgaggacggcgaacagtcgccagccgtgccaggcggattgagaggttgggacggtcatggtggggctcctggttgccgggagcggctcggcgatgtgccgccgcttcccgtggccaggagtgttgcaagcgggtttatccgcagtgtgtccgccgagggcggttatgtatcgctctgtacgggcgcctcaggggtccagctcgatgcgcgcgcaaagcccgccgccggcgcggttggccagggtcaggcggccgccgagggccaggctcagctgctgcgcgatggccaggccgaggccggtgccaccggtgtcgcgattgcgcgagttttccacccggtagaagggcttgagcacctcgtcgagttcctcggcgggaatccccgggccattgtccagcacctggattcgcgtgccgccatcggtacggcgttccacttccaggcgcgcggcgccggcgaacttcagcgcattgtcgaccaggttcaccagcacccggcgcagggcgtgcggacgggtgtcgatcaccgcgccggtacggccgtcgagttgtacctgcttgccgctgtcctggtagtcgaagaccaggctgtcgaggaaggcgtcgaggtccacccggcaactggtttcggtgctgccgtgcatgctgcgggcataggccacgccttcgcggaccaggtgctgcatctcttcgagatcgttccacagcttgtccctgtcgctggaggcgtccatgaactcgacgcgcagcttcatccgcgtgatcggcgtctgcaggtcgtgggaaatcgccgcgagcaactgcatgcgctccttgaggtagtcggcgatgcgcgcctgcatggcattgaaggccgccgccgcatgcgccacttcgcgtgggccggtttccgcgagaggctgtgccggacgattcggatcgagatgttccacggccttcaccagccgggtcagcgggccgatggcggtgcgcaccgcgaggccggtgcagagcagcagcaggagcaactgcaccagcagtaccagcggcagccagccggacagcggcaccggggccggcgtgacgtcgatggtcagcgggctgccgtcgcgcaggcgcaggaggacctggaagtgcggacggctgtcggccaccgtgcgcagggtcagcgggtattgaccgtcgagggcgcgttcgatggagtgcgcggcaaccggcgcgtcggccagcgccagcggctggccgggctcgccggcgtcgaggcgatagcggtaggtgcgtcgttccaggcgcggcagccaggcctcgcgctcggcgggcgtcaggcggtcgagcatggctaccgagatcgccacgtcctgttcgaggctgtcgagcatcatgtgcttcgcggtctggtagcgctcgtagaactgcgaggcgaaggacagcccgtaggccagcaccagcccggcgaagaggatcagcgccaggcgcgcggcgaggctgcgcgggcgcggcacggtgagcttcatggatgggcctcgaccagtcgcaccggcagcgagaacacatag

SEQ ID NO: 11575 - DNA, 372 bp, Pseudomonas aeruginosa
ccccgtggccgaaggggaccaggcgctgcggctggttcttcagcgcgggggcgacgatcagacccagctccggggtctctgcctgcgggtcgaggcggaggaagccaccggactcgacggtgttcgaggtcagcgccccgcgccggccgaacaggtactgccagggcgagcgcagcagcggcagccagcccttcggcgagaagcccaggccgtagccgagcttggcctcggtgcggtacatcagcacgatgtcctggtggtcctgcaggttctcgccgaccccaggcaactcatggcgctggacgatgccgtggcgcgccagttccgccgccgggccgatgccggagagcaacaggagctgcggcgagttga

SEQ ID NO: 11576 - DNA, 276 bp, Pseudomonas aeruginosa
ccgccgtccaccgccagcacggcgccggtgacgaagctggcgccgggaccgcagaggaaggccgcggcgctggccacctcgggcgcctcgccccagcgcgccagcggcgtgcgctgcatgatccggcgggtggcctcgacgtcggccttgagcccggcgcccagcggcgtgtcgatccagccgggggcgatggcgttgacccggatgcgctcggcggcatactcgcaggccagggaacgggtgagctggacgatggcgcccttgctggcgctgtag

SEQ ID NO: 11577 - DNA, 1185 bp, Pseudomonas aeruginosa
agcccatcgactcgcagaggttgtagcggccttcccggcagtagcggcattcgccgcagcggtattccggctccaccgcgacgcggtcgccgatgcgcagtccctccacgccagggccgagcgcggcgaccacgccgcagaactcatggccgagggtcagcggcgcgcggcaaccggacagcgggtgcgcctcggcctggggaatcgagtgcgggccgctctggtattcgtgcaggtcgctgccgcagatgccgcagtaggcgacttccagttcgacttcgccgggccgcggcgcctggtgttccagttcgctcaggcggaggtcgcgggcagcgtgccagcgcagtgctttcatggttggtttccttgcaggacggaggtaggcgcgctgcgctggcgcgccagcacggcgggcgcggtttcgcgcaggaacagcgagaggaacgcggcgagcagggcgccgccgcaggacatccacatgacgatggacaggccgaagcggtcggcggcgaagccggccacggtcggcgcgaggaaaccgccgaccagttcgccgaggcccatgatcaggccgagggcggtggcgatgacgccgcgcgagacggtctccgccgggatggtcgccatgaacagggtgaagcagccgagcccggtgtaggtcagcagcaacagcaggccgaggctggtcgcgttcggcgcatagagcagcgccagcgggcaacacgcggcgagcagggagaacgccaccagggtcggtcgacggccgatgcgatcggatatcgccggtacggcgaagccccagaccacccaggcgacgcccaggcagctcatcagcctgcccatggtcgccgggctgaagccgcgggcgttgaccaggaaggtcggggtaaaggaaatcagcacgatgaaccaggtgacgaatacgcaactgatcagggtgcagagcaggatgttgcggctcttcagcagtgccaggcgcttgcctttcgcttcttctgcgcgcggcgccgggcgctgcgcgcggggcgggtcgggacgcacatggcgccagatcaaccaggcgatcagcagacccggcagcaacgagacgatgaaggcgtgacgccagccgagggcttcggccagggccaccagcagcggcgggccgatcaccgcgccgagcaggccggccgccgagccctgtag

SEQ ID NO: 11578 - DNA, 522 bp, Pseudomonas aeruginosa
cagacccatgttgaggccgcggcgatgtggcgaggaggcctcgaccatcagcgattgcgagagcggcaggatcggcccctcggccaggcccatgatgccgcggaacagcagcaggctgaggaagccgccgaccagcccggacagcgccgagcacagcgagaacaggatcaccgccacgatcagcagcggcttgcgctgcccgcggcggtcggaccaggcgccgaccagcgcgccggataccgcccaggccagggccagcaccgaggagagcatgcccaggtggctgttgctcagttgcagctcctgttccatgaagggaaacaggaaggacagcgccaggcggtcgaagaagacgaagccgaaggtcaggaacagcacgcagagcaggacgttttcgtaactggcggaattgttgttatgcgccatgtcggtctccaggccgggcgggccggccggcgggggaggcgcgcgtccgccagggcggcgcgcgcccggggtcagcggaacagggagtcgatgtag

SEQ ID NO: 11579 - DNA, 612 bp, Pseudomonas aeruginosa
cccgctgttcctgcgcatgcagcgccagcgccgcggcccggtgccgctgctgggccacctgctggccgaggacatcgagttcgatgcttaccgcgaggcgatctatcgggacaatggcctgagcgagcggctgtcgagcctgcattgggacgaggaaggccggccgctgctgttcaatctctaccggcaccgcgaggacggctatttcagcgagcgcgagatcgccgccttcgagcagtgggtgccggccctgctgcaactgctgagggggcacctggccttgcgccggggacgcagcgcgaccgacgagtggcggctggcgctgttgcaccgggcgacggacctgacaccccaggagctggcggtctgcctgcacctgctgcgcgggttgagccatgccggtatcgccgccgagctggggctcaaggaaagcacggtgaaaacctaccgcaaccgcgcctttgcccgcctggacatccattttcgcagccagcttttcgccctggtgcagggctgaggagggccggacgccgcctgtggggcggctccggagagaggggtcaggcggctcggcaggctcgctgcaggcgatggaagctgcggctgaagtag

SEQ ID NO: 11580 - DNA, 519 bp, Pseudomonas aeruginosa
accaggccgtcgccctgttcgaggacctggatgtcctccagctccagcaacagcaccgaatgggtgccgatctcctggacctcggcgatgcgtccctgcaggttggccagggcgccgtgcagcaccggcaacccggcgaggccctcgcgccagtcgtggagggcgaagcggcgttccatcgggacctcggtcatgccggcgaagtggcgggccacctcttcatgttcgccgctgaggacgttcacgcagagtcgaccgttggccttgaacaccgtgttcatctcgctgttgcggttgatgcagagcatcagcgtcggcgggctgtcggtgaccgagcagaccgcggtggcggtgatcccgcagcgtccggccgggccgttgctggtgatcacgttgaccgccgccgaaagatgcgccatggcgttgcggaaggcttgttgcctgggttcgagctgggacatgggaataacctccggacgcgacgcgggcgtcattggcggatgcggtcgagcacgttga

SEQ ID NO: 11581 - DNA, 657 bp, Pseudomonas aeruginosa
acagcgcttcgacgcgggccaggtcgaggccgaaggtggtgtccatgggcgtcctcacagatcgtggcgggtctggttgagcacctgggccagggcgccgaccgggaagttaaccggggtggcgaagtcgtcgtcctggtagccgaagatcttgccgtcggtgcgcccggcttccaggtcgatcagcagcacgccgagggtcggcacgatcttctcgcgccagacgaacaggtacaggcgttcggccagtcggtagcagtggcagcggtcggtatcggccagccctcgctcggcgccgcgcaggcattgccaggcgtagaagtcgggattgaggtagacgtgttcgtaggcctcgctggcgctgtagacgtagcggttgcgcaagccgaccaactcgtcgctggggacgtgcgggcaggcgtcgggctgccacgggcggtcgaggctgccatgcaggaactcggccttcacgccggtcagttcccggccggccagggcccgggagaacagaccctgttcgcaggccgtgcggtcgggcagatggccgagcaccgcggtgaacgcctggttgtcgaagtccagcaccaggctgaccgagaccggccggccgttttcctgcttgaggaaatccaccaggtaaaggttttcccgcagtga

SEQ ID NO: 11582 - DNA, 225 bp, Pseudomonas aeruginosa
tggggccgtcgaaagccaagggcgtgcagatccagatcttcaacaattcggcggccaacaccacgaagatcccgctgggcttggtcgatgccgccccgcagaaaggcaaccatcgacaagaacacggcgaccctgaagtacaaggcctcctatgtgtccaccgagaagaccgtgatcgcgggtaccggcctgtcccatatccgctacctcctggcgtacgagtaa

SEQ ID NO: 11583 - DNA, 777 bp, Pseudomonas aeruginosa
gcggcggtcgacggacgaagaggtgaggccatggcgccgctaatgcatcgttttcattctttcgtggcggcaagcgccgtggccatcgccctgtgcgtcggaacggctcacgccgggctgatcgcacagggcactcgcgtcgtctttccggccagcgagcgcgaggtcaccttgcggatcagcaatacctccggcactcccgtgctggcgcaagcctggatcgacgatggccggcaggacgttccccccgaggaactgcaggttcccttcagtgtcacgccggccgtgacgcgagtggaccccaatggcggcgccgtattgcgcatcgcctacctgaaggccccgttgccgacggatcgcgaatcgctgttctggctgaatatcctggaagttccgcccagggacgaagacgaaaacaatgcattgcagttttcctttcgttcgcgcttcaaactcttctttcgacccagccagttgaagagtgtcgattcggctgccgggaaacttcaatggaagtttctggagtcagggggagcaggaaaaaagaccgtagtacaggtaaataatccgacgccttactacgtttcgttcgccagcgtcgaattgattgtcgatggccgtgtcatgtccgtgggaaagggaatggtcgcgccattctcgacgaaggagttcgactggcagggaaatccgaagaacatggaagccgcttccgtcagatacgaagtcatcaacgattacggtggccgcaatacccacgatagggcactcggcaaataa

SEQ ID NO: 11584 - DNA, 1233 bp, Pseudomonas aeruginosa
gtggcgattttaaaatcgctgcagggattacatatgcccaaagtttctcttcataggtgcttgtccgctcccgcttacggtgggcaggtcgccctgttgcgaatggcgatgcagggagggatcgccgttcgttccctgcgattcgcctgtctgctggcactgtttccttcgctgtcctcctgccagtcctggtcctccgtcggcgccgccggcgtagccggggcgaaggaggccaggacgggagcaccggcgaaacagccgcaggcgcccgcggtggccgttgcgtcaccggccggcgggttggacgcaccgtcgcggcggatcgtcttcgacgcgcagatgctggccctggggccgggcggacgctcgatcgatacgtcgcgtttcgagcgcggcgacgtcatcgagccaggccgctatcgcctcgacctgctgctcaacagccgatggcgtggcgtcgaggaagtcgagctgcgccgccagccggggcgggaaagcgcggtcttctgctacgaccggggcctgctggagcgggcgggcatcgacctggagaagagcgcgcgtggccaggaccgttcctcggctcgcgatcctctgcccgaaggtttgcactgcgacccgctcgagcgctatgtgccgggggcccgggtcaagctcgatatcgccgagcagtcggtctatgtctcggtgcccagctattacctgagtctggattcttcgaagacctatgtcgatccggcgagctgggacagcggcatttccgccgccttgctcaactacaacagcaatctccacgtcagggaaaaccacggcaggagcgccaccagcggctatgccgggatgaacgccggcttcaatttcgggcgggcgcgcctgcgccacaacggcacggccacctggtcgcgccgcatgggcagccattaccagcgtagcgcaacctatgtgcagaccgacctgccggcctggcgtgcgcagttattgctgggagaaaactccaccagcagcgagttcttcgatgcggtgtccttccgtggagtgcagctttccagcgatgaccggatgctgccggattcgctgcgctactacgctccggtggtccgtgggaccgccagtaccaatgcgcgggtatcggtctaccagcgcggctacctcatctacgaaaccacggtggcacccggggcgttcgctctcgacgcagactgtgtaaaaacgttggcatcgaccttgctgtga

SEQ ID NO: 11585 - DNA, 324 bp, Pseudomonas aeruginosa
tggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagagctggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 11586 - DNA, 648 bp, Pseudomonas aeruginosa
tcgccatcgcttgctgcgtttttacacggtctgggccgaggacgatcgccagggtggtcagcgcgccgaaaccgatccccggtacgccgttctccagcatgtggatgcgcgcgcagaacatcgccgagatccacagcaacagggcgacgaagggcaggatgtcgtagtgatcgtagagcagcacctgcaagcccaccgccagcgcacagccgagcagcgtaccgagggcgcggatgcgcccggcgaagtgcacgcccttccagtgcatgggaaacaacaccaggatcgaggcgatctgcgccgacagcgagtccttcaggtcgaaggtctggaagaccacgaaggacaaggtcgccaccgtggccccgagcagcgtctcgtggcgccggctgggggcgtccttggccggcgcctggcgcggcggccgcggttcgacgtcggggaacaggtagaacatcagcacggcgatggccaccgtcagccaggtggcgaccatgttgctggcgagcatgtcgaacagatcgacgtccggatagctggcaaagtgcagcagcatcgagaggaacaccgaactcagtgcgccgaagaagaacagcgggccgcgcgccatcagggcgaagcggtagacgaagaggccgaagacgatag

SEQ ID NO: 11587 - DNA, 372 bp, Pseudomonas aeruginosa
catgcagccatcattcgcacggaagcttcgccaatgaaattcggactcttcgcctcgactgccctcttcctcctgtcggtctgcgcacttccggcgctggctgccaatagcccctgctcgggaaagaaaggcggtatcgccggttgcgacggcgatatcttcctctgcaacgacggctccatcagcgcctcgaagcgcagttgcgcggcctacttcggcaacgccggcggacgtaccggacaacccgccgtacagcgtctgcaaggcacgacgcagggctgtgcctgtggcagcggctcgttctgcacgggcccgcgcggaggggtgtactgcctgacgccgggcggcaagaaaagctatcggagaaagtga

SEQ ID NO: 11588 - DNA, 1683 bp, Pseudomonas aeruginosa
ggcggggttgtcgctgcgttgggtgcggttgccgaccgcgtcgtaggcgtagctgcgcccgccctggacgccgcgttcctcggtcaggcggtccagcgggtcgtactggtagtccagggtgccccagaggctgtggcggtgctgctggatattgccattggcatcgtgctggtagtcgctctgccaggggccgaccttctgccgcagcagttggtagtcctggtcgtactcgcggctgagagtgatgccgttgccccaggtcaggcgctgcagcgggccgaagggcaggtaggcgatctgcccaaccagggtgctcggcgccttgtcgcccactgccagggtcacgctggcgacctggccgccggcgttgcgcgggtagccgatggcgaggccggaggggtagccgatctccagcagttggttggccgcgtcgtagcggtaggtcacgcggtcgagcagggtctgctggtcgaggcggatgctgcgtacctgctcgaccaggttgccgcgctcgtcgtagcggtacaccaggctgtcgcgggcaccttcgatggcgcccaggcggccgatgccctggttgccgtcggcggtgaggtcgtagcggtactgtacgtcgaggctcgggtcgctcggcgagcggcgctcgaccagccgattgagggcgtcgtagcgatactcggtgaccgcaccgcgagcgtcggtgcggcggatgacgttgccggcggcgtcgtgctcgaaggtggtggtgccgctgtccgggctgaccagtcgggtcaggttgccgaggccgtcgtattcgtagcgggtggtgacgccgcgcgggtccttgacctcggtgaggttgtcctgggcgtcgtaggcgagtcgggtcttgccgccgaggggatcgctctggccgaccagccggtcgagggcgtcgaaggcctggctgtgggcgaactggcgcgggttggtttcgccgaccggattgtcgttgaggtcgtaggcgaagctgcgtgtctggccgccggcgccgaccgcacggagcagccggccaagctcgtcgtaggcccattgctgctggcgcaccaggctgccgctggcgtccttgatgcgctgggcggtgcgattgcccttggtgtcgacgtcgtattcgaggcgttcgccgaggttgttgccgatcgccaccaggcgccgtgcgtcgtcgtattcgtagctcagccaactgccgtcgccacgggtgacgcgggtgatctggccgactgcgtcatagtcgaagcgggtggtgctgccggcggtgctgacggaggccagccagccgtcgacgccggtgtaggcgaggctgctggtgacgccgttggcatcggtgatgctgccgggcttgccgcgctcgtcatagtcgccgaggcgggtgacctggccgagggcgttggtcacctgggtcaggttgccgcgactgtcgtaggcatagagggtgacgtcctgcacatcggtgcgcggaccgtcggcgcgctcgatcaggccgagggcgttgtagctgtagctccaggcgcgctcggccgcctgcgcgggcagggccagggcgcaagccagggcgagggcgccgagacgggggaagtatggggggatgcgcatgggtgtcgtccttgtcagcgggtggtgacggtctcgccggtcttgcgtccctcggcgtcgtactggtag

SEQ ID NO: 11589 - DNA, 237 bp, Pseudomonas aeruginosa
gccggcacaaggaacagcgagcccgacggagagggctccgggagtgaaaccatgtcacgatccgccgtcattcttctgttcgtagtgatcgccagcgcgatcctggcgctgagcctgccgcccgaggccaccctcctcgcctggtgcgcctggggtctgctgggcatttccggcgcatggctgctgtttgcactggtggtaggtcggcgaatccgcttcgatccaagcctggactga

SEQ ID NO: 11590 - DNA, 480 bp, Pseudomonas aeruginosa
accggcacctggcgggcgtcgccggtgccgagcagggtcaggcgcatgcgcggtcgctgccgagacgggccaggagggtgcgtagcgtgtcgtcgagatcaccggagttgtccagttggaacagcgggccctccaggccggcggcgaactcggcgttacgcgccaggcgcgcctcgatttcctcggggctttcccggccgcgcgccagcaggcgctggcgcagcacctcgggtttcaccccgagcaggaccgcgagcagatccggatagcgccggcgggcctgcgccaggtagccgcgcgagccgttcaccagcacgtcgtagccctgcgccagccactcgtcgatctgcaccggaatgccatagcaaaggccgttggcgcgccagctcatggcgaacgccgaggcccgctcgagggtgtcgaactgcgccggagtcaccgcctgggcgtcctcccccaccgcttccgcggagcgcgtga

SEQ ID NO: 11591 - DNA, 1485 bp, Pseudomonas aeruginosa
tcacccgccgcacgatacggcagccgcgcagcgccaggggctcgcgcgcggcctgcaacaggctgtccttgcccgagccggaaggccccatcagataaatcagtctgcctgtcatcagaacactctctgcccgccgcgccagacctgacgcaccaccggctggttgttgccgagcgcccgcgcatgcagcagatcggcgcgcaggccgacgcggatttcgccacgatcggtcagcccggcggccagcgccggggtacggctgaccatcgccaccgcgcgcggcaggtcgtagcggatcgcatcatactcgctgtgctcgccggcgagcagcaaggccgcatgcagcaggctggccggatagtagtcgctggaaaggatatccagcacgccgattcccgccagttgcgccgccgccacgttgcccgagtgggaaccgccgcggaccacgttgggcgcgcccatcagcacctgcaggccgtgctcgtggctggccctggcggcctccacggtggtcgggaactcggcgatggccatgccgtagccggccgactcgcggacatgcgcgagggtcgcgtcgtcatggctggccaccgacaggccgcgtccctggcagacatcgacgatggccgcacgggcggcgtcgctgtagcgctcggagttggctacctgctcgacgatgaaggcgtccatctcggcatcgctcaggtggtacttgccctggtagtactcgcggtacttctccagcctggcgaactggcgctggccgggggcgtggtccatcaccgagaccagttgcaccagcggatgctcgaccagttcgcggaacacctccagcgtctgcggatggctgacctcgcaacgcaggtgcaggcgatggtcggcgcgcgcgtcgccgctggcggcggcctcgccgatggcctcgagcatcttcggcaactgctgcatgcgcttgcccttggggttgacgtcgccgatggacagcgcgtcgaacaccgtggtgattcccgcggcgacgatctgcgcgtcgtgcgccagcaccgccgaggccgatggccagtcgacgccgggacgcggggtcatgtgcttctccaggttgtcggtgtgcagctcgaccagaccgggcagcaggtagtcgccccccaggtcctcggccccggccaggtggctgcggccttcgtcgaccgcggcgatcaggccgtcgcgcagcagcacgctgccgacgaagacccgctcggcgctgactacccgggcattgctgagaacgcgttcagacgacatgggcttgctcctggcgggaaagctcctggctcatgtccaggtagcggctggccaccgcctcgcgggcggcgcggtcgtggaagatgccgatcaacgcggcgccagcggccttggcttcgccgatcagctccagcactacctggcggttggcttcgtcgagggacgcggtcggctcgtcgagcagcaggatcggccactcgaccatga

SEQ ID NO: 11592 - DNA, 486 bp, Pseudomonas aeruginosa
ggtcgcggacctcgatcaggttgttcatcgctacttctccgggcgcccgtcgcgcggaccggcgccgacgcttcggctcagggttgcaggaccgacgacaccagcaattgcgtgtacggatgctgcgggtcgtcgagaatctggtcggtgagaccggcttccaccacccgcgaacggcgcatgaccatcaggcggtcggcgagcaggcgcgccaccgccaggtcgtgggtgacgatcaccaccgccaggtccagctcgcgcaccaggccgcgcagcaggtcgagcaggcgcgcctgcaccgacacgtcgaggccgccggtgggttcgtccatgaacaccaggcgtggcgccgagaccaggttgcgggcgatctgcagacgctgctgcatgccgccggaaaaggttcgcggcaggtcgtcgatgcgcagcggatcgatctccacctgttccagccagtccagcccggcctggcgcagccgaccgtag

SEQ ID NO: 11593 - DNA, 1446 bp, Pseudomonas aeruginosa
gcaggccgcggcggatcatgcgcttggtctgctcgtcgaggtaggcgaagttgtagccctgctccggcgcggcgctggcttgcggggaaaggctcatgcgcgcttctcctggacagtgggttgcgcggattcggcgacgccgggacgacgcagcttgcgaatcagctccagctcggactggaaatcgacgtagtgcggcagcttcaggtgcgagacgaagccaccggcctcgacgttgtcgcagtgcatcaggacgaactcttcctgctgcgccggcgacaccacctcctcgccgtattcctcggcgcgcagggcgcggtcgaccagggccatgcccatcgccttgcgttcggcgtagccgaaggccaggccgtagccacgggtgaattgcggcagctcctcgcgggaaccgacgaactggttgaccatctcgcactcggtgacctcgatctcgcccaccggcaccgcgaagccgagttcctcgggctccagccagacctcgcaggcgccgatgcggatctccccggcgaacggatggttgcggccgtagccgcgctgggtcgaatagcccagggcgagaaggaagccctcgtcgccgcgggccagggcctgcaggcgctgggcgcggccggtggggaagtcgagcggctcgcgggtgatatccggcaccgcgccgggcagttcgtactccggcgtcatcaggccttcccggtcgagcaggccgagcacgcgcggacaaggctccagggacgcgccccgctccacttcggggccggggtagtcgccctcggcgagcaggctgaagtcgagcaggcgatgggtatagtcgaaggtcggaccgagcagttgcccgcccggcaggtccttgtaggtcgccgagatccgccgttgcaggcgcatcccggcggtatccagcggcaggctggcggcgaagcgcggcagcgtggtgcggtaggcgcggaggaggaagatcgcttccatcaggtcgccggccgcctgcttgatcgccagtgccgccagttgctcgtcgtacagcgaaccctcggtcatcacccgcgacacggccagcggcatctgctggcggatctgctccaccgacagctccggcagcgcggtatcgccgcggcgcttgcgcgccagcaggcgatgggcgttgtcgatggccttctcgccacccttgacggctacgtacatcaggccacctcctcgacgggttcgctgacccgggtactgcgtggcaggccgaggatgcgctcgccggcggcgaagaaggcatccaggcccctggggaattcggtgcgtgcggcgcgctgtgcccagaacccggcgctcaccggcaacgccacctggcgcacttcggcgatgcccggtccgcgccactccagcgaggcgccgccatcgaggccggcaagctggatcagcagggtgcaggactggtccggataa

SEQ ID NO: 11594 - DNA, 594 bp, Pseudomonas aeruginosa
gcaacggcgcatggcggggcatcagcaggcgcgccgcctcctcgcggttgggcaggcgcgcaccgatcaggctgtaggtgcgggtcagcggcaggcctttgtcggccaggtagcgacgcagcgaaccgccctggtagtcggcgagcagctcgctgcgggaaacggcgaagcaatggcggatcaggctcactggctggccgtcgaggtaacgcagggtggtcagttccagcacccgcccgccctcgccgatccccaggtgggtggcatcggcggcgccggccgggcgctggcgcgcctccagcagccgggcctcgacccggtggccctgggccgagagcgactcggtgtaggcgttggcggcgcccatcgggtagatcgtcggcgcctccaggacctgggtgcccttgccctggcgccgcagcacgcggccttcgagcaccagttcgtcgagcgccctgcgcagggtatggcggttcaccgcgaagcgctgggccagctggatctcgccgggcaggtagtcgccggggcggtaggccagcagttcctggcgcagccgttcggccagttcgcggtacagcggttcgctttgtctag

SEQ ID NO: 11595 - DNA, 978 bp, Pseudomonas aeruginosa
cagaacgtcgatcaggctcaccaccacgatgatcacgatcagcacggcgcaggtctggccgaactggaagccgcggatggcctcccagaggatcacgccgatgccgccggcgccgaccatcccgaccactgtggcggaacgcacgttggactcgaagcggtacagcgaataggagatccacagcggcaggacctgcgggatgaccccgaagatgacctcctgcagggcgctggcaccggtggcgcggacgccttcgaccggaccggggtcgatcgcctcgaccgcctcggcgaagagcttggcgagcaccccggtggtactgatgaacagcgccagcacgccggcgaacgggcccaggccgacggcgaccacgaagagcatggcgaagaccatctcgttgatcgaacggcaggcatccatcacccgccgcaccggctggtagacccaccagggcacgatgttctcggaagccaggatcgacagcgggatggcgcagacgatcgccagcaccgtgccccagagggcgatctgcacggtgaccagcatctcgctgaggtagagcttccagttgccgaagtccggcgggaagaagtcggcggcgaaggtcgccatgttgccggcgtcgcggaacagcacggccgggttcatttccgcgcccttccaggaccaggcgaggatggcgaggaacaggccccagccgaccaggcgtccccaggatggcttgccggtggcggccgccgcggcagtggtgctcagagtgctcatatcgggaatctcgacagcggtattggcgaatcgggtggggcgcggcgccggccgcgcccggggtggatcagccggcgttggcggcggttttctgctcgcgctcggccatgcgtttctccagcttggccagctcctcgtcgagggccttcagcttggcggccttctcctcggcgccgaggttggcgttgttcgccacgtcggtgcgctgcttga

SEQ ID NO: 11596 - DNA, 834 bp, Pseudomonas aeruginosa
tgctgcgccggcagcgaggcgaatcgtaggctgatctcccctgcccagcccggagtgtttcccatgcatccctatttcagcctcgccggccgcgtcgccctggtcaccggcggcagccgcggcatcggccagatgatcgcccagggtcttctcgaagccggcgcccgcgtcttcatctgcgcacgtgacgcagaggcctgcgccgacaccgccacacacctctcggcctacggcgattgccaggcgatccctgccgacctttccagcgaagccggtgcccggcgcctggcgcaggcgctcggcgaactcagcgcgcggctggatatcctggtgaacaacgccggcaccagttggggcgcagcgctggaaagctatccggtgtccggctgggaaaaggtcatgcagctcaatgtcacctcggtgttttcctgcatccagcaactgctgccgctgctgcgccgctcggccagcgcggaaaatccggcgcgagtgatcaacatcggctcggtggcgggcatcagcgccatgggcgaacaagcctatggctacgggccgagcaaggccgcgctgcatcaactgtcgcggatgctggcgaaggaactggtcggcgagcacatcaatgtcaacgtgatcgctcccggacgcttcccgagccgcatgacccgtcacatcgccaatgacccgcaggcactggaggcggacagcgcgtcgattcccatgggccgctggggtcgcccggaggagatggcggcgctggcgatcagcctggccggcaccgccggcgcctacatgaccggcaacgtgatccccatcgacggcggttttcatctctga

SEQ ID NO: 11597 - DNA, 534 bp, Pseudomonas aeruginosa
cgcccccgaccgctcgcctcgtcccgccatgacccacagcgtttctcccatcggctacatccgctcctgcttcatggagaagttcgccatcccgcgccagccgctgctcgcgccggcggcgcgggggaccctggaactgctgccgccgttcgaccaggtggaagcgctggaaggcctggagcaggtcagccatgtctggctgctgttcctcttccaccaggccctggaagacaagccgcgactgaaggtgcgcccgccgcgcctgggcggcaaccgctcgctgggagtcttcgccacccgcgccacccatcggccgaacggcatcggccagtcggtggtgcgcctggagggcttcgaagcggggcgcctgtggctttccggaatcgacctgctcgacggcaccccggtactcgatatcaagccctacgtaccctacgccgacgccgtggccgacgcccgcaacggcatcgccgacgcgccgccgccgggcatcgccgtggagtggagcgagcaggcgcggcgccaggcccatga

SEQ ID NO: 11598 - DNA, 2187 bp, Pseudomonas aeruginosa
ccagtagtagatggaacctatgcgcgcccttcgtttttccgccggatcgtggcggtgtgtcttcgcctggatgctcctgctggtcggcctcgccgcccagggtgccgaactcagcgagttggagcgcctgcgcatcgcccaggtattccccgcggtcgagcggatcggcgaccccgaaggcgactacggcgtacgccgcctgagcaagggcgaggaaaccctcggctacgccttccagaccctcagcgtcaccgacatcccggcctactccggcaagccgatcaacctgcaggtgatcctcgatccgcaggcggttatccgcgacgcctacgtcctcgaacaccacgaaccgatcctgctgatcggcatcccggaagagaagctgcacgccttcagcgccaggtacgacggcgtgcgcgccgaccagcgggtggtggtcggccgctccagcgacccgcaggcggttaccgtcgacgcggtgagcggcgccacggtgacggtgatggtggtcaacgagatcgtcatgcgcgccgcacatacggtggcggtttccctcggcctgatcgaggaccgcggcaatgtgcggcccaagccggcgcaggtgcgccagcaaccggcagcgacggcgagctggagcgaattgctcggcaacggtgcgatccgccgcctgcagttgagtcgcgggcagatcgacgacgccttcaagggcagcgaggccgaaggcatcggcgaagccgacgcggcgcaccgcgacgagccgttcatcgatctctacagcgccctgctcaaccctcccgcggtgggccgcagcctgctcggcgacaaccagtaccgcgaactgatggcgtcgctgaagccaggcgaatacgccttcgtcgtgctcggcgacggcgagtattccttcaagggttccggctacgtgcgcggtggcatcttcgatcgggtccaactgcgccagttcggcgacatcatcagcttccgcgacctcgactaccagcgcctgtcggacgtctacgccgaaggcatgccggagttccgcgagatggcgatcttcgtcgcccgcgccagccagcgtttcgatccgggctcgccctggaccctggagttgctcgtgcggcgccagaccggcccggtggcgggggtattcaccagcttcgagctggcctgccagacgcccgaggaatacctggagcggccgcagccaacggccgaggaactggccgccctggaagaggctgcccggccgctgtggctgcgggtctggtaccagaagagtttccaggtcggggtcctctgtaccgccctcgtcctgctcctggcgatcctcttcctccaggaccgcctggtgcgacggccgcgcctgatgcagcgactgcgcaccggctacctggcgttcaccctggtctacctgggctggtacagcctcggccagctatcggtggtcaacgtgctgaccttcgtccacgcgctgttcgaaggcttccgctgggagctgttcctcagcgacccgctgctgttcatcctctggacattcaccgcagccagcctgctgctctggggccgcggcgtgttctgcggctggctgtgcccgttcggtgcgctacaggaactgctcaacgaactcgcgcgcaagctccgcgtgccgcagttccaggtgccgttcgccgtgcacgagcggctctgggcgatcaagtacatcatcctgctggtgctcttcggtctctccctggaatccctggcgctggccgagcaggccgcggaggtggagccgttcaagaccaccatcaccctcggcttcgaccgccagtggtggttcgtcgcctacgccgtcgcgctgctggtggtcaacctgttcacccgcaaggtctattgccgctacctctgcccgctgggcgcggccctggcgatcccggccaaggcgcgcctgttcgactggctcaagcgccgcgcggaatgcggcaggccctgccagctctgtgcccgcgaatgcgagatccaggcgatccatcccgacggccgcatcgaggccaacgaatgccactactgcctcgactgccagatgacctaccacgaccaggacaagtgcccgccgctggtgaacaagcgcaagaagcgcgcgaagagcgcgccggcggacaacgcgcggatacccgcggagaacctctgacctggctccctttcccctga

SEQ ID NO: 11599 - DNA, 495 bp, Pseudomonas aeruginosa
gtactacgggttctggagcggcggacattccggcgaagtacgcgtgctcggcgtgccgtcgatgcgcgagctgatgcgcataccggtgttcaacgtcgactcggccaccggctggggcctgaccaacgagagcaagcgggtcctcggggacagcgcgcgcttcctcaacggcgactgccaccatccgcacatctcgatgaccgacggcaagtacgacggcaagtacctgttcatcaacgacaaggccaacagccgggtcgcgcgcatccgcctggacgtcatgaaatgcgaccgcatcgtcaccattcccaacgtccaggcgatccacggcctgcgcctgcaaaaggtgccgcatacccgctacgtgttctggcaacgccgagttcatcatcccccatcccaacgacggctcgaccttcgacctgtccggcgacaacgccttcaccctgtacaacgccatcgacgccgagaccatggaagtggcctggcaggtga

SEQ ID NO: 11600 - DNA, 2367 bp, Pseudomonas aeruginosa
cccacggcttcgtcatggtcaaccacggcgtctgcatggagatcagcccgcaacagacctcgtcgatcaccttcgtcgccgataagcccggggtgcactggtactactgcagctggttctgccacgccctgcacatggaaatgtgcgggcggatgctggtggaaaaggcttgatccacgcagcgcggtcgctggccgggcgccgggcggggccgctcctcgccctgctcctgctcggcctcgccacggcccgcgcggagccggtcgacggcctgccgctgcgggccgacggcgatggccgctggagcctggcggcgggccgctacgccggcaacttcgtcatcgaccggccgctgcacctacgctgcgaggccggcgccgaactggacggcggcggccacggcagtctgctgaccctgaccagccccgggatcaccgtcgagggctgccggctgcgcaactgggggcgcaacctgaccgaactcgacgccgcgatcttcgtcggcaaggccgccagcggcgccgtgatccgcggcaacgacctgcgcggcgcgggattcggcgtctggctcgacgccacggtgggcgcgcaggtgctcgacaaccgcatcgagggcgacgaaagcgtgcgctcccaggatcgcggcaacggtatccacctctatgcggtgaaggacgctctggtccgcggcaaccgggtcagccacacccgcgacggggtctacatcgacacttccaacgacagcagcatcgaagccaaccgcttcgaggagctgcgctacggcgtgcactacatgttcacccacaacagccgggtgaccgacaacctgacccggcgcacccgcaccggctacgcgctgatgcagagccgcaagctgaccgtgaccggcaaccgctccatcgacgacgagaactacggcatcctgatgaactacatcacctactcgaccctggccggcaaccgcgtcgagggcgtgcgcagcggcagcaccggcgacgcgatgatttccggcgccgagggcaaggcgctgttcatctacaactcgctgttcaaccgcatcgaaggcaacagcttcgccgacagcgccctgggcatccacctcaccgccggctcggaggacaatcgcatcgccggcaacgccttcataggcaaccgccagcaggtcaagtacgtcgccagccgcgagcaggagtggtccgccgacggccgcggcaactactggagcgactacctgggctgggaccgcgacgacgacggtctcggcgacgtcgcctacgagcccaacgacaacgtcgaccggctgatctggctgtacccgcaggtacgcctgctgttgaacagcccgagcatcgagctgctgcgctgggtccagcgcgccttcccggtggtgcgctcgcccggcgtgcgcgacagccatccgctgatgcggatgcccgccgcggagccgaggccgtgagcctggtcgagatcgacggcgcgaccctgcgctacggcgccctcaccgccctgagcgggctcgacctgcgcctggagcccggcgaggtgctcggcctgctcggccacaacggcgccggcaagaccaccaccatcaagctggtcctcggcctgctggcccccagcgaaggccgcgtgcgggtcctcggccacgatgcgaggagcctggaggcgcgccgccagctcggctacctgccggagaacgtgaccttctacccgcagctcagcggcgcggaaaccctgcgccacttcgcccgcctcaagggcgtggcgccggccgaagccgcgcgcctgctggaacaggtcggcctcggccatgcagccaggcggcgcctgaaaacctactcgaagggcatgcgccagcgcctcggcctggcccaggcgctgctcggcgaaccgcgcctgctgctgctcgacgaaccgacggtgggcctcgacccgctggccaccgtcgagctctaccaattgctcgaccgcctgcgcggccagggcaccgggatcgtcctttgctcccatgtgctgcccggcgtcgagacgcacatcgaccgcgccgcgattctcgccggcggccgcctgcaagtggccggcagcctcgccgaattgcgccgcaaggcggctctgccgacccgcgtgcgcctggccagcccgcataacccgcagtggctcgaacgctggcaccgggccggcctggcggcgcggagactggacgaccagcgcatcgaggtactgctggacgatgccgagcgcgacggcgtgctggaagcgctgctggccgcgtgcgagttcgacctggaaatcctgccgccgtcgctggaggacctctatcgccaccacatgtcccccgcccccgccggagccacgccatgcccgtag

SEQ ID NO: 11601 - DNA, 711 bp, Pseudomonas aeruginosa
tcaacctgtccggcttcgacgcagccgccgccggcggggtggttcccctggccagcgacctgccggtgtccgccagcgccctctggctggccctggccctctgggccggcgctgccctggcgctggcccacggcctgttccgccgccgccccatctgactcacgaggttccgccatgcaacgtcataccctccccctgcgccctctgctcggcacgctcctgctcggcctgctgctggccggctgcgatgcgtcgcgggacgacgccacggcactcggcccggtgccgatcgccagcggcgacgaatgccacgtctgcggcatgctcatcgaggaaatgcccggtcccaagggcgagtcggtgcttcccggcgcggtgcgcaagttctgctccaccgccgaactgttcggctggtggctgcaaccggaaaaccgccagggccaggcgcgcctgtatgtccacgacatgagccaggccgactggcggcaccccgacgacgcccgcctgatcgacgccacccgcgcctactacgtggtcggcatccagcggccgggcggcatgggcgccaccctcgcctcgttcgccgacgaagaggccgcgacgcgcctggcggccgaggaaggcggccgggtactgcgcttcgacgagatcgaccaggcggtgctgcaaggcgtgggcggcgaccacccgcaccggcacccggcgcactga

SEQ ID NO: 11602 - DNA, 393 bp, Pseudomonas aeruginosa
gcgtgggccggaaagcagaaagcccctgccgcggatacggcaggggctttcttcgcctggcgcgacgaggcgcggcggaggcctacttctcgacgaaggcgcgctcgatcaggtagtcgcccggctcgcccatgcgcggcgagatcttcaggccgaagctgtcgagcacggcgctggtctcttccagcatgctcgggctgccgcagatcatcgcacggtcgtcctgcggattcatcggcggcaggccgatgtcctcgaacagcttgccgctgcgcatcaggtcggtctggcggccctggttgcggaacggctcgcgggtcaccagcgggtagtagatcagcttctctttcacctggtcgccgaagtactcgtgttccggcaggaccttggtga

SEQ ID NO: 11603 - DNA, 1281 bp, Pseudomonas aeruginosa
gaacgcgctcggtgtacagattgctcatcaaagactcctaggaaaacgcgggcgcacaccaacagcagcagacgtgacgcagttgcgcggcattttatcggttgccaaaatatccgcaaaatgaattgtctggataatgcttatccagaatatggatatgggataacacgatatcggtcggccgccggccgccgagggctcccatcgctcccgcggacggggcgcaaggataaccgagccaaccccgccgacggaacggcaaaatgtcgcggggcctttcgctctagacgaggaagcctggatgaaattcaccctccgccagctcgaggtgttcgtcgccgtggcccagcaggagagcgtctcccgcgccgccgaggggctgtcgctgtcgcagtcggcgaccagcacctcgctcggcgagctggagcggcagttcgactgcaagctgttcgaccgcgccggcaagcgcctgaccctcaatgccctcggccgccaactgctgccgcaggcggtggcgctgctcgaccgcggcgaggaaatcgagaacctgctcaacggcaagaccgccttcggctccctcgacctcggcgccaccctgaccatcggcaactacctggccacgctgctgatcggcgccttcatgcagcgccagccggactgccgggtgcgcctgcacgtgcacaacaccgcccaggtggtgcagcaggtcgcccactacgagctggacctgggcctgatcgagggcgactgccggcatccggacatcgaggtgcaaccctggatggaggacgaactggtggtgttctgcgccccccagcatccgctggcgcggcggggcggcgccgacctggaacggctgacgcgggaggcctggatcctccgcgagcagggctccggcacccgcctgaccttcgaccaggccatgcgtcatcacccgcggccgctgaacatccgcctggagctggagcacaccgaggcgatcaagcgtgccgtggagtccggcctgggcatcggctgcatttcccgcctggccctgcgcgacgctttccgccgcggcagcctggtgccggtggaaacgcccggcctggacctgcgccggcagttctacttcatctggcacaagcagaagtaccagactgcgaccatgcgcgagttcctcgacctgtgccgcagcgagaccgccgggatcagccgcagcgacgagatcgtgctgccgctgattccctgactcagttggccagggacaggttgccgtcgcggtactggcggtacgaggtatag

SEQ ID NO: 11604 - DNA, 1023 bp, Pseudomonas aeruginosa
ggtgctgcacggccttgcggctaccggccaccatcaccgtgccggagaccccgacacccttgtccagcggggccaacccggcccacaggagaaagccgacgaagccgagcagcaccagcccccagccgagccgggaaaaacgcttctcgtccagttccagcgccgcgccgccggcgccgacttcgcgcaaccgcgcctgcccgctcatcgcgccgctcctcccggcacaccgccgaccggcatccccggtcccggccggtagccgaaaccgaacgccggcgtcggccgtgtcggcgccggggccgcagcggccggcggcgaggcgctggcaagcacctcggcggtcgcgccgaaacgctgcaggcgcccgccatgcagcaacaacagcttgtcggtcagcgccagcaccgccggcttgtgggtgaccagcaccaggctgctgccgtgccggcgcatcgccgcgatggcctcggccagggccgcctcacccgcctcgtcgaggctggcattgggttcgtcgagcacgatcagcgccggtcgcccgtacagcgcgcgggccaggccgatgcgctggcgctggccgccggagagtccggcgccgccgtcgccaaggcgcgtgtcgtagccctgcggcaggcgcagcaccaggtcgtgcacgccggccaggcgcgccgccgccaccaccttctcggcatccacctcggcgaagcgcgcgatgttctcggcgatgctgccggcgaacagttgcacgtcctgggccaggtagccgatgtgcggccccagtgccgccgcgctccagtgccgcaggtcggcgccgtccaggcgcaccgcgccggacagcggctgccaggcgcccaccagcaagcgcgccagggtcgacttgccggaaccggacggcccgatcacgccgagcgcttcgccaggttccagggcgaaaccgaggtcctgcaacaatgcctgctcgcgtcccggcgcggccgcgcagagccgctcgacgcgcaacgcgccgcgcggcgccggtag

SEQ ID NO: 11605 - DNA, 1314 bp, Pseudomonas aeruginosa
cggcatgcccagggcggccggcggattctcctcgagcagccgcgccagtcgctggtaggcctgccgcgcgccgctccactggcgccagaccgcgatcaactggtcgatggggctgagcacgcggcccatcaggatcgagccggcgatcatcatccccggggtgatcaggccttccaccgccagccaggcgccgaggccgagcaccagcgactgcagggccaggcgcacgcccttggaggtcgcgccgatcgccgcgctgcgctcgctgccgaggttctgccgggcaaggaaggcctggtgctgggcgaaccagcgcgcgcgcatggccggcaacatgcccattgccgccagggtttccgcctggcgcaggttggccgaggcctgctgggtggcgaggatcgacagttgcccggcctcggccagcggttcgcgcgagcggctttcgttgacccaggcaagcagcaccagcagcagcgccccaaccagggcgagcaggccgagccagggactgaagaggaagatcaccagcaggtagagcgggaaccagggcgcgtcgaagaaggcgaacagggcgttgccggtgaggaactggcgcaggctggtcaggtcgttcagcgcctgcccgacggcctgctcgccgtgctccaggctggcgcggaacgaggcgtcgtagatgcgctggttgagttgcatgtcgagctggccgccgaggcggatcaccaccaggctgcgcacccactccagggcgccgagcagcaggtagaggccgagcaccatgagggtcagcatcagcagggtcatgtggttgccggagccgagcacccggtcgtagacctgcagcatgtacagcgacggcgccagcatcagcaggttgatcaccgcggtgaacagcgcgacgctgcgcagcgccgggcggaagcggccgagggtggcgaggatttcattgcgcggcgaggccggccggagcttcatcggagtcgggtcctgtgggtgtccgggccgcgagcgggcccggaggacattgcggcagtctccacttgccgggcacggccggcggaggaacaatccgggggccgccgtcgccacgggtgcgaggcgcagcgacggcggttcgtgcgccggagaggagcgccaactcctctccggcctttagcgcaagcagtccacgaacgctatcgtggacagttgctcaggccgccagggccaggtcgtgcggcagttcctgcacgccgaccacgccgacctccgccgctgccgcagccggggtggcatgggcgacgccggccgcggccaactggtcgaaggtggagttga

SEQ ID NO: 11606 - DNA, 408 bp, Pseudomonas aeruginosa
agtggtcggccagccaggtcacgccggcgtcgcgttcgctccaggcgctgcccagggccagcagcaccgccgccgccgcggcccagccgcgccaccccttgcgccgccccccggcgcggcgcggcgcgctggcaaccggcgtctgaaccatcgtccgcggttcggccagcgatcccagctgtttccaggtccgttgcgccagcgccagcgcggccgggtgccgggggtcagccgccagccagccgtccagcgcttcgcgccgggaccggtcgaggtcgccgccgtccaggcggatcgcccattcggcggcctgctggcggatctgctgttgttcctgggggctgttcacgtgcggctctcgttggtcgttatagaggttcagacgcgcgaaccggcaagactcggtaa

SEQ ID NO: 11607 - DNA, 1161 bp, Pseudomonas aeruginosa
aggaggaacaggtggaagaactcggcatcttcatggcgaagaaccgcgacgccttcgcccgcgccttcaagaaccagccggacgccctcaacgaactgttcgaggaaaacgccgcggacgaatgagccgccgctgcaagcaaagcgcaaggagccgaaacatgccgcgacaacttgccggcctgctgtgcgtcctcctcggcctcgccggcgcccctgccctcgcctgcccattccgggccacggacgccgagacaccggcagcctctgccggcgccgcgcaggtcctggccctgggcggcaccggcagactgcaactcgacctgcaacgggcccccgccaccctgctgcacagcggcgacctgctgatcgctcgctacgccgagggtcattacctcgcccaccgcctgctcgaaggcaacgagatgggcgcggacgagggcgaacggctcgaccttccgcgacaggttcgcctgctcttcggagccctgccgctggacggcctgcccgacgccgagcgcgagcgtctccaggcgcagcgccaggccctcggcctgtgcgaccggcgcgccagcgtcagccgctaccgcgtggccggcaccgaggtctatcgcctgcgcggcagccaggccggcaagccctaccacgcgctctacctgctcgacggtccccaggtgcactacctcgacagctccggcagcgacgccttcgtcgaacaactgctcgccagcctgcgacgccgctgagtccgcgcggcgcttgtccgacccgcgcccggcttgccggaaactggcgcttgccgtacaacgcccggcagccccatcgaccaggaaggtcccatgcccgctctccccgcctcccccgtccgctcccgacgctggcgcctggaccggcgcagcctgctgctggcactgctgctgttcggcctgctggtcctgctcgccaccctgggccggcattggggctggatacgcagcttcggcggcgacctgctggcgttggtctggctctactacctgatgggcagcgcgctcagggcgccggccgcctggctggcatccgccgcctttgccgtcggcgcgctgctggaactgggccagtacctggcggcgcaactgcattggcaattttccagtcccgtgctgcgcatcgttctcggtag

SEQ ID NO: 11608 - DNA, 1314 bp, Pseudomonas aeruginosa
agtgcttcatggtcgtctccccttggctcaggcgtagccgagcacggtgtcgcaggccgccaggatgtcctccacggcgggcatgtacagcgcttccaggcggtacagcggcggcgggatatcggccgcggcgacccgctggatcggcgcccgcaggtcgaacaggacacgctcgtagaggctcgcggcgatttccccgccgaggccgccactcttcggcgcctcatggacgatcacgcagcgaccggtcttgcgcaccgaggcttcgagggtgtcgaggtcgagcggcttgaggcaggcgacgtcgatcacttcggcctcgatgccgcgctgcgccaggcgctcggcggcctgctgggtctcgtggacgctggcgccccagctgaccagggtcaggtcgccgccttcgcgaagggtgaagcaactgtccagcggcaggcgccgggcgtcgtccgccagcggctgcgggttcatccggtagagccgggtcggctcgaggaagatcaccggatcgggatcgtcgatcgccgccaggagcaggccgtaggcccgcgccggcgacgacggcaccagcacgcggacgccggggatgtgcgcgaacatcgcctcggtcgcctcgctgtggtgctccggcgcgcggatccccgcgcccatcggcgtgcgcagcaccaacgggcaggccaggcggccgcgggtgcgattgcgcaggcggctggcatgggacaccagttgctccatggcggcgtagatgaagcccatgaactggatctccatcaccggcttcaggccctgggcggccatgccgatggacagcccggcgatcatgttctccgccagcggcgtatccagcacccgcttgaagccgaagcgctcgcgcaggccgagggtggcgcgaaacaccccgccgttgaccccgacgtcttcgcccagcaccaccaccgtctcgtcctcggccatggcccggtgcaacgccaggttgaccgcctccagaacggccaggcgtgtcgcttcgccgttgcgctcattcatgttcggcccctccccgccgccgcgcggggcgctcccagaattgctcgcgctgctcctccaggaccgccgggcagcgcgcgtagacatgctcgaacaatgcctgcggcgcctgccccggctaacgtctcgaaacgctccaccgactcctgcacccgcgcctggcactcccccaccagcgcgtgctcgcgctcctcgtcccactggccgcggccggcgaggaaggcgcgcaggcgcttgatcggttcctcgcgccaggcctggttgacctcctcgggggaacggtag

SEQ ID NO: 11609 - DNA, 2274 bp, Pseudomonas aeruginosa
ccgctccgccagctccaggccgctgcgcagggtctgctgggcctggggcaattgtccggagaggaactggcactcggcgatacccatgcgcacttcgcaaagcagcgtctgccgcccctgcgcctcgagaatggcgagcagcccgcgcagccgcgcttcggcggcggctgcctcgccgctgtagagttcggccagtgccaattggtgctctacccgcgcttccagctccggttcggagggcggcgacaggcgcgcccgtcccggctggaagtaggcgcggacccgcagcaggatctcccgcgcctgcgccggccgtccctgctgcagggtcagggcggagctgaccagcagcagcgcgccgcgatacagcggatcggggacatggcgctgctgcatcagccgttcgacctccagcaggcggttgaacgccgcgtccaggtcgccctgcccggcctccagcaaggccagtcccaggtagccgtagagcgcccagggatcgagattctcccgtgcctgctccagccccagccgataccagtgcccggcctcgacctcgcggccctgctgcaggcacaggcgcgcgcggcgcagggcgatccggccgagcatcgggctgccctgctggccgaggtcctccaggtagcgctgggcgcgatcgaggacgccttccgcgcgcagcagttcgccgcgctgctccagccactgcgcccgctccagttcgatcagcgcctcgaagatcaggctgtcgtgctcgcgcgccaggcgcaaggcatcgcggccgatcaaccgcgcctggtccatccgcccctcgattatcgccagttgcatcagcgccgagcggcagatcagtccctgcgaccaggcgtcctccggcagttgctccagcgcctcgcgcaggtagtcggcggcgccgcgctcgccgcggcagtgcaggaggatcccgaacaagccctgccattgcgccagcagcacccgctggcgggacgccgagggcatcggcaggaagcgcgccaactggccgatgcagtcctcggcttcggccaggcgtccggcgtagagcagcgtccaggcattcaggatcaccaggcgcggcgtgctggccagcagcgccgccggcagttcgtcgcgcagggccaggaccatgccgatgttgtggccgtgcagcaattgctcctcggtgagcttctgcaacaatccggcggcggtttccggttcgtcggcggccagcgcctggtcgaccgcctcgcgggtctcgccgtgttcggcgaaccattcgcaggcttcccggtggaagtcccgctgcgggcgctgcggcgcttcgcgccaggcctcgcggatcgccggtggcaggctgtagcgctggttcgcatcggccagcagggggaagccccgcgccaacaggtcgtccagcccgtggggcagctcctcgaacagccggcggaacagctccggaccgacttgcggcagccaggccagggcacgcgcggcgtcggccagcggcggcggcagctcgtcgagcaactcgtgctggaggtattcctgcaacaacggtccggccgtctcttcgccgaccagcaggcgcaagcgcaacgcggcgcaccaaccgccgctgcgttccagcagcgccccggtcgcagcggcatcggcgctgcgaccgtgcaggcggagcagttcggcgacctcgtcggcatcgaacgccagcaggccgccgtcgacctccagcaactccccttccagcagcaaccgcgccaggttgcactgcggccgccgccggctcgccagccaccagcccacccgtggcgaggccgcgctcaacaagcaatcgaggcaggcgtcaaaggcggggtcggggtgccgtgggtaatcgtcgagcagcagccacagcgcggatgcgttgcgcaaccgccggcacagctgcgcttcgtcgctttcctcgggcaagccgagggcgccggccaggcggcggcggaaggtcgcggggtccagcgcttccccgcccagcgccagccagaccacctgcacgccaggcggcgcccgccgcgcgcattctccgaggaggacggtcttgccgctgccagcgggcgcgcagagcagtcgcaggcggcattcgccgcgcagcagcggctggtgcaaacggggccgcggcaggtgctgcggcggcagccgcggcaaggcggcgggcagctcggtcggctcggtcatggcagtgctcttgttctgtcgaagcgccttgccgggagcctagaccgcgcctgccccgctgctgaacgatga

SEQ ID NO: 11610 - DNA, 927 bp, Pseudomonas aeruginosa
acaggggccctggaaagcgcctcggcgaacgccatatgcaggatggatacgccgtcatccagtgcatggatgacagcgcggcactgttccgccggcggcggcgatggcatccttcgctgcatgcagcccgaacagaccattcccgccgaccgcgatctcgccgacgccacccgcgagacggtcatgcgttatcacctcagctggaagcaccgcgacatcgacgcggtgatggcgctctatcatcccgaggtcgaatacaacgacttcttccagaaccgccggatgcgcctggccgatctccgcgagtacgtcgaggcgaccatgcccaagggccccgacgagtcgctggagcacaccgaccgtatccgcttcgacggcgataccgccttcatccagtaccgcctgcgggtgaccctcagcggccgcctggcttcgttccgcgccagcgaggcgatcaccgtgcgcgacggcctgatctggcgcatcaacgaatacgcctcgctggtccacgaaagcggcggcggagcccaggccggcggcgacggccggccgccggccagccgcctggggctttcggccaagcagctgagcctgctggcacgcgacctggagcactacttccagcaggcccagccctatctcgatccggacctggacctgacccaggtggccaatgccaccggctatacgcgcaaccagatttcctacctgctcaaccaggtgctcggcctgagcttctaccagtacgtcaaccagacccgcctgcaacacctgctcggccagctttccggcgagctgcccggacgggtcgacgaactggccttcgccgccggcttcaattcgctgtcggccttctaccgctgcttccgccagcacaccggccagtctccgcgcgaatacctgaagcgcctgtcgtcgcgccgctga

SEQ ID NO: 11611 - DNA, 1497 bp, Pseudomonas aeruginosa
gatttcccagcggacccgcgcgcacgacaggcgcacggcatcttcctactctcgccgcattcccccttccctctcgctatggagccctctatgtcggcctggcgccacctcagcctgtggatgaatcaactggacgatccgctcgaagcgcgcccgtccctggaagaatccctcgaggtcgacgtggccatcgtcggcgccggctacaccggcctctggaccgcctattacctgaagcgccgggcgccgcagttgcgcgtcgccatcgtcgaggcagaaaccgccggcttcggcgcctcggggcgcaacggcggctggctgatgggcaacctgctcggcgaggacggcctgctcgccggcttgccgccggagcggcgccgggccggctacgacctgctgcacgggattcccgacgaagtcgcgcgggtgctgcaagaggaaggcatcgactgcgactaccgcaagggcggcgtgctctactgcgcggcgcgctacccggaacaggaacgccgcctgcgcgcctatctgcatgatctctatgccgaaggcctggacgaaagcgactaccgctggctgaggccgcaggaactcgaccagcagttgcgcatccccggcagctacggggcgatccattcgccgcactgcgccaccatccagccggccaggctcgcgcgcggcctggcccgcgcggtggagcgcctgggcgtgcggctgttcgagaagagccgggtgctgcactggcaacgcggcctgctgcgcaccgagcgcggcgaactacgcgccgaatggatcgtgccggcggtggaaggctatgccgccagcctgccgccgctgggccactaccagttgccggtgcagagtctgctggtggccaccgagccgctgccgtcgtcggtctgggcggagatcggcctggagcgcggccaggccttcagcgaattcagccgccaggtcacctatggccagcgcaccgccgacgaccgcctggccttcggcgcgcggggcggctaccgcttcggcggcaagctgcgcagcgacttcagcctcgacgacgaggaagtcggcctgcgtcgctacctgttcggcgaactcttcccgctgctcaaggacgccaggatcagccacacctggggcggcaacctcggcatggcccggcgcttccgcccgcacatgttgctcgaccgcgccagtggcatcgccctctccggcggctacggcggcgaaggggtcggcgccagcaacctcggcggccgcaccctggccgcgctgatcctcggtgaggacagcgagctgctgcggcagccctgggtgctgggcgagcgtccgctggacagcctggcccgctgggaaccggaaccctgccgctggctcggctacaacgcgatcatccgcagtttcgtccatgaggaccgggtccttgccgacccgcacagcgcgccctggcgccgcagcctggcgcaaaccctcgcggccggcatggaaagcctgatgcgctga

SEQ ID NO: 11612 - DNA, 864 bp, Pseudomonas aeruginosa
gaatcccctccacctcccacagaggaaaaaccgcatggccctgacccttctgaaaaataccgccggcgccgatcttggcgccgccagcccggtcgcggtgccccttggcgagccggtcgcgcagacccgcgcctacgccgtggagcgcaccgaccaggtggaaaccggcatctgggaatgcacccccggacgctggcggcggcagatcgtcgagcaggagttctgccacttcctgcaaggccgctgcaccttcaccccggacggcggcgagaccatccgcatcgaggccggcgatgccttgctgctgccggagaacagtctcggcgtgtgggatgtgcaggaaaccgtgcgcaagagctacgtgatcatccaccgctagcccgggcggcgcgacggcgtcactcgaagcgcccgtggcgcccctcgccgtccttgaagcgctgcgcgccctccagggtctcgccgctctcgatcaccgccagcccgccctggaattcgttggccagggccacgtcgaaggacagttcccactgcgcatatacgctggcgcggtcggcgagcatgcaggtctgcgggaaggcggcgagttccgccgccagctcctcggcctcggctcgcgccgaaccgctcggcaccacccggttggccaggccgatctgcaacgcttcgtcggccttcaccggacgcccggtgaggatcaggtcgagcgcccggccctgcccgacgatccgcggcaggcgcacgctgccgccatcgatcagcggcaccccgaaacgccggcagaacactccgcagatggcgtcctcggccatcacccgcaggtcggcgagcagcgccagctccagcccgccggccaccgcatag

SEQ ID NO: 11613 - DNA, 882 bp, Pseudomonas aeruginosa
aatccagagtgcggccgcgcctccgccaggcctccaggggaatgccgggcagcgccgcggtcactggcggtagcccgggttctgctggtcgagcttgcgcagcagcgccggccaggcgagctggccgcccatgccggtcttgctgcgcatcaccccggcgatcatgtcgcgcgcgccggcgaggatctgccccgggatgtggatcagctcggcgccgccgctctgcgccatcacctgtacctcgcaggcgcgttgcagggtgaacatcatgaggaaggtatcggcgatggaaccgccgcaggtgagcaggccgtggttgggcaggatcaggaagttgctggtccccaggtcggcctgcaggcgggccttttcctcatggttcagggcgacgccctcgtaggcgtggtaggacaggctggagagcacgaacaacgattgctgcgacagcggcaacaggccctgcttctggcaggacaccgcgatccccgcggcggtatgggtgtgcagcacgcactcgacgtcgtggcggacctcgtgcaccgcgctatggatggtgtagccggccgggttgatctcgtaggggctgtccatcagcttcttgccgctggcatccaccttcaccaggctggaggcggtgatctcgtggaacatcaggccgaacgggttgatcaggaagtcctcggtgcccggcaccttggccgagatgtgggtgaagatcaggtcgtcccaaccgtgcagggcgaccagccggtagcaggcagcgagatcgacgcgggtctgccattcggcggcggagacctgggcttgcacatcggcgggcagggagtgaacggcggtcacggcggcatcctcttttgtcgttatcggatgcccgcagtctag

SEQ ID NO: 11614 - DNA, 417 bp, Pseudomonas aeruginosa
gcccgactggtgccggcgccgtgcgcgccgacgccgaacagcgcgccgcgggccagcggcgtgcgcaagcgcaggacgcgcagcagggtgccgccgatcaccgcgccgaacaccccggtgatcatcacgaaggcggcggtcagttccggcacgccacccaggtcgtgggacatctccatggcgaacggcgtggtgatcgagcgcggcagcaacgacagcgtgacctggccgtccagcgccagggcctgggccagcgcccaggagctgccgatggccaccgcggtgccggcgaacatcccggccagcagcgccggccagtggcgcatcagcagctcgcgctgctgccagatcgggatggcgaaggccaccgtcgccggaccgagcagcgccaccagccaattggtgtcgcgggcgtag

SEQ ID NO: 11615 - DNA, 534 bp, Pseudomonas aeruginosa
cagcgcgccgtagtcgagcaggctcatcagcgccgggatgaagaacagcaacatctccgccagcaacaggccggcgccggcctgcagccaggccggacgcagcaggccgctggcgaacagcagcaacagtgccgccaggccgaccaccccgcccggcagcggcaggccgatggccttcgccagccagccgccggcccaccagaaggcgatgagtaccgccagttcggcggcaaggcgggacagacggcggacgagcgggggcaacatgggaaaggccttggctgggaaatcggggatggagaaaggataaggcccggcctatcatccccaaagcgaattgtccgcatgagagccattccagaatggaattccgtcaactccgcagcttcgtcgaagtggtccgccagggcagcttcacccaggcggctcaggtccgccacgccagccagtcgaccatcagcaagcaggtcgcccaactggagcagagccttggcgtgcaggtattggaacgcaacgggccgcacgtgcgcctga

SEQ ID NO: 11616 - DNA, 555 bp, Pseudomonas aeruginosa
ccgacgccggcgccgtggtgtttcgccgcgccgaggagatgctgcggctgcgccgcgacctgctcagcgaattggacgacctcagccagctcaaccgcggcgaactgcgcctgggcctgccgttgctcggtgccgacgcgctgttcgcccaacgcttcgccgaataccggcggcgctatccgaacatcgccgtgcacctggtggagggcggcagcaagaccatggagcaggcggtgctggccggcgagctggaattggccggcagcctcaccccggcagacgacggcttcgactaccagccgttctgcaacgaaccgctggacgtgctgctgccggccgggcatcccaaggccgctgccgccagcgtcgccctcggcgaactggcggacagcccgttcctgctctaccagcagagcttcaccctcaacgaccgcctgctgcgcgcctgcctggaggccggcttcagcccgcgcgaaggcggccgcagcggccaggccgacttcctcggcgcgctggtggcggccaaccagggagtggtgctgctaccacgagtga

SEQ ID NO: 11617 - DNA, 906 bp, Pseudomonas aeruginosa
cgccgccagctccgcgacctgccgcgaggcggccaggctgcgctgggcggcgagggcgtcgtagtaggcctgggcggcgagggcgaaggtgttctgcagggtcgcgtcctggctggcgttggccgccagcagcaactgctgggcgttgcgcagggcggcgctgcggcggccgaagtcgaacagcacccagctcaattggaggctggcgccacgccggtggcgatggccgtcgccggagaggtagggggcatcgcgataatccatgtcgctgtagccgcgactggcgtcgagacggccgtccaggcgcggcaggtaggcggacttgccgatcccgacctgggccgccttggcattggcccaggcgaggcgggtctgtgggtcgtggcagaggatccgctcgatggcttcctccaggctcagctcggtcggtggcggcccgccgcggcagggcaaaccgctgccgccgaggtcgtagaccgcctggccggcgacctggccgacggtgccgaacacgtccggctcgtaggcggcggcgccgggaaccaggccgagcaggccgcacaacaggccggcgagggcacgcatcaggcctgctcccgcgccgcggcggcctggcgttcggccaggcgcgcggtgctttcgtcgaggcttaccttgccctggccgaggactatcacgcggtccgccgaggcgatggtctcgggccgatgggcgaccatgacgcgggtgatgcgcagcgcgcgaatggcggcgttgacccgctgttcacagtgtacgtcgaggtggctggtggcttcgtcgaggaacaggatgcgcggcttcttgtacagcgcccgggccagcatcacccgctgcttctggccgccggagagcaccgtgcccatgtcgccgaccagggtgttgtag

SEQ ID NO: 11618 - DNA, 3180 bp, Pseudomonas aeruginosa
cccatcggcatggcctggatgtcatcgtggatggcagccatctgcgcgcactggcgccagccagggcatgtccggttgcgggtcaaaaaaactgatgttgttcggttgagcgaaccggcgaacagcacgtcgtcctgcagcaccgtgccgaccagttcgcgcagcccttccaggcccaattgcgcaaggtccaggccggccatggcggatctgttccccccctggcgggaggatgcccagcaggacgttgaacagggtgctcttgccgcagcccgaggggccgacgatggccaccgactcgccgccggcgatgcgcaggtcgaggccgtcgaggacccagggctcctgttccgcgtagcggtagcgcaggccctggatctcgatgctcgcctcgcgctcgcgaaggttcttcgggaggatgtcgccgtggctgacctccggggcctggagcacgatgtcggccaggcgctcgccctgcaactggagcatgcgcagctcgaagaacttgtcgatcaggctgccgacgcggctgtcgaactgcgacttgtaggcgttgaaggccatcaggatgccgacgctgaactggccgtccatcaccatggtcgcgccgagccagatcaccagcaggttctccacgccgaacagcaggccgttgagctgctggtagaacagttgcagcttctgcgtacgcaggccggcgttgatctgttccaccagcaggccgagccataccgagcggcgctcgtcctggcgctggaacagcttcagcgggcggatgccgcgcaccgtctcgaggaaatggctctgctggcgcgcggcgtggacgatctgctcctcggtggcgttgcgcaacggccggtaccagatccagcggccgagggcgtagaggctcatggcggcgatggcgatggccgccagtggcggactgtagagcagcatcatgccgagggtggcgacggtcatcaggccgtccagcaccgccgagaggaaggccgcggtgagggtctgctggatgctgttcaccgcgccgaagcgcgacaccacgtcgcccaggtggcgcttctcgaaatactgcgcgggcagccgcagcaggtggctgaagacgttggcctgccactgcacgccgagcagggtgctcatgtgcatcatcacccaggcgcgcaccccgctgaccgcctgctgcatcagcagcaacaggccgaagccgatggccagggtgctgagcaggtcacggtcttcgctgacgatgacgttgtcgatggtccattgcaggaagaacggactgatcagcgagaacacttccagcgcgccggcgagcagcagcacctgggccagcgagcggtacagcccggtgaccttgccgagcatgcccagcagcttgatccgcggcggcgcctcctgtttctcgaagccgctctccggccagagttccagggctaccccggtgaagctccgcgagacttcctccaggcccagccggcgctggccgtgggcggggtcgtggagcaccgcgccgcgcccgtcgaccgccttgagcacgacgaagtggttgaagttccagtgcagcacgcagggcagcttgagcttgccgaggtcgccgaggtcgagcttcaccgcgcgggtacccaggccgaggcggtgggcggtctggatcagttgcttgagggagatgcccttgagcgatacggagaagcgccggcgcagttccatcaggccggtatggtggccgtggtagccggcgatcatcgccaggcaggccaggccgcattcggtggcttcggtctgcagcaccagcggcaggcggcggcccaggcgcagggcgagagcgtcgagaaaggccatgggtcgttcctagagtttgccggtcaggctgtagagcggttccagcacccattcgtagaggcgccgggtgtcctggaggatgtcggcgtccagcagcatgccgctctgcagcggacgcggctggccgtaggcggtcaccgcctggtcgtcgagggttacccgcagccggtacagctgctcgccatcctggccgagccccggtacgccgccgaccatgctggaaagctcggcataggagacgctggcgcgggagatcgactgcaccttgccgtggtactggccgaacttctggtacggataggcctggtagcggatcagcaccgcgtcgcccggccggatgaaaccgatggacttgctcggcgcgtagagttcggcctgcaacggggtgtcggcgggaacgatgctcagcagcggacgcgagctgtcgacggtctgcccggcttcggcgagcacggcggtggcgatgccgctctccggcgcggtgaccagcaaggtgcgcttggcttcgctttcggccaggtcctgctccaccgcgctgagctggcggcgggtttccgcgagctggttggcctggcgcgcggaaagcccggcgagttcgttgcggcgctcggtcaactgctgccgcagcgacgtgcgttcgcgctccaggccttgcagcgtctggcgctggccgagcagctcggcctggcgctgctgcaactggtccatggagatgtagcccttgtccatcagcccctggtagcgcgcggcggcgtcgctggccagcgccagcaggcgttgctggctgtcggtctgggcggcgagggtggtgagttcgcgctgcaggctggcgaccttgctggtcaggctgtcgcgctcgtcgtcttgcaggcggcgaagcttttccagttcgtcgcgcagggagtcgcggcgttgttccaggcgcctgctgatgccggcctgcaccggcccggcatcgctgccgtagcgttcgctggaaagcaccatcaggcgctcgccgcgtcgtaccgcctggccttcctggacgaacttgcgcagcacgatgccggcctgcggcgcgtgcaccttgacctggccgctggcgggcaccaattggccgctgacggtgctgcgcttggtgtagctgccgaacaggaagaagcccaccaccagcagcgccatcgccgcggccagcagggtgagaaaagtgaaggagaccgggcggatcagcacgatctcgcccaggccgccggcatgctgggcgtcgagggcttcctggcgaaacatggtggctggatcctggattcgaataatacttgcatgacactccgacacccttgcgaaagttcaaacgcatga

SEQ ID NO: 11619 - DNA, 1344 bp, Pseudomonas aeruginosa
ggcggtagatgcgtcgctgcattcccgaaccgcccgaggcggcggtccggtgaactccctcccaacctgtctcctcgggcatccaccgtgccaaaggagatacccgtgtccgtcccgacccatcagcaagacctgatcgccctgctcgaagagcgtggcttcgtccaccagtgcaccgaccgcgacggcctcgccgcgcacctggctgccggtccggcaaccgcctacctgggcttcgacgccaccgccgacagcctgcacgtcggccacctgcagggcctgatgctgatgcgctggctacagaaggccgggcaccgcccgttgctgctgatcggtggcgcgaccacccggatcggcgatccgagcttccgcgattcgagccggccgatcctcaccgaggcgcagatccaggccaatatcgacggcatcgcccgggttttctcgcgctacgtcgaactgcacgacgacagcctggtgaacaacgccgaatggctggacggcgtcggctacctggagttcctcgaccgggtcggccggcacttctcgatcaaccgcctgctgaccttcgacgccatcaggcagcgcctggaccgcgagcattcgctgtcgttcctcgagttcggctacaccctgttgcaggcctacgatttcgtcgaactgtcgcgccggcgcggctgcaccctgcaactcggcggcgccgaccagtgggcgaacatcatcaacggcgtggagctgtcgcgacgccagggcggcgcccagctgttcggcctgaccatgccgctgctggccaccagtgacgggcgcaagatgggcaagtcggcgcagggtgcggtatggctcaacgccgagcgcctggcgccgttcgacttctggcagttctggcgcaactgcgatgatcgcgacgtcggtcgcttcctcgccctgttcagcgaactgccgatggatgaggtgcgccgcctgggcgccttgcagggcgccgagctgaacgaagcgaaggtggtcctggccaatgccgccaccgccctggcgcacggcgagcacgccgcgcgatccgccgccgatgccgcgcgcggggtgttcgccgacggtacgcgggacagcggcctgccggtgatgaagctatcccgcgcgcgcctggcgcagggactgtcgctgaccgacctgctgctggaacacgcgatccagccctcccgcagcgcggtccgccgcctcgccgccggcggcggcctgcgcctggacggcacgccggtcagcgatccggacgcgccgctggcgggcgaggtcgacgggctgcgcctgagcctgggcaagaagcagcatttgcacctgcgactcgaggattga

SEQ ID NO: 11620 - DNA, 294 bp, Pseudomonas aeruginosa
tgctctgggccggctggcgcgcgttgttcgtggtcctggcgctgttcgccgggctctgcctgctggcggtctggcgggtcgccgaaagccacccgccggagcgccgcggcggcagcctggcccaggcctttctcgcctatgggcggctgctcggcgaccgtcgcgcgctgggctacgtgctgtgcatggggctggcgttcgccgggatgttcgcctacatcagcgccgcgccattcgtgttcatcgagcatttcggcgtgcgcgcggagcgcttcggctggttcttcggcctga

SEQ ID NO: 11621 - DNA, 573 bp, Pseudomonas aeruginosa
tggccgtctgcggcgtcggcagcctgctcgcgctgggcttggccctgcacggcggaaaccgttgatttccttctgcatacccgcatgcagcctgtgttttttccgctactcttctgcactttcgaaaccagtcatccaagctcggaccctatgtcaacgccaagaccctccctgaccctgaccctgttgcaggctcgcgaagccgcgatgagtttcttccgcccctccctcaaccagcacggcctcaccgagcagcagtggcgggtgatccgcatcctgcgccagcagggcgagatggagagctaccagttggccaaccaggcctgcatcctgcgcccgagcatgaccggcgtgctggcgcgcctggagcgcgacggcatcgtccggcgctggaaggcgcccaaggaccagcggcgggtctacgtgaacctgacggaaaagggccagcagtgcttcgtctccatgagcggcgacatggagaagaactaccagcgcatccaggagcggttcggcgaggaaaagctcgcgcagttgctggaactgctcaacgagctgaagaagataaagccctga

SEQ ID NO: 11622 - DNA, 519 bp, Pseudomonas aeruginosa
ctgccgaggagtgccagcgggtcgccgagcgcttcgtattgccgcgctacctgccgccggccgacggcgagctggcctacggcagcgcccgtgcggccgatccgaccttcgcccgctgggcctcgcgcaacgtccaggcgcacaaggtgccgggctacgcctcggtggtgctgtcgaccaagcccggcgccagcgcgccgccgggcgacgtcaccgcggagcagatggaacgcgtcgccgattgggccgagcgctacggtttcggcgagatccgtgtggcccacgaacagaacctggtgctccccgacgtgcgcctggagaacctccacgcgctgtggcacgaggcctgcgcagccggcctcggcacgcctaaccaaggcctgctcagcgacatcatcgcctgtcccggcggcgactactgcgcgctggccaacgccaagtcgatccccatcgcccagggtatccagcagcgcttcgaggacctcgaccacctgcacgacatcggcgagcttagcctga

SEQ ID NO: 11623 - DNA, 975 bp, Pseudomonas aeruginosa
gcacgcgcccgtcggcgatcttgcgctcgacccaggcgcgctggatggcgtaggcgtcctcgatggcgatgtccgggtagtcgagggagaactgccttacctgctggcgcgagcgttcggcggcgtcgaggcggttggcggcttcctggatcagacggggatcgagcatggtcggggtctctcggttcagcgtgggtagaccacggcggcgggggtccgcaggaccaggccggcgccgagggcgatgaggatggccagcaggtacagggccaggctggcgctctgggtggtgtcgcgcatccagccgatcaggtagggcgcgaggaaggcggcgatgctgccgaaggaactgatcagggcgattccggcggccagggtggcgctggaaaggaaggccggcggcagttgccagaacatcggcagggcggcgctggcgcccatcccggcgatcaccagaccgcccatcaccagccaggcgctggtcggtgccagggccgccaggctgagcccggcggcggccatcagcaacggaatgcccaggtgccagcggcgctcgcgcaggcggtcggaggaacggccgatgaagatcatgaaggcgcagccggcgagatagggcaccgcgctgagcatgccgatgcggctgtcctgggcgatgccggcgccatggatcaggctcggcatccagaacgcgatggtgttcaccgccagcatcaccgcgaaatagatcgccaccagcagccacacctgcggattgctgaagatgccggagaaggaggtgatggtcttgcgctgctcctcgccggccagttcctcgcgcagcaggtgcttctgttcgtcgctgagccacgtcacccgttcgaagctttccggcagcgagcaccagaccaccacgccgagcaacacaaccggcaggccttcgatcaggaacatccactgccagccgcgcagtccgagggcgtcatggaagccttctag

SEQ ID NO: 11624 - DNA, 561 bp, Pseudomonas aeruginosa
tcgtgcttgccgtcggccatgcgccaggtgtccaggcgcacgccgcggctgcggatgccgccgagcgggaaaacgccgctggcgccaaggcaggcgtggaccttctcgaacaggccgggcaggtcggcttcggcttcgatgttgtcggtgtattcggcgatgaagtgcggcatggtggcgtcctcagaggcggctggcgcaactggcgccggccgggttgccggcctgggcggcggggatcgccgagccgtcctgggcggtgaccgggaataccgcgttgatctgcccggtgccggaggagccgaagtagggcgtcaccacctccgccttgccgtcgtaggccgaccagccgagggcgccgaggagcatcgcggtgtcgtgcatgaagccttcgccatggcccttggaggcgtactccgggagcatcccgcagaattccgcccagcggccttcctgccacatctgcacgacttcatggtcgaggacctcgaggaacgggctccagatgcggtcggagaagtccggcgcctggccgttctgggcgaagcggtgggacagtga

SEQ ID NO: 11625 - DNA, 618 bp, Pseudomonas aeruginosa
gccgctggcgaggaacgccaccgtgccgtcgtagtgctcttccaccgccttgcgcatggcccagcccaggcgcgcgctgtcgttcaggtaatgcacggtgcacagggcggagaccgagaccaccttgaagtggcggtcctggttcatgtagcgcatcggtaccagggtgccgtactccgggccgagggtggtggcgtcgtgggccagggtctccacgccgagcgcgttgcagccctcggcgaggatgcggcccagctccgggttgccggggaagccgtactccatgttggcgatgaagtgcggcaactcgttgctggtgtagagcccctcgaagtgcggcgcgcagttgatgtggtagccggcgttgaccagccagtgggtgtcgaacaccacgatggtgtcgacccccagttcgcggcagcgccggccgatctcgcggtgcccgtcgatcgccggctggcggcagccgtggcgcgggccgggcagctcggacaggtacagcgagggtacgtgggtgatcttggcagccagagcgactttgcccatgacgattctcctggtggcccgttgggcctggcagcgggcgcggccgttggcggctggcccggattcttctga

SEQ ID NO: 11626 - DNA, 243 bp, Pseudomonas aeruginosa
gaggccaggccgtattccacgtcgttggccaggcgcagcgcctcggcttcgtccttgaacgggatcaggcagaccaccgggccgaagatctcctcctgggcgatgcgcatgcggttgtccacgtcggcgaacaccgtgggctggatgaactgccccttgctcaggtgcgccggcaggccggccggacgctccaggccgccggccaccagggtggcgccttcctcgaggccgatgcggatgtag

SEQ ID NO: 11627 - DNA, 423 bp, Pseudomonas aeruginosa
acgagatctgctaccagctcggcttcaaggacccggcctacttcagtcgtttcttcgtgcgttacgcggggctcacccccagcgcttaccgccagcgacaggccgacggggagtcccgtcgctgagcgggtgggcgggtatactcgcgctcccactcgaacaggaagcgtttctccatgcatgatgcagccacctccatgccgccgcaggctccctccacctgggccgactaccttgccggctaccgctggcgagggcagggcgaaggatgttccgcggccactgtccaccgcctggaggttgcgcggcggccgaccctgttcgtcaagcaggaagtgctgtccgcacatgccgagctgcccgccgaaatcgcccgcctgcgctggctgcacggtgccggcatcgattgcccgcaggtgctga

SEQ ID NO: 11628 - DNA, 2136 bp, Pseudomonas aeruginosa
caaggaaaatctcgaatttatctgtcgccggcctggcaccggggaaatcctgccactagccgtggacgaaaagatccggcatcggctgggataatcgactcttctcctgatatcgttgcgtttccgccggatgctcggccagtcgaagggaggaacgaagcatgtcgtatgaacagtccagcagcgtacctagcgactttctttcctcctttttccaagagcctgtcatccatgatcgaactcagaaccatcacccgcgacgattgggaaacctgcattgacctgaaggtcgcccgccaccaggcgcacttcgtcgcttccaacctctattcgctggcccagagccgcttcctgccggggttccgcgcggtcggcatccaccacggcgggcgcatggtcggcttcgcccctctacggccccgacgccgacgacggccactactggctctaccgcctgatgatcgaccgccgctaccagggcaaggggcatggccgcgccgccctgcaacggatcatcgccagcgtgcgccggacgaggcggcgcagcgatcgcctgatggtcgcctacgccgtcgacaacgatgtggcccgccagctttatcgggatgccggtttcgtcgaacagggcctcgcgccctggggcgagacgatggcctgcctgatgctgccggagccgtcccatcgctccgggaaggtcgccggagcgccgggcgggcgtgcagcgcacggcgtcccggcgtagaatcgcgggattcggcagttccctccaatacctataacgaccatccaacgcacatcgccgccccggacccttgcgtccggggcgttttccgtcgtgcgtggcgagggtcgcgggacctgcccgtccgccccctgctccggaaccgaacgccccatggacagcacctccgaaacccgcagcggcagctggctgagcgtgatcgccctggccctggccgccttcatctacaacaccacggagttcgtcccggtcggcctgctcagcgacatcggccacagcttcgagatgcccacctcgcaggtcggcctgatgttgaccatctatgcctgggtggtgtcgctggcctcgttgccgatgatgctgctgacccgcaatatcgagcggcgcaagctgctggtcggggtattcctgctgttcatcgccagccacgtgctgtccgggctggcctggagcttccaggtgctgatgctcagccggatcggcattgccttcgcccacgcggtgttctgggccatcaccgcttcgctggcggtgcgcgtggcgccgccgggacagcaggccaaggcgctagggctgctggccaccggcaccaccctggcgatggtcctgggcatcccgctggggcgggtggtcggcgaggccctgggctggcgtaccaccttcatggccatcgccggactctcggtgctgaccctgctctacctggcgcgctccctgccgctgctgccaagccagaactccggttccctgcgcagcctgccgatgctgttccgacgcccggcgctggtctgcctgtacgtgctgaccgtggtggtgatcagcgcccagttcaccgcgaacagctacatcgagccgttccccaagcaggtggcgcggatgagcggcgaggcgaccaccctgctgctgctgttgttcggcggcgccgggatcttcggttcgatcttcttcagccgatacagcgaggctttcccgcgaggcttcatgctggccgcgatcctagtcttgggcagcagcctggcgctgctgttgccgctgtccgcgcagccgacctggctgatggcgctcagcctgctctggggcatgtcgatcatgtgcttcggcctggcccagcagtcccgcgtcctgcgcctcgcctcggacgccaccgacgtggccatggcgctgttctccggcctgtacaacgtcggcatcggcgccggcgcgctgctcggcagcgtggtcagcgaacgcatgggcctggcctcgatcggcaacgtcggcgccgtgctggcgctggccggcctgctgctcgccctgttcgccgcactgcgctacgcggaggcgctgaaaagcacgtcgttgtgagcggtcatacctggggtcggatgattcggcggaggaatccgcccgcttga

SEQ ID NO: 11629 - DNA, 606 bp, Pseudomonas aeruginosa
ccggcgaggtgctggccgggttgcccatcgacaacgcggctatccacctcgaactcagcgacgtcaccggcgacggcgctgccgtgcccttcttcgtcaacggcgccgcggcgccggctcaacgcctgttcggccacatgctgcggcgggagatctacggtcggcactggcagatggcgttcagcgcactgccgctgttcgtccagcgcctgcaccagccttcgccgcgcatcctgttcctggccggcagcctggtcagcctgttgctggcggcgctggtcaacgccagcgccctcggccgcctgcgccggcgtcgggaggcggcgacccaggcgcggctggcggcgatcgtcggcaattcggcggacggcatcatcggcgtcggcctcgacggcgtcatcagcgactggaatcgcggggccgaggcgttgttcggctaccgcgaggagcaggcggtcgggcggcgggtggtggacctgctggtgccgccatccaaggagaacgaggaactcgacatcctcgcccgcatcgcccgtaaagaacaggtggtcagcttcgataccgtgcgccggcaccaggatggccacctgctcgacgtggcggtga

SEQ ID NO: 11630 - DNA, 486 bp, Pseudomonas aeruginosa
gcagggcgtaggcgacttccgggcgcttctccaggccgcggcggatggcggcggggatcgcctggcgggtcttgcggcagagccccggctgctcctcgaagcgcatgcggatgccgcgcatgctgcgcacctcgccgaaggccggggcgatccgcaggcggatgcccagttgttcctccatgcgccgcagcaggtgttccaggtcttccaggctgcgcagggcttccaggcgagcggccaggcgctgctcttcctggcgggtcaggaggaggatgcgacggtccgcgccgggcgcctccaggcgctcgcgttcgcagacgcaggcgccgggcgggcagggctggcggaggggcggggaagcgctcatggcaccatcatagccaggaccggcgtcccgcgccgctacgctccgtcgccctcgcgagcgcgcttcagcgcttcagcggcaccttgccctgctgctccaggccgctgaggatggcgtag

SEQ ID NO: 11631 - DNA, 909 bp, Pseudomonas aeruginosa
aaaaatttggagcagagattggttcgaccccatttgccgctgaacgccctgcgcgccttcgaagcttcggcccggcacctgagcttcacccgcgcggccatcgagctgtgcgtgacccaggcggcggtcagccaccaggtgaagagcctcgaggagcgtctcggcgtggccctgttcaagcgtctgccgcgcggcctcatgctgacccacgagggcgagagcctgctgccggtactgtgtgactccttcgaccgcatcgccggcctgctggaacgtttcgagggtggccactaccgggacgtgctcaccgtcggcgcggtcggaaccttcacggtcggttggctgctgccgcggctggaggacttccaggcgcgccatcccttcatcgatctgcgcctgtccacccacaacaaccgcgtcgacatcgccgccgaggggctcgactacgcgatccgcttcggcggcggcgcctggcacggcaccgaggcgctggcgttgttcgaggcgccgctgacggtgctctgctgcccggaggtcgccgcccagttgcacagtcccgccgacctgctgcagcacaccctgctgcgctcctaccgcgccgacgagtggccgctgtggttccaggcggccggactgccggcgcacgcgccactgacccggagcatcgtcttcgacacctcgctggccatgctcgaggcggcccgccagggtgtcggcgtggccctggcgccggcggcgatgtttgcctggcaactggccagcgagagcatccggcgtccgttcgccaccgaagtgagtaccggcagctactggctgacgcgcttgcagtcgcgggaggagaccagcgcgatgctggcgttccgggggtggttgctggagatggctgccgttgaggcgcgggggagataa

SEQ ID NO: 11632 - DNA, 1698 bp, Pseudomonas aeruginosa
gcgtcactcccaggctggcggcataggcccggcgtgccgcaacgatctcgctctcgagcatgcctgctttccctgctgcggcaacgacggcaagttcgcataggcggccagccttcctcggggaaaccctcaggtcggcgcctgcggaccacagggcaagcaacgctttggatggagcacagccatttctgctgtgctcttcgattgtctccaggagcggacacatatggcctcttgaaaactgtcggcggattgccagcagtatcgacgatggtgcgcttaaagcaacgcggagcaggcggagattgcggcgaagcggcggataacgcttcgcgttatgcgccctacgggagcggtgctcggcttgcgggcggaaggcgtctacggatttccggttcccgcgtcgaaataagagcccgtggacttggccagtcccgtccacatctcgtcgagattgcggaagttccaggtttccgccggctcgaagccgacgattcggtcggtctgtccggccctacccaggtctaccacctgctgcgggatcggcaccttcgagcgggccgagaagaataccttgacccgtggcgtcagcagcgagcggccgtgttgttcgaggaccacgccgaggcgcccgctttccagcctgaccagcgcgccgaccgggtagatgcccaccgccttgacgaaggcgcggaacacctgcgggtcgaagtgcccgttccattcggccatgcgtcggatcgcctcggcggcgttccagcccttcttgtagggacggtcggaggtgatcgcgtcgtagacgtcgcacaccgcgcccattcgcgccagcaggctgatctgctcctgcgccaggccgaaggggtagccggtgccgtcgatgcgctcgtggtggtgcaggcagacatccaccaccagggcgctgacctggcggcaatcgagcagcatccgcgcgccgttctgcggatgccggcgaaccaggccgaactcctggtcggtgagcttgccgggcttgttcaggatcggatcgggcaccgccatcttgccgatgtcgtgcagcagtccggccagccccgcctcgcgtaccagcgggtcgggcagttcgagctggcgggcgagggcgatcatcagcgcacagaccgccaccgaatgcatgtaggtgtattcatccgaggtcttcagccgtaccaggctgagcagcgcgttgggatggcgcagcaccgaggcggagatttcgtccaccaggtccgatgcatgcgcggtatcgatggcctggcccatgcgcgcgtcgcggaacatgctgaccacggcggccttggcacggctgcagagcagggcggcgtggcggatttcctcctccagggcgacccgcgccggcgaagggccggccggcatggtgaccggcaggaccgcagcggccgagaccgccgcttcctccgggaggtcgaggcccttgctggcatcgatccagacttccttcacggcgctttcgcgcaggcgctgcaggtcggcctggctgtcgagcaggaagccacctcttttccagaacgggtggtccagccacgagccgcaaaggctctggacgaacataccgaggcgaagctgggttaccggaatgcgtttcagcacgatgggctcgacctcgagactgggccaggtggctgtctcctaacggtagccgagatgggccggcgggagtga

SEQ ID NO: 11633 - DNA, 720 bp, Pseudomonas aeruginosa
gagatgcccggcacttcgtcggcatgcccgcgctcgattgcgtatcgctttgtatccatgcgcggtttcgatacctccggcgtacaaatccaagtgtcgggcgatacacccccgatacatctcccaggcgaaatggccacatccgaaccgcggcgcccgggacgaccccagaaggtcccgccgcccggttcgtaccggcgcccaccagcgccgcgcctgcggcccggccgcgtttactgtggagaagaagcatgtccgttttcgattcgcgtcaaaagacttccgccagcctgctcggtgccgtactggtggggggaatgctgctcggccgttcggcgttcgccgtccagccgttggggcatgggctgcaactggcggcggcgatcgcccgcgaatgcccatgcggagaaaggcaagtgtggtagcggcggctccgcgaagaccccggccaaggccggcgccgagggcaagtgcggggagggcaagtgcggcgacgcctcctttgcccgaaccgacaccgatcacgatggcaaggtctcgcgcgccgagttcctcgcggtggccaaggaccgtgccggtgagttcgacagcatcgatagcgaccatgacggcttcatttccgaagccgaggcctacgaacacctgcgcaagacctacgaggccaacggcaagccgatgcccgccgggctgttcagcaagctggagcaaggccggcactga

SEQ ID NO: 11634 - DNA, 909 bp, Pseudomonas aeruginosa
agcccggcgtctgggccttgctcggagccgcctatcgtcgtttcggcgtgcgcccgaccctgctcgagcgggacttcaactatccgccgctgggcgaactgctgctggaagtggagcagatccgccaatggcaacgcgacgagggacgccgtcatggatgagcgcctgcgccaacagcagttcagcctcgcccggcacctgcgcgacccgcttggcaatgcgccgccgccggacatcgaagaacgtcgcctgcgggtctaccgcgagctgttctacaacgccatcgaaggcctccttgccagcggcttcccgcgcttgcgcgggctgcttggcgagcagcagtggcatggcctggtgcgcgagttctatcgcgaggagagaagccatacccccctgttcacccgtatcgccggggtcttcgtcgactacctgcggcagcggggcgagtatcggccggcgtggcaagccgagttggcccacttcgaatggagcgaaacgcgcctctacctggccgagcccgacgatccgccgtatcggcgtgaaggcgacctgctcgacggggtgccgctgctgtcgagcctggcgctgccgctgggctatcgctggccggtgcatcggctcgaagaggacgtcgcgctcgccgaagcgcctgcggaaccgaccctgctgttgatgcatcgcgattcttcgcatcgcgtgcataccgcgcgcctgactccgctggcctaccgcctgctggagtcgctggcgagacggcgcctgagcgggcgcgagcacctggcggcgctggcgcttgaggcgcggagtgcgcccggagcgctcgacgcggcggggctggagttgctggcagcgttgcggacccagggtgtcgtgctcggaaccctggaacgcgattgggcgggcggatga

SEQ ID NO: 11635 - DNA, 1941 bp, Pseudomonas aeruginosa
tcaggcgccggccagagcctgcacggccggttgtcgcgcgggcggtgcatggggcgccggcttgccgaggatcaggtcggcggccttctcgccgatcatgatcgccggggcgttggtattgccggtgatcagcgtcggcatgatcgacgcatcggccacccgcaggccttgcaggccgtgcacgcgcaactggtcgtcgaccaccgcgagctggtcgtggcccatcttgcaggtgcccaccggatggaacacggtgcccaggttggcgcggatccaggcctcgatctggccgcggctggaaacctgcgggcccggtaccagctcgcccttgaggtgacgggcgaagctgcggctggcggccagtttgcggaccagttggaaaccctggaccagggtatcgaggtcggcagggtggctgaggaagttggcttcgatcagcggccggtcgtgcgggtccggcgagttcaggcggacccgcccgcggctctgcgggtgcatcaccgcgacgtgcaggctgaccccgtggccgaaggggaccaggcgctgcggctggttcttcagcgcgggggcgacgatcagacccagctccggggtctctgcctgcgggtcgaggcggaggaagccaccggactcgacggtgttcgaggtcagcgccccgcgccggccgaacaggtactgccagggcgagcgcagcagcggcagccagcccttcggcgagaagcccaggccgtagccgagcttggcctcggtgcggtacatcagcacgatgtcctggtggtcctgcaggttctcgccgaccccaggcaactcatggcgctggacgatgccgtggcgcgccagttccgccgccgggccgatgccggagagcaacaggagctgcggcgagttgatcgagccggcgctgaggatcacttcgcggcgtgcctgcaattgcacgacctcgccagcctggctgatctccacgccggtggcgcgggtaccttccagcagcacgcgcagggtcagcgccgagctgagcacggtgaggttgggccgcgccagggccgggtgcaggaaggcgcgcgccgcgctacagcgttcgccgttgacctgggtgacgtggaacgggccgatgccttcctggcgctcgccgttgaagtcggcgttgtacggccagcccatttcctcggcggcctggaagaacacctggttgatcgggcccgggctgcgctgcgcggcgacgttcaattcgccgccgcgcccgtgccagggcgattcgcccggctcgaaatgttccgagcggcgaaagtagggcagcagctcgtcgtagctccagccacggttgccgagggatgcccagcggtcgtagtcgtggcggtcgccgcggatgtagatcatcccgttgatcgcgctggagccgccccagaccttgccgcgcgggcaggcgatcggctggttggcggtgccgggctgggcggcgaagcgatgcatccagttccacttcgggttggcgatcaggcggatgatcccggccggcgtgcggatgtaggcggcggggagcggcgtgcggtcgctggggccggcctcgaccaggcagaccgagacggcgggatcggcggaaagacggttggccaggacgcaaccggcggagccggcgccgaccacgatgtagtcgaacgaacggcgggcagtggaagtcatgtcggcacctttctgggtgtgctgccgggcctcgcccggcgttctttttcgccccgcgcccatgggcgcgacgctactccattggacggggaagcgcgcccggccgcttgtcccagcctgccggcggggttgaccgaggctgccaggcggcgcgctacagccccagcagcgagcccatgtcgaccatcagttgcaggccgacgacgaaaccgtctccgctcagttcgcgagcgccggggttgtagtagttgtccgggttga

SEQ ID NO: 11636 - DNA, 1419 bp, Pseudomonas aeruginosa
ccagcacctgctggccggcgtagatatcgtgttggaaaaccatcggcgatcgttccttcaggcgtcggccagggccgggttgggattgaccagcaccttgacctgcgacttgtcgcgcagcagggcctcgaaaccgtgctcgacggcctgctccaggggcacgctgcgggtcactgcgcgggccaggtcgaggcggccgtcggcgagcagggcgatcagctccgggtaggcgtcgcggtagccgacgctgccgagcaggcgcagttcgcggttgaccaggtcgaaggcgtccagccggacctcgcccatcaggctcaccagcaccagctcgccacccttgcgcaggctggccagggcggcgtcgaggctggcctggctgccggcggcctcgaaggcgcagtcgagcgcgccgccctcgcgcaggcgcgccgccgtgtcgccgtcgcgggcgtcgagcgcccggctggcgccgaactccccggccagggcgaggcgctcgggactgacgtcgatcgcgacgatgtcctcgattccgcgcaggtgggcgagcatcaccagcagcaggccgatcgggccgagcccgaacaccgcgcagcgctggcccggcgccaggctgctgcggcgcagcgcgtgcagggccacggcggccggttcgagcacggcggcctggcggaagcccaccgcgtccggcaggcggtgcagcatgtaggccggcacccgcgcgcgctcggcgaagccgccgtcgcccatcaggccgatgaagcccatcgactcgcagaggttgtagcggccttcccggcagtagcggcattcgccgcagcggtattccggctccaccgcgacgcggtcgccgatgcgcagtccctccacgccagggccgagcgcggcgaccacgccgcagaactcatggccgagggtcagcggcgcgcggcaaccggacagcgggtgcgcctcggcctggggaatcgagtgcgggccgctctggtattcgtgcaggtcgctgccgcagatgccgcagtaggcgacttccagttcgacttcgccgggccgcggcgcctggtgttccagttcgctcaggcggaggtcgcgggcagcgtgccagcgcagtgctttcatggttggtttccttgcaggacggaggtaggcgcgctgcgctggcgcgccagcacggcgggcgcggtttcgcgcaggaacagcgagaggaacgcggcgagcagggcgccgccgcaggacatccacatgacgatggacaggccgaagcggtcggcggcgaagccggccacggtcggcgcgaggaaaccgccgaccagttcgccgaggcccatgatcaggccgagggcggtggcgatgacgccgcgcgagacggtctccgccgggatggtcgccatgaacagggtgaagcagccgagcccggtgtag

SEQ ID NO: 11637 - DNA, 1545 bp, Pseudomonas aeruginosa
cggggtgccaggcgcctcgccgaccgaccgcgacaggtcggcggagcggcccggcgcctggccccggaggccttgcctgaggtccgggaggtccacgcagcgttcgacgagaagaataaaaatgcccgcacatgccttgctcgaaacccggcgggccagcacccaggacattcccctggagcagcggctggcgttctgggaggactacaacgcttccatcctggttggcctgaaatgttcgtcgtattcccaggccggcttcgccgcgacccaggacaacctctgcctcgaacgcctgcggctggcccgcatcggcggcaacgagcacgtggtggagcgcgaccgctcgatgatccgcgcagtgcccaaggagtcgatcttcgtctctctggtgcagggcagccagtcgttcttctaccaggacaacggctgcaacctcctgcaaccgggcgagctggttatctaccggaccgacaagccctacctgttcggtttttccggaccgatgcggcagttcatcttcgacattccccaggacgatttcgccgagcgctgcctgcgcgacttcaagggaccgctgaagatcggcgcggaaagcccggtgcagcgcctgctggtgcggaccctcggcgagcgtacccgggatttcctcgacagcccccatggcgaggatgccgagcgctaccaggaggaagcctacgacctgctggcgagcatcatcagcgaccatgccggcgagcaccgtgccagcgccctgggcgcgtcctacctgctggcgggcaagcagtacatccagcagcacctcgacgaacccgccctgagctgcgagcgggtggccgccgccactggcgtctccagccggcacctggcgcggctgttcgcccaggaaggcagctcgcccgggcgctacctgcaggagcggcgcttggagcgggcccgccagttgctcgcttcgccccagggccggcgcctggatgtcgccgaggtcgcctatcgccacggcttctccagccaggcgcatttcgcccgggccttcaaggcgcgctacgggatgacgccgagcgaggcgcgtggccgctagacccgactaccgtacctttcctcctcctactgccaaggacccgttccgtgaccgacaagaaagagcagatcgcccgtttcatccagcgcgaatttccccagacccgggtcgtggtcgaagccgtcggcgagcgtagcgccacggtctggcaggcggtcgacgccagcgacctgcgccccggcggcacggtctccgggccgaccctgatggccatcgccgatgtcgcgctgtacgtggcggtactgggcgagatcggcatcgtcccgctggcggtgaccaccagcctgaccatcaacttcctgcggcgtcccgcggcggaccgccgggtggtcgccgagtgccgcctgatgaaggtcggcaagaccctggcgatgggcgaggtctcgctgttctccgaaggcgacgcggaaccggtcgcccatgtggtcggcacctactcgatcccgccggcgcaccgccgctga

SEQ ID NO: 11638 - DNA, 660 bp, Pseudomonas aeruginosa
actggcgatgagattggcgttgggcaggctcatgaggcgtctccgtggttgttcttcggggtcagagatcgagttccaggtagttgccgcggcagcgtgatacgcagatcagcaaggtttccccgctggcccgctcggtgtcggaaagcacatggtcgaagtgctccggctcgccggcgcagacgcgtgtctcgcaggtcctgcatatcccggcgcggcaggcgtagggaggctccaggccctgttcctcgaggacttcgaggatgctctggtggctttcgacgcgcaggctcagggcgctgcggcgcaactccaggcggaaggcgtcggtgccgccggacgaggacgccggcgctactggagcgtcgaagcgttcgaagtgcaggcgttccgcgcagccgctcccggcgtcgcggatggcctgcatcaacccgtcgggtccgcagcagtagagttcttcgtcggcacctaggccggcgatcagcgcggtactgtcgagtgggtcgccttcgtcgctgcaatgcagccgcgtccgttcgccaccgagcgtcatcagttcggcgaggaaggctgcgcgctggcgttcgcggaccgcatacagtaggcgccagtccttgccctgcgcctggcaccagcgaaccatcgagagaatcggggtga

SEQ ID NO: 11639 - DNA, 927 bp, Pseudomonas aeruginosa
cgctcctccagtgccggcctgtccccccagaggtggacagcgggtttaccggcgtccgtcgcggttgctaacgtgtcggtcgaggcctggacaggacctgcccttcctcacccattacaacaagaacaacgatgcgtgcccgcaaccatgatcagcttctggaatgccccgccggggtcgccgtcggcggacctgcgccccttcgtcgagctggcctgcgccttgggtggcgaaggcttccccgccgctctgctggaaacccttggccattgggttgccgcccgtcatttcaacgtgctgcgcatcggtgcaccgcgccccgaactgctcctggccggcactcgccatcgcgacgcgcaactagtgtggcgctgctggcaggcctattcgcggtactaccacagccatgacccgctgttcctgcgcatgcagcgccagcgccgcggcccggtgccgctgctgggccacctgctggccgaggacatcgagttcgatgcttaccgcgaggcgatctatcgggacaatggcctgagcgagcggctgtcgagcctgcattgggacgaggaaggccggccgctgctgttcaatctctaccggcaccgcgaggacggctatttcagcgagcgcgagatcgccgccttcgagcagtgggtgccggccctgctgcaactgctgagggggcacctggccttgcgccggggacgcagcgcgaccgacgagtggcggctggcgctgttgcaccgggcgacggacctgacaccccaggagctggcggtctgcctgcacctgctgcgcgggttgagccatgccggtatcgccgccgagctggggctcaaggaaagcacggtgaaaacctaccgcaaccgcgcctttgcccgcctggacatccattttcgcagccagcttttcgccctggtgcagggctga

SEQ ID NO: 11640 - DNA, 480 bp, Pseudomonas aeruginosa
cctccggacgcgacgcgggcgtcattggcggatgcggtcgagcacgttgatgtcgtccgggttgtgcaggtgcggcacggtccagccgttctcgtcgtagtcgcccatgcactgctcgaccatgccgagcatgcccttcatcgccccgctgccgaccgcctggcgcagggcctgcatgcggatctcgtcctggctgccggcgtagttgatctcgtacagctcgtggcggccgccgaactcgctgccgatggcgtcccagagcagcttgaggatcttgatccgctcccggtggcccatgccgccggagccgcggcaataggtggagaggtacttgtcgagttgcggattgtgcaggtcgcgaacgccggagggcaggtagatcaggccgctggcgaccacctgctcgatggtcttcttgatctccgggtaggcctgcggcgccagcacgcggtaggcctgcagggcctcggcgctgggtag

SEQ ID NO: 11641 - DNA, 1200 bp, Pseudomonas aeruginosa
gaaggcgccgctgtgccattcgctggcgttgccgtacatggcgtcggtcagcgaccagaacaggttgcgccaggccaccacttcgccgacctgcgcctgcacgccgcggaactccagggagccggtgcattgcagggccttgtagagggcgccggtgatgaagtcgagcttgaccgccaggcgggtgcagccctgcatcgggaacagccggccgaagccaccctgggggaaccactgcttgcagcgctcgaagtcgcggtagatcagtacgttctcccaggggatgaacaccttgtccatcaccaggatcgcgtcgttctcgtcgaaacggctggacagcgggtagtcgaacggcgatccggcgatacccgccaccagttcgtaggaggggcggcagatcagcttcatgccgggggtgttcatcggcgcgatgaacatcagggcgaagtcggtgttgtcgccgagcagttgcgccgaaccctggccgacgaagttgtagtgggtcagcgcggaattcgtggcaaccaccttggcgccgctgacgacgatgccgccgtcgacttcctcgtccaccgagatgaacacgtccttgacctggtccaccggcttgtcgcggtcgatcggcgggttgacgatggcatggttgaggtacaggcaggcttcctggatgcgcttgtaccaggttttcgcgttgtcctcgaaacgcccgtagaagcccgggttggcgccgagggcgctgccgaaggcggccttgtattccggggtgcggcccatccagccgtaggtcagccgcgaccactcggcgatggcgtcgcgctgctggcgcagttcgtcggcgctgcgcgcgtagcggaagaacttgtgggtatagccgccgttgccggtatcggtctcccagcagagcttttccttgctctgcggatcgtgcagggcgtcgtagagccgggccatggaggcggccgcgttgcggaaggcggggtggctggtgacgtccttgacgcggtcgccgtacatgtagatctcacggtcgtcgcgcaggctggcgaggtactcctcgccggtgaacggacgggtggcagaggcacggaaatcttcgggtttcatcatcgtctccagtcattgttgttatctgcgcgagagcgcctggaggggatgatgggacgggggcggagcgagctgaatggcttttccggggaatga

SEQ ID NO: 11642 - DNA, 456 bp, Pseudomonas aeruginosa
ccccggccttgctcgccgcatagtgcgagagcccagggatcgccgtgcgcgggccggtcaccgaggaggtcaccaggacgcgcccggccacgctgcggcgcagggcgggaagggcggcctgggtcagccggaagcagcttttcaggttcaccgccagggtccgttccagggtgccttcgtccagttccgcgagggcgcactggggaaaggcagcggcgttgtgcaggaggatgtccaactggccgaagcgctccagggtcgcgctcaccgctcgtctcgcggcgtcgtgctcgctcaggtcgacggccagcagttcggccgtgcctccgcccaggcggatcgcctccaggacggcctggccgcggctggcggtacgcgtcgccagcagaaccctggcgccttcggcggcgaagcattcggcgatggcccggccgatgccctggccggcgccggtga

SEQ ID NO: 11643 - DNA, 1290 bp, Pseudomonas aeruginosa
ccagtgcgacgcggttctccaagcgcctcacgatgggcgctccagcagttcgcccaggcaatcgcggagcaggcggtcgtgcagttcgacgtcctctgcgcgggtcgccgggcaggtcagcgccatgttgtggaatggcgtcaagagcacgccgcggttgagcaggtagaggtgcaggcaggcctcgatcaggccgttgcgtgcgtggtgggcctcgccgccgttgcgcggggcgtgggtcatgaacaggtactcgacgcgcgcgccgatgcgcgtcacgtgccagggcaggcgcagttcctcgagcgtcgcgcggacgcccgcctcgagctgcgcggcgagctggaacatgtgccgataggcgtcctccgtcatcacttcggcgaaggtcgcgcgcatcgccgccagttgcagcgcgttgccggccagggtgccgccaaagccgaaatggttgatcgcctgccccggtcggaagtgcggcagtaccgcccagatccgctccgcctgcgcctggctgcatccccagacggcgctgggaatgccgccggcgatgcatttgccgaggacgaagaagtccggctcgaggccatgcgcgccgctatagccggcgggaccgcaggagatggtgtgggtctcgtcgatgatcagcgccacgtcgtggcggcgggtcagttcgcgcaggccggcgtggaagccttcggccggcgggaccatgccgacgttggtcatgaagggttcggtgagcaccgcggcgacgtcgccatgggcgagggcggcctccagcgcgtcgaggtcgttgaactccaccaggcgggtggtggcgtcgtggcgtacgccattggggtgaacgcccgcgcgcggaaccatgcgcccggcggcgtcgaattccacctgcgattcgtcgacgctgccgtggtagttgcagttgaacaccaccaccttgtcacgtccgctgagcatccggcacaggcgcaggacgaaacggttggcgtcggtggccgaggtggtcacctgccaatagggcaggccgaagcgccgcgccagttcggcgccgacccacaggctgtcctcggtcggcagcatcagggtcgagccgcgccgcgcctggcgggcgatggcgtcggccaccgccggttgggcgtggccgaacatggcgccgctatcgccgagggcgaagtcgacgtactgctggccgtcgatgtcggtgacgcgcgcgccctgggcctccttcaccagcagcgggcagttgcccggccactgttgcatccagtgcaacggtgcgccgtatag

SEQ ID NO: 11644 - DNA, 489 bp, Pseudomonas aeruginosa
ccggggcgaaggaggccaggacgggagcaccggcgaaacagccgcaggcgcccgcggtggccgttgcgtcaccggccggcgggttggacgcaccgtcgcggcggatcgtcttcgacgcgcagatgctggccctggggccgggcggacgctcgatcgatacgtcgcgtttcgagcgcggcgacgtcatcgagccaggccgctatcgcctcgacctgctgctcaacagccgatggcgtggcgtcgaggaagtcgagctgcgccgccagccggggcgggaaagcgcggtcttctgctacgaccggggcctgctggagcgggcgggcatcgacctggagaagagcgcgcgtggccaggaccgttcctcggctcgcgatcctctgcccgaaggtttgcactgcgacccgctcgagcgctatgtgccgggggcccgggtcaagctcgatatcgccgagcagtcggtctatgtctcggtgcccagctattacctga

SEQ ID NO: 11645 - DNA, 963 bp, Pseudomonas aeruginosa
gaaaatcactcagcagttgatcgccatcgcttgctgcgtttttacacggtctgggccgaggacgatcgccagggtggtcagcgcgccgaaaccgatccccggtacgccgttctccagcatgtggatgcgcgcgcagaacatcgccgagatccacagcaacagggcgacgaagggcaggatgtcgtagtgatcgtagagcagcacctgcaagcccaccgccagcgcacagccgagcagcgtaccgagggcgcggatgcgcccggcgaagtgcacgcccttccagtgcatgggaaacaacaccaggatcgaggcgatctgcgccgacagcgagtccttcaggtcgaaggtctggaagaccacgaaggacaaggtcgccaccgtggccccgagcagcgtctcgtggcgccggctgggggcgtccttggccggcgcctggcgcggcggccgcggttcgacgtcggggaacaggtagaacatcagcacggcgatggccaccgtcagccaggtggcgaccatgttgctggcgagcatgtcgaacagatcgacgtccggatagctggcaaagtgcagcagcatcgagaggaacaccgaactcagtgcgccgaagaagaacagcgggccgcgcgccatcagggcgaagcggtagacgaagaggccgaagacgataggcgtcatcagcaacggccggtcgccgaacaacccgtacagcaccagtacctcgacgctgatcaccaccgagttggcgaggaactggcggacgatgtgcaggttgatcaccggcgtcaggccgagcagcagcatcgggtagacgccgaagaacgagccgtagtcccagttcatcagcttgcagacgaagaaccccagggtgccgccgccggcgatgcgcaggcactgacgcaggtcgttggcggacatcgcgagcttggccggcatggcgtcagtagacgtagtgcagcaggctga

SEQ ID NO: 11646 - DNA, 285 bp, Pseudomonas aeruginosa
tgctcctgggacagggtgttcatgtccacccggcagaacccctcggcgtcgccgtgcagggccctggccagggcgcgcacgatctcggtcttgccgaccccggtggggccgaggaacagcgcgctgaacagcggacggcgcgggtcggcgatgtccgcgcgaaccaccttgagcatgtcctcgacggcctgtagcgccggttcctggccgagcacctcggcgcgcaggcagtccatcaccgccgccgggtcgaaacggaaacggctgtgcagggcgctgcggtga

SEQ ID NO: 11647 - DNA, 729 bp, Pseudomonas aeruginosa
gtgcccgatatatttggcgtcccggagaggggtcgaacctccaaccttccccttaggagggggatgctctatccaattgagctaccgggacacgccggacatggcgagcggtgcgccgcgtccgggcggcatgttaacggcagagaaagcgtttgtcatgccactgccaccaaggctgcgcataattttccgcaaccctggaggtgcagcatgaaccagaccgtcgccattcccgccgcacaggacctgccggacgccccgcgccagccgcggataccggactcccccttcgccagcttcgacgtgcggatcgccagcgagcacgacgcgccgcgcctgtcgttgctgctacagcaactcggtagcgccgattcgcgcccggacccggcgttgctggccatccagctgcaacgaccgcgcggcgaccgggtcaccctggtggccgagcgcggcgagcgcctgctcggcacctgcaccctgcatctgatcgaacacctggcgcacgatttcgcccgctcggcgattctcgaagacatggtggtcgaccgccacgcccgcggccagggcgtaggccgcgaactgatcggccgggccgtggagcgcgcgcgcagttggggctgctacaaactggcgctttccagccaccaggaccgggaaaccgcgcagcgcttctatgccgcgctagggttcaccagccacggcgtaagcctggcgctgcatctgggctga

SEQ ID NO: 11648 - DNA, 393 bp, Pseudomonas aeruginosa
ttcattgatttaaaaggattttttatagaaaaaagttggcacaaccgctgctacaagaccctcaggatcaaaccttggccatctgcctggcaaagctacgaaatggaggtgaacatgagcagctcacgcaacctggtcggcaccggacttctttccctgctggctctcgtagtcttccagaacagcgcactgggcgacgaggacaggacgcaggaacgcaacggcgaaaggccggtagtgctggacagcaacgcaacgccgcagtgggcacccgctgcgcaacaactggtgatccaggcgcccgacgaatccccgcgcatcgtcaccgtaggcgaggacgagcgcggcacggcgctggtgaccgcggccgacgaacaggcctggacattctga

SEQ ID NO: 11649 - DNA, 543 bp, Pseudomonas aeruginosa
cgtgtcgtcgagatcaccggagttgtccagttggaacagcgggccctccaggccggcggcgaactcggcgttacgcgccaggcgcgcctcgatttcctcggggctttcccggccgcgcgccagcaggcgctggcgcagcacctcgggtttcaccccgagcaggaccgcgagcagatccggatagcgccggcgggcctgcgccaggtagccgcgcgagccgttcaccagcacgtcgtagccctgcgccagccactcgtcgatctgcaccggaatgccatagcaaaggccgttggcgcgccagctcatggcgaacgccgaggcccgctcgagggtgtcgaactgcgccggagtcaccgcctgggcgtcctcccccaccgcttccgcggagcgcgtgatcacccgccgcacgatacggcagccgcgcagcgccaggggctcgcgcgcggcctgcaacaggctgtccttgcccgagccggaaggccccatcagataaatcagtctgcctgtcatcagaacactctctgcccgccgcgccagacctga

SEQ ID NO: 11650 - DNA, 408 bp, Pseudomonas aeruginosa
tactcgcggtacttctccagcctggcgaactggcgctggccgggggcgtggtccatcaccgagaccagttgcaccagcggatgctcgaccagttcgcggaacacctccagcgtctgcggatggctgacctcgcaacgcaggtgcaggcgatggtcggcgcgcgcgtcgccgctggcggcggcctcgccgatggcctcgagcatcttcggcaactgctgcatgcgcttgcccttggggttgacgtcgccgatggacagcgcgtcgaacaccgtggtgattcccgcggcgacgatctgcgcgtcgtgcgccagcaccgccgaggccgatggccagtcgacgccgggacgcggggtcatgtgcttctccaggttgtcggtgtgcagctcgaccagaccgggcagcaggtag

SEQ ID NO: 11651 - DNA, 975 bp, Pseudomonas aeruginosa
tcgccccccaggtcctcggccccggccaggtggctgcggccttcgtcgaccgcggcgatcaggccgtcgcgcagcagcacgctgccgacgaagacccgctcggcgctgactacccgggcattgctgagaacgcgttcagacgacatgggcttgctcctggcgggaaagctcctggctcatgtccaggtagcggctggccaccgcctcgcgggcggcgcggtcgtggaagatgccgatcaacgcggcgccagcggccttggcttcgccgatcagctccagcactacctggcggttggcttcgtcgagggacgcggtcggctcgtcgagcagcaggatcggccactcgaccatgaagccgcgggcaatgttgacgcgttgctgctcgccgccggaaaaggtacccggcgccagttgccagaggcgttccgggatgttcagccgggccagcaggctgcgcgcccgcagttcggcgctgtcgcggctccagccacgggccagggccggctccatgaccacgtcgagggtcgccacccgcgggatcacccgcaggaactggctgacgtagccgagggtctggcgacgcacggcgagcacctcgcgaggctcggcgccgaccagttccaaccagtcgccggcgtggcgcaggcggatgctgccgccggccggcaggtagttgccgtagagcgtgcgcagcagggtgctcttgccggcgccggagcgtccgtggagcaccaggcattcgccgccggcgacattgaagttgagcccgcgcagcacattgagcactacgccctgttgctggtgcagggtgaaggtcttgctgaggtcgcggacctcgatcaggttgttcatcgctacttctccgggcgcccgtcgcgcggaccggcgccgacgcttcggctcagggttgcaggaccgacgacaccagcaattgcgtgtacggatgctgcgggtcgtcgagaatctggtcggtga

SEQ ID NO: 11652 - DNA, 1536 bp, Pseudomonas aeruginosa
acaccaggcgtggcgccgagaccaggttgcgggcgatctgcagacgctgctgcatgccgccggaaaaggttcgcggcaggtcgtcgatgcgcagcggatcgatctccacctgttccagccagtccagcccggcctggcgcagccgaccgtagtggcgcacgccctgggccatcagccgttcgccgatgttggcgccggcggacacgcccatgcgcaggccgtcgcgcgggttctgctcgacgaagccccactcggtgcgcagcagggtgcgccgctcggcttcgctggcggcgtagaggtccagccagcggtcgccgtcgtcgcggtaggcgaccgtgccggcgtccggcggacagcgcccggagagcaacgagagcagggtcgacttgcccgagccggactcaccgacgatgcccagcacctcgccggggtagagatcgaagtcgacctcctggcagcccttttccggcccgtacaggcgggtcaggccacgcaccgagagcagcggccggtcgcgcgcgtcgaggttcgcatcgatggattcgcagaccgcgttcattgcgcgtcctccccttcttcctggcaggcacgccgctgcgtgcagtaatcggtgtcggaacagacgaagcgcttgccgccacggtcgtcgacgatcagttcgtccaggtaggactcgtggctgccgcagaaggcgcagctttcttcccagcgctggacttcgaaggggtggtcctcgaagtccaggctcgccacccgggtgaacggcggcaccgcgtacaggcgcttctcgcgaccggcgccgaacagcatcagcgccgggttcatgtccagcttggggttgtcgaacttgggaatcggcgagggatccatcacgtagcgctcgtccaccgtcaccgggtaggcatagctggtggcgatgtggccgaaggtggcgatgtcctcgtagagcttcacgtgcatcaccccatagtcgttgagcgcatgcatggtccgggtctccgcctcggaaggctcgatgaagcgcagcggctcggggatcggcacctggtagaccatgatctgctcgccgctcagggcggtttccggtatccggtggcgggtctggatcaccgtcgcctccggggtccgttcggtggtggcgaccccggcggtgcgggcgaagaaacgccggatggataccgcgttggtggtgtcgtcggcgccctggtcgatcaccttgagcacgtcgtcggcaccgaggatggccgcggtcacctgcatgccgccggtgccccagccgtagggcagcggcatctcgcggccgccgaagggcacctggtagccggggatcgccaccgccttgagcaggccgcggcggatcatgcgcttggtctgctcgtcgaggtaggcgaagttgtagccctgctccggcgcggcgctggcttgcggggaaaggctcatgcgcgcttctcctggacagtgggttgcgcggattcggcgacgccgggacgacgcagcttgcgaatcagctccagctcggactggaaatcgacgtag

SEQ ID NO: 11653 - DNA, 1515 bp, Pseudomonas aeruginosa
gcgccgcgcggaaactccgctgggcatccaggaccgggtcctggaacgccggttgcaatagcgcggcggtatccgccgggctgggaagcgaagcgctggtcatcaatcttctcctcggaccagggtgaagaactccaccttggtagtggcgatttccgcatcctgggcggcgcggcgctcggcatgggtgcgggccagcggttcgatcaggcgcgcctgccaggccgccgcgtcggcgccctgcaggtgcgcgtcggccagggcggccagttcggcgtggcgcttgtcgcgcccggcgacatagctgtagccggtgcgtccgtcaccgagccgcaccacgcagcgggtcacggtcatctcgccgaggttgaacgggctgccggtgccgcccatgcgtccgcgcaccagggtcatgccggtctcggcggcgcgcagcaggtgatagtcggcatcgcgcagggcgtccgcatgggcgtccagctcctcgcgacgggcgcgggcgagcacgcccatccagcgctgtcgtgcggcgatggtgggatcggaatgcaaggcggtcatgggcttctcctagggggcgacctggtactggaagcgatcggcgcggctgatcgactgggccagttccaccggttggccggtacggtcgcgggacagggtgaggacggtgagcaacggcgcatggcggggcatcagcaggcgcgccgcctcctcgcggttgggcaggcgcgcaccgatcaggctgtaggtgcgggtcagcggcaggcctttgtcggccaggtagcgacgcagcgaaccgccctggtagtcggcgagcagctcgctgcgggaaacggcgaagcaatggcggatcaggctcactggctggccgtcgaggtaacgcagggtggtcagttccagcacccgcccgccctcgccgatccccaggtgggtggcatcggcggcgccggccgggcgctggcgcgcctccagcagccgggcctcgacccggtggccctgggccgagagcgactcggtgtaggcgttggcggcgcccatcgggtagatcgtcggcgcctccaggacctgggtgcccttgccctggcgccgcagcacgcggccttcgagcaccagttcgtcgagcgccctgcgcagggtatggcggttcaccgcgaagcgctgggccagctggatctcgccgggcaggtagtcgccggggcggtaggccagcagttcctggcgcagccgttcggccagttcgcggtacagcggttcgctttgtctagacaagtgcatggtttggaaagggcgcaccaggcgccctcctcgcgtcgtcagatgaacagcttgcgcaggcgttgtgacagaacgtcgatcaggctcaccaccacgatgatcacgatcagcacggcgcaggtctggccgaactggaagccgcggatggcctcccagaggatcacgccgatgccgccggcgccgaccatcccgaccactgtggcggaacgcacgttggactcgaagcggtacagcgaatag

SEQ ID NO: 11654 - DNA, 1434 bp, Pseudomonas aeruginosa
agcttccagttgccgaagtccggcgggaagaagtcggcggcgaaggtcgccatgttgccggcgtcgcggaacagcacggccgggttcatttccgcgcccttccaggaccaggcgaggatggcgaggaacaggccccagccgaccaggcgtccccaggatggcttgccggtggcggccgccgcggcagtggtgctcagagtgctcatatcgggaatctcgacagcggtattggcgaatcgggtggggcgcggcgccggccgcgcccggggtggatcagccggcgttggcggcggttttctgctcgcgctcggccatgcgtttctccagcttggccagctcctcgtcgagggccttcagcttggcggccttctcctcggcgccgaggttggcgttgttcgccacgtcggtgcgctgcttgaacagctcgagctggcggatcggcagcaactggtcgtcgtcggagggctggaacttcgaccattgcaggtcggcgaggaccttcttctgctcggcgttggcgccgtacttgaagaagaagtcgcgcagcttgttcttctgctcgtcgctcaggttgttgcgccacaccagcgggtcgcccgggatcagcggcgacttccagatcaccttgagctgcctggccttctccggctgggtcaattccaggcgctccatgccctcggtattgaaggtggcgacgtcgacctgcttgttggccaccgccagggcgttgacctcatggctggagttgagggtgcgcttgaaagccttgaccgggtcgacgttgttcttggcgaacacgtagtagccgggcaccaggtagccggacgtggagttcggatcgccgttgccgaaggtcaggctcttggcgttcgccaacatgtcctcgaggctgtcgatcttgctgtccttgttggcgatcagcaggctccagtagcccggcgcgccactggcggcgacggtctgggcgaagatctcgccgtgggcgcgatccaccgcttccatggcggccttgttgccgtaccaggcgatgtcgaccttgtcgaaacgcatgccctggatgatcccggcgtagtcgggggcgaagaaggccttcacctggtagccggtctgctggctcatgtccttgaggaagggttcccagatgctcttgaggttctgcgacgactcggtggagatgatcccgaaattgatcaccggctggtcggcgtgcgccatcccggcaagggagccggcgagcagggcggaagccgcgagcacacgactgaagcgtttcaacatggagagaactcctgggcagggtttggcgggtttttatgcggttcgaatgacgtcaggcgcgcgcgagggtcagttccggctggctctccgccccgcgccgggaacggtcggaaaacagcagcggggtgtccccttcggcgccgtagagttcgttga

SEQ ID NO: 11655 - DNA, 198 bp, Pseudomonas aeruginosa
tcgcccagggtcttctcgaagccggcgcccgcgtcttcatctgcgcacgtgacgcagaggcctgcgccgacaccgccacacacctctcggcctacggcgattgccaggcgatccctgccgacctttccagcgaagccggtgcccggcgcctggcgcaggcgctcggcgaactcagcgcgcggctggatatcctggtga

SEQ ID NO: 11656 - DNA, 729 bp, Pseudomonas aeruginosa
catgacgcccccgaccgctcgcctcgtcccgccatgacccacagcgtttctcccatcggctacatccgctcctgcttcatggagaagttcgccatcccgcgccagccgctgctcgcgccggcggcgcgggggaccctggaactgctgccgccgttcgaccaggtggaagcgctggaaggcctggagcaggtcagccatgtctggctgctgttcctcttccaccaggccctggaagacaagccgcgactgaaggtgcgcccgccgcgcctgggcggcaaccgctcgctgggagtcttcgccacccgcgccacccatcggccgaacggcatcggccagtcggtggtgcgcctggagggcttcgaagcggggcgcctgtggctttccggaatcgacctgctcgacggcaccccggtactcgatatcaagccctacgtaccctacgccgacgccgtggccgacgcccgcaacggcatcgccgacgcgccgccgccgggcatcgccgtggagtggagcgagcaggcgcggcgccaggcccatgagcacggccagcggttgcggcagccggtagccgagctgatcgagcaatgcctggcgcaggacccacgcccggcctaccagaagccagagcccgggcgccgctacggggtgcgcctgtgggacctcgacgtgcattggcactacccgcgcccggacctgatccgcgtgctggacgtcgccagcggcgattga

SEQ ID NO: 11657 - DNA, 660 bp, Pseudomonas aeruginosa
aattattgtatacaaaaaaggaagcaaacccatgtccgaccgccctgcccgcccctcccgcctcaacggcctgcgtcacctcgccctgctggtgcccaacctggaagaatgcgagcgcttctatgtcgacgtactgggcatggaagtgctgaaccgcgccaacgaagacctggtgtatctcacctgcggcaacgacaacctttcccttggccgcgcccacgctgccagcaacggcctgcagaccatggatcactacggcttcgtcgtcgacagcgtggaggaactggaggcctggtaccgttacctgaaagcgctgggcgtgaccctgctcgaccaacccttcgaccacggcgacggcgcgcgcagcttccacctgctcgacccggcgggcaacaaggtgcagccgctgtaccatccagcggtatccgggcaacgcctggcctgagcctcgggcagccctctcccctctccctgaagggagaggggcgactcggtacactgagtgccagcaacctcgcttgttcctcatctccacttcttgactttcatcaagcgcgttccgcccccgctcctcctagcatccggcaacggaagcgattccaccgccaggcgcagaccccaccgcagcgcggcgtcccttttttcgccggtagccagtag

SEQ ID NO: 11658 - DNA, 2157 bp, Pseudomonas aeruginosa
atggaacctatgcgcgcccttcgtttttccgccggatcgtggcggtgtgtcttcgcctggatgctcctgctggtcggcctcgccgcccagggtgccgaactcagcgagttggagcgcctgcgcatcgcccaggtattccccgcggtcgagcggatcggcgaccccgaaggcgactacggcgtacgccgcctgagcaagggcgaggaaaccctcggctacgccttccagaccctcagcgtcaccgacatcccggcctactccggcaagccgatcaacctgcaggtgatcctcgatccgcaggcggttatccgcgacgcctacgtcctcgaacaccacgaaccgatcctgctgatcggcatcccggaagagaagctgcacgccttcagcgccaggtacgacggcgtgcgcgccgaccagcgggtggtggtcggccgctccagcgacccgcaggcggttaccgtcgacgcggtgagcggcgccacggtgacggtgatggtggtcaacgagatcgtcatgcgcgccgcacatacggtggcggtttccctcggcctgatcgaggaccgcggcaatgtgcggcccaagccggcgcaggtgcgccagcaaccggcagcgacggcgagctggagcgaattgctcggcaacggtgcgatccgccgcctgcagttgagtcgcgggcagatcgacgacgccttcaagggcagcgaggccgaaggcatcggcgaagccgacgcggcgcaccgcgacgagccgttcatcgatctctacagcgccctgctcaaccctcccgcggtgggccgcagcctgctcggcgacaaccagtaccgcgaactgatggcgtcgctgaagccaggcgaatacgccttcgtcgtgctcggcgacggcgagtattccttcaagggttccggctacgtgcgcggtggcatcttcgatcgggtccaactgcgccagttcggcgacatcatcagcttccgcgacctcgactaccagcgcctgtcggacgtctacgccgaaggcatgccggagttccgcgagatggcgatcttcgtcgcccgcgccagccagcgtttcgatccgggctcgccctggaccctggagttgctcgtgcggcgccagaccggcccggtggcgggggtattcaccagcttcgagctggcctgccagacgcccgaggaatacctggagcggccgcagccaacggccgaggaactggccgccctggaagaggctgcccggccgctgtggctgcgggtctggtaccagaagagtttccaggtcggggtcctctgtaccgccctcgtcctgctcctggcgatcctcttcctccaggaccgcctggtgcgacggccgcgcctgatgcagcgactgcgcaccggctacctggcgttcaccctggtctacctgggctggtacagcctcggccagctatcggtggtcaacgtgctgaccttcgtccacgcgctgttcgaaggcttccgctgggagctgttcctcagcgacccgctgctgttcatcctctggacattcaccgcagccagcctgctgctctggggccgcggcgtgttctgcggctggctgtgcccgttcggtgcgctacaggaactgctcaacgaactcgcgcgcaagctccgcgtgccgcagttccaggtgccgttcgccgtgcacgagcggctctgggcgatcaagtacatcatcctgctggtgctcttcggtctctccctggaatccctggcgctggccgagcaggccgcggaggtggagccgttcaagaccaccatcaccctcggcttcgaccgccagtggtggttcgtcgcctacgccgtcgcgctgctggtggtcaacctgttcacccgcaaggtctattgccgctacctctgcccgctgggcgcggccctggcgatcccggccaaggcgcgcctgttcgactggctcaagcgccgcgcggaatgcggcaggccctgccagctctgtgcccgcgaatgcgagatccaggcgatccatcccgacggccgcatcgaggccaacgaatgccactactgcctcgactgccagatgacctaccacgaccaggacaagtgcccgccgctggtgaacaagcgcaagaagcgcgcgaagagcgcgccggcggacaacgcgcggatacccgcggagaacctctga

SEQ ID NO: 11659 - DNA, 1836 bp, Pseudomonas aeruginosa
ggacgacacgagatgagcgacgacacgaaaagcccccacgaagaaacccacggcctgaaccgccgcggcttcctcggcgcctcggcgctgaccggagccgccgccctggttggcgccagcgccctgggcagcgcggtggtcggccgcgaggcccgggccgcgggcaagggcgagcgcagcaaggccgaggtcgcccccggcgaactggatgagtactacgggttctggagcggcggacattccggcgaagtacgcgtgctcggcgtgccgtcgatgcgcgagctgatgcgcataccggtgttcaacgtcgactcggccaccggctggggcctgaccaacgagagcaagcgggtcctcggggacagcgcgcgcttcctcaacggcgactgccaccatccgcacatctcgatgaccgacggcaagtacgacggcaagtacctgttcatcaacgacaaggccaacagccgggtcgcgcgcatccgcctggacgtcatgaaatgcgaccgcatcgtcaccattcccaacgtccaggcgatccacggcctgcgcctgcaaaaggtgccgcatacccgctacgtgttctggcaacgccgagttcatcatcccccatcccaacgacggctcgaccttcgacctgtccggcgacaacgccttcaccctgtacaacgccatcgacgccgagaccatggaagtggcctggcaggtgatcgtcgacggcaacctcgacaacaccgacatggactacagcggcaggttcgccgcctccacctgctacaactcggagaaggccgtcgacctcggcggcatgatgcgcaacgagcgcgactgggtggtggtgttcgacatcccgcgcatcgaggccgagatcaaggccaggcgcttcgtcaccctcggcgactcgaaggtgccggtggtcgacggccggcgcaaggacggcaaggacagcccggtgacccgctacatcccggtaccgaagaacccccacgggctgaacacctcgccggacggcaagtacttcatcgccaacggcaagctctcgccgacctgcaccatgatcgccatcgagcgcctcggcgacctgttcgccggcaagctggccgacccgcgcgacgtggtggtgggcgagccggaactgggcctcggcccgctgcacaccaccttcgatggccgaggcaacgcctataccacgctgttcatcgacagccagttggtgaagtggaacctggccgacgcggtgcgcgcctacaagggcgtgaaggtcgactacatccgccagaaactcgacgtgcagtaccagccggggcacaaccacgccaccctgtgcgagaccagcgaagccgacggcaagtggatcgtggtgctcagcaagttctccaaggaccgcttcctgcccaccggtccgctgcacccggagaacgaccagttgatcgacatttccggcgaggaaatgaagctggtccacgacggcccgaccttcgccgaaccgcacgattgcatcctcgcccgccgcgaccagatcaagacccgcaagatctgggaccgcaaggacccgttcttcgccgagacggtcaagcgcgcggaaaaggacggcatcgacctgatgaaggacaacaaggtcatccgcgagggcaacaaggtccgcgtctacatggtctcgatggcgccctccttcggcctcaccgagttcaaggtgaagcagggcgacgaagtcaccgtgaccatcaccaacctcgacgagatcgaggacgtgacccacggcttcgtcatggtcaaccacggcgtctgcatggagatcagcccgcaacagacctcgtcgatcaccttcgtcgccgataa

SEQ ID NO: 11660 - DNA, 1371 bp, Pseudomonas aeruginosa
gcccggggtgcactggtactactgcagctggttctgccacgccctgcacatggaaatgtgcgggcggatgctggtggaaaaggcttgatccacgcagcgcggtcgctggccgggcgccgggcggggccgctcctcgccctgctcctgctcggcctcgccacggcccgcgcggagccggtcgacggcctgccgctgcgggccgacggcgatggccgctggagcctggcggcgggccgctacgccggcaacttcgtcatcgaccggccgctgcacctacgctgcgaggccggcgccgaactggacggcggcggccacggcagtctgctgaccctgaccagccccgggatcaccgtcgagggctgccggctgcgcaactgggggcgcaacctgaccgaactcgacgccgcgatcttcgtcggcaaggccgccagcggcgccgtgatccgcggcaacgacctgcgcggcgcgggattcggcgtctggctcgacgccacggtgggcgcgcaggtgctcgacaaccgcatcgagggcgacgaaagcgtgcgctcccaggatcgcggcaacggtatccacctctatgcggtgaaggacgctctggtccgcggcaaccgggtcagccacacccgcgacggggtctacatcgacacttccaacgacagcagcatcgaagccaaccgcttcgaggagctgcgctacggcgtgcactacatgttcacccacaacagccgggtgaccgacaacctgacccggcgcacccgcaccggctacgcgctgatgcagagccgcaagctgaccgtgaccggcaaccgctccatcgacgacgagaactacggcatcctgatgaactacatcacctactcgaccctggccggcaaccgcgtcgagggcgtgcgcagcggcagcaccggcgacgcgatgatttccggcgccgagggcaaggcgctgttcatctacaactcgctgttcaaccgcatcgaaggcaacagcttcgccgacagcgccctgggcatccacctcaccgccggctcggaggacaatcgcatcgccggcaacgccttcataggcaaccgccagcaggtcaagtacgtcgccagccgcgagcaggagtggtccgccgacggccgcggcaactactggagcgactacctgggctgggaccgcgacgacgacggtctcggcgacgtcgcctacgagcccaacgacaacgtcgaccggctgatctggctgtacccgcaggtacgcctgctgttgaacagcccgagcatcgagctgctgcgctgggtccagcgcgccttcccggtggtgcgctcgcccggcgtgcgcgacagccatccgctgatgcggatgcccgccgcggagccgaggccgtga

SEQ ID NO: 11661 - DNA, 1665 bp, Pseudomonas aeruginosa
aaacctactcgaagggcatgcgccagcgcctcggcctggcccaggcgctgctcggcgaaccgcgcctgctgctgctcgacgaaccgacggtgggcctcgacccgctggccaccgtcgagctctaccaattgctcgaccgcctgcgcggccagggcaccgggatcgtcctttgctcccatgtgctgcccggcgtcgagacgcacatcgaccgcgccgcgattctcgccggcggccgcctgcaagtggccggcagcctcgccgaattgcgccgcaaggcggctctgccgacccgcgtgcgcctggccagcccgcataacccgcagtggctcgaacgctggcaccgggccggcctggcggcgcggagactggacgaccagcgcatcgaggtactgctggacgatgccgagcgcgacggcgtgctggaagcgctgctggccgcgtgcgagttcgacctggaaatcctgccgccgtcgctggaggacctctatcgccaccacatgtcccccgcccccgccggagccacgccatgcccgtagtttggaccatcgcccgcaaggaactggccgacggcctgcgcaatcgctggctgctggcgatcagcctgctgttcgccctgctctcggtgggcatcgcctggttcggcgccgccgcggccggccaggtcggcttcacctcggtgccggcgacggtcgccagcctgaccagcctggccaccttcctgatgccgctgatcgccctgctgctggcctacgacgccatcgtcggcgaggaggaaggcggcaccctgctgctgctcctgacctacccgctggggcgcggccagttgctgctcggcaagttcctcggtcacggcctgatcctcgccctggccaccctgatcggcttcggcagcgcggcgctggcgatcctcgcgctggtgccggaggtcgaggcggccatcctgctgggcgccttcggccgcttcatgggttcctcgctgctgctcggctgcgtgttcctcgccctggcctacgccctgagcagccgcgccagcgagaaatccagcgccgccgggcaggcgctcggcctgtggttcttcttcgtcctgctgttcgacctggccctgctggcgatcctggtcctcagccagggtcacctgagcccgcggctgctgccctggctgttgctgctcaacccgaccgacctctaccggctgatcaacctgtccggcttcgacgcagccgccgccggcggggtggttcccctggccagcgacctgccggtgtccgccagcgccctctggctggccctggccctctgggccggcgctgccctggcgctggcccacggcctgttccgccgccgccccatctgactcacgaggttccgccatgcaacgtcataccctccccctgcgccctctgctcggcacgctcctgctcggcctgctgctggccggctgcgatgcgtcgcgggacgacgccacggcactcggcccggtgccgatcgccagcggcgacgaatgccacgtctgcggcatgctcatcgaggaaatgcccggtcccaagggcgagtcggtgcttcccggcgcggtgcgcaagttctgctccaccgccgaactgttcggctggtggctgcaaccggaaaaccgccagggccaggcgcgcctgtatgtccacgacatga

SEQ ID NO: 11662 - DNA, 1158 bp, Pseudomonas aeruginosa
tcgacgccacccgcgcctactacgtggtcggcatccagcggccgggcggcatgggcgccaccctcgcctcgttcgccgacgaagaggccgcgacgcgcctggcggccgaggaaggcggccgggtactgcgcttcgacgagatcgaccaggcggtgctgcaaggcgtgggcggcgaccacccgcaccggcacccggcgcactgagcgtgggccggaaagcagaaagcccctgccgcggatacggcaggggctttcttcgcctggcgcgacgaggcgcggcggaggcctacttctcgacgaaggcgcgctcgatcaggtagtcgcccggctcgcccatgcgcggcgagatcttcaggccgaagctgtcgagcacggcgctggtctcttccagcatgctcgggctgccgcagatcatcgcacggtcgtcctgcggattcatcggcggcaggccgatgtcctcgaacagcttgccgctgcgcatcaggtcggtctggcggccctggttgcggaacggctcgcgggtcaccagcgggtagtagatcagcttctctttcacctggtcgccgaagtactcgtgttccggcaggaccttggtgatgaagtcggcgtaggccagttcgctgacccagcgcacgccgtggaccaggatcaccttctcgtagcgctcgtaggtttccgggtcctggatcacgctgaggaagggcgccatgccggtgccggtgctgagcaggtagaggtgcttgccgggcagcaggtcgtcgtgcaccagggtgccggtcggcttgcggctgaccatcagctcgtcgccttccttcaggtgctgcaggcgcgaggtcagcgggccgtccgggaccttgatgctgaagaactccaggtgctcttcgtagttcgggctggcaatgctgtaggcgcgcatcagcggacgaccgtcgacttccaggccgatcatcacgaactggccagtcttgaagcgcagacccgggttgcgggtggtcttgaagctgaacagggtgtcgttccagtggtgcacgctgagaacgcgctcggtgtacagattgctcatcaaagactcctaggaaaacgcgggcgcacaccaacagcagcagacgtgacgcagttgcgcggcattttatcggttgccaaaatatccgcaaaatga

SEQ ID NO: 11663 - DNA, 1062 bp, Pseudomonas aeruginosa
cacgatatcggtcggccgccggccgccgagggctcccatcgctcccgcggacggggcgcaaggataaccgagccaaccccgccgacggaacggcaaaatgtcgcggggcctttcgctctagacgaggaagcctggatgaaattcaccctccgccagctcgaggtgttcgtcgccgtggcccagcaggagagcgtctcccgcgccgccgaggggctgtcgctgtcgcagtcggcgaccagcacctcgctcggcgagctggagcggcagttcgactgcaagctgttcgaccgcgccggcaagcgcctgaccctcaatgccctcggccgccaactgctgccgcaggcggtggcgctgctcgaccgcggcgaggaaatcgagaacctgctcaacggcaagaccgccttcggctccctcgacctcggcgccaccctgaccatcggcaactacctggccacgctgctgatcggcgccttcatgcagcgccagccggactgccgggtgcgcctgcacgtgcacaacaccgcccaggtggtgcagcaggtcgcccactacgagctggacctgggcctgatcgagggcgactgccggcatccggacatcgaggtgcaaccctggatggaggacgaactggtggtgttctgcgccccccagcatccgctggcgcggcggggcggcgccgacctggaacggctgacgcgggaggcctggatcctccgcgagcagggctccggcacccgcctgaccttcgaccaggccatgcgtcatcacccgcggccgctgaacatccgcctggagctggagcacaccgaggcgatcaagcgtgccgtggagtccggcctgggcatcggctgcatttcccgcctggccctgcgcgacgctttccgccgcggcagcctggtgccggtggaaacgcccggcctggacctgcgccggcagttctacttcatctggcacaagcagaagtaccagactgcgaccatgcgcgagttcctcgacctgtgccgcagcgagaccgccgggatcagccgcagcgacgagatcgtgctgccgctgattccctga

SEQ ID NO: 11664 - DNA, 387 bp, Pseudomonas aeruginosa
acgtccgcacgtcggcgcagggtacagcccggcggtgacaaagaactttccgggcgacacccagtcccaaccagcacgacagcattcaggtggtccgccatgaccgacagcagccctttccagctcctcaccgaggccttccaggccgagtaccgggtcaacctcagcctggagcggccggacggcagcatcgtcctcaccctctccaacgaacgcggggtcgccgccaagcgcctgatccgaccggcgcaactgcatgacctggagcagttgcagcggatgatcgagagcatccgcttcggcatcgccatcgaaaacggcaccagcgcgccgcaactgttgcaggcgatgacccaaggcaaggcacgctggccgatagctatctga

SEQ ID NO: 11665 - DNA, 1608 bp, Pseudomonas aeruginosa
cggtggagtcgttgcgcgccttgttgtagtcgtagcgcaggctcggcagcaggccggcacggccgatggcgcggttttcgctgccagcgcggcgctcgtggagcgccgcctggaaggtcgggtcgtggcgcaccgccagttggtaggcgtccagcaggcccagcgcctgggccgaagaggccgaaagcagcgcggaggacagcaggcaggctcgcaggcgattcattcttcccccagcgccaggtgggtacggtcggccagcggcttgaacaggtagttcaacagcgagcgctcgccgctgcgaacgaaggcctccaccggcatccccgggcggatctccaggccggccaggcgacgtacgccctcctcgcctacgcggatgcgcacccggtagtacggcgcctcgctgcgctcgtccagcaggcggtcggccgagaccagggtcacttcgccctccacccgcggcgtagtgctctggttgaaggcgctgaacatcagctccaccggcaggccgacgcggaccttgtcgaccatctccaccggcagccgagcgtccaccagcagcggctggcgctccgggaggatttccatcagttgctggccgggcgcgatcacgccgccctcggtgaacacttcctggccgaccaccaggccggcgaccggcgcccgtacctcgctgttggccaggtcgaagcgcgcgctggccaggcgattgcgcaactcctcggcgcgcacctgggcgtcggccaggctggcgcgcacctcttcctggaacttctcccgccgctgggccatgcgcaggcgcagttcgaggatctgccggcgggtactgccgaggctgccgaggtcgccggcgatctcgccgttgacctgggccagcaggcgctcgctgtcgagcaggcggttgcgcggcacgtagccctcgctggccagttggcgcaggccgcgcaactgttcctcgagggcggcgcgctgctgctccttgctgcgcagcgcggcttgcaggccgtccagttgcgcctggctgccggcgaccgtctcggcgagaccatcgagttccaggcgcagcgcccgccgacggctgtcgtgcaactgccgctgctgttccagcagggtcggcaggcgcgggtcgtccagcgccagcagctcggcgggaaactcgatccgcgccttttcatcgcgctcggcgctcagccgcgccagactcgccagcgccgccaggtactgggcgaacaggccatcggcctgggcccgggcctgggtagcgtccatctccagcagcacctgtcctgcctccacccgctcgccttcgtgcacgcggatgtgcctgaccaggccgccggtagggtgctgcacggccttgcggctaccggccaccatcaccgtgccggagaccccgacacccttgtccagcggggccaacccggcccacaggagaaagccgacgaagccgagcagcaccagcccccagccgagccgggaaaaacgcttctcgtccagttccagcgccgcgccgccggcgccgacttcgcgcaaccgcgcctgcccgctcatcgcgccgctcctcccggcacaccgccgaccggcatccccggtcccggccggtag

SEQ ID NO: 11666 - DNA, 315 bp, Pseudomonas aeruginosa
ccgatgtgcggccccagtgccgccgcgctccagtgccgcaggtcggcgccgtccaggcgcaccgcgccggacagcggctgccaggcgcccaccagcaagcgcgccagggtcgacttgccggaaccggacggcccgatcacgccgagcgcttcgccaggttccagggcgaaaccgaggtcctgcaacaatgcctgctcgcgtcccggcgcggccgcgcagagccgctcgacgcgcaacgcgccgcgcggcgccggtagcggcatgcccagggcggccggcggattctcctcgagcagccgcgccagtcgctggtag

SEQ ID NO: 11667 - DNA, 477 bp, Pseudomonas aeruginosa
gcctgccgcgcgccgctccactggcgccagaccgcgatcaactggtcgatggggctgagcacgcggcccatcaggatcgagccggcgatcatcatccccggggtgatcaggccttccaccgccagccaggcgccgaggccgagcaccagcgactgcagggccaggcgcacgcccttggaggtcgcgccgatcgccgcgctgcgctcgctgccgaggttctgccgggcaaggaaggcctggtgctgggcgaaccagcgcgcgcgcatggccggcaacatgcccattgccgccagggtttccgcctggcgcaggttggccgaggcctgctgggtggcgaggatcgacagttgcccggcctcggccagcggttcgcgcgagcggctttcgttgacccaggcaagcagcaccagcagcagcgccccaaccagggcgagcaggccgagccagggactgaagaggaagatcaccagcaggtag

SEQ ID NO: 11668 - DNA, 822 bp, Pseudomonas aeruginosa
agccgatcgttacgacaagatgctggagctggcggaaacgctggccgaggtgctgcagaaggcggtgccgtcgctgaaggaggaacaggtggaagaactcggcatcttcatggcgaagaaccgcgacgccttcgcccgcgccttcaagaaccagccggacgccctcaacgaactgttcgaggaaaacgccgcggacgaatgagccgccgctgcaagcaaagcgcaaggagccgaaacatgccgcgacaacttgccggcctgctgtgcgtcctcctcggcctcgccggcgcccctgccctcgcctgcccattccgggccacggacgccgagacaccggcagcctctgccggcgccgcgcaggtcctggccctgggcggcaccggcagactgcaactcgacctgcaacgggcccccgccaccctgctgcacagcggcgacctgctgatcgctcgctacgccgagggtcattacctcgcccaccgcctgctcgaaggcaacgagatgggcgcggacgagggcgaacggctcgaccttccgcgacaggttcgcctgctcttcggagccctgccgctggacggcctgcccgacgccgagcgcgagcgtctccaggcgcagcgccaggccctcggcctgtgcgaccggcgcgccagcgtcagccgctaccgcgtggccggcaccgaggtctatcgcctgcgcggcagccaggccggcaagccctaccacgcgctctacctgctcgacggtccccaggtgcactacctcgacagctccggcagcgacgccttcgtcgaacaactgctcgccagcctgcgacgccgctga

SEQ ID NO: 11669 - DNA, 492 bp, Pseudomonas aeruginosa
gtccgcgcggcgcttgtccgacccgcgcccggcttgccggaaactggcgcttgccgtacaacgcccggcagccccatcgaccaggaaggtcccatgcccgctctccccgcctcccccgtccgctcccgacgctggcgcctggaccggcgcagcctgctgctggcactgctgctgttcggcctgctggtcctgctcgccaccctgggccggcattggggctggatacgcagcttcggcggcgacctgctggcgttggtctggctctactacctgatgggcagcgcgctcagggcgccggccgcctggctggcatccgccgcctttgccgtcggcgcgctgctggaactgggccagtacctggcggcgcaactgcattggcaattttccagtcccgtgctgcgcatcgttctcggtagcaccgccgacggcttcgacctgctcgcctatgccctcggcgcgctgctggcatggtggctggagcgccggcgctga

SEQ ID NO: 11670 - DNA, 519 bp, Pseudomonas aeruginosa
atgaagcccatgaactggatctccatcaccggcttcaggccctgggcggccatgccgatggacagcccggcgatcatgttctccgccagcggcgtatccagcacccgcttgaagccgaagcgctcgcgcaggccgagggtggcgcgaaacaccccgccgttgaccccgacgtcttcgcccagcaccaccaccgtctcgtcctcggccatggcccggtgcaacgccaggttgaccgcctccagaacggccaggcgtgtcgcttcgccgttgcgctcattcatgttcggcccctccccgccgccgcgcggggcgctcccagaattgctcgcgctgctcctccaggaccgccgggcagcgcgcgtagacatgctcgaacaatgcctgcggcgcctgccccggctaacgtctcgaaacgctccaccgactcctgcacccgcgcctggcactcccccaccagcgcgtgctcgcgctcctcgtcccactggccgcggccggcgaggaaggcgcgcaggcgcttga

SEQ ID NO: 11671 - DNA, 1515 bp, Pseudomonas aeruginosa
ttgctgcttgttgtccgggccgggctgttgccgcccggcaccttcagtataggcaggcgtcggcgaaacgcccgcaaggccgacgaccaggcggcggcgctcgccgagccgggtactggacgaagcttcggcggacggttacaaccttggggtccgcccgctcgaaaccggccccggcgtgctccgaacggcccgtccgcagcgatccaggcgcaccaggaggaaagccatggacccgcgtcaagcctgcctcgattgtctcgcccaggaaccgccagcgctgttcgaggcggccctgtggatcgccgcggagcacctcccggcgtattcgcccgcccacaccctgcgcgaactcgacgaactcgtccggcagatcggcgccagcctggacgaccgcgcctcggccagcgagcgcgcccaggggttgctgcggcgaatgagcgaacagggtttctgcgaggacgacgacttccccctgcaaccgcgctcggccctgctcccgctggtgttgcagcggcgccagggacagccgttgtcgctggcgctggtggccatggaactggcgcggcggctggacattccgctggtcggagtgaacttcccgggacgcttcctgctgcgcgtgccgcaggccgaccatctgctcgacccggccaccggacggcgcctctatcccaccgactgccgcgaactgctgctgcgcctgcaggggccgaagagcgaactgcaggccgcctacctgaagcaggcctctcccggggaaatcctccagcgtctgtcgcgcaacctgcgacaactgcacagcgccgccggcgagccgctggccgcgctgaaggatgcccagcgggtgatcgaactcggcccggtgggcgccgccgaccacgaggcccgcgccggcctctatcggcaactggattgcccgcaggcggaacgctacgacctggaacgcgcgctcttgctcagcgacgatcccaccgagcaactgcgcctcggccagcgcctgggcgaactcgccccgccgaccggccgcgccctgcactgaggccgctcagggggagcaggccgagggccttggcccgcgccaccgcctgggtccgacgggccaccccgagcttgccgttgatccgccgggcgtgggtcttcaccgtgtgcagggaaatgaacagttgctcgccgatctcctggttggagcagccctgggcgatcaggccgagcaccgccagctcccgacaactgagcggactgagcccctcctcttcttcccccggcagggcggcgaacagttgcggctggcgatcccgcagtcgccgctgcggcagttgcaggcctagccgctccgccagctccaggccgctgcgcagggtctgctgggcctggggcaattgtccggagaggaactggcactcggcgatacccatgcgcacttcgcaaagcagcgtctgccgcccctgcgcctcgagaatggcgagcagcccgcgcagccgcgcttcggcggcggctgcctcgccgctgtag

SEQ ID NO: 11672 - DNA, 507 bp, Pseudomonas aeruginosa
cgctggttcgcatcggccagcagggggaagccccgcgccaacaggtcgtccagcccgtggggcagctcctcgaacagccggcggaacagctccggaccgacttgcggcagccaggccagggcacgcgcggcgtcggccagcggcggcggcagctcgtcgagcaactcgtgctggaggtattcctgcaacaacggtccggccgtctcttcgccgaccagcaggcgcaagcgcaacgcggcgcaccaaccgccgctgcgttccagcagcgccccggtcgcagcggcatcggcgctgcgaccgtgcaggcggagcagttcggcgacctcgtcggcatcgaacgccagcaggccgccgtcgacctccagcaactccccttccagcagcaaccgcgccaggttgcactgcggccgccgccggctcgccagccaccagcccacccgtggcgaggccgcgctcaacaagcaatcgaggcaggcgtcaaaggcggggtcggggtgccgtgggtaa

SEQ ID NO: 11673 - DNA, 693 bp, Pseudomonas aeruginosa
ggccgcaggaactcgaccagcagttgcgcatccccggcagctacggggcgatccattcgccgcactgcgccaccatccagccggccaggctcgcgcgcggcctggcccgcgcggtggagcgcctgggcgtgcggctgttcgagaagagccgggtgctgcactggcaacgcggcctgctgcgcaccgagcgcggcgaactacgcgccgaatggatcgtgccggcggtggaaggctatgccgccagcctgccgccgctgggccactaccagttgccggtgcagagtctgctggtggccaccgagccgctgccgtcgtcggtctgggcggagatcggcctggagcgcggccaggccttcagcgaattcagccgccaggtcacctatggccagcgcaccgccgacgaccgcctggccttcggcgcgcggggcggctaccgcttcggcggcaagctgcgcagcgacttcagcctcgacgacgaggaagtcggcctgcgtcgctacctgttcggcgaactcttcccgctgctcaaggacgccaggatcagccacacctggggcggcaacctcggcatggcccggcgcttccgcccgcacatgttgctcgaccgcgccagtggcatcgccctctccggcggctacggcggcgaaggggtcggcgccagcaacctcggcggccgcaccctggccgcgctga

SEQ ID NO: 11674 - DNA, 387 bp, Pseudomonas aeruginosa
tgcgctgagaatcccctccacctcccacagaggaaaaaccgcatggccctgacccttctgaaaaataccgccggcgccgatcttggcgccgccagcccggtcgcggtgccccttggcgagccggtcgcgcagacccgcgcctacgccgtggagcgcaccgaccaggtggaaaccggcatctgggaatgcacccccggacgctggcggcggcagatcgtcgagcaggagttctgccacttcctgcaaggccgctgcaccttcaccccggacggcggcgagaccatccgcatcgaggccggcgatgccttgctgctgccggagaacagtctcggcgtgtgggatgtgcaggaaaccgtgcgcaagagctacgtgatcatccaccgctag

SEQ ID NO: 11675 - DNA, 483 bp, Pseudomonas aeruginosa
cctggccgtccagcgccagggcctgggccagcgcccaggagctgccgatggccaccgcggtgccggcgaacatcccggccagcagcgccggccagtggcgcatcagcagctcgcgctgctgccagatcgggatggcgaaggccaccgtcgccggaccgagcagcgccaccagccaattggtgtcgcgggcgtagtcggcgtagcgggtatgggtgggaatcgccagggcgtagagcagcaccgggacgaacacgatgggcgacagccagtaccacttcacccggcggtacagctggcggctcaggaggtagccgccgacggtcgccgccaaccagaacagggcttgcttatcgagactcatggcgcgccctccagcggcacatccactccaccgacaccgcggtgaccagcatcaccagcagggtgctgagcatgatcaccaggaggatgcgccagccctcgctgcgtagcagcgcgccgtag

SEQ ID NO: 11676 - DNA, 1104 bp, Pseudomonas aeruginosa
gagccattccagaatggaattccgtcaactccgcagcttcgtcgaagtggtccgccagggcagcttcacccaggcggctcaggtccgccacgccagccagtcgaccatcagcaagcaggtcgcccaactggagcagagccttggcgtgcaggtattggaacgcaacgggccgcacgtgcgcctgaccgacgccggcgccgtggtgtttcgccgcgccgaggagatgctgcggctgcgccgcgacctgctcagcgaattggacgacctcagccagctcaaccgcggcgaactgcgcctgggcctgccgttgctcggtgccgacgcgctgttcgcccaacgcttcgccgaataccggcggcgctatccgaacatcgccgtgcacctggtggagggcggcagcaagaccatggagcaggcggtgctggccggcgagctggaattggccggcagcctcaccccggcagacgacggcttcgactaccagccgttctgcaacgaaccgctggacgtgctgctgccggccgggcatcccaaggccgctgccgccagcgtcgccctcggcgaactggcggacagcccgttcctgctctaccagcagagcttcaccctcaacgaccgcctgctgcgcgcctgcctggaggccggcttcagcccgcgcgaaggcggccgcagcggccaggccgacttcctcggcgcgctggtggcggccaaccagggagtggtgctgctaccacgagtgatcgctcgcgagatcgaacgcccgggagtggtgcgggtcctgctcagggagccggacctgcgctgggacatcgccttcatctggcgccgtggcggctacctgtcgcgggcggcgcaggcctggctggagctgctgcgcgagcagccgctggaggaaagcccggcgtaggacgaataaccgccagctcggcagaggctacggcggataacgcctgggggcgttattcgccctaccgcttgctccctccccgtgtagggcgaataaccgctacgcggttatccgccacctcggcaggcgtttcggcggatgacgcctggggcgttattcgccctaccgcttgctccctccccgtgcagggcgaataa

SEQ ID NO: 11677 - DNA, 1050 bp, Pseudomonas aeruginosa
cagcaccactccctggttggccgccaccagcgcgccgaggaagtcggcctggccgctgcggccgccttcgcgcgggctgaagccggcctccaggcaggcgcgcagcaggcggtcgttgagggtgaagctctgctggtagagcaggaacgggctgtccgccagttcgccgagggcgacgctggcggcagcggccttgggatgcccggccggcagcagcacgtccagcggttcgttgcagaacggctggtagtcgaagccgtcgtctgccggggtgaggctgccggccaattccagctcgccggccagcaccgcctgctccatggtcttgctgccgccctccaccaggtgcacggcgatgttcggatagcgccgccggtattcggcgaagcgttgggcgaacagcgcgtcggcaccgagcaacggcaggcccaggcgcagttcgccgcggttgagctggctgaggtcgtccaattcgctgagcaggtcgcggcgcagccgcagcatctcctcggcgcggcgaaacaccacggcgccggcgtcggtcaggcgcacgtgcggcccgttgcgttccaatacctgcacgccaaggctctgctccagttgggcgacctgcttgctgatggtcgactggctggcgtggcggacctgagccgcctgggtgaagctgccctggcggaccacttcgacgaagctgcggagttgacggaattccattctggaatggctctcatgcggacaattcgctttggggatgataggccgggccttatcctttctccatccccgatttcccagccaaggcctttcccatgttgcccccgctcgtccgccgtctgtcccgccttgccgccgaactggcggtactcatcgccttctggtgggccggcggctggctggcgaaggccatcggcctgccgctgccgggcggggtggtcggcctggcggcactgttgctgctgttcgccagcggcctgctgcgtccggcctggctgcaggccggcgccggcctgttgctggcggagatgttgctgttcttcatcccggcgctga

SEQ ID NO: 11678 - DNA, 738 bp, Pseudomonas aeruginosa
tgctggtcaccgcggtgtcggtggagtggatgtgccgctggagggcgcgccatgagtctcgataagcaagccctgttctggttggcggcgaccgtcggcggctacctcctgagccgccagctgtaccgccgggtgaagtggtactggctgtcgcccatcgtgttcgtcccggtgctgctctacgccctggcgattcccacccatacccgctacgccgactacgcccgcgacaccaattggctggtggcgctgctcggtccggcgacggtggccttcgccatcccgatctggcagcagcgcgagctgctgatgcgccactggccggcgctgctggccgggatgttcgccggcaccgcggtggccatcggcagctcctgggcgctggcccaggccctggcgctggacggccaggtcacgctgtcgttgctgccgcgctcgatcaccacgccgttcgccatggagatgtcccacgacctgggtggcgtgccggaactgaccgccgccttcgtgatgatcaccggggtgttcggcgcggtgatcggcggcaccctgctgcgcgtcctgcgcttgcgcacgccgctggcccgcggcgcgctgttcggcgtcggcgcgcacggcgccggcaccagtcgggcctacgagttcggcggcgaggaaggttcggcggccggtctgctgatggttctcaccgggctgttcaacctgctggtcgcgcccctggtcgcccactgcctgtag

SEQ ID NO: 11679 - DNA, 750 bp, Pseudomonas aeruginosa
tgcgcagcaagaccggcatgggcggccagctcgcctggccggcgctgctgcgcaagctcgaccagcagaacccgggctaccgccagtgaccgcggcgctgcccggcattcccctggaggcctggcggaggcgcggccgcactctggatttcaagggcttcccgatccgctattgggaagccgggcagggtcggccgttgctgctgatccacggttttcccagcgccgcctgggactggcactacctctgggagccgctggcgcagcgctaccgcgtgctggtctgcgacctgctcggcttcggcgattcggccaagccgcgcgcccatcgctacagcctgctggagcaggccgacctgcaacaggcgctgctcggccgcctgggaatcgacgagccgctgcacgtgctggcccacgactacggcgacagcgtcgcccaggaactgctcgcccgccatcacgaaggccggctgcggctcgcctcctgcgtgttcctcaatggtgggctgttcccggaaacgcaccgcccggtgctcagccagaagctgttgctgagcccgttgggcgggctgttcggccggctgttcgaccgccgcgccctggcgcgcaacttcgccaaggttttcggcccgcgcagccagcccggcgagaccgagctggatgccttctggagcctgatcgaaagcaaccaggggcagcgggtgatgcatcgcctgatccgctacatcgtcgaccgccgcgagcagcgtga

SEQ ID NO: 11680 - DNA, 408 bp, Pseudomonas aeruginosa
ttcagagttttcttaagcgagtttgagattgcagcaagtgccatcgcgcaaggatcggggctagggtgctggcgcctcgctggacgaggcgtttcgtcacccatggaggtctccatgcacgatcccgtttctcccttgcgcgtgttcgacgagggctcctggttgttccgccagttggtgcaggcgcaaccgttcatccgccagtccgggatggtcctcgccgaactcggcctgctgctggcgctcgggctcggctacctgtgctggcaggaaggcagtcgctggtacgccgtcggcgccggcctcgcgttgctcggcagcctgctgctggtggtggtccggcacaactacgactggtggctgttcaagctcggcccgcgtggccggctgtacattccgttcgactga

SEQ ID NO: 11681 - DNA, 846 bp, Pseudomonas aeruginosa
ggtgaagaccggctgacgccggtcttctgccatccggccggtgtcttttttcgctttttccgcagggagtctgtcatgagtgtcatcgtcgaacgcaacggcccggtcaccaccctggtcatcgctcgccctgagcggcgcaatgcggtggaccggccgaccgcccaggccctggccgacgccctgcgcgagttcgaagcggacgatacggcgcgggtcgcggtactcaccggcagcggcggcaatttctgcgccggcgccgacctggcggcggtggccgaggatggcgagcggcgcaatcgcctggaggcggagggcgacggaccgatggggccgagccgcatgcagctcggcaagccgctgatcgccgccatcgaaggctatgcggtggccggcgggctggagctggcgctgctcgccgacctgcgggtgatggccgaggacgccatctgcggagtgttctgccggcgtttcggggtgccgctgatcgatggcggcagcgtgcgcctgccgcggatcgtcgggcagggccgggcgctcgacctgatcctcaccgggcgtccggtgaaggccgacgaagcgttgcagatcggcctggccaaccgggtggtgccgagcggttcggcgcgagccgaggccgaggagctggcggcggaactcgccgccttcccgcagacctgcatgctcgccgaccgcgccagcgtatatgcgcagtgggaactgtccttcgacgtggccctggccaacgaattccagggcgggctggcggtgatcgagagcggcgagaccctggagggcgcgcagcgcttcaaggacggcgaggggcgccacgggcgcttcgagtga

SEQ ID NO: 11682 - DNA, 1842 bp, Pseudomonas aeruginosa
ggtgtacccacctcgaccctgtcaggagagccgcatgacaacaacaaaaaggcgcggaatcttccctctgcacgcactcgctgcggccacagccctgggttgcgccacccaggcctcggccgtgtcattcaacatcggggagatcgaagggcaattcgactcgtcgctgtcggtgggggccagctggtccatgcgttccgccgacaaggactacatcggcacccgcaacggcggccacgcctcgtcgcagacctccgacgacggccggctgaacttcaagaagggcgaaaccttctcgaagatcttcaagggcatccacgatctcgaactcaagtacggcgacaccggcgcgttcttccgtggcaagtactggtacgacttcgagctgaaggacgaacaccgcctgctctacgacatcgacgaccacaatcgcaaggagggcgccaagtcctccggggcgcagctgctcgatgccttcctctaccacaactacagcatcggcgacctgcccggcagcgtgcgggtcggcaagcaggtggtgagctggggcgagagcacgttcatccagaactcgatcaacagtatcaacccgatggacgtcgccgcgttccgccggcccggcgcggagatcaaggaaggcctgatcccggtgaacatgctctacctgtcccagggcatcagcgacgcgctgaccgtcgaaggcttctaccagttggagtgggaccagacggtgatcgacaactgcggcaccttcttctctaccaccgacgtggtcgccgatggctgcgagcggatggtctacgccggcagcgacttcgacccgaacccggccaacggctaccgctacctgccgcgcgccggcgatcgcgatgcccgcgacagcggccagtggggcctggccctgcgctggtacgcggcggagctgaacgacaccgagttcggcctgtacgcgatgaactaccacagtcgcaacccgtactacagcgtgatcgccggcaacggcctggccacctccgacccggtcaccgggcgctccaccggctattacttcatcgactatcccgaggacatccgcctctacggcctgagcttccagaccaacatcggcagcacctcggtggccggcgagctgagctaccggccgaacatgccgctacaaatcaacagcaccgacatgtcgatcgccgcgatctacccgaccaccctgttcggcaacccgatctacgacagcggcttcgccaccccgcgcgccggcgaggtgatcaacggctacgtgcgcaagccggtgacccaggcacaggtgaccgtcacccagttcttcgaccgggtactggcggccgaccgcctgaccgtggtcggcgaagtcggctacaaccacctcagcggggtcgacggcgacgacctgcgctacggtcgcgacgccatctatggcatcggcgaactgccgaacaacgccttgtgcaccggcgcgctcaacgtggccaacccgcaggagtgcaacagccacggcttctacacccgcaactcgtggggctatcgcctgcgcgggatcctcgaatatcccaacgtgttcgccggggtcaacctgaagccgaacctggcctggtcgcacgacgtcgagggatacgggccgaacttcagcgagggcgccaaggccgtcagcgtcggcctcgatgccgaataccagaacacgtataccgccagcatcagctacaccgacttcttcggcggcaactacaacccgatcaacgaccgcgacttcctcgcggtgagcttcggggtgaacttctgaggtccgccgcccctcggggcggccgctttcgcggatacgaacaaggataa

SEQ ID NO: 11683 - DNA, 1377 bp, Pseudomonas aeruginosa
cgacgcatgaaaacagcacgactcctgtcctccggggcgctggccctcagcctgctggccggttcggtgacggcggcggtttcgcccgacgaggccgccaagctcggcagcagcctgacccccatcggcgcgcagaaggaaggcaacgccgacggcagcatcccggcctggaccggcggcctcgcggccagcgccggcaaggtcgatggcaagggcttcctttccgatccctttgccgacgagaagccgctgttcaccatcaccgcgcagaacgtcgagcaatacaaggacaagctctccgacggccagttggcgatgttcaagcgctacccggaaacctaccggatcccggtgtacaagacccatcgcacggtggccctgccggccgagatcgacgaggcggtcaggcagagcgcgctgaacgtgcagccgatcaacgacggcaacggcctgtcgaatttcgagaagagccgctactacgccttcccgatcccgaagaacggtgtcgaagtgctctggaaccacatcacccgctaccgcggcggcaacctcaagcgcaccatcgtccaggccaccccgcagaccaacggcagcttcacgccgatccgcttcgaggagtcggtggcattcccgcagaacatgcccgacctcgaccagagcaaggcggccaacatcctcaccttcttcaagcagcaggtgaccgcgccggcgcgcctggcgggcaacgtgctgctggtccacgagaccctcgaccaggtcaaggagccgcgcctggcctgggtctacaacgccggccagcgccgcgtgcggcgcgccccgcaggtggcctacgatggcccgggcaccgccgccgacggcctgcgcacctcggataacttcgacatgttctccggcgccccggaccgctacgactggaagctggtcggcaagctcgagatgtacatcccctacaacgcctacaagctcaacgacccgaccctgaagtacggcgacatcatcaaggccgggcacatcaaccaggacctgacccgctacgagctgcaccgggtgtgggaagtggtcggcacggtgaagccgggcgagcggcacatctacgccaagcgccacatgtacatcgacgaggacagctggcagatcgccctggtcgaccactacgacggtcgcggccagctctggcgggtcggcgagggccacgcgcagtaccactacgaccagaaggtcgccggctacaccctggaggcgctctacgacgtgatcgccggtcgctacctggcgctgggcatgaacaacgaggagaagcgcggctacgagttcggcttcaaggcctcgtccgccgactacacgccggccgccctgcgcaacgccggggtacgctga

SEQ ID NO: 11684 - DNA, 1014 bp, Pseudomonas aeruginosa
tggacgcggcccggctcgacggtctccacctcgcccaagacccggccacgggactcaaggccattatcgccatccacagcacgcgactcggcccggcgctgggtggttgtcgctacctgccttaccccaacgacgaagccgccatcggcgacgcccatccgcctggcccagggcatgagctacaaggcggccctggccgggctggagcagggcggcggcaaggcggtgatcatccgcccgccgcacctggacaatcgcggcgcgctgttcgaggccttcgggcgcttcatcgaaagcctcggcggaggctacatcactgcggtggacagcggtacctccagcgccgacatggactgcatcgcccagcagacccgccacgtcaccagcaccacccaggccggcgacccctcgccgcataccgccctcggcgtgttcgccgggattcgcgccagcgcccaggcgcgcctcggcagcgacgacctggaaggcctgcgggtcgcggtgcaggggctcggccacgtcggctacgcattggccgagcaactggcggcggtcggcgccgagctgctggtctgcgacctcgatcccggccgggtgcaactggccgtcgagcagctcggtgcccatccgctggcgccggaggcattgctctccaccccttgcgacatcctcgcgccctgcggcctgggcggcgtgctcaccagccagagcgtcagccagttgcgctgcgcggcggtggccggggcggcgaacaaccagttggagcggccggaggtcgccgacgagctggaggcgcgcggcatcctctatgcgccggactacgtgatcaactccggcggcctgatctacgtcgccctcaagcaccgcggcgccgacccgcacagcatcaccgcgcacctggcgcggattcccgcgcggctcaccgagatctatgcccatgcccaggccgaccaccagtcgccggcgcggatcgccgaccgtctggcggaacggattctctacggcccgcagtga

SEQ ID NO: 11685 - DNA, 1131 bp, Pseudomonas aeruginosa
gcggcacgcctacccggcgtgcggaggaggtttgcgatggttcacaaccggatcgacccgcctttcacccgctacctcgacagcgacggtcggcccctcggcgagttgcccgcctgggccggcgacagcgatgcgctggtcggcctctaccggcagatgctcctgacccgcctgttcgaccagaaggcggtggccctccagcgtaccgggcggatcggcacctatgcgccaaccctcggccaggaagccatcggagtggccatcggcagccagatgcgcgccgaggacgtgctggtgccgtattaccgcgataccgccgtgcaattgatgcgcggcgtgcgcatggaggacatcctcctctactggggcggcgacgagcgcggcagcgactacgccgaaccgctggcggcgcaggactttcccatttgcgtgccgatcgccacccaggccctgcatgcctgcggggtcgcctcggcgttccgcatccgcggcgaacaccgggtggcggtgaccacctgcggcgacggcgccaccagcaagggcgatttcctcgaggcgctgaacgtggcgggcgcctggcagttgccggtgctcttcgtggtcaacaacaaccagtgggcgatctcggtgccgcggcgcatccagtgcggcgcgccgaccctggcggagaatgcggtgggtgccggcttccccggcgaacaggtggacggcaacgacgtgctggcggtcgccgaacgcgtccgcgcggccctggagcgcgcgcgccacggcaaggggccgaccctgctggagtgcatcagctatcgcctctgcgaccacaccacggccgacaacgccagccgctaccgttcccccgaggaggtcaaccaggcctggcgcgaggaaccgatcaagcgcctgcgcgccttcctcgccggccgcggccagtgggacgaggagcgcgagcacgcgctggtgggggagtgccaggcgcgggtgcaggagtcggtggagcgtttcgagacgttagccggggcaggcgccgcaggcattgttcgagcatgtctacgcgcgctgcccggcggtcctggaggagcagcgcgagcaattctgggagcgccccgcgcggcggcggggaggggccgaacatga

SEQ ID NO: 11686 - DNA, 942 bp, Pseudomonas aeruginosa
tcgtccatgaggcgccgaagagtggcggcctcggcggggaaatcgccgcgagcctctacgagcgtgtcctgttcgacctgcgggcgccgatccagcgggtcgccgcggccgatatcccgccgccgctgtaccgcctggaagcgctgtacatgcccgccgtggaggacatcctggcggcctgcgacaccgtgctcggctacgcctgagccaaggggagacgaccatgaagcacttcaagctgcccgacctgggcgagggcctgcaggaagcggaaatcgtcgaatggcacgtcaaggccggcgacagcgtgcgcgccgaccagcgcctggtttcggtggaaaccgccaaggcgctggtggacatccctgcgccctacgatggggtggtgggcaagctgttgcggcgccggagggcgacatccttgccacgtcggcggaaccgctggtgggcttcgaggccgaggaggcggaccgccggtaccttgggtggggcgcctggcgggcaggcggtaaccccctgggggaccgtttgttcatcggggccgcaccgtccacccggcgaacacctgggcaccgccccgccgaccccgggcggtgcgcccagttcgcccgcccagcagggcgtcgaactggccggcatgagcggctccgccctggatggcgtgatcaccatctcggacgtggaggccgccgcctagggcgcccgagaatgctttggcggcgagcgcttgcgcggggtacggcggagcatggcgctgaacatggcgcgctcgcatgccgaggtggtgccggtgacgatctacggcgacgccgacctgcatcgctggaagaccgcacgcgacccgttgatccgcctggcccaggcgctggccgaggcctgtcgcgccgagccgaccctcaacgcctggttcgatggcgcctcgttgtcgctgaaactgcatga

SEQ ID NO: 11687 - DNA, 456 bp, Pseudomonas aeruginosa
gcgcgctgcccatcaggtagtagagccagaccaacgccagcaggtcgccgccgaagctgcgtatccagccccaatgccggcccagggtggcgagcaggaccagcaggccgaacagcagcagtgccagcagcaggctgcgccggtccaggcgccagcgtcgggagcggacgggggaggcggggagagcgggcatgggaccttcctggtcgatggggctgccgggcgttgtacggcaagcgccagtttccggcaagccgggcgcgggtcggacaagcgccgcgcggactcagcggcgtcgcaggctggcgagcagttgttcgacgaaggcgtcgctgccggagctgtcgaggtagtgcacctggggaccgtcgagcaggtagagcgcgtggtagggcttgccggcctggctgccgcgcaggcgatagacctcggtgccggccacgcggtagcggctga

SEQ ID NO: 11688 - DNA, 549 bp, Pseudomonas aeruginosa
aaaatatgctgctgcccttctgaaaggacgtgggtggatgcgccgttggcggagcaggatctcaaggcactgtttctcaggcatgcccggcagttgcagtcgtatctgttgcgcaagacccgtgatccacacctggcggcggacctggcgcaggaaagcttcctgcgcctggccgagcagcggcacaaggagccgatcgagcatgtcgacgcctatctctaccgcaccgcgcacaacctcaccatcgaccattaccggcaggaacggcggcgccgcaccgagacccggcccaacgacgacctcgccgggttcgtcgccgaccagcccggccccgaggagtccgcggtggatgccgatgcgcttgcccgcctgcgcgagatagtcgccgaactgccgccgcgcacccgtgagatcttccgtctcaaccgtctggaggggctgacccatgccgaggtggcgagacgcctggaaatctccgatagctcggtgcagaagcacctggcccgcgccctggcccttgtgatgctcgcactctacgattctcgctga

SEQ ID NO: 11689 - DNA, 564 bp, Pseudomonas aeruginosa
cccccggcacccggccgcgctggcgctggcgcaacggacctggaaacagctgggatcgctggccgaaccgcggacgatggttcagacgccggttgccagcgcgccgcgccgcgccggggggcggcgcaaggggtggcgcggctgggccgcggcggcggcggtgctgctggccctgggcagcgcctggagcgaacgcgacgccggcgtgacctggctggccgaccactctaccggcaagggcgaggtacgcatcctgcggctggtggatggcagcgaggtcgagctggacgcacagagtgccatcgatgtcgcctacgacagccgcgagcgacgggtgcgcctgctcgaaggcagcgcgatcttccgcgccgccccccgcgcggggcgggagacacggcccttcgtggtggaaagcgccggcggcagcactcgcgcgctgggtactcggttcctggtcagccgcaacgacgacggcagcgtccaggtcggggtgctcgaacaccgcgtcgcggtggccctggcgcatccgcgcacggggaccgtcgggcgccgcgagctgggtga

SEQ ID NO: 11690 - DNA, 2934 bp, Pseudomonas aeruginosa
gctgggagtgcgcagcccgggcctggcgggggggacgctgctgtactgatcgggccgatcgcttctgagaaccttgaccacgggccgggcagtcgccccgcgcgcttgttccggcaggggccgggaagcgtattttcgagccgtggatcccgccggcgaaaaattttgtcgatttccgttactgactttccctgcctccatcgttctcttaacgagactgattcttattacacaaaacgatggagtgtaggcgctgtcatgaaacatcgtggatggagtgccgtgcgaggcggtcgcaagggggcgcaactggccctggggctgggcctggtcctgctgggaacggccgcgctaccgctgcatgcgcaagacggggcggactcggcgagccagcagcagaccgcgctgcgccgggtccggctggacatcccggcacaaccggtgaaccgcgccctgctgcgattcgccgagcaggccggggtccaggtgttcttcgacagccagcgtttcgccggtctcggcagcgcggcggtgcacggcgaatacgtgctggccgacggcctgagccagatgctccagggcagcccggtggaataccgcttctccggcaaggaccaattgagcctgatccgcgtcagccaggacgacctggtgcagatgtcgccctcggtgatttccgccgcgcgtccggacgactgggtctaccagacgccgcattcggtcagcgtgatcggccgcgagcagatcgagcgcaacccgccgcggcatgccgccgacatgctcgaggaaacccccggggtgtactcctcggtgagccagcaggaccccggcctgtcggtgaacatccgtggcatccaggactacgggcgggtcaacatgtcggtcgacggcatgcgccagaactaccagcagagcggccaccagcagcgcaacgggacgctctacgtcgatcccgagctgctcagcgaggtggtcatcgacaagggcgccagctcggccatgggcggcgccggggtgatcggcgggatcgccaacttccgcaccgtggaggcccgcgacctggtcaggccgggcaagcaggtcggtggccgggtgcgcctcaccagcggcctgggcggcgacgccaatggcacccacttcatcggcagcgcggccttcgccatcggcaccgaggtctgggacatgctggtcgccgccagcgagcgccacctgggcgactacgacccggggaccaagggcagcattggcgagctgcgcaccggcgcctggttcaatcccgaggccgggcagcgggtcaagcattcgccggtggcctactccggctacgtgatgcgctcgcgactggccaagcttggcgtcgccctgccgcaggaccagcgcctgcagttcagctacctgaccacccaggtgtcctacgacgacgccaacatgctcaacaccgagaaccaggcgctctgggaaaagctcggcagcagcgacgtgcgtgcgcagaacttcgccatcgactacggctacgcgccggacaacccgttggtggacttcaaggccaagctctactacgtcgacaaccgcaaccgccagcagaccctgcaacgcggtatcacccccggctactcgatcacctaccagaccgacacctacggcgcgcaggcgcagaacacctcgaccttcgctctcgacgatctctccacgctgcgcgccaactatggcctggagttcttctacgacaaggtgcggccggactccagccagccgcgggcgagcacctcggcggtcggcttccctgcggccgaaggcatgacccccaagggcgaccgcgccctcggtagcctgttcgcccgtctcgactacgactacgacgactggctcaacctcaacgccgggctgcgttacgaccgctaccgcctgcgcggcgacaccggcttcaacgcgcgcaccttcatccttggcaccacccggcagaccgacatgccgctgcaatacgccgtcgaccgcgaggaggggcgcttctcgccgaccttcggcctgtcggtcaagcccggcgtcgactggttgcagttgttcgccacctacggcaagggctggcgcccgccggcggtgaccgagagcctgatcaccggccgcccccacggcggcggcgcggaaaacatgtaccccaacccgttcctcagtccggagcgctcgaaggcctgggaagtcggtttcaacgtgctgaaggagaacctctggttcagcgacgaccgcctgggcctgaaggtcgcctacttcgacacccgggtcgacgacttcatcttcatgggcatgggcatgcagccgccgggctacggcatggccgggatcggcaacagcgcctacgtcaacaacctcgacagcacgcgcttccgtggcgtcgagtaccagctcgactacgatgccgggctggcctacgggcagctctcctacacgcacatgatcggcagcaacgacttctgttcgaagaccgcctggctcggcggcgtcacccagacggtgaagggcagcggtcgccgcccgccggtgatcgacatgcggccggacgagcaggccaacgccgccacccattgcagcgcggtgctcggctccgccgaacacatgccgatggaccgcggctcgctgaccctgggcatgcgcttcttcgaccgcaggctggacgtcggcgcccgtgcccgctacagcgaaggctactcggtggctggcggcgccacggtgtcgcaggccggcgtgtacccggcggactggaaggaatacaccgtctacgacctgtacggcagctaccgggtgagcgacgaactgaccctgcgcctggccatggagaacgtcaccgaccgcgcctacctggtgccgctgggcgacgtgctggccttcaccctcggtcgcgggcggaccctgcaaggcaccctcgaataccagttctga

SEQ ID NO: 11691 - DNA, 2304 bp, Pseudomonas aeruginosa
aaaggcgcggatcgagtttcccgccgagctgctggcgctggacgacccgcgcctgccgaccctgctggaacagcagcggcagttgcacgacagccgtcggcgggcgctgcgcctggaactcgatggtctcgccgagacggtcgccggcagccaggcgcaactggacggcctgcaagccgcgctgcgcagcaaggagcagcagcgcgccgccctcgaggaacagttgcgcggcctgcgccaactggccagcgagggctacgtgccgcgcaaccgcctgctcgacagcgagcgcctgctggcccaggtcaacggcgagatcgccggcgacctcggcagcctcggcagtacccgccggcagatcctcgaactgcgcctgcgcatggcccagcggcgggagaagttccaggaagaggtgcgcgccagcctggccgacgcccaggtgcgcgccgaggagttgcgcaatcgcctggccagcgcgcgcttcgacctggccaacagcgaggtacgggcgccggtcgccggcctggtggtcggccaggaagtgttcaccgagggcggcgtgatcgcgcccggccagcaactgatggaaatcctcccggagcgccagccgctgctggtggacgctcggctgccggtggagatggtcgacaaggtccgcgtcggcctgccggtggagctgatgttcagcgccttcaaccagagcactacgccgcgggtggagggcgaagtgaccctggtctcggccgaccgcctgctggacgagcgcagcgaggcgccgtactaccgggtgcgcatccgcgtaggcgaggagggcgtacgtcgcctggccggcctggagatccgcccggggatgccggtggaggccttcgttcgcagcggcgagcgctcgctgttgaactacctgttcaagccgctggccgaccgtacccacctggcgctgggggaagaatgaatcgcctgcgagcctgcctgctgtcctccgcgctgctttcggcctcttcggcccaggcgctgggcctgctggacgcctaccaactggcggtgcgccacgacccgaccttccaggcggcgctccacgagcgccgcgctggcagcgaaaaccgcgccatcggccgtgccggcctgctgccgagcctgcgctacgactacaacaaggcgcgcaacgactccaccgtcagccagggcgacgcccgcgtcgagcgcgactatcgcagctacgcctcgaccctcagcctggagcagccgctgttcgactacgaggcctacgcgcgctaccgccagggcgaggcccaggcgctgttcgccgacgaacagttccgcgggcgcagccaggaactggcggtgcgcctgttcgccgcctacagcgaaaccctgttcgcccgcgagcaggtggtcctggccgaggcccagcggcgcgccctggaaacccagctggcgttcaaccagcgtgccttcgaggaaggcgagggcacccgcaccgacctgctggagacccgcgcccggctgagcctgacccgcgccgaggagatcgccgccagcgatcgcgcggcggcggcgcggcgtacgctggaggcgatgctcgggcaggcactggaggatcgcgaactggccgcgcccatcgagcgcttcccggcgctgcgcctgcaaccggcgaccttcgaaggctggcgccaggtggccctgcaacgcagcgccgagctgggcgcccagcgccatgcgctggaggcggcagcctacgaggtggagcgcaatcgtgccggccacttgcccaggctcagcctctacgccagcagcagcaagacgcactcggcttcggaaagcacctacgagcagaaatacgacaccgacagtgtcggcctgcgtctcagcctgccgctgttcgagggcgggcgggtgtcggcagcgacccgccaggccggcgacaagtacgcccaggcccaggccgagctggatgcccaggtggccagtgtgatcaatgacctgcacagccagttcgacctgaccgccagcagcctggccaaggtgcgtgcctacgagatggcggtggcggcggcgcgcgaacaggtgacagcgacgcggcgcagcgtcgccggcggggagcgggtcaatcgcgacgtgctggacgccgaacagcagttcaacggcgcccgccgcgacctggcggaagcgcgctacgcctacctcaacgcctggctgcgcctgcgccagctggcgggggtgctggaagaccgcgacctggcggtgctggctgcctatttcggtgccggcgaaggacgcgcgcaggtcgccgctgccatcagatag

SEQ ID NO: 11692 - DNA, 459 bp, Pseudomonas aeruginosa
tcagcctcgacagccccgagctggaagcccagctcgatgccttgcacgcggcgcgcaaccaggcccaggcgcagctcgacgagtcgctccacggtacccgcgaggagagcatccgcgcgctcaaggccagcctggcacaggccgaggccgagttgcgcaacgccgagtcggatttccagcgcaaccagcagatggtcgagcgcggcttcctctcgcggacccagttcgacctctcgcggcgtgagcgcgatgtcgcccgcgaccgcgtcgccgaggcgcgggccaatctcgacgaaggcctcaagggcgaccgcgaggagcgccgccaggcgttgcaggccgcggtgcgccgggccgacgcgcagatcgccgagctacaggcgcagatcgacgacctgcaggtgcgcgcgccggtcaacggcgaggtcgggccgatccccgccgaacagggcgaactga

SEQ ID NO: 11693 - DNA, 1536 bp, Pseudomonas aeruginosa
gcccgatatgaagaactacctgcaaatcctccgggaaaccctgaaggccatgctgtccaagccgatgtggctgatggtcgtggcctcggtgtgcatcacctcgctgccgtacatgaaccacaccgccctcgacctgccggtggcggtggtcgacgaggatcacagcgacgtgtcgcgcgagctggtccggctgctcgattcggcgccgaaagtcgccgtggtcggctacgacagcctgccgcaggccaagcgcgacctggcctggcgcgagctgtacgcgatcatcgtgatcccgctgaacttcgagaagcgcctgctgcgcggcgaggcgctggtgatcccgtacttcggcgatgccaccaaccgcatggccaacggccagatccagcaggacatctcggcggtttacagcgcgctgaccaaccgttacaacgccgctctgctggaacgcgaaggcttcaccgcgacccaggcgcaggtggtgctgagcccgctggtagggcaattgaccgacctgttcaaccccggcatcagcttcgccgcgatcgtccttccggggctgctgtcgctgatcctgcaacacagcctgctgctcggctgcacccgcggcaacatcatgctgcgcggcggcaccccgcgctacatgcgccagccgctgtcgacccgcttcggccgctacagcgcgcaactgctgatctggtccgtgctggcgatgctcttttacgtgatctggccgcacctgctgggctatcgccagtcggcctcgttcttcatgctgctggggatcgtcctgccgttcctaatcgcggtgatcgccctcagcgagttcatcgccgagctgctgcccaccgaggaatcggtgtacctgaccatgaccttcatcaccctgccgctgttctacatggccggctacagctggccggaacaggccatgccggactgggtacgctggctggccgacgcgatcccctcgacctgggcgatccgcgccatcgccgagatgaaccagatggacctgccgctgcgcgaagtcagcgaccatgccctggtgctgctgggcatggccgccacctatgcgttgctgggtacgctgctgtaccagtaccgcaactggcgctgggacaacgtcaagggttggtgaagcggcgcaaggccggccatactcggctggcgttcgcacagggagatgaaggaatgtttcgttcggggctttctttgctggtgcttctggggctcgccacgctcggcgggtgcggttccgtcaacacgctggtgcgcgacgacgccagcgccgcccacgacttgcgcctgaaggcgaccgcctgcaccagcctgccgcgggtgtacagcggggtcagctacaccttctgccggctcaacgtgaagaccgggtcgccggtggcgccggcgcaagccgacggcatcctcgaggtgctggccctcgacttcgcgctgtccggggtgatcgacaccctcgcgctgccctatacctcgtaccgccagtaccgcgacggcaacctgtccctggccaactga

SEQ ID NO: 11694 - DNA, 894 bp, Pseudomonas aeruginosa
cgttgcatggcggaacctcgtgagtcagatggggcggcggcggaacaggccgtgggccagcgccagggcagcgccggcccagagggccagggccagccagagggcgctggcggacaccggcaggtcgctggccaggggaaccaccccgccggcggcggctgcgtcgaagccggacaggttgatcagccggtagaggtcggtcgggttgagcagcaacagccagggcagcagccgcgggctcaggtgaccctggctgaggaccaggatcgccagcagggccaggtcgaacagcaggacgaagaagaaccacaggccgagcgcctgcccggcggcgctggatttctcgctggcgcggctgctcagggcgtaggccagggcgaggaacacgcagccgagcagcagcgaggaacccatgaagcggccgaaggcgcccagcaggatggccgcctcgacctccggcaccagcgcgaggatcgccagcgccgcgctgccgaagccgatcagggtggccagggcgaggatcaggccgtgaccgaggaacttgccgagcagcaactggccgcgccccagcgggtaggtcaggagcagcagcagggtgccgccttcctcctcgccgacgatggcgtcgtaggccagcagcagggcgatcagcggcatcaggaaggtggccaggctggtcaggctggcgaccgtcgccggcaccgaggtgaagccgacctggccggccgcggcggcgccgaaccaggcgatgcccaccgagagcagggcgaacagcaggctgatcgccagcagccagcgattgcgcaggccgtcggccagttccttgcgggcgatggtccaaactacgggcatggcgtggctccggcgggggcgggggacatgtggtggcgatag

SEQ ID NO: 11695 - DNA, 1578 bp, Pseudomonas aeruginosa
cgaagttgccggcgtagcggcccgccgccaggctccagcggccatcgccgtcggcccgcagcggcaggccgtcgaccggctccgcgcgggccgtggcgaggccgagcaggagcagggcgaggagcggccccgcccggcgcccggccagcgaccgcgctgcgtggatcaagccttttccaccagcatccgcccgcacatttccatgtgcagggcgtggcagaaccagctgcagtagtaccagtgcaccccgggcttatcggcgacgaaggtgatcgacgaggtctgttgcgggctgatctccatgcagacgccgtggttgaccatgacgaagccgtgggtcacgtcctcgatctcgtcgaggttggtgatggtcacggtgacttcgtcgccctgcttcaccttgaactcggtgaggccgaaggagggcgccatcgagaccatgtagacgcggaccttgttgccctcgcggatgaccttgttgtccttcatcaggtcgatgccgtccttttccgcgcgcttgaccgtctcggcgaagaacgggtccttgcggtcccagatcttgcgggtcttgatctggtcgcggcgggcgaggatgcaatcgtgcggttcggcgaaggtcgggccgtcgtggaccagcttcatttcctcgccggaaatgtcgatcaactggtcgttctccgggtgcagcggaccggtgggcaggaagcggtccttggagaacttgctgagcaccacgatccacttgccgtcggcttcgctggtctcgcacagggtggcgtggttgtgccccggctggtactgcacgtcgagtttctggcggatgtagtcgaccttcacgcccttgtaggcgcgcaccgcgtcggccaggttccacttcaccaactggctgtcgatgaacagcgtggtataggcgttgcctcggccatcgaaggtggtgtgcagcgggccgaggcccagttccggctcgcccaccaccacgtcgcgcgggtcggccagcttgccggcgaacaggtcgccgaggcgctcgatggcgatcatggtgcaggtcggcgagagcttgccgttggcgatgaagtacttgccgtccggcgaggtgttcagcccgtgggggttcttcggtaccgggatgtagcgggtcaccgggctgtccttgccgtccttgcgccggccgtcgaccaccggcaccttcgagtcgccgagggtgacgaagcgcctggccttgatctcggcctcgatgcgcgggatgtcgaacaccaccacccagtcgcgctcgttgcgcatcatgccgccgaggtcgacggccttctccgagttgtagcaggtggaggcggcgaacctgccgctgtagtccatgtcggtgttgtcgaggttgccgtcgacgatcacctgccaggccacttccatggtctcggcgtcgatggcgttgtacagggtgaaggcgttgtcgccggacaggtcgaaggtcgagccgtcgttgggatgggggatgatgaactcggcgttgccagaacacgtagcgggtatgcggcaccttttgcaggcgcaggccgtggatcgcctggacgttgggaatggtga

SEQ ID NO: 11696 - DNA, 561 bp, Pseudomonas aeruginosa
acaccggtatgcgcatcagctcgcgcatcgacggcacgccgagcacgcgtacttcgccggaatgtccgccgctccagaacccgtagtactcatccagttcgccgggggcgacctcggccttgctgcgctcgcccttgcccgcggcccgggcctcgcggccgaccaccgcgctgcccagggcgctggcgccaaccagggcggcggctccggtcagcgccgaggcgccgaggaagccgcggcggttcaggccgtgggtttcttcgtgggggcttttcgtgtcgtcgctcatctcgtgtcgtcctcaagggcagtcaggggaaagggagccaggtcagaggttctccgcgggtatccgcgcgttgtccgccggcgcgctcttcgcgcgcttcttgcgcttgttcaccagcggcgggcacttgtcctggtcgtggtaggtcatctggcagtcgaggcagtagtggcattcgttggcctcgatgcggccgtcgggatggatcgcctggatctcgcattcgcgggcacagagctggcagggcctgccgcattccgcgcggcgcttga

SEQ ID NO: 11697 - DNA, 1221 bp, Pseudomonas aeruginosa
gaggagcgggggcggaacgcgcttgatgaaagtcaagaagtggagatgaggaacaagcgaggttgctggcactcagtgtaccgagtcgcccctctcccttcagggagaggggagagggctgcccgaggctcaggccaggcgttgcccggataccgctggatggtacagcggctgcaccttgttgcccgccgggtcgagcaggtggaagctgcgcgcgccgtcgccgtggtcgaagggttggtcgagcagggtcacgcccagcgctttcaggtaacggtaccaggcctccagttcctccacgctgtcgacgacgaagccgtagtgatccatggtctgcaggccgttgctggcagcgtgggcgcggccaagggaaaggttgtcgttgccgcaggtgagatacaccaggtcttcgttggcgcggttcagcacttccatgcccagtacgtcgacatagaagcgctcgcattcttccaggttgggcaccagcagggcgaggtgacgcaggccgttgaggcgggaggggcgggcagggcggtcggacatgggtttgcttccttttttgtatacaataattttataaatctaaaacaaaaggaagtttccgtgtactgcatctttatcaagacccgcctcaggcccggctgcgccgaggctttcatcgatgccatccaggtcaacgccgccgcttccgtgtccaccgagcccggctgcctggtgttcgacgtttcccgcgaccgacaggaccctgacctggtctatctctacgaggtctatcgcgatgacgcgggcctacgaggcgcacacccgcaccgcgcatttccgcgacagccgaccgttggtcgagccgctgatcctcgaacaggaagtcttcgaaagcgacgcgctggcgctcaatccgctgcgctgagaaggctcaatcgccgctggcgacgtccagcacgcggatcaggtccgggcgcgggtagtgccaatgcacgtcgaggtcccacaggcgcaccccgtagcggcgcccgggctctggcttctggtaggccgggcgtgggtcctgcgccaggcattgctcgatcagctcggctaccggctgccgcaaccgctggccgtgctcatgggcctggcgccgcgcctgctcgctccactccacggcgatgcccggcggcggcgcgtcggcgatgccgttgcgggcgtcggccacggcgtcggcgtagggtacgtagggcttga

SEQ ID NO: 11698 - DNA, 912 bp, Pseudomonas aeruginosa
cacagtctccttctatcttggtctacaccagatggcgccgctggcgtcttcgtgcaaccgattggagggagaacgatgagcgcggtgatccgtgtcgacagcctgaacaagacctttgcccgcaagcaggcgcttttcaacctgaggctggagatccaggcgggcgagatggtggcgttgatcggtgcatccggctccggcaaatccacgctcctgcgtcacgtcgccgggcttgcccgctgcgaccgcgacaacggcggcagcatcgacgtgctgggtcgccgcctccaggcgtccggccgcctgagcggcgaagtgcgtcgcctgcgcgccgacatcggctacatcttccagcagttcaacctggtcaaccgcctcagcgtgctggacaacgtcctgctcggcttcctcggtcgcatgccgcgctggcgcggttcgctggggctgttcagcgccgagcagaagcgccaggccctggaagcgctggcacgggtcggcctggccgatttcgccgggcagcgcgcctcgaccctttccggcggccagcagcagcgcgtggccatcgcccgcgccctgacccagaaggccgaggtgattctcgccgacgaaccgatcgcctcgctcgacccggagtcggcgcgcaaggtgatggacatcctcgccgatatcaaccgccacgacggcaagaccgtggtggtgaccctgcatcaggtcgactacgcgttgcgctattgcccgcgcgcggtggccctgaagggcggccggatcctcttcgacggcagcagcgagcacctttccgaaggcttcctcaacgaactctacggcgccgaaggggacaccccgctgctgttttccgaccgttcccggcgcggggcggagagccagccggaactgaccctcgcgcgcgcctga

SEQ ID NO: 11699 - DNA, 225 bp, Pseudomonas aeruginosa
acccggccgtgctgttccgcgacgccggcaacatggcgaccttcgccgccgacttcttcccgccggacttcggcaactggaagctctacctcagcgagatgctggtcaccgtgcagatcgccctctggggcacggtgctggcgatcgtctgcgccatcccgctgtcgatcctggcttccgagaacatcgtgccctggtgggtctaccagccggtgcggcgggtga

SEQ ID NO: 11700 - DNA, 939 bp, Pseudomonas aeruginosa
acaaagcgaaccgctgtaccgcgaactggccgaacggctgcgccaggaactgctggcctaccgccccggcgactacctgcccggcgagatccagctggcccagcgcttcgcggtgaaccgccataccctgcgcagggcgctcgacgaactggtgctcgaaggccgcgtgctgcggcgccagggcaagggcacccaggtcctggaggcgccgacgatctacccgatgggcgccgccaacgcctacaccgagtcgctctcggcccagggccaccgggtcgaggcccggctgctggaggcgcgccagcgcccggccggcgccgccgatgccacccacctggggatcggcgagggcgggcgggtgctggaactgaccaccctgcgttacctcgacggccagccagtgagcctgatccgccattgcttcgccgtttcccgcagcgagctgctcgccgactaccagggcggttcgctgcgtcgctacctggccgacaaaggcctgccgctgacccgcacctacagcctgatcggtgcgcgcctgcccaaccgcgaggaggcggcgcgcctgctgatgccccgccatgcgccgttgctcaccgtcctcaccctgtcccgcgaccgtaccggccaaccggtggaactggcccagtcgatcagccgcgccgatcgcttccagtaccaggtcgccccctaggagaagcccatgaccgccttgcattccgatcccaccatcgccgcacgacagcgctggatgggcgtgctcgcccgcgcccgtcgcgaggagctggacgcccatgcggacgccctgcgcgatgccgactatcacctgctgcgcgccgccgagaccggcatgaccctggtgcgcggacgcatgggcggcaccggcagcccgttcaacctcggcgagatgaccgtgacccgctgcgtggtgcggctcggtga

SEQ ID NO: 11701 - DNA, 849 bp, Pseudomonas aeruginosa
cggacgcaccggctacagctatgtcgccgggcgcgacaagcgccacgccgaactggccgccctggccgacgcgcacctgcagggcgccgacgcggcggcctggcaggcgcgcctgatcgaaccgctggcccgcacccatgccgagcgccgcgccgcccaggatgcggaaatcgccactaccaaggtggagttcttcaccctggtccgaggagaagattgatgaccagcgcttcgcttcccagcccggcggataccgccgcgctattgcaaccggcgttccaggacccggtcctggatgcccagcggagtttccgcgcggcgctcaaggccctcgccgaaccggggctggtgcgcaacctcgaacgcgcaccggcgctggccgcgttgcatccggccagctacgcgctgtgcctgagcttcctcgactccgatgccccgctgtggctggcgccgggtctcgacagcccgacgttgcgcgccaacctggccttccattgcggctgcccgatcgtcgccgagcgtgagcaggcgctgttcgctttgctcgacgaaggcgagctggacgacctgagcggcttcgacagcggcagcgaccgttatccggaccagtcctgcaccctgctgatccagcttgccggcctcgatggcggcgcctcgctggagtggcgcggaccgggcatcgccgaagtgcgccaggtggcgttgccggtgagcgccgggttctgggcacagcgcgccgcacgcaccgaattccccaggggcctggatgccttcttcgccgccggcgagcgcatcctcggcctgccacgcagtacccgggtcagcgaacccgtcgaggaggtggcctga

SEQ ID NO: 11702 - DNA, 282 bp, Pseudomonas aeruginosa
tggaagcgatcttcctcctccgcgcctaccgcaccacgctgccgcgcttcgccgccagcctgccgctggataccgccgggatgcgcctgcaacggcggatctcggcgacctacaaggacctgccgggcgggcaactgctcggtccgaccttcgactatacccatcgcctgctcgacttcagcctgctcgccgagggcgactaccccggccccgaagtggagcggggcgcgtccctggagccttgtccgcgcgtgctcggcctgctcgaccgggaaggcctga

SEQ ID NO: 11703 - DNA, 447 bp, Pseudomonas aeruginosa
cgccggagtacgaactgcccggcgcggtgccggatatcacccgcgagccgctcgacttccccaccggccgcgcccagcgcctgcaggccctggcccgcggcgacgagggcttccttctcgccctgggctattcgacccagcgcggctacggccgcaaccatccgttcgccggggagatccgcatcggcgcctgcgaggtctggctggagcccgaggaactcggcttcgcggtgccggtgggcgagatcgaggtcaccgagtgcgagatggtcaaccagttcgtcggttcccgcgaggagctgccgcaattcacccgtggctacggcctggccttcggctacgccgaacgcaaggcgatgggcatggccctggtcgaccgcgccctgcgcgccgaggaatacggcgaggaggtggtgtcgccggcgcagcaggaagagttcgtcctga

SEQ ID NO: 11704 - DNA, 1761 bp, Pseudomonas aeruginosa
ttcgcaagctgcgtcgtcccggcgtcgccgaatccgcgcaacccactgtccaggagaagcgcgcatgagcctttccccgcaagccagcgccgcgccggagcagggctacaacttcgcctacctcgacgagcagaccaagcgcatgatccgccgcggcctgctcaaggcggtggcgatccccggctaccaggtgcccttcggcggccgcgagatgccgctgccctacggctggggcaccggcggcatgcaggtgaccgcggccatcctcggtgccgacgacgtgctcaaggtgatcgaccagggcgccgacgacaccaccaacgcggtatccatccggcgtttcttcgcccgcaccgccggggtcgccaccaccgaacggaccccggaggcgacggtgatccagacccgccaccggataccggaaaccgccctgagcggcgagcagatcatggtctaccaggtgccgatccccgagccgctgcgcttcatcgagccttccgaggcggagacccggaccatgcatgcgctcaacgactatggggtgatgcacgtgaagctctacgaggacatcgccaccttcggccacatcgccaccagctatgcctacccggtgacggtggacgagcgctacgtgatggatccctcgccgattcccaagttcgacaaccccaagctggacatgaacccggcgctgatgctgttcggcgccggtcgcgagaagcgcctgtacgcggtgccgccgttcacccgggtggcgagcctggacttcgaggaccaccccttcgaagtccagcgctgggaagaaagctgcgccttctgcggcagccacgagtcctacctggacgaactgatcgtcgacgaccgtggcggcaagcgcttcgtctgttccgacaccgattactgcacgcagcggcgtgcctgccaggaagaaggggaggacgcgcaatgaacgcggtctgcgaatccatcgatgcgaacctcgacgcgcgcgaccggccgctgctctcggtgcgtggcctgacccgcctgtacgggccggaaaagggctgccaggaggtcgacttcgatctctaccccggcgaggtgctgggcatcgtcggtgagtccggctcgggcaagtcgaccctgctctcgttgctctccgggcgctgtccgccggacgccggcacggtcgcctaccgcgacgacggcgaccgctggctggacctctacgccgccagcgaagccgagcggcgcaccctgctgcgcaccgagtggggcttcgtcgagcagaacccgcgcgacggcctgcgcatgggcgtgtccgccggcgccaacatcggcgaacggctgatggcccagggcgtgcgccactacggtcggctgcgccaggccgggctggactggctggaacaggtggagatcgatccgctgcgcatcgacgacctgccgcgaaccttttccggcggcatgcagcagcgtctgcagatcgcccgcaacctggtctcggcgccacgcctggtgttcatggacgaacccaccggcggcctcgacgtgtcggtgcaggcgcgcctgctcgacctgctgcgcggcctggtgcgcgagctggacctggcggtggtgatcgtcacccacgacctggcggtggcgcgcctgctcgccgaccgcctgatggtcatgcgccgttcgcgggtggtggaagccggtctcaccgaccagattctcgacgacccgcagcatccgtacacgcaattgctggtgtcgtcggtcctgcaaccctga

SEQ ID NO: 11705 - DNA, 792 bp, Pseudomonas aeruginosa
gccgaagcgtcggcgccggtccgcgcgacgggcgcccggagaagtagcgatgaacaacctgatcgaggtccgcgacctcagcaagaccttcaccctgcaccagcaacagggcgtagtgctcaatgtgctgcgcgggctcaacttcaatgtcgccggcggcgaatgcctggtgctccacggacgctccggcgccggcaagagcaccctgctgcgcacgctctacggcaactacctgccggccggcggcagcatccgcctgcgccacgccggcgactggttggaactggtcggcgccgagcctcgcgaggtgctcgccgtgcgtcgccagaccctcggctacgtcagccagttcctgcgggtgatcccgcgggtggcgaccctcgacgtggtcatggagccggccctggcccgtggctggagccgcgacagcgccgaactgcgggcgcgcagcctgctggcccggctgaacatcccggaacgcctctggcaactggcgccgggtaccttttccggcggcgagcagcaacgcgtcaacattgcccgcggcttcatggtcgagtggccgatcctgctgctcgacgagccgaccgcgtccctcgacgaagccaaccgccaggtagtgctggagctgatcggcgaagccaaggccgctggcgccgcgttgatcggcatcttccacgaccgcgccgcccgcgaggcggtggccagccgctacctggacatgagccaggagctttcccgccaggagcaagcccatgtcgtctgaacgcgttctcagcaatgcccgggtag

SEQ ID NO: 11706 - DNA, 555 bp, Pseudomonas aeruginosa
ccgatcgtggcgaaatccgcgtcggcctgcgcgccgatctgctgcatgcgcgggcgctcggcaacaaccagccggtggtgcgtcaggtctggcgcggcgggcagagagtgttctgatgacaggcagactgatttatctgatggggccttccggctcgggcaaggacagcctgttgcaggccgcgcgcgagcccctggcgctgcgcggctgccgtatcgtgcggcgggtgatcacgcgctccgcggaagcggtgggggaggacgcccaggcggtgactccggcgcagttcgacaccctcgagcgggcctcggcgttcgccatgagctggcgcgccaacggcctttgctatggcattccggtgcagatcgacgagtggctggcgcagggctacgacgtgctggtgaacggctcgcgcggctacctggcgcaggcccgccggcgctatccggatctgctcgcggtcctgctcggggtgaaacccgaggtgctgcgccagcgcctgctggcgcgcggccgggaaagccccgaggaaatcgaggcgcgcctggcgcgtaa

SEQ ID NO: 11707 - DNA, 822 bp, Pseudomonas aeruginosa
tctcgacgacacgctacgcaccctcctggcccgtctcggcagcgaccgcgcatgcgcctgaccctgctcggcaccggcgacgcccgccaggtgccggtctacggttgcgattgcccggcctgtcgcaacgcccgcgccgacgccggcctgcgtcgccgtccctgtagcgcgctgctggagtgcgccggccagcgttggctgatcgacagcggcctggtcgatctctgcgagcgcttcccgccccatagcctcgatggcatcctccagacccattaccacgccgaccacgcccagggcctgctgcacctgcgctggggccagggtctggtgatcccggtgcacggcccggccgacccggagggcctcgccgacctctacaagcatccgggcatcctcgatttcagccagcccttcggcgccttcgagcggcgccagtggggcgcgctggcggcgaccgcgttgccgctggtccactcgaagccaaccttcggctacttgctggagggggcttccgaggagggaacgatacggcgcctggcctacctcaccgataccgtcgggctgccggcggacagcgcctcgcgattgctcgcggcgccgctggacctgctggtgctggactgctcgatgccgccgcaggagcagccgccgcgcaaccacaacgacctcacgcgggcattggagtgcatcgaatcgctgcgtccccggcgggccgtgttgactcacgtcgggcatacgctggacgcctggctgctggaccaccccgctgcgttgcccgaaggggtggaactggcgcgcgacggcgtgtgcctgccgctgtga

SEQ ID NO: 11708 - DNA, 1515 bp, Pseudomonas aeruginosa
atgaggactaaggcaagtctattagctcaggggaggctacgttctgtaacgcgtttaatgttcacgttgttcttcgcccagagcgctaatgctgaactttatcaatggaaaattagcataccaggggaacctacagccttctttccatcctatgcggcggcgtgccagtactacttcgataatacatcgaaaaactggctaaaaaaaattgagaaaatgaatcccaagtgggttcaatgcaatgtttcgggtactggcgggattacttggcagacctcgggagctaccttgatcggcaacagctgcccactaggggctgagcttaataacgagacaggaagctgcgattgccgccccggttacgaaatgaatgacgctggctgtaagcttccagataaaaatggccccgacaagggggctccgccgccggagggttgcgcaggaaacccggtcaacatcaccaatggcaacaaatatcaggtcgagcatgacttaataaccccgattccgcttgcccgacactacaatggcctggacggattatggcgtcattcgttctctgcgcgcataacacgcaaggatgatagctacctactttaccgcgaagacggaaaggtttcggagttcagtggggccgggagagatctaacttccctcacggatctgggaaagcttagccgactagcaggaagatttttctatacctcggagctcaacgaaactatagagtttgacccgtatggaaaactcgccaggctcaagaccaaggagggtcgaaagtatcgtgtagagcgaggcgctaatcttacgattagcgacgaacgtggcaacaaactcgttctctcggagggagccaaccatcaactccttcgcgctcagatagggggtatatccattgagtacacatacgacaaggaacagcgactcacttcggtaacacgaacagatgggcaatacaacacgaaaacacagtacctctatgacgacccgaggaacataaaactacttacaggcatccaggataacaataatcgccgcttcgccacctgggcctacgacaaccaaggccgcgccatctccagcgaacacgccaacggcgccgaaaaggtctccctcgcctacaacgatgacgcctccaccaccgtcaccaacgaatacggcaagcaggccatctattatttccaaatagtcaatggcagcagacgcatcgtcgccatcgaaggcgaaccctcgcccaactgccccagcagcaattccaccttcacctacgatgaccagggcctgctcaccagcaaacgcgacaacaacggcaacctgaccacctaccagtacaacgcccgtggcctggagacctcgcgcaccgaggccgccggcactgcgcaggcgcgcaccatcacaaccgattggcacccgaccctgttcctcccggtgcaggtcagcgagcccggccggatcacccgctaccagtacgacgccgagggacgcaagaccggcgagaccgtcaccacccgctga

SEQ ID NO: 11709 - DNA, 423 bp, Pseudomonas aeruginosa
gctacgaatacgacgacgcacggcgcctggtggcgatcggcaacaacctcggcgaacgcctcgaatacgacgtcgacaccaagggcaatcgcaccgcccagcgcatcaaggacgccagcggcagcctggtgcgccagcagcaatgggcctacgacgagcttggccggctgctccgtgcggtcggcgccggcggccagacacgcagcttcgcctacgacctcaacgacaatccggtcggcgaaaccaacccgcgccagttcgcccacagccaggccttcgacgccctcgaccggctggtcggccagagcgatcccctcggcggcaagacccgactcgcctacgacgcccaggacaacctcaccgaggtcaaggacccgcgcggcgtcaccacccgctacgaatacgacggcctcggcaacctga

SEQ ID NO: 11710 - DNA, 438 bp, Pseudomonas aeruginosa
ccagcgacgccgccggcaacctcacccaggaccgcgccgcgcgcaaactggcctacgacgcccagggccgcctgcaaagcgtcagcctcgacggccagcaggtcgccgaataccgctacaacgccctcggccagcgcatcgtcaagctcacccccgagagcatcaccacctacctctacggtcccgacggccagttgctcggcgaagccgaacacgacggcagcggccggaaactgcgagcccagtactacctgtggctggacagcctgccgctggccaccatcgacgccgactacgacgcccagggcaaggtcggcaacccgaccctgctctacctccatggcgaccacctcgacaccccgcgcctggctaccgacgccagcggccagatcgcctggcagtggcagtccgacgccttcggccgcggcgaagcgctga

SEQ ID NO: 11711 - DNA, 789 bp, Pseudomonas aeruginosa
agactttctcgccggagttcgtcaatcgtctcgatagcgtggtcaccttcaactggatcgaacgcgacgtcgtcgcgcgcctggtcgagctggaggtgcagcggctcaaccggcgcctggagaagcatcgctgccgcctggaggcgacccccgaggtgctggcgaagatcgcccgcgccggcttcgaccggcagttcggcgcccgtgcgttgcgccgcagcgtccgtcatcatctcgaggtaccgctggccgagcatctgctcgaccaccaccagccgggcgacgggaactgcacgacctacctggcgagcctggagcacgagcgggttcgcttcgtgcggcgctgagcgacagtcacaggagaggaaacggatgggatcgcaccaggagcggtcgctgatcggcctgctgttctccgaaaccggcgtcaccgccgatatcgagcgctcgcagcgctatggcgcattgcttgcggtcgagcaactgaaccgcgagggcggcgtcggcggtcgcccgatcgaaacgctgtcccaggaccccggcggcgacccggaccgctatcggctgtgcgccgaggacttcattcgcaaccggggggtacggttcctcgtgggctgctacatgtcgcacacgcgcaaggcggtgatgccggtggtcgagcgcgccgacgcgctgctctgctacccgaccccctacgagggcttcgagtattcgccgaacatcgtttacggcggtccggcgccgaaccagaacagtgcgccgctggcggcgtacctgattcgccaataa

SEQ ID NO: 11712 - DNA, 1350 bp, Pseudomonas aeruginosa
agttcgcaggagggctacaggggtgtcctggcactggcgatgcatggcccggtgccggactgccggcagcggcctgccgtgccggctcgttcgattgttacgctgtctgtaacgatctattggccgatgccggcaggccaggggcgattgtctcgaaatatactgcgtcacctggtcgccgcagcggcgacggctacccactggccgtcgtccgggtcgccggttccatcccggccgcgccaacccccgcattcaggccccgctgcggcgactgcattcccgctggattcgaggctcgtaccctatgactcccgatcaacgatttgcccgttgggttcaagtcgctatcgcggtattcgtgttgctgttcgtctacttcctggtcgccgacccaccccgcaggcccagttgacccggccggtggtgcgcgtcgcgccgcgtgtcagcggtcaggtcgccgaggtgctggtgtccaacaacggccacgtgcagcccggcgaagtattgttccgcctcgatcccgagcctttccgactggccgtgcgccaggccgaactggcactggaggaagccgagcgcaccaaccgcgagctggatgccgccatcgcctcggccaaggccgacctcctggccgcgcgcagcagcgccggcgagctggacagcgaggcgcgccgcaccgcccaactggtgcagcgccaccatgtgtcgcagcagatgcacgagcaggtcagcgcccaggcccaggccgcccgtgcccgggtcgccgcggcccaggcgcggatcggcgagctgaccgcgcgacgcggcacggccggcgaggacaacctgcgcctgcgccaggcgcgcaatgccctggcccaggctcgtctgcaactgcaatacagcagcgtccgggccgaccgcgccgggaccctgagcaacctgcaactgaccccgggcacctacgttccggccggaacgccggtggcggcgctggtggacgaccgtatcgacatcgtcgccgacttccgcgagaaatcgctgcgctacgtgcgccctggcgaccgtgcggcggtggtgttcgacgcgcgtcccggcgaagtgttcggcgcgcgggtggcggccatcgacgccggggtcaaggagggccagctggacgccaacggcgacctcgccgcgccggtcacctccgaccgctgggttcgcgacgcccagcgccagcgcctgcacgtggtgctcgacgaacttcccgaaggcctgctgcccaccggtgccaaggccaccgtgcagctctatcccggcgacggcctgagccatctgctcggtcgcgcgcagatcgtcgccatcagcctgctgcactacgtctactga

SEQ ID NO: 11713 - DNA, 519 bp, Pseudomonas aeruginosa
ctttcccttcgccgctccgtactatttccgtggcatatcgacctatcaaccatccggtcgatatcgggatactcgaagacaggccagcatgggtttcccacgacgaggagaaccctatgtccgcccactcgcattccggatggatcaccgtcggcgccctggccgacggcttcgccccggacaaccacgtccttcccgcctgcggcgatctcgccgggctcgaacgggtcctgcacttcgccaacggctgggtcatcgaacatgccttcgactcgcagcgcctgcgctggcgcctggccgacggcagtgccagcggcgagtcggactaccgcgccagttcactgcgggaaaacctttacctggtggatttcctcaagcaggaaaacggccggccggtctcggtcagcctggtgctggacttcgacaaccaggcgttcaccgcggtgctcggccatctgcccgaccgcacggcctgcgaacagggtctgttctcccgggccctggccggccgggaactga

SEQ ID NO: 11714 - DNA, 285 bp, Pseudomonas aeruginosa
aggccgagttcctgcatggcagcctcgaccgcccgtggcagcccgacgcctgcccgcacgtccccagcgacgagttggtcggcttgcgcaaccgctacgtctacagcgccagcgaggcctacgaacacgtctacctcaatcccgacttctacgcctggcaatgcctgcgcggcgccgagcgagggctggccgataccgaccgctgccactgctaccgactggccgaacgcctgtacctgttcgtctggcgcgagaagatcgtgccgaccctcggcgtgctgctga

SEQ ID NO: 11715 - DNA, 1410 bp, Pseudomonas aeruginosa
  unsure (1262): Identity of nucleotide at the above locations are unknown.
cggcgcgcatggcctcgagccggacttcttcgtcctcggcaaatgcatcgccggcggcattcccagcgccgtctggggatgcagccaggcgcaggcggagcggatctgggcggtactgccgcacttccgaccggggcaggcgatcaaccatttcggctttggcggcaccctggccggcaacgcgctgcaactggcggcgatgcgcgcgaccttcgccgaagtgatgacggaggacgcctatcggcacatgttccagctcgccgcgcagctcgaggcgggcgtccgcgcgacgctcgaggaactgcgcctgccctggcacgtgacgcgcatcggcgcgcgcgtcgagtacctgttcatgacccacgccccgcgcaacggcggcgaggcccaccacgcacgcaacggcctgatcgaggcctgcctgcacctctacctgctcaaccgcggcgtgctcttgacgccattccacaacatggcgctgacctgcccggcgacccgcgcagaggacgtcgaactgcacgaccgcctgctccgcgattgcctgggcgaactgctggagcgcccatcgtgaggcgcttggagaaccgcgtcgcactggtcaccggcgccggccagggcatcggccgggccatcgccgaatgcttcgccgccgaaggcgccagggttctgctggcgacgcgtaccgccagccgcggccaggccgtcctggaggcgatccgcctgggcggaggcacggccgaactgctggccgtcgacctgagcgagcacgacgccgcgagacgagcggtgagcgcgaccctggagcgcttcggccagttggacatcctcctgcacaacgccgctgcctttccccagtgcgccctcgcggaactggacgaaggcaccctggaacggaccctggcggtgaacctgaaaagctgcttccggctgacccaggccgcccttcccgccctgcgccgcagcgtggccgggcgcgtcctggtgacctcctcggtgaccggcccgcgcacggcgatccctgggctctcgcactatgcggcgagcaaggccggggtcaacggtttcatccgcgccgccgcgctggagctggccggcgacggcatcaccgtcaacggcgtcgagcccggcctggtcgcgactccggcgctgggcagcctccggcgacgccgccgcgctggccgcgcacatccccctcgggcgtgtcggccagccgctggacatcgcccacgccatgctcttcctccgcctccgacgaggcgagntacatcaccgggcagaccctggttgtggatggcggcgcgttgctgccggaaaacggcgggctggcctgaagccgctggcgttcgccctctccctccagagagagcgccttccgacgtatccggcaaacacttccgccggctccggtag

SEQ ID NO: 11716 - DNA, 2022 bp, Pseudomonas aeruginosa
gatctacatgtacggcgaccgcgtcaaggacgtcaccagccaccccgccttccgcaacgcggccgcctccatggcccggctctacgacgccctgcacgatccgcagagcaaggaaaagctctgctgggagaccgataccggcaacggcggctatacccacaagttcttccgctacgcgcgcagcgccgacgaactgcgccagcagcgcgacgccatcgccgagtggtcgcggctgacctacggctggatgggccgcaccccggaatacaaggccgccttcggcagcgccctcggcgccaacccgggcttctacgggcgtttcgaggacaacgcgaaaacctggtacaagcgcatccaggaagcctgcctgtacctcaaccatgccatcgtcaacccgccgatcgaccgcgacaagccggtggaccaggtcaaggacgtgttcatctcggtggacgaggaagtcgacggcggcatcgtcgtcagcggcgccaaggtggttgccacgaattccgcgctgacccactacaacttcgtcggccagggttcggcgcaactgctcggcgacaacaccgacttcgccctgatgttcatcgcgccgatgaacacccccggcatgaagctgatctgccgcccctcctacgaactggtggcgggtatcgccggatcgccgttcgactacccgctgtccagccgtttcgacgagaacgacgcgatcctggtgatggacaaggtgttcatcccctgggagaacgtactgatctaccgcgacttcgagcgctgcaagcagtggttcccccagggtggcttcggccggctgttcccgatgcagggctgcacccgcctggcggtcaagctcgacttcatcaccggcgccctctacaaggccctgcaatgcaccggctccctggagttccgcggcgtgcaggcgcaggtcggcgaagtggtggcctggcgcaacctgttctggtcgctgaccgacgccatgtacggcaacgccagcgaatggcacagcggcgccttcctacccagcgccgaggccctgcaggcctaccgcgtgctggcgccgcaggcctacccggagatcaagaagaccatcgagcaggtggtcgccagcggcctgatctacctgccctccggcgttcgcgacctgcacaatccgcaactcgacaagtacctctccacctattgccgcggctccggcggcatgggccaccgggagcggatcaagatcctcaagctgctctgggacgccatcggcagcgagttcggcggccgccacgagctgtacgagatcaactacgccggcagccaggacgagatccgcatgcaggccctgcgccaggcggtcggcagcggggcgatgaagggcatgctcggcatggtcgagcagtgcatgggcgactacgacgagaacggctggaccgtgccgcacctgcacaacccggacgacatcaacgtgctcgaccgcatccgccaatgacgcccgcgtcgcgtccggaggttattcccatgtcccagctcgaacccaggcaacaagccttccgcaacgccatggcgcatctttcggcggcggtcaacgtgatcaccagcaacggcccggccggacgctgcgggatcaccgccaccgcggtctgctcggtcaccgacagcccgccgacgctgatgctctgcatcaaccgcaacagcgagatgaacacggtgttcaaggccaacggtcgactctgcgtgaacgtcctcagcggcgaacatgaagaggtggcccgccacttcgccggcatgaccgaggtcccgatggaacgccgcttcgccctccacgactggcgcgagggcctcgccgggttgccggtgctgcacggcgccctggccaacctgcagggacgcatcgccgaggtccaggagatcggcacccattcggtgctgttgctggagctggaggacatccaggtcctcgaacagggcgacggcctggtctacttcagccgcagcttccatcgcctgcagcgagcctgccgagccgcctga

SEQ ID NO: 11717 - DNA, 1071 bp, Pseudomonas aeruginosa
caaccgcgacggacgccggtaaacccgctgtccacctctggggggacaggccggcactggaggagcgctagcctcgctgcatgtctgccgaaggaacccccgacaatgagcgcatcgccttcctcccgcctgcacctgcaggtcaccgatttccgcgctgttgcgcgcgacgtggtgctggtcgagctggccgccgtggacggcaccgaactgccggccttcacccccggcgcgcatctggagcttcacctgggcaacggcctgatccgccactactccctgctcaacgactgccgcgaacgccagcgctaccaactggcgataggccttggcgacgacagccgtggcggcgcccgcttcatccaccgccaactgcgcacgggcgaccgcctgcacgcggcggcaccacgcaaccacttcatgctgcgcgaagacgccgcgcgctactgtttcgtcgctggcggcatcggcatcaccccgattctctcgatggttcgctggtgccaggcgcagggcaaggactggcgcctactgtatgcggtccgcgaacgccagcgcgcagccttcctcgccgaactgatgacgctcggtggcgaacggacgcggctgcattgcagcgacgaaggcgacccactcgacagtaccgcgctgatcgccggcctaggtgccgacgaagaactctactgctgcggacccgacgggttgatgcaggccatccgcgacgccgggagcggctgcgcggaacgcctgcacttcgaacgcttcgacgctccagtagcgccggcgtcctcgtccggcggcaccgacgccttccgcctggagttgcgccgcagcgccctgagcctgcgcgtcgaaagccaccagagcatcctcgaagtcctcgaggaacagggcctggagcctccctacgcctgccgcgccgggatatgcaggacctgcgagacacgcgtctgcgccggcgagccggagcacttcgaccatgtgctttccgacaccgagcgggccagcggggaaaccttgctgatctgcgtatcacgctgccgcggcaactacctggaactcgatctctga

SEQ ID NO: 11718 - DNA, 570 bp, Pseudomonas aeruginosa
agtcggctcgacgataacaacgacagaggccgccccatgcccgaactcgccacccgtgaattctggaaagacctgcaaccgattcccgactgcttcaagccggacgccaagcccgaggtctacctgcgcaacgcgccgaccgaggacgagcgcctctacgtgcccttcaccgagaccgtgaagtcgcgtccgctgtggatctcgccaagcgaaaaccgctggtgcgacatcctgatggcaacgagcgccggcctggtcaaccgccactaccacccgcacgaggtgttcgcctacaccatcagcggcaagtggggctacctggagcacgactggaccgccaccgccggcgacttcgtctacgagacgcccggcgagggccacaccctggtggcctacgagcacgagcagccgatgcgtgcattcttcatcgtcaagggaccgctggtctggctcgacgagaagggcaacgcggacggcatcttcgacgtccacgactacatcgcgatgtgccgtgagcactacgacaagatcggcgtcggcgccgcctacatcgactccctgttccgctga

SEQ ID NO: 11719 - DNA, 423 bp, Pseudomonas aeruginosa
tcatgggcctcggcgaactggtcggcggtttcctcgcgccgaccgtggccggcttcgccgccgaccgcttcggcctgtccatcgtcatgtggatgtcctgcggcggcgccctgctcgccgcgttcctctcgctgttcctgcgcgaaaccgcgcccgccgtgctggcgcgccagcgcagcgcgcctacctccgtcctgcaaggaaaccaaccatgaaagcactgcgctggcacgctgcccgcgacctccgcctgagcgaactggaacaccaggcgccgcggcccggcgaagtcgaactggaagtcgcctactgcggcatctgcggcagcgacctgcacgaataccagagcggcccgcactcgattccccaggccgaggcgcacccgctgtccggttgccgcgcgccgctgaccctcggccatga

SEQ ID NO: 11720 - DNA, 1587 bp, Pseudomonas aeruginosa
gttctgcggcgtggtcgccgcgctcggccctggcgtggagggactgcgcatcggcgaccgcgtcgcggtggagccggaataccgctgcggcgaatgccgctactgccgggaaggccgctacaacctctgcgagtcgatgggcttcatcggcctgatgggcgacggcggcttcgccgagcgcgcgcgggtgccggcctacatgctgcaccgcctgccggacgcggtgggcttccgccaggccgccgtgctcgaaccggccgccgtggccctgcacgcgctgcgccgcagcagcctggcgccgggccagcgctgcgcggtgttcgggctcggcccgatcggcctgctgctggtgatgctcgcccacctgcgcggaatcgaggacatcgtcgcgatcgacgtcagtcccgagcgcctcgccctggccggggagttcggcgccagccgggcgctcgacgcccgcgacggcgacacggcggcgcgcctgcgcgagggcggcgcgctcgactgcgccttcgaggccgccggcagccaggccagcctcgacgccgccctggccagcctgcgcaagggtggcgagctggtgctggtgagcctgatgggcgaggtccggctggacgccttcgacctggtcaaccgcgaactgcgcctgctcggcagcgtcggctaccgcgacgcctacccggagctgatcgccctgctcgccgacggccgcctcgacctggcccgcgcagtgacccgcagcgtgcccctggagcaggccgtcgagcacggtttcgaggccctgctgcgcgacaagtcgcaggtcaaggtgctggtcaatcccaacccggccctggccgacgcctgaaggaacgatcgccgatggttttccaacacgatatctacgccggccagcaggtgctggtcactggcggcagctccggcatcggcgcggccatcgccatgcagttcgccgaactcggcgccgaagtcgtcgccctcggcctggacgccgacggcgtgcacgcaccgcgtcatccgcggattcgccgggaagaactggacatcaccgacagccagcgcctgcaacggctgttcgaagcgctgccgcgcctggatgtgctggtgaacaacgccggcatcagccgcgaccgcgaggaatacgacctggctaccttcgaacgggtgctgcgcctcaacctgagcgccgccatgctcgccagccaactggcccggccgctgctggcgcagcgcggcggcagcatcctcaacatcgcctcgatgtacagcaccttcggttccgccgaccgcccggcctacagcgccagcaagggcgccatcgtccagctcacccgttccctggcctgcgagtatgccgccgagcgcatccgggtcaacgccatcgcccccggctggatcgacacgccgctgggcgccgggctcaaggccgacgtcgaggccacccgccggatcatgcagcgcacgccgctggcgcgctggggcgaggcgcccgaggtggccagcgccgcggccttcctctgcggtcccggcgccagcttcgtcaccggcgccgtgctggcggtggacggcggctatctctgcgcctga

SEQ ID NO: 11721 - DNA, 1389 bp, Pseudomonas aeruginosa
gccgccttcgctccggatgcacctgtccgcttggggcggacagcgattcgcacgacagaacaacaacaagacgagtgccttgccatgaaaaccctccgcaccttgccggcgctgctctgcgccggtttcctcggtctctccgcgcaggccgccgaagacagccgcagcggcccgctggccgggttcggcgaacgactccagcgccacggcgtgaagacccacgcgcagttctggagcctgtcgctgaagaacctcgacaccggcccgcgccagcacagcttcggcaacagcggcgacctgttcctcggcgccgacctcgacctcgccaccctcgccggcctggacggcgcctcgctgcacatcgaggaaaccctgttcatcctcgaccgcggcaccggtcagcccaccgggccgagctggcagggcgcggtgggcagctacttcggcggcgcgccgctgcacaacgacatcggcgccaaccagctgagcctgctcacctggcagcagcagtggctgggcggacgcctcgacagccatctcggacggaccaatgcgcggcgctatttcctgatctacaactgcgagaccgtggtcacctgcaacgacccgatcatcgacgcctccaccggcatcctgccgccgccctacggcgcctggggcggctacttgaagtaccgggcgaccccgaccctgtacctgcacgccggggccttcgagtccaacccggtggattacctgaagaagcgccatggcctcgatttcggcaccgacgacgccagcggcaccagcctgctgctggggatcggcgacaagcgcgaggaaagcctcgatccctaccgctcgcactatgaactcaacgcctacctgaacaccgccaaccaggtcgacccgctcaccggcgccagcgaccacggcagcgccggcggcttcttcaagttccagcagctgttctggcgcgccgacggcggccgcctcgattcgccgagggcgctggggctgttcggctcgctgtcggtatcggccgacgacaagcagccgttccgtcatttcgccgagctgggcctgacctaccatgcgcccttcgaccgcacgcgggacaagctcaacctcaaggccagctacctgcgcctgaacgatcaccagctggagttccagcgccaggcgcggatcgccgctggcggcgatgcgaaactcggccagcgcgacgtgtacgccctggaaaccaatgcgcacatcgcactgaccccgcacatcgcgctggagccgtcggtgcagtacatcttcaacccggacaactactacaaccccggcgctcgcgaactgagcggagacggtttcgtcgtcggcctgcaactgatggtcgacatgggctcgctgctggggctgtag

SEQ ID NO: 11722 - DNA, 2166 bp, Pseudomonas aeruginosa
gttgcctggggtcggcgagaacctgcaggaccaccaggacatcgtgctgatgtaccgcaccgaggccaagctcggctacggcctgggcttctcgccgaagggctggctgccgctgctgcgctcgccctggcagtacctgttcggccggcgcggggcgctgacctcgaacaccgtcgagtccggtggcttcctccgcctcgacccgcaggcagagaccccggagctgggtctgatcgtcgcccccgcgctgaagaaccagccgcagcgcctggtccccttcggccacggggtcagcctgcacgtcgcggtgatgcacccgcagagccgcgggcgggtccgcctgaactcgccggacccgcacgaccggccgctgatcgaagccaacttcctcagccaccctgccgacctcgataccctggtccagggtttccaactggtccgcaaactggccgccagccgcagcttcgcccgtcacctcaagggcgagctggtaccgggcccgcaggtttccagccgcggccagatcgaggcctggatccgcgccaacctgggcaccgtgttccatccggtgggcacctgcaagatgggccacgaccagctcgcggtggtcgacgaccagttgcgcgtgcacggcctgcaaggcctgcgggtggccgatgcgtcgatcatgccgacgctgatcaccggcaataccaacgccccggcgatcatgatcggcgagaaggccgccgacctgatcctcggcaagccggcgccccatgcaccgcccgcgcgacaaccggccgtgcaggctctggccggcgcctgactagccgccctggctgcaggcgctggcgtacttgcggtaggccagcgaatgcagcttgccggcggagtctaggtagtccatccgtgcatcgacgatctcgcaggtggtcgacgcctgttcctgggtcgccaccaccttgtgcacatccagcggcatgccgtagcggtagctttcggtcggtaccggtgcggcggcctgggcggcgaacgcgggaagcgcaagcgcggcgagcagggtggtggcgagcagggtgcgagtcatgggggatctcctggcggcaggaccgcgtcggtggaaggcgacatgccttcgtcgaggcctattccaggccgcggagttgtcccggatgtgtcgctggaatgcccgattcgtcagccgctgtatcgccgctgccggccgatacatggccgtacattcgccgccccgctcccgccggacgaatcgcgcccggcgccatccgtcgtctcccccgttcgcgacagcgacaaccgggcttttttgcacgccccggtattcgccccggctccggatacagtgcaatacaaaccccggcaggcaagcgccgcgggcgcggatacactgcttgcaagcacaccaaccgccacgggagccaggcaatggagcatgtcgatcacatcctgatcgtcgacgatgaccgcgagattcgcgagctggtaggcaactacctgaagaagaacggcctgcgcaccaccatcgtcgccgatggccggcagatgcgcgcgttcctcgaagccaacacggtggacctgatcgtcctcgacatcatgatgcccggcgacgacggcctgctgctctgccgcgagctgcgcgtcggcaagcacaaggccacgccggtgctgatgctcaccgcgcgcaacgacgagaccgaccgcatcatcggcctggagatgggcgccgacgactacctgaccaagcccttctccgcccgcgaactgcttgcccggatcaacgccgtgctgcggcgtacgcggatgctgccgccgaacctcaccgtgagcgagagcagccggctgatcggcttcggccagtggcaactggacaccagcgcccgccacctgctcgacgacgccggcaccgtggtcgccctcagcggcgccgagtaccgcctgctgcgggtgttcctcgatcatccgcaacgggtactcagccgcgaccagttgctcaacctgacccagggccgcgaggcggacatcttcgaccgttccatcgacctgctggtcagccgcctgcgccaacgcctcggcgacgacgcccgcgaaccggagtacatcaagaccgtgcgcagcgagggctatgtgttctcgctgccggtgcgactggtcgaggcccatccatga

SEQ ID NO: 11723 - DNA, 876 bp, Pseudomonas aeruginosa
tcctggcctactggaagctgttccccgagacattctggagcggccgctcggtcgcggcgaacatccccggctcgatcggctacctgttcatcctgctgctcaccctcacctccttccgcaccccggcccgactgctcggcccacgcgcctggaaagccctgcactcgaccggcacctgggtgctggcgggcatcttctgcctgtcgttcttcaaacgcatccccatgggcggctggtacgtactggcgttcgccacgatcttctccgccatcgtcctcaagctcaccgccaagctcgccgtgcgcttgcgtcgtcgcgacgtacagccggcctgacccatccaccgccctcaacgagacatcgatcatgcaagcatccgacctgcgcgcctggcgccgacccttcgccctgctcgaccgctgcggcggctggagcgccgacctgtccctgcgactgttcctggcctgggagttcttcgagtccggttgggaaaagtggaacggcgagaactggttcggcgatatccagtcggctttcccctttcccttcgaccgcctgcccgccgccttcaactgggaactgtcgctgtgggccgaactgctcggcgcgctgctcctcctgctcggcctcggtacccgcctgaccgccctggtgctgatcgtcgtcaccctggtggcgaccgccgccgtacactggccggcggagtggtcgagcctggcggaactggcccgcggctactcgatcaccgaccacggcttcggcaatttcaagctcccggcgatctacctggcggcgctgctgccgctgctgttggcgggagcggggaagctgagcctggaccactggctcgggcggcgcctgggcctgtcccgctag

SEQ ID NO: 11724 - DNA, 561 bp, Pseudomonas aeruginosa
cgccaacggcgctatccgccgatgcatcgactccacaagggctgcgtcgtcatccgcccgcccaatcgcgttccagggttccgagcacgacaccctgggtccgcaacgctgccagcaactccagccccgccgcgtcgagcgctccgggcgcactccgcgcctcaagcgccagcgccgccaggtgctcgcgcccgctcaggcgccgtctcgccagcgactccagcaggcggtaggccagcggagtcaggcgcgcggtatgcacgcgatgcgaagaatcgcgatgcatcaacagcagggtcggttccgcaggcgcttcggcgagcgcgacgtcctcttcgagccgatgcaccggccagcgatagcccagcggcagcgccaggctcgacagcagcggcaccccgtcgagcaggtcgccttcacgccgatacggcggatcgtcgggctcggccaggtagaggcgcgtttcgctccattcgaagtgggccaactcggcttgccacgccggccgatactcgccccgctgccgcaggtagtcgacgaagaccccggcgatacgggtga

SEQ ID NO: 11725 - DNA, 807 bp, Pseudomonas aeruginosa
cgcgaatcgaaaacggacatgcttcttctccacagtaaacgcggccgggccgcaggcgcggcgctggtgggcgccggtacgaaccgggcggcgggaccttctggggtcgtcccgggcgccgcggttcggatgtggccatttcgcctgggagatgtatcgggggtgtatcgcccgacacttggatttgtacgccggaggtatcgaaaccgcgcatggatacaaagcgatacgcaatcgagcgcgggcatgccgacgaagtgccgggcatctctcactcccgccggcccatctcggctaccgttaggagacagccacctggcccagtctcgaggtcgagcccatcgtgctgaaacgcattccggtaacccagcttcgcctcggtatgttcgtccagagcctttgcggctcgtggctggaccacccgttctggaaaagaggtggcttcctgctcgacagccaggccgacctgcagcgcctgcgcgaaagcgccgtgaaggaagtctggatcgatgccagcaagggcctcgacctcccggaggaagcggcggtctcggccgctgcggtcctgccggtcaccatgccggccggcccttcgccggcgcgggtcgccctggaggaggaaatccgccacgccgccctgctctgcagccgtgccaaggccgccgtggtcagcatgttccgcgacgcgcgcatgggccaggccatcgataccgcgcatgcatcggacctggtggacgaaatctccgcctcggtgctgcgccatcccaacgcgctgctcagcctggtacggctgaagacctcggatga

SEQ ID NO: 11726 - DNA, 543 bp, Pseudomonas aeruginosa
atcgcctgcataaccgttatctcccccgcgcctcaacggcagccatctccagcaaccacccccggaacgccagcatcgcgctggtctcctcccgcgactgcaagcgcgtcagccagtagctgccggtactcacttcggtggcgaacggacgccggatgctctcgctggccagttgccaggcaaacatcgccgccggcgccagggccacgccgacaccctggcgggccgcctcgagcatggccagcgaggtgtcgaagacgatgctccgggtcagtggcgcgtgcgccggcagtccggccgcctggaaccacagcggccactcgtcggcgcggtaggagcgcagcagggtgtgctgcagcaggtcggcgggactgtgcaactgggcggcgacctccgggcagcagagcaccgtcagcggcgcctcgaacaacgccagcgcctcggtgccgtgccaggcgccgccgccgaagcggatcgcgtagtcgagcccctcggcggcgatgtcgacgcggttgttgtgggtggacaggcgcagatcgatga

SEQ ID NO: 11727 - DNA, 480 bp, Pseudomonas aeruginosa
gcaagaccttcaccgccaccctcgccggctatgccctggcccaggacaagatgcgcctcgacgaccgcgccagccagcactggccggcactgcagggcagccgcttcgacggcatcagcctgctcgacctcgcgacctataccgccggcggcttgccgctgcagttccccgactcggtgcagaaggaccaggcacagatccgcgactactaccgccagtggcagccgacctatgcgccgggcagccagcgcctctattccaacccgagcatcggcctgttcggctatctcgccgcgcgcagcctgggccagccgttcgaacgactcatggagcagcaagtgtgcccggcactgggcctcgaacagacccacctcgacgtgcccgaggcggcgctggcgcagtacgcccagggctacggcaaggacgaccgcccgctacgggtcggtcccggcccgctggatgccgaagggtacggggtga

SEQ ID NO: 11728 - DNA, 471 bp, Pseudomonas aeruginosa
agcgctgaagcgcgctcgcgagggcgacggagcgtagcggcgcgggacgccggtcctggctatgatggtgccatgagcgcttccccgcccctccgccagccctgcccgcccggcgcctgcgtctgcgaacgcgagcgcctggaggcgcccggcgcggaccgtcgcatcctcctcctgacccgccaggaagagcagcgcctggccgctcgcctggaagccctgcgcagcctggaagacctggaacacctgctgcggcgcatggaggaacaactgggcatccgcctgcggatcgccccggccttcggcgaggtgcgcagcatgcgcggcatccgcatgcgcttcgaggagcagccggggctctgccgcaagacccgccaggcgatccccgccgccatccgccgcggcctggagaagcgcccggaagtcgcctacgccctgctcaacgcccacgacctgctgcgcgacgcctga

SEQ ID NO: 11729 - DNA, 705 bp, Pseudomonas aeruginosa
cgacggccctcggccatcgccgcctggacccgcgccaccgcctcgctgccgctgccgacgcagtcggcgcgccagccgagggcgccgaccgtgcgttcgagcagctcgccggccaccaggttgtcgtccgccaccagcagccgcagcggttcgccggccccggggcaggccgcacgcagcggttggtcgtgggcgacgtcgaggtccaggtcgaaccagaaccggctaccgctgcccggcgcgctctcgacccgcaattcaccgcccatcaggtcgaccaggcgtttgcatatgaacaggccgaggccggtgccgccgaagcgtcgcgaggtggacgcctcggcctgggtgaaaccttcgaagatgcgctgctgctgttccgcgctgatgccgatgccggtgtccgccaccagcacccgcaggcgcaccaggtgggcgtcgtgcgccagacgccgcaagctcaccaggacgtgcccgcgggcggtgaacttcagtgcgttgccggccaggttgatgaggatctgctgcaggcgcaggcggtcgccgaccaccgcgctgggcagctcgggatcgatgtcgaagatcacctcgacgtccttgtcgccctggttgccggagagcaccacggccaggtcctgcatcagcggctccagctcgaaggggagcatttccaggaccagtttgccggcctcgatcttcgagtag

SEQ ID NO: 11730 - DNA, 399 bp, Pseudomonas aeruginosa
atcaagcgggcggattcctccgccgaatcatccgaccccaggtatgaccgctcacaacgacgtgcttttcagcgcctccgcgtagcgcagtgcggcgaacagggcgagcagcaggccggccagcgccagcacggcgccgacgttgccgatcgaggccaggcccatgcgttcgctgaccacgctgccgagcagcgcgccggcgccgatgccgacgttgtacaggccggagaacagcgccatggccacgtcggtggcgtccgaggcgaggcgcaggacgcgggactgctgggccaggccgaagcacatgatcgacatgccccagagcaggctgagcgccatcagccaggtcggctgcgcggacagcggcaacagcagcgccaggctgctgcccaagactag

SEQ ID NO: 11731 - DNA, 429 bp, Pseudomonas aeruginosa
gatcgcggccagcatgaagcctcgcgggaaagcctcgctgtatcggctgaagaagatcgaaccgaagatcccggcgccgccgaacaacagcagcagcagggtggtcgcctcgccgctcatccgcgccacctgcttggggaacggctcgatgtagctgttcgcggtgaactgggcgctgatcaccaccacggtcagcacgtacaggcagaccagcgccgggcgtcggaacagcatcggcaggctgcgcagggaaccggagttctggcttggcagcagcggcagggagcgcgccaggtagagcagggtcagcaccgagagtccggcgatggccatgaaggtggtacgccagcccagggcctcgccgaccacccgccccagcgggatgcccaggaccatcgccagggtggtgccggtggccagcagccctag

SEQ ID NO: 11732 - DNA, 1059 bp, Pseudomonas aeruginosa
cgccttggcctgctgtcccggcggcgccacgcgcaccgccagcgaagcggtgatggcccagaacaccgcgtgggcgaaggcaatgccgatccggctgagcatcagcacctggaagctccaggccagcccggacagcacgtggctggcgatgaacagcaggaataccccgaccagcagcttgcgccgctcgatattgcgggtcagcagcatcatcggcaacgaggccagcgacaccacccaggcatagatggtcaacatcaggccgacctgcgaggtgggcatctcgaagctgtggccgatgtcgctgagcaggccgaccgggacgaactccgtggtgttgtagatgaaggcggccagggccagggcgatcacgctcagccagctgccgctgcgggtttcggaggtgctgtccatggggcgttcggttccggagcagggggcggacgggcaggtcccgcgaccctcgccacgcacgacggaaaacgccccggacgcaagggtccggggcggcgatgtgcgttggatggtcgttataggtattggagggaactgccgaatcccgcgattctacgccgggacgccgtgcgctgcacgcccgcccggcgctccggcgaccttcccggagcgatgggacggctccggcagcatcaggcaggccatcgtctcgccccagggcgcgaggccctgttcgacgaaaccggcatcccgataaagctggcgggccacatcgttgtcgacggcgtaggcgaccatcaggcgatcgctgcgccgcctcgtccggcgcacgctggcgatgatccgttgcagggcggcgcggccatgccccttgccctggtagcggcggtcgatcatcaggcggtagagccagtagtggccgtcgtcggcgtcggggccgtagaggggcgaagccgaccatgcgcccgccgtggtggatgccgaccgcgcggaaccccggcaggaagcggctctgggccagcgaatagaggttggaagcgacgaagtgcgcctggtggcgggcgaccttcaggtcaatgcaggtttcccaatcgtcgcgggtga

SEQ ID NO: 11733 - DNA, 1629 bp, Pseudomonas aeruginosa
tggcaggatttccccggtgccaggccggcgacagataaattcgagattttccttgtcagatcagtcaggttctcgctattacatttaaccaagaccctggagccaagccccagcgcacggttgcctcgtcgccccactccgacggctgatcgccctctcccccggcacgcaacctgcccggcgctcccttatccggatgccgcggctcttctacgccgccgcatcccctgcatggaatcgcacatgtctcatcgccctgtgatcaacgcctcggtcagtccgaaaggcacgctggaaaccctctcccaacgcgaagtgcaacaactgagcgaaaccgccaacggcaagacctaccaactgttccgccagtgcgccctggcgatcctcaataccggcgcccacagcgacaacgccaagaccatcctcgacgcctacaaggacttcgaggtgcgtatccaccagcaggaccgcggcgtgcgcctggagctgatcaacgcgccggccgacgccttcgtcgatggcgagatgatcgccagtactcgcgagatgctgttcagcgccctgcgcgacatcgtctatacccagagcgggctggacagccagcacgtcgacctggacagctcccagggcctcaccgactacgtcttccagctgctgcgcaacgcccgtacgctgcgccccggcgtcgagccgaagatcgtcgtgtgctggggcggccactcgatcagcagcgaggaatacaagtacaccaagagggtcggccacgaactcggcctgcgcagcctggatgtctgcaccggctgcggaccgggggtgatgaaggggccgatgaagggcgccaccatcagccacgccaagcagcgcatcgtcggcggccgctacctgggcctgaccgagccggggatcatcgccgccgaggcgccgaacccgatcgtcaacgaactggtgatcctgccggacatcgagaagcgcctggaagccttcgtccgcgtcggccacggggtcatcatcttccccggcggcgccgggaccgcggaggagttcctctacctgctgggcatcctcatgcacccggacaaccaggacctgcccttcccggtcatcctcaccggtccccgcagcgccgaagcctacctgcagcagctccatgaattcgtcggggcgaccctcggccatgcggcgcagcgccactaccggatcgtcatcgacgacccggccgaggtggccaagcagatggcccagggcctgaaggaagtgaagcagttccgccgcgagcgcaacgacgccttccacttcaactggatgctgaagatcgatgaaagcttccagcgcccgttcgagccgacccacgagaacatggccagcctccagctcagccgcagcctgccgccccacgagttggcggccaacctgcgccgcgcgttttccgggatcgtcgccggcaacgtcaaggacaacggcatccgcatgatcgagcaatacgggccctacgagatccacggcgacccggcggtgatgctgccgctggaccgcctgctgcaggccttcgtcaagcagcaccggatgaagctgcccggcggcgcggcctacgtcccctgctaccgggtggtgcagaccgaggcggcctga

SEQ ID NO: 11734 - DNA, 705 bp, Pseudomonas aeruginosa
gcgcgcccgctccggcatccctgcgccgcgcgcggggatgcccatttattccgagccgggcgtacggcttcctgctactcttttccgttcatgcctcgaatcgctggccctgacctcatgtccccatctccatcgccagccctcgccgcactccgcgacgccacccgtgacctgcacgcagaactggaccgccgttcgccgttgggcgacgacgatctcgacgaccgcgcctacctcgaccatgccggacgcatccttggctggctggagcctctggagcgcgcgctgcgcgacaaccgcagcggctggccggcggcgctgcgggccgacgcgcggctggtcaagagcgcctggctggaaagcgacctgctggccggcggcatgagccgcgcgcaggtggaggcgctaccgcgctgcgccgacctgccgaatgcgacacgggccgcggaggtcttcggggtggcctacgtgatggaaggcgcgacgctgggcggcgcgtatctctacaaacgactagctccacgcctgcccggtctgccgctacagtggttgcagggctacggccaggcaaccggggtgcgctggcaggagtttctcgaacagctcgcccggcagatcgacagccccgaagccatcggccttgcgcaggatgcggcacaggctacattcctttcgtttcgtcgatgggttctcgacgaagcctga

SEQ ID NO: 11735 - DNA, 2187 bp, Pseudomonas aeruginosa
atgacgagcatcaccccggttaccctggcgaactgcgaggacgaacccatccacgtgcctggcgcgatccagccgcacggggcgctggtcaccctgcgcgcggacggcatggtcctcgcggcaagcgagaacatccaggcgctactgggtttcgtcgcctcgccgggttcctacctgacgcaggagcaggtggggccggaggtcctgcgcatgctcgaagagggactgaccggcaacggcccatggtcgaacagcgtcgagacgcggatcggcgaacacctgttcgacgtgatcggccacagctacaaggaagtgttctacctggagttcgagatccgcaccgcggacacgctgtcgatcacctccttcaccctcaacgcccagcgcatcatcgcccaggtccagttgcacaacgacaccgccagcctgctcagcaacgtcaccgacgaactgcgccggatgaccggctacgaccgggtgatggcctaccgtttccgtcatgacgactccggcgaggtggtcgccgagagccgtcgcgaagacctcgaaagctacctggggcaacgctacccggcctcggacatcccggcccaggcgcgtcgcctgtacatccagaacccgatcaggctgatcgccgacgtggcctatacgccgatgcgcgtgtttcccgcgctgaacccggagaccaacgaatcgttcgatctcagctacagcgtgctgcgcagcgtttcgccgatccactgcgaatacctgaccaacatgggcgtgcgcgcctcgatgagcatctccatcgtggtcggcggcaagctctggggactgttttcctgccatcacatgtcgcccaagctgattccctacccggtgcgcatgtcgttccagatcttctcccaggtctgcagcgccatcgtcgagcgcctggagcaggggcgtatcgccgaactgctgcgcgtgtccaccgagcgcaggctggccctggctcgccgcgcgcgggacgccgacgacctgttcggcgcactggcccacccggacgatggcatcgccgcactgattccctgcgacggcgccctggtcatgctcggcggccgcaccctgagcatccgcggcgacttcgagcgccaggccgggaatgtcctgcaacgcctgcagcgcgacccggaacgggacatctaccacaccgacaactggccgcagcccagcgaggactctccggacggcggcgactgctgcggtgtgctggcgatccgtttccaccgccaggaatcgggctggatcttctggttccgccacgaggaagtgcaccgcatccgctggggcggcaagccggaaaagctgttgaccatcggcccctccggcccgcggctgaccccgcgcggctcgttcgaggcctgggaggaagtggtccgcggccactccacgccctggagcgaaaccgacctggcgatcgccgaaaagctgcgcctggacctgatggaactgtgcctcaaccatgcggccgaggtcgaccgcatgcgccagcgcctgatcgcggtgctcggccacgacctgcgcaacccgttgcagtcgatctccatggcggcggccctgctgtcctccagcgacacccgcaccaccgaactgcgccaacacatttccgcgtccagcagccgcatggaacggctggtcagccagatcctcgacatgagccgcctgcaatcgggcatcggcctcaccgtgaacccggtcgacaccgacgtctcgcaactggtgcggcagatcgtctgcgaaaccgacgtcgcctatcccggcctggtgatcgagatcgccatcgacccgcaggttcgtgccgtggtcgacccggaccgctacgcccaggtcgccgccaacctgctgagcaacgcccgtcatcacggcctgcccggccggccggtgctggtaaccctgacccgccagggcgacgaggtgtgcctgagcgtgctcaacgaaaccagcggcctctccgaagcgcagctggccaacctgttcgaaccgttcaagcgcgagtcggcggacaaccagcgcaaccgcaacggcctcggtatcggcctgtacatctcccaggccatcgcccaggcccaccaggggcgtatcgacgtggactgccgcgacgacgtcatcaccttctgcctgcgcctgccggtgcgccaggcggagaccggctcctcgtcctga

SEQ ID NO: 11736 - DNA, 894 bp, Pseudomonas aeruginosa
tcaccggcacccccgaagggcgagtcgacgtgcatcccggcgaccgcgtcgaggtcgagatcgacggcctcggccgcctcgccaacagcatcgtcgcggaatgaggaaccgaccatgaaacacgcacgcatccgctaccagggccgggttcaccaggtcaccgtggaagacgccaacgccgtccgcctggccgacggcaccctgctcgccgaggaccgggtggagtggctgccgccggccaccgggagcatgttcgccctcggcctgaactacgccgaccatgccgccgaactgtcgttcaaggcgcccagcgaaccgctggcgttcatcaagtcgccgggcacctacaccggccaccgccaggtcagctggcgtccggacaacgtcgactacatgcactacgagtgcgaactggtggcggtgatcggcaagccggcgcgcaacgtccgccgcgaggacgccctcggctacctggccggctacacggtgtgcaacgactacgcgatccgcgactacctggagaactactaccggcccaacctgcgggtgaagaaccgcgacgccaccaccccggtggggccgtggatcgtcgatgcggccgaggttcccgagccgaaccggctgaccctgcgcacctgggtcaacggcgagctgcgccaggaaggcagcaccgcggacatgatcttcgacattccctacctgatcgaatacttctccagcttcatgaccctgcagccgggcgacatgatcgccaccggcaccccggaaggcctgtccgacgtggtccccggcgacgaagtggtggtggaggtggaaggcgtcggtcgcctggtcaaccgaatcgtcagcgaggccgaattcttccgcgcccgcgcacaggagcacgcagaatga

SEQ ID NO: 11737 - DNA, 879 bp, Pseudomonas aeruginosa
aggcctcgggcaccggacgcgaaggcggggaatacagcttcgaggtattcgccgagatcaagaacgtgtgtatatccatgggcagccatcacatcccccgctggggcgtgtagggcgcgctcgtgcagagcggccccccgaggccgccagcagcgccggcgtgcagacacaatcagaagaatccgggccagccgccaacggccgcgcccgctgccaggcccaacgggccaccaggagaatcgtcatgggcaaagtcgctctggctgccaagatcacccacgtaccctcgctgtacctgtccgagctgcccggcccgcgccacggctgccgccagccggcgatcgacgggcaccgcgagatcggccggcgctgccgcgaactgggggtcgacaccatcgtggtgttcgacacccactggctggtcaacgccggctaccacatcaactgcgcgccgcacttcgaggggctctacaccagcaacgagttgccgcacttcatcgccaacatggagtacggcttccccggcaacccggagctgggccgcatcctcgccgagggctgcaacgcgctcggcgtggagaccctggcccacgacgccaccaccctcggcccggagtacggcaccctggtaccgatgcgctacatgaaccaggaccgccacttcaaggtggtctcggtctccgccctgtgcaccgtgcattacctgaacgacagcgcgcgcctgggctgggccatgcgcaaggcggtggaagagcactacgacggcacggtggcgttcctcgccagcggctcactgtcccaccgcttcgcccagaacggccaggcgccggacttctccgaccgcatctggagcccgttcctcgaggtcctcgaccatga

SEQ ID NO: 11738 - DNA, 492 bp, Pseudomonas aeruginosa
agtcgtgcagatgtggcaggaaggccgctgggcggaattctgcgggatgctcccggagtacgcctccaagggccatggcgaaggcttcatgcacgacaccgcgatgctcctcggcgccctcggctggtcggcctacgacggcaaggcggaggtggtgacgccctacttcggctcctccggcaccgggcagatcaacgcggtattcccggtcaccgcccaggacggctcggcgatccccgccgcccaggccggcaacccggccggcgccagttgcgccagccgcctctgaggacgccaccatgccgcacttcatcgccgaatacaccgacaacatcgaagccgaagccgacctgcccggcctgttcgagaaggtccacgcctgccttggcgccagcggcgttttcccgctcggcggcatccgcagccgcggcgtgcgcctggacacctggcgcatggccgacggcaagcacgactacgccttcgtccacatga

SEQ ID NO: 11739 - DNA, 642 bp, Pseudomonas aeruginosa
acaacccggcggactgaccggcccgccataacgctgcactcacccagctcgcctcccggccaccgacaggtcgccgggacgtccgggcgctcacaaaaagtacaagatcatgagcacagccagcaccctgaacagcaccaccctgcctctcagcgacagcacccacgaccgcgtcacctggcggctgatgccgctgctgctggtgtgctacgtcttcgcccatctggaccgcatcaacatcggtttcgccaaattgcagatgagcgccgacctgcacttcagcgacaccgtctacggtctcggcgccgggctattcttcatcgcctatgcgctgttcggcctgcccagcaacctgatgctggaacggatcggcccgcgccgctggatcgcctgcctgatgctggtctggggctgtctctccaccgccatgctgctggtggagaccgcgcgcggcttctacctgctgcgctttctcctgggggtcgccgaggccggcttcttccccggtatcctggtctacctgaaccgttggttcccggcgcgccgacgcgggcagatcaccgccctgttcgccatcgccgtgcccatggccggggtgatcggcggaccgctttcgggctggatcctagaaggcttccatga

SEQ ID NO: 11740 - DNA, 1593 bp, Pseudomonas aeruginosa
cgccctcggactgcgcggctggcagtggatgttcctgatcgaaggcctgccggttgtgttgctcggcgtggtggtctggtgctcgctgccggaaagcttcgaacgggtgacgtggctcagcgacgaacagaagcacctgctgcgcgaggaactggccggcgaggagcagcgcaagaccatcacctccttctccggcatcttcagcaatccgcaggtgtggctgctggtggcgatctatttcgcggtgatgctggcggtgaacaccatcgcgttctggatgccgagcctgatccatggcgccggcatcgcccaggacagccgcatcggcatgctcagcgcggtgccctatctcgccggctgcgccttcatgatcttcatcggccgttcctccgaccgcctgcgcgagcgccgctggcacctgggcattccgttgctgatggccgccgccgggctcagcctggcggccctggcaccgaccagcgcctggctggtgatgggcggtctggtgatcgccgggatgggcgccagcgccgccctgccgatgttctggcaactgccgccggccttcctttccagcgccaccctggccgccggaatcgccctgatcagttccttcggcagcatcgccgccttcctcgcgccctacctgatcggctggatgcgcgacaccacccagagcgccagcctggccctgtacctgctggccatcctcatcgccctcggcgccggcctggtcctgcggacccccgccgccgtggtctacccacgctgaaccgagagaccccgaccatgctcgatccccgtctgatccaggaagccgccaaccgcctcgacgccgccgaacgctcgcgccagcaggtaaggcagttctccctcgactacccggacatcgccatcgaggacgcctacgccatccagcgcgcctgggtcgagcgcaagatcgccgacgggcgcgtgctcaagggccacaagatcggcctgacctcgcgcgccatgcaggtctcgtcgaacatcagcgagccggactacggcgccttgctcgacgacatgttcttcgaggagggcagcgacatccccttccagcgcttcatcgtgccgcgggtcgaggtggagctggcgttcatcctcggcaagccgctgaagggaccgggctgcaccctgttcgacgtgctcgaggccaccgagtgggtgatcccggcgctggagatcatcgatgcgcgcatccagcaggtcgacccgcaaacgaaagtcacgcgcaaggtcttcgacaccatctccgacaacgccgccaacgccggcgtggtgatgggcggccgggccgtacggccaggcgatatcgacctgcggcgggtaccggcaatcctctaccgcaatggcgtgatcgaggagtctggcgtctccgccgcggtgctcaaccacccggccaagggcgtcgcctggctggccaacaagctggcgccctacggcgtctgcctggaggccggccaggtgatcctcggcggctccttcacccgcccggtggcggccgcgccgggggacaccttccacgtcgactacgacctgctcggcagcatctcctgccgtttcgtctga

SEQ ID NO: 11741 - DNA, 819 bp, Pseudomonas aeruginosa
ggaggcatttccatggacctgcccgtcaatcgcttcaagcaacgcctgcgcagcggcgaggcgcagatcggcctgtggctcggcctggccgatccctactgcgcggagctggccgccaacgccggcttcgactggctgctgctggacggcgagcacgcgcccaacgacctgcgcagcctgctcggccagttgcaggcgctggcgccctaccccggccagccggtgatccgcccggtgcagggcgacaccgcgctgatcaagcaattgctcgacatcggcgcgcagaccctgctggtaccgatggtcgacagcgccgcccaggccgaagggctggtgcgcgccgtgcgctatccgccggcgggcgtacgcggggtcggcagtgcgctggcccgggcctcgcgctggaacagcgtggcggagtacctgaaccacgccgacgagcagatgtgcctgctggtccaggtggaaaacctggagggcctggccaacctcgacgcgatcgccgccgtcgagggcgtcgacggcgtgttcatcggtccggccgacctcagcgcagccatgggccatcgcggcaatccaggccatcccgaggtgcaggcggccatagaggacgccatccaccgcatccgcacggccggcaaggccgccggcatcctctccgccgacgagacactggcgcggcgctacctggagctgggctgcgcgttcgtcgcggtgggcgtggacaccagcctgctgatgcgttcgctgcgcgagctggcggggcgcttcaagggcggcgcgccggcgccgtccgccagttcctcggtctacggctga

SEQ ID NO: 11742 - DNA, 1668 bp, Pseudomonas aeruginosa
agcccggcgagatcctcgacttcccggtgtcggtggcctctaccgccgaacgcgccagggccggctcgcaaccgctggcgttcagcctgcgcggcatcgacgacccgagcctggcggtcggcagcaccagcaccttcgtttcgccggcgcgctgaggaggccgcgatgaggcatgacaacacggtcccggcacgcatagagtgggcgccagcggccgtgcccacggccagccaggacagcggccaggacaagatgaagcgctacgagaaattcgccgacgagattgccgagctgatccgcaccggcgtcctcgcccccgggcagaaggtgccctcggtacggcacgccagtcgtacctacggggtcagcgcttccaccgtgttccaggcctactacctgctggaaagccgtgggctgatcatggcccgcgcacgctccggctacttcgtctgccagcacgtgcagcggccgctgccggaaccggagatcagcccgcgccaggccgacgccaccgaggtcgacgtcagcgagctggtgttctccgtactcagttcgatcaaggacccggacaccgtgcccttcggctcggcgttccccagcccgcaactgtttcccctgccgcgcctggcgcgctcgatggcccacgcggtgcgcgacatggacccgcagtcggtggtcgccgacatgacgccgggcaaccatggcctgcgccggcagatcgccctgcgctacatggtcggcggcctgctgctgccggtggaagaactggtcatcagcaacggcgcgctggaggcactcaacctctgcctgcaggtggtcacccgtcccggcgacctggtggccatcgaggcgccggcgttctacgccaccctgcaggtgctggaacggttgaagctgaaggcggtggaaatccccgtgcatccgcgtgaaggcatcgacctggaagtgctcgccgacagcctggagcgcctgccgatcaaggcctgctggttcatgagcaacttccagaacccgatgggcgcgagcatggacgacgagaagaaacgcgccctcgccgagctgctggcgcgccaccaggtgccgatgatcgaggacgacgtgtacgccgaactgtacttcggccagcaggcgccgaaaccggtcaaggcctacgaccaggaaggcctggtgatgcactgcagttccttctccaagagcctggcgccgggctaccgggtcggctgggtggccggcggacgctacgccgagcagatcgagcgactgaagctgatgaccagcctgtcggcgtcgatcccggcccaggcggccatcgccgactatctccagcacggcggctacgaccgccacctgcgcaagctgcgctacgccctggagacccagcagaacgccatgctcgcggcggtggcgcgttacttccccgagcagacccgggtcagccgtcccagcggcggctacttcctctggctggagttgcccgaggcggtcgactcgctgcgcctgttccaactggccctggcccagggcatcagcctcgccccggggccgatcttctccgccacccgccgcttcgcccattgcgcccggctcaactacgggcacccgtggagcgcgcggcaggagaaggcgatggagacactcgggcggatcgcccagtcgctggcgggatga

SEQ ID NO: 11743 - DNA, 441 bp, Pseudomonas aeruginosa
gctacaacacctggcgcacggtacgccaggcgcgcccggaaggaatcctcgcggcggcccgcatggcctgagccgcgacagcgcgtcccttcccttcccgagcctcgcccgccacgctgcgggcaaggctcgacagccgacgaggagaatcatcatggaattcagctggagcgagatcctgctggagctgctggcgatcgccgtgctgttcttcggcgtgcattggagcctgcgccacgccaagaccctggaccaggcgagcatgctgccgttcgccgacgacgaggaggtggcccgccgggtcgagcgggaaaccggcaggagccgcaccggctgcggctgtcccggtcgctgccagggcgactgccggcactgggacaagaattggccggcatgacgccggccagtcgcttcagggctttatcttcttcagctcgttga

SEQ ID NO: 11744 - DNA, 300 bp, Pseudomonas aeruginosa
gcagttccagcaactgcgcgagcttttcctcgccgaaccgctcctggatgcgctggtagttcttctccatgtcgccgctcatggagacgaagcactgctggcccttttccgtcaggttcacgtagacccgccgctggtccttgggcgccttccagcgccggacgatgccgtcgcgctccaggcgcgccagcacgccggtcatgctcgggcgcaggatgcaggcctggttggccaactggtagctctccatctcgccctgctggcgcaggatgcggatcacccgccactgctgctcggtga

SEQ ID NO: 11745 - DNA, 1317 bp, Pseudomonas aeruginosa
aactcaccgtgcaatcggcgtcacccatacctacaagaacaacaaccaagggaagaatcgatgatcacggcatgcccccgcccgtgcgcctggcgcagctatgcgcttggcctcggcctcctgcccctcgccgcgcaagcggaattcctcgcggacagcagcgcccacctcgacctccgcaacttctaccagttgcgcgactaccgccagcacgatgcgccccaatcgcaggccggcaactggtcgcagggcttcgtcctgcgcctgcaatccggtttcaccggcggcccgctcggcttcggcctggatgctaccgggctgctcggcgtcaagctcgactcgggacgcgggcgtagcaacgatggcacgctgccgttcggagcgaattcgaaggagccggtggacgactacagtcacctcggcctgaccgccaagctgcgctattcgcagacccagctacaggtcggcatcctcatgccgcaactgccggtggcgttccgcgacgacgtgcgcctgttgccgcagaccttcgacggcgcgctgctgacctccagcgagatcgagggtctcaccctcaccgcggggcaattgtggaagtcgcgcacccgcgagtcggccggcagcgacgacatgtacatcatgggccgcgacaaggcccacgccagcgacgagttcaatctcgccggcgcgacctacgccttcacccctcggctcagcgccagctattactacggccagctcaaggacatctaccggcagcactatctcggcctgctgcacaccctgccgctgggcgaagggctgtcgctgcgcagcgacctgcgctacttcgacagcggcgaagacggcgcggcgatctccgggccggtggacaatcgcaacctcaacgccatgctcaccctgcgcgccggcgcccacgccttcggcatcggtgtccagaagatgatcggcaacgacgcctttccggtgctcaacggctacaccacgccctacgtggccaacctcatggcctaccagaccttcacccgaccgcaggagaaatcctggcaactgcgctacgactacgacttcgccggcctcggcctgcccggcctgaacctcatgacccgctatgtacagggccgcgacatcgaccgcggcgccggccgcgccgacgacagcgaatgggagcgcaacaccgacctgtcctacgtgatccagagcggaccgctgaagagcgtcgccttgaaatggcgcaacatcacctaccgcagccgctacggtgcggacctggacgagaaccgcttcatcgtcaattacacgctaaagctctggtga

SEQ ID NO: 11746 - DNA, 312 bp, Pseudomonas aeruginosa
aggaatagcgccatgcaactcgccacacttcaggaactgagcttcgatgaaatcgaccaggtatcgggcgccggactcttcagcttcgtcggcgatgccatcgtcgatgtggtcaaggtgtccaacgacctgctcaacacgtcggtcatctcttcggtcggcaaggtgttcaacgccgtcggcctgacccccatccatcaactggccgacaccctcggctacggcgtgttcaagggcgtcgccgcggtcggcggcctgctcggcggcgacaccagccgcatcgattaccactacgacaccgagtggacctga

SEQ ID NO: 11747 - DNA, 432 bp, Pseudomonas aeruginosa
gacccggcaaccgggaaggggcgaccagcgccccgatcaggagaaccgccatgcacgacctcatccagcacgccgacgccttcgtcggcgatcccgaccaggaatccggcggcctgtcgcgccgcagcttcctcggcaagagtgccacgctcggcgcggtcggcctggtggccggctggaccccggccttcgtcatccagcccgccgaagccgccgccagcagttgtccggcgccggcaggctttccggccggcctcgaactttatcggcgggcgttccgcaattggtcgggggaaatcgccgccgacgacctctggagctgcgccccgcgcaccaacgaagaggttctcgcggtggtcaactgggcctggcagaacggcttcaaggtgcgcccgcgcggcatgggtcacaactggtccccgctgctgctga

SEQ ID NO: 11748 - DNA, 1998 bp, Pseudomonas aeruginosa
tgtaggccgcaccaccatctaattagaaaagtcgcactccggcacttcatgcgtttgaactttcgcaagggtgtcggagtgtcatgcaagtattattcgaatccaggatccagccaccatgtttcgccaggaagccctcgacgcccagcatgccggcggcctgggcgagatcgtgctgatccgcccggtctccttcacttttctcaccctgctggccgcggcgatggcgctgctggtggtgggcttcttcctgttcggcagctacaccaagcgcagcaccgtcagcggccaattggtgcccgccagcggccaggtcaaggtgcacgcgccgcaggccggcatcgtgctgcgcaagttcgtccaggaaggccaggcggtacgacgcggcgagcgcctgatggtgctttccagcgaacgctacggcagcgatgccgggccggtgcaggccggcatcagcaggcgcctggaacaacgccgcgactccctgcgcgacgaactggaaaagcttcgccgcctgcaagacgacgagcgcgacagcctgaccagcaaggtcgccagcctgcagcgcgaactcaccaccctcgccgcccagaccgacagccagcaacgcctgctggcgctggccagcgacgccgccgcgcgctaccaggggctgatggacaagggctacatctccatggaccagttgcagcagcgccaggccgagctgctcggccagcgccagacgctgcaaggcctggagcgcgaacgcacgtcgctgcggcagcagttgaccgagcgccgcaacgaactcgccgggctttccgcgcgccaggccaaccagctcgcggaaacccgccgccagctcagcgcggtggagcaggacctggccgaaagcgaagccaagcgcaccttgctggtcaccgcgccggagagcggcatcgccaccgccgtgctcgccgaagccgggcagaccgtcgacagctcgcgtccgctgctgagcatcgttcccgccgacaccccgttgcaggccgaactctacgcgccgagcaagtccatcggtttcatccggccgggcgacgcggtgctgatccgctaccaggcctatccgtaccagaagttcggccagtaccacggcaaggtgcagtcgatctcccgcgccagcgtctcctatgccgagctttccagcatggtcggcggcgtaccggggctcggccaggatggcgagcagctgtaccggctgcgggtaaccctcgacgaccaggcggtgaccgcctacggccagccgcgtccgctgcagagcggcatgctgctggacgccgacatcctccaggacacccggcgcctctacgaatgggtgctggaaccgctctacagcctgaccggcaaactctaggaacgacccatggcctttctcgacgctctcgccctgcgcctgggccgccgcctgccgctggtgctgcagaccgaagccaccgaatgcggcctggcctgcctggcgatgatcgccggctaccacggccaccataccggcctgatggaactgcgccggcgcttctccgtatcgctcaagggcatctccctcaagcaactgatccagaccgcccaccgcctcggcctgggtacccgcgcggtgaagctcgacctcggcgacctcggcaagctcaagctgccctgcgtgctgcactggaacttcaaccacttcgtcgtgctcaaggcggtcgacgggcgcggcgcggtgctccacgaccccgcccacggccagcgccggctgggcctggaggaagtctcgcggagcttcaccggggtagccctggaactctggccggagagcggcttcgagaaacaggaggcgccgccgcggatcaagctgctgggcatgctcggcaaggtcaccgggctgtaccgctcgctggcccaggtgctgctgctcgccggcgcgctggaagtgttctcgctgatcagtccgttcttcctgcaatggaccatcgacaacgtcatcgtcagcgaagaccgtga

SEQ ID NO: 11749 - DNA, 1146 bp, Pseudomonas aeruginosa
cctgctcagcaccctggccatcggcttcggcctgttgctgctgatgcagcaggcggtcagcggggtgcgcgcctgggtgatgatgcacatgagcaccctgctcggcgtgcagtggcaggccaacgtcttcagccacctgctgcggctgcccgcgcagtatttcgagaagcgccacctgggcgacgtggtgtcgcgcttcggcgcggtgaacagcatccagcagaccctcaccgcggccttcctctcggcggtgctggacggcctgatgaccgtcgccaccctcggcatgatgctgctctacagtccgccactggcggccatcgccatcgccgccatgagcctctacgccctcggccgctggatctggtaccggccgttgcgcaacgccaccgaggagcagatcgtccacgccgcgcgccagcagagccatttcctcgagacggtgcgcggcatccgcccgctgaagctgttccagcgccaggacgagcgccgctcggtatggctcggcctgctggtggaacagatcaacgccggcctgcgtacgcagaagctgcaactgttctaccagcagctcaacggcctgctgttcggcgtggagaacctgctggtgatctggctcggcgcgaccatggtgatggacggccagttcagcgtcggcatcctgatggccttcaacgcctacaagtcgcagttcgacagccgcgtcggcagcctgatcgacaagttcttcgagctgcgcatgctccagttgcagggcgagcgcctggccgacatcgtgctccaggccccggaggtcagccacggcgacatcctcccgaagaaccttcgcgagcgcgaggcgagcatcgagatccagggcctgcgctaccgctacgcggaacaggagccctgggtcctcgacggcctcgacctgcgcatcgccggcggcgagtcggtggccatcgtcggcccctcgggctgcggcaagagcaccctgttcaacgtcctgctgggcatcctcccgccagggggggaacagatccgccatggccggcctggaccttgcgcaattgggcctggaagggctgcgcgaactggtcggcacggtgctgcaggacgacgtgctgttcgccggttcgctcaaccgaacaacatcagtttttttga

SEQ ID NO: 11750 - DNA, 651 bp, Pseudomonas aeruginosa
gcctcgacgaaagcaccgcgcgcctggccgaacgccaggccgccgcggcgcgggagcaggcctgatgcgtgccctcgccggcctgttgtgcggcctgctcggcctggttcccggcgccgccgcctacgagccggacgtgttcggcaccgtcggccaggtcgccggccaggcggtctacgacctcggcggcagcggtttgccctgccgcggcgggccgccaccgaccgagctgagcctggaggaagccatcgagcggatcctctgccacgacccacagacccgcctcgcctgggccaatgccaaggcggcccaggtcgggatcggcaagtccgcctacctgccgcgcctggacggccgtctcgacgccagtcgcggctacagcgacatggattatcgcgatgccccctacctctccggcgacggccatcgccaccggcgtggcgccagcctccaattgagctgggtgctgttcgacttcggccgccgcagcgccgccctgcgcaacgcccagcagttgctgctggcggccaacgccagccaggacgcgaccctgcagaacaccttcgccctcgccgcccaggcctactacgacgccctcgccgcccagcgcagcctggccgcctcgcggcaggtcgcggagctggcggcgca

SEQ ID NO: 11751 - DNA, 1206 bp, Pseudomonas aeruginosa
ggaaaaggcccgcctgcaggccgacctggggaccagcaacttcctgatcctgcccaaccacggcctgctcacctgcggcggttccatcgccgataccttcctcatgatgttcaccctgcaacgcgcctgcgaggtacaggtgatggcgcagagcggcggcgccgagctgatccacatcccggggcagatcctcgccggcgcgcgcgacatgatcgccggggtgatgcgcagcaagaccggcatgggcggccagctcgcctggccggcgctgctgcgcaagctcgaccagcagaacccgggctaccgccagtgaccgcggcgctgcccggcattcccctggaggcctggcggaggcgcggccgcactctggatttcaagggcttcccgatccgctattgggaagccgggcagggtcggccgttgctgctgatccacggttttcccagcgccgcctgggactggcactacctctgggagccgctggcgcagcgctaccgcgtgctggtctgcgacctgctcggcttcggcgattcggccaagccgcgcgcccatcgctacagcctgctggagcaggccgacctgcaacaggcgctgctcggccgcctgggaatcgacgagccgctgcacgtgctggcccacgactacggcgacagcgtcgcccaggaactgctcgcccgccatcacgaaggccggctgcggctcgcctcctgcgtgttcctcaatggtgggctgttcccggaaacgcaccgcccggtgctcagccagaagctgttgctgagcccgttgggcgggctgttcggccggctgttcgaccgccgcgccctggcgcgcaacttcgccaaggttttcggcccgcgcagccagcccggcgagaccgagctggatgccttctggagcctgatcgaaagcaaccaggggcagcgggtgatgcatcgcctgatccgctacatcgtcgaccgccgcgagcagcgtgagcgctgggtggcggcgttgcagcacggcggggtgccgttgcgggtgatcgacggagccgtcgacccgatctccggggcgcacatggtcgagcgctaccggcaactggtcgccgatgccgactgcgtgctgctcgatggcatcggccattatccgcagatcgaagcgccggcggcggtgctcgaacattacctggcgtttcgcgcccgactggatgattcagagttttcttaa

SEQ ID NO: 11752 - DNA, 1371 bp, Pseudomonas aeruginosa
ggtgctggcgcctcgctggacgaggcgtttcgtcacccatggaggtctccatgcacgatcccgtttctcccttgcgcgtgttcgacgagggctcctggttgttccgccagttggtgcaggcgcaaccgttcatccgccagtccgggatggtcctcgccgaactcggcctgctgctggcgctcgggctcggctacctgtgctggcaggaaggcagtcgctggtacgccgtcggcgccggcctcgcgttgctcggcagcctgctgctggtggtggtccggcacaactacgactggtggctgttcaagctcggcccgcgtggccggctgtacattccgttcgactgaagcggaacatcccgctgccttatcgggcgccattcatggcggcgcgaagccttgtccccgccggcgggctggccgacactcgggcaatccttcctactgccctggagtcccgaacatgagcgatgccctgcgtttcgacgaccaagtcgtgatcgtcaccggagccggcggcggccttggccgcgcccacgccctgctgttcgcgaagcatggcgcccgggtggtggtcaacgacctcggcggcagcacccatggcgaaggcgccagtgcctcggcggcggacaaggtagtggcggagatccgtgccgccggcggcaccgcggtggccaaccacgactcggtcacggacggcggcaggatcgtggagaacgcgctggacgccttcggtcgcgtcgacgtggtggtcaacaatgccggcatcctgcgtgacaagaccttccacaagatggaggacgccgactgggacctggtctaccaggtgcatgtcgaaggcgcctacaaggtcactcgcgccgcctggccgcacttgcgcgagcaggcctacgggcgggtggtgttcacctcctcgacctcgggcatctacggcaacttcggccagagcaactacggcatggccaagctcggcctctacggcctgacccgcaccctggccctggaagggcgcaagaacaatatcctggtcaacgccatcgcccccaccggcggtacgcggatgaccgaggggctgatcccgccgcaggtcttcgagcagctcaagccggagctggtcagcccgctggtggtctacctcggcagttcggcctgcgaggatacctcggggctctatgaggtcggcggtggctggatcggcaaggtacgctgggaacgcagcctgggcttcggcttcgatccgaaggccggcttcgacgccgaggacgtggccgcgcactggcagcagatctgcgacttcgagaacgccgcgcacccggcggacaacgtcgaggcgctccgtgaaatgatggccaacctgcagaagcacgcgctctga

SEQ ID NO: 11753 - DNA, 822 bp, Pseudomonas aeruginosa
aggcctggccgcgctccaggccgatctccgcccagaccgacgacggcagcggctcggtggccaccagcagactctgcaccggcaactggtagtggcccagcggcggcaggctggcggcatagccttccaccgccggcacgatccattcggcgcgtagttcgccgcgctcggtgcgcagcaggccgcgttgccagtgcagcacccggctcttctcgaacagccgcacgcccaggcgctccaccgcgcgggccaggccgcgcgcgagcctggccggctggatggtggcgcagtgcggcgaatggatcgccccgtagctgccggggatgcgcaactgctggtcgagttcctgcggcctcagccagcggtagtcgctttcgtccaggccttcggcatagagatcatgcagataggcgcgcaggcggcgttcctgttccgggtagcgcgccgcgcagtagagcacgccgcccttgcggtagtcgcagtcgatgccttcctcttgcagcacccgcgcgacttcgtcgggaatcccgtgcagcaggtcgtagccggcccggcgccgctccggcggcaagccggcgagcaggccgtcctcgccgagcaggttgcccatcagccagccgccgttgcgccccgaggcgccgaagccggcggtttctgcctcgacgatggcgacgcgcaactgcggcgcccggcgcttcaggtaataggcggtccagaggccggtgtagccggcgccgacgatggccacgtcgacctcgagggattcttccagggacgggcgcgcttcgagcggatcgtccagttgattcatccacaggctga

SEQ ID NO: 11754 - DNA, 2040 bp, Pseudomonas aeruginosa
ccgtctcgcgggtggcgtcggcgagatcgcggtcggcgggaatggtctgttcgggctgcatgcagcgaaggatgccatcgccgccgccggcggaacagtgccgcgctgtcatccatgcactggatgacggcgtatccatcctgcatatggcgttcgccgaggcgctttccagggcccctgttcactctttcgggcgacagccggaatacctccttggtgcgcttaccgccgttcgggccgctgggtagggtgtacccacctcgaccctgtcaggagagccgcatgacaacaacaaaaaggcgcggaatcttccctctgcacgcactcgctgcggccacagccctgggttgcgccacccaggcctcggccgtgtcattcaacatcggggagatcgaagggcaattcgactcgtcgctgtcggtgggggccagctggtccatgcgttccgccgacaaggactacatcggcacccgcaacggcggccacgcctcgtcgcagacctccgacgacggccggctgaacttcaagaagggcgaaaccttctcgaagatcttcaagggcatccacgatctcgaactcaagtacggcgacaccggcgcgttcttccgtggcaagtactggtacgacttcgagctgaaggacgaacaccgcctgctctacgacatcgacgaccacaatcgcaaggagggcgccaagtcctccggggcgcagctgctcgatgccttcctctaccacaactacagcatcggcgacctgcccggcagcgtgcgggtcggcaagcaggtggtgagctggggcgagagcacgttcatccagaactcgatcaacagtatcaacccgatggacgtcgccgcgttccgccggcccggcgcggagatcaaggaaggcctgatcccggtgaacatgctctacctgtcccagggcatcagcgacgcgctgaccgtcgaaggcttctaccagttggagtgggaccagacggtgatcgacaactgcggcaccttcttctctaccaccgacgtggtcgccgatggctgcgagcggatggtctacgccggcagcgacttcgacccgaacccggccaacggctaccgctacctgccgcgcgccggcgatcgcgatgcccgcgacagcggccagtggggcctggccctgcgctggtacgcggcggagctgaacgacaccgagttcggcctgtacgcgatgaactaccacagtcgcaacccgtactacagcgtgatcgccggcaacggcctggccacctccgacccggtcaccgggcgctccaccggctattacttcatcgactatcccgaggacatccgcctctacggcctgagcttccagaccaacatcggcagcacctcggtggccggcgagctgagctaccggccgaacatgccgctacaaatcaacagcaccgacatgtcgatcgccgcgatctacccgaccaccctgttcggcaacccgatctacgacagcggcttcgccaccccgcgcgccggcgaggtgatcaacggctacgtgcgcaagccggtgacccaggcacaggtgaccgtcacccagttcttcgaccgggtactggcggccgaccgcctgaccgtggtcggcgaagtcggctacaaccacctcagcggggtcgacggcgacgacctgcgctacggtcgcgacgccatctatggcatcggcgaactgccgaacaacgccttgtgcaccggcgcgctcaacgtggccaacccgcaggagtgcaacagccacggcttctacacccgcaactcgtggggctatcgcctgcgcgggatcctcgaatatcccaacgtgttcgccggggtcaacctgaagccgaacctggcctggtcgcacgacgtcgagggatacgggccgaacttcagcgagggcgccaaggccgtcagcgtcggcctcgatgccgaataccagaacacgtataccgccagcatcagctacaccgacttcttcggcggcaactacaacccgatcaacgaccgcgacttcctcgcggtgagcttcggggtgaacttctga

SEQ ID NO: 11755 - DNA, 609 bp, Pseudomonas aeruginosa
acaacgaggagaagcgcggctacgagttcggcttcaaggcctcgtccgccgactacacgccggccgccctgcgcaacgccggggtacgctgagtcccggccagtcgcgacgagcgcgtcggcttgtgccgacgcgctcgtgcgttatgacggcccatcacccggcgcaatcatcgttcagcagcggggcaggcgcggtctaggctcccggcaaggcgcttcgacagaacaagagcactgccatgaccgagccgaccgagctgcccgccgccttgccgcggctgccgccgcagcacctgccgcggccccgtttgcaccagccgctgctgcgcggcgaatgccgcctgcgactgctctgcgcgcccgctggcagcggcaagaccgtcctcctcggagaatgcgcgcggcgggcgccgcctggcgtgcaggtggtctggctggcgctgggcggggaagcgctggaccccgcgaccttccgccgccgcctggccggcgccctcggcttgcccgaggaaagcgacgaagcgcagctgtgccggcggttgcgcaacgcatccgcgctgtggctgctgctcgacgattacccacggcaccccgaccccgcctttga

SEQ ID NO: 11756 - DNA, 2232 bp, Pseudomonas aeruginosa
cgcctgcctcgattgcttgttgagcgcggcctcgccacgggtgggctggtggctggcgagccggcggcggccgcagtgcaacctggcgcggttgctgctggaaggggagttgctggaggtcgacggcggcctgctggcgttcgatgccgacgaggtcgccgaactgctccgcctgcacggtcgcagcgccgatgccgctgcgaccggggcgctgctggaacgcagcggcggttggtgcgccgcgttgcgcttgcgcctgctggtcggcgaagagacggccggaccgttgttgcaggaatacctccagcacgagttgctcgacgagctgccgccgccgctggccgacgccgcgcgtgccctggcctggctgccgcaagtcggtccggagctgttccgccggctgttcgaggagctgccccacgggctggacgacctgttggcgcggggcttccccctgctggccgatgcgaaccagcgctacagcctgccaccggcgatccgcgaggcctggcgcgaagcgccgcagcgcccgcagcgggacttccaccgggaagcctgcgaatggttcgccgaacacggcgagacccgcgaggcggtcgaccaggcgctggccgccgacgaaccggaaaccgccgccggattgttgcagaagctcaccgaggagcaattgctgcacggccacaacatcggcatggtcctggccctgcgcgacgaactgccggcggcgctgctggccagcacgccgcgcctggtgatcctgaatgcctggacgctgctctacgccggacgcctggccgaagccgaggactgcatcggccagttggcgcgcttcctgccgatgccctcggcgtcccgccagcgggtgctgctggcgcaatggcagggcttgttcgggatcctcctgcactgccgcggcgagcgcggcgccgccgactacctgcgcgaggcgctggagcaactgccggaggacgcctggtcgcagggactgatctgccgctcggcgctgatgcaactggcgataatcgaggggcggatggaccaggcgcggttgatcggccgcgatgccttgcgcctggcgcgcgagcacgacagcctgatcttcgaggcgctgatcgaactggagcgggcgcagtggctggagcagcgcggcgaactgctgcgcgcggaaggcgtcctcgatcgcgcccagcgctacctggaggacctcggccagcagggcagcccgatgctcggccggatcgccctgcgccgcgcgcgcctgtgcctgcagcagggccgcgaggtcgaggccgggcactggtatcggctggggctggagcaggcacgggagaatctcgatccctgggcgctctacggctacctgggactggccttgctggaggccgggcagggcgacctggacgcggcgttcaaccgcctgctggaggtcgaacggctgatgcagcagcgccatgtccccgatccgctgtatcgcggcgcgctgctgctggtcagctccgccctgaccctgcagcagggacggccggcgcaggcgcgggagatcctgctgcgggtccgcgcctacttccagccgggacgggcgcgcctgtcgccgccctccgaaccggagctggaagcgcgggtagagcaccaattggcactggccgaactctacagcggcgaggcagccgccgccgaagcgcggctgcgcgggctgctcgccattctcgaggcgcaggggcggcagacgctgctttgcgaagtgcgcatgggtatcgccgagtgccagttcctctccggacaattgccccaggcccagcagaccctgcgcagcggcctggagctggcggagcggctaggcctgcaactgccgcagcggcgactgcgggatcgccagccgcaactgttcgccgccctgccgggggaagaagaggaggggctcagtccgctcagttgtcgggagctggcggtgctcggcctgatcgcccagggctgctccaaccaggagatcggcgagcaactgttcatttccctgcacacggtgaagacccacgcccggcggatcaacggcaagctcggggtggcccgtcggacccaggcggtggcgcgggccaaggccctcggcctgctccccctgagcggcctcagtgcagggcgcggccggtcggcggggcgagttcgcccaggcgctggccgaggcgcagttgctcggtgggatcgtcgctgagcaagagcgcgcgttccaggtcgtag

SEQ ID NO: 11757 - DNA, 597 bp, Pseudomonas aeruginosa
tcatccgcccgccgcacctggacaatcgcggcgcgctgttcgaggccttcgggcgcttcatcgaaagcctcggcggaggctacatcactgcggtggacagcggtacctccagcgccgacatggactgcatcgcccagcagacccgccacgtcaccagcaccacccaggccggcgacccctcgccgcataccgccctcggcgtgttcgccgggattcgcgccagcgcccaggcgcgcctcggcagcgacgacctggaaggcctgcgggtcgcggtgcaggggctcggccacgtcggctacgcattggccgagcaactggcggcggtcggcgccgagctgctggtctgcgacctcgatcccggccgggtgcaactggccgtcgagcagctcggtgcccatccgctggcgccggaggcattgctctccaccccttgcgacatcctcgcgccctgcggcctgggcggcgtgctcaccagccagagcgtcagccagttgcgctgcgcggcggtggccggggcggcgaacaaccagttggagcggccggaggtcgccgacgagctggaggcgcgcggcatcctctatgcgccggactacgtga

SEQ ID NO: 11758 - DNA, 447 bp, Pseudomonas aeruginosa
acgtggcgggcgcctggcagttgccggtgctcttcgtggtcaacaacaaccagtgggcgatctcggtgccgcggcgcatccagtgcggcgcgccgaccctggcggagaatgcggtgggtgccggcttccccggcgaacaggtggacggcaacgacgtgctggcggtcgccgaacgcgtccgcgcggccctggagcgcgcgcgccacggcaaggggccgaccctgctggagtgcatcagctatcgcctctgcgaccacaccacggccgacaacgccagccgctaccgttcccccgaggaggtcaaccaggcctggcgcgaggaaccgatcaagcgcctgcgcgccttcctcgccggccgcggccagtgggacgaggagcgcgagcacgcgctggtgggggagtgccaggcgcgggtgcaggagtcggtggagcgtttcgagacgttag

SEQ ID NO: 11759 - DNA, 798 bp, Pseudomonas aeruginosa
gcgcaacggcgaagcgacacgcctggccgttctggaggcggtcaacctggcgttgcaccgggccatggccgaggacgagacggtggtggtgctgggcgaagacgtcggggtcaacggcggggtgtttcgcgccaccctcggcctgcgcgagcgcttcggcttcaagcgggtgctggatacgccgctggcggagaacatgatcgccgggctgtccatcggcatggccgcccagggcctgaagccggtgatggagatccagttcatgggcttcatctacgccgccatggagcaactggtgtcccatgccagccgcctgcgcaatcgcacccgcggccgcctggcctgcccgttggtgctgcgcacgccgatgggcgcggggatccgcgcgccggagcaccacagcgaggcgaccgaggcgatgttcgcgcacatccccggcgtccgcgtgctggtgccgtcgtcgccggcgcgggcctacggcctgctcctggcggcgatcgacgatcccgatccggtgatcttcctcgagccgacccggctctaccggatgaacccgcagccgctggcggacgacgcccggcgcctgccgctggacagttgcttcacccttcgcgaaggcggcgacctgaccctggtcagctggggcgccagcgtccacgagacccagcaggccgccgagcgcctggcgcagcgcggcatcgaggccgaagtgatcgacgtcgcctgcctcaagccgctcgacctcgacaccctcgaagcctcggtgcgcaagaccggtcgctgcgtgatcgtccatga

SEQ ID NO: 11760 - DNA, 687 bp, Pseudomonas aeruginosa
ggcgccgaagagtggcggcctcggcggggaaatcgccgcgagcctctacgagcgtgtcctgttcgacctgcgggcgccgatccagcgggtcgccgcggccgatatcccgccgccgctgtaccgcctggaagcgctgtacatgcccgccgtggaggacatcctggcggcctgcgacaccgtgctcggctacgcctgagccaaggggagacgaccatgaagcacttcaagctgcccgacctgggcgagggcctgcaggaagcggaaatcgtcgaatggcacgtcaaggccggcgacagcgtgcgcgccgaccagcgcctggtttcggtggaaaccgccaaggcgctggtggacatccctgcgccctacgatggggtggtgggcaagctgttgcggcgccggagggcgacatccttgccacgtcggcggaaccgctggtgggcttcgaggccgaggaggcggaccgccggtaccttgggtggggcgcctggcgggcaggcggtaaccccctgggggaccgtttgttcatcggggccgcaccgtccacccggcgaacacctgggcaccgccccgccgaccccgggcggtgcgcccagttcgcccgcccagcagggcgtcgaactggccggcatgagcggctccgccctggatggcgtgatcaccatctcggacgtggaggccgccgcctag

SEQ ID NO: 11761 - DNA, 654 bp, Pseudomonas aeruginosa
ggcgcccgagaatgctttggcggcgagcgcttgcgcggggtacggcggagcatggcgctgaacatggcgcgctcgcatgccgaggtggtgccggtgacgatctacggcgacgccgacctgcatcgctggaagaccgcacgcgacccgttgatccgcctggcccaggcgctggccgaggcctgtcgcgccgagccgaccctcaacgcctggttcgatggcgcctcgttgtcgctgaaactgcatgagcggctcgacctggggatcgccgtggacaccccggacggcctgttcgtgccggtgctgcgcgacgtcggtgcgcgttcggcggaggacctgcgcgccggtatgcggcgcctgcgcgaagacgtccaggcacgctcgatcccgccggcggaaatgctcggcgcgaccctgaccctatccaacttcggcaccctgttcggccgctacgccaaccccgtggtggtgccgccgcaggtggccatcctcggcgccggcggcatccgcgacgaagtagtggcctggcgcggcgagatggcgatccacccgatcctgccgctctcgctgagcttcgatcaccgcgccgccaccggtggcgaggcggcgcgtttcctcaaggtactggtgaacgccctggagcagcccgacggctga

SEQ ID NO: 11762 - DNA, 1305 bp, Pseudomonas aeruginosa
tcagcgccggcgctccagccaccatgccagcagcgcgccgagggcataggcgagcaggtcgaagccgtcggcggtgctaccgagaacgatgcgcagcacgggactggaaaattgccaatgcagttgcgccgccaggtactggcccagttccagcagcgcgccgacggcaaaggcggcggatgccagccaggcggccggcgccctgagcgcgctgcccatcaggtagtagagccagaccaacgccagcaggtcgccgccgaagctgcgtatccagccccaatgccggcccagggtggcgagcaggaccagcaggccgaacagcagcagtgccagcagcaggctgcgccggtccaggcgccagcgtcgggagcggacgggggaggcggggagagcgggcatgggaccttcctggtcgatggggctgccgggcgttgtacggcaagcgccagtttccggcaagccgggcgcgggtcggacaagcgccgcgcggactcagcggcgtcgcaggctggcgagcagttgttcgacgaaggcgtcgctgccggagctgtcgaggtagtgcacctggggaccgtcgagcaggtagagcgcgtggtagggcttgccggcctggctgccgcgcaggcgatagacctcggtgccggccacgcggtagcggctgacgctggcgcgccggtcgcacaggccgagggcctggcgctgcgcctggagacgctcgcgctcggcgtcgggcaggccgtccagcggcagggctccgaagagcaggcgaacctgtcgcggaaggtcgagccgttcgccctcgtccgcgcccatctcgttgccttcgagcaggcggtgggcgaggtaatgaccctcggcgtagcgagcgatcagcaggtcgccgctgtgcagcagggtggcgggggcccgttgcaggtcgagttgcagtctgccggtgccgcccagggccaggacctgcgcggcgccggcagaggctgccggtgtctcggcgtccgtggcccggaatgggcaggcgagggcaggggcgccggcgaggccgaggaggacgcacagcaggccggcaagttgtcgcggcatgtttcggctccttgcgctttgcttgcagcggcggctcattcgtccgcggcgttttcctcgaacagttcgttgagggcgtccggctggttcttgaaggcgcgggcgaaggcgtcgcggttcttcgccatgaagatgccgagttcttccacctgttcctccttcagcgacggcaccgccttctgcagcacctcggccagcgtttccgccagctccagcatcttgtcgtaa

SEQ ID NO: 11763 - DNA, 279 bp, Pseudomonas aeruginosa
ggttgcgcgcctgccgcccgttgcgcggcgcataccttccgccccgcaaggatgcccggcatgcaagacttcggtttcgcccttctgctcatcggctacgtctggtccgtggccagcggcggccgccgttcgatcccctgcgcattgctctgcctgctgctgtttccgctggcgcaactggccttcgccatcaacgacgcgccgatgcgcccgccgctggcgctggcggcccttggcgcgggcctggcctgcctcggcggcggctcggtgttcggctga

SEQ ID NO: 11764 - DNA, 426 bp, Pseudomonas aeruginosa
gccccggcatctcacaagaatacgattgaaaatcattatcataaaaaatatgctgctgcccttctgaaaggacgtgggtggatgcgccgttggcggagcaggatctcaaggcactgtttctcaggcatgcccggcagttgcagtcgtatctgttgcgcaagacccgtgatccacacctggcggcggacctggcgcaggaaagcttcctgcgcctggccgagcagcggcacaaggagccgatcgagcatgtcgacgcctatctctaccgcaccgcgcacaacctcaccatcgaccattaccggcaggaacggcggcgccgcaccgagacccggcccaacgacgacctcgccgggttcgtcgccgaccagcccggccccgaggagtccgcggtggatgccgatgcgcttgcccgcctgcgcgagatag

SEQ ID NO: 11765 - DNA, 1080 bp, Pseudomonas aeruginosa
tgctcgcactctacgattctcgctgaatggattaccgagtcttgccggttcgcgcgtctgaacctctataacgaccaacgagagccgcacgtgaacagcccccaggaacaacagcagatccgccagcaggccgccgaatgggcgatccgcctggacggcggcgacctcgaccggtcccggcgcgaagcgctggacggctggctggcggctgacccccggcacccggccgcgctggcgctggcgcaacggacctggaaacagctgggatcgctggccgaaccgcggacgatggttcagacgccggttgccagcgcgccgcgccgcgccggggggcggcgcaaggggtggcgcggctgggccgcggcggcggcggtgctgctggccctgggcagcgcctggagcgaacgcgacgccggcgtgacctggctggccgaccactctaccggcaagggcgaggtacgcatcctgcggctggtggatggcagcgaggtcgagctggacgcacagagtgccatcgatgtcgcctacgacagccgcgagcgacgggtgcgcctgctcgaaggcagcgcgatcttccgcgccgccccccgcgcggggcgggagacacggcccttcgtggtggaaagcgccggcggcagcactcgcgcgctgggtactcggttcctggtcagccgcaacgacgacggcagcgtccaggtcggggtgctcgaacaccgcgtcgcggtggccctggcgcatccgcgcacggggaccgtcgggcgccgcgagctgggtgagggcgagagcctgcgctacagcgcggagggcggcgtcgaggcgccgctgggcggtcgcctccacgacctgaccagttggcggcgcggcctgctggtcttcgacgagcacgcgatgggcgaggtggtggcgctgctcaatcgctaccggccgggggcatttgctggtggctcccggtgcgttggcgcacccgcgggtcatcggggtattccgggtcgccgacctggcaggcctcgttgcactctatcagcgcatgagctgggagtgcgcagcccgggcctggcgggggggacgctgctgtactga

SEQ ID NO: 11766 - DNA, 402 bp, Pseudomonas aeruginosa
ccacccaggtgtcctacgacgacgccaacatgctcaacaccgagaaccaggcgctctgggaaaagctcggcagcagcgacgtgcgtgcgcagaacttcgccatcgactacggctacgcgccggacaacccgttggtggacttcaaggccaagctctactacgtcgacaaccgcaaccgccagcagaccctgcaacgcggtatcacccccggctactcgatcacctaccagaccgacacctacggcgcgcaggcgcagaacacctcgaccttcgctctcgacgatctctccacgctgcgcgccaactatggcctggagttcttctacgacaaggtgcggccggactccagccagccgcgggcgagcacctcggcggtcggcttccctgcggccgaaggcatga

SEQ ID NO: 11767 - DNA, 684 bp, Pseudomonas aeruginosa
agggcaaaaccggagcgggcattcgtgcgctccggcattcaccactcgttgaattggagttttggcatgagcatttcgatttcctacagcaccacctacagcggctggaccgtagcggattacctggcggactggtcggcctacttcggcgacgtcaaccatcgtccgggccaggtggtggacggcagcaataccggcggcttcaaccccggtccgttcgacggcagccagtacgcgctgaagagcaccgccagcgacgcggccttcatcgccggcggcgacctccactacaccctgttcagcaaccccagccacaccctgtggggcaagctggacagcatcgccctcggcgacaccctgaccggcggcgcctccagcggtggctacgccctggacagccaggaggtgagcttcagcaacctgggcctggattcgccgatcgcccagggccgcgacggcaccgtgcacaaagtggtttacggcctgatgagcggcgacagcagcgccctgcaggggcagattgacgcgctgctgaaagcggtcgacccgagcctgtcgatcaactccaccttcgaccagttggccgcggccggcgtcgcccatgccaccccggctgcggcagcggcggaggtcggcgtggtcggcgtgcaggaactgccgcacgacctggccctggcggcctga

SEQ ID NO: 11768 - DNA, 1479 bp, Pseudomonas aeruginosa
aatcctcgccaccctcggccgcttccgcccggcgctgcgcagcgtcgcgctgttcaccgcggtgatcaacctgctgatgctggcgccgtcgctgtacatgctgcaggtctacgaccgggtgctcggctccggcaaccacatgaccctgctgatgctgaccctcatggtgctcggcctctacctgctgctcggcgccctggagtgggtgcgcagcctggtggtgatccgcctcggcggccagctcgacatgcaactcaaccagcgcatctacgacgcctcgttccgcgccagcctggagcacggcgagcaggccgtcgggcaggcgctgaacgacctgaccagcctgcgccagttcctcaccggcaacgccctgttcgccttcttcgacgcgccctggttcccgctctacctgctggtgatcttcctcttcagtccctggctcggcctgctcgccctggttggggcgctgctgctggtgctgcttgcctgggtcaacgaaagccgctcgcgcgaaccgctggccgaggccgggcaactgtcgatcctcgccacccagcaggcctcggccaacctgcgccaggcggaaaccctggcggcaatgggcatgttgccggccatgcgcgcgcgctggttcgcccagcaccaggccttccttgcccggcagaacctcggcagcgagcgcagcgcggcgatcggcgcgacctccaagggcgtgcgcctggccctgcagtcgctggtgctcggcctcggcgcctggctggcggtggaaggcctgatcaccccggggatgatgatcgccggctcgatcctgatgggccgcgtgctcagccccatcgaccagttgatcgcggtctggcgccagtggagcggcgcgcggcaggcctaccagcgactggcgcggctgctcgaggagaatccgccggccgccctgggcatgccgctaccggcgccgcgcggcgcgttgcgcgtcgagcggctctgcgcggccgcgccgggacgcgagcaggcattgttgcaggacctcggtttcgccctggaacctggcgaagcgctcggcgtgatcgggccgtccggttccggcaagtcgaccctggcgcgcttgctggtgggcgcctggcagccgctgtccggcgcggtgcgcctggacggcgccgacctgcggcactggagcgcggcggcactggggccgcacatcggctacctggcccaggacgtgcaactgttcgccggcagcatcgccgagaacatcgcgcgcttcgccgaggtggatgccgagaaggtggtggcggcggcgcgcctggccggcgtgcacgacctggtgctgcgcctgccgcagggctacgacacgcgccttggcgacggcggcgccggactctccggcggccagcgccagcgcatcggcctggcccgcgcgctgtacgggcgaccggcgctgatcgtgctcgacgaacccaatgccagcctcgacgaggcgggtga

SEQ ID NO: 11769 - DNA, 1608 bp, Pseudomonas aeruginosa
ggcggccctggccgaggccatcgcggcgatgcgccggcacggcagcagcctggtgctggtcacccacaagccggcggtgctggcgctgaccgacaagctgttgttgctgcatggcgggcgcctgcagcgtttcggcgcgaccgccgaggtgcttgccagcgcctcgccgccggccgctgcggccccggcgccgacacggccgacgccggcgttcggtttcggctaccggccgggaccggggatgccggtcggcggtgtgccgggaggagcggcgcgatgagcgggcaggcgcggttgcgcgaagtcggcgccggcggcgcggcgctggaactggacgagaagcgtttttcccggctcggctgggggctggtgctgctcggcttcgtcggctttctcctgtgggccgggttggccccgctggacaagggtgtcggggtctccggcacggtgatggtggccggtagccgcaaggccgtgcagcaccctaccggcggcctggtcaggcacatccgcgtgcacgaaggcgagcgggtggaggcaggacaggtgctgctggagatggacgctacccaggcccgggcccaggccgatggcctgttcgcccagtacctggcggcgctggcgagtctggcgcggctgagcgccgagcgcgatgaaaaggcgcggatcgagtttcccgccgagctgctggcgctggacgacccgcgcctgccgaccctgctggaacagcagcggcagttgcacgacagccgtcggcgggcgctgcgcctggaactcgatggtctcgccgagacggtcgccggcagccaggcgcaactggacggcctgcaagccgcgctgcgcagcaaggagcagcagcgcgccgccctcgaggaacagttgcgcggcctgcgccaactggccagcgagggctacgtgccgcgcaaccgcctgctcgacagcgagcgcctgctggcccaggtcaacggcgagatcgccggcgacctcggcagcctcggcagtacccgccggcagatcctcgaactgcgcctgcgcatggcccagcggcgggagaagttccaggaagaggtgcgcgccagcctggccgacgcccaggtgcgcgccgaggagttgcgcaatcgcctggccagcgcgcgcttcgacctggccaacagcgaggtacgggcgccggtcgccggcctggtggtcggccaggaagtgttcaccgagggcggcgtgatcgcgcccggccagcaactgatggaaatcctcccggagcgccagccgctgctggtggacgctcggctgccggtggagatggtcgacaaggtccgcgtcggcctgccggtggagctgatgttcagcgccttcaaccagagcactacgccgcgggtggagggcgaagtgaccctggtctcggccgaccgcctgctggacgagcgcagcgaggcgccgtactaccgggtgcgcatccgcgtaggcgaggagggcgtacgtcgcctggccggcctggagatccgcccggggatgccggtggaggccttcgttcgcagcggcgagcgctcgctgttgaactacctgttcaagccgctggccgaccgtacccacctggcgctgggggaagaatga

SEQ ID NO: 11770 - DNA, 555 bp, Pseudomonas aeruginosa
atcgcctgcgagcctgcctgctgtcctccgcgctgctttcggcctcttcggcccaggcgctgggcctgctggacgcctaccaactggcggtgcgccacgacccgaccttccaggcggcgctccacgagcgccgcgctggcagcgaaaaccgcgccatcggccgtgccggcctgctgccgagcctgcgctacgactacaacaaggcgcgcaacgactccaccgtcagccagggcgacgcccgcgtcgagcgcgactatcgcagctacgcctcgaccctcagcctggagcagccgctgttcgactacgaggcctacgcgcgctaccgccagggcgaggcccaggcgctgttcgccgacgaacagttccgcgggcgcagccaggaactggcggtgcgcctgttcgccgcctacagcgaaaccctgttcgcccgcgagcaggtggtcctggccgaggcccagcggcgcgccctggaaacccagctggcgttcaaccagcgtgccttcgaggaaggcgagggcacccgcaccgacctgctggagacccgcgcccggctga

SEQ ID NO: 11771 - DNA, 1176 bp, Pseudomonas aeruginosa
cagcgacgcggcgcagcgtcgccggcggggagcgggtcaatcgcgacgtgctggacgccgaacagcagttcaacggcgcccgccgcgacctggcggaagcgcgctacgcctacctcaacgcctggctgcgcctgcgccagctggcgggggtgctggaagaccgcgacctggcggtgctggctgcctatttcggtgccggcgaaggacgcgcgcaggtcgccgctgccatcagatagctatcggccagcgtgccttgccttgggtcatcgcctgcaacagttgcggcgcgctggtgccgttttcgatggcgatgccgaagcggatgctctcgatcatccgctgcaactgctccaggtcatgcagttgcgccggtcggatcaggcgcttggcggcgaccccgcgttcgttggagagggtgaggacgatgctgccgtccggccgctccaggctgaggttgacccggtactcggcctggaaggcctcggtgaggagctggaaagggctgctgtcggtcatggcggaccacctgaatgctgtcgtgctggttgggactgggtgtcgcccggaaagttctttgtcaccgccgggctgtaccctgcgccgacgtgcggacgtctatctgcgcacgtgccttggcctgggccttgcacgcttcgggccaggtggccgtcgtctttgtcgggagaagctatgaaacagaattgggccgagcgcctgcgcgcaagcatgcaccaccaggcggagagcctcggcaacctgctggtggaggcgttccactacctggccctgttcgccatcggcgccacggtcttctgggcggcgggcgcggccttcctggggatggtgaacaaggggcatgcgtcgatcgacgacatcctcctgctgttcatctacctcgagctgggcgcgatggtcggtatctacttcaagaccaaccacatgccggtacgcttcctgatctacgtggcgatgaccgcgctgacccgcctgatgatcgccgacatccagcacaaccatacgccggacgatggcatcatcctggtctcggtggcgttgctcctgctggcgctggcgatcctggtggtgcgcttcgcctcggcgcgcttcccttcggcgaagtccgacggcgccgccgcgcggcgggtggcgagcgaggacgccgaaggggaagcctga

SEQ ID NO: 11772 - DNA, 729 bp, Pseudomonas aeruginosa
gcgcgatgtcgcccgcgaccgcgtcgccgaggcgcgggccaatctcgacgaaggcctcaagggcgaccgcgaggagcgccgccaggcgttgcaggccgcggtgcgccgggccgacgcgcagatcgccgagctacaggcgcagatcgacgacctgcaggtgcgcgcgccggtcaacggcgaggtcgggccgatccccgccgaacagggcgaactgatcaacgcctacagtccgctgctgacgctggtgcggctggacgacagctacttcgtcttcaacctgcgcgaggacatcctggccaaggtgcgcaagggcgaccgcatcgtcatgcaggtgcccggcctgggcggcgccgaggtcgagaccgagctgcgctacatcgccccgctgggcgatttctcgaccaggcgcgcgacccgcgccaccggcgatttcgacctgaagaccttcgagacccgcttttacccgttgcagccgacacccggcctgcgcccgggcatgagcgcgctgtggcgctggacgaactgagcgatggcgtgggccgcgctgaagcgcaacgccagccgtttcgtccaggcgttcaacaccgagacgcggatcgcctgccgcagctggaccatccactggctcggctggtgctggccgctgctgctgttcggcgtgatcagcggcgtctaccaggccggtaccctgctggacatgccgctggcggtgatcgacaaggaccatag

SEQ ID NO: 11773 - DNA, 2103 bp, Pseudomonas aeruginosa
ccaactgtcgcgcaagttgatccgcgaactcgacgcgacctcccacgcccaggtgatcaccgttcccgccggcgtccaggaggggctcgacgcgatccgtcgggccgatgcctacgccttgctctacatcccgccggacttcgaggccgacgtgctcggcgggcgcgcgccgaaggccgagctgtactacaacgcgctgctgtattcggccggctacgccgccacccaggacttctcggcgctggtcgccagcctcaacggcgaattgcgtccgcgcctggccgccgggatgccggcggcgctgccgcacctggcgagcatcagcgtgtcctacgacagcctgttcaatgccagcggcaactacatctattaccagcagttcgccgccatcgtgcacctgctacagctgttcgtgatcgtcaccatggtccatgtgctggcccgcgaggcgccggaactgcgcgcctcctcgccgcacatcctgcgggccaaggccctcggcgtacgcctggtgggcaagctggcgccctacacgctgctgttcaccgcgctgctgatgctggaaatcttcctgctggtggcgttctccggcgcgcgcatcaacggcagcccgctggcgatgctgatgatcacgctgttctacgtgatcgccgcgcagagcgtcgggctggtgctgttcgtcttcaccgccaaccgcttcaccgcctattcgctggtgggcatgctgatcggcgtcgcccagacctactcgggagtgctgatcccggaactggcgatgccgaccctggcgcgggtgatcgccgaggccgagccgctgacccacaccctgcacggcctgttcgaccagttcctgcgccaggcgccgcccagttcggcgctctacacctgcgccaagctggcgctgtacccgctgatcgcctacatgatcgccaagatgcgcctgcgcagccgcctggacctgagcccgatatgaagaactacctgcaaatcctccgggaaaccctgaaggccatgctgtccaagccgatgtggctgatggtcgtggcctcggtgtgcatcacctcgctgccgtacatgaaccacaccgccctcgacctgccggtggcggtggtcgacgaggatcacagcgacgtgtcgcgcgagctggtccggctgctcgattcggcgccgaaagtcgccgtggtcggctacgacagcctgccgcaggccaagcgcgacctggcctggcgcgagctgtacgcgatcatcgtgatcccgctgaacttcgagaagcgcctgctgcgcggcgaggcgctggtgatcccgtacttcggcgatgccaccaaccgcatggccaacggccagatccagcaggacatctcggcggtttacagcgcgctgaccaaccgttacaacgccgctctgctggaacgcgaaggcttcaccgcgacccaggcgcaggtggtgctgagcccgctggtagggcaattgaccgacctgttcaaccccggcatcagcttcgccgcgatcgtccttccggggctgctgtcgctgatcctgcaacacagcctgctgctcggctgcacccgcggcaacatcatgctgcgcggcggcaccccgcgctacatgcgccagccgctgtcgacccgcttcggccgctacagcgcgcaactgctgatctggtccgtgctggcgatgctcttttacgtgatctggccgcacctgctgggctatcgccagtcggcctcgttcttcatgctgctggggatcgtcctgccgttcctaatcgcggtgatcgccctcagcgagttcatcgccgagctgctgcccaccgaggaatcggtgtacctgaccatgaccttcatcaccctgccgctgttctacatggccggctacagctggccggaacaggccatgccggactgggtacgctggctggccgacgcgatcccctcgacctgggcgatccgcgccatcgccgagatgaaccagatggacctgccgctgcgcgaagtcagcgaccatgccctggtgctgctgggcatggccgccacctatgcgttgctgggtacgctgctgtaccagtaccgcaactggcgctgggacaacgtcaagggttggtga

SEQ ID NO: 11774 - DNA, 1017 bp, Pseudomonas aeruginosa
tcgacaccctcgcgctgccctatacctcgtaccgccagtaccgcgacggcaacctgtccctggccaactgagtcagggaatcagcggcagcacgatctcgtcgctgcggctgatcccggcggtctcgctgcggcacaggtcgaggaactcgcgcatggtcgcagtctggtacttctgcttgtgccagatgaagtagaactgccggcgcaggtccaggccgggcgtttccaccggcaccaggctgccgcggcggaaagcgtcgcgcagggccaggcgggaaatgcagccgatgcccaggccggactccacggcacgcttgatcgcctcggtgtgctccagctccaggcggatgttcagcggccgcgggtgatgacgcatggcctggtcgaaggtcaggcgggtgccggagccctgctcgcggaggatccaggcctcccgcgtcagccgttccaggtcggcgccgccccgccgcgccagcggatgctggggggcgcagaacaccaccagttcgtcctccatccagggttgcacctcgatgtccggatgccggcagtcgccctcgatcaggcccaggtccagctcgtagtgggcgacctgctgcaccacctgggcggtgttgtgcacgtgcaggcgcacccggcagtccggctggcgctgcatgaaggcgccgatcagcagcgtggccaggtagttgccgatggtcagggtggcgccgaggtcgagggagccgaaggcggtcttgccgttgagcaggttctcgatttcctcgccgcggtcgagcagcgccaccgcctgcggcagcagttggcggccgagggcattgagggtcaggcgcttgccggcgcggtcgaacagcttgcagtcgaactgccgctccagctcgccgagcgaggtgctggtcgccgactgcgacagcgacagcccctcggcggcgcgggagacgctctcctgctgggccacggcgacgaacacctcgagctggcggagggtgaatttcatccaggcttcctcgtctag

SEQ ID NO: 11775 - DNA, 786 bp, Pseudomonas aeruginosa
gagtctttgatgagcaatctgtacaccgagcgcgttctcagcgtgcaccactggaacgacaccctgttcagcttcaagaccacccgcaacccgggtctgcgcttcaagactggccagttcgtgatgatcggcctggaagtcgacggtcgtccgctgatgcgcgcctacagcattgccagcccgaactacgaagagcacctggagttcttcagcatcaaggtcccggacggcccgctgacctcgcgcctgcagcacctgaaggaaggcgacgagctgatggtcagccgcaagccgaccggcaccctggtgcacgacgacctgctgcccggcaagcacctctacctgctcagcaccggcaccggcatggcgcccttcctcagcgtgatccaggacccggaaacctacgagcgctacgagaaggtgatcctggtccacggcgtgcgctgggtcagcgaactggcctacgccgacttcatcaccaaggtcctgccggaacacgagtacttcggcgaccaggtgaaagagaagctgatctactacccgctggtgacccgcgagccgttccgcaaccagggccgccagaccgacctgatgcgcagcggcaagctgttcgaggacatcggcctgccgccgatgaatccgcaggacgaccgtgcgatgatctgcggcagcccgagcatgctggaagagaccagcgccgtgctcgacagcttcggcctgaagatctcgccgcgcatgggcgagccgggcgactacctgatcgagcgcgccttcgtcgagaagtag

SEQ ID NO: 11776 - DNA, 825 bp, Pseudomonas aeruginosa
gccagcagcagggcgatcagcggcatcaggaaggtggccaggctggtcaggctggcgaccgtcgccggcaccgaggtgaagccgacctggccggccgcggcggcgccgaaccaggcgatgcccaccgagagcagggcgaacagcaggctgatcgccagcagccagcgattgcgcaggccgtcggccagttccttgcgggcgatggtccaaactacgggcatggcgtggctccggcgggggcgggggacatgtggtggcgatagaggtcctccagcgacggcggcaggatttccaggtcgaactcgcacgcggccagcagcgcttccagcacgccgtcgcgctcggcatcgtccagcagtacctcgatgcgctggtcgtccagtctccgcgccgccaggccggcccggtgccagcgttcgagccactgcgggttatgcgggctggccaggcgcacgcgggtcggcagagccgccttgcggcgcaattcggcgaggctgccggccacttgcaggcggccgccggcgagaatcgcggcgcggtcgatgtgcgtctcgacgccgggcagcacatgggagcaaaggacgatcccggtgccctggccgcgcaggcggtcgagcaattggtagagctcgacggtggccagcgggtcgaggcccaccgtcggttcgtcgagcagcagcaggcgcggttcgccgagcagcgcctgggccaggccgaggcgctggcgcatgcccttcgagtaggttttcaggcgccgcctggctgcatggccgaggccgacctgttccagcaggcgcgcggcttcggccggcgccacgcccttga

SEQ ID NO: 11777 - DNA, 1338 bp, Pseudomonas aeruginosa
tccatgtcggtgttgtcgaggttgccgtcgacgatcacctgccaggccacttccatggtctcggcgtcgatggcgttgtacagggtgaaggcgttgtcgccggacaggtcgaaggtcgagccgtcgttgggatgggggatgatgaactcggcgttgccagaacacgtagcgggtatgcggcaccttttgcaggcgcaggccgtggatcgcctggacgttgggaatggtgacgatgcggtcgcatttcatgacgtccaggcggatgcgcgcgacccggctgttggccttgtcgttgatgaacaggtacttgccgtcgtacttgccgtcggtcatcgagatgtgcggatggtggcagtcgccgttgaggaagcgcgcgctgtccccgaggacccgcttgctctcgttggtcaggccccagccggtggccgagtcgacgttgaacaccggtatgcgcatcagctcgcgcatcgacggcacgccgagcacgcgtacttcgccggaatgtccgccgctccagaacccgtagtactcatccagttcgccgggggcgacctcggccttgctgcgctcgcccttgcccgcggcccgggcctcgcggccgaccaccgcgctgcccagggcgctggcgccaaccagggcggcggctccggtcagcgccgaggcgccgaggaagccgcggcggttcaggccgtgggtttcttcgtgggggcttttcgtgtcgtcgctcatctcgtgtcgtcctcaagggcagtcaggggaaagggagccaggtcagaggttctccgcgggtatccgcgcgttgtccgccggcgcgctcttcgcgcgcttcttgcgcttgttcaccagcggcgggcacttgtcctggtcgtggtaggtcatctggcagtcgaggcagtagtggcattcgttggcctcgatgcggccgtcgggatggatcgcctggatctcgcattcgcgggcacagagctggcagggcctgccgcattccgcgcggcgcttgagccagtcgaacaggcgcgccttggccgggatcgccagggccgcgcccagcgggcagaggtagcggcaatagaccttgcgggtgaacaggttgaccaccagcagcgcgacggcgtaggcgacgaaccaccactggcggtcgaagccgagggtgatggtggtcttgaacggctccacctccgcggcctgctcggccagcgccagggattccagggagagaccgaagagcaccagcaggatgatgtacttgatcgcccagagccgctcgtgcacggcgaacggcacctggaactgcggcacgcggagcttgcgcgcgagttcgttgagcagttcctgtag

SEQ ID NO: 11778 - DNA, 1560 bp, Pseudomonas aeruginosa
ctggccgaggctgtaccagcccaggtagaccagggtgaacgccaggtagccggtgcgcagtcgctgcatcaggcgcggccgtcgcaccaggcggtcctggaggaagaggatcgccaggagcaggacgagggcggtacagaggaccccgacctggaaactcttctggtaccagacccgcagccacagcggccgggcagcctcttccagggcggccagttcctcggccgttggctgcggccgctccaggtattcctcgggcgtctggcaggccagctcgaagctggtgaatacccccgccaccgggccggtctggcgccgcacgagcaactccagggtccagggcgagcccggatcgaaacgctggctggcgcgggcgacgaagatcgccatctcgcggaactccggcatgccttcggcgtagacgtccgacaggcgctggtagtcgaggtcgcggaagctgatgatgtcgccgaactggcgcagttggacccgatcgaagatgccaccgcgcacgtagccggaacccttgaaggaatactcgccgtcgccgagcacgacgaaggcgtattcgcctggcttcagcgacgccatcagttcgcggtactggttgtcgccgagcaggctgcggcccaccgcgggagggttgagcagggcgctgtagagatcgatgaacggctcgtcgcggtgcgccgcgtcggcttcgccgatgccttcggcctcgctgcccttgaaggcgtcgtcgatctgcccgcgactcaactgcaggcggcggatcgcaccgttgccgagcaattcgctccagctcgccgtcgctgccggttgctggcgcacctgcgccggcttgggccgcacattgccgcggtcctcgatcaggccgagggaaaccgccaccgtatgtgcggcgcgcatgacgatctcgttgaccaccatcaccgtcaccgtggcgccgctcaccgcgtcgacggtaaccgcctgcgggtcgctggagcggccgaccaccacccgctggtcggcgcgcacgccgtcgtacctggcgctgaaggcgtgcagcttctcttccgggatgccgatcagcaggatcggttcgtggtgttcgaggacgtaggcgtcgcggataaccgcctgcggatcgaggatcacctgcaggttgatcggcttgccggagtaggccgggatgtcggtgacgctgagggtctggaaggcgtagccgagggtttcctcgcccttgctcaggcggcgtacgccgtagtcgccttcggggtcgccgatccgctcgaccgcggggaatacctgggcgatgcgcaggcgctccaactcgctgagttcggcaccctgggcggcgaggccgaccagcaggagcatccaggcgaagacacaccgccacgatccggcggaaaaacgaagggcgcgcataggttccatctactactggctaccggcgaaaaaagggacgccgcgctgcggtggggtctgcgcctggcggtggaatcgcttccgttgccggatgctaggaggagcgggggcggaacgcgcttgatgaaagtcaagaagtggagatga

SEQ ID NO: 11779 - DNA, 1038 bp, Pseudomonas aeruginosa
aaacccgccaaaccctgcccaggagttctctccatgttgaaacgcttcagtcgtgtgctcgcggcttccgccctgctcgccggctcccttgccgggatggcgcacgccgaccagccggtgatcaatttcgggatcatctccaccgagtcgtcgcagaacctcaagagcatctgggaacccttcctcaaggacatgagccagcagaccggctaccaggtgaaggccttcttcgcccccgactacgccgggatcatccagggcatgcgtttcgacaaggtcgacatcgcctggtacggcaacaaggccgccatggaagcggtggatcgcgcccacggcgagatcttcgcccagaccgtcgccgccagtggcgcgccgggctactggagcctgctgatcgccaacaaggacagcaagatcgacagcctcgaggacatgttggcgaacgccaagagcctgaccttcggcaacggcgatccgaactccacgtccggctacctggtgcccggctactacgtgttcgccaagaacaacgtcgacccggtcaaggctttcaagcgcaccctcaactccagccatgaggtcaacgccctggcggtggccaacaagcaggtcgacgtcgccaccttcaataccgagggcatggagcgcctggaattgacccagccggagaaggccaggcagctcaaggtgatctggaagtcgccgctgatcccgggcgacccgctggtgtggcgcaacaacctgagcgacgagcagaagaacaagctgcgcgacttcttcttcaagtacggcgccaacgccgagcagaagaaggtcctcgccgacctgcaatggtcgaagttccagccctccgacgacgaccagttgctgccgatccgccagctcgagctgttcaagcagcgcaccgacgtggcgaacaacgccaacctcggcgccgaggagaaggccgccaagctgaaggccctcgacgaggagctggccaagctggagaaacgcatggccgagcgcgagcagaaaaccgccgccaacgccggctga

SEQ ID NO: 11780 - DNA, 1605 bp, Pseudomonas aeruginosa
tccaccccgggcgcggccggcgccgcgccccacccgattcgccaataccgctgtcgagattcccgatatgagcactctgagcaccactgccgcggcggccgccaccggcaagccatcctggggacgcctggtcggctggggcctgttcctcgccatcctcgcctggtcctggaagggcgcggaaatgaacccggccgtgctgttccgcgacgccggcaacatggcgaccttcgccgccgacttcttcccgccggacttcggcaactggaagctctacctcagcgagatgctggtcaccgtgcagatcgccctctggggcacggtgctggcgatcgtctgcgccatcccgctgtcgatcctggcttccgagaacatcgtgccctggtgggtctaccagccggtgcggcgggtgatggatgcctgccgttcgatcaacgagatggtcttcgccatgctcttcgtggtcgccgtcggcctgggcccgttcgccggcgtgctggcgctgttcatcagtaccaccggggtgctcgccaagctcttcgccgaggcggtcgaggcgatcgaccccggtccggtcgaaggcgtccgcgccaccggtgccagcgccctgcaggaggtcatcttcggggtcatcccgcaggtcctgccgctgtggatctcctattcgctgtaccgcttcgagtccaacgtgcgttccgccacagtggtcgggatggtcggcgccggcggcatcggcgtgatcctctgggaggccatccgcggcttccagttcggccagacctgcgccgtgctgatcgtgatcatcgtggtggtgagcctgatcgacgttctgtcacaacgcctgcgcaagctgttcatctgacgacgcgaggagggcgcctggtgcgccctttccaaaccatgcacttgtctagacaaagcgaaccgctgtaccgcgaactggccgaacggctgcgccaggaactgctggcctaccgccccggcgactacctgcccggcgagatccagctggcccagcgcttcgcggtgaaccgccataccctgcgcagggcgctcgacgaactggtgctcgaaggccgcgtgctgcggcgccagggcaagggcacccaggtcctggaggcgccgacgatctacccgatgggcgccgccaacgcctacaccgagtcgctctcggcccagggccaccgggtcgaggcccggctgctggaggcgcgccagcgcccggccggcgccgccgatgccacccacctggggatcggcgagggcgggcgggtgctggaactgaccaccctgcgttacctcgacggccagccagtgagcctgatccgccattgcttcgccgtttcccgcagcgagctgctcgccgactaccagggcggttcgctgcgtcgctacctggccgacaaaggcctgccgctgacccgcacctacagcctgatcggtgcgcgcctgcccaaccgcgaggaggcggcgcgcctgctgatgccccgccatgcgccgttgctcaccgtcctcaccctgtcccgcgaccgtaccggccaaccggtggaactggcccagtcgatcagccgcgccgatcgcttccagtaccaggtcgccccctag

SEQ ID NO: 11781 - DNA, 468 bp, Pseudomonas aeruginosa
gagaagcccatgaccgccttgcattccgatcccaccatcgccgcacgacagcgctggatgggcgtgctcgcccgcgcccgtcgcgaggagctggacgcccatgcggacgccctgcgcgatgccgactatcacctgctgcgcgccgccgagaccggcatgaccctggtgcgcggacgcatgggcggcaccggcagcccgttcaacctcggcgagatgaccgtgacccgctgcgtggtgcggctcggtgacggacgcaccggctacagctatgtcgccgggcgcgacaagcgccacgccgaactggccgccctggccgacgcgcacctgcagggcgccgacgcggcggcctggcaggcgcgcctgatcgaaccgctggcccgcacccatgccgagcgccgcgccgcccaggatgcggaaatcgccactaccaaggtggagttcttcaccctggtccgaggagaagattga

SEQ ID NO: 11782 - DNA, 2118 bp, Pseudomonas aeruginosa
gcgccgggttctgggcacagcgcgccgcacgcaccgaattccccaggggcctggatgccttcttcgccgccggcgagcgcatcctcggcctgccacgcagtacccgggtcagcgaacccgtcgaggaggtggcctgatgtacgtagccgtcaagggtggcgagaaggccatcgacaacgcccatcgcctgctggcgcgcaagcgccgcggcgataccgcgctgccggagctgtcggtggagcagatccgccagcagatgccgctggccgtgtcgcgggtgatgaccgagggttcgctgtacgacgagcaactggcggcactggcgatcaagcaggcggccggcgacctgatggaagcgatcttcctcctccgcgcctaccgcaccacgctgccgcgcttcgccgccagcctgccgctggataccgccgggatgcgcctgcaacggcggatctcggcgacctacaaggacctgccgggcgggcaactgctcggtccgaccttcgactatacccatcgcctgctcgacttcagcctgctcgccgagggcgactaccccggccccgaagtggagcggggcgcgtccctggagccttgtccgcgcgtgctcggcctgctcgaccgggaaggcctgatgacgccggagtacgaactgcccggcgcggtgccggatatcacccgcgagccgctcgacttccccaccggccgcgcccagcgcctgcaggccctggcccgcggcgacgagggcttccttctcgccctgggctattcgacccagcgcggctacggccgcaaccatccgttcgccggggagatccgcatcggcgcctgcgaggtctggctggagcccgaggaactcggcttcgcggtgccggtgggcgagatcgaggtcaccgagtgcgagatggtcaaccagttcgtcggttcccgcgaggagctgccgcaattcacccgtggctacggcctggccttcggctacgccgaacgcaaggcgatgggcatggccctggtcgaccgcgccctgcgcgccgaggaatacggcgaggaggtggtgtcgccggcgcagcaggaagagttcgtcctgatgcactgcgacaacgtcgaggccggtggcttcgtctcgcacctgaagctgccgcactacgtcgatttccagtccgagctggagctgattcgcaagctgcgtcgtcccggcgtcgccgaatccgcgcaacccactgtccaggagaagcgcgcatgagcctttccccgcaagccagcgccgcgccggagcagggctacaacttcgcctacctcgacgagcagaccaagcgcatgatccgccgcggcctgctcaaggcggtggcgatccccggctaccaggtgcccttcggcggccgcgagatgccgctgccctacggctggggcaccggcggcatgcaggtgaccgcggccatcctcggtgccgacgacgtgctcaaggtgatcgaccagggcgccgacgacaccaccaacgcggtatccatccggcgtttcttcgcccgcaccgccggggtcgccaccaccgaacggaccccggaggcgacggtgatccagacccgccaccggataccggaaaccgccctgagcggcgagcagatcatggtctaccaggtgccgatccccgagccgctgcgcttcatcgagccttccgaggcggagacccggaccatgcatgcgctcaacgactatggggtgatgcacgtgaagctctacgaggacatcgccaccttcggccacatcgccaccagctatgcctacccggtgacggtggacgagcgctacgtgatggatccctcgccgattcccaagttcgacaaccccaagctggacatgaacccggcgctgatgctgttcggcgccggtcgcgagaagcgcctgtacgcggtgccgccgttcacccgggtggcgagcctggacttcgaggaccaccccttcgaagtccagcgctgggaagaaagctgcgccttctgcggcagccacgagtcctacctggacgaactgatcgtcgacgaccgtggcggcaagcgcttcgtctgttccgacaccgattactgcacgcagcggcgtgcctgccaggaagaaggggaggacgcgcaatga

SEQ ID NO: 11783 - DNA, 876 bp, Pseudomonas aeruginosa
tggtcatgcgccgttcgcgggtggtggaagccggtctcaccgaccagattctcgacgacccgcagcatccgtacacgcaattgctggtgtcgtcggtcctgcaaccctgagccgaagcgtcggcgccggtccgcgcgacgggcgcccggagaagtagcgatgaacaacctgatcgaggtccgcgacctcagcaagaccttcaccctgcaccagcaacagggcgtagtgctcaatgtgctgcgcgggctcaacttcaatgtcgccggcggcgaatgcctggtgctccacggacgctccggcgccggcaagagcaccctgctgcgcacgctctacggcaactacctgccggccggcggcagcatccgcctgcgccacgccggcgactggttggaactggtcggcgccgagcctcgcgaggtgctcgccgtgcgtcgccagaccctcggctacgtcagccagttcctgcgggtgatcccgcgggtggcgaccctcgacgtggtcatggagccggccctggcccgtggctggagccgcgacagcgccgaactgcgggcgcgcagcctgctggcccggctgaacatcccggaacgcctctggcaactggcgccgggtaccttttccggcggcgagcagcaacgcgtcaacattgcccgcggcttcatggtcgagtggccgatcctgctgctcgacgagccgaccgcgtccctcgacgaagccaaccgccaggtagtgctggagctgatcggcgaagccaaggccgctggcgccgcgttgatcggcatcttccacgaccgcgccgcccgcgaggcggtggccagccgctacctggacatgagccaggagctttcccgccaggagcaagcccatgtcgtctga

SEQ ID NO: 11784 - DNA, 690 bp, Pseudomonas aeruginosa
acgcgttctcagcaatgcccgggtagtcagcgccgagcgggtcttcgtcggcagcgtgctgctgcgcgacggcctgatcgccgcggtcgacgaaggccgcagccacctggccggggccgaggacctggggggcgactacctgctgcccggtctggtcgagctgcacaccgacaacctggagaagcacatgaccccgcgtcccggcgtcgactggccatcggcctcggcggtgctggcgcacgacgcgcagatcgtcgccgcgggaatcaccacggtgttcgacgcgctgtccatcggcgacgtcaaccccaagggcaagcgcatgcagcagttgccgaagatgctcgaggccatcggcgaggccgccgccagcggcgacgcgcgcgccgaccatcgcctgcacctgcgttgcgaggtcagccatccgcagacgctggaggtgttccgcgaactggtcgagcatccgctggtgcaactggtctcggtgatggaccacgcccccggccagcgccagttcgccaggctggagaagtaccgcgagtactaccagggcaagtaccacctgagcgatgccgagatggacgccttcatcgtcgagcaggtagccaactccgagcgctacagcgacgccgcccgtgcggccatcgtcgatgtctgccagggacgcggcctgtcggtggccagccatga

SEQ ID NO: 11785 - DNA, 744 bp, Pseudomonas aeruginosa
tgcgatccgctacgacctgccgcgcgcggtggcgatggtcagccgtaccccggcgctggccgccgggctgaccgatcgtggcgaaatccgcgtcggcctgcgcgccgatctgctgcatgcgcgggcgctcggcaacaaccagccggtggtgcgtcaggtctggcgcggcgggcagagagtgttctgatgacaggcagactgatttatctgatggggccttccggctcgggcaaggacagcctgttgcaggccgcgcgcgagcccctggcgctgcgcggctgccgtatcgtgcggcgggtgatcacgcgctccgcggaagcggtgggggaggacgcccaggcggtgactccggcgcagttcgacaccctcgagcgggcctcggcgttcgccatgagctggcgcgccaacggcctttgctatggcattccggtgcagatcgacgagtggctggcgcagggctacgacgtgctggtgaacggctcgcgcggctacctggcgcaggcccgccggcgctatccggatctgctcgcggtcctgctcggggtgaaacccgaggtgctgcgccagcgcctgctggcgcgcggccgggaaagccccgaggaaatcgaggcgcgcctggcgcgtaacgccgagttcgccgccggcctggagggcccgctgttccaactggacaactccggtgatctcgacgacacgctacgcaccctcctggcccgtctcggcagcgaccgcgcatgcgcctga

SEQ ID NO: 11786 - DNA, 453 bp, Pseudomonas aeruginosa
ccacctaccagtacaacgcccgtggcctggagacctcgcgcaccgaggccgccggcactgcgcaggcgcgcaccatcacaaccgattggcacccgaccctgttcctcccggtgcaggtcagcgagcccggccggatcacccgctaccagtacgacgccgagggacgcaagaccggcgagaccgtcaccacccgctgacaaggacgacacccatgcgcatccccccatacttcccccgtctcggcgccctcgccctggcttgcgccctggccctgcccgcgcaggcggccgagcgcgcctggagctacagctacaacgccctcggcctgatcgagcgcgccgacggtccgcgcaccgatgtgcaggacgtcaccctctatgcctacgacagtcgcggcaacctgacccaggtgaccaacgccctcggccaggtcacccgcctcggcgactatga

SEQ ID NO: 11787 - DNA, 1857 bp, Pseudomonas aeruginosa
cgcagtcggccagatcacccgcgtcacccgtggcgacggcagttggctgagctacgaatacgacgacgcacggcgcctggtggcgatcggcaacaacctcggcgaacgcctcgaatacgacgtcgacaccaagggcaatcgcaccgcccagcgcatcaaggacgccagcggcagcctggtgcgccagcagcaatgggcctacgacgagcttggccggctgctccgtgcggtcggcgccggcggccagacacgcagcttcgcctacgacctcaacgacaatccggtcggcgaaaccaacccgcgccagttcgcccacagccaggccttcgacgccctcgaccggctggtcggccagagcgatcccctcggcggcaagacccgactcgcctacgacgcccaggacaacctcaccgaggtcaaggacccgcgcggcgtcaccacccgctacgaatacgacggcctcggcaacctgacccgactggtcagcccggacagcggcaccaccaccttcgagcacgacgccgccggcaacgtcatccgccgcaccgacgctcgcggtgcggtcaccgagtatcgctacgacgccctcaatcggctggtcgagcgccgctcgccgagcgacccgagcctcgacgtacagtaccgctacgacctcaccgccgacggcaaccagggcatcggccgcctgggcgccatcgaaggtgcccgcgacagcctggtgtaccgctacgacgagcgcggcaacctggtcgagcaggtacgcagcatccgcctcgaccagcagaccctgctcgaccgcgtgacctaccgctacgacgcggccaaccaactgctggagatcggctacccctccggcctcgccatcggctacccgcgcaacgccggcggccaggtcgccagcgtgaccctggcagtgggcgacaaggcgccgagcaccctggttgggcagatcgcctacctgcccttcggcccgctgcagcgcctgacctggggcaacggcatcactctcagccgcgagtacgaccaggactaccaactgctgcggcagaaggtcggcccctggcagagcgactaccagcacgatgccaatggcaatatccagcagcaccgccacagcctctggggcaccctggactaccagtacgacccgctggaccgcctgaccgaggaacgcggcgtccagggcgggcgcagctacgcctacgacgcggtcggcaaccgcacccaacgcagcgacaaccccgcctcaggcggcaccgccagcagccaggactaccagtacgcgcccgacagcaaccgattgaccgccatcggcgcgcaagcggtgaccagcgacgccgccggcaacctcacccaggaccgcgccgcgcgcaaactggcctacgacgcccagggccgcctgcaaagcgtcagcctcgacggccagcaggtcgccgaataccgctacaacgccctcggccagcgcatcgtcaagctcacccccgagagcatcaccacctacctctacggtcccgacggccagttgctcggcgaagccgaacacgacggcagcggccggaaactgcgagcccagtactacctgtggctggacagcctgccgctggccaccatcgacgccgactacgacgcccagggcaaggtcggcaacccgaccctgctctacctccatggcgaccacctcgacaccccgcgcctggctaccgacgccagcggccagatcgcctggcagtggcagtccgacgccttcggccgcggcgaagcgctgagccagggcagcacccaggtcaacctgcgcttccccgggcagtactacgatgcggagagcgggctgcactacaactacttccgcgactatga

SEQ ID NO: 11788 - DNA, 225 bp, Pseudomonas aeruginosa
tggctgcatgctatctcaggcgcgcgccgtgcgctttcgcgagcgcgccgattacatggtcttacccgagccttgacaggtcttttcaacggggcttataagtggcgccatcaggtcatgcgcatcagcgtcgatgtcgcggggccgaacctaacgcatacgtacagagcaaatgggctctcccggggttacccgggagggccttttttcgtcccgaaaaaataa

SEQ ID NO: 11789 - DNA, 1059 bp, Pseudomonas aeruginosa
caacaagaggtgatatccatgcgtcacggcgatatttccagcagcaacgacaccgtcggagtggcggtggtcaactacaagatgccgcgcctgcacaccgcggcggaggtcctggacaacgcccggaagatcgccgacatgatcgtcggcatgaagcagggcctacccggcatggacctggtggtgttccccgagtacagcctgcagggcatcatgtacgatccggcggagatgatggaaaccgcggtggcgatccccggcgaggaaaccgagatattctcccgcgcctgccgcaaggccaatgtctggggcgtattctccctcaccggcgaacggcacgaggagcatccgcgcaaggcgccgtacaacaccctggtgctgatcgacaacaacggcgagatcgtccagaagtaccgcaagatcattccctggtgccccatcgagggctggtatcccggtggccagacctacgtcagcgaagggccgaagggcatgaagatcagcctgatcatctgcgacgacggcaactacccggaaatctggcgcgactgcgcgatgaagggcgccgagctgatcgtgcgctgccagggctacatgtatccggccaaggaccagcaggtgatgatggccaaggccatggcctgggccaacaactgctatgtggcggtggccaacgccgccggcttcgacggcgtgtattcctacttcggccactcggcgatcatcggcttcgacggtcgtaccctcggtgagtgcggcgaggaggaaatgggtatccagtacgcccagctgtcgctttcgcagatccgcgatgcgcgcgccaacgatcagtcgcagaaccacctgttcaagatcctccaccgcggctacagcggcttgcaggcgtccggcgatggcgaccggggcctggcggagtgtccgttcgagttctaccgcacctgggtcaccgacgccgagaaggcgcgcgagaatgtcgagcgactgacccgctcgactaccggtgtggcgcaatgtccggtcggccggctgccctacgagggactggagaaggaggcctga

SEQ ID NO: 11790 - DNA, 729 bp, Pseudomonas aeruginosa
cggcaccggcgtgccgtcgtgcggcacgccgtctccgccatttccccctgtggcagaaggagtttcatccatgccttttctgagcgacatgctcgaccagtcccgccggcagcaggacgaggaacaggccctggcgcgggagaatcttgccgaggcaagtctgctccaggcccacctgagtcaccgcagcgccctgcacagccgtttccgtttcgacccggcggcggtgatggactgcctgcgcgccgaggtgctcggccaggaaccggcgctacaggccgtcgaggacatgctcaaggtggttcgcgcggacatcgccgacccgcgccgtccgctgttcagcgcgctgttcctcggccccaccggggtcggcaagaccgagatcgtgcgcgccctggccagggccctgcacggcgacgccgaggggttctgccgggtggacatgaacaccctgtcccaggagcactatgccgccgccctcaccggtgcgccgccgggctacgtcggggcgaaggagggcaccaccctgttggagcaggacaagctggacggcagtcccgggcgccccggcatcgttctcttcgacgaactggaaaaggccagcccggaagtggtccatgcgttgctcaacgtactcgacaacggcctgctgcgggtcgcttccggcgaacgcacctaccatttccgcaataccctggtgttcatgaccagcaatctctgcgcccatga

SEQ ID NO: 11791 - DNA, 633 bp, Pseudomonas aeruginosa
cctcgacgactggtccgccagcatgggcgggggagcgctcccatgagcgccaactcgctgctcggcagcctgcgcgagttgcaggtgctggtactcaacccgccgggagaggtcagcgacgccctggtcttgcaactgatccgcatcggttgttcggtgcgccagtgctggccgccgccggaagctttcgacgtgccggtggacgtggtcttcaccagcattttccagaatcgccaccacgacgagatcgctgcgctgctcgccgccggaactccgcgcactaccctggtggcgctggtggagtacgaaagccccgcggtgctctcgcagatcatcgagctggagtgccacggcgtgatcacccagccgctcgacgcccaccgggtgctgcctgtgctggtatcggcgcggcgcatcagcgaggaaatggcgaagctgaagcagaagaccgagcagcttcaggaacgcatcgccggccaggcccggatcaaccaggccaaggcgttgctgatgcagcgccatggctgggacgagcgcgaggcgcaccagtacctgtcgcgggaagcgatgaagcggcgcgagccgatcctgaagatcgctcaggagttgctgggaaacgagccgtccgcctga

SEQ ID NO: 11792 - DNA, 618 bp, Pseudomonas aeruginosa
gcgatccgggccgaccagaacaataacaagaggggtatcgtcatgatgctgggactggttctgctgtacgttggcgcggtgctgtttctcaatgccgtctggttgatgggcaagatcagcggtcgggaggtggcggtgatcaacttcctggtcggcgtgctgagcgcctgcgtcgcgttctacctgatcttttccgcagcagccgggcagggctcgctgaaggccggagcgctaaccctgctattcgcttttacctatctgtgggtggccgccaaccagttcctcgaggtggacggcaagggcctcggctggttctgcctgttcgtcagcctcaccgcctgcaccgtggcgatcgagtcgttcgccggcgccagtggtccgttcggcctgtggaacgcggtcaactggacagtctgggcgttgctctggttctgtttcttcctgctgctggggctgtcccgcagcatccagaagccggtggcctacctgaccctggccagcgccatattcaccgcctggttgcccggcctgctgctgctcgggcaggtgctcaaggcattgcaggaagtcggaaagggatggcggcttgccgccatcccgtcccttccgaactcctag

SEQ ID NO: 11793 - DNA, 381 bp, Pseudomonas aeruginosa
cccggccggtggtgcgcgtcgcgccgcgtgtcagcggtcaggtcgccgaggtgctggtgtccaacaacggccacgtgcagcccggcgaagtattgttccgcctcgatcccgagcctttccgactggccgtgcgccaggccgaactggcactggaggaagccgagcgcaccaaccgcgagctggatgccgccatcgcctcggccaaggccgacctcctggccgcgcgcagcagcgccggcgagctggacagcgaggcgcgccgcaccgcccaactggtgcagcgccaccatgtgtcgcagcagatgcacgagcaggtcagcgcccaggcccaggccgcccgtgcccgggtcgccgcggcccaggcgcggatcggcgagctga

SEQ ID NO: 11794 - DNA, 987 bp, Pseudomonas aeruginosa
gccatctgctcggtcgcgcgcagatcgtcgccatcagcctgctgcactacgtctactgacgccatgccggccaagctcgcgatgtccgccaacgacctgcgtcagtgcctgcgcatcgccggcggcggcaccctggggttcttcgtctgcaagctgatgaactgggactacggctcgttcttcggcgtctacccgatgctgctgctcggcctgacgccggtgatcaacctgcacatcgtccgccagttcctcgccaactcggtggtgatcagcgtcgaggtactggtgctgtacgggttgttcggcgaccggccgttgctgatgacgcctatcgtcttcggcctcttcgtctaccgcttcgccctgatggcgcgcggcccgctgttcttcttcggcgcactgagttcggtgttcctctcgatgctgctgcactttgccagctatccggacgtcgatctgttcgacatgctcgccagcaacatggtcgccacctggctgacggtggccatcgccgtgctgatgttctacctgttccccgacgtcgaaccgcggccgccgcgccaggcgccggccaaggacgcccccagccggcgccacgagacgctgctcggggccacggtggcgaccttgtccttcgtggtcttccagaccttcgacctgaaggactcgctgtcggcgcagatcgcctcgatcctggtgttgtttcccatgcactggaagggcgtgcacttcgccgggcgcatccgcgccctcggtacgctgctcggctgtgcgctggcggtgggcttgcaggtgctgctctacgatcactacgacatcctgcccttcgtcgccctgttgctgtggatctcggcgatgttctgcgcgcgcatccacatgctggagaacggcgtaccggggatcggtttcggcgcgctgaccaccctggcgatcgtcctcggcccagaccgtgtaaaaacgcagcaagcgatggcgatcaactgctga

SEQ ID NO: 11795 - DNA, 492 bp, Pseudomonas aeruginosa
cgtcgccgcgctcgaaacgcgacgtatcgatcgagcgtccgcccggccccagggccagcatctgcgcgtcgaagacgatccgccgcgacggtgcgtccaacccgccggccggtgacgcaacggccaccgcgggcgcctgcggctgtttcgccggtgctcccgtcctggcctccttcgccccggctacgccggcggcgccgacggaggaccaggactggcaggaggacagcgaaggaaacagtgccagcagacaggcgaatcgcagggaacgaacggcgatccctccctgcatcgccattcgcaacagggcgacctgcccaccgtaagcgggagcggacaagcacctatgaagagaaactttgggcatatgtaatccctgcagcgattttaaaatcgccactcatatgtcgggccgtaagtaaaaagcggggaaacggaggggttatttgccgagtgccctatcgtgggtattgcggccaccgtaatcgttga

SEQ ID NO: 11796 - DNA, 903 bp, Pseudomonas aeruginosa
gacttcatcttcgataactttcccttcgccgctccgtactatttccgtggcatatcgacctatcaaccatccggtcgatatcgggatactcgaagacaggccagcatgggtttcccacgacgaggagaaccctatgtccgcccactcgcattccggatggatcaccgtcggcgccctggccgacggcttcgccccggacaaccacgtccttcccgcctgcggcgatctcgccgggctcgaacgggtcctgcacttcgccaacggctgggtcatcgaacatgccttcgactcgcagcgcctgcgctggcgcctggccgacggcagtgccagcggcgagtcggactaccgcgccagttcactgcgggaaaacctttacctggtggatttcctcaagcaggaaaacggccggccggtctcggtcagcctggtgctggacttcgacaaccaggcgttcaccgcggtgctcggccatctgcccgaccgcacggcctgcgaacagggtctgttctcccgggccctggccggccgggaactgaccggcgtgaaggccgagttcctgcatggcagcctcgaccgcccgtggcagcccgacgcctgcccgcacgtccccagcgacgagttggtcggcttgcgcaaccgctacgtctacagcgccagcgaggcctacgaacacgtctacctcaatcccgacttctacgcctggcaatgcctgcgcggcgccgagcgagggctggccgataccgaccgctgccactgctaccgactggccgaacgcctgtacctgttcgtctggcgcgagaagatcgtgccgaccctcggcgtgctgctgatcgacctggaagccgggcgcaccgacggcaagatcttcggctaccaggacgacgacttcgccaccccggttaa

SEQ ID NO: 11797 - DNA, 1449 bp, Pseudomonas aeruginosa
cttcccggtcggcgccctggcccaggtgctcaaccagacccgccacgatctgtgaggacgcccatggacaccaccttcggcctcgacctggcccgcgtcgaagcgctgttcaagcgcgagctgcgacgcttcgacgaactgcatccgcgctccgcccaggcctaccgggaaaaccgccgccactggctatacggcgcaccgttgcactggatgcaacagtggccgggcaactgcccgctgctggtgaaggaggcccagggcgcgcgcgtcaccgacatcgacggccagcagtacgtcgacttcgccctcggcgatagcggcgccatgttcggccacgcccaaccggcggtggccgacgccatcgcccgccaggcgcggcgcggctcgaccctgatgctgccgaccgaggacagcctgtgggtcggcgccgaactggcgcggcgcttcggcctgccctattggcaggtgaccacctcggccaccgacgccaaccgtttcgtcctgcgcctgtgccggatgctcagcggacgtgacaaggtggtggtgttcaactgcaactaccacggcagcgtcgacgaatcgcaggtggaattcgacgccgccgggcgcatggttccgcgcgcgggcgttcaccccaatggcgtacgccacgacgccaccacccgcctggtggagttcaacgacctcgacgcgctggaggccgccctcgcccatggcgacgtcgccgcggtgctcaccgaacccttcatgaccaacgtcggcatggtcccgccggccgaaggcttccacgccggcctgcgcgaactgacccgccgccacgacgtggcgctgatcatcgacgagacccacaccatctcctgcggtcccgccggctatagcggcgcgcatggcctcgagccggacttcttcgtcctcggcaaatgcatcgccggcggcattcccagcgccgtctggggatgcagccaggcgcaggcggagcggatctgggcggtactgccgcacttccgaccggggcaggcgatcaaccatttcggctttggcggcaccctggccggcaacgcgctgcaactggcggcgatgcgcgcgaccttcgccgaagtgatgacggaggacgcctatcggcacatgttccagctcgccgcgcagctcgaggcgggcgtccgcgcgacgctcgaggaactgcgcctgccctggcacgtgacgcgcatcggcgcgcgcgtcgagtacctgttcatgacccacgccccgcgcaacggcggcgaggcccaccacgcacgcaacggcctgatcgaggcctgcctgcacctctacctgctcaaccgcggcgtgctcttgacgccattccacaacatggcgctgacctgcccggcgacccgcgcagaggacgtcgaactgcacgaccgcctgctccgcgattgcctgggcgaactgctggagcgcccatcgtga

SEQ ID NO: 11798 - DNA, 324 bp, Pseudomonas aeruginosa
tatcggaaatccccaaccgagaggattcgcttcatgttccgctccacctcccatgtccgtaccgaatcggcggcacgctacgtcaatcgcctgtgcaagcactggggccacaagttcgaagtcgaactcactcccgagcgcggcttcatcgacttcggcgactccaactgcgagctgctcgcccaccccgaccatgtcctgatgattctcaacagccccgacgaggacagcctcgcccacatgcagaacgtggtcgccgatcacctgcaacgcatggccaacagcgaaagcctggagattgcctggcagcccgccgaaagctga

SEQ ID NO: 11799 - DNA, 1575 bp, Pseudomonas aeruginosa
ctggagacgatgatgaaacccgaagatttccgtgcctctgccacccgtccgttcaccggcgaggagtacctcgccagcctgcgcgacgaccgtgagatctacatgtacggcgaccgcgtcaaggacgtcaccagccaccccgccttccgcaacgcggccgcctccatggcccggctctacgacgccctgcacgatccgcagagcaaggaaaagctctgctgggagaccgataccggcaacggcggctatacccacaagttcttccgctacgcgcgcagcgccgacgaactgcgccagcagcgcgacgccatcgccgagtggtcgcggctgacctacggctggatgggccgcaccccggaatacaaggccgccttcggcagcgccctcggcgccaacccgggcttctacgggcgtttcgaggacaacgcgaaaacctggtacaagcgcatccaggaagcctgcctgtacctcaaccatgccatcgtcaacccgccgatcgaccgcgacaagccggtggaccaggtcaaggacgtgttcatctcggtggacgaggaagtcgacggcggcatcgtcgtcagcggcgccaaggtggttgccacgaattccgcgctgacccactacaacttcgtcggccagggttcggcgcaactgctcggcgacaacaccgacttcgccctgatgttcatcgcgccgatgaacacccccggcatgaagctgatctgccgcccctcctacgaactggtggcgggtatcgccggatcgccgttcgactacccgctgtccagccgtttcgacgagaacgacgcgatcctggtgatggacaaggtgttcatcccctgggagaacgtactgatctaccgcgacttcgagcgctgcaagcagtggttcccccagggtggcttcggccggctgttcccgatgcagggctgcacccgcctggcggtcaagctcgacttcatcaccggcgccctctacaaggccctgcaatgcaccggctccctggagttccgcggcgtgcaggcgcaggtcggcgaagtggtggcctggcgcaacctgttctggtcgctgaccgacgccatgtacggcaacgccagcgaatggcacagcggcgccttcctacccagcgccgaggccctgcaggcctaccgcgtgctggcgccgcaggcctacccggagatcaagaagaccatcgagcaggtggtcgccagcggcctgatctacctgccctccggcgttcgcgacctgcacaatccgcaactcgacaagtacctctccacctattgccgcggctccggcggcatgggccaccgggagcggatcaagatcctcaagctgctctgggacgccatcggcagcgagttcggcggccgccacgagctgtacgagatcaactacgccggcagccaggacgagatccgcatgcaggccctgcgccaggcggtcggcagcggggcgatgaagggcatgctcggcatggtcgagcagtgcatgggcgactacgacgagaacggctggaccgtgccgcacctgcacaacccggacgacatcaacgtgctcgaccgcatccgccaatga

SEQ ID NO: 11800 - DNA, 1188 bp, Pseudomonas aeruginosa
tctgcgtatcacgctgccgcggcaactacctggaactcgatctctgaccccgaagaacaaccacggagacgcctcatgagcctgcccaacgccaatctcatcgccagttcacgcaaggccgccgcgcagatggccacgcgcgacacgtcgttcatcttcaacgagtggtacgtcgccgccttcgccgaggaggtcggccgcgaactgctcgcgcgcactctgctcggcaagcgcgtggtgctctatcgcaccctcgccggccaggcggtagccctggaagaccgctgcgcgcatcgctccttcccgctatcgcgcagtcgcctggagggggacgggatcgtctgcggctatcacggtttccgctacgacagccagggcgagttgatcgagacaccgtcgcagaaagcctgtccgcgcggcgtcggcatccgtcactacccgcttctggagcgcggcccgctggtctggatttggctcggcgacccgcgactggccgacccgaagcgactgccgcagcggccctggctggaggatccgggctgggcctgctccaagggctacttcctacacccgggcaactacgtgagcatgcacgagaacctgatggacctgacccatctcacctacctccacgccaataccatcggcaccccggattacgccggggcgccctatgagctggacctgaaggaaggccactaccggctggtacggcacgtgctgccgaccaccctgtcgccggtctggggccgcaccaccggcctcgacggctgtcccacggcggcgcgcatcaccacctcggagtttctctcgccaggcctgcaccaggtcagcgcgaccttctacgacacagccctgcccgccgagcgacgaccggaattccacatccgcacggcgcacatcctcaccccggagacccacggcagcatgcactacttcatcgtccacggacgcgatttcgcccaggacgacgagaccgtcggcgctttcatgcacgagcaactgttcgccgccttcgtcgaggacgtggaaggcctcggcgcgctggaaaaggtactcgcggaggccgatgaggatagctacgagatctccgtcgccagcgacgcgccggcggtggccacccgcacctacctcaagcgccgcgccgatgaggaagcgcgccagcgcgcggcgcaccgggtggcctga

SEQ ID NO: 11801 - DNA, 417 bp, Pseudomonas aeruginosa
tggcaacgagcgccggcctggtcaaccgccactaccacccgcacgaggtgttcgcctacaccatcagcggcaagtggggctacctggagcacgactggaccgccaccgccggcgacttcgtctacgagacgcccggcgagggccacaccctggtggcctacgagcacgagcagccgatgcgtgcattcttcatcgtcaagggaccgctggtctggctcgacgagaagggcaacgcggacggcatcttcgacgtccacgactacatcgcgatgtgccgtgagcactacgacaagatcggcgtcggcgccgcctacatcgactccctgttccgctgaccccgggcgcgcgccgccctggcggacgcgcgcctcccccgccggccggcccgcccggcctggagaccgacatggcgcataa

SEQ ID NO: 11802 - DNA, 2304 bp, Pseudomonas aeruginosa
caacaattccgccagttacgaaaacgtcctgctctgcgtgctgttcctgaccttcggcttcgtcttcttcgaccgcctggcgctgtccttcctgtttcccttcatggaacaggagctgcaactgagcaacagccacctgggcatgctctcctcggtgctggccctggcctgggcggtatccggcgcgctggtcggcgcctggtccgaccgccgcgggcagcgcaagccgctgctgatcgtggcggtgatcctgttctcgctgtgctcggcgctgtccgggctggtcggcggcttcctcagcctgctgctgttccgcggcatcatgggcctggccgaggggccgatcctgccgctctcgcaatcgctgatggtcgaggcctcctcgccacatcgccgcggcctcaacatgggtctgctacagggctcggcggccggcctgctcggcgcggtgatcggcccgccgctgctggtggccctggccgaagccctcggctggcgtcacgccttcatcgtctcgttgctgccgggtctgctgatcgcctggttgatctggcgccatgtgcgtcccgacccgccccgcgcgcagcgcccggcgccgcgcgcagaagaagcgaaaggcaagcgcctggcactgctgaagagccgcaacatcctgctctgcaccctgatcagttgcgtattcgtcacctggttcatcgtgctgatttcctttaccccgaccttcctggtcaacgcccgcggcttcagcccggcgaccatgggcaggctgatgagctgcctgggcgtcgcctgggtggtctggggcttcgccgtaccggcgatatccgatcgcatcggccgtcgaccgaccctggtggcgttctccctgctcgccgcgtgttgcccgctggcgctgctctatgcgccgaacgcgaccagcctcggcctgctgttgctgctgacctacaccgggctcggctgcttcaccctgttcatggcgaccatcccggcggagaccgtctcgcgcggcgtcatcgccaccgccctcggcctgatcatgggcctcggcgaactggtcggcggtttcctcgcgccgaccgtggccggcttcgccgccgaccgcttcggcctgtccatcgtcatgtggatgtcctgcggcggcgccctgctcgccgcgttcctctcgctgttcctgcgcgaaaccgcgcccgccgtgctggcgcgccagcgcagcgcgcctacctccgtcctgcaaggaaaccaaccatgaaagcactgcgctggcacgctgcccgcgacctccgcctgagcgaactggaacaccaggcgccgcggcccggcgaagtcgaactggaagtcgcctactgcggcatctgcggcagcgacctgcacgaataccagagcggcccgcactcgattccccaggccgaggcgcacccgctgtccggttgccgcgcgccgctgaccctcggccatgagttctgcggcgtggtcgccgcgctcggccctggcgtggagggactgcgcatcggcgaccgcgtcgcggtggagccggaataccgctgcggcgaatgccgctactgccgggaaggccgctacaacctctgcgagtcgatgggcttcatcggcctgatgggcgacggcggcttcgccgagcgcgcgcgggtgccggcctacatgctgcaccgcctgccggacgcggtgggcttccgccaggccgccgtgctcgaaccggccgccgtggccctgcacgcgctgcgccgcagcagcctggcgccgggccagcgctgcgcggtgttcgggctcggcccgatcggcctgctgctggtgatgctcgcccacctgcgcggaatcgaggacatcgtcgcgatcgacgtcagtcccgagcgcctcgccctggccggggagttcggcgccagccgggcgctcgacgcccgcgacggcgacacggcggcgcgcctgcgcgagggcggcgcgctcgactgcgccttcgaggccgccggcagccaggccagcctcgacgccgccctggccagcctgcgcaagggtggcgagctggtgctggtgagcctgatgggcgaggtccggctggacgccttcgacctggtcaaccgcgaactgcgcctgctcggcagcgtcggctaccgcgacgcctacccggagctgatcgccctgctcgccgacggccgcctcgacctggcccgcgcagtgacccgcagcgtgcccctggagcaggccgtcgagcacggtttcgaggccctgctgcgcgacaagtcgcaggtcaaggtgctggtcaatcccaacccggccctggccgacgcctga

SEQ ID NO: 11803 - DNA, 492 bp, Pseudomonas aeruginosa
gcgccgccatgctcgccagccaactggcccggccgctgctggcgcagcgcggcggcagcatcctcaacatcgcctcgatgtacagcaccttcggttccgccgaccgcccggcctacagcgccagcaagggcgccatcgtccagctcacccgttccctggcctgcgagtatgccgccgagcgcatccgggtcaacgccatcgcccccggctggatcgacacgccgctgggcgccgggctcaaggccgacgtcgaggccacccgccggatcatgcagcgcacgccgctggcgcgctggggcgaggcgcccgaggtggccagcgccgcggccttcctctgcggtcccggcgccagcttcgtcaccggcgccgtgctggcggtggacggcggctatctctgcgcctgagccgccttcgctccggatgcacctgtccgcttggggcggacagcgattcgcacgacagaacaacaacaagacgagtgccttgccatga

SEQ ID NO: 11804 - DNA, 1866 bp, Pseudomonas aeruginosa
tggtcgacatgggctcgctgctggggctgtagcgcgccgcctggcagcctcggtcaaccccgccggcaggctgggacaagcggccgggcgcgcttccccgtccaatggagtagcgtcgcgcccatgggcgcggggcgaaaaagaacgccgggcgaggcccggcagcacacccagaaaggtgccgacatgacttccactgcccgccgttcgttcgactacatcgtggtcggcgccggctccgccggttgcgtcctggccaaccgtctttccgccgatcccgccgtctcggtctgcctggtcgaggccggccccagcgaccgcacgccgctccccgccgcctacatccgcacgccggccgggatcatccgcctgatcgccaacccgaagtggaactggatgcatcgcttcgccgcccagcccggcaccgccaaccagccgatcgcctgcccgcgcggcaaggtctggggcggctccagcgcgatcaacgggatgatctacatccgcggcgaccgccacgactacgaccgctgggcatccctcggcaaccgtggctggagctacgacgagctgctgccctactttcgccgctcggaacatttcgagccgggcgaatcgccctggcacgggcgcggcggcgaattgaacgtcgccgcgcagcgcagcccgggcccgatcaaccaggtgttcttccaggccgccgaggaaatgggctggccgtacaacgccgacttcaacggcgagcgccaggaaggcatcggcccgttccacgtcacccaggtcaacggcgaacgctgtagcgcggcgcgcgccttcctgcacccggccctggcgcggcccaacctcaccgtgctcagctcggcgctgaccctgcgcgtgctgctggaaggtacccgcgccaccggcgtggagatcagccaggctggcgaggtcgtgcaattgcaggcacgccgcgaagtgatcctcagcgccggctcgatcaactcgccgcagctcctgttgctctccggcatcggcccggcggcggaactggcgcgccacggcatcgtccagcgccatgagttgcctggggtcggcgagaacctgcaggaccaccaggacatcgtgctgatgtaccgcaccgaggccaagctcggctacggcctgggcttctcgccgaagggctggctgccgctgctgcgctcgccctggcagtacctgttcggccggcgcggggcgctgacctcgaacaccgtcgagtccggtggcttcctccgcctcgacccgcaggcagagaccccggagctgggtctgatcgtcgcccccgcgctgaagaaccagccgcagcgcctggtccccttcggccacggggtcagcctgcacgtcgcggtgatgcacccgcagagccgcgggcgggtccgcctgaactcgccggacccgcacgaccggccgctgatcgaagccaacttcctcagccaccctgccgacctcgataccctggtccagggtttccaactggtccgcaaactggccgccagccgcagcttcgcccgtcacctcaagggcgagctggtaccgggcccgcaggtttccagccgcggccagatcgaggcctggatccgcgccaacctgggcaccgtgttccatccggtgggcacctgcaagatgggccacgaccagctcgcggtggtcgacgaccagttgcgcgtgcacggcctgcaaggcctgcgggtggccgatgcgtcgatcatgccgacgctgatcaccggcaataccaacgccccggcgatcatgatcggcgagaaggccgccgacctgatcctcggcaagccggcgccccatgcaccgcccgcgcgacaaccggccgtgcaggctctggccggcgcctga

SEQ ID NO: 11805 - DNA, 1521 bp, Pseudomonas aeruginosa
cccagggccgcgaggcggacatcttcgaccgttccatcgacctgctggtcagccgcctgcgccaacgcctcggcgacgacgcccgcgaaccggagtacatcaagaccgtgcgcagcgagggctatgtgttctcgctgccggtgcgactggtcgaggcccatccatgaagctcaccgtgccgcgcccgcgcagcctcgccgcgcgcctggcgctgatcctcttcgccgggctggtgctggcctacgggctgtccttcgcctcgcagttctacgagcgctaccagaccgcgaagcacatgatgctcgacagcctcgaacaggacgtggcgatctcggtagccatgctcgaccgcctgacgcccgccgagcgcgaggcctggctgccgcgcctggaacgacgcacctaccgctatcgcctcgacgccggcgagcccggccagccgctggcgctggccgacgcgccggttgccgcgcactccatcgaacgcgccctcgacggtcaatacccgctgaccctgcgcacggtggccgacagccgtccgcacttccaggtcctcctgcgcctgcgcgacggcagcccgctgaccatcgacgtcacgccggccccggtgccgctgtccggctggctgccgctggtactgctggtgcagttgctcctgctgctgctctgcaccggcctcgcggtgcgcaccgccatcggcccgctgacccggctggtgaaggccgtggaacatctcgatccgaatcgtccggcacagcctctcgcggaaaccggcccacgcgaagtggcgcatgcggcggcggccttcaatgccatgcaggcgcgcatcgccgactacctcaaggagcgcatgcagttgctcgcggcgatttcccacgacctgcagacgccgatcacgcggatgaagctgcgcgtcgagttcatggacgcctccagcgacagggacaagctgtggaacgatctcgaagagatgcagcacctggtccgcgaaggcgtggcctatgcccgcagcatgcacggcagcaccgaaaccagttgccgggtggacctcgacgccttcctcgacagcctggtcttcgactaccaggacagcggcaagcaggtacaactcgacggccgtaccggcgcggtgatcgacacccgtccgcacgccctgcgccgggtgctggtgaacctggtcgacaatgcgctgaagttcgccggcgccgcgcgcctggaagtggaacgccgtaccgatggcggcacgcgaatccaggtgctggacaatggcccggggattcccgccgaggaactcgacgaggtgctcaagcccttctaccgggtggaaaactcgcgcaatcgcgacaccggtggcaccggcctcggcctggccatcgcgcagcagctgagcctggccctcggcggccgcctgaccctggccaaccgcgccggcggcgggctttgcgcgcgcatcgagctggacccctgaggcgcccgtacagagcgatacataaccgccctcggcggacacactgcggataa

SEQ ID NO: 11806 - DNA, 1056 bp, Pseudomonas aeruginosa
aggcggcatccagcggtgtggagccgccgagggacagcgagagaccgtggcaggtcagtggaaagcgctccaccaggcgctccaggtcggcaccgaaggcaccgccgacgccgatccagttgtccggcgcgcattcgaggaagtccaccgcgccgggcgccatcgccagcagttgcggaagcaggccgcgcctcaggccgaggccggcggcgttgtcgatcagggtcatgggatagctccggaaacggcgacgcccccgctttcccaggggaaagagagggcgccgccagggtgtggaaaggctcagtgccggccttgctccagcttgctgaacagcccggcgggcatcggcttgccgttggcctcgtaggtcttgcgcaggtgttcgtaggcctcggcttcggaaatgaagccgtcatggtcgctatcgatgctgtcgaactcaccggcacggtccttggccaccgcgaggaactcggcgcgcgagaccttgccatcgtgatcggtgtcggttcgggcaaaggaggcgtcgccgcacttgccctccccgcacttgccctcggcgccggccttggccggggtcttcgcggagccgccgctaccacacttgcctttctccgcatgggcattcgcgggcgatcgccgccgccagttgcagcccatgccccaacggctggacggcgaacgccgaacggccgagcagcattccccccaccagtacggcaccgagcaggctggcggaagtcttttgacgcgaatcgaaaacggacatgcttcttctccacagtaaacgcggccgggccgcaggcgcggcgctggtgggcgccggtacgaaccgggcggcgggaccttctggggtcgtcccgggcgccgcggttcggatgtggccatttcgcctgggagatgtatcgggggtgtatcgcccgacacttggatttgtacgccggaggtatcgaaaccgcgcatggatacaaagcgatacgcaatcgagcgcgggcatgccgacgaagtgccgggcatctctcactcccgccggcccatctcggctaccgttag

SEQ ID NO: 11807 - DNA, 1284 bp, Pseudomonas aeruginosa
gagacagccacctggcccagtctcgaggtcgagcccatcgtgctgaaacgcattccggtaacccagcttcgcctcggtatgttcgtccagagcctttgcggctcgtggctggaccacccgttctggaaaagaggtggcttcctgctcgacagccaggccgacctgcagcgcctgcgcgaaagcgccgtgaaggaagtctggatcgatgccagcaagggcctcgacctcccggaggaagcggcggtctcggccgctgcggtcctgccggtcaccatgccggccggcccttcgccggcgcgggtcgccctggaggaggaaatccgccacgccgccctgctctgcagccgtgccaaggccgccgtggtcagcatgttccgcgacgcgcgcatgggccaggccatcgataccgcgcatgcatcggacctggtggacgaaatctccgcctcggtgctgcgccatcccaacgcgctgctcagcctggtacggctgaagacctcggatgaatacacctacatgcattcggtggcggtctgtgcgctgatgatcgccctcgcccgccagctcgaactgcccgacccgctggtacgcgaggcggggctggccggactgctgcacgacatcggcaagatggcggtgcccgatccgatcctgaacaagcccggcaagctcaccgaccaggagttcggcctggttcgccggcatccgcagaacggcgcgcggatgctgctcgattgccgccaggtcagcgccctggtggtggatgtctgcctgcaccaccacgagcgcatcgacggcaccggctaccccttcggcctggcgcaggagcagatcagcctgctggcgcgaatgggcgcggtgtgcgacgtctacgacgcgatcacctccgaccgtccctacaagaagggctggaacgccgccgaggcgatccgacgcatggccgaatggaacgggcacttcgacccgcaggtgttccgcgccttcgtcaaggcggtgggcatctacccggtcggcgcgctggtcaggctggaaagcgggcgcctcggcgtggtcctcgaacaacacggccgctcgctgctgacgccacgggtcaaggtattcttctcggcccgctcgaaggtgccgatcccgcagcaggtggtagacctgggtagggccggacagaccgaccgaatcgtcggcttcgagccggcggaaacctggaacttccgcaatctcgacgagatgtggacgggactggccaagtccacgggctcttatttcgacgcgggaaccggaaatccgtag

SEQ ID NO: 11808 - DNA, 1191 bp, Pseudomonas aeruginosa
ccgttatctcccccgcgcctcaacggcagccatctccagcaaccacccccggaacgccagcatcgcgctggtctcctcccgcgactgcaagcgcgtcagccagtagctgccggtactcacttcggtggcgaacggacgccggatgctctcgctggccagttgccaggcaaacatcgccgccggcgccagggccacgccgacaccctggcgggccgcctcgagcatggccagcgaggtgtcgaagacgatgctccgggtcagtggcgcgtgcgccggcagtccggccgcctggaaccacagcggccactcgtcggcgcggtaggagcgcagcagggtgtgctgcagcaggtcggcgggactgtgcaactgggcggcgacctccgggcagcagagcaccgtcagcggcgcctcgaacaacgccagcgcctcggtgccgtgccaggcgccgccgccgaagcggatcgcgtagtcgagcccctcggcggcgatgtcgacgcggttgttgtgggtggacaggcgcagatcgatgaagggatggcgcgcctggaagtcctccagccgcggcagcagccaaccgaccgtgaaggttccgaccgcgccgacggtgagcacgtcccggtagtggccaccctcgaaacgttccagcaggccggcgatgcggtcgaaggagtcacacagtaccggcagcaggctctcgccctcgtgggtcagcatgaggccgcgcggcagacgcttgaacagggccacgccgagacgctcctcgaggctcttcacctggtggctgaccgccgcctgggtcacgcacagctcgatggccgcgcgggtgaagctcaggtgccgggccgaagcttcgaaggcgcgcagggcgttcagcggcaaatggggtcgaaccaatctctgctccaaatttttctaatggctgccgcgagtattcgtcgtttgccgcaaatcctgcgcaagcctagattttccccgcccgccgatcaaggagcgctcccggggcggtttctcatgcagccaacgacaaaggacgccaatcctcatgcgcgataccagattcccctgcctgtgcggcatcgccgcttccacactgctgttcgccaccaccccggccattgccggcgaggccccggcggatcgcctgaaggcactggtcgacgccgccgtacaaccggtgatgaaggccaatga

SEQ ID NO: 11809 - DNA, 1074 bp, Pseudomonas aeruginosa
cattccgggcctggccgtagccatcagcctgaaaggagaaccgcattacttcagctatgggctggcctcgaaagaggacggccgccaggtgacgccggagaccctgttcgagatcggctcggtgagcaagaccttcaccgccaccctcgccggctatgccctggcccaggacaagatgcgcctcgacgaccgcgccagccagcactggccggcactgcagggcagccgcttcgacggcatcagcctgctcgacctcgcgacctataccgccggcggcttgccgctgcagttccccgactcggtgcagaaggaccaggcacagatccgcgactactaccgccagtggcagccgacctatgcgccgggcagccagcgcctctattccaacccgagcatcggcctgttcggctatctcgccgcgcgcagcctgggccagccgttcgaacgactcatggagcagcaagtgtgcccggcactgggcctcgaacagacccacctcgacgtgcccgaggcggcgctggcgcagtacgcccagggctacggcaaggacgaccgcccgctacgggtcggtcccggcccgctggatgccgaagggtacggggtgaagaccagcgcggccgacctgctgcgcttcgtcgatgccaacctgcatccggagcgcctggacaggccctgggcgcaggcgctcgatgccacccatcgcggttactacaaggtcggcgacatgacccagggcctgggctgggaagcctacgactggccgatctccctgaagcgcctgcaggccggcaactcgacgccgatggcgctgcaaccgcacaggatcgccaggctgcccgcgccacaggcgctggagggccagcgcctgctgaacaagaccggttccaccaacggcttcggcgcctacgtggcgttcgtcccgggccgcgacctgggactggtgatcctggccaaccgcaactatcccaatgccgagcgggtgaagatcgcctacgccatcctcagcggcctggagcagcagggcaaggtgccgctgaagcgctgaagcgcgctcgcgagggcgacggagcgtag

SEQ ID NO: 11810 - DNA, 687 bp, Pseudomonas aeruginosa
tggtatgcagggtcgcggcgctgccctggacatcgccctcgccgagctggcgttcgagctgggcgaagaggtcctgcatgtccggaacgaagcgccgcaacacctggacgatcagctccaggctgccgccgaaacgcccgacgatatcgccccgcgcctcgaccagttcgcccgcgtccgctgccgttgccggcgcgcccctggcgccgctcctgccgagatgaccgagcaggcaaagcaccaggcgctccttgtcgatcggcttcgccacatggtcgttcatgcccgccgccaggcaggcttcgcggtcggccagcgaggcgttggcggtcatggccaggatcggcagcccggcgaagcgcccgtcggcgcggattctccgggtcgcctcgagaccatcgatatccggcatctgcatgtccatcagcaccgcgtcgaacggcacgctcgcctccagcacctgctgaacgcccgccagcccgccgtcggcgagggccacccgggcgccctcgctgctcaacagctcggcggcgacctggcggttcagcgcgttgtcctccactaccagcagacgcacgccccgcaaccgctgggtgcgctccaccgggcgcggcggcgggttggccggggcgccctgttcgccgtgcaacgcatgcagcaccgagtcggccagttgcttgggcgtga

SEQ ID NO: 11811 - DNA, 468 bp, Pseudomonas aeruginosa
cgcagtgcggcgaacagggcgagcagcaggccggccagcgccagcacggcgccgacgttgccgatcgaggccaggcccatgcgttcgctgaccacgctgccgagcagcgcgccggcgccgatgccgacgttgtacaggccggagaacagcgccatggccacgtcggtggcgtccgaggcgaggcgcaggacgcgggactgctgggccaggccgaagcacatgatcgacatgccccagagcaggctgagcgccatcagccaggtcggctgcgcggacagcggcaacagcagcgccaggctgctgcccaagactaggatcgcggccagcatgaagcctcgcgggaaagcctcgctgtatcggctgaagaagatcgaaccgaagatcccggcgccgccgaacaacagcagcagcagggtggtcgcctcgccgctcatccgcgccacctgcttggggaacggctcgatgtag

SEQ ID NO: 11812 - DNA, 936 bp, Pseudomonas aeruginosa
gcgtgctcaacgaaaccagcggcctctccgaagcgcagctggccaacctgttcgaaccgttcaagcgcgagtcggcggacaaccagcgcaaccgcaacggcctcggtatcggcctgtacatctcccaggccatcgcccaggcccaccaggggcgtatcgacgtggactgccgcgacgacgtcatcaccttctgcctgcgcctgccggtgcgccaggcggagaccggctcctcgtcctgacgacgaggaccgtgcacaatgcaacgcttgcaggtatcttcggcagccatcgccgtctgacaggatcgccccgttccatgccccgcctccgcctccggaccgtcctcgcctgcctcgccgtgttctgcgcgactcccgcactggccagggtcgaagtgcattcgctgcaacacaagagcatggggcgggtgctgacggtccgcgtctcggaggagatcgcgccgggcgactacgaaacgctgctcaagggtttgcgcaacaatccgggaacctactcgcgcaagctgctcctgctgaacagcatcggcggcagcgtgccggaggcgatccgcatgggccgcctgctgcgcgaatccggcttcgacgcgctggtgccgtcgagcagcgtctgccagggcacctgcgtctacctgctggcggccggcaagcgcaagaccgtacgcggctacgtcggcctgcaccgtccctactacgcccacggcgactcgctgcactcgcgctcggccaacggcatgcgctacgactccgccgcctacttccgcgaaatggatatccccagcaccttggtacaggccatgcaaagcaccgatcccaaacggatgcgcgtgctttcggcgaaggaactggcgcagtaccggctgaactgaaccggcgactccgcggaacgagcgagggcgcgcggtggcgttggcgatag

SEQ ID NO: 11813 - DNA, 474 bp, Pseudomonas aeruginosa
agcgccgcccctccgccagcagatttggcaggcaggcgtcgccatgggcgaccaccaggtcttcgaccgccggacgccggtcgagcagcaggcggtacagctccgtggcgctgcgaccgcgatggtcgtcgtcgaagtccgcctcgtccaccagcccggcctcgacccgctggcgcacggtgtccaggcgccgttccaggcgatgatcgaagggacaggcggccggatcgagatcgtgcagccggcgcagggcggcggccaccaggcgcaccaggcgctcgggctccagctcgccgcgctgcgccagcgcggacagcgtgtcccccggcacggcgctcatcagcagccattgccggccgtcgctctgggtttcgttcagcacctgcgggcaatcgatgccggcaccgtgcagccagcgcaggcgggcgatttcggcgggcagctcggcatgtgcggacagcacttcctgcttga

SEQ ID NO: 11814 - DNA, 654 bp, Pseudomonas aeruginosa
cgtcgccgccggcaccctgttcggcgtcgcgctgaactacaagggcctgctcgacagccgcctgccggagttccagcagccgccctaccagaagccgccagtgaagccggtgttgttcatcaagacaccgaatacccgcaacgagcacgacgccccggtgctcttcccgcgcggcgtcgagcgcctgcaaccgggcccggcgctgggcgtggtgatcgctcgcgacgccagccgggtgaaggaggaagaggccatggcgcatgtcgccggctacgtgatcgtcaacgagttcagcctgccggaagacagctactaccgcccggcggtgaaagccaagtgccgcgacggcttctgcccgttcggtccgcaactggtgccgacgcaggagatcgccgatccccatgcgctggagctgaagctgtacgtcaacggcgaactgcgccaacgcaacaacaccgccaacctggtgcgcgacatcccgcggctgatcgccgagatcagcgagttcatgaccctgcacgccggcgacgtgctgatcaccggcacccccgaagggcgagtcgacgtgcatcccggcgaccgcgtcgaggtcgagatcgacggcctcggccgcctcgccaacagcatcgtcgcggaatgaggaaccgaccatga

SEQ ID NO: 11815 - DNA, 2268 bp, Pseudomonas aeruginosa
gaccctcgacaccggcctgccgatccaccagacgaagaacgtgctgatcccgcgcgcctcgcacaacttcgagttcttcgccgaagtctgcacgcggatgaacgggcacagctatccggtcgacgaccagatgctcaactacaccctgtaccagccggtgggcgtctgcggcctggtctcgccgtggaacgtaccgttcatgaccgccacctggaagaccgcgccgtgcctggcgctgggcaacacggcggtgctgaagatgtccgagctgtcgccgctgaccgccaacgagctgggccgcctggtgcacgaggcgggcattccgccgggggtgttcaacgtggtccagggctacggcgccagcgccggcgacgcgctggttcgccaccgcgacgtgcgcgcggtgtccttcaccggcggcaccgccaccgggcgacggatcatggaggcggccgggatcaagaaatactcgatggaactgggcggcaagtcgccggtgctggtcttcgaagacgccgacctcgagcgggcgctggacgccgctctgttcaccatcttctcgctgaacggcgagcgctgcaccgccggcagtcgcatcttcgtccaggaaagcgtctacccgcagttcgtcgccgagttcgccgcacgcgccaggcgcctgatcgtcggcgatccgcaggacccgaagacccaggtcggctcgatgatcacccaggcccactacgacaaggtcaccggctacatccgcatcggcctcgaggaaggcgccaccctggtggccggcggcctggagcgtccggccggcctgccggcgcacctgagcaaggggcagttcatccagcccacggtgttcgccgacgtggacaaccgcatgcgcatcgcccaggaggagatcttcggcccggtggtctgcctgatcccgttcaaggacgaagccgaggcgctgcgcctggccaacgacgtggaatacggcctggcctcctacatctggacccaggacatcggcaaggcccatcgcctggcacgcggcatcgaggccgggatggtcttcatcaacagccagaacgtgcgcgacctgcgccagccgttcggcggggtgaaggcctcgggcaccggacgcgaaggcggggaatacagcttcgaggtattcgccgagatcaagaacgtgtgtatatccatgggcagccatcacatcccccgctggggcgtgtagggcgcgctcgtgcagagcggccccccgaggccgccagcagcgccggcgtgcagacacaatcagaagaatccgggccagccgccaacggccgcgcccgctgccaggcccaacgggccaccaggagaatcgtcatgggcaaagtcgctctggctgccaagatcacccacgtaccctcgctgtacctgtccgagctgcccggcccgcgccacggctgccgccagccggcgatcgacgggcaccgcgagatcggccggcgctgccgcgaactgggggtcgacaccatcgtggtgttcgacacccactggctggtcaacgccggctaccacatcaactgcgcgccgcacttcgaggggctctacaccagcaacgagttgccgcacttcatcgccaacatggagtacggcttccccggcaacccggagctgggccgcatcctcgccgagggctgcaacgcgctcggcgtggagaccctggcccacgacgccaccaccctcggcccggagtacggcaccctggtaccgatgcgctacatgaaccaggaccgccacttcaaggtggtctcggtctccgccctgtgcaccgtgcattacctgaacgacagcgcgcgcctgggctgggccatgcgcaaggcggtggaagagcactacgacggcacggtggcgttcctcgccagcggctcactgtcccaccgcttcgcccagaacggccaggcgccggacttctccgaccgcatctggagcccgttcctcgaggtcctcgaccatgaagtcgtgcagatgtggcaggaaggccgctgggcggaattctgcgggatgctcccggagtacgcctccaagggccatggcgaaggcttcatgcacgacaccgcgatgctcctcggcgccctcggctggtcggcctacgacggcaaggcggaggtggtgacgccctacttcggctcctccggcaccgggcagatcaacgcggtattcccggtcaccgcccaggacggctcggcgatccccgccgcccaggccggcaacccggccggcgccagttgcgccagccgcctctga

SEQ ID NO: 11816 - DNA, 1383 bp, Pseudomonas aeruginosa
cgctgcactcacccagctcgcctcccggccaccgacaggtcgccgggacgtccgggcgctcacaaaaagtacaagatcatgagcacagccagcaccctgaacagcaccaccctgcctctcagcgacagcacccacgaccgcgtcacctggcggctgatgccgctgctgctggtgtgctacgtcttcgcccatctggaccgcatcaacatcggtttcgccaaattgcagatgagcgccgacctgcacttcagcgacaccgtctacggtctcggcgccgggctattcttcatcgcctatgcgctgttcggcctgcccagcaacctgatgctggaacggatcggcccgcgccgctggatcgcctgcctgatgctggtctggggctgtctctccaccgccatgctgctggtggagaccgcgcgcggcttctacctgctgcgctttctcctgggggtcgccgaggccggcttcttccccggtatcctggtctacctgaaccgttggttcccggcgcgccgacgcgggcagatcaccgccctgttcgccatcgccgtgcccatggccggggtgatcggcggaccgctttcgggctggatcctagaaggcttccatgacgccctcggactgcgcggctggcagtggatgttcctgatcgaaggcctgccggttgtgttgctcggcgtggtggtctggtgctcgctgccggaaagcttcgaacgggtgacgtggctcagcgacgaacagaagcacctgctgcgcgaggaactggccggcgaggagcagcgcaagaccatcacctccttctccggcatcttcagcaatccgcaggtgtggctgctggtggcgatctatttcgcggtgatgctggcggtgaacaccatcgcgttctggatgccgagcctgatccatggcgccggcatcgcccaggacagccgcatcggcatgctcagcgcggtgccctatctcgccggctgcgccttcatgatcttcatcggccgttcctccgaccgcctgcgcgagcgccgctggcacctgggcattccgttgctgatggccgccgccgggctcagcctggcggccctggcaccgaccagcgcctggctggtgatgggcggtctggtgatcgccgggatgggcgccagcgccgccctgccgatgttctggcaactgccgccggccttcctttccagcgccaccctggccgccggaatcgccctgatcagttccttcggcagcatcgccgccttcctcgcgccctacctgatcggctggatgcgcgacaccacccagagcgccagcctggccctgtacctgctggccatcctcatcgccctcggcgccggcctggtcctgcggacccccgccgccgtggtctacccacgctga

SEQ ID NO: 11817 - DNA, 327 bp, Pseudomonas aeruginosa
tcctcggcggctccttcacccgcccggtggcggccgcgccgggggacaccttccacgtcgactacgacctgctcggcagcatctcctgccgtttcgtctgaggaggcatttccatggacctgcccgtcaatcgcttcaagcaacgcctgcgcagcggcgaggcgcagatcggcctgtggctcggcctggccgatccctactgcgcggagctggccgccaacgccggcttcgactggctgctgctggacggcgagcacgcgcccaacgacctgcgcagcctgctcggccagttgcaggcgctggcgccctaccccggccagccggtga

SEQ ID NO: 11818 - DNA, 996 bp, Pseudomonas aeruginosa
tcgcaaccgcctctccagcctgatgggcctacgaaaaatgagcgaaagaattcccgcgatccaggtcgagcccgccgcaccggccgctccgtcgaaacagccgcccgcgcccggcaagctgccgtcggcggtgaacggcccgatctacacccgcagcttcaccggtctgttccgcaacttccgccgcctcggcggcggcctgctgttcctgctgttcttcggcaccctgtggctgaactggaacggccgccaggcggtgctctgggacctgcccgaacgcaagttctacattttcggcgcgaccttctggccgcaggacttcatcctgctctcggcgctgctgatcatcgccgccttcggcctgttcttcatcaccgtgttcgccggccgcgtctggtgcggctatacctgcccgcagagcgtgtggacctgggtgttcatgtggtgcgagaaggtcaccgagggcgaccgcaatgcgcggatcaagctcgaccagggtccggcgagcgccgccaagctcttgcgcaaaacggccaagcacgcgctgtggctgggtgtgagcctggtcacggcgatcaccttcatcggctacttcactccggtgcggccgctggtggccgacctgttcagcttccagctggacctggaaagcctgttctgggtgctgttcttcaccgccgccacctatgtcaacgccggctggctgcgcgagcaggtgtgcatccacatgtgcccctactcgcgcttccagagcgtgatgttcgacaaggacaccctgatcgtgtcctacgacgccgcccgcggcgagtcccgcggcgcccgcaagaaaggcagcgatccgcgcgcccaagggctcggcgactgcatcgactgccagcagtgcgtgcaggtctgccccaccggcatcgacatccgcgacggcctgcagatcgcctgcatcggctgcgccgcctgcgtcgacgcctgcgactcgatcatggacaagatgggctatga

SEQ ID NO: 11819 - DNA, 204 bp, Pseudomonas aeruginosa
cgccgggcaaccatggcctgcgccggcagatcgccctgcgctacatggtcggcggcctgctgctgccggtggaagaactggtcatcagcaacggcgcgctggaggcactcaacctctgcctgcaggtggtcacccgtcccggcgacctggtggccatcgaggcgccggcgttctacgccaccctgcaggtgctggaacggttga

SEQ ID NO: 11820 - DNA, 459 bp, Pseudomonas aeruginosa
ccagcctgtcggcgtcgatcccggcccaggcggccatcgccgactatctccagcacggcggctacgaccgccacctgcgcaagctgcgctacgccctggagacccagcagaacgccatgctcgcggcggtggcgcgttacttccccgagcagacccgggtcagccgtcccagcggcggctacttcctctggctggagttgcccgaggcggtcgactcgctgcgcctgttccaactggccctggcccagggcatcagcctcgccccggggccgatcttctccgccacccgccgcttcgcccattgcgcccggctcaactacgggcacccgtggagcgcgcggcaggagaaggcgatggagacactcgggcggatcgcccagtcgctggcgggatgacgccccgcagacggaaagccaccccggcgtagggcggataaccgcgcgcggtcatccgccatga

SEQ ID NO: 11821 - DNA, 432 bp, Pseudomonas aeruginosa
tgtaggcgaacatcccggcgaacgccagccccatgcacagcacgtagcccagcgcgcgacggtcgccgagcagccgcccataggcgagaaaggcctgggccaggctgccgccgcggcgctccggcgggtggctttcggcgacccgccagaccgccagcaggcagagcccggcgaacagcgccaggaccacgaacaacgcgcgccagccggcccagagcatcaggtagccgccgagcagcggcgcggccagcggtgccagcatggtcaccatgtgcatcaatgccagcatccgggcggcctcgcccaacggatagaggtcgcgcaccatggcccgcgccagcaccgacgcggcgccgccgccgagggcctggagcaccctcagcaggaccagttgccccgcgctgtcggccagcacgcaggccaggctgctga

SEQ ID NO: 11822 - DNA, 363 bp, Pseudomonas aeruginosa
tcacggcatgcccccgcccgtgcgcctggcgcagctatgcgcttggcctcggcctcctgcccctcgccgcgcaagcggaattcctcgcggacagcagcgcccacctcgacctccgcaacttctaccagttgcgcgactaccgccagcacgatgcgccccaatcgcaggccggcaactggtcgcagggcttcgtcctgcgcctgcaatccggtttcaccggcggcccgctcggcttcggcctggatgctaccgggctgctcggcgtcaagctcgactcgggacgcgggcgtagcaacgatggcacgctgccgttcggagcgaattcgaaggagccggtggacgactacagtcacctcggcctga

SEQ ID NO: 11823 - DNA, 822 bp, Pseudomonas aeruginosa
cttcatcaccggcaggccgctgtcccgcgtaccgtcggcgaacaccccgcgcgcggcatcggcggcggatcgcgcggcgtgctcgccgtgcgccagggcggtggcggcattggccaggaccaccttcgcttcgttcagctcggcgccctgcaaggcgcccaggcggcgcacctcatccatcggcagttcgctgaacagggcgaggaagcgaccgacgtcgcgatcatcgcagttgcgccagaactgccagaagtcgaacggcgccaggcgctcggcgttgagccataccgcaccctgcgccgacttgcccatcttgcgcccgtcactggtggccagcagcggcatggtcaggccgaacagctgggcgccgccctggcgtcgcgacagctccacgccgttgatgatgttcgcccactggtcggcgccgccgagttgcagggtgcagccgcgccggcgcgacagttcgacgaaatcgtaggcctgcaacagggtgtagccgaactcgaggaacgacagcgaatgctcgcggtccaggcgctgcctgatggcgtcgaaggtcagcaggcggttgatcgagaagtgccggccgacccggtcgaggaactccaggtagccgacgccgtccagccattcggcgttgttcaccaggctgtcgtcgtgcagttcgacgtagcgcgagaaaacccgggcgatgccgtcgatattggcctggatctgcgcctcggtgaggatcggccggctcgaatcgcggaagctcggatcgccgatccgggtggtcgcgccaccgatcagcagcaacgggcggtgcccggccttctgtag

SEQ ID NO: 11824 - DNA, 825 bp, Pseudomonas aeruginosa
cccccatccatcaactggccgacaccctcggctacggcgtgttcaagggcgtcgccgcggtcggcggcctgctcggcggcgacaccagccgcatcgattaccactacgacaccgagtggacctgatcccaggacctcggcccgctcccgtcgcggagcgggcctccaccgtcgccggagacccggacgcccccggcggcgacctaggacccggcaaccgggaaggggcgaccagcgccccgatcaggagaaccgccatgcacgacctcatccagcacgccgacgccttcgtcggcgatcccgaccaggaatccggcggcctgtcgcgccgcagcttcctcggcaagagtgccacgctcggcgcggtcggcctggtggccggctggaccccggccttcgtcatccagcccgccgaagccgccgccagcagttgtccggcgccggcaggctttccggccggcctcgaactttatcggcgggcgttccgcaattggtcgggggaaatcgccgccgacgacctctggagctgcgccccgcgcaccaacgaagaggttctcgcggtggtcaactgggcctggcagaacggcttcaaggtgcgcccgcgcggcatgggtcacaactggtccccgctgctgctgaaaggcggcgagaactgcgagagccgcatcgtgctggtggaaaccagccgttacctgacccgcgtacggatcgacgcccagggcgagttcggcctgttcagcgcgcagaccggcgtcaccatggaagccctgctgaaacaactggagcgggtcaagctcggcttcgtcgccacgccggcgccgggtga

SEQ ID NO: 11825 - DNA, 1251 bp, Pseudomonas aeruginosa
cctgaccctcggcggggtgctcgccatcgacggccacggcaccggcatcccggcgcagggcgaaagccgcctgccggggcagagctacggctccctgagcaacagcatcgtggcgctgaccgcggtggtctgggacggcgccgccggacaatacgtgctgaagaccttccgccgcgacgatccggcctgcgcgccgttcctcgtccacctcggacgcgccttcatcgtcgaggcgaccctccaggccggggtcaacaagcgcatgcgctgccagagctacgtgaacatcccggcgagcgagatgttcgccgcggccggcagcggcggaaggaccttcgacagcttcctgcagaaaagcggacgcgccgaggccatctggttccccttcaccgacaagccctggctgaaggtctggacgccgaccccgcgctgcccgttcggcgcccgcgcggtcaacggcccgttcaactaccccttctccgacaacattcccaaggcgctgtccgacctgctggcggcgatcaacaccggccacccggaactcaccccgctgctcggcaagctgcagtacgacctggtagtgggcggcatggcgctgaccctgggctacgacctgtggggctggagcaaggacctgctgctgtacatcaagcccagcaccctgcgcgtcaccgccaacggctacgcggtgctgacccggcgtcgcgacgtgcagcgggtgatcaacgagttctacctgcagtaccagacgatggtcgccgcctaccgcgccaacggccactaccccatgaacggcccggtggagattcgcgtcagcgggctcgaccagcccggcgagtcgatcgttcccggcgcccaggtgcccagcctgtcggcgatccgtccgcgccccgaccaaccggagtgggacacggcgatctggctggacatcctcagcctgcccggtaccccgcaggccaatgccttctaccacgagttcgaggcctggctgttcgaccacttcagcggcgactacgcctcgctgcgggtggagtggagcaagggctggggctacagccccgccgccgcctgggacgagccgacggtggtcgaccagttggtggcgcagtcgctacgccagggcctggtcgcagacaacgattgggacagcgccgtgcgccagttgaacgaagccgatccgcatcggctgttcagctcgccgctgctcgaccggctgatgccatgaaatgccgctatgcgaggccgtactga

SEQ ID NO: 11826 - DNA, 384 bp, Pseudomonas aeruginosa
tcctggcagttcatcccactctttcggattagtaccatcgaatggctttccagactcatgggaagcctaaaggagatatatgaaatgaaagaactcaatgacattgaagtcacctgcgtttcgggtggaactctttccggcatgatcgtaggcgccgtcgacggcgccgcgacgggcatggcaatcggcgggaaatggggcggtgccggcggcttcggcttcggcgctctttcccagttggtcggcctgatcgtgccaaccgcaatgggcgctattgccgggggcacggtcggtctcttcaccaatgcagagacggctgtcggttacttgggccaataccgggaaaacttcggtcccggtgatgtaggccgcaccaccatctaa

SEQ ID NO: 11827 - DNA, 1317 bp, Pseudomonas aeruginosa
actttcgcaagggtgtcggagtgtcatgcaagtattattcgaatccaggatccagccaccatgtttcgccaggaagccctcgacgcccagcatgccggcggcctgggcgagatcgtgctgatccgcccggtctccttcacttttctcaccctgctggccgcggcgatggcgctgctggtggtgggcttcttcctgttcggcagctacaccaagcgcagcaccgtcagcggccaattggtgcccgccagcggccaggtcaaggtgcacgcgccgcaggccggcatcgtgctgcgcaagttcgtccaggaaggccaggcggtacgacgcggcgagcgcctgatggtgctttccagcgaacgctacggcagcgatgccgggccggtgcaggccggcatcagcaggcgcctggaacaacgccgcgactccctgcgcgacgaactggaaaagcttcgccgcctgcaagacgacgagcgcgacagcctgaccagcaaggtcgccagcctgcagcgcgaactcaccaccctcgccgcccagaccgacagccagcaacgcctgctggcgctggccagcgacgccgccgcgcgctaccaggggctgatggacaagggctacatctccatggaccagttgcagcagcgccaggccgagctgctcggccagcgccagacgctgcaaggcctggagcgcgaacgcacgtcgctgcggcagcagttgaccgagcgccgcaacgaactcgccgggctttccgcgcgccaggccaaccagctcgcggaaacccgccgccagctcagcgcggtggagcaggacctggccgaaagcgaagccaagcgcaccttgctggtcaccgcgccggagagcggcatcgccaccgccgtgctcgccgaagccgggcagaccgtcgacagctcgcgtccgctgctgagcatcgttcccgccgacaccccgttgcaggccgaactctacgcgccgagcaagtccatcggtttcatccggccgggcgacgcggtgctgatccgctaccaggcctatccgtaccagaagttcggccagtaccacggcaaggtgcagtcgatctcccgcgccagcgtctcctatgccgagctttccagcatggtcggcggcgtaccggggctcggccaggatggcgagcagctgtaccggctgcgggtaaccctcgacgaccaggcggtgaccgcctacggccagccgcgtccgctgcagagcggcatgctgctggacgccgacatcctccaggacacccggcgcctctacgaatgggtgctggaaccgctctacagcctgaccggcaaactctag

SEQ ID NO: 11828 - DNA, 1830 bp, Pseudomonas aeruginosa
gaacgacccatggcctttctcgacgctctcgccctgcgcctgggccgccgcctgccgctggtgctgcagaccgaagccaccgaatgcggcctggcctgcctggcgatgatcgccggctaccacggccaccataccggcctgatggaactgcgccggcgcttctccgtatcgctcaagggcatctccctcaagcaactgatccagaccgcccaccgcctcggcctgggtacccgcgcggtgaagctcgacctcggcgacctcggcaagctcaagctgccctgcgtgctgcactggaacttcaaccacttcgtcgtgctcaaggcggtcgacgggcgcggcgcggtgctccacgaccccgcccacggccagcgccggctgggcctggaggaagtctcgcggagcttcaccggggtagccctggaactctggccggagagcggcttcgagaaacaggaggcgccgccgcggatcaagctgctgggcatgctcggcaaggtcaccgggctgtaccgctcgctggcccaggtgctgctgctcgccggcgcgctggaagtgttctcgctgatcagtccgttcttcctgcaatggaccatcgacaacgtcatcgtcagcgaagaccgtgacctgctcagcaccctggccatcggcttcggcctgttgctgctgatgcagcaggcggtcagcggggtgcgcgcctgggtgatgatgcacatgagcaccctgctcggcgtgcagtggcaggccaacgtcttcagccacctgctgcggctgcccgcgcagtatttcgagaagcgccacctgggcgacgtggtgtcgcgcttcggcgcggtgaacagcatccagcagaccctcaccgcggccttcctctcggcggtgctggacggcctgatgaccgtcgccaccctcggcatgatgctgctctacagtccgccactggcggccatcgccatcgccgccatgagcctctacgccctcggccgctggatctggtaccggccgttgcgcaacgccaccgaggagcagatcgtccacgccgcgcgccagcagagccatttcctcgagacggtgcgcggcatccgcccgctgaagctgttccagcgccaggacgagcgccgctcggtatggctcggcctgctggtggaacagatcaacgccggcctgcgtacgcagaagctgcaactgttctaccagcagctcaacggcctgctgttcggcgtggagaacctgctggtgatctggctcggcgcgaccatggtgatggacggccagttcagcgtcggcatcctgatggccttcaacgcctacaagtcgcagttcgacagccgcgtcggcagcctgatcgacaagttcttcgagctgcgcatgctccagttgcagggcgagcgcctggccgacatcgtgctccaggccccggaggtcagccacggcgacatcctcccgaagaaccttcgcgagcgcgaggcgagcatcgagatccagggcctgcgctaccgctacgcggaacaggagccctgggtcctcgacggcctcgacctgcgcatcgccggcggcgagtcggtggccatcgtcggcccctcgggctgcggcaagagcaccctgttcaacgtcctgctgggcatcctcccgccagggggggaacagatccgccatggccggcctggaccttgcgcaattgggcctggaagggctgcgcgaactggtcggcacggtgctgcaggacgacgtgctgttcgccggttcgctcaaccgaacaacatcagtttttttgacccgcaaccggacatgccctggctggcgccagtgcgcgcagatggctgccatccacgatga

SEQ ID NO: 11829 - DNA, 765 bp, Pseudomonas aeruginosa
acagcgggtcaacgccgccattcgcgcgctgcgcatcacccgcgtcatggtcgcccatcggcccgagaccatcgcctcggcggaccgcgtgatagtcctcggccagggcaaggtaagcctcgacgaaagcaccgcgcgcctggccgaacgccaggccgccgcggcgcgggagcaggcctgatgcgtgccctcgccggcctgttgtgcggcctgctcggcctggttcccggcgccgccgcctacgagccggacgtgttcggcaccgtcggccaggtcgccggccaggcggtctacgacctcggcggcagcggtttgccctgccgcggcgggccgccaccgaccgagctgagcctggaggaagccatcgagcggatcctctgccacgacccacagacccgcctcgcctgggccaatgccaaggcggcccaggtcgggatcggcaagtccgcctacctgccgcgcctggacggccgtctcgacgccagtcgcggctacagcgacatggattatcgcgatgccccctacctctccggcgacggccatcgccaccggcgtggcgccagcctccaattgagctgggtgctgttcgacttcggccgccgcagcgccgccctgcgcaacgcccagcagttgctgctggcggccaacgccagccaggacgcgaccctgcagaacaccttcgccctcgccgcccaggcctactacgacgccctcgccgcccagcgcagcctggccgcctcgcggcaggtcgcggagctggcggcg

SEQ ID NO: 11830 - DNA, 441 bp, Pseudomonas aeruginosa
gccgggccttatcctttctccatccccgatttcccagccaaggcctttcccatgttgcccccgctcgtccgccgtctgtcccgccttgccgccgaactggcggtactcatcgccttctggtgggccggcggctggctggcgaaggccatcggcctgccgctgccgggcggggtggtcggcctggcggcactgttgctgctgttcgccagcggcctgctgcgtccggcctggctgcaggccggcgccggcctgttgctggcggagatgttgctgttcttcatcccggcgctgatgagcctgctcgactacggcgcgctgctacgcagcgagggctggcgcatcctcctggtgatcatgctcagcaccctgctggtgatgctggtcaccgcggtgtcggtggagtggatgtgccgctggagggcgcgccatgagtctcgataa

SEQ ID NO: 11831 - DNA, 1581 bp, Pseudomonas aeruginosa
gcaagccctgttctggttggcggcgaccgtcggcggctacctcctgagccgccagctgtaccgccgggtgaagtggtactggctgtcgcccatcgtgttcgtcccggtgctgctctacgccctggcgattcccacccatacccgctacgccgactacgcccgcgacaccaattggctggtggcgctgctcggtccggcgacggtggccttcgccatcccgatctggcagcagcgcgagctgctgatgcgccactggccggcgctgctggccgggatgttcgccggcaccgcggtggccatcggcagctcctgggcgctggcccaggccctggcgctggacggccaggtcacgctgtcgttgctgccgcgctcgatcaccacgccgttcgccatggagatgtcccacgacctgggtggcgtgccggaactgaccgccgccttcgtgatgatcaccggggtgttcggcgcggtgatcggcggcaccctgctgcgcgtcctgcgcttgcgcacgccgctggcccgcggcgcgctgttcggcgtcggcgcgcacggcgccggcaccagtcgggcctacgagttcggcggcgaggaaggttcggcggccggtctgctgatggttctcaccgggctgttcaacctgctggtcgcgcccctggtcgcccactgcctgtagcctgcgcgcataggccggctgaatcctccgccattcagccggcgcgcgagtgtaagcccggcgacagtcgccggaggagggcggggctagactgcgggcatccgataacgacaaaagaggatgccgccgtgaccgccgttcactccctgcccgccgatgtgcaagcccaggtctccgccgccgaatggcagacccgcgtcgatctcgctgcctgctaccggctggtcgccctgcacggttgggacgacctgatcttcacccacatctcggccaaggtgccgggcaccgaggacttcctgatcaacccgttcggcctgatgttccacgagatcaccgcctccagcctggtgaaggtggatgccagcggcaagaagctgatggacagcccctacgagatcaacccggccggctacaccatccatagcgcggtgcacgaggtccgccacgacgtcgagtgcgtgctgcacacccataccgccgcggggatcgcggtgtcctgccagaagcagggcctgttgccgctgtcgcagcaatcgttgttcgtgctctccagcctgtcctaccacgcctacgagggcgtcgccctgaaccatgaggaaaaggcccgcctgcaggccgacctggggaccagcaacttcctgatcctgcccaaccacggcctgctcacctgcggcggttccatcgccgataccttcctcatgatgttcaccctgcaacgcgcctgcgaggtacaggtgatggcgcagagcggcggcgccgagctgatccacatcccggggcagatcctcgccggcgcgcgcgacatgatcgccggggtgatgcgcagcaagaccggcatgggcggccagctcgcctggccggcgctgctgcgcaagctcgaccagcagaacccgggctaccgccagtga

SEQ ID NO: 11832 - DNA, 348 bp, Pseudomonas aeruginosa
tccacggttttcccagcgccgcctgggactggcactacctctgggagccgctggcgcagcgctaccgcgtgctggtctgcgacctgctcggcttcggcgattcggccaagccgcgcgcccatcgctacagcctgctggagcaggccgacctgcaacaggcgctgctcggccgcctgggaatcgacgagccgctgcacgtgctggcccacgactacggcgacagcgtcgcccaggaactgctcgcccgccatcacgaaggccggctgcggctcgcctcctgcgtgttcctcaatggtgggctgttcccggaaacgcaccgcccggtgctcagccagaagctgttgctga

SEQ ID NO: 11833 - DNA, 348 bp, Pseudomonas aeruginosa
tggcggagatccgtgccgccggcggcaccgcggtggccaaccacgactcggtcacggacggcggcaggatcgtggagaacgcgctggacgccttcggtcgcgtcgacgtggtggtcaacaatgccggcatcctgcgtgacaagaccttccacaagatggaggacgccgactgggacctggtctaccaggtgcatgtcgaaggcgcctacaaggtcactcgcgccgcctggccgcacttgcgcgagcaggcctacgggcgggtggtgttcacctcctcgacctcgggcatctacggcaacttcggccagagcaactacggcatggccaagctcggcctctacggcctga

SEQ ID NO: 11834 - DNA, 735 bp, Pseudomonas aeruginosa
gcggcgcaatgcggtggaccggccgaccgcccaggccctggccgacgccctgcgcgagttcgaagcggacgatacggcgcgggtcgcggtactcaccggcagcggcggcaatttctgcgccggcgccgacctggcggcggtggccgaggatggcgagcggcgcaatcgcctggaggcggagggcgacggaccgatggggccgagccgcatgcagctcggcaagccgctgatcgccgccatcgaaggctatgcggtggccggcgggctggagctggcgctgctcgccgacctgcgggtgatggccgaggacgccatctgcggagtgttctgccggcgtttcggggtgccgctgatcgatggcggcagcgtgcgcctgccgcggatcgtcgggcagggccgggcgctcgacctgatcctcaccgggcgtccggtgaaggccgacgaagcgttgcagatcggcctggccaaccgggtggtgccgagcggttcggcgcgagccgaggccgaggagctggcggcggaactcgccgccttcccgcagacctgcatgctcgccgaccgcgccagcgtatatgcgcagtgggaactgtccttcgacgtggccctggccaacgaattccagggcgggctggcggtgatcgagagcggcgagaccctggagggcgcgcagcgcttcaaggacggcgaggggcgccacgggcgcttcgagtgacgccgtcgcgccgcccgggctag

SEQ ID NO: 11835 - DNA, 855 bp, Pseudomonas aeruginosa
gcgcgggtctgcgcgaccggctcgccaaggggcaccgcgaccgggctggcggcgccaagatcggcgccggcggtatttttcagaagggtcagggccatgcggtttttcctctgtgggaggtggaggggattctcagcgcatcaggctttccatgccggccgcgagggtttgcgccaggctgcggcgccagggcgcgctgtgcgggtcggcaaggacccggtcctcatggacgaaactgcggatgatcgcgttgtagccgagccagcggcagggttccggttcccagcgggccaggctgtccagcggacgctcgcccagcacccagggctgccgcagcagctcgctgtcctcaccgaggatcagcgcggccagggtgcggccgccgaggttgctggcgccgaccccttcgccgccgtagccgccggagagggcgatgccactggcgcggtcgagcaacatgtgcgggcggaagcgccgggccatgccgaggttgccgccccaggtgtggctgatcctggcgtccttgagcagcgggaagagttcgccgaacaggtagcgacgcaggccgacttcctcgtcgtcgaggctgaagtcgctgcgcagcttgccgccgaagcggtagccgccccgcgcgccgaaggccaggcggtcgtcggcggtgcgctggccataggtgacctggcggctgaattcgctgaaggcctggccgcgctccaggccgatctccgcccagaccgacgacggcagcggctcggtggccaccagcagactctgcaccggcaactggtagtggcccagcggcggcaggctggcggcatagccttccaccgccggcacgatccattcggcgcgtag

SEQ ID NO: 11836 - DNA, 2613 bp, Pseudomonas aeruginosa
gctcccggcaaggcgcttcgacagaacaagagcactgccatgaccgagccgaccgagctgcccgccgccttgccgcggctgccgccgcagcacctgccgcggccccgtttgcaccagccgctgctgcgcggcgaatgccgcctgcgactgctctgcgcgcccgctggcagcggcaagaccgtcctcctcggagaatgcgcgcggcgggcgccgcctggcgtgcaggtggtctggctggcgctgggcggggaagcgctggaccccgcgaccttccgccgccgcctggccggcgccctcggcttgcccgaggaaagcgacgaagcgcagctgtgccggcggttgcgcaacgcatccgcgctgtggctgctgctcgacgattacccacggcaccccgaccccgcctttgacgcctgcctcgattgcttgttgagcgcggcctcgccacgggtgggctggtggctggcgagccggcggcggccgcagtgcaacctggcgcggttgctgctggaaggggagttgctggaggtcgacggcggcctgctggcgttcgatgccgacgaggtcgccgaactgctccgcctgcacggtcgcagcgccgatgccgctgcgaccggggcgctgctggaacgcagcggcggttggtgcgccgcgttgcgcttgcgcctgctggtcggcgaagagacggccggaccgttgttgcaggaatacctccagcacgagttgctcgacgagctgccgccgccgctggccgacgccgcgcgtgccctggcctggctgccgcaagtcggtccggagctgttccgccggctgttcgaggagctgccccacgggctggacgacctgttggcgcggggcttccccctgctggccgatgcgaaccagcgctacagcctgccaccggcgatccgcgaggcctggcgcgaagcgccgcagcgcccgcagcgggacttccaccgggaagcctgcgaatggttcgccgaacacggcgagacccgcgaggcggtcgaccaggcgctggccgccgacgaaccggaaaccgccgccggattgttgcagaagctcaccgaggagcaattgctgcacggccacaacatcggcatggtcctggccctgcgcgacgaactgccggcggcgctgctggccagcacgccgcgcctggtgatcctgaatgcctggacgctgctctacgccggacgcctggccgaagccgaggactgcatcggccagttggcgcgcttcctgccgatgccctcggcgtcccgccagcgggtgctgctggcgcaatggcagggcttgttcgggatcctcctgcactgccgcggcgagcgcggcgccgccgactacctgcgcgaggcgctggagcaactgccggaggacgcctggtcgcagggactgatctgccgctcggcgctgatgcaactggcgataatcgaggggcggatggaccaggcgcggttgatcggccgcgatgccttgcgcctggcgcgcgagcacgacagcctgatcttcgaggcgctgatcgaactggagcgggcgcagtggctggagcagcgcggcgaactgctgcgcgcggaaggcgtcctcgatcgcgcccagcgctacctggaggacctcggccagcagggcagcccgatgctcggccggatcgccctgcgccgcgcgcgcctgtgcctgcagcagggccgcgaggtcgaggccgggcactggtatcggctggggctggagcaggcacgggagaatctcgatccctgggcgctctacggctacctgggactggccttgctggaggccgggcagggcgacctggacgcggcgttcaaccgcctgctggaggtcgaacggctgatgcagcagcgccatgtccccgatccgctgtatcgcggcgcgctgctgctggtcagctccgccctgaccctgcagcagggacggccggcgcaggcgcgggagatcctgctgcgggtccgcgcctacttccagccgggacgggcgcgcctgtcgccgccctccgaaccggagctggaagcgcgggtagagcaccaattggcactggccgaactctacagcggcgaggcagccgccgccgaagcgcggctgcgcgggctgctcgccattctcgaggcgcaggggcggcagacgctgctttgcgaagtgcgcatgggtatcgccgagtgccagttcctctccggacaattgccccaggcccagcagaccctgcgcagcggcctggagctggcggagcggctaggcctgcaactgccgcagcggcgactgcgggatcgccagccgcaactgttcgccgccctgccgggggaagaagaggaggggctcagtccgctcagttgtcgggagctggcggtgctcggcctgatcgcccagggctgctccaaccaggagatcggcgagcaactgttcatttccctgcacacggtgaagacccacgcccggcggatcaacggcaagctcggggtggcccgtcggacccaggcggtggcgcgggccaaggccctcggcctgctccccctgagcggcctcagtgcagggcgcggccggtcggcggggcgagttcgcccaggcgctggccgaggcgcagttgctcggtgggatcgtcgctga

SEQ ID NO: 11837 - DNA, 4236 bp, Pseudomonas aeruginosa
gcaagagcgcgcgttccaggtcgtagcgttccgcctgcgggcaatccagttgccgatagaggccggcgcgggcctcgtggtcggcggcgcccaccgggccgagttcgatcacccgctgggcatccttcagcgcggccagcggctcgccggcggcgctgtgcagttgtcgcaggttgcgcgacagacgctggaggatttccccgggagaggcctgcttcaggtaggcggcctgcagttcgctcttcggcccctgcaggcgcagcagcagttcgcggcagtcggtgggatagaggcgccgtccggtggccgggtcgagcagatggtcggcctgcggcacgcgcagcaggaagcgtcccgggaagttcactccgaccagcggaatgtccagccgccgcgccagttccatggccaccagcgccagcgacaacggctgtccctggcgccgctgcaacaccagcgggagcagggccgagcgcggttgcagggggaagtcgtcgtcctcgcagaaaccctgttcgctcattcgccgcagcaacccctgggcgcgctcgctggccgaggcgcggtcgtccaggctggcgccgatctgccggacgagttcgtcgagttcgcgcagggtgtgggcgggcgaatacgccgggaggtgctccgcggcgatccacagggccgcctcgaacagcgctggcggttcctgggcgagacaatcgaggcaggcttgacgcgggtccatggctttcctcctggtgcgcctggatcgctgcggacgggccgttcggagcacgccggggccggtttcgagcgggcggaccccaaggttgtaaccgtccgccgaagcttcgtccagtacccggctcggcgagcgccgccgcctggtcgtcggccttgcgggcgtttcgccgacgcctgcctatactgaaggtgccgggcggcaacagcccggcccggacaacaagcagcaatcaggggagccccaccatgttcgacatgatggacgcggcccggctcgacggtctccacctcgcccaagacccggccacgggactcaaggccattatcgccatccacagcacgcgactcggcccggcgctgggtggttgtcgctacctgccttaccccaacgacgaagccgccatcggcgacgcccatccgcctggcccagggcatgagctacaaggcggccctggccgggctggagcagggcggcggcaaggcggtgatcatccgcccgccgcacctggacaatcgcggcgcgctgttcgaggccttcgggcgcttcatcgaaagcctcggcggaggctacatcactgcggtggacagcggtacctccagcgccgacatggactgcatcgcccagcagacccgccacgtcaccagcaccacccaggccggcgacccctcgccgcataccgccctcggcgtgttcgccgggattcgcgccagcgcccaggcgcgcctcggcagcgacgacctggaaggcctgcgggtcgcggtgcaggggctcggccacgtcggctacgcattggccgagcaactggcggcggtcggcgccgagctgctggtctgcgacctcgatcccggccgggtgcaactggccgtcgagcagctcggtgcccatccgctggcgccggaggcattgctctccaccccttgcgacatcctcgcgccctgcggcctgggcggcgtgctcaccagccagagcgtcagccagttgcgctgcgcggcggtggccggggcggcgaacaaccagttggagcggccggaggtcgccgacgagctggaggcgcgcggcatcctctatgcgccggactacgtgatcaactccggcggcctgatctacgtcgccctcaagcaccgcggcgccgacccgcacagcatcaccgcgcacctggcgcggattcccgcgcggctcaccgagatctatgcccatgcccaggccgaccaccagtcgccggcgcggatcgccgaccgtctggcggaacggattctctacggcccgcagtgacgggccggcgtttccggcgaggccgccagcgggcctcgccagcggcagtgcgggccacccccgccgcgccgcgcgtgcacgccgccacccgcggcgcgaccctgagcggcacgcctacccggcgtgcggaggaggtttgcgatggttcacaaccggatcgacccgcctttcacccgctacctcgacagcgacggtcggcccctcggcgagttgcccgcctgggccggcgacagcgatgcgctggtcggcctctaccggcagatgctcctgacccgcctgttcgaccagaaggcggtggccctccagcgtaccgggcggatcggcacctatgcgccaaccctcggccaggaagccatcggagtggccatcggcagccagatgcgcgccgaggacgtgctggtgccgtattaccgcgataccgccgtgcaattgatgcgcggcgtgcgcatggaggacatcctcctctactggggcggcgacgagcgcggcagcgactacgccgaaccgctggcggcgcaggactttcccatttgcgtgccgatcgccacccaggccctgcatgcctgcggggtcgcctcggcgttccgcatccgcggcgaacaccgggtggcggtgaccacctgcggcgacggcgccaccagcaagggcgatttcctcgaggcgctgaacgtggcgggcgcctggcagttgccggtgctcttcgtggtcaacaacaaccagtgggcgatctcggtgccgcggcgcatccagtgcggcgcgccgaccctggcggagaatgcggtgggtgccggcttccccggcgaacaggtggacggcaacgacgtgctggcggtcgccgaacgcgtccgcgcggccctggagcgcgcgcgccacggcaaggggccgaccctgctggagtgcatcagctatcgcctctgcgaccacaccacggccgacaacgccagccgctaccgttcccccgaggaggtcaaccaggcctggcgcgaggaaccgatcaagcgcctgcgcgccttcctcgccggccgcggccagtgggacgaggagcgcgagcacgcgctggtgggggagtgccaggcgcgggtgcaggagtcggtggagcgtttcgagacgttagccggggcaggcgccgcaggcattgttcgagcatgtctacgcgcgctgcccggcggtcctggaggagcagcgcgagcaattctgggagcgccccgcgcggcggcggggaggggccgaacatgaatgagcgcaacggcgaagcgacacgcctggccgttctggaggcggtcaacctggcgttgcaccgggccatggccgaggacgagacggtggtggtgctgggcgaagacgtcggggtcaacggcggggtgtttcgcgccaccctcggcctgcgcgagcgcttcggcttcaagcgggtgctggatacgccgctggcggagaacatgatcgccgggctgtccatcggcatggccgcccagggcctgaagccggtgatggagatccagttcatgggcttcatctacgccgccatggagcaactggtgtcccatgccagccgcctgcgcaatcgcacccgcggccgcctggcctgcccgttggtgctgcgcacgccgatgggcgcggggatccgcgcgccggagcaccacagcgaggcgaccgaggcgatgttcgcgcacatccccggcgtccgcgtgctggtgccgtcgtcgccggcgcgggcctacggcctgctcctggcggcgatcgacgatcccgatccggtgatcttcctcgagccgacccggctctaccggatgaacccgcagccgctggcggacgacgcccggcgcctgccgctggacagttgcttcacccttcgcgaaggcggcgacctgaccctggtcagctggggcgccagcgtccacgagacccagcaggccgccgagcgcctggcgcagcgcggcatcgaggccgaagtgatcgacgtcgcctgcctcaagccgctcgacctcgacaccctcgaagcctcggtgcgcaagaccggtcgctgcgtgatcgtccatgaggcgccgaagagtggcggcctcggcggggaaatcgccgcgagcctctacgagcgtgtcctgttcgacctgcgggcgccgatccagcgggtcgccgcggccgatatcccgccgccgctgtaccgcctggaagcgctgtacatgcccgccgtggaggacatcctggcggcctgcgacaccgtgctcggctacgcctga

SEQ ID NO: 11838 - DNA, 294 bp, Pseudomonas aeruginosa
acgttctaccaaggagacatcctcatgagagtgatcccgttggcacttgtcgcgctgctcggcctggcgccgctggcccaggcgcagcagcagccctacggacccaacccggactcgaaatcgctccgccagcactacgtggaagggcgcctggacatcgcccgggtgatctacaagaccgacctgtggagcgcctgtgggatcgtcccggcgcgcctggtctacgaggactcgcagggcgagcggcataccgtcgagtacaaggcctggggcagcggttgcagcggcaattga

SEQ ID NO: 11839 - DNA, 1608 bp, Pseudomonas aeruginosa
ttcttattacacaaaacgatggagtgtaggcgctgtcatgaaacatcgtggatggagtgccgtgcgaggcggtcgcaagggggcgcaactggccctggggctgggcctggtcctgctgggaacggccgcgctaccgctgcatgcgcaagacggggcggactcggcgagccagcagcagaccgcgctgcgccgggtccggctggacatcccggcacaaccggtgaaccgcgccctgctgcgattcgccgagcaggccggggtccaggtgttcttcgacagccagcgtttcgccggtctcggcagcgcggcggtgcacggcgaatacgtgctggccgacggcctgagccagatgctccagggcagcccggtggaataccgcttctccggcaaggaccaattgagcctgatccgcgtcagccaggacgacctggtgcagatgtcgccctcggtgatttccgccgcgcgtccggacgactgggtctaccagacgccgcattcggtcagcgtgatcggccgcgagcagatcgagcgcaacccgccgcggcatgccgccgacatgctcgaggaaacccccggggtgtactcctcggtgagccagcaggaccccggcctgtcggtgaacatccgtggcatccaggactacgggcgggtcaacatgtcggtcgacggcatgcgccagaactaccagcagagcggccaccagcagcgcaacgggacgctctacgtcgatcccgagctgctcagcgaggtggtcatcgacaagggcgccagctcggccatgggcggcgccggggtgatcggcgggatcgccaacttccgcaccgtggaggcccgcgacctggtcaggccgggcaagcaggtcggtggccgggtgcgcctcaccagcggcctgggcggcgacgccaatggcacccacttcatcggcagcgcggccttcgccatcggcaccgaggtctgggacatgctggtcgccgccagcgagcgccacctgggcgactacgacccggggaccaagggcagcattggcgagctgcgcaccggcgcctggttcaatcccgaggccgggcagcgggtcaagcattcgccggtggcctactccggctacgtgatgcgctcgcgactggccaagcttggcgtcgccctgccgcaggaccagcgcctgcagttcagctacctgaccacccaggtgtcctacgacgacgccaacatgctcaacaccgagaaccaggcgctctgggaaaagctcggcagcagcgacgtgcgtgcgcagaacttcgccatcgactacggctacgcgccggacaacccgttggtggacttcaaggccaagctctactacgtcgacaaccgcaaccgccagcagaccctgcaacgcggtatcacccccggctactcgatcacctaccagaccgacacctacggcgcgcaggcgcagaacacctcgaccttcgctctcgacgatctctccacgctgcgcgccaactatggcctggagttcttctacgacaaggtgcggccggactccagccagccgcgggcgagcacctcggcggtcggcttccctgcggccgaaggcatgacccccaagggcgaccgcgccctcggtag

SEQ ID NO: 11840 - DNA, 1968 bp, Pseudomonas aeruginosa
aggccggagaggagttggcgctcctctccggcgcacgaaccgccgtcgctgcgcctcgcacccgtggcgacggcggcccccggattgttcctccgccggccgtgcccggcaagtggagactgccgcaatgtcctccgggcccgctcgcggcccggacacccacaggacccgactccgatgaagctccggccggcctcgccgcgcaatgaaatcctcgccaccctcggccgcttccgcccggcgctgcgcagcgtcgcgctgttcaccgcggtgatcaacctgctgatgctggcgccgtcgctgtacatgctgcaggtctacgaccgggtgctcggctccggcaaccacatgaccctgctgatgctgaccctcatggtgctcggcctctacctgctgctcggcgccctggagtgggtgcgcagcctggtggtgatccgcctcggcggccagctcgacatgcaactcaaccagcgcatctacgacgcctcgttccgcgccagcctggagcacggcgagcaggccgtcgggcaggcgctgaacgacctgaccagcctgcgccagttcctcaccggcaacgccctgttcgccttcttcgacgcgccctggttcccgctctacctgctggtgatcttcctcttcagtccctggctcggcctgctcgccctggttggggcgctgctgctggtgctgcttgcctgggtcaacgaaagccgctcgcgcgaaccgctggccgaggccgggcaactgtcgatcctcgccacccagcaggcctcggccaacctgcgccaggcggaaaccctggcggcaatgggcatgttgccggccatgcgcgcgcgctggttcgcccagcaccaggccttccttgcccggcagaacctcggcagcgagcgcagcgcggcgatcggcgcgacctccaagggcgtgcgcctggccctgcagtcgctggtgctcggcctcggcgcctggctggcggtggaaggcctgatcaccccggggatgatgatcgccggctcgatcctgatgggccgcgtgctcagccccatcgaccagttgatcgcggtctggcgccagtggagcggcgcgcggcaggcctaccagcgactggcgcggctgctcgaggagaatccgccggccgccctgggcatgccgctaccggcgccgcgcggcgcgttgcgcgtcgagcggctctgcgcggccgcgccgggacgcgagcaggcattgttgcaggacctcggtttcgccctggaacctggcgaagcgctcggcgtgatcgggccgtccggttccggcaagtcgaccctggcgcgcttgctggtgggcgcctggcagccgctgtccggcgcggtgcgcctggacggcgccgacctgcggcactggagcgcggcggcactggggccgcacatcggctacctggcccaggacgtgcaactgttcgccggcagcatcgccgagaacatcgcgcgcttcgccgaggtggatgccgagaaggtggtggcggcggcgcgcctggccggcgtgcacgacctggtgctgcgcctgccgcagggctacgacacgcgccttggcgacggcggcgccggactctccggcggccagcgccagcgcatcggcctggcccgcgcgctgtacgggcgaccggcgctgatcgtgctcgacgaacccaatgccagcctcgacgaggcgggtgaggcggccctggccgaggccatcgcggcgatgcgccggcacggcagcagcctggtgctggtcacccacaagccggcggtgctggcgctgaccgacaagctgttgttgctgcatggcgggcgcctgcagcgtttcggcgcgaccgccgaggtgcttgccagcgcctcgccgccggccgctgcggccccggcgccgacacggccgacgccggcgttcggtttcggctaccggccgggaccggggatgccggtcggcggtgtgccgggaggagcggcgcgatga

SEQ ID NO: 11841 - DNA, 1083 bp, Pseudomonas aeruginosa
actacctgttcaagccgctggccgaccgtacccacctggcgctgggggaagaatgaatcgcctgcgagcctgcctgctgtcctccgcgctgctttcggcctcttcggcccaggcgctgggcctgctggacgcctaccaactggcggtgcgccacgacccgaccttccaggcggcgctccacgagcgccgcgctggcagcgaaaaccgcgccatcggccgtgccggcctgctgccgagcctgcgctacgactacaacaaggcgcgcaacgactccaccgtcagccagggcgacgcccgcgtcgagcgcgactatcgcagctacgcctcgaccctcagcctggagcagccgctgttcgactacgaggcctacgcgcgctaccgccagggcgaggcccaggcgctgttcgccgacgaacagttccgcgggcgcagccaggaactggcggtgcgcctgttcgccgcctacagcgaaaccctgttcgcccgcgagcaggtggtcctggccgaggcccagcggcgcgccctggaaacccagctggcgttcaaccagcgtgccttcgaggaaggcgagggcacccgcaccgacctgctggagacccgcgcccggctgagcctgacccgcgccgaggagatcgccgccagcgatcgcgcggcggcggcgcggcgtacgctggaggcgatgctcgggcaggcactggaggatcgcgaactggccgcgcccatcgagcgcttcccggcgctgcgcctgcaaccggcgaccttcgaaggctggcgccaggtggccctgcaacgcagcgccgagctgggcgcccagcgccatgcgctggaggcggcagcctacgaggtggagcgcaatcgtgccggccacttgcccaggctcagcctctacgccagcagcagcaagacgcactcggcttcggaaagcacctacgagcagaaatacgacaccgacagtgtcggcctgcgtctcagcctgccgctgttcgagggcgggcgggtgtcggcagcgacccgccaggccggcgacaagtacgcccaggcccaggccgagctggatgcccaggtggccagtgtgatcaatga

SEQ ID NO: 11842 - DNA, 1254 bp, Pseudomonas aeruginosa
tcgccgacatccagcacaaccatacgccggacgatggcatcatcctggtctcggtggcgttgctcctgctggcgctggcgatcctggtggtgcgcttcgcctcggcgcgcttcccttcggcgaagtccgacggcgccgccgcgcggcgggtggcgagcgaggacgccgaaggggaagcctgattcgtcgccgcgccggagccggtctccggcgcgcttccggccagcgcaacggcctggcaatgtactaccatcgcccggtcgtgttcaggaagcctgccccatgaagggatggaaactctttaccccgctgctgatcctcgcgatcgtcgccatcaccctctacctgcgcctgcacaatccgcccctgctgttgcagggcgaggcggacgccaccaacgtcatcgtttcctccaaggccaagggccgggtccaggtgctgcacgtgcggcgcggcgacgaggtgaagcagggcgacctgctgatcagcctcgacagccccgagctggaagcccagctcgatgccttgcacgcggcgcgcaaccaggcccaggcgcagctcgacgagtcgctccacggtacccgcgaggagagcatccgcgcgctcaaggccagcctggcacaggccgaggccgagttgcgcaacgccgagtcggatttccagcgcaaccagcagatggtcgagcgcggcttcctctcgcggacccagttcgacctctcgcggcgtgagcgcgatgtcgcccgcgaccgcgtcgccgaggcgcgggccaatctcgacgaaggcctcaagggcgaccgcgaggagcgccgccaggcgttgcaggccgcggtgcgccgggccgacgcgcagatcgccgagctacaggcgcagatcgacgacctgcaggtgcgcgcgccggtcaacggcgaggtcgggccgatccccgccgaacagggcgaactgatcaacgcctacagtccgctgctgacgctggtgcggctggacgacagctacttcgtcttcaacctgcgcgaggacatcctggccaaggtgcgcaagggcgaccgcatcgtcatgcaggtgcccggcctgggcggcgccgaggtcgagaccgagctgcgctacatcgccccgctgggcgatttctcgaccaggcgcgcgacccgcgccaccggcgatttcgacctgaagaccttcgagacccgcttttacccgttgcagccgacacccggcctgcgcccgggcatgagcgcgctgtggcgctggacgaactga

SEQ ID NO: 11843 - DNA, 1176 bp, Pseudomonas aeruginosa
gcgatggcgtgggccgcgctgaagcgcaacgccagccgtttcgtccaggcgttcaacaccgagacgcggatcgcctgccgcagctggaccatccactggctcggctggtgctggccgctgctgctgttcggcgtgatcagcggcgtctaccaggccggtaccctgctggacatgccgctggcggtgatcgacaaggaccatagccaactgtcgcgcaagttgatccgcgaactcgacgcgacctcccacgcccaggtgatcaccgttcccgccggcgtccaggaggggctcgacgcgatccgtcgggccgatgcctacgccttgctctacatcccgccggacttcgaggccgacgtgctcggcgggcgcgcgccgaaggccgagctgtactacaacgcgctgctgtattcggccggctacgccgccacccaggacttctcggcgctggtcgccagcctcaacggcgaattgcgtccgcgcctggccgccgggatgccggcggcgctgccgcacctggcgagcatcagcgtgtcctacgacagcctgttcaatgccagcggcaactacatctattaccagcagttcgccgccatcgtgcacctgctacagctgttcgtgatcgtcaccatggtccatgtgctggcccgcgaggcgccggaactgcgcgcctcctcgccgcacatcctgcgggccaaggccctcggcgtacgcctggtgggcaagctggcgccctacacgctgctgttcaccgcgctgctgatgctggaaatcttcctgctggtggcgttctccggcgcgcgcatcaacggcagcccgctggcgatgctgatgatcacgctgttctacgtgatcgccgcgcagagcgtcgggctggtgctgttcgtcttcaccgccaaccgcttcaccgcctattcgctggtgggcatgctgatcggcgtcgcccagacctactcgggagtgctgatcccggaactggcgatgccgaccctggcgcgggtgatcgccgaggccgagccgctgacccacaccctgcacggcctgttcgaccagttcctgcgccaggcgccgcccagttcggcgctctacacctgcgccaagctggcgctgtacccgctgatcgcctacatgatcgccaagatgcgcctgcgcagccgcctggacctgagcccgatatga

SEQ ID NO: 11844 - DNA, 582 bp, Pseudomonas aeruginosa
ttgccgatggtcagggtggcgccgaggtcgagggagccgaaggcggtcttgccgttgagcaggttctcgatttcctcgccgcggtcgagcagcgccaccgcctgcggcagcagttggcggccgagggcattgagggtcaggcgcttgccggcgcggtcgaacagcttgcagtcgaactgccgctccagctcgccgagcgaggtgctggtcgccgactgcgacagcgacagcccctcggcggcgcgggagacgctctcctgctgggccacggcgacgaacacctcgagctggcggagggtgaatttcatccaggcttcctcgtctagagcgaaaggccccgcgacattttgccgttccgtcggcggggttggctcggttatccttgcgccccgtccgcgggagcgatgggagccctcggcggccggcggccgaccgatatcgtgttatcccatatccatattctggataagcattatccagacaattcattttgcggatattttggcaaccgataaaatgccgcgcaactgcgtcacgtctgctgctgttggtgtgcgcccgcgttttcctaggagtctttga

SEQ ID NO: 11845 - DNA, 1155 bp, Pseudomonas aeruginosa
tcgccagcagccagcgattgcgcaggccgtcggccagttccttgcgggcgatggtccaaactacgggcatggcgtggctccggcgggggcgggggacatgtggtggcgatagaggtcctccagcgacggcggcaggatttccaggtcgaactcgcacgcggccagcagcgcttccagcacgccgtcgcgctcggcatcgtccagcagtacctcgatgcgctggtcgtccagtctccgcgccgccaggccggcccggtgccagcgttcgagccactgcgggttatgcgggctggccaggcgcacgcgggtcggcagagccgccttgcggcgcaattcggcgaggctgccggccacttgcaggcggccgccggcgagaatcgcggcgcggtcgatgtgcgtctcgacgccgggcagcacatgggagcaaaggacgatcccggtgccctggccgcgcaggcggtcgagcaattggtagagctcgacggtggccagcgggtcgaggcccaccgtcggttcgtcgagcagcagcaggcgcggttcgccgagcagcgcctgggccaggccgaggcgctggcgcatgcccttcgagtaggttttcaggcgccgcctggctgcatggccgaggccgacctgttccagcaggcgcgcggcttcggccggcgccacgcccttgaggcgggcgaagtggcgcagggtttccgcgccgctgagctgcgggtagaaggtcacgttctccggcaggtagccgagctggcggcgcgcctccaggctcctcgcatcgtggccgaggacccgcacgcggccttcgctgggggccagcaggccgaggaccagcttgatggtggtggtcttgccggcgccgttgtggccgagcaggccgagcacctcgccgggctccaggcgcaggtcgagcccgctcagggcggtgagggcgccgtagcgcagggtcgcgccgtcgatctcgaccaggctcacggcctcggctccgcggcgggcatccgcatcagcggatggctgtcgcgcacgccgggcgagcgcaccaccgggaaggcgcgctggacccagcgcagcagctcgatgctcgggctgttcaacagcaggcgtacctgcgggtacagccagatcagccggtcgacgttgtcgttgggctcgtag

SEQ ID NO: 11846 - DNA, 1038 bp, Pseudomonas aeruginosa
tggccttctgaccaccggtcgttcaagggattgtcactcgactgtcatcgtcacttcaccgggctgacacagtctccttctatcttggtctacaccagatggcgccgctggcgtcttcgtgcaaccgattggagggagaacgatgagcgcggtgatccgtgtcgacagcctgaacaagacctttgcccgcaagcaggcgcttttcaacctgaggctggagatccaggcgggcgagatggtggcgttgatcggtgcatccggctccggcaaatccacgctcctgcgtcacgtcgccgggcttgcccgctgcgaccgcgacaacggcggcagcatcgacgtgctgggtcgccgcctccaggcgtccggccgcctgagcggcgaagtgcgtcgcctgcgcgccgacatcggctacatcttccagcagttcaacctggtcaaccgcctcagcgtgctggacaacgtcctgctcggcttcctcggtcgcatgccgcgctggcgcggttcgctggggctgttcagcgccgagcagaagcgccaggccctggaagcgctggcacgggtcggcctggccgatttcgccgggcagcgcgcctcgaccctttccggcggccagcagcagcgcgtggccatcgcccgcgccctgacccagaaggccgaggtgattctcgccgacgaaccgatcgcctcgctcgacccggagtcggcgcgcaaggtgatggacatcctcgccgatatcaaccgccacgacggcaagaccgtggtggtgaccctgcatcaggtcgactacgcgttgcgctattgcccgcgcgcggtggccctgaagggcggccggatcctcttcgacggcagcagcgagcacctttccgaaggcttcctcaacgaactctacggcgccgaaggggacaccccgctgctgttttccgaccgttcccggcgcggggcggagagccagccggaactgaccctcgcgcgcgcctgacgtcattcgaaccgcataaaaacccgccaaaccctgcccaggagttctctccatgttga

SEQ ID NO: 11847 - DNA, 942 bp, Pseudomonas aeruginosa
aggccctcgacgaggagctggccaagctggagaaacgcatggccgagcgcgagcagaaaaccgccgccaacgccggctgatccaccccgggcgcggccggcgccgcgccccacccgattcgccaataccgctgtcgagattcccgatatgagcactctgagcaccactgccgcggcggccgccaccggcaagccatcctggggacgcctggtcggctggggcctgttcctcgccatcctcgcctggtcctggaagggcgcggaaatgaacccggccgtgctgttccgcgacgccggcaacatggcgaccttcgccgccgacttcttcccgccggacttcggcaactggaagctctacctcagcgagatgctggtcaccgtgcagatcgccctctggggcacggtgctggcgatcgtctgcgccatcccgctgtcgatcctggcttccgagaacatcgtgccctggtgggtctaccagccggtgcggcgggtgatggatgcctgccgttcgatcaacgagatggtcttcgccatgctcttcgtggtcgccgtcggcctgggcccgttcgccggcgtgctggcgctgttcatcagtaccaccggggtgctcgccaagctcttcgccgaggcggtcgaggcgatcgaccccggtccggtcgaaggcgtccgcgccaccggtgccagcgccctgcaggaggtcatcttcggggtcatcccgcaggtcctgccgctgtggatctcctattcgctgtaccgcttcgagtccaacgtgcgttccgccacagtggtcgggatggtcggcgccggcggcatcggcgtgatcctctgggaggccatccgcggcttccagttcggccagacctgcgccgtgctgatcgtgatcatcgtggtggtgagcctgatcgacgttctgtcacaacgcctgcgcaagctgttcatctga

SEQ ID NO: 11848 - DNA, 1425 bp, Pseudomonas aeruginosa
gcaggcgctgttcgctttgctcgacgaaggcgagctggacgacctgagcggcttcgacagcggcagcgaccgttatccggaccagtcctgcaccctgctgatccagcttgccggcctcgatggcggcgcctcgctggagtggcgcggaccgggcatcgccgaagtgcgccaggtggcgttgccggtgagcgccgggttctgggcacagcgcgccgcacgcaccgaattccccaggggcctggatgccttcttcgccgccggcgagcgcatcctcggcctgccacgcagtacccgggtcagcgaacccgtcgaggaggtggcctgatgtacgtagccgtcaagggtggcgagaaggccatcgacaacgcccatcgcctgctggcgcgcaagcgccgcggcgataccgcgctgccggagctgtcggtggagcagatccgccagcagatgccgctggccgtgtcgcgggtgatgaccgagggttcgctgtacgacgagcaactggcggcactggcgatcaagcaggcggccggcgacctgatggaagcgatcttcctcctccgcgcctaccgcaccacgctgccgcgcttcgccgccagcctgccgctggataccgccgggatgcgcctgcaacggcggatctcggcgacctacaaggacctgccgggcgggcaactgctcggtccgaccttcgactatacccatcgcctgctcgacttcagcctgctcgccgagggcgactaccccggccccgaagtggagcggggcgcgtccctggagccttgtccgcgcgtgctcggcctgctcgaccgggaaggcctgatgacgccggagtacgaactgcccggcgcggtgccggatatcacccgcgagccgctcgacttccccaccggccgcgcccagcgcctgcaggccctggcccgcggcgacgagggcttccttctcgccctgggctattcgacccagcgcggctacggccgcaaccatccgttcgccggggagatccgcatcggcgcctgcgaggtctggctggagcccgaggaactcggcttcgcggtgccggtgggcgagatcgaggtcaccgagtgcgagatggtcaaccagttcgtcggttcccgcgaggagctgccgcaattcacccgtggctacggcctggccttcggctacgccgaacgcaaggcgatgggcatggccctggtcgaccgcgccctgcgcgccgaggaatacggcgaggaggtggtgtcgccggcgcagcaggaagagttcgtcctgatgcactgcgacaacgtcgaggccggtggcttcgtctcgcacctgaagctgccgcactacgtcgatttccagtccgagctggagctgattcgcaagctgcgtcgtcccggcgtcgccgaatccgcgcaacccactgtccaggagaagcgcgcatga

SEQ ID NO: 11849 - DNA, 705 bp, Pseudomonas aeruginosa
gtccggctcgggcaagtcgaccctgctctcgttgctctccgggcgctgtccgccggacgccggcacggtcgcctaccgcgacgacggcgaccgctggctggacctctacgccgccagcgaagccgagcggcgcaccctgctgcgcaccgagtggggcttcgtcgagcagaacccgcgcgacggcctgcgcatgggcgtgtccgccggcgccaacatcggcgaacggctgatggcccagggcgtgcgccactacggtcggctgcgccaggccgggctggactggctggaacaggtggagatcgatccgctgcgcatcgacgacctgccgcgaaccttttccggcggcatgcagcagcgtctgcagatcgcccgcaacctggtctcggcgccacgcctggtgttcatggacgaacccaccggcggcctcgacgtgtcggtgcaggcgcgcctgctcgacctgctgcgcggcctggtgcgcgagctggacctggcggtggtgatcgtcacccacgacctggcggtggcgcgcctgctcgccgaccgcctgatggtcatgcgccgttcgcgggtggtggaagccggtctcaccgaccagattctcgacgacccgcagcatccgtacacgcaattgctggtgtcgtcggtcctgcaaccctgagccgaagcgtcggcgccggtccgcgcgacgggcgcccggagaagtag

SEQ ID NO: 11850 - DNA, 246 bp, Pseudomonas aeruginosa
tgctcaatgtgctgcgcgggctcaacttcaatgtcgccggcggcgaatgcctggtgctccacggacgctccggcgccggcaagagcaccctgctgcgcacgctctacggcaactacctgccggccggcggcagcatccgcctgcgccacgccggcgactggttggaactggtcggcgccgagcctcgcgaggtgctcgccgtgcgtcgccagaccctcggctacgtcagccagttcctgcgggtga

SEQ ID NO: 11851 - DNA, 1194 bp, Pseudomonas aeruginosa
gccaggagctttcccgccaggagcaagcccatgtcgtctgaacgcgttctcagcaatgcccgggtagtcagcgccgagcgggtcttcgtcggcagcgtgctgctgcgcgacggcctgatcgccgcggtcgacgaaggccgcagccacctggccggggccgaggacctggggggcgactacctgctgcccggtctggtcgagctgcacaccgacaacctggagaagcacatgaccccgcgtcccggcgtcgactggccatcggcctcggcggtgctggcgcacgacgcgcagatcgtcgccgcgggaatcaccacggtgttcgacgcgctgtccatcggcgacgtcaaccccaagggcaagcgcatgcagcagttgccgaagatgctcgaggccatcggcgaggccgccgccagcggcgacgcgcgcgccgaccatcgcctgcacctgcgttgcgaggtcagccatccgcagacgctggaggtgttccgcgaactggtcgagcatccgctggtgcaactggtctcggtgatggaccacgcccccggccagcgccagttcgccaggctggagaagtaccgcgagtactaccagggcaagtaccacctgagcgatgccgagatggacgccttcatcgtcgagcaggtagccaactccgagcgctacagcgacgccgcccgtgcggccatcgtcgatgtctgccagggacgcggcctgtcggtggccagccatgacgacgcgaccctcgcgcatgtccgcgagtcggccggctacggcatggccatcgccgagttcccgaccaccgtggaggccgccagggccagccacgagcacggcctgcaggtgctgatgggcgcgcccaacgtggtccgcggcggttcccactcgggcaacgtggcggcggcgcaactggcgggaatcggcgtgctggatatcctttccagcgactactatccggccagcctgctgcatgcggccttgctgctcgccggcgagcacagcgagtatgatgcgatccgctacgacctgccgcgcgcggtggcgatggtcagccgtaccccggcgctggccgccgggctgaccgatcgtggcgaaatccgcgtcggcctgcgcgccgatctgctgcatgcgcgggcgctcggcaacaaccagccggtggtgcgtcaggtctggcgcggcgggcagagagtgttctga

SEQ ID NO: 11852 - DNA, 795 bp, Pseudomonas aeruginosa
cctcgatggcatcctccagacccattaccacgccgaccacgcccagggcctgctgcacctgcgctggggccagggtctggtgatcccggtgcacggcccggccgacccggagggcctcgccgacctctacaagcatccgggcatcctcgatttcagccagcccttcggcgccttcgagcggcgccagtggggcgcgctggcggcgaccgcgttgccgctggtccactcgaagccaaccttcggctacttgctggagggggcttccgaggagggaacgatacggcgcctggcctacctcaccgataccgtcgggctgccggcggacagcgcctcgcgattgctcgcggcgccgctggacctgctggtgctggactgctcgatgccgccgcaggagcagccgccgcgcaaccacaacgacctcacgcgggcattggagtgcatcgaatcgctgcgtccccggcgggccgtgttgactcacgtcgggcatacgctggacgcctggctgctggaccaccccgctgcgttgcccgaaggggtggaactggcgcgcgacggcgtgtgcctgccgctgtgagcgacgctgtagcgcccggcaaagcgctgcgggcgaaatcagtccaggcttggatcgaagcggattcgccgacctaccaccagtgcaaacagcagccatgcgccggaaatgcccagcagaccccaggcgcaccaggcgaggagggtggcctcgggcggcaggctcagcgccaggatcgcgctggcgatcactacgaacagaagaatgacggcggatcgtga

SEQ ID NO: 11853 - DNA, 2997 bp, Pseudomonas aeruginosa
ccagggcctgctcaccagcaaacgcgacaacaacggcaacctgaccacctaccagtacaacgcccgtggcctggagacctcgcgcaccgaggccgccggcactgcgcaggcgcgcaccatcacaaccgattggcacccgaccctgttcctcccggtgcaggtcagcgagcccggccggatcacccgctaccagtacgacgccgagggacgcaagaccggcgagaccgtcaccacccgctgacaaggacgacacccatgcgcatccccccatacttcccccgtctcggcgccctcgccctggcttgcgccctggccctgcccgcgcaggcggccgagcgcgcctggagctacagctacaacgccctcggcctgatcgagcgcgccgacggtccgcgcaccgatgtgcaggacgtcaccctctatgcctacgacagtcgcggcaacctgacccaggtgaccaacgccctcggccaggtcacccgcctcggcgactatgacgagcgcggcaagcccggcagcatcaccgatgccaacggcgtcaccagcagcctcgcctacaccggcgtcgacggctggctggcctccgtcagcaccgccggcagcaccacccgcttcgactatgacgcagtcggccagatcacccgcgtcacccgtggcgacggcagttggctgagctacgaatacgacgacgcacggcgcctggtggcgatcggcaacaacctcggcgaacgcctcgaatacgacgtcgacaccaagggcaatcgcaccgcccagcgcatcaaggacgccagcggcagcctggtgcgccagcagcaatgggcctacgacgagcttggccggctgctccgtgcggtcggcgccggcggccagacacgcagcttcgcctacgacctcaacgacaatccggtcggcgaaaccaacccgcgccagttcgcccacagccaggccttcgacgccctcgaccggctggtcggccagagcgatcccctcggcggcaagacccgactcgcctacgacgcccaggacaacctcaccgaggtcaaggacccgcgcggcgtcaccacccgctacgaatacgacggcctcggcaacctgacccgactggtcagcccggacagcggcaccaccaccttcgagcacgacgccgccggcaacgtcatccgccgcaccgacgctcgcggtgcggtcaccgagtatcgctacgacgccctcaatcggctggtcgagcgccgctcgccgagcgacccgagcctcgacgtacagtaccgctacgacctcaccgccgacggcaaccagggcatcggccgcctgggcgccatcgaaggtgcccgcgacagcctggtgtaccgctacgacgagcgcggcaacctggtcgagcaggtacgcagcatccgcctcgaccagcagaccctgctcgaccgcgtgacctaccgctacgacgcggccaaccaactgctggagatcggctacccctccggcctcgccatcggctacccgcgcaacgccggcggccaggtcgccagcgtgaccctggcagtgggcgacaaggcgccgagcaccctggttgggcagatcgcctacctgcccttcggcccgctgcagcgcctgacctggggcaacggcatcactctcagccgcgagtacgaccaggactaccaactgctgcggcagaaggtcggcccctggcagagcgactaccagcacgatgccaatggcaatatccagcagcaccgccacagcctctggggcaccctggactaccagtacgacccgctggaccgcctgaccgaggaacgcggcgtccagggcgggcgcagctacgcctacgacgcggtcggcaaccgcacccaacgcagcgacaaccccgcctcaggcggcaccgccagcagccaggactaccagtacgcgcccgacagcaaccgattgaccgccatcggcgcgcaagcggtgaccagcgacgccgccggcaacctcacccaggaccgcgccgcgcgcaaactggcctacgacgcccagggccgcctgcaaagcgtcagcctcgacggccagcaggtcgccgaataccgctacaacgccctcggccagcgcatcgtcaagctcacccccgagagcatcaccacctacctctacggtcccgacggccagttgctcggcgaagccgaacacgacggcagcggccggaaactgcgagcccagtactacctgtggctggacagcctgccgctggccaccatcgacgccgactacgacgcccagggcaaggtcggcaacccgaccctgctctacctccatggcgaccacctcgacaccccgcgcctggctaccgacgccagcggccagatcgcctggcagtggcagtccgacgccttcggccgcggcgaagcgctgagccagggcagcacccaggtcaacctgcgcttccccgggcagtactacgatgcggagagcgggctgcactacaactacttccgcgactatgatccggagactgggcggtatgtggagagtgatccgattggactaagtgggggagtgaacacatacggatatgtacagggagcccccctcaaccgtattgatcctttaggtctagcagcaatagagattgatattcctaaatcagcatacgattggatacccggaaatattcgattacctgcgggaagactgttagggggagtattgctggtggctagtatttccggagctacgccacaagctgacagcgatacaaaagagcaaaactgcccaaaagactgcccgccgtgcaagacaattagcggcaggatcattcctgttggaaccttgggctatagaccattagacattattccagacgacgaaatgcaacacggggtttatggatctcatcacaacatgtttgttgccaatcagaaccccaacaattgccgatgcttctggcagaagaaaaactacgtattaaaacctgagcagctaccgaaaaacgcagttccagtagagccgtttataaactga

SEQ ID NO: 11854 - DNA, 360 bp, Pseudomonas aeruginosa
tggccaaggccatggcctgggccaacaactgctatgtggcggtggccaacgccgccggcttcgacggcgtgtattcctacttcggccactcggcgatcatcggcttcgacggtcgtaccctcggtgagtgcggcgaggaggaaatgggtatccagtacgcccagctgtcgctttcgcagatccgcgatgcgcgcgccaacgatcagtcgcagaaccacctgttcaagatcctccaccgcggctacagcggcttgcaggcgtccggcgatggcgaccggggcctggcggagtgtccgttcgagttctaccgcacctgggtcaccgacgccgagaaggcgcgcgagaatgtcgagcgactga

SEQ ID NO: 11855 - DNA, 1260 bp, Pseudomonas aeruginosa
cccgctcgactaccggtgtggcgcaatgtccggtcggccggctgccctacgagggactggagaaggaggcctgacggcaccggcgtgccgtcgtgcggcacgccgtctccgccatttccccctgtggcagaaggagtttcatccatgccttttctgagcgacatgctcgaccagtcccgccggcagcaggacgaggaacaggccctggcgcgggagaatcttgccgaggcaagtctgctccaggcccacctgagtcaccgcagcgccctgcacagccgtttccgtttcgacccggcggcggtgatggactgcctgcgcgccgaggtgctcggccaggaaccggcgctacaggccgtcgaggacatgctcaaggtggttcgcgcggacatcgccgacccgcgccgtccgctgttcagcgcgctgttcctcggccccaccggggtcggcaagaccgagatcgtgcgcgccctggccagggccctgcacggcgacgccgaggggttctgccgggtggacatgaacaccctgtcccaggagcactatgccgccgccctcaccggtgcgccgccgggctacgtcggggcgaaggagggcaccaccctgttggagcaggacaagctggacggcagtcccgggcgccccggcatcgttctcttcgacgaactggaaaaggccagcccggaagtggtccatgcgttgctcaacgtactcgacaacggcctgctgcgggtcgcttccggcgaacgcacctaccatttccgcaataccctggtgttcatgaccagcaatctctgcgcccatgagatccagcgctacgacgagcgtcgccagcgcctgccctggcgcctgctgccggtcggcggcgagcgccggcggcgggacatcgacgggatggtccgggcccggctgctgaagactttctcgccggagttcgtcaatcgtctcgatagcgtggtcaccttcaactggatcgaacgcgacgtcgtcgcgcgcctggtcgagctggaggtgcagcggctcaaccggcgcctggagaagcatcgctgccgcctggaggcgacccccgaggtgctggcgaagatcgcccgcgccggcttcgaccggcagttcggcgcccgtgcgttgcgccgcagcgtccgtcatcatctcgaggtaccgctggccgagcatctgctcgaccaccaccagccgggcgacgggaactgcacgacctacctggcgagcctggagcacgagcgggttcgcttcgtgcggcgctga

SEQ ID NO: 11856 - DNA, 1185 bp, Pseudomonas aeruginosa
gcgacagtcacaggagaggaaacggatgggatcgcaccaggagcggtcgctgatcggcctgctgttctccgaaaccggcgtcaccgccgatatcgagcgctcgcagcgctatggcgcattgcttgcggtcgagcaactgaaccgcgagggcggcgtcggcggtcgcccgatcgaaacgctgtcccaggaccccggcggcgacccggaccgctatcggctgtgcgccgaggacttcattcgcaaccggggggtacggttcctcgtgggctgctacatgtcgcacacgcgcaaggcggtgatgccggtggtcgagcgcgccgacgcgctgctctgctacccgaccccctacgagggcttcgagtattcgccgaacatcgtttacggcggtccggcgccgaaccagaacagtgcgccgctggcggcgtacctgattcgccaataacgggaagcgggtggtgttcatcggctcggacaacatctatccgcggggaaagcaaccatgtgatgccccacttgttccgccagcacggcggcacggtgctggaggaaatctacattccgctgtatccccccgacgacgacgtgcagcgcgccgtcgagcgcatctaccaggcgcgcgccgacgtggtcttctccaccgtggtgggcaccggcaccgccgagctgtatcgcgccatcgcccgtcgctacggcgatggcaggcggccgccgatcgccagcctgaccaccagcgaggcggaggtggcgaagatggagagcgacgtggcagaggggcaggtggtggtcgcgccttacttctccagcatcgatacgcccgccagccgagccttcgtccaggcctgccatggtttcttcccggagaacgcgaccatcactgcctgggccgaggcggcctactggcagaccttgttgctcggccgcgccgcgcaggccgcaggcagctggcgggtggaagacgtgcagcggcacctgtacgacatcgacatcgacgcgccccaggggccggtccgggtggagcgccagaacaaccacagccgcctgtcttcgcgcatcgcggaaatcgatgcgcgcggcgtgttccaggtccgctggcagtcgcccgaaccgattcgccccgatccttatgtcgtcgtgcataacctcgacgactggtccgccagcatgggcgggggagcgctcccatga

SEQ ID NO: 11857 - DNA, 1140 bp, Pseudomonas aeruginosa
ctcccgatcaacgatttgcccgttgggttcaagtcgctatcgcggtattcgtgttgctgttcgtctacttcctggtcgccgacccaccccgcaggcccagttgacccggccggtggtgcgcgtcgcgccgcgtgtcagcggtcaggtcgccgaggtgctggtgtccaacaacggccacgtgcagcccggcgaagtattgttccgcctcgatcccgagcctttccgactggccgtgcgccaggccgaactggcactggaggaagccgagcgcaccaaccgcgagctggatgccgccatcgcctcggccaaggccgacctcctggccgcgcgcagcagcgccggcgagctggacagcgaggcgcgccgcaccgcccaactggtgcagcgccaccatgtgtcgcagcagatgcacgagcaggtcagcgcccaggcccaggccgcccgtgcccgggtcgccgcggcccaggcgcggatcggcgagctgaccgcgcgacgcggcacggccggcgaggacaacctgcgcctgcgccaggcgcgcaatgccctggcccaggctcgtctgcaactgcaatacagcagcgtccgggccgaccgcgccgggaccctgagcaacctgcaactgaccccgggcacctacgttccggccggaacgccggtggcggcgctggtggacgaccgtatcgacatcgtcgccgacttccgcgagaaatcgctgcgctacgtgcgccctggcgaccgtgcggcggtggtgttcgacgcgcgtcccggcgaagtgttcggcgcgcgggtggcggccatcgacgccggggtcaaggagggccagctggacgccaacggcgacctcgccgcgccggtcacctccgaccgctgggttcgcgacgcccagcgccagcgcctgcacgtggtgctcgacgaacttcccgaaggcctgctgcccaccggtgccaaggccaccgtgcagctctatcccggcgacggcctgagccatctgctcggtcgcgcgcagatcgtcgccatcagcctgctgcactacgtctactgacgccatgccggccaagctcgcgatgtccgccaacgacctgcgtcagtgcctgcgcatcgccggcggcggcaccctggggttcttcgtctgcaagctga

SEQ ID NO: 11858 - DNA, 486 bp, Pseudomonas aeruginosa
ctccagaaacttccattgaagtttcccggcagccgaatcgacactcttcaactggctgggtcgaaagaagagtttgaagcgcgaacgaaaggaaaactgcaatgcattgttttcgtcttcgtccctgggcggaacttccaggatattcagccagaacagcgattcgcgatccgtcggcaacggggccttcaggtaggcgatgcgcaatacggcgccgccattggggtccactcgcgtcacggccggcgtgacactgaagggaacctgcagttcctcggggggaacgtcctgccggccatcgtcgatccaggcttgcgccagcacgggagtgccggaggtattgctgatccgcaaggtgacctcgcgctcgctggccggaaagacgacgcgagtgccctgtgcgatcagcccggcgtgagccgttccgacgcacagggcgatggccacggcgcttgccgccacgaaagaatgaaaacgatgcattag

SEQ ID NO: 11859 - DNA, 996 bp, Pseudomonas aeruginosa
ctaaaaaaccaaaaaagaagaaacaaaaactcatctaagacttcatcttcgataactttcccttcgccgctccgtactatttccgtggcatatcgacctatcaaccatccggtcgatatcgggatactcgaagacaggccagcatgggtttcccacgacgaggagaaccctatgtccgcccactcgcattccggatggatcaccgtcggcgccctggccgacggcttcgccccggacaaccacgtccttcccgcctgcggcgatctcgccgggctcgaacgggtcctgcacttcgccaacggctgggtcatcgaacatgccttcgactcgcagcgcctgcgctggcgcctggccgacggcagtgccagcggcgagtcggactaccgcgccagttcactgcgggaaaacctttacctggtggatttcctcaagcaggaaaacggccggccggtctcggtcagcctggtgctggacttcgacaaccaggcgttcaccgcggtgctcggccatctgcccgaccgcacggcctgcgaacagggtctgttctcccgggccctggccggccgggaactgaccggcgtgaaggccgagttcctgcatggcagcctcgaccgcccgtggcagcccgacgcctgcccgcacgtccccagcgacgagttggtcggcttgcgcaaccgctacgtctacagcgccagcgaggcctacgaacacgtctacctcaatcccgacttctacgcctggcaatgcctgcgcggcgccgagcgagggctggccgataccgaccgctgccactgctaccgactggccgaacgcctgtacctgttcgtctggcgcgagaagatcgtgccgaccctcggcgtgctgctgatcgacctggaagccgggcgcaccgacggcaagatcttcggctaccaggacgacgacttcgccaccccggttaacttcccggtcggcgccctggcccaggtgctcaaccagacccgccacgatctgtga

SEQ ID NO: 11860 - DNA, 849 bp, Pseudomonas aeruginosa
  unsure (780): Identity of nucleotide at the above locations are unknown.
cctgcccggcgacccgcgcagaggacgtcgaactgcacgaccgcctgctccgcgattgcctgggcgaactgctggagcgcccatcgtgaggcgcttggagaaccgcgtcgcactggtcaccggcgccggccagggcatcggccgggccatcgccgaatgcttcgccgccgaaggcgccagggttctgctggcgacgcgtaccgccagccgcggccaggccgtcctggaggcgatccgcctgggcggaggcacggccgaactgctggccgtcgacctgagcgagcacgacgccgcgagacgagcggtgagcgcgaccctggagcgcttcggccagttggacatcctcctgcacaacgccgctgcctttccccagtgcgccctcgcggaactggacgaaggcaccctggaacggaccctggcggtgaacctgaaaagctgcttccggctgacccaggccgcccttcccgccctgcgccgcagcgtggccgggcgcgtcctggtgacctcctcggtgaccggcccgcgcacggcgatccctgggctctcgcactatgcggcgagcaaggccggggtcaacggtttcatccgcgccgccgcgctggagctggccggcgacggcatcaccgtcaacggcgtcgagcccggcctggtcgcgactccggcgctgggcagcctccggcgacgccgccgcgctggccgcgcacatccccctcgggcgtgtcggccagccgctggacatcgcccacgccatgctcttcctccgcctccgacgaggcgagntacatcaccgggcagaccctggttgtggatggcggcgcgttgctgccggaaaacggcgggctggcctga

SEQ ID NO: 11861 - DNA, 381 bp, Pseudomonas aeruginosa
agccgctggcgttcgccctctccctccagagagagcgccttccgacgtatccggcaaacacttccgccggctccggtagggcgctcgccctgtcccacggacaagggccgaccatttgccgggcgattatcgaaagcccctgcaaaatggatgaataagaatgactctcagcaggttagtatcggaaatccccaaccgagaggattcgcttcatgttccgctccacctcccatgtccgtaccgaatcggcggcacgctacgtcaatcgcctgtgcaagcactggggccacaagttcgaagtcgaactcactcccgagcgcggcttcatcgacttcggcgactccaactgcgagctgctcgcccaccccgaccatgtcctga

SEQ ID NO: 11862 - DNA, 540 bp, Pseudomonas aeruginosa
aggaaggccactaccggctggtacggcacgtgctgccgaccaccctgtcgccggtctggggccgcaccaccggcctcgacggctgtcccacggcggcgcgcatcaccacctcggagtttctctcgccaggcctgcaccaggtcagcgcgaccttctacgacacagccctgcccgccgagcgacgaccggaattccacatccgcacggcgcacatcctcaccccggagacccacggcagcatgcactacttcatcgtccacggacgcgatttcgcccaggacgacgagaccgtcggcgctttcatgcacgagcaactgttcgccgccttcgtcgaggacgtggaaggcctcggcgcgctggaaaaggtactcgcggaggccgatgaggatagctacgagatctccgtcgccagcgacgcgccggcggtggccacccgcacctacctcaagcgccgcgccgatgaggaagcgcgccagcgcgcggcgcaccgggtggcctgagcgccgccctcagcggcggtgcgccggcgggatcgagtag

SEQ ID NO: 11863 - DNA, 1386 bp, Pseudomonas aeruginosa
gcactacgacaagatcggcgtcggcgccgcctacatcgactccctgttccgctgaccccgggcgcgcgccgccctggcggacgcgcgcctcccccgccggccggcccgcccggcctggagaccgacatggcgcataacaacaattccgccagttacgaaaacgtcctgctctgcgtgctgttcctgaccttcggcttcgtcttcttcgaccgcctggcgctgtccttcctgtttcccttcatggaacaggagctgcaactgagcaacagccacctgggcatgctctcctcggtgctggccctggcctgggcggtatccggcgcgctggtcggcgcctggtccgaccgccgcgggcagcgcaagccgctgctgatcgtggcggtgatcctgttctcgctgtgctcggcgctgtccgggctggtcggcggcttcctcagcctgctgctgttccgcggcatcatgggcctggccgaggggccgatcctgccgctctcgcaatcgctgatggtcgaggcctcctcgccacatcgccgcggcctcaacatgggtctgctacagggctcggcggccggcctgctcggcgcggtgatcggcccgccgctgctggtggccctggccgaagccctcggctggcgtcacgccttcatcgtctcgttgctgccgggtctgctgatcgcctggttgatctggcgccatgtgcgtcccgacccgccccgcgcgcagcgcccggcgccgcgcgcagaagaagcgaaaggcaagcgcctggcactgctgaagagccgcaacatcctgctctgcaccctgatcagttgcgtattcgtcacctggttcatcgtgctgatttcctttaccccgaccttcctggtcaacgcccgcggcttcagcccggcgaccatgggcaggctgatgagctgcctgggcgtcgcctgggtggtctggggcttcgccgtaccggcgatatccgatcgcatcggccgtcgaccgaccctggtggcgttctccctgctcgccgcgtgttgcccgctggcgctgctctatgcgccgaacgcgaccagcctcggcctgctgttgctgctgacctacaccgggctcggctgcttcaccctgttcatggcgaccatcccggcggagaccgtctcgcgcggcgtcatcgccaccgccctcggcctgatcatgggcctcggcgaactggtcggcggtttcctcgcgccgaccgtggccggcttcgccgccgaccgcttcggcctgtccatcgtcatgtggatgtcctgcggcggcgccctgctcgccgcgttcctctcgctgttcctgcgcgaaaccgcgcccgccgtgctggcgcgccagcgcagcgcgcctacctccgtcctgcaaggaaaccaaccatga

SEQ ID NO: 11864 - DNA, 1704 bp, Pseudomonas aeruginosa
cccgcagcgtgcccctggagcaggccgtcgagcacggtttcgaggccctgctgcgcgacaagtcgcaggtcaaggtgctggtcaatcccaacccggccctggccgacgcctgaaggaacgatcgccgatggttttccaacacgatatctacgccggccagcaggtgctggtcactggcggcagctccggcatcggcgcggccatcgccatgcagttcgccgaactcggcgccgaagtcgtcgccctcggcctggacgccgacggcgtgcacgcaccgcgtcatccgcggattcgccgggaagaactggacatcaccgacagccagcgcctgcaacggctgttcgaagcgctgccgcgcctggatgtgctggtgaacaacgccggcatcagccgcgaccgcgaggaatacgacctggctaccttcgaacgggtgctgcgcctcaacctgagcgccgccatgctcgccagccaactggcccggccgctgctggcgcagcgcggcggcagcatcctcaacatcgcctcgatgtacagcaccttcggttccgccgaccgcccggcctacagcgccagcaagggcgccatcgtccagctcacccgttccctggcctgcgagtatgccgccgagcgcatccgggtcaacgccatcgcccccggctggatcgacacgccgctgggcgccgggctcaaggccgacgtcgaggccacccgccggatcatgcagcgcacgccgctggcgcgctggggcgaggcgcccgaggtggccagcgccgcggccttcctctgcggtcccggcgccagcttcgtcaccggcgccgtgctggcggtggacggcggctatctctgcgcctgagccgccttcgctccggatgcacctgtccgcttggggcggacagcgattcgcacgacagaacaacaacaagacgagtgccttgccatgaaaaccctccgcaccttgccggcgctgctctgcgccggtttcctcggtctctccgcgcaggccgccgaagacagccgcagcggcccgctggccgggttcggcgaacgactccagcgccacggcgtgaagacccacgcgcagttctggagcctgtcgctgaagaacctcgacaccggcccgcgccagcacagcttcggcaacagcggcgacctgttcctcggcgccgacctcgacctcgccaccctcgccggcctggacggcgcctcgctgcacatcgaggaaaccctgttcatcctcgaccgcggcaccggtcagcccaccgggccgagctggcagggcgcggtgggcagctacttcggcggcgcgccgctgcacaacgacatcggcgccaaccagctgagcctgctcacctggcagcagcagtggctgggcggacgcctcgacagccatctcggacggaccaatgcgcggcgctatttcctgatctacaactgcgagaccgtggtcacctgcaacgacccgatcatcgacgcctccaccggcatcctgccgccgccctacggcgcctggggcggctacttgaagtaccgggcgaccccgaccctgtacctgcacgccggggccttcgagtccaacccggtggattacctgaagaagcgccatggcctcgatttcggcaccgacgacgccagcggcaccagcctgctgctggggatcggcgacaagcgcgaggaaagcctcgatccctaccgctcgcactatga

SEQ ID NO: 11865 - DNA, 2004 bp, Pseudomonas aeruginosa
ccgcgagattcgcgagctggtaggcaactacctgaagaagaacggcctgcgcaccaccatcgtcgccgatggccggcagatgcgcgcgttcctcgaagccaacacggtggacctgatcgtcctcgacatcatgatgcccggcgacgacggcctgctgctctgccgcgagctgcgcgtcggcaagcacaaggccacgccggtgctgatgctcaccgcgcgcaacgacgagaccgaccgcatcatcggcctggagatgggcgccgacgactacctgaccaagcccttctccgcccgcgaactgcttgcccggatcaacgccgtgctgcggcgtacgcggatgctgccgccgaacctcaccgtgagcgagagcagccggctgatcggcttcggccagtggcaactggacaccagcgcccgccacctgctcgacgacgccggcaccgtggtcgccctcagcggcgccgagtaccgcctgctgcgggtgttcctcgatcatccgcaacgggtactcagccgcgaccagttgctcaacctgacccagggccgcgaggcggacatcttcgaccgttccatcgacctgctggtcagccgcctgcgccaacgcctcggcgacgacgcccgcgaaccggagtacatcaagaccgtgcgcagcgagggctatgtgttctcgctgccggtgcgactggtcgaggcccatccatgaagctcaccgtgccgcgcccgcgcagcctcgccgcgcgcctggcgctgatcctcttcgccgggctggtgctggcctacgggctgtccttcgcctcgcagttctacgagcgctaccagaccgcgaagcacatgatgctcgacagcctcgaacaggacgtggcgatctcggtagccatgctcgaccgcctgacgcccgccgagcgcgaggcctggctgccgcgcctggaacgacgcacctaccgctatcgcctcgacgccggcgagcccggccagccgctggcgctggccgacgcgccggttgccgcgcactccatcgaacgcgccctcgacggtcaatacccgctgaccctgcgcacggtggccgacagccgtccgcacttccaggtcctcctgcgcctgcgcgacggcagcccgctgaccatcgacgtcacgccggccccggtgccgctgtccggctggctgccgctggtactgctggtgcagttgctcctgctgctgctctgcaccggcctcgcggtgcgcaccgccatcggcccgctgacccggctggtgaaggccgtggaacatctcgatccgaatcgtccggcacagcctctcgcggaaaccggcccacgcgaagtggcgcatgcggcggcggccttcaatgccatgcaggcgcgcatcgccgactacctcaaggagcgcatgcagttgctcgcggcgatttcccacgacctgcagacgccgatcacgcggatgaagctgcgcgtcgagttcatggacgcctccagcgacagggacaagctgtggaacgatctcgaagagatgcagcacctggtccgcgaaggcgtggcctatgcccgcagcatgcacggcagcaccgaaaccagttgccgggtggacctcgacgccttcctcgacagcctggtcttcgactaccaggacagcggcaagcaggtacaactcgacggccgtaccggcgcggtgatcgacacccgtccgcacgccctgcgccgggtgctggtgaacctggtcgacaatgcgctgaagttcgccggcgccgcgcgcctggaagtggaacgccgtaccgatggcggcacgcgaatccaggtgctggacaatggcccggggattcccgccgaggaactcgacgaggtgctcaagcccttctaccgggtggaaaactcgcgcaatcgcgacaccggtggcaccggcctcggcctggccatcgcgcagcagctgagcctggccctcggcggccgcctgaccctggccaaccgcgccggcggcgggctttgcgcgcgcatcgagctggacccctga

SEQ ID NO: 11866 - DNA, 759 bp, Pseudomonas aeruginosa
ggcgcccgtacagagcgatacataaccgccctcggcggacacactgcggataaacccgcttgcaacactcctggccacgggaagcggcggcacatcgccgagccgctcccggcaaccaggagccccaccatgaccgtcccaacctctcaatccgcctggcacggctggcgactgttcgccgtcctcgccgtcgccgtgctgtgcatgaccgccctcgtcctggctctccaggcgcaaccggtggagggcctgcgcagcgccatccgcgccaccgcgcgcagttccttcgcgctgttcctcgccgctttcctcgcgtcctcgctggcgaccctggtgcccggcccggggacccgcgcgctgctccgtgaaaggcgctacctgggcctggccttcgccttctcccacgcagtacacgccttgctgatcctggcctactggaagctgttccccgagacattctggagcggccgctcggtcgcggcgaacatccccggctcgatcggctacctgttcatcctgctgctcaccctcacctccttccgcaccccggcccgactgctcggcccacgcgcctggaaagccctgcactcgaccggcacctgggtgctggcgggcatcttctgcctgtcgttcttcaaacgcatccccatgggcggctggtacgtactggcgttcgccacgatcttctccgccatcgtcctcaagctcaccgccaagctcgccgtgcgcttgcgtcgtcgcgacgtacagccggcctga

SEQ ID NO: 11867 - DNA, 426 bp, Pseudomonas aeruginosa
acaagcccggcaagctcaccgaccaggagttcggcctggttcgccggcatccgcagaacggcgcgcggatgctgctcgattgccgccaggtcagcgccctggtggtggatgtctgcctgcaccaccacgagcgcatcgacggcaccggctaccccttcggcctggcgcaggagcagatcagcctgctggcgcgaatgggcgcggtgtgcgacgtctacgacgcgatcacctccgaccgtccctacaagaagggctggaacgccgccgaggcgatccgacgcatggccgaatggaacgggcacttcgacccgcaggtgttccgcgccttcgtcaaggcggtgggcatctacccggtcggcgcgctggtcaggctggaaagcgggcgcctcggcgtggtcctcgaacaacacggccgctcgctgctga

SEQ ID NO: 11868 - DNA, 294 bp, Pseudomonas aeruginosa
tggccaccctcgaaacgttccagcaggccggcgatgcggtcgaaggagtcacacagtaccggcagcaggctctcgccctcgtgggtcagcatgaggccgcgcggcagacgcttgaacagggccacgccgagacgctcctcgaggctcttcacctggtggctgaccgccgcctgggtcacgcacagctcgatggccgcgcgggtgaagctcaggtgccgggccgaagcttcgaaggcgcgcagggcgttcagcggcaaatggggtcgaaccaatctctgctccaaatttttctaa

SEQ ID NO: 11869 - DNA, 1320 bp, Pseudomonas aeruginosa
tggctgccgcgagtattcgtcgtttgccgcaaatcctgcgcaagcctagattttccccgcccgccgatcaaggagcgctcccggggcggtttctcatgcagccaacgacaaaggacgccaatcctcatgcgcgataccagattcccctgcctgtgcggcatcgccgcttccacactgctgttcgccaccaccccggccattgccggcgaggccccggcggatcgcctgaaggcactggtcgacgccgccgtacaaccggtgatgaaggccaatgacattccgggcctggccgtagccatcagcctgaaaggagaaccgcattacttcagctatgggctggcctcgaaagaggacggccgccaggtgacgccggagaccctgttcgagatcggctcggtgagcaagaccttcaccgccaccctcgccggctatgccctggcccaggacaagatgcgcctcgacgaccgcgccagccagcactggccggcactgcagggcagccgcttcgacggcatcagcctgctcgacctcgcgacctataccgccggcggcttgccgctgcagttccccgactcggtgcagaaggaccaggcacagatccgcgactactaccgccagtggcagccgacctatgcgccgggcagccagcgcctctattccaacccgagcatcggcctgttcggctatctcgccgcgcgcagcctgggccagccgttcgaacgactcatggagcagcaagtgtgcccggcactgggcctcgaacagacccacctcgacgtgcccgaggcggcgctggcgcagtacgcccagggctacggcaaggacgaccgcccgctacgggtcggtcccggcccgctggatgccgaagggtacggggtgaagaccagcgcggccgacctgctgcgcttcgtcgatgccaacctgcatccggagcgcctggacaggccctgggcgcaggcgctcgatgccacccatcgcggttactacaaggtcggcgacatgacccagggcctgggctgggaagcctacgactggccgatctccctgaagcgcctgcaggccggcaactcgacgccgatggcgctgcaaccgcacaggatcgccaggctgcccgcgccacaggcgctggagggccagcgcctgctgaacaagaccggttccaccaacggcttcggcgcctacgtggcgttcgtcccgggccgcgacctgggactggtgatcctggccaaccgcaactatcccaatgccgagcgggtgaagatcgcctacgccatcctcagcggcctggagcagcagggcaaggtgccgctgaagcgctga

SEQ ID NO: 11870 - DNA, 474 bp, Pseudomonas aeruginosa
tggtgccatgagcgcttccccgcccctccgccagccctgcccgcccggcgcctgcgtctgcgaacgcgagcgcctggaggcgcccggcgcggaccgtcgcatcctcctcctgacccgccaggaagagcagcgcctggccgctcgcctggaagccctgcgcagcctggaagacctggaacacctgctgcggcgcatggaggaacaactgggcatccgcctgcggatcgccccggccttcggcgaggtgcgcagcatgcgcggcatccgcatgcgcttcgaggagcagccggggctctgccgcaagacccgccaggcgatccccgccgccatccgccgcggcctggagaagcgcccggaagtcgcctacgccctgctcaacgcccacgacctgctgcgcgacgcctgaaggcactgaacgacaggaagaggatgtcgctcaagacctgggcgggcttcaggagtatcggcggataa

SEQ ID NO: 11871 - DNA, 4473 bp, Pseudomonas aeruginosa
cgcccatggcgttatccgccctacaggccgcatcggatgcagggcgagccccgggtccgcctgaatccttggcgggactggccaccgcgccggggttcagctcgccgactccgcctgcacgtcgccgaacatcgcctgcaggcggagcaggcaggcatcgcacagggtgcgcagttcgtcgaggcggatgccggcgaggatttccatgccgcgcagcggatcggcgcggcgcagggcctgctccagctcgctggcacggccggccagggcgctggcgccaacggtggaagcgctgcccttgatggtatgcagggtcgcggcgctgccctggacatcgccctcgccgagctggcgttcgagctgggcgaagaggtcctgcatgtccggaacgaagcgccgcaacacctggacgatcagctccaggctgccgccgaaacgcccgacgatatcgccccgcgcctcgaccagttcgcccgcgtccgctgccgttgccggcgcgcccctggcgccgctcctgccgagatgaccgagcaggcaaagcaccaggcgctccttgtcgatcggcttcgccacatggtcgttcatgcccgccgccaggcaggcttcgcggtcggccagcgaggcgttggcggtcatggccaggatcggcagcccggcgaagcgcccgtcggcgcggattctccgggtcgcctcgagaccatcgatatccggcatctgcatgtccatcagcaccgcgtcgaacggcacgctcgcctccagcacctgctgaacgcccgccagcccgccgtcggcgagggccacccgggcgccctcgctgctcaacagctcggcggcgacctggcggttcagcgcgttgtcctccactaccagcagacgcacgccccgcaaccgctgggtgcgctccaccgggcgcggcggcgggttggccggggcgccctgttcgccgtgcaacgcatgcagcaccgagtcggccagttgcttgggcgtgaccggcttggtgagaaaatcgacgaagggcggcgcgctgtggtcgcgcgcatcggccagcacctcgcggccataggcggtgatcatgatcaccatgggcggcggcaggtcgccctgcaactggcggatcagttgcgccgcgctgaggccgtcgagatcgggcatgcgccaatccatcagcaccacgtcgtagcgacggccctcggccatcgccgcctggacccgcgccaccgcctcgctgccgctgccgacgcagtcggcgcgccagccgagggcgccgaccgtgcgttcgagcagctcgccggccaccaggttgtcgtccgccaccagcagccgcagcggttcgccggccccggggcaggccgcacgcagcggttggtcgtgggcgacgtcgaggtccaggtcgaaccagaaccggctaccgctgcccggcgcgctctcgacccgcaattcaccgcccatcaggtcgaccaggcgtttgcatatgaacaggccgaggccggtgccgccgaagcgtcgcgaggtggacgcctcggcctgggtgaaaccttcgaagatgcgctgctgctgttccgcgctgatgccgatgccggtgtccgccaccagcacccgcaggcgcaccaggtgggcgtcgtgcgccagacgccgcaagctcaccaggacgtgcccgcgggcggtgaacttcagtgcgttgccggccaggttgatgaggatctgctgcaggcgcaggcggtcgccgaccaccgcgctgggcagctcgggatcgatgtcgaagatcacctcgacgtccttgtcgccctggttgccggagagcaccacggccaggtcctgcatcagcggctccagctcgaaggggagcatttccaggaccagtttgccggcctcgatcttcgagtagtcgaggatgtcgttgagcaggccgagcaacgaggttgccgccgagctggccttgtccaggtagtcgcgctggcgttcgttgagatcggtctgccgggccagttgcagcatgcccagcacggcattcatcggcgtgcggatctcgtggctcatgttcgccaggaacgacgacttcgccgcgctggcggcgtccgcctgctccttggcctcgcgcaggcgcgcctgcagttgctggtcgctggtgatatcgatattgatcccggtgacctgcagcgggttgccgtcggcgtcgcgctcgacctgcgcgccggcctggatgaagcggatgccgccgtcgggcagcaccacgcggaagatcacatcgtagttgccgcgcccctccaccgccgcgcgcaggctggcctcggtgcgctcgaggtcttccggatgcaggcggctgcgccaatgctcgtagaccaggccgccgtcgcgcaacgccagcggctggccatacagctcgcacatgcgctcgttccactgcaggctgtcgtcggccaggttccagcgccagatgcccaggcgcgccacgtcggcggccatttgcaactggtcgcgcgccgcggccatctcgcgctcggcgttgcgccattcggtgacatcgacggcgatgcccaggtagccgttgatcgccccagcctcgtcgcgcaggacggtaaccgaaagcgtcacgctgagcggcgagccgtccttgcgcagataggtccattcgcgggtctcggcgccctcctgttcggcccgcgccaccagcacgcggaaaccctcctcgcccagctcctggccgcgggcgagcaactcccgctcgctgtgcagcagggtcggcgaggccttgccgaccacctcgtcggcgcggtagccgagcatccgctcggcaccgagattgaagccgctgatgatgccatcgcggtcgagggtgatgatcgacacctcggacgccgcctgcagcacgctgccgagcagtacgttcaaccgacgcagttcggcggtacgctcggcgatctggtgctccaggccggtattgagctcgcggatgcgggcctcggcggccttctgcgcggagatgtcgcgtacggtcttcgaggcgccgaccacgccgccgtccggaccgaggatcggcgagacggtcaccgccacgtcgagcaggtggccatcctggtgccggcgcacggtatcgaagctgaccacctgttctttacgggcgatgcgggcgaggatgtcgagttcctcgttctccttggatggcggcaccagcaggtccaccacccgccgcccgaccgcctgctcctcgcggtagccgaacaacgcctcggccccgcgattccagtcgctgatgacgccgtcgaggccgacgccgatgatgccgtccgccgaattgccgacgatcgccgccagccgcgcctgggtcgccgcctcccgacgccggcgcaggcggccgagggcgctggcgttgaccagcgccgccagcaacaggctgaccaggctgccggccaggaacaggatgcgcggcgaaggctggtgcaggcgctggacgaacagcggcagtgcgctgaacgccatctgccagtgccgaccgtagatctcccgccgcagcatgtggccgaacaggcgttgagccggcgccgcggcgccgttgacgaagaagggcacggcagcgccgtcgccggtgacgtcgctgagttcgaggtggatagccgcgttgtcgatgggcaacccggccagcacctcgccggtcagcagcggcgcatagctccagccgaagccttcgagttcgcgctggggccccggcggtggagtgatgccgctgcggtagatcggcatcaggatgaggaacgattgctggcgcaagccgctggcctggaccagggtgatcggccccgtcaggcgcacctgcccggtctccagggcggcgcgggcggcctcccggcgattggcttccgaggcgatgtccaggcccagcgcctggccgttgcgcgccaccggctcgatgtactggatgacgtagcgctcgccatcgtgcggagtcagttgctggatgcggaactccggctggccgtcggcccgcgcctggcgcaggaacccggcctcgtcggcggccgccacccggcgtatgaagccgaagccgcgggcgccgggaaactcacggtcgatgtcgcgggtcaggctgtagcggcggaacagttcgcggtcgatgtgcgcctcgcccgccgtcagcaaggcaccgcgcaccccgcgcaagccatactggtagagttccacgcggcgggtcaccgcctcggccagcagttccgcctcgcgttccagcgccatccgcgcctgttgctcgttgaccagcgccagcccccaggcgcccagcccggacagcagcagtccgagtgccagtgtcgcgcccgcccagcggctcagcctgaacttgctctgttgtacgttcacccgatattccgtccctgcgccgccccggcgcggggcaatcccgcactccctgcgccttttcgtcccagaagactagatcaagcgggcggattcctccgccgaatcatccgaccccaggtatga

SEQ ID NO: 11872 - DNA, 1002 bp, Pseudomonas aeruginosa
tcgccctctcccccggcacgcaacctgcccggcgctcccttatccggatgccgcggctcttctacgccgccgcatcccctgcatggaatcgcacatgtctcatcgccctgtgatcaacgcctcggtcagtccgaaaggcacgctggaaaccctctcccaacgcgaagtgcaacaactgagcgaaaccgccaacggcaagacctaccaactgttccgccagtgcgccctggcgatcctcaataccggcgcccacagcgacaacgccaagaccatcctcgacgcctacaaggacttcgaggtgcgtatccaccagcaggaccgcggcgtgcgcctggagctgatcaacgcgccggccgacgccttcgtcgatggcgagatgatcgccagtactcgcgagatgctgttcagcgccctgcgcgacatcgtctatacccagagcgggctggacagccagcacgtcgacctggacagctcccagggcctcaccgactacgtcttccagctgctgcgcaacgcccgtacgctgcgccccggcgtcgagccgaagatcgtcgtgtgctggggcggccactcgatcagcagcgaggaatacaagtacaccaagagggtcggccacgaactcggcctgcgcagcctggatgtctgcaccggctgcggaccgggggtgatgaaggggccgatgaagggcgccaccatcagccacgccaagcagcgcatcgtcggcggccgctacctgggcctgaccgagccggggatcatcgccgccgaggcgccgaacccgatcgtcaacgaactggtgatcctgccggacatcgagaagcgcctggaagccttcgtccgcgtcggccacggggtcatcatcttccccggcggcgccgggaccgcggaggagttcctctacctgctgggcatcctcatgcacccggacaaccaggacctgcccttcccggtcatcctcaccggtccccgcagcgccgaagcctacctgcagcagctccatga

SEQ ID NO: 11873 - DNA, 423 bp, Pseudomonas aeruginosa
aagcttccagcgcccgttcgagccgacccacgagaacatggccagcctccagctcagccgcagcctgccgccccacgagttggcggccaacctgcgccgcgcgttttccgggatcgtcgccggcaacgtcaaggacaacggcatccgcatgatcgagcaatacgggccctacgagatccacggcgacccggcggtgatgctgccgctggaccgcctgctgcaggccttcgtcaagcagcaccggatgaagctgcccggcggcgcggcctacgtcccctgctaccgggtggtgcagaccgaggcggcctgagcgcgcccgctccggcatccctgcgccgcgcgcggggatgcccatttattccgagccgggcgtacggcttcctgctactcttttccgttcatgcctcgaatcgctggccctga

SEQ ID NO: 11874 - DNA, 1065 bp, Pseudomonas aeruginosa
cctgcacgcagaactggaccgccgttcgccgttgggcgacgacgatctcgacgaccgcgcctacctcgaccatgccggacgcatccttggctggctggagcctctggagcgcgcgctgcgcgacaaccgcagcggctggccggcggcgctgcgggccgacgcgcggctggtcaagagcgcctggctggaaagcgacctgctggccggcggcatgagccgcgcgcaggtggaggcgctaccgcgctgcgccgacctgccgaatgcgacacgggccgcggaggtcttcggggtggcctacgtgatggaaggcgcgacgctgggcggcgcgtatctctacaaacgactagctccacgcctgcccggtctgccgctacagtggttgcagggctacggccaggcaaccggggtgcgctggcaggagtttctcgaacagctcgcccggcagatcgacagccccgaagccatcggccttgcgcaggatgcggcacaggctacattcctttcgtttcgtcgatgggttctcgacgaagcctgactgcctggagaccaggctggacgatagatgacgagcatcaccccggttaccctggcgaactgcgaggacgaacccatccacgtgcctggcgcgatccagccgcacggggcgctggtcaccctgcgcgcggacggcatggtcctcgcggcaagcgagaacatccaggcgctactgggtttcgtcgcctcgccgggttcctacctgacgcaggagcaggtggggccggaggtcctgcgcatgctcgaagagggactgaccggcaacggcccatggtcgaacagcgtcgagacgcggatcggcgaacacctgttcgacgtgatcggccacagctacaaggaagtgttctacctggagttcgagatccgcaccgcggacacgctgtcgatcacctccttcaccctcaacgcccagcgcatcatcgcccaggtccagttgcacaacgacaccgccagcctgctcagcaacgtcaccgacgaactgcgccggatgaccggctacgaccgggtgatggcctaccgtttccgtcatga

SEQ ID NO: 11875 - DNA, 2331 bp, Pseudomonas aeruginosa
cgactccggcgaggtggtcgccgagagccgtcgcgaagacctcgaaagctacctggggcaacgctacccggcctcggacatcccggcccaggcgcgtcgcctgtacatccagaacccgatcaggctgatcgccgacgtggcctatacgccgatgcgcgtgtttcccgcgctgaacccggagaccaacgaatcgttcgatctcagctacagcgtgctgcgcagcgtttcgccgatccactgcgaatacctgaccaacatgggcgtgcgcgcctcgatgagcatctccatcgtggtcggcggcaagctctggggactgttttcctgccatcacatgtcgcccaagctgattccctacccggtgcgcatgtcgttccagatcttctcccaggtctgcagcgccatcgtcgagcgcctggagcaggggcgtatcgccgaactgctgcgcgtgtccaccgagcgcaggctggccctggctcgccgcgcgcgggacgccgacgacctgttcggcgcactggcccacccggacgatggcatcgccgcactgattccctgcgacggcgccctggtcatgctcggcggccgcaccctgagcatccgcggcgacttcgagcgccaggccgggaatgtcctgcaacgcctgcagcgcgacccggaacgggacatctaccacaccgacaactggccgcagcccagcgaggactctccggacggcggcgactgctgcggtgtgctggcgatccgtttccaccgccaggaatcgggctggatcttctggttccgccacgaggaagtgcaccgcatccgctggggcggcaagccggaaaagctgttgaccatcggcccctccggcccgcggctgaccccgcgcggctcgttcgaggcctgggaggaagtggtccgcggccactccacgccctggagcgaaaccgacctggcgatcgccgaaaagctgcgcctggacctgatggaactgtgcctcaaccatgcggccgaggtcgaccgcatgcgccagcgcctgatcgcggtgctcggccacgacctgcgcaacccgttgcagtcgatctccatggcggcggccctgctgtcctccagcgacacccgcaccaccgaactgcgccaacacatttccgcgtccagcagccgcatggaacggctggtcagccagatcctcgacatgagccgcctgcaatcgggcatcggcctcaccgtgaacccggtcgacaccgacgtctcgcaactggtgcggcagatcgtctgcgaaaccgacgtcgcctatcccggcctggtgatcgagatcgccatcgacccgcaggttcgtgccgtggtcgacccggaccgctacgcccaggtcgccgccaacctgctgagcaacgcccgtcatcacggcctgcccggccggccggtgctggtaaccctgacccgccagggcgacgaggtgtgcctgagcgtgctcaacgaaaccagcggcctctccgaagcgcagctggccaacctgttcgaaccgttcaagcgcgagtcggcggacaaccagcgcaaccgcaacggcctcggtatcggcctgtacatctcccaggccatcgcccaggcccaccaggggcgtatcgacgtggactgccgcgacgacgtcatcaccttctgcctgcgcctgccggtgcgccaggcggagaccggctcctcgtcctgacgacgaggaccgtgcacaatgcaacgcttgcaggtatcttcggcagccatcgccgtctgacaggatcgccccgttccatgccccgcctccgcctccggaccgtcctcgcctgcctcgccgtgttctgcgcgactcccgcactggccagggtcgaagtgcattcgctgcaacacaagagcatggggcgggtgctgacggtccgcgtctcggaggagatcgcgccgggcgactacgaaacgctgctcaagggtttgcgcaacaatccgggaacctactcgcgcaagctgctcctgctgaacagcatcggcggcagcgtgccggaggcgatccgcatgggccgcctgctgcgcgaatccggcttcgacgcgctggtgccgtcgagcagcgtctgccagggcacctgcgtctacctgctggcggccggcaagcgcaagaccgtacgcggctacgtcggcctgcaccgtccctactacgcccacggcgactcgctgcactcgcgctcggccaacggcatgcgctacgactccgccgcctacttccgcgaaatggatatccccagcaccttggtacaggccatgcaaagcaccgatcccaaacggatgcgcgtgctttcggcgaaggaactggcgcagtaccggctgaactga

SEQ ID NO: 11876 - DNA, 1869 bp, Pseudomonas aeruginosa
cctgaagtacgccagccgttcgccgtcgatatcgccgccgtattcgacgaggaaggcctcggcccaggccgcgccgagttcggcctcgatgtcccgcgcggccagggccaggtcctggtgccggtcggcgacgccgagccgcccgcaatcgatgaagccgctgaagcgccgcccctccgccagcagatttggcaggcaggcgtcgccatgggcgaccaccaggtcttcgaccgccggacgccggtcgagcagcaggcggtacagctccgtggcgctgcgaccgcgatggtcgtcgtcgaagtccgcctcgtccaccagcccggcctcgacccgctggcgcacggtgtccaggcgccgttccaggcgatgatcgaagggacaggcggccggatcgagatcgtgcagccggcgcagggcggcggccaccaggcgcaccaggcgctcgggctccagctcgccgcgctgcgccagcgcggacagcgtgtcccccggcacggcgctcatcagcagccattgccggccgtcgctctgggtttcgttcagcacctgcgggcaatcgatgccggcaccgtgcagccagcgcaggcgggcgatttcggcgggcagctcggcatgtgcggacagcacttcctgcttgacgaacagggtcggccgccgcgcaacctccaggcggtggacagtggccgcggaacatccttcgccctgccctcgccagcggtagccggcaaggtagtcggcccaggtggagggagcctgcggcggcatggaggtggctgcatcatgcatggagaaacgcttcctgttcgagtgggagcgcgagtatacccgcccacccgctcagcgacgggactccccgtcggcctgtcgctggcggtaagcgctgggggtgagccccgcgtaacgcacgaagaaacgactgaagtaggccgggtccttgaagccgagctggtagcagatctcgttcaccgagccgccggtgaacagcagcaggcgcttggactcctgcataagccgttcgtacaccaggcgcttcgacggcaggtcggcgatgcgccggcagacgtcgttgaggcgcgcctcggtgacgccgatccggctggcgtagagcgacagcggccagtgctcggcatagcgctcctcgatcagcgcgttgaagcgctggaagatctgcaggtcttcgtggcgcatcggccgcgcagccaccgaattggccgagagacgcagcaggctgatcatgaccagccgggtcagcgccagcagcatctgctggcggccgggacggctggccatcgactcgctgcgcaactgctcgaagagcagcgccaggcgcgccgcctcctcggccgcgccgccctccaggttgcccagcgccacgcaggccggcgccacctgcgggccgggcgccaggcccggctcggcctcggtgaggctccacaccagttgctggcgcacggtcagcacatggccatcggcgtccgcctcggtgacgaaggcgtgcggcacggtcggcggggtgaggaagaacatcggccccgactccaggtactggcgctcgtcgagatagacccgcaccgcgccgttcttcacgtagtgcacctggaagaaacggtcgtgccggtgcaccggcatgttgcgaccgaagaatccggccaggttgcccagcgcatcgtagtgcacctcggcgtcggcatagcgctggtcgtagacctgcccgatgttgatgttggggatcggctggcgctctggcatggcgatcttctctttgttgttcttcccggctgcgcacgcaagccgtcgcgggcttccgtataccgcagacggcgcctcttgccacctccccgggacgaatggcgcagcaaccggggttga

SEQ ID NO: 11877 - DNA, 729 bp, Pseudomonas aeruginosa
cacattaacgagttttcgccaggacggccccctcgccgttcgcttatcgcgccaggagacaccaccacaatgagccgcgcactgaatgacgtcgccgccggcaccctgttcggcgtcgcgctgaactacaagggcctgctcgacagccgcctgccggagttccagcagccgccctaccagaagccgccagtgaagccggtgttgttcatcaagacaccgaatacccgcaacgagcacgacgccccggtgctcttcccgcgcggcgtcgagcgcctgcaaccgggcccggcgctgggcgtggtgatcgctcgcgacgccagccgggtgaaggaggaagaggccatggcgcatgtcgccggctacgtgatcgtcaacgagttcagcctgccggaagacagctactaccgcccggcggtgaaagccaagtgccgcgacggcttctgcccgttcggtccgcaactggtgccgacgcaggagatcgccgatccccatgcgctggagctgaagctgtacgtcaacggcgaactgcgccaacgcaacaacaccgccaacctggtgcgcgacatcccgcggctgatcgccgagatcagcgagttcatgaccctgcacgccggcgacgtgctgatcaccggcacccccgaagggcgagtcgacgtgcatcccggcgaccgcgtcgaggtcgagatcgacggcctcggccgcctcgccaacagcatcgtcgcggaatga

SEQ ID NO: 11878 - DNA, 2247 bp, Pseudomonas aeruginosa
ggaaccgaccatgaaacacgcacgcatccgctaccagggccgggttcaccaggtcaccgtggaagacgccaacgccgtccgcctggccgacggcaccctgctcgccgaggaccgggtggagtggctgccgccggccaccgggagcatgttcgccctcggcctgaactacgccgaccatgccgccgaactgtcgttcaaggcgcccagcgaaccgctggcgttcatcaagtcgccgggcacctacaccggccaccgccaggtcagctggcgtccggacaacgtcgactacatgcactacgagtgcgaactggtggcggtgatcggcaagccggcgcgcaacgtccgccgcgaggacgccctcggctacctggccggctacacggtgtgcaacgactacgcgatccgcgactacctggagaactactaccggcccaacctgcgggtgaagaaccgcgacgccaccaccccggtggggccgtggatcgtcgatgcggccgaggttcccgagccgaaccggctgaccctgcgcacctgggtcaacggcgagctgcgccaggaaggcagcaccgcggacatgatcttcgacattccctacctgatcgaatacttctccagcttcatgaccctgcagccgggcgacatgatcgccaccggcaccccggaaggcctgtccgacgtggtccccggcgacgaagtggtggtggaggtggaaggcgtcggtcgcctggtcaaccgaatcgtcagcgaggccgaattcttccgcgcccgcgcacaggagcacgcagaatgatcaaacactggatcaatggccgcgaggtcgaaagcaaggacgtcttcgagaactacaacccggccaccggcgagctgatcggcgaggttgccagcggcggcgcggcggaaatcgacgcggcggtggcggcggcccgggaagccttcccgaaatgggccaataccccggccaaggagcgcgcgcgcctgatgcgccggctcggcgagctgatcgaccggaacgtgccgcacctggcggaacttgagaccctcgacaccggcctgccgatccaccagacgaagaacgtgctgatcccgcgcgcctcgcacaacttcgagttcttcgccgaagtctgcacgcggatgaacgggcacagctatccggtcgacgaccagatgctcaactacaccctgtaccagccggtgggcgtctgcggcctggtctcgccgtggaacgtaccgttcatgaccgccacctggaagaccgcgccgtgcctggcgctgggcaacacggcggtgctgaagatgtccgagctgtcgccgctgaccgccaacgagctgggccgcctggtgcacgaggcgggcattccgccgggggtgttcaacgtggtccagggctacggcgccagcgccggcgacgcgctggttcgccaccgcgacgtgcgcgcggtgtccttcaccggcggcaccgccaccgggcgacggatcatggaggcggccgggatcaagaaatactcgatggaactgggcggcaagtcgccggtgctggtcttcgaagacgccgacctcgagcgggcgctggacgccgctctgttcaccatcttctcgctgaacggcgagcgctgcaccgccggcagtcgcatcttcgtccaggaaagcgtctacccgcagttcgtcgccgagttcgccgcacgcgccaggcgcctgatcgtcggcgatccgcaggacccgaagacccaggtcggctcgatgatcacccaggcccactacgacaaggtcaccggctacatccgcatcggcctcgaggaaggcgccaccctggtggccggcggcctggagcgtccggccggcctgccggcgcacctgagcaaggggcagttcatccagcccacggtgttcgccgacgtggacaaccgcatgcgcatcgcccaggaggagatcttcggcccggtggtctgcctgatcccgttcaaggacgaagccgaggcgctgcgcctggccaacgacgtggaatacggcctggcctcctacatctggacccaggacatcggcaaggcccatcgcctggcacgcggcatcgaggccgggatggtcttcatcaacagccagaacgtgcgcgacctgcgccagccgttcggcggggtgaaggcctcgggcaccggacgcgaaggcggggaatacagcttcgaggtattcgccgagatcaagaacgtgtgtatatccatgggcagccatcacatcccccgctggggcgtgtag

SEQ ID NO: 11879 - DNA, 534 bp, Pseudomonas aeruginosa
ggcgcgctcgtgcagagcggccccccgaggccgccagcagcgccggcgtgcagacacaatcagaagaatccgggccagccgccaacggccgcgcccgctgccaggcccaacgggccaccaggagaatcgtcatgggcaaagtcgctctggctgccaagatcacccacgtaccctcgctgtacctgtccgagctgcccggcccgcgccacggctgccgccagccggcgatcgacgggcaccgcgagatcggccggcgctgccgcgaactgggggtcgacaccatcgtggtgttcgacacccactggctggtcaacgccggctaccacatcaactgcgcgccgcacttcgaggggctctacaccagcaacgagttgccgcacttcatcgccaacatggagtacggcttccccggcaacccggagctgggccgcatcctcgccgagggctgcaacgcgctcggcgtggagaccctggcccacgacgccaccaccctcggcccggagtacggcaccctggtaccgatgcgctacatga

SEQ ID NO: 11880 - DNA, 330 bp, Pseudomonas aeruginosa
acgacagcgcgcgcctgggctgggccatgcgcaaggcggtggaagagcactacgacggcacggtggcgttcctcgccagcggctcactgtcccaccgcttcgcccagaacggccaggcgccggacttctccgaccgcatctggagcccgttcctcgaggtcctcgaccatgaagtcgtgcagatgtggcaggaaggccgctgggcggaattctgcgggatgctcccggagtacgcctccaagggccatggcgaaggcttcatgcacgacaccgcgatgctcctcggcgccctcggctggtcggcctacgacggcaaggcggaggtggtga

SEQ ID NO: 11881 - DNA, 534 bp, Pseudomonas aeruginosa
cgccctacttcggctcctccggcaccgggcagatcaacgcggtattcccggtcaccgcccaggacggctcggcgatccccgccgcccaggccggcaacccggccggcgccagttgcgccagccgcctctgaggacgccaccatgccgcacttcatcgccgaatacaccgacaacatcgaagccgaagccgacctgcccggcctgttcgagaaggtccacgcctgccttggcgccagcggcgttttcccgctcggcggcatccgcagccgcggcgtgcgcctggacacctggcgcatggccgacggcaagcacgactacgccttcgtccacatgaccctgaaagtcggcgccggtcgcgacctggagactcgccggcaagtcgccgaggcacttttcgaggtgatcaccgcgcacttcgccgagctccaggcgcgacgcctgctggcgctgtccttcgaactcaccgaactggacgcggagctgaactacaagcgcaacaacgtgcatgaattcctgaacaacccggcggactga

SEQ ID NO: 11882 - DNA, 1920 bp, Pseudomonas aeruginosa
tcggctggatgcgcgacaccacccagagcgccagcctggccctgtacctgctggccatcctcatcgccctcggcgccggcctggtcctgcggacccccgccgccgtggtctacccacgctgaaccgagagaccccgaccatgctcgatccccgtctgatccaggaagccgccaaccgcctcgacgccgccgaacgctcgcgccagcaggtaaggcagttctccctcgactacccggacatcgccatcgaggacgcctacgccatccagcgcgcctgggtcgagcgcaagatcgccgacgggcgcgtgctcaagggccacaagatcggcctgacctcgcgcgccatgcaggtctcgtcgaacatcagcgagccggactacggcgccttgctcgacgacatgttcttcgaggagggcagcgacatccccttccagcgcttcatcgtgccgcgggtcgaggtggagctggcgttcatcctcggcaagccgctgaagggaccgggctgcaccctgttcgacgtgctcgaggccaccgagtgggtgatcccggcgctggagatcatcgatgcgcgcatccagcaggtcgacccgcaaacgaaagtcacgcgcaaggtcttcgacaccatctccgacaacgccgccaacgccggcgtggtgatgggcggccgggccgtacggccaggcgatatcgacctgcggcgggtaccggcaatcctctaccgcaatggcgtgatcgaggagtctggcgtctccgccgcggtgctcaaccacccggccaagggcgtcgcctggctggccaacaagctggcgccctacggcgtctgcctggaggccggccaggtgatcctcggcggctccttcacccgcccggtggcggccgcgccgggggacaccttccacgtcgactacgacctgctcggcagcatctcctgccgtttcgtctgaggaggcatttccatggacctgcccgtcaatcgcttcaagcaacgcctgcgcagcggcgaggcgcagatcggcctgtggctcggcctggccgatccctactgcgcggagctggccgccaacgccggcttcgactggctgctgctggacggcgagcacgcgcccaacgacctgcgcagcctgctcggccagttgcaggcgctggcgccctaccccggccagccggtgatccgcccggtgcagggcgacaccgcgctgatcaagcaattgctcgacatcggcgcgcagaccctgctggtaccgatggtcgacagcgccgcccaggccgaagggctggtgcgcgccgtgcgctatccgccggcgggcgtacgcggggtcggcagtgcgctggcccgggcctcgcgctggaacagcgtggcggagtacctgaaccacgccgacgagcagatgtgcctgctggtccaggtggaaaacctggagggcctggccaacctcgacgcgatcgccgccgtcgagggcgtcgacggcgtgttcatcggtccggccgacctcagcgcagccatgggccatcgcggcaatccaggccatcccgaggtgcaggcggccatagaggacgccatccaccgcatccgcacggccggcaaggccgccggcatcctctccgccgacgagacactggcgcggcgctacctggagctgggctgcgcgttcgtcgcggtgggcgtggacaccagcctgctgatgcgttcgctgcgcgagctggcggggcgcttcaagggcggcgcgccggcgccgtccgccagttcctcggtctacggctgaggggtgcgccccgctcccgctgcgggagaggggtcaggtcggcgttgcggcaggtatcggcgtcggtccgggggcgtatgcctagcgtcggcggaacaacggtcgcggctcgatcgccgagcggccgtagagcacgctcaaacccgccagccccttga

SEQ ID NO: 11883 - DNA, 1251 bp, Pseudomonas aeruginosa
gctggtcgcgcaacacgtcgcccactgcgcgcaactcgccgctccaccccaggcgcacgcgcagcaggtaggccaggctgtagccacgaccgtcgcggaagctggggaagtcgacggcgatcagcggcagctcggcgaagtgcggcagcaaggcctccacctcatcgtccggcgccagccagggcgcggcggctccggcctcgccgcggcgctccagccaggccgccagaggcagcagcaacggccccggcggcagcgcgtcgggcaactcgcgcaggagttgccagggatcgtcgcggcagacctcggcgacgccatcgcgcaaacggatcaggttgttcatgccggttcctccatcctggcgtagacccgggccttgaacggctccaggccgacccggttgaaggtgtcgatgaaacgttccgggccgacccgcaggtcggtgaaggtttcgacgatccgttcgatcaccgccggcacctcggcagcgctgaacgatggcccgatcaccttgcccagcgcgctgtccttgccctgggcgccgccgagggtgacctggtaccactcgctgccgttcttgtcgacgccgaggatgccgatgttgccgatgtggtggtggccgcaggcgttcatgcagccggagatgttcaggctaagctcgccgatgtcgtgcaggtggtcgaggtcctcgaagcgctgctggataccctgggcgatggggatcgacttggcgttggccagcgcgcagtagtcgccgccgggacaggcgatgatgtcgctgagcaggccttggttaggcgtgccgaggccggctgcgcaggcctcgtgccacagcgcgtggaggttctccaggcgcacgtcggggagcaccaggttctgttcgtgggccacacggatctcgccgaaaccgtagcgctcggcccaatcggcgacgcgttccatctgctccgcggtgacgtcgcccggcggcgcgctggcgccgggcttggtcgacagcaccaccgaggcgtagcccggcaccttgtgcgcctggacgttgcgcgaggcccagcgggcgaaggtcggatcggccgcacgggcgctgccgtaggccagctcgccgtcggccggcggcaggtagcgcggcaatacgaagcgctcggcgacccgctggcactcctcggcagtcagttgtgccgggccgtcgcgcaggtgctgccactcttcctccacctcgcgggcgaaagcctcgatgcccagcgccttgactag

SEQ ID NO: 11884 - DNA, 2589 bp, Pseudomonas aeruginosa
gatcttgatccgcgccttgtacttgttgtcgcgccggccgtggcggttgtagacccgcaggatcgcctcgacgtaggacagcaggtgctgccagggcaggtcgtcgcggatcacctggccgagcatcggcgtgcgtcccaggccgccgccgaccaggacccgcaggcgcaactcgccggcgtcggggtggcggtaaaggtacaggccgatgtcgtgcatctgcaccgcggcgcggtcttccaccgccgaactgagggcgatcttgaacttgcgcgggaggaacaggaactccgggttcaccgtcgaccactggcgcaggatctcggccagcggccgggggtcggtccattcgtccgcggcgaccccggcgaaggcttcggtggtgatgttgcgcacgcagttgccggaggtctggatcgcatgcatctgcgcgccggcgaggtgttcgaggatatcgccgacctgctccagttcgatccagttgaactggatgttctgccgcgtggtgaaatgcccgtagccgcggtcgtagtgccgggcgacgtgcgccaaggcgcgcagttgcggcgacgagagggtgccgtagggaatcgccacgcgcagcatgtaggcgtgcttctgcaggtacaggccgttctgcaggcgcagcgggaggaactcctcctcgctcagttcgccgtcgaggcggcgggcgatctggtcgcggaactgcgccacccgctcgctcaccagcgcctggtcgtattcgtcgtactggtacatcgcaaagccctcatcgacagggtttctccaccgatgacgggcagggtgcgtggcgaagaaaccggggaccggctgcgcccctgtttctggcgacaggatgggccggtgttcactggcacccactatcgcccgcgtacagacagcgaaacagcggcagattccgccgaaaaaaacacatcagatggccgacggcggcgaattcgtgccgcctgcgaccggttgccacggggcgcatatctgtactgcccgaggtcgcccggcaacccgcggcaatgctgggccgctgctttccggaggcatctgatacggtttttcccgctcgatctgccgctgtttcgcccatcagccggttcctatagtcgcaaccgcctctccagcctgatgggcctacgaaaaatgagcgaaagaattcccgcgatccaggtcgagcccgccgcaccggccgctccgtcgaaacagccgcccgcgcccggcaagctgccgtcggcggtgaacggcccgatctacacccgcagcttcaccggtctgttccgcaacttccgccgcctcggcggcggcctgctgttcctgctgttcttcggcaccctgtggctgaactggaacggccgccaggcggtgctctgggacctgcccgaacgcaagttctacattttcggcgcgaccttctggccgcaggacttcatcctgctctcggcgctgctgatcatcgccgccttcggcctgttcttcatcaccgtgttcgccggccgcgtctggtgcggctatacctgcccgcagagcgtgtggacctgggtgttcatgtggtgcgagaaggtcaccgagggcgaccgcaatgcgcggatcaagctcgaccagggtccggcgagcgccgccaagctcttgcgcaaaacggccaagcacgcgctgtggctgggtgtgagcctggtcacggcgatcaccttcatcggctacttcactccggtgcggccgctggtggccgacctgttcagcttccagctggacctggaaagcctgttctgggtgctgttcttcaccgccgccacctatgtcaacgccggctggctgcgcgagcaggtgtgcatccacatgtgcccctactcgcgcttccagagcgtgatgttcgacaaggacaccctgatcgtgtcctacgacgccgcccgcggcgagtcccgcggcgcccgcaagaaaggcagcgatccgcgcgcccaagggctcggcgactgcatcgactgccagcagtgcgtgcaggtctgccccaccggcatcgacatccgcgacggcctgcagatcgcctgcatcggctgcgccgcctgcgtcgacgcctgcgactcgatcatggacaagatgggctatgaacgcggcctggtgcgctacacctcggaacgcgccctggaaggtggccagacccgcttcctgcgtccacgcctggtcggctacgcggcggtgatgctggcgatgatcggcgccttcgtcgtcgccctgaatgcccgcccgctggcctcgctggacgtgacccgcgaccgtgggctgttccgcgagaacgccgccgggcagatcgagaacatctacaccctcaaggtcatcaacaagacccagcagccgcagcgctatcgcctgcaactcgacgacgcgccggagttccgcctgcagggcgagcacaccctgagcctgaagcccggcgagatcctcgacttcccggtgtcggtggcctctaccgccgaacgcgccagggccggctcgcaaccgctggcgttcagcctgcgcggcatcgacgacccgagcctggcggtcggcagcaccagcaccttcgtttcgccggcgcgctga

SEQ ID NO: 11885 - DNA, 1506 bp, Pseudomonas aeruginosa
attgcaggctccggccggcgccccgtctcccccctcgacggcggtcgccggctgttcatttctttcgggactgtacagatgaacaaagcaacgacggaacctgcctacaactacaaggtggttcgccagttcgccatcatgaccgtggtatggggcgtgatcggcatggggttgggcgtactgatcgcctcgcaactggtctggccccagatgaacttcgacctgccctggaccagcttcggccgcctgcggccgctgcataccaacctggtgatcttcgccttcggcggctgcgcgctgttcgccaccagctactacacggtgcagcgtacctgccaggtgcgactgttctccgacaccctggccgccttcaccttctggggctggcaggcggtggcggtgatcctgctggtcagcctgccgctgggcaacaccaccaccaaggaatacgccgagatcgagttcaccggcgcgatctggctggcgatcgtctgggtcgcctacgcggtggtgttcttcggcaccctgatcaagcgcaaggtcaagcacatctatgtcggcaactggttcttcggctcgttcatcctgaccaccgcgatgctgcacatcgtcaaccacatgtcgctgccggtgagctggttcaagtcctactcgatgtactccggcgccaccgatgccatggtccagtggtggtacgggcacaacgccgtaggcttcttcctgaccaccggcttcctcggcatgatgtactacttcgtgcccaagcaagccgggcgcccggtctactcctaccggctgtccatcgtccacttctgggcgctgatcaccctgtacatctgggccggcccgcaccacctgcactacaccgcgctgccggactgggcgcagtcgctgggcatggtgatgtcgctgatcctcctggcgccgagctggggcggcatgatcaacggcatgatgaccctctccggggcctggcataagctgcgcgacgacccgatcctgcgcttcctggtggtgtccctggcgttctacggcatgtccaccttcgaaggcccgatgatggcgatcaagaccgtcaacgccctctcccactacaccgactggaccatcggccacgtccacgccggcgccctcggctgggtcgcgatgatcaccatcggctcgctctaccacctgattcccaaggtctacggggtcgagaagatgcacagcgtcggcctgatcaatgcgcacttctggctggccaccatcggcaccgtgctgtacatcgcctcgctgtgggtcaacggcattacccagggcctgatgtggcgcgcggtcaacgaggacggcacgctgacctactccttcgtcgagtcgctggtggccagccatccgggcttcatcgtgcgcctggtcggtggcgggttcttcctcaccggcatgctgctgatgagctacaacacctggcgcacggtacgccaggcgcgcccggaaggaatcctcgcggcggcccgcatggcctga

SEQ ID NO: 11886 - DNA, 1431 bp, Pseudomonas aeruginosa
ctggtttcgaaagtgcagaagagtagcggaaaaaacacaggctgcatgcgggtatgcagaaggaaatcaacggtttccgccgtgcagggccaagcccagcgcgagcaggctgccgacgccgcagacggccatcaccagcgccatcggcagcacgccgggcagcgccagccagccgaccgccaggctggccaggcagccgaggccgaactgcccggacaccgccaccgccgaagccgccccggcctgtccgggatacaacgccagcaggctggcgatgcagttggcgccgagcaggccggtgacgctgacgaagcacagcaggccgggcaccagcgcccacaacccgccccgctcgccgagcgccgcatagccgaggaggaacagcccggacacgcaggccagcaggctgccggcccgcagcagcggccgcggaccgtggcggcgcaccaggcgcgcgctgcaccaggtggcgagcatcacgccgaggatgttcaggccgaagaaccagccgaagcgctccgcgcgcacgccgaaatgctcgatgaacacgaatggcgcggcgctgatgtaggcgaacatcccggcgaacgccagccccatgcacagcacgtagcccagcgcgcgacggtcgccgagcagccgcccataggcgagaaaggcctgggccaggctgccgccgcggcgctccggcgggtggctttcggcgacccgccagaccgccagcaggcagagcccggcgaacagcgccaggaccacgaacaacgcgcgccagccggcccagagcatcaggtagccgccgagcagcggcgcggccagcggtgccagcatggtcaccatgtgcatcaatgccagcatccgggcggcctcgcccaacggatagaggtcgcgcaccatggcccgcgccagcaccgacgcggcgccgccgccgagggcctggagcaccctcagcaggaccagttgccccgcgctgtcggccagcacgcaggccaggctgctgaacaggtacaaggcgataccggccagcagcaccgggcgccggccgaaacggtcggacaaggggccgtagaacagcatgccgaagcagaagccgaccaggaagccgctgatgctccgctgcacctgggcatcgctggcgccgagatcggcggcgatcgccggcaggctcggcaaatacatgtcgatcgacagcgggccgaacgccaccagcgccgacaacagcagcaacaggcgtccttcgccgcttccgacctgaatcctcgatgcactcgcaggcacgctcgccctcctcttcttcgcctttcggtccagacgacaccgccgtgcacgcggatgcaagttcgccgtccgggaaatcctcgcgccgcgacctcgttcaccctggcagcgcgcgggcctggctcctttcgcgggccgacaacgttaacagattaa

SEQ ID NO: 11887 - DNA, 1692 bp, Pseudomonas aeruginosa
caacgatggcacgctgccgttcggagcgaattcgaaggagccggtggacgactacagtcacctcggcctgaccgccaagctgcgctattcgcagacccagctacaggtcggcatcctcatgccgcaactgccggtggcgttccgcgacgacgtgcgcctgttgccgcagaccttcgacggcgcgctgctgacctccagcgagatcgagggtctcaccctcaccgcggggcaattgtggaagtcgcgcacccgcgagtcggccggcagcgacgacatgtacatcatgggccgcgacaaggcccacgccagcgacgagttcaatctcgccggcgcgacctacgccttcacccctcggctcagcgccagctattactacggccagctcaaggacatctaccggcagcactatctcggcctgctgcacaccctgccgctgggcgaagggctgtcgctgcgcagcgacctgcgctacttcgacagcggcgaagacggcgcggcgatctccgggccggtggacaatcgcaacctcaacgccatgctcaccctgcgcgccggcgcccacgccttcggcatcggtgtccagaagatgatcggcaacgacgcctttccggtgctcaacggctacaccacgccctacgtggccaacctcatggcctaccagaccttcacccgaccgcaggagaaatcctggcaactgcgctacgactacgacttcgccggcctcggcctgcccggcctgaacctcatgacccgctatgtacagggccgcgacatcgaccgcggcgccggccgcgccgacgacagcgaatgggagcgcaacaccgacctgtcctacgtgatccagagcggaccgctgaagagcgtcgccttgaaatggcgcaacatcacctaccgcagccgctacggtgcggacctggacgagaaccgcttcatcgtcaattacacgctaaagctctggtgaagcgcggccccttggggccgcaggcacctcaatcctcgagtcgcaggtgcaaatgctgcttcttgcccaggctcaggcgcagcccgtcgacctcgcccgccagcggcgcgtccggatcgctgaccggcgtgccgtccaggcgcaggccgccgccggcggcgaggcggcggaccgcgctgcgggagggctggatcgcgtgttccagcagcaggtcggtcagcgacagtccctgcgccaggcgcgcgcgggatagcttcatcaccggcaggccgctgtcccgcgtaccgtcggcgaacaccccgcgcgcggcatcggcggcggatcgcgcggcgtgctcgccgtgcgccagggcggtggcggcattggccaggaccaccttcgcttcgttcagctcggcgccctgcaaggcgcccaggcggcgcacctcatccatcggcagttcgctgaacagggcgaggaagcgaccgacgtcgcgatcatcgcagttgcgccagaactgccagaagtcgaacggcgccaggcgctcggcgttgagccataccgcaccctgcgccgacttgcccatcttgcgcccgtcactggtggccagcagcggcatggtcaggccgaacagctgggcgccgccctggcgtcgcgacagctccacgccgttgatgatgttcgcccactggtcggcgccgccgagttgcagggtgcagccgcgccggcgcgacagttcgacgaaatcgtag

SEQ ID NO: 11888 - DNA, 2187 bp, Pseudomonas aeruginosa
aatcgaccaggtatcgggcgccggactcttcagcttcgtcggcgatgccatcgtcgatgtggtcaaggtgtccaacgacctgctcaacacgtcggtcatctcttcggtcggcaaggtgttcaacgccgtcggcctgacccccatccatcaactggccgacaccctcggctacggcgtgttcaagggcgtcgccgcggtcggcggcctgctcggcggcgacaccagccgcatcgattaccactacgacaccgagtggacctgatcccaggacctcggcccgctcccgtcgcggagcgggcctccaccgtcgccggagacccggacgcccccggcggcgacctaggacccggcaaccgggaaggggcgaccagcgccccgatcaggagaaccgccatgcacgacctcatccagcacgccgacgccttcgtcggcgatcccgaccaggaatccggcggcctgtcgcgccgcagcttcctcggcaagagtgccacgctcggcgcggtcggcctggtggccggctggaccccggccttcgtcatccagcccgccgaagccgccgccagcagttgtccggcgccggcaggctttccggccggcctcgaactttatcggcgggcgttccgcaattggtcgggggaaatcgccgccgacgacctctggagctgcgccccgcgcaccaacgaagaggttctcgcggtggtcaactgggcctggcagaacggcttcaaggtgcgcccgcgcggcatgggtcacaactggtccccgctgctgctgaaaggcggcgagaactgcgagagccgcatcgtgctggtggaaaccagccgttacctgacccgcgtacggatcgacgcccagggcgagttcggcctgttcagcgcgcagaccggcgtcaccatggaagccctgctgaaacaactggagcgggtcaagctcggcttcgtcgccacgccggcgccgggtgacctgaccctcggcggggtgctcgccatcgacggccacggcaccggcatcccggcgcagggcgaaagccgcctgccggggcagagctacggctccctgagcaacagcatcgtggcgctgaccgcggtggtctgggacggcgccgccggacaatacgtgctgaagaccttccgccgcgacgatccggcctgcgcgccgttcctcgtccacctcggacgcgccttcatcgtcgaggcgaccctccaggccggggtcaacaagcgcatgcgctgccagagctacgtgaacatcccggcgagcgagatgttcgccgcggccggcagcggcggaaggaccttcgacagcttcctgcagaaaagcggacgcgccgaggccatctggttccccttcaccgacaagccctggctgaaggtctggacgccgaccccgcgctgcccgttcggcgcccgcgcggtcaacggcccgttcaactaccccttctccgacaacattcccaaggcgctgtccgacctgctggcggcgatcaacaccggccacccggaactcaccccgctgctcggcaagctgcagtacgacctggtagtgggcggcatggcgctgaccctgggctacgacctgtggggctggagcaaggacctgctgctgtacatcaagcccagcaccctgcgcgtcaccgccaacggctacgcggtgctgacccggcgtcgcgacgtgcagcgggtgatcaacgagttctacctgcagtaccagacgatggtcgccgcctaccgcgccaacggccactaccccatgaacggcccggtggagattcgcgtcagcgggctcgaccagcccggcgagtcgatcgttcccggcgcccaggtgcccagcctgtcggcgatccgtccgcgccccgaccaaccggagtgggacacggcgatctggctggacatcctcagcctgcccggtaccccgcaggccaatgccttctaccacgagttcgaggcctggctgttcgaccacttcagcggcgactacgcctcgctgcgggtggagtggagcaagggctggggctacagccccgccgccgcctgggacgagccgacggtggtcgaccagttggtggcgcagtcgctacgccagggcctggtcgcagacaacgattgggacagcgccgtgcgccagttgaacgaagccgatccgcatcggctgttcagctcgccgctgctcgaccggctgatgccatga

SEQ ID NO: 11889 - DNA, 834 bp, Pseudomonas aeruginosa
tcgacaagttcttcgagctgcgcatgctccagttgcagggcgagcgcctggccgacatcgtgctccaggccccggaggtcagccacggcgacatcctcccgaagaaccttcgcgagcgcgaggcgagcatcgagatccagggcctgcgctaccgctacgcggaacaggagccctgggtcctcgacggcctcgacctgcgcatcgccggcggcgagtcggtggccatcgtcggcccctcgggctgcggcaagagcaccctgttcaacgtcctgctgggcatcctcccgccagggggggaacagatccgccatggccggcctggaccttgcgcaattgggcctggaagggctgcgcgaactggtcggcacggtgctgcaggacgacgtgctgttcgccggttcgctcaaccgaacaacatcagtttttttgacccgcaaccggacatgccctggctggcgccagtgcgcgcagatggctgccatccacgatgacatccaggccatgccgatgggctacaacaccctggtcggcgacatgggcacggtgctctccggcggccagaagcagcgggtgatgctggcccgggcgctgtacaagaagccgcgcatcctgttcctcgacgaagccaccagccacctcgacgtacactgtgaacagcgggtcaacgccgccattcgcgcgctgcgcatcacccgcgtcatggtcgcccatcggcccgagaccatcgcctcggcggaccgcgtgatagtcctcggccagggcaaggtaagcctcgacgaaagcaccgcgcgcctggccgaacgccaggccgccgcggcgcgggagcaggcctga

SEQ ID NO: 11890 - DNA, 2328 bp, Pseudomonas aeruginosa
gcgggcaggccccgccggttggaggcgcgtattcgcgaggtgtcgcagcgctacggcatgccgctggagcctcgccggctggtccatgggctgtccatcggcgagcgccagcgggtggagatcgtgcgctgcctgatgcaggacatccgcctgctgatcctcgacgagccgacttcggtgctgaccccacgcgaggccgaggatctcttcgtcaccctgcgccgtcttgcggaagagggctgcagtgtcctcttcatcagccacaagctggccgaggtccgtgcgctctgccagcgcgccacggtgctgcgcggcggacgggtggccggacagtgcgtgccggcgcaatgttccgatctcgagctggcgcggctgatggtgggcgacgccgagggcctggcggcggaatatccgaaggttaccggcggcgcgcctttcctccaggtgcgcgacctgcactggcgcaacccggaccccttcggcgtgtccttcgccggcctcgatctggaggtgcgcagcggcgagatcctcggtatcgccggggtcgccggcaacggccaggacgagttgctcgctctgctcagcggcgaagtgcgcctgccgcgcgcccaggccgagcgcatccgcctaggcgcctgcgccggcgcgcacctggcgccggatgcgcggcgccgcgccggccaggccttcgtgcccgccgagcggctggggcacggcgcggtggccggagatgagcctggcggacaatgcgctgctcaccgccttccagcagggactggtgaagcgcgggttggtccggcggcgcaaggtgctggcgctggccgaggagatcatccgccgtttcgccgtgaaggccccgggtgccggggcgccggcacgcatcctttccggcggcaacctgcagaagttcatcctcggccgcgagatcctccaggccccgcgcctgctggtggcggcgcatcccacctggggcgtggacgtcggcgcggcggcgctgatccaccgcgcgctgatcgccttgcgcgatgccggtacggcgatcctggtggtctccgaggacctcgacgagctgttcctgctcagcgaccgcatcgccgcgctgtgttcgggtcggctgtgcccggcggtcgccaccgcgagcgcttcgccgcagcaggtcggcggctggatggccggtcaattcgaggcgccggcggcagtcgccggcgccgttgcccaagggagcctgtgatgctgttgtccctggaaccgcgcggccgacagtcacgctggatgctgctggcctctccgctgctggcggggctgctgaccctggtctgcggtgcgctactgttcgcctgtctcggccacgatccctggcagaccctgcataccgtgctggtacagccgctcagcgacctctatgggctcggcgagctgctggtcaaggccatgccgatcctgctctgtgccctcggcctggcactggcctaccaggcgcgcgtgtggaacatcggcgcggagggccagttgctggtcggcgccctggccggcagcgcggtggcgatccagttgctcgactggcagagccgctgggcgctggcctgggtgctgctcgccggcaccgctgccggggcgctctgggccgggttcgccgcctggctgcgaacgcgcttcaacgccaacgagatcctgaccaccatcatgctcaactacatcgcgctgaacctgctgctgtacggcgtgcacgggccgttgaaggacccggatggcttcaacttcccgcagtcggcgctgttcggcgaggccagccgcctgccggcgctgttcgaggacagccgggtgcaccttggcgcattgttcggcctgctggcgctggcggcggtctgggtgctggcgcagcgcaacttcctcggtttccaggtccgcgtgctcggcctcgaccgccgcgccgccggtttcgtcggtttccgcgagaagcgcctggtctggttcgtgctgctgttctccggcgcgctggcaggcctggccggcgtctgcgaggtcgccgggccgatcggccaactggtgccgcaggtctcgccgggctacggctatgcggcgatcaccgtggccttccttggccgtctcaatccgttcggcatcctctgcgccagcctgctgatggcgttgctctacctcggcggcgaggccgcgcagatgagcctcaacctgccattggcgctgtccgggctgttccaggggatgatgctgttcttcctcctcgcctgcgacgtgctgatcctctaccgcccacgtttgcacggacgctggcgcaagcgcccggcgctgcgcgacgccctggcctga

SEQ ID NO: 11891 - DNA, 648 bp, Pseudomonas aeruginosa
atcaatggggcatttttgccgaaccccgttaagattctcccagtcgatttgaaacaccccattcaactgagagaggaacgactgatgtccctgatcaacactcaagtccaaccgttcaaggtcaacgctttccacaacggcaagttcatcgaggtgaccgagcaatccctgaagggcaagtggtcggtcctgatcttcatgccggctgccttcaccttcaactgcccgaccgagatcgaagacgccgccaacaactacggcgagttccagaaagccggtgccgaggtctacatcgtgaccaccgacacccacttctcgcacaaggtctggcacgaaacctccccggcagtcggcaaggcccagttcccgctgatcggcgacccgacccaccagctgaccaacgccttcggcgtgcacatcccggaagaaggcctggccctgcgcggtaccttcgtgatcaacccggaaggcgtgatcaagaccgtcgagatccactccaacgagatcgcccgtgacgtcggcgagaccgtgcgcaagctgaaggccgcccagtacaccgccgcccacccgggcgaagtctgcccggccaagtggaaggaaggcgagaagaccctcgctccgtccctggacctggtcggcaagatctaa

SEQ ID NO: 11892 - DNA, 1569 bp, Pseudomonas aeruginosa
accatgttggacgccaatcttaaaacccagttgaaggcctacctggaaaaggtcagccagccgttcgagatcgtcgcgtccctcgatgacagcgacaaatcccgcgagttgctgggcctgctgcaagacatcgtcggcctgaccgacaagatcaccctgaagaccgacggcagcgatgcgcgcaaaccgtcgttctcgctgaaccgccccggtgcggacatcggcctgcgcttcgccggtatccccatgggccacgaattcacctcgctggtgctggccctgctgcaggtaggcggccacccctccaagctcgacgcggacgtgatcgagcaggtcaagggcatcgagggcaccttcgagttcgaaacctacttctcgctgtcctgccagaactgcccggacgtggtccaggcgctgaacctgatggccgtgctcaacccgaacatccgtcacgtcgccatcgacggcgcgctgttccaggatgaggtcgaggcgcgccagatcatgtcggtgccgagcatctacctcaacggcgaagtcttcggccagggccgcatgggcgtggaagagatcctcgccaagatcgacaccggcgccgccgcccgcgacgccgagaagctgaccgcccgcgacgccttcgacgtgctggtggtcggcggtggcccggccggcgccgcggcggcgatctacgccgcgcgcaagggcattcgcaccggcgtcgccgccgagcgcttcggcggccaggtgctggacaccatggccatcgagaacttcatctcggtgcaggagaccgaagggccgaagctggcgcgggcgcttgaagagcacgtgcgtcactacgaggtcgacatcatgaacctgcagcgcgccagcaagctggttccggcgaagaacaccggcgagttgcacgaggtgcagttcgagagcggcggcagcctcaaggccaagaccctgatcctcgccaccggcgctcgctggcgcgaaatgggcgtgcccggcgagcaggagtacaaggccaagggtgtgtgcttctgcccgcactgcgacggcccgctgttcaagggcaagcgcgtggcggtgatcggcggcggcaactctggcgtcgaggcggccatcgacctggccggcatcgtcgcccacgtgaccctgctggaattcgacagcaagttgcgcgccgacgccgtgctgcaacgcaagctctacagcctgccgaacgtcgaggtgatcaccagtgccctgaccagcgaagtgaagggcgacggccagaaggtcaccggcctggtgtacaaggaccgcaactccgaggagttcaagtcgatcgagctggaaggcatcttcgtgcagatcggcctgctgcccaacaccgagtggctcaagggcagcgtcgagctgtcgccgcgtggcgagatcatcgtcgacgcccgtggcgagacctcgctgcccggcatcttcgccgccggcgacgtgaccacggtgccgtacaagcagatcgtgatcgccgtgggcgagggcgccaaggcttcgctgagcgccttcgaccacctgatccggacctccgcgccggagtga

SEQ ID NO: 11893 - DNA, 774 bp, Pseudomonas aeruginosa
gccgaagcagccgctggccgaaggcaacgcggtggactacctgatccgtaccctgcgcgcggcgccggagaagagcgtgaccctggccatgctcggcccggagaccaacctcgcgctggccctgacccaggccccggacatcgtcaagggcatccgcgagatcgtgatcatgggcggcgcccacttcaacggcggcaacatcaccccggccgccgaattcaatatcttcgccgacccccacgcggcggaaatcgtgctcaagagcggggcgccgatcaccatgctgccgctcgacgtgacccacaagatcctcaccagccccgagcgcatcgccaagctgcgcaacctcggcaaccaggccggcaagaccgtcgccgacatcctcgacgcctacgtccagtacgacatcaagtactacggcctgaagggaggcccggtgcacgacgccacggtggtcgcctacctgctcaagccctcgctgttcaagggcaagcggatcaacgtgcaggtcgacagccgcgagggcatcaccttcggccagaccgtggccgactggtacggcggcctcaagcagccggccaacgtcgagtggatcaacgagggcgatgcccaggggttcttcgacctgctcaccgagcgtatcgcccgcctgccctgagtctctcgccgtacggccggcgccgggtcagccgtggcgccggctggcgagttggcgcagggcctgctcggcgtcgccgacgacgatcctgccgggcaccgacagcatcaggttga

SEQ ID NO: 11894 - DNA, 357 bp, Pseudomonas aeruginosa
gcggcaggccgaactcttccagggtcatgccgtcgcggtcgcgggtcggatcctcgccgatcagctccggggcgtgccggcggattcgctcggcgtagctgccggcgtcgtcgacgtagccatagaccggcttgccgagggcggtggcatagccgacctcgaaggcggtgccgctgtccggctcggcgccgcggaagaagttcaggttggccagcaccgcgtcggcgcgttcgatcaggccgatgttggcgcggtagatccaggccgcctgttcgcgcggctcggcgagctgtttcggcagcgcgttgtccagcgggtagaggccctcgaaaccgtagcgtgcgcacagtgccttga

SEQ ID NO: 11895 - DNA, 804 bp, Pseudomonas aeruginosa
cgcggcgcgcagaagcgcgagcttgagcggagttgtccgggtggtcaggtaattgcatcggcgggcgggctgaacgcgaagccacgcccgatggccaaccctgcactcaccggagcacgcctatccatgaaacaccgtcgcacgcaatcccgcatgtccgtcctgcgccgccttgccgccgtcctcggcctcggcgcctgcgctctcgccgccgaggccgccgaaccactgaagatcggcttcgtctatgtcggcccggtcggcgaccacggctggacctaccagcacgaactgggccgccgcgaactggtggagcacttcggcgacaaggtgaagaccagcttcgtcgagaacgtcgccgagggcgccgacgccgagcgggtcatccgcaacctggcgaaagacggctacggcctggtcttcaccacctccttcggctacatgaaccctaccgccaaggtggcccggcagtttcccaaggtgaccttcgagcacgccaccggctacaagcgcgacaggaacctcggcacctacctgtcgcgctcctacgagggacgctacgtcggcggcttcctcgcggcgaaaatgacccgcagccacaagatcggctacatcgcctcgtttccgattcccgaggtgatccgcgacatcaacgcgatccagctggcgctggacaaatacgacccgcaggccgaactcaaggtgatgtgggtgagcacctggttcgatccgggcaaggaggctgacggcgcccaacgcgctgatcgaccagggcgtcgacgtggtgttccagcacaccgatag

SEQ ID NO: 11896 - DNA, 966 bp, Pseudomonas aeruginosa
tcgagaacccaccccatgtacgaatggctcaacgccttgcccaaggccgaactgcacctgcacctggaaggtaccctggagccggagctgctgttcgccctcgccgagcgcaaccgcatcgccctgccctggaacgacgtcgagaccctgcgcaaggcctacgccttcaacaacctgcaggaattcctcgacctttactacgccggcgccgacgtgctgcgcaccgagcaggacttctacgacctgacctgggcctacctgcagaagtgcaaggcgcagaacgtcgtccacgtcgagccgttcttcgacccgcagacccacaccgatcgcggcattcccttcgaggtggtgctcgccggcatccgcgccgcgctgcaggacggcgagaagctgctgggcatccgccatgggctgatcctcagcttcctccgccacctcagcgaggaacaggcgcagaaaaccctcgaccaggcgctgccgttccgcgacgccttcatcgccgtcggcctcgacagctcggaagtagggcatccgccgagcaagttccagcgggtcttcgaccgggcccgcagcgaaggcttcctcaccgtcgcccatgccggcgaggaggggccgcccgagtacatatgggaagccctcgacctgctcaaggtcgagcgcatcgaccacggcgtacgcgccttcgaggacgagcggctgatgcggcggctgatcgacgaacagatcccgctgaccgtctgcccgctgtccaacaccaagctctgcgtgttcgacgacatgagccagcacaccatcctcgacatgctcgaacgcggcgtgaaggtgacggtgaactccgatgacccggcctacttcggcggctatgtcaccgagaacttccatgccttgcagcagagcctgggaatgaccgaggagcaggccaggcgcctggcgcagaacagcctggatgcgcgcctggtgaagtga

SEQ ID NO: 11897 - DNA, 1734 bp, Pseudomonas aeruginosa
  unsure (891): Identity of nucleotide at the above locations are unknown.
ggggcggcgtgccgggtagcccggcgcgcgacccgcaaggcgtttcgtcgtcgccggcttctcggtattgatgataagcattatcatttgcgggcctgctcagcattcccatggcgccgccccggcgccggctttcgtgcagccgtcctcaccgatgcccgaccgcgacctacctcccggcccgcgcccggatgccttgccggcagacggcgatgcggcgcgccgcgcggatctcctcaaggccttcctggcccagcgccagcgcatggaaagcctggtcagccgctgggtctgctgccgggcgaccgccgccgacctggtccaggagctgttcctgcgcttctggcggcgcccggccgccccggtggaggagcttggcagctacctcctgcgcagcgcgcgcaacctggccatcgaccacttgcgtggcgaaggatcgcggcaacggcaactggacgattggctgccggagcagcgccagggcgagccggtcagtcccgagcaggcgctcgaggccggcgaccagtggcgccgggtcgaggccgccttgcgcggcctgcccgagcggacccggcggattttcctgctcaatcgcatccacggccgcacctacgcggagatcgcccaggccatgcagctttcccaaagcgccgtggaaaaacatatgatgcgcgccctcgacgcctgcaaggcgagcctggccggcccggccggcgagcaggcaaggagcgcccagccatgacccgacccgatagcgacgccgcgccctacgagcccgtcctcgagcagaccgcccaggcctggctggtgcgcctgcgcggtacgccggatgcggcgacccggcgggccttcgaggactggctggcgcagcggccggcgcatgccgaggcntatgcccgcgccgaggcgctctggcgcctgacggaaataccggcgagccgcctggccatcgaagaggccgatgccctggaagcctacctgcggccgcgccgagcgtcgcgcaacccgcggcgctgggcctacccgctggccagcgtcgcctgcctgctggcgatgctctggctgggcggctggtggcagcccggcgactggctgcaggactggcgtgccgactatgtcgccgcgccgggacaggtcgccgaatggaagctggccgatggctcctacctgagcctggacgccggcagcgcggtgcgcgtgcgtatcgacggcggccagcggcgggtcgaactgctgcgcggcgccgccgcgttgcgggtgaagcgcgacgcgctgccattcgtggtcgaggccggcgaaggtcgggcgcgggtactgggcaccgagttcgaggtccgtcgcggcgccggggcgacccgcgtcaccgtgttgcaagggcgggtcgcggtgagcgccggcaccggtgcgggcgccgccgaggaagtgctgggcgccggccagcaggtcggcttcgccgacggcaagctgggccggcccgtggccatcgacgccgccgccgcgctggcctggcgccagggttggctgagcttctaccggcggccgctggcggaagtgctcgacgaactcgctcgctactaccccggacgcattctcctgctcgacgacgcgctcggtcgccagctggtcagcggcagcttccgcagcgatgatcccgaagccgcgctgaagtcgctgcaggcggtgctcggctatcgccagcagatcctgttcggacgcctggtggtgattcgctga

SEQ ID NO: 11898 - DNA, 2412 bp, Pseudomonas aeruginosa
aaaagcgaccgacacgagcaacccatgaccccgttcccgcgcttcgccctgcgtactctccccgccctgttcctcagcctcggctgtctcgccgccaccgtgcaggccgccgaggcggttcgctaccgcttcagccaggctgccgcgccgctggcccaggcgctcaacgcgttcagccgggccagcgggcagacgctgctctacaccgccgagctgccgccgcaggcgaccgctccggcattgcacggttcgctggacgcggaggaggcgctgcaacgcctgctgcagggcagcggcctgcgcgcgcggcggatcgacgagcgcaccctgaccctggaaccgatccccgccagcggcgcgctcgacctcgatgccacgacggtctccgccgccgccccggcgcagggctaccggccggcggccaacgcctcgatcagccgcggcgatgcgccggtactggaaatcccccaggcgatcagcgtggtcccggcacaggcgctgcaggaccagcgcccgcgcaaccttgacgacgcgctgggcaacatcagcggcatcacccaggccaacaccctcggcggtacccaggacgcggtgatgaagcgcggcttcggcgacaaccgcgacggctcgatcatgcgcgacggcatgccctcggtgcagggccgcaatttcaccgccaccgccgaccacgtcgaggtgctgaaggggccagcatccctgctctatggcatccaggacccgggcggggtggtcaacgtggtgagcaagaagcctcaactgcaacaagccaacgccctgaccctgcgtggctcggcctacgcccacgggcgcaacggcagcggcggccagctcgactccaccggcccgctgggcgacagcggactggcctaccggatgatcctcgatcatgaggacgaggattactggcgcgacttcggcaagagtcgcgagacgctggtggcgccctcgctggcctggtacggcgaggacacgacggtcaacctgagctacgagcaccgcgagttcaccacgccgttcgaccgtggcacggccatcgacccgcgtaccaaccgcccgctggacatcccgcgcagccggcgcctggacgagcccttcaacatcaccgagggccgttccgagctgacccgcctggatctcgaacggcagctcgacgacacctggaaggcccacttcggctacggctacagtcgcgagacctacgacgacaaccaggcccgggtgatggccgtgaatgccgacggcaccctgacccggcgcatggacggcacccacggcgcggtcagcagcgacagcttcgccaccctcggcctgagcggaacgctgcaactggccgggatgcaacatgacctgcaattcggcatggaccacgagaagcgcaagatcttccgcgccgacctgctgcgcgacagcaagaccagccgcttcgactacctcgacccggtctatggccaggtggtgccgtcgacccgggtggtcgccggcgacagcgaccagaccgacaagctgcgcagcgactcgctgtacttccaggactcgatccacctggacgaacgctggatcctggtcggcggcgcgcgctaccagatctacgaccagctcgccgggcgcggccggccgttcaacgccaacaccgatatcaacgggcagaaatgggtgccgcgcggcggcctggtctaccgcctgagcgacgaggtttcgctgtacggcagctacacgcgctcgttcaagccgaactcgaccatcgccccgctgagcaccggcgagaccatcgattcggcgatcctgccggagcaggcgacctcctgggagctgggcgccaagctggatgtgccggggcgtctcagcggcaccctggcgctgttcgacattcgcaagaagaacgtgctggtcaacgaactcgacggtgccggcaacagcagcgtgcgcgccgccggccgggtccgctcgcgcggcctggagctggacctcaccggccagctcagcgaacgctggagcctgatcggcagctacgcctggctcgccgcggaagtcaccgaggacccgaccctggagggcaagcgcctgcagaacgtggcgcgcaacaccgcgtcgctgtcggcggtctacgaactcggccagctcttcggcggcgaccgcctgcgcctgggcggcggcgcgcgccacgtcggcaagcgcccgggcgacccggccaattccttcgacctgccctcctacaccgtggccgatgccttcgccagctacgacacccgcttcggcggacacggcgtgaagttccagctcaacgtgaagaacctgttcgaccgcacctactacccgtccagtgccaatcgactgtacgtggcgatgggcgagccccggcagttccaggtgtcgacgacggtggagttctga

SEQ ID NO: 11899 - DNA, 609 bp, Pseudomonas aeruginosa
gtcgttccgccatccagtgccttctccctttggggaaaggaaggcggagaaccgcctggcacgacctcgccgcacgccacacctcgttcccaacccgcccgttgggtaccatgcccgcaccactcgccgccacggccgccccatgaacctcgacaaccgcatcaagttccgccacctcgcctgcttcctcgaagtcgcccgccagcgcagcttcgccaaggcggcggatgccgtggcggtgtcgcagccggcgatctccaagaccctcaaggaactggaggaaatcctcggcgcgcgcctgttcgaacggagcaaggccggcgccgagctgaccgaggcgggcgtgaccttcctgcgctatgccggcccctgcgtgcaggccctgcgcgacggggtgaacaccctgcgcggccacgaggcgcaggtcgagacggtgcgggtcggcgtgctgtcgacggtggagagcctggtggtgcccgaggtgatccggcgcctgcaccggcgccacggtgcgctggtggtcagcgtcgccaccggacccagcgcctacctgctggcgcaactgaaggtcggcgagctggacctggtggtcgggcggatgaccgatag

SEQ ID NO: 11900 - DNA, 732 bp, Pseudomonas aeruginosa
caggagcccgacatgcacgacgccgaaagccgtcgtttcgtcatccgtgaccgaaactggcaccccaaagccttgacccccgactacaagacctccgtgccgcgctcgccgagccaggcgctggtgagcatcccgcaatcgctctcggaaaccagcgggccggacttctcccacctcaggctcggccgccacgacaacgacctgctgctcaacttcgaccacggcggcctgccccagggcgagcgcatcatcatgttcggccgggtcttcgaccagtacggcaagccggtcccgcacaccctggtggagatgtggcaggccaacgccggcgggcgctaccggcacaagaacgaccgctacctggcgccgctcgacccgaacttcggcggcgtcggccggaccctcaccgacagcgagggccactattacttccgcaccatcaagcccgggccctatccctggcgcaacggccccaacgactggcgcccggcgcacatccacgtgtctgtcagcggcccggcgatcgccgcgcggctggtcacccagatgtacttcgagggcgacccgctgatccccaagtgcccgatcatccgcacccttgccgacccggaggcggcgcagagcctgatcggccggctcgacatgagcatggccaacccgatggattgcctggcctaccgcttcgacatcgtcctgcgcgggcagcgcaagaccttcttcgagaacgtctga

SEQ ID NO: 11901 - DNA, 876 bp, Pseudomonas aeruginosa
tcggcgagcctttccgtgacccgagcccgaacgtccatgagcgaactcccggaacaccccgccaccctggcgccgccgaccgtcctttcgccggccaagcgcatcgaggccttcaccggcgatcccaacttcatgacctcgctggcccgtggcctggcggtgatccatgcgttccaggagcgcaagcggcacctgaccatcgcccagatcagccaccgcaccgagataccccgcgccgccgtgcgtcgctgcctgcacacgctgatgcagcttggctacgccaccaccgacgggcgcacctactcgctgttgccgaaggtgctcaccctcggccacgcctacctgtcgtcgacgccgctggcgatcaccgcgcagccgatcctcgaccgcctcagcgaacagctccacgaagcctgctcgatggccaccctggagggcgacgacgtgctctacatcgcccgttcggccactccccagcggctgatttcggtggacctcaacgtcggcagccggctgcccgcctattgcacctcgatgggccgcatcctcctcgccgcgctggacgacgacgcgctgcacgcctacttcggcggagtggagatgcaggccaagaccagccgtaccctgtatacccccgagaccctgctgccgtgcctggtggagattcgtcgccagggctggtgcatcgtcgaccaggagctggaagtcggcctgcgctcgctggcggtgccggtacgcgactccgccggccatgtgctcgccgcgctgaacgtcggcacccatgccgggcgggtctcccgcgccgaactggaaagccgtttcctgccgttgctgctggaggccagccgcgagctgagcgcgcgcctgttcacctga

SEQ ID NO: 11902 - DNA, 309 bp, Pseudomonas aeruginosa
aggccgcccaggcgcagttggccaacgcccgcgacctgctttcctataccgagctgcgtgcctccgacgccggggtcatcactgcccgccaggccgaggtcggccaggtggtgcaggccaccgtgccgatcttcaccctggcccgcgacggcgagcgcgacgcggtgttcaacgtctacgagtcgttgttcagccacgatgtcgacggccagcggatcaccgtcagcctgctcggcaagccggaagtcaccgccagcggcaaggtccgcgagatcaccccgacggtggacgagcgcagcggtacgctga

SEQ ID NO: 11903 - DNA, 468 bp, Pseudomonas aeruginosa
gcctcggcagcgtggtcaacgccagcgtcgccgcgccggccgagcacagcgtggtgctgccctggtcggcgctgtccaaggtcggcgagcagccggcggtctggttgctcgaccagcaaggcaaggcgcgtctgcaaccggtgcgggtggcacgctacgccagcgagaaggtggtcatcgacggtggcctggaggcgggccagacggtggtcacggtgggcggccaactgctccatccgggccaggtggtcgaggtggcccagccgccgcagccgacccagagcaccgccagccgcgacgccgtgggcggaggccagccatgaagccgttttccctcgccggcctgttcggcttcgccctgctcctctccggctgcggcgacgagccgccgccggcaccgccgcggccggtgctgacggtgaccgtgaagaccctgaagaacgacgacctcggtcgcttcgccggtag

SEQ ID NO: 11904 - DNA, 609 bp, Pseudomonas aeruginosa
cttcgtcggcaagggcgcgctgctggcgaccctcgaccccaccgaccagcagaaccagttgcgcgccagccagggcgacctggccagcgccgaggcacagttgatcgacgcccaggccaatgcccggcgccaggaagaactgttcgcccgcagcgttactgcccaggcgcgcctggacgatgcgcggacccgcctgaagaccagccaggccagcttcgaccaggccaaagcggcggtgcagcaggccagggaccagctttcctacacgcgcctggtgaccgatttcgacggcgtcatcaccacctggcacgccgaggccgggcaagtggtcagcgccggccaggcggtggtcaccctggcccggcccgaagtgcgcgaggcagtcttcgacctgcccaccgaggtcgccgagagcctgccggccgacgcgcgcttcctggtcagcgcccagctcgacccgcaggccaggaccaccggcagcatccgcgagctgggtccgcaggccgacgcctcgacccgcacccgtcgcgtgcgcctgagcctggcgcagacgccggaggcgtttcgcctcggttcgaccatccaggtccagctgagcagcgccggtag

SEQ ID NO: 11905 - DNA, 3279 bp, Pseudomonas aeruginosa
cgtgcgcagcgtgctgccggccagcgtgctgctggagcgcgacggcaagacccaggtctgggtcgtcgatgggaaacagtccagcgtggccctgcgcgaggtacaggtgctcagccgcgacgaacgccaggtggtgatcggacagggcctggccgacggcgaccgggtggtccgcgccggagtctacagcctcaagcccggccagaagatcaaactcgacgaggatgcgcgatgaagggcggtttcaacctgtcggactgggccctgcgccaccagtccctggtctggtacctgatggcggtatcgctggtgatgggcgtgttctcctacctcaacctggggcgcgaggaggatccctcgttcgccatcaagaccatggtcatccagacccgctggccgggcgccacggtggacgacaccctggagcaggtcaccgaccgcatcgagaagaagctcgaggacctggactcgctggattacgtgaagagctacacgcgacccggcgaatcgacggtcttcgtctacctcaaggacaccaccaaggccggcgacatcccggatatctggtaccaggtgcgcaagaagatatccgacatccagggcgaattcccccagggcatccagggaccgggtttcaacgacgagttcggcgacgtgttcggcagcgtctacgccttcaccgccgacggcctggacttccgccagctgcgcgactacgtggagaaagtgcgcctggacatccgctcggtgaaagacctgggcaaggtgcagatgatcggtgcgcagaacgaggtcatctacctcaacttctctacccgcaagctggccgccctcggtctcgaccagcgccaggtcgtgcagagcctgcaggcgcagaacgcggtgaccccgtccggcgtggtcgaggccggccccgagcgcatctcggtgcgcacctccggcaacttccgttcggaaaaggacctgcaggcggtcaacctgcgggtcaacgatcgtttctaccggctgtccgacctggccagcatcagccgcgatttcgtcgacccgccgacctcgctgttccgctacaagggcgagccggccatcggcctggcggtggcgatgaaggagggcggcaatatcctcgagttcggcgaggcgctcaatgcgcgcatgcaggagatcaccggcgaactgccggttggtgtcggcgtgcaccaggtgtcgaaccaggcccaggtggtgaagaaggcggtcggcggtttcacccgggcgctgttcgaggcggtggtgatcgtcctcatcgtcagcttcgtcagcctcggcctgcgcgccgggctggtggtggcctgctcgatcccgctggtgctggcgatggtcttcgtgttcatggaatacaccgacatcaccatgcagcgggtttccctcggcgcgctgatcatcgccctcggcctgctggtggacgatgccatgatcaccgtggagatgatgatcacgcgcctcgaactgggcgactcgctgcacgactcggcgacctacgcctacacctcgacggccttcccgatgctcaccgggaccctggtgacggtggccggcttcgtgcccatcgggctcaacgccagctccgccggcgagtacaccttcaccctgttcgcagtgatcgccgtggcgctgctgctgtcgtggatcgtcgcggtgctgttcgccccggtgatcgccgtgcacatcctgccgaagactctcaagcacaagtcggagcagaagaagggccgcatcgccgagcgtttcgacagcctgctgcacctggcgatgcgccggcgctggacgaccatcttcctcaccgcgctgctgttcggcgtgtcgctgttcctgatgaagttcgtccagcaccagttcttcccgtcttccgaccgtccggaactgctggtcgacctcaacctgccgcaaaacagcagcatccacgagaccagggcggtgatggaccgtctggaaacgacgctgaaggacgacgaggacatcgaccactggagcgcctacgtcggcgaaggcgcgatccgcttctacctgccgctggaccagcagttgcagaacaacttctatggccagctggtgatcgtcaccaaggacctggaggcccgcgagcgcgtcgccgcgcgcctgcgcgatcgcttgcgcaaggactacgtcggcatcagcacctacgtgcagccgctggagatggggccgccggtgggacggccgatccagtaccgggtcagcggaccgcagatcgacaaggtccgcgagtacgccatgggcctggccggcgtgctcgacggcaacccgaacatcggcgatatcgtctacgactggaacgagcccgggaagatgctcaagatcgacatcgcccaggacaaggcgcgccagctcgggctttcctccgaggacgtggcgcagatcatgaacagcgtggtgaccggcagcgcggtgacccaggtgcgcgacgacatctacctggtgaacgtcatcggccgcgccgaggatagcgagcgcggctcgctggagaccctggagagcctgcagatcgtcacgcccagcggcacctcgatcccgctcaaggcgttcgccaaggtcagctacgagctggagcagccgctggtgtggcgccgcgaccgcaagccgacgatcacggtgaaggcgtcgctgcgcggcgagatccagcccaccgacctggtcgcccggctggcgccggaggtcaagcgcttcgccgacggcctgccggcgaactaccggatcgaagtgggcggcacggtggaggagagcggcaaggccgagggcccgatcgccaaggtggtgccgctgatgctgttcctcatggcgaccttcctgatgatccagttgcagagcgtgcagaagctgttcctggtggccagcgtcgcgccgctggggctgatcggggtggtcgcggcgttgctgccgaccggcacgccgatgggcttcgtggcgatcctcgggattctcgcgctgatcggcatcatcatccgcaactcggtgatcctggtgacccagatcgatgccttcgagaaagacggcaagacgccctgggaagccgtgctggaagccacccaccaccgcacccggccgatcctgctgacggcggcggcggccagcctggggatgatccccatcgcccgcgaagtgttctgggggccgatggcctatgcgatgatcggcggcatcgtcgccgccacgctgctcacgctgatcttcctgccggcgctgtacgtcgcctggtaccggattccggaaccgggacgctga

SEQ ID NO: 11906 - DNA, 1104 bp, Pseudomonas aeruginosa
cagagtctgtgcggggggaaggagagcggacggcgggtgggccatccgccccgacgccgggcagggtatgcccggcgttgctacggcgacggcggccagtataggcagcccggcgtcagggaaaatccgaccaatttacgaatctgttttgcaaccgaggtaatagtggacacattgcaaggcatgcgcgtgttcgccagggtggtggacagcggcagcttcacttccgccgcccaggccctggacctgtccaccgcgcaggtatcgcggctgatctccgacctggaggcgcacctgcagacgcgcctgctgcaccgcaccacccggcgcctggccctgaccgaggccggcgagcgttacctggaacggtgccgcgggatcctcgaggacatcgaggtcgccgaggccgaagccgccggcgcgcacatccgcccctgcggccgcttgcgcgtgcagtcgctgatgggcatgggccagcatcacctggtgccgatgatcgcccgctacggcgcactgttccccgacgtggtgatcgagctgaccctgtcccagcgcaacccggacatgctcgaggaaggccaggacgtgctgatcaccggcgagcgccagttgcccgactcggagttcgtcgcccagcgcctgggcagcatccacagcgtgctctgcgccagtcccggctacctgcagcagcgcggcgtgccacgctcggtggacgacctggagcgccacgtctgcctgcgcctgcaggacccggcctacccggagggctggatcttcgccgacgagcagggcgagcgcaccgtcagcccgcagaacaccttcatggtcaatgtcgccgaggtcatggcccaggcggccaaggccgacctcggcatcgccctgctgcccagctacgtggcggccgcggcgctgcgcaacggcgagctgctacgggtgttgcccggccatgccatgcaccagcggaccatctatgcgctgtatccctcgcggcgttacctggacgcgaagatccgcacctgggtcgatctgttgcaacaggaacttccccaggcattcgcccgcgacgaaactaccatgcaaagttcaagttactgggcacagtga

SEQ ID NO: 11907 - DNA, 1500 bp, Pseudomonas aeruginosa
agaccctgttcgactcggcgatcaccagcggcggcatcaccgccatcctgctcaacctgctgctgcccgaggagcgcgttgccgaagcggcgcaggccagcgcgaagggcggcgccctggcgcgctggcgcaagccgctgggttgatacgggcgtttgcaaatttttccgcgcctggcttgtgtcccgcggccgggctggggtatcaacgcggggatcacgccgatggaaacctgcgcatgaccctgacagtgcccgcccacgacccggccgcccgcgacaagccggccgggcgcatccgccagaagaacgaggaggcgatcctcgccgcggccgaggaggagttcgcccgccacggcttcaagggcaccagcatgaacaccatcgcgcagaacgtcggcctgcccaaggccaacctgcactactacttcggcaacaagctgggcctctacacggcggtgctgagcaacatcctcgaactctgggacagtaccttcaacaccctcggcgtcgacgacgatccggccgaggcgctggcccgctacatccgcgccaagatggagttctcccgccgctacccgctggcctcgcggatcttcgccatggagatcatcagcggcggagagtgcctcaccgcgcatttcaaccaggactaccgcagctggttccgcggtcgcgccgcggtattcgaggcctggatcgccgccggccggatggacccggtggatcccgtgcacctgatcttcctgctctggggcagcacccagcactacgccgacttcgccagccagatcggcctggtcaccggccgcaagcgcatgtccaggcaggacttcgccgccgccgccgacaacctggtgcggatcatcctcaagggctgcggactgaccccgccggcggcctgaacgcgatgccgagcaccctgcaaggcctcgccgaataccgcgaggaaatccgcaagagccgcttccacaccatcgccgcgccggtggccgacgaggacgaggcgcaggcgttcatcgccgcccaccgcgacgcttccgccggacacaactgctgggcctggaagtgcggcgcgcagtaccgcttcagcgacgacggcgaacccggcggcagcgccgggcggccgatcctggcggccatcgagggacaggacatggactgcgtggcggtgctggtcagccgctggttcggtggcatcaagctcggcaccggcggcctcgcccgcgcctatggcggcggcgcggccaagtgcctgcagcaggcgccgcgcagcgagctggtcgagcgctgtcgggtgcgcttcgcctgtgccttcgccgaccacgcgctgctcaaggcgcgcagcctggcgctgggcgccagcgtggcggccgaagactacggcgccgacggcgtcgtcctgaccctggagttgccggtggcgcgcttcgaggcgcttcaggcgctgctggtggacctcagccgaggccaggtgcggctgcagcggctggacgcctga

SEQ ID NO: 11908 - DNA, 993 bp, Pseudomonas aeruginosa
gcctgcatgccttcggcgatgcccagccggggcttggcgatgaagtccaccgcgcccagttccagcgcgcgcagggtggcttcggaaccgcgctcggtgagcgaggagatcatcagcaccggggtcggccgcgccttcatcagcttgtcgaggaaggtcaggccgtccattcgcggcatttccacgtcgaggctgatcacgtccggcgcgtgctgcttgatcaggtcgcgggcgacgaaggcgtccggcgcgcagccgaccaggcgcagctccgggtcggcctggatgatctccttgagcaggctgcggatcagggcggaatcgtcgacgaccaggacactgatgggcatggcgggctctcccggagagtcagaacaggtcgatggggccgccgtccgcgttgcggtcgatacggcggcggtagtcgcgttcacgctgcagcacggtgtcgttcttcagctccaccagggacttcaccaggacccggccattgcgcgggaagaagtagatcttgcgcgggaaggcctccagcacgtcgctggcgagcagcgggatacgctcggtggccaggtagtcgagggtgaactcgacgttgcgctggccgatggcggcgctgatctggcgcagtaccgagccgccgccgaagaccttggcctgcaggcgctcgcggctggcgccgagggccagcatgcggttgatcagcagttccatggcgtggctgccgtagcgcgccgacggcgaggccgggtcgccgccgaggccgcgctcggggagcatgaagtggttcatcccggcgatgccgttgagcgggtcgcgcaggcacaccgagacgcaggagccgagcacggtgacgatcaccaggtcttcgccgctggcgaagtattcgccgggcaaaagcttcaccgcatcgcaggcgaagtacggatcgtagtagcggttcagcggcgcgccttcccgggcctggagattcatcgcgatcaggccgggctgtag

SEQ ID NO: 11909 - DNA, 1074 bp, Pseudomonas aeruginosa
tggaactcctggttgccgaacaccggcgaaggcgtggaggtgggcattggcgtcgggtttccctggtcgaccctaagggcttgccgccctccgcctggcggaggcgcggcgtggtctcagaactcttcccagccgtcttccttgcgcgccttgctggcccgcgccatgccgctgcgggccagcggcgccggcgcgctggggcgtggcgcggacggccgcgcgctggcgagctggaccacgctcggcggagtgtccagcctgaacaccgccaccgactggttgagcaggcccgcctgctcctgcatggcctcggccgcggccgcggcttcctccaccagcgcggcgttctgctgggtcatgtcgtccatctgcgagaccgcgctgttcacctcttcgatgccggtgctctgctcggcggaggcggcggcgatctccgacatgatgtcggtgacccggcggatcgccaccacgatgtcgctcatggtctgtccggcctgggccaccagggtgttgccgttctccaccttgtccaccgagtcggagatcagcgtcttgatctccttggccgcggcggcggaacgctgggcgagggtgcgcacttccccggcgaccaccgcgaagccgcggccctgctcgccggcgcgggctgcctcgaccgcggcgttgagggcgaggatgttggtctggaaggcgatgccgtcgatcaccccgatgatgtcggcgatcttgcgcgccgactcgttgatcgaggacatggtgctgaccaccttctgcaccacggtgccgccctgggtcgccacttccgaggcattggccgccagcgagttggcctggcgggcattctcggcgttgagcttcaccgtgctggtcagttcttccatgctcgaggcggtttcctccaggctcgacgcctgctgctcggtgcgcgccgacagttcggcgttgccgctggcgatctcgctggcggcggtgttgatggtgtcggcggcctcgcgaatctgcccgagcatccgcgacaggctttgtgcggtgtcgttggagaaatccttgagctggccgaaggtgccctggtag

SEQ ID NO: 11910 - DNA, 1704 bp, Pseudomonas aeruginosa
ttgaccgcttcgacggcgacgatcaggccgtcgaggatcgccagggtcagcggcaggcggatgccgatgcgagtgcccatgccgggcgccgagtcgatgtcgatgcgcccgcccatggcaccgatgttgcgcttcaccacgtccatgccgacgccgcgtccggacagctcggtgaccgtctcggcggtggagaagccgggcatgaacaccagttgccagacctcggcgtcgctcatcccgtcatgcaccggcaggttgcgctcgcgggccttggcgaggatgcgcggacgcgacaggccgcgaccgtcgtcggaaacctccaccaccacgctgccgccctggtggctggcggcgagcttcaccgtgccgctcgccggcttgccggcggcgaggcgttcggcgggcgtttcgatgccgtggtcgatgctgttgcggacgatgtgggtgagcggatcgctgagtttctcgatcacgctcttgtccagttcggtgtgctcgccgtgcaggtgcagctcgacctgcttgcccaggcgcgtggcggtgtcgcgcaccagcctggggaagcggctgaagatgaagttgatcggcagcatgcggatcgacatcaccgactcctgcaggtcgcgggtgttgtgttcgagctgggccagggcgtgctgcaggcgctcgtggcggctcgggtcgagctgctcgccgagctggccgagcatggcctgggtgatcaccagttcgccgaccaggttgatcaggctgtcgatcttttccacgctgacccggatcgagccggactcgccgtcgccacgcactggcgcgactgcgcccctggccgtcgcggcgacggcttgcgcgggcgcactgggcgcggcggggctgccgggggcgccgtcgaacaggccgaaggcgcgttcctccgccggtggggaacccggtgcctcatcgaagaggccgaacgcttcgctcgcggccggtgcgccgggcgcctcgtcgaagagcccgaacgctcccggcgcggccgctcgttccggagcgcccgggccttcgtcgaagaagccgaaggcatcgtcgtccgcggtttccctggcgggactggcgggcgcgtcgtcgaacaggccgaagccttcctccgccgcttcctgttccggcacccgcagccagccgcgcaggcgctcgaccgtctccagcaacggcaccccggggtcgggacggccgctgcgatgggcgtcgagcaggcgctgcaacacgtcgcgggcttcgaggaaggaactgatcatgtccggccgcaggtgcatctggccgcagcggatgcggtcgagcagggtctccagttcgtgggtgacggcggtgatgtcgtcgaaaccgaacattccgctggaacccttgatcgaatgcgcggcgcggaagattccgtgcagcgtctcgctgtccggccggtccaggtcgagaccgatcaggaggagttcgagggtggccaggtgttcctcggtttcctcgaagaacacctggagaaactggctcatatcctggggcatgggacctcccccgcgggggaacgggaatcagggcaggaccttgcgcgtcacttcgagcagtttcggcgggtcgaacggcttcaccagccagccggtggcgccggcgctgcgtccctgctgcttcatcgcgtcgctcgattcggtggtcagcatgaggatcggcacgctgcggtag

SEQ ID NO: 11911 - DNA, 879 bp, Pseudomonas aeruginosa
gggtttccatgggaaagggcccgcataaaccattggtatcggctgaatatagcgattacccgctaccaggtctgcaatggacgacggaaactcggggcctgtctatccactccgatggagatttccatgtccgtatcctctgcatccctcgccggcaaagtcgccttcgtccagggcggttcccgcggcatcggcgccgccatcgttcgccggctggccgccgaaggcgccagcgtcgccttcacctacgtcagctcggcggacaagtcccgggccctggcggccgaactcgaaggcgccggagccagcatcctggccctgcatgccgatagcgccgacgcggcggcgctcgtcgccgccgtcgacgaagcggcggctcgcttcggacgcatcgacatcctggtcaacaacgccgccgtcctcgccctcggttcggtggaagagctgccgctggccgacttcgagcggaccctggcgatcaacgtgcgcagcgtcttcgtcgccacccaggcggcggtcaagcacatgggcgacggcgggcgggtgatcagcatcggcagcaccaatgccgaacgcatgccgttcgccggcggcgccacctacgcgatgagcaagtcggcgctggtcggcctgaccaagggcctggcccgcgacctcggcccgcgcgggatcacggtgaacaacgtgcagccgggtccggtggataccgacatgaacccggacgacggcgacttcgccgaggccctcaagggcctgatggcgctgccgcgctacgcccgcagcgaggaaattgccagcttcgtcgcctacttggccgggccggaagcggcctacatcaccggggccagcctgaccatcgatggcggtttctcggcctga

SEQ ID NO: 11912 - DNA, 531 bp, Pseudomonas aeruginosa
cccgggtcgcctcgttccacccggcgaagtagcccctctccccgaccttctggccagacgctccctcctgaagggagagggcgaggggagaggttccgcttatcgcaccaggaaaggcgaagccccctctacgacaccggtctcgctgacgtatcgcttccaatgctcgatcagctccgccagcttgcccggctggctgtcagcgaggtcgtggatctcgcccgggtcgcgggccaggtcgtagagctgccaggtggccgggcccaccggggccggcaggtacaccgccttccagtcgccctggcggatcgcacgcatgccgaacagctcccagccggtcacggtgttctcgtcgtgggccgcctcggtctcgccggaaagccaacccagccaagacctgccgcgcggctcggcgatctcgcggccgcgccagcgcttgcctgggtggcggacaccggcgaggtcgaggatggtcggggtgacgtccatcaccgtggcgaaggcatggctgatcgcaccctgccggcttag

SEQ ID NO: 11913 - DNA, 2304 bp, Pseudomonas aeruginosa
ccgcgggtagcgcaccagcgctggcacgcgaatcccgccctgggttgtgaacgccttgtacaggcgcgatggtgcggtggccgcctgggcccagcgcgggccataccagacgtaggaattggcgcggccgatgttttccaggctgttgtcgtagtgccggtcgagaaagcccagcaggtccgggccgaatttcgggaacgcctccagcagggcgccttcggcgccgttgtcggacatgaacaggacgaaggtgttgtccagctcgccctgccggcgcaggtagtccacgaccctgccgatgttccagtccatgcgctcgaccatcgccgcatagacctccatcgcccgcgccgacttagcccgttcctcgtcctccagggcctcccactcgcgggtcagggcgagcaccggatgggcttcgacgtccgcttccaccaggcccagctccttgagccgggccaggcgttcctggcgcagcgcttctggaccggcgtcgtagcgaccgcggtacttctcgacgatctcccgcggcgcttgcagcggccagtgcggcgcggagaacggcaggtaggcgaagaacggccggctctggtcgcgctccttgaggtattgcagcagcttgtcgccgaaggcgtcggaggaatagaagccctccggcagcgtgtcgaggtagcgctcgtcttccacgtagagcgctggcgtacccttgaggatgcgcggagtgctttcgtcgtagggcggctcgaaaccatagtggttggcggcgcccggcagcagcgagaaggaacgctcgaaaccgcgtgcatggggcgtctgttccggcttcagaccgaggtgccacttgccggccatgagggtctggtagccggcctcgcggagcagctccggcagcgccaccacgcgctcgttgagatgcccttcgtaacccggcttgccttccagttccggggtcagcgcctcggccatggtgccgatcccggcgatgtggtggtcggtgccggtgagcagcatcgagcgggtcggcgagcaggtcgaggcggtgtggaagtcggtcaggcgcaggccggcgatggccagggcgtcgaggttcggcgtggcgatctcgccgccgaaggcgccgatatcggagaagcccaggtcgtcggcgacgatcaccaggaagttggggcgtttgctcatgcgcgggtctcgtctggatgggaggagaaggtggggccctcgcccccgcccttcccgcagggggaaagggccagggcaaggggcttttcagcaagcgaggaattcgaagggcaggttttccacccgtcgcggcggcggcgcgacgtactcgccgtcggcggtcagttcgtgcagcagcgcttcgcgctggcgcaggaagtcgaagccaccgcgctcgcgcggatgcgccaggcccacctcgaccacccgcctgatccgccccggacgcggctccatcaccaccacccggtcggccaggtagagcgcctcctcgacgtcgtgggtgaccagcagggtggtgatacgggtgcgccggcggatcgccagcaactcttcctgcaactgctggcgggtcagtgcgtcgagggcgctgaacggctcgtcgagcagcagcaggcgcgggctggccaccaggccacgggcgatcgccacgcgctgggccatgccgccggacaactggtgcgggtaggcacgctcgaagccgtgcaggccgaccaggcggatgtattcgtcgatccgcgccgccttgtcggtttcgccaagggcttcgttgaccaggccgagggcgacgttctgctgcaccgtcagccaggggaacaggcggtgctcctggaacacgatgccgcgttcgccgccgatgccggcgattggccggccgtcgacgcggatctcgccgtcgtagtcgcggtccaggccgatcagcaggcgcagcagggtcgacttgccgcagccactggcgccgacgatggcgatgaactcgccctcgccgatctccaggtcgaactgctggatcgcttccagtcgccggccgtccacggcgaagtgcttgcgcacctggcggaagctgaccagcggggtgcccgtggcgggcgcggtgaatgcgttcatgcgtgtctccagcgcgtggcgcgcgcttcgatgcgttggccgagggcattgagcagggcgccggtgaggccgaccaggagcatgccggcgccgatcaggtccatgcggaacaattgctgggcgccgatcatcaggctgccgatgccgccgtcggagggcatgaagtactcggcgccgatggttcccagccaggcgtag

SEQ ID NO: 11914 - DNA, 723 bp, Pseudomonas aeruginosa
atcagcgccaggcgcaggccggcgaacaccgacggggcggcacccggcaggaccagccggagcagccgtcgccagggacccaggcgcagcacccgggccgcctcgccgaggctcggcggcaggctggcgatgccgcgctgggtggccagcagcagcgggaagaaggcggcgattgcgacgaacgtcagcttggccggttcgcccaggccgaaccaggcggtgagcagcggtacccaggcgaagatcgccacctgccgcagtgccgcgaaagtggggccgaagaagcgttccgccgggcgccacaggccgagcagcaggccgccgaggaaacccaggccgccgcccagcaggagcccgccgagcgtgcgcttcaggctgtcgaacagggcgcctgggaggctgccgtcgagcgctccgctccaggtcgcccgcgccacttccagagggctggcgaggatcgccggatcgacccattcggcgctgctcgccgactgccacaggagcagcagcgccagcggcggcagccacacctgcaggcgctgccagccgcgtcccggcgggcgccggcggaattcgccggtggcggcttgcggccagtgcagcaggcggcggtcgagccactggatggcgcggtccatgcccaccccgaccaggccgatgatgaggatgcagacgaacacgatgtcgagcatgaacagttgccggccctgcaccatcaggtag

SEQ ID NO: 11915 - DNA, 702 bp, Pseudomonas aeruginosa
ccgataccctcgctggaagcaagcaactcgaccgccagcagcgaggtccagccctgcgccagggccaggcgcagcccggtgaggaaggccggcagcgccgccggcaggatcagccgccagaccagcaggcgtggcggcaggcgcagtactgcggcggcttcgcgcagcttgggctgggcgtcgcgcacgccgaccagggtatggatggtcaccggcaccacgaccgctttcaccagcaccaccagcttgagcagttcgccgatgccgaagaacagcatgaacagcgggatccaggccagcgtggggatttgcgcgagggcgctgaaggtggggaagaccaggcgctcggcacgcggactgaagcccagccaggcgcctagcgcggcgccgctggcgaccccggcgagcaggccccaggccaggcgccgcaggctgatcgccaattcgctccagagttcgccggcgagcaactcgcgggcgctctgccagaccagctcgggagttggcagcacctgggccgacatccagtggcgatggctggcgacccaccacagcagcgccagcccgagcggcagcaaccagggcagcaggccgtcccccaggcgccgggcgaaagccgcggagggcggcggcgccaggcgcggcaggggccggctccaggcgggcgaaagggttttatcgatattcttcatgggaatataa

SEQ ID NO: 11916 - DNA, 1260 bp, Pseudomonas aeruginosa
ccgcacacccgctcccggcgggaatccctctcttcccgttccaaggagccgccccatgaaagcgcttacgtcttccctgctcggtctgttcgccgcgcctgtgctcgccggcctgctcggtgcctacgtgccgctggcgagcgccgctccgccgaaggaaatccgcatcgcggtgccggacgtcagcgccggcagttcgcactcgggcggcggcgtggtcgacgtgctctacacccgccagttgctggagaaggagttcgccaacgacggcatcgcggtgaaatggagcttcttcaagggcgccggcccggtggtcaacgaagcgttcgccaacggccaggtggacttcgcctacctcggcgacctggcggcgatcatcggcaagtccggaggcctggacagccgcctgctggccgctaccgcgcgaggggtcaaccactatctcggcgtgcagccgggctccgggatcaagaccctggaggatctcaagggcaagcgcgtaggcatctttcgtggcaccgccagccagttgtcgttcgacaatgccctggccagcgtcggtctcagcgagaaggacctgaaggtgatcaacctcgatttcagcgccgccctgtccgccctcgcagccaggcagatcgatgccacctggggcctggccggactgttcgccctgcgcgaccgcgggctcgcggaaattccgctgagcacccgcgacctgaacggcgccggcaccctgcaggcgctgctggtcggctccggagccttcgtcgatgcccatccggacatcaccgagcggctgctcaaggtgcagttgcaggcccaggactggctggcccgcgaggagaaccgcgacgcttacatcgaactggtgtcgaagcaggccagctacccggtggtgatcctgcagagcgagtaccgtggccgcaagctgggcgacgccctgtcgccgcgcctggacaccgatttccttggccggctggatgcttcgatccaggcggccaagcgtttcggcctgatccgtcgcgaattcagcgccgagcagtgggccgcgccggaactgctggaggcggccggcaagctggcgaaggccaaggccgtggcgcaggcggcggagtgacgccgagccggggacggccgaggcggcgccgtttcgtagcaatttgtaatatgtttcgagattcttgcaccgacccaaccaatgactggatcgagcgaagtatccagccgttggtcggggattctgcgtatatcgcgtcatga

SEQ ID NO: 11917 - DNA, 1680 bp, Pseudomonas aeruginosa
caaattgttcgacgcgacactcgatctcgaacgcgtgaaagtttcggtgagaacgctggtgaagttatcccgccaggaacaatcggcgatcatccggaccctcaacgagtttggtttcctgctgttgcgcagcgaacagggcgaagacaggcaggaacttctcgcgctcaaggagttgttcggccgcgccgccccccacccgcgcgccgacgccgacggcatcgtgccgatcagcaatgcgcggtatgtcagcggctacctcggctccacgccgctggagcacaagctgcacaccgacggcgctttcctcgacaccccggagcaattgtgcagcctgcaatgcgtgcgcaacgcccgggagggcggggagaccctgctggccagcgccggactggccttcgagcgcctgcgccggcgcatgccgaccaagcatctcggcctgctgcgcggcgacgccctgaccatcgtgcgcaagcaccagagcagcacccagccggtgttccgcctgaacggcgaggcgctgggcatcaagttccggcagaacgacggggcggccgaggtggtcgagcatcctgtggcggtggaggccttcgccgaactggtggcggcgctcgaggatccggcctgccaactgcggatcaagctcgagccgggggaaatcctggtgctcgacaacactgcggtgttgcacgggcgcactgccttctgcgccaacgaactgcgcgagatgcgccggctcaacttcgacggccacggccgcctgcgggcggagctggaactgggcttcaaggtggggttgtgatcgcacagttcgtcgcggtggtgctgccgatcctgatctgcaccgggatcggtttcgcctggagccgttccgccgggccggtggatacccgcgcgctggtgttcctggtggccaacgtcggctttccctgcctgctgctgtcgtcgctggaccgccccggcctgtccattggcatggtggccggggtgttcctcgccaccgcgctggcggtgctggcgttcgccctgctgggcctggtcgccctgcgcctgctgcggatgccggtgcggcgctacctgccgtcgatcatgctgccgaactccgggaacatgggcatccccatcgcctacctggccttcggcgaggaggcgctggtgtatgcggtggcgttctccaccctgatccaggtgggccacgcgacgctcggcgtctggttcgcttcgggcgatatcaccccggcgagcatcctgcgcaacccgatgatctatgccctggccgtggcgctgggcctgatcgccctgggctggagcctgccgccgccgttgcgcgatgtgacccgcctgctgggcgggattaccgtgccgctgatgctggtgatgctcggcctgtcgctggccggtctgcgcctgcacgagacctggcggccgttgctgctgtctctggtgcgggtctggggcggtttcgcggtcggctatgggatcgctgccggcctgggcatggaggcggtggcggcgggcaccttcgccatccagtgcgggatgccgaccgcggtgctcacctacctgttggccaagcgttacgacggaccggtgaacgaagtggcaggcatggtgctgatcaccacgctgctggtgctgctctccacgcctttgttcatccagttgctgccgcgcgcgtga

SEQ ID NO: 11918 - DNA, 543 bp, Pseudomonas aeruginosa
agcaccactaccgcttgccgctccgccgaacgccgcccggcggctccgactacgccctggccctgctgctcgccctcggcggtgcgttgccggccagtgccgccgatgctcccgcgcccgccgaggaagcgccgccgctggccagcagcgtcccggacaaggccgatacggccctgggcaaggtcactgtcaccgcgcgtcgccgcgaggaggattcgcagaaggtaccgacgccgatcaccgtgctcggcggcgagactctcgaggcccagcgcatctcccgggtgcaggacctgcagcaggtgctgcccagcgtcaatgtcgcctacatccatgcgcggcagtcgagcgtcgccgtgcgcggcatcggcaacaaccccgccagcgacggcctggaaggcagcgccgggatctacctcgacaacgtctacctgggacgtccgggaatggccgtgttcgacctgctggacatcgagcaactggagctgctgcgcggtccgcagggcaccctgttcggcaagaacaccaccgccggggtgctga

SEQ ID NO: 11919 - DNA, 477 bp, Pseudomonas aeruginosa
acatcagcacccgcgcgccgaccttcactgccgagcgtaccgtcgaggtctccggcgggcaggatggctacttccagggccgcggcacggtttccgggccgctcggcgaaaccctcgccggacgcctctcggcctatcgcacccgcgacgacggctacatcaagaacatccacgacgacaactatctcaacggcggcgagcgccagggcgcgcgcgggcaattgctgttcgagccgaacgaggacttcagcctgcgctggatcgccgactacaacgaggaggattcgagcaacggcagcatggtggtctacggcgccgccgagcgtttctggcagcgcgccgcgctggtcggcgcttcgccgttgcgcgatccgcagcgcaggaaggtcaacatcaacggccgccagcacgtcagcgtgcaccagggcggcagctcgctggaggccaactggaacctcgccggcggctaccgcctga

SEQ ID NO: 11920 - DNA, 429 bp, Pseudomonas aeruginosa
acgacacctactcgaaggccaacggcaagatcgagaccgacagcttcgcgctgttcgcccagggcacctggcacctcaccgaacgcctggacttcaccgccggcctgcgcggtacctacgaggagaagaacgccaaggtcgagcgcttcgctccgctgggcggcgcggcggtcggcggggtcggcgcggcggtgcgcaacggccagctcggcgcctacgattccggcgatctcagccagtacaacttcgccccttcggcgttgctcagcctcagctaccagttcagcgacgacctgctcggctacgccagcctgtcccacggcgagaagtccggcggggtcaacctggcggtgggcagcgcaccgagcgccggcgccgattcgctgctggtcggaccggagcgcgccaacgacgccgagctgggcctga

SEQ ID NO: 11921 - DNA, 639 bp, Pseudomonas aeruginosa
gcgccttcgccagcatcaacggctcctacaccgcatcggtggggcagccgcgcacgctcggcgtatcgctgcgctacgacttctgagccttcacccacgcagtaccccacgcatgaggaacatgacatgagcaatgcagcacaagccctcgccacgccggtacggctcgacgtccggccggtcgccggacggatcggcgcggagattcgcggcgtgaccctgtccggcgaactggacgccgccaccgtcgaggcgatccaggccgccctggtacgccacaaggtgatcttcttccgggaccagagccatctcgacgaccagacccaggaggccttcgcccacttgctcggcgaaccggtcgcccaccccaccgtgccgtcccgcgaaggcacccgcttcctcctcgagctggatggcgccgaaggccgccgggccaactcctggcataccgacgtgaccttcgtcgaggcctacccgaaggcctcgatcctgcgcagcgtggtggccccggagtccggcggcgacaccgtctgggccaacacggcgagcgcctacgccgacctgccggcggagctgcgcgagctggccgaccggctctgggcggtgcacagcaacgagtacgactacgccggggtctag

SEQ ID NO: 11922 - DNA, 390 bp, Pseudomonas aeruginosa
cccagcgcctcggtggagcagttggagaactaccgcaaggtgttcacctcgaccgtctacgagaccgagcacccggtggtccgcgtgcatccgcaaagcggcgagcggacgctgctcctcggccacttcgtgaaacgcctgaagggtctttcgcagcatgactcggcgcacctcttcgcggtgctgcaggggcacgtcacgcgcctggagaacaccgtgcgctggcgctggcaggccggcgacgtggcgatctgggacaaccgcgcgacccagcactacgcgatcgacgactacggcgaccagccgcgcgtggtgcgccgggtgaccctcggcggcgacgtgccggtaggcatcgacgggcaacgcagccggacgatccggaaggcatga

SEQ ID NO: 11923 - DNA, 792 bp, Pseudomonas aeruginosa
gcagtacttgcgcttcgccaccctgttcggctcggtgttccagccgccggcggacatcccggtgctgtcctcgggtggcgacggcaaggtgccggacatcgtcaaggtggccaacaccggcgacggcgaactgggcaacttcgccctgccggcacacatcgaccaccaatggacgccggtgccgtcctccggctcgttcctctacgcactggaggtgccgtccagtggcggcgagacgcgcttcaccaacctggcgcgcgcctacgagagcctcgacgaggcgacccggcgcgagatcgatggcctgcgcctgatcaactacaaccccttcatccgcctgcgcgagggcggctacggcggcggtttcgccacctaccgcacgccggacatcgaaccgatccagggcagcgagcacccgctggtacgcacccacccggaaagcggccggcgcgtactgttcctcagcgcccacaccgaggtggagattcccggctacgaccccgcgcggggccaggcgctgatcggtcgcctgcgcgaacatctggcgcgcccggaactgagctacagccacgcctggtcggtgggcgacatcgtctggtgggacaaccaggccgtgctgcatgcgcgcaacgccttcccggccagcgagcggcggcgcctgaagcgcatcagcctagcgggcagccgtccgttctgagccggcatcccccagcgtgcgccggctcctccgttgccgaccggcgtaggtcgctgcgcgccgctctggcgagccccttccgttccggcgaatag

SEQ ID NO: 11924 - DNA, 213 bp, Pseudomonas aeruginosa
aggcttttcggctcgattgcacaatgccgcgccaaggttcgttcgcgaatcgcggtatgtgagctagacctccgcagccggtgcgccatccgcagtgccccggactactcgacaatcacgcaggagattcgtgagtgcagatcggtgtccccctcgagacccatgccggtgagacgcgggtttccgccaccccggaaaccgtcaagaagctga

SEQ ID NO: 11925 - DNA, 1437 bp, Pseudomonas aeruginosa
ccccgctgggcaaggccatgggcaccctcgccgtggccctggccgcggtcaatgtgttcggtggcttcctggtcacccggcgcatgctggaaatgttcaagaagaaagcgccgaaggcggggggccactgatgagcatgaacctggtcaccctcctgtacctcatcgcctcggtctgcttcatccaggccctgaaaggcctgtcgcacccgaccacctcgcgccgcggcaacctcttcggcatggtcggcatggccatcgccgtggccaccaccgtcggcctggtgttcaagctgggcgcggagatcgccaccaccggcgtcggctacatcgtcgtcggcctgctggtcggcggtaccgccggctcgatcatggccaagcgcgtcgagatgaccaagatgcccgagctggtcgccttcatgcacagcatgatcggcctggccgcggtgttcatcgccatcgcagcggtggtcgagccgcagtcgctggggatcgtcgcgcacctgggcgacaccattcccaccggcaaccgcctggagctgttcctcggcgcggccatcggcgccatcaccttctccggttcggtgatcgccttcggcaagctctccggcaagtacaagttccgcctgttccagggcaccccggtgcagttctccgggcagcacctgctgaacctggtgctcggcctggcaaccctcggcctgggcctggtgttcatgttcaccggcaacctcaccgccttcgccgtgatgctggcgctggccttcgtcctcggcgtgctgatcatcatccccatcggcggcgccgacatgccggtggtggtgtcgatgctcaactcctattccggctgggccgcggcgggtatcggcttctcgctgaacaactcgatgctgatcatcgccggctcgctggtcggctcctcgggcgcgatcctctcctacatcatgtgcaaggcgatgaaccgctcgttcttcaacgtcatcctcggcggcttcggcgccgaagccgacgccggcggcccggcgggctccaaggagcagcgtccggtgaagtccggttcggccgacaatgcctcgttcctgctgaccaacgccgacagcgtgatcatcgtccccggctacggcctggcggtggcccgcgcccagcacgcgctgatggaactggcggagaagctgacccatcgcggggtcaccgtgaagttcgccatccacccggtcgccgggcgcatgccggggcacatgaacgtggctgctggccgaggccgaagtgccctacaagcaggtgttcgagatggaggacatcaactccgagttcggccagaccgacgtggtcctggtgctcggtgccaacgacgtggtcaacccggcggcgaagaacgatccgaagtcgcccatcgccggcatgccgatcctcgaggcctacaaggccaagaccgtga

SEQ ID NO: 11926 - DNA, 600 bp, Pseudomonas aeruginosa
gcgcctgcgccggcgcgcacctggcgccggatgcgcggcgccgcgccggccaggccttcgtgcccgccgagcggctggggcacggcgcggtggccggagatgagcctggcggacaatgcgctgctcaccgccttccagcagggactggtgaagcgcgggttggtccggcggcgcaaggtgctggcgctggccgaggagatcatccgccgtttcgccgtgaaggccccgggtgccggggcgccggcacgcatcctttccggcggcaacctgcagaagttcatcctcggccgcgagatcctccaggccccgcgcctgctggtggcggcgcatcccacctggggcgtggacgtcggcgcggcggcgctgatccaccgcgcgctgatcgccttgcgcgatgccggtacggcgatcctggtggtctccgaggacctcgacgagctgttcctgctcagcgaccgcatcgccgcgctgtgttcgggtcggctgtgcccggcggtcgccaccgcgagcgcttcgccgcagcaggtcggcggctggatggccggtcaattcgaggcgccggcggcagtcgccggcgccgttgcccaagggagcctgtga

SEQ ID NO: 11927 - DNA, 1017 bp, Pseudomonas aeruginosa
tcctctaccgcccacgtttgcacggacgctggcgcaagcgcccggcgctgcgcgacgccctggcctgagccgaaccgccgaggaaccacgatggatatcgatctgctcgacaacctgctgttcgccatggtccgcaccggtactccgctgctgctggtggccctgggcgaactggtctgcgagagaagcggggtgctcaacctgggccaggaggggatgatgctgttcggcgcggtgatcggcttcatggtcgccttctccagcggcagcctgtggctcggcgtgctcctcgcggtgctcgccggcatgctgctggcggcgctgttcgccggggtcgccctgtacctgaacgccaaccaggtggcctgcgggctggcgctgaccatcttcggcgtcggcctgtcgtcgttcgtcggcgccgcctgggtcggcaagccgctgcaagggttcgccccgctggcgctgccggtgctgggcgagttgccgctgctcgggcgcatgctgttcgcccaggacgcgctggtctacctgagcctggcgctgttcgccgcggtcgcctggatgctcctgcgcagccgcgccgggctggttctccaggcggtcggcgagaaccccgacgcggccagcgcgatgggcctgccggtgctgcgcgtgcgcaccctggcggtgctcttcggcggcgccatggccggcctggccggtgcctacctgtcgctggcctacacgccgatgtgggcggagaacatgaccgccggacgcggctggatcgccctggcgctggtggtcttcgccagttggcgggtgttccgcgtgctgctcggtgcctggttgttcggcctggccagcatcctgcacctggtggcccaggggatcgggctgtcgattccggccaacctgctggcgatgctgccctatgcggcgaccatcctggtgctggtcctgctctcccgcgatgccctgcgcacccggctgtatgccccggtttccctgggccagccgtggaaggccgggcactga

SEQ ID NO: 11928 - DNA, 1251 bp, Pseudomonas aeruginosa
  unsure (1010): Identity of nucleotide at the above locations are unknown.
tccggacctccgcgccggagtgacccggccagcgaccgtcgaaccagggacgcccggagcgcgaaagcgccccgggcgttttcgttggcgcgaccgcccgcctcaggccgggatatccaggttcgcgtggcccggcgcggcggccgcctcggcgtagaccttctcgtcgtcctcgatcacccgcgaggccggccccaccagcaacgggtcgggctcatgggcgatgcgccggtccttgtccgggtagtccagcgagtgcaggaagtggcggatgcagttgagtcgcgcgcgcttcttgtcgtcggacttgatgaccgtccacggcgcgtcggcggtgtcggtatggaagaacatcgcctgcttggcggcggtgtagtcgtcccacttgtccagagacttgatgtcgatgggcgacagcttccagtgcttgagcggatcgtcgcggcgcgagatgaagcgccgcagttgttcctcgcggctcaccgagaaccagtacttgaacagcaggatgccgctgttggtgagcatgcgctccagctccggcgcctggcgcatgaactccaggtattgcagcggcgaacagaagcccatgacccgctcgacgccggcgcggttgtaccaggagcggtcgaagaagaccatctcgccggcggtgggcagatgttggatgtagcgctggaaataccactggccctgctcctgggaggacggtttctccaaggctacgatccgcgcgccgcgcgggttcaggtgttccatgaagcgcttgatggtgccgcccttgccggcggcgtcgcggccttcgaacaggaccaccacgcgctggccggtctccttcacccagctctgcaccttgagcagttcgatctgcaggtcgtgcttggccttctcgtactcgttgcggcgcatccgcgtgtgatagggatagttcgccggcaggctcgccgaggtgctgtcctcgctgttgccgtggggcgcactggcgacctgcagggccaccggcttctggntgattgcctggatctcctcgcgggccttctgcgccgggctggccactcgcgggcggcgggtcgccggcttgcgcggggcgcggcgggcggctggccgggccggcttggccggctgcgcggcgggttgctcgggggaggggggactgacagtgggttcttcgctcatgcgggactccttccgttctacgttttcagctatgcagtcccccactctatgcccctgccgggaggcgtccgttga

SEQ ID NO: 11929 - DNA, 837 bp, Pseudomonas aeruginosa
  unsure (752): Identity of nucleotide at the above locations are unknown.
gctggctctcatcaaccgagggccggcagcgttcgcgccggcccgccgatccgacgaaggtccgcacatgtcccgcacctggattcgcagtcccctcgccatcttcaccgccaacggtctcgacgccgccggcggcctggtcgtcgaagacggccgcatcgtcaagctgctcggcgccggccaacagcccgcgcagccctgcgccagccagttcgacgccagccggcacgtggtgttgccggggctggtcaacacccatcaccacttctaccagaccctcacccgcgcctgggcgccggtggtcaaccagccgctgttcccctggctgaagaccctctacccggtctgggcgcggctgaccccggagaaactcgaactggccaccaaggtggcgctggccgagctgctgttgtccgggtgtaccactgccgccgaccaccactacctgtttcccggcggcctcgaacaggccatcgacgtgcaggccggggtggtcgaggaactgggcatgcgcgccatgctcacccgcggctcgatgagcctcggcgagaaggacggcggcttgccgccgcagcagacggtgcaggaggccgagaccatcctcgccgacagcgagcgactgatcgcccgctaccaccagcgcggagacggtgcccgggtgcagatcgccctggcgccctgctcgccgttctcggtgactccggagatcatgcgcgccagcgccgaactggcggcgcgccacgaggtacgcntgcacacccacctggcggagaccctcgacgaggaagacttctgcctgcagcgcttcggcctgcgcaccgtggactacctggatag

SEQ ID NO: 11930 - DNA, 1083 bp, Pseudomonas aeruginosa
actgtggcattccccaccaggagccgccccatgttacgcgccgcccgcccatgcaatcgcttttgcagccttctgctaggactcgccctgctgatgcccgccagccttcctctgtccgctgccgaaacggtggcgccgccatcgccgcggacgctgatcatcgacaccgatccgggcgccgacgatgtgatcgccctgctgttcgccatggcctcgccgaaggagctgaagatccaggcgctgaccaccgtcgccggcaacgtgccgctggaaaagaccgcgcgtaacgcccggctggcccgcgagtggggcaagcgcccggatatcccggtctacgccggcgccccgcgaccgctgctgcgcacgccgatctacgccgccgacgtgcacggcagcgaaggcatcagcggcgtcgaggtgcatgagccgaagcagccgctggccgaaggcaacgcggtggactacctgatccgtaccctgcgcgcggcgccggagaagagcgtgaccctggccatgctcggcccggagaccaacctcgcgctggccctgacccaggccccggacatcgtcaagggcatccgcgagatcgtgatcatgggcggcgcccacttcaacggcggcaacatcaccccggccgccgaattcaatatcttcgccgacccccacgcggcggaaatcgtgctcaagagcggggcgccgatcaccatgctgccgctcgacgtgacccacaagatcctcaccagccccgagcgcatcgccaagctgcgcaacctcggcaaccaggccggcaagaccgtcgccgacatcctcgacgcctacgtccagtacgacatcaagtactacggcctgaagggaggcccggtgcacgacgccacggtggtcgcctacctgctcaagccctcgctgttcaagggcaagcggatcaacgtgcaggtcgacagccgcgagggcatcaccttcggccagaccgtggccgactggtacggcggcctcaagcagccggccaacgtcgagtggatcaacgagggcgatgcccaggggttcttcgacctgctcaccgagcgtatcgcccgcctgccctga

SEQ ID NO: 11931 - DNA, 510 bp, Pseudomonas aeruginosa
gcacctggttcgatccgggcaaggaggctgacggcgcccaacgcgctgatcgaccagggcgtcgacgtggtgttccagcacaccgatagcccggcaccgatccaagccgccgagcgtcgcggggtgtacgccgtgggatacgcctcggacatgcagcacttcggtccgaagaccgtgctcacctcgatcgtcaacgactggggcccgcactatatccgctcggcccaggcggtgatggacggcacctggaaatccgaggacttctggggtggcctggccgagagtacggtggtcctgccgctgaaccaggaggtgctgccggcgccggtgcgggaagaggcgggcaggctgatcgagtcgatccgcagcggagccttccaccccttcaccgggccgatccgcgaccagtccggcaaggagcgtttcgccgccggcgtcagcgcgaccaatgccgacctggcgtcgatgaactattacgtggaaggcatcaaggccgacctgccgaagtga

SEQ ID NO: 11932 - DNA, 1035 bp, Pseudomonas aeruginosa
gccctggccttgtatggaaaaagtcgccgagcgcaggcactttccgtacaggacccatcgaggagagcgcgattggaccgtctacccatcatcgacatcgccccgctctacggcgccgaccgtggcgcctggaacgacgtggcgcggcggatcgaccaggcctgccgcgagtggggcttcttctacatcgccggacacccgttgccggccgcgcgcttcgaagccctgctggcggcggcgcgggagttcttcgcgctgcccgtcgaagagaagctgaagatcgatatcacccgtagccgcaatcatcgcggctatggcgcgatcgccaccgagcagctcgacccggcgttgcccagcgacttcaaggagaccttcgacatggccctgcacctgccggcggagcatcccgacgtgcgcgccggcaagtccttctacgggcccaaccgacaccccgacctgcccggctgggaggccctgctggaaggacactatgccgacatgctggcgctggcccgtaccgtgctgcgcgccctggccatcgccctggggatcgaggaggacttcttcgatcgccgcttcgagcagccggtcagcgtgttccgcctgatccactatccgccggcctcggcccggcagagcgccgaccagcccggcgccggcgcgcacaccgactacggctgcgtgaccctgctctaccaggacgccgccggtggcctgcaagtgcagaaccgccagggcgaatggatcgacgcgccgcccatcgacggcaccttcgtggtcaacatcggcgacatgatggcgcgctggagcaacgaccgttaccgctcgaccccgcaccgggtgatcagcccgcgcggggtgcaccgctactccatgccgttcttcgccgaaccgcacatggacaccgagatccgctgcctgccgggctgcttcgacgcggacaacccgccgaagtatccgccgaccacctgtggcgattggctgacctcgcgcttcgcgcagacctatgcctatcggcgcggcgaaacggcctga

SEQ ID NO: 11933 - DNA, 288 bp, Pseudomonas aeruginosa
ctcccgggacaggttaaacttgccggccaagaccagcctgatcgagaacccaccccatgtacgaatggctcaacgccttgcccaaggccgaactgcacctgcacctggaaggtaccctggagccggagctgctgttcgccctcgccgagcgcaaccgcatcgccctgccctggaacgacgtcgagaccctgcgcaaggcctacgccttcaacaacctgcaggaattcctcgacctttactacgccggcgccgacgtgctgcgcaccgagcaggacttctacgacctga

SEQ ID NO: 11934 - DNA, 723 bp, Pseudomonas aeruginosa
cccggcgcgcgacccgcaaggcgtttcgtcgtcgccggcttctcggtattgatgataagcattatcatttgcgggcctgctcagcattcccatggcgccgccccggcgccggctttcgtgcagccgtcctcaccgatgcccgaccgcgacctacctcccggcccgcgcccggatgccttgccggcagacggcgatgcggcgcgccgcgcggatctcctcaaggccttcctggcccagcgccagcgcatggaaagcctggtcagccgctgggtctgctgccgggcgaccgccgccgacctggtccaggagctgttcctgcgcttctggcggcgcccggccgccccggtggaggagcttggcagctacctcctgcgcagcgcgcgcaacctggccatcgaccacttgcgtggcgaaggatcgcggcaacggcaactggacgattggctgccggagcagcgccagggcgagccggtcagtcccgagcaggcgctcgaggccggcgaccagtggcgccgggtcgaggccgccttgcgcggcctgcccgagcggacccggcggattttcctgctcaatcgcatccacggccgcacctacgcggagatcgcccaggccatgcagctttcccaaagcgccgtggaaaaacatatgatgcgcgccctcgacgcctgcaaggcgagcctggccggcccggccggcgagcaggcaaggagcgcccagccatga

SEQ ID NO: 11935 - DNA, 372 bp, Pseudomonas aeruginosa
gcggaacgctgcaactggccgggatgcaacatgacctgcaattcggcatggaccacgagaagcgcaagatcttccgcgccgacctgctgcgcgacagcaagaccagccgcttcgactacctcgacccggtctatggccaggtggtgccgtcgacccgggtggtcgccggcgacagcgaccagaccgacaagctgcgcagcgactcgctgtacttccaggactcgatccacctggacgaacgctggatcctggtcggcggcgcgcgctaccagatctacgaccagctcgccgggcgcggccggccgttcaacgccaacaccgatatcaacgggcagaaatgggtgccgcgcggcggcctggtctaccgcctga

SEQ ID NO: 11936 - DNA, 1308 bp, Pseudomonas aeruginosa
agaacctgttcgaccgcacctactacccgtccagtgccaatcgactgtacgtggcgatgggcgagccccggcagttccaggtgtcgacgacggtggagttctgagtcggcgctcgctccaggtggggttccccggcgtcctcctggacgtggaggcccccctgaagggcgaagggtcggcgcgatgctgcccgaccatgctccatccggttccttcttcccccagggaagggattgcccggcgcgtgagtcgttccgccatccagtgccttctccctttggggaaaggaaggcggagaaccgcctggcacgacctcgccgcacgccacacctcgttcccaacccgcccgttgggtaccatgcccgcaccactcgccgccacggccgccccatgaacctcgacaaccgcatcaagttccgccacctcgcctgcttcctcgaagtcgcccgccagcgcagcttcgccaaggcggcggatgccgtggcggtgtcgcagccggcgatctccaagaccctcaaggaactggaggaaatcctcggcgcgcgcctgttcgaacggagcaaggccggcgccgagctgaccgaggcgggcgtgaccttcctgcgctatgccggcccctgcgtgcaggccctgcgcgacggggtgaacaccctgcgcggccacgaggcgcaggtcgagacggtgcgggtcggcgtgctgtcgacggtggagagcctggtggtgcccgaggtgatccggcgcctgcaccggcgccacggtgcgctggtggtcagcgtcgccaccggacccagcgcctacctgctggcgcaactgaaggtcggcgagctggacctggtggtcgggcggatgaccgatagcccggacatccagggcctgaccttcgagcacctgtacagcgagtcgatgatgctggtggtgcgtcccggccaccccttgctcgccgcgcccctcggcgacctgcagcggctggccgaattcccactggtgctgccgctggccggcaccaccatccgccgccacgccgacagcctgttcgtgcaatggggcatcgcgctcgccggacagcgcctggaaaccctctcgccgaccctcagccgcagctatgtgttgcgcagcgaggcgatctgggtggcgccgcgcgatgccgtgcgcctggacgtcggcaacggcgagctggccgagctggacctgggtatccgcgaaccgggcggttcggtcgggctgtgccacaacgcggccttgccgttgccgctgggggcgcaatggttcagcgcggtgttgcgcgaggtggccgccgagttgcactga

SEQ ID NO: 11937 - DNA, 444 bp, Pseudomonas aeruginosa
gcatcccgcaatcgctctcggaaaccagcgggccggacttctcccacctcaggctcggccgccacgacaacgacctgctgctcaacttcgaccacggcggcctgccccagggcgagcgcatcatcatgttcggccgggtcttcgaccagtacggcaagccggtcccgcacaccctggtggagatgtggcaggccaacgccggcgggcgctaccggcacaagaacgaccgctacctggcgccgctcgacccgaacttcggcggcgtcggccggaccctcaccgacagcgagggccactattacttccgcaccatcaagcccgggccctatccctggcgcaacggccccaacgactggcgcccggcgcacatccacgtgtctgtcagcggcccggcgatcgccgcgcggctggtcacccagatgtacttcgagggcgacccgctga

SEQ ID NO: 11938 - DNA, 702 bp, Pseudomonas aeruginosa
gcatggccaacccgatggattgcctggcctaccgcttcgacatcgtcctgcgcgggcagcgcaagaccttcttcgagaacgtctgaggagccgaccatgagccacgaactgctgcgggaaaccccttcccagaccgccggtccctatgtccacatcggcctggcgctggccgccgccggcaacccgacccgtgacctggagatctggaaccgcatggcccgcgaagacgcgccgggccagcacatcctcctgctcggccacgtctacgacggcaacggccacctggtgcgcgactcgttcctggagttctggcaggccgacagcgaaggccgctaccaggagcgctacgatccggagcgaccgttcaacagcttcggccgcaccgccaccaccttcgatgccggcgagtggaccctgcacacggtcaagccgggggtggtgcgtaacgcccagggcgtgccgatggcgccgcacatcaacgtctcgctgttcgcccgcggcatcaacatccacttgcagacccggctgtacttcgatgacgagaccgaggccaacgccgcctgtccggtgctcaacctgatcgagcaggcgccgcgtcgcgacaccctgctcgcgcagcgctgcgaagtggacggacagctcgcctaccgtttcgacatccgcatccagggcgacaacgagacggtgttctttgacttctag

SEQ ID NO: 11939 - DNA, 2313 bp, Pseudomonas aeruginosa
tcgcaatccttggggacgcggctagaatccctgccaattctgggagtttccggccggatcggccggtatctgtatggatcgcgaaggggaaggcatgtcagacgccagaggcgcttttcattccaaaggtcgctggtcgcggatggcgctgcccgccatcctgtgcgccggcctgcttgtcggttgcggcgccgagccgcccgccgaggaacacgtccgtgtgctggcgcagacggtgaagatggccgagttcgcctcggccacctcgatcaccggcgacatccaggcacgggtacaggccgaccagtcgttccgtgtcggcggcaagatcgtcgagcgcctggtcgatgtcggcgaccacgtcgcggctggccaggtgctggcgcggctcgacccgcaggaccagcgcagcaacgtggagaacgcccaggcggcggtcgccgcgcagcaggcgcagtcgaagctcgccgacctcaactaccagcggcagaaggcgctgctgcccaagggctacaccagccagagcgagtacgaccaggcgctggcctctgtgcgcagcgcgcagagttcgctgaaggccgcccaggcgcagttggccaacgcccgcgacctgctttcctataccgagctgcgtgcctccgacgccggggtcatcactgcccgccaggccgaggtcggccaggtggtgcaggccaccgtgccgatcttcaccctggcccgcgacggcgagcgcgacgcggtgttcaacgtctacgagtcgttgttcagccacgatgtcgacggccagcggatcaccgtcagcctgctcggcaagccggaagtcaccgccagcggcaaggtccgcgagatcaccccgacggtggacgagcgcagcggtacgctgaaggtcaaggtcggcctcgactcggtgccggcggaaatgagcctcggcagcgtggtcaacgccagcgtcgccgcgccggccgagcacagcgtggtgctgccctggtcggcgctgtccaaggtcggcgagcagccggcggtctggttgctcgaccagcaaggcaaggcgcgtctgcaaccggtgcgggtggcacgctacgccagcgagaaggtggtcatcgacggtggcctggaggcgggccagacggtggtcacggtgggcggccaactgctccatccgggccaggtggtcgaggtggcccagccgccgcagccgacccagagcaccgccagccgcgacgccgtgggcggaggccagccatgaagccgttttccctcgccggcctgttcggcttcgccctgctcctctccggctgcggcgacgagccgccgccggcaccgccgcggccggtgctgacggtgaccgtgaagaccctgaagaacgacgacctcggtcgcttcgccggtagcatccaggcgcgctacgagagcgtgctcggcttccgcaccaacggacggatcgcctcgcgcctgttcgacgtcggtgacttcgtcggcaagggcgcgctgctggcgaccctcgaccccaccgaccagcagaaccagttgcgcgccagccagggcgacctggccagcgccgaggcacagttgatcgacgcccaggccaatgcccggcgccaggaagaactgttcgcccgcagcgttactgcccaggcgcgcctggacgatgcgcggacccgcctgaagaccagccaggccagcttcgaccaggccaaagcggcggtgcagcaggccagggaccagctttcctacacgcgcctggtgaccgatttcgacggcgtcatcaccacctggcacgccgaggccgggcaagtggtcagcgccggccaggcggtggtcaccctggcccggcccgaagtgcgcgaggcagtcttcgacctgcccaccgaggtcgccgagagcctgccggccgacgcgcgcttcctggtcagcgcccagctcgacccgcaggccaggaccaccggcagcatccgcgagctgggtccgcaggccgacgcctcgacccgcacccgtcgcgtgcgcctgagcctggcgcagacgccggaggcgtttcgcctcggttcgaccatccaggtccagctgagcagcgccggtagcgtgcgcagcgtgctgccggccagcgtgctgctggagcgcgacggcaagacccaggtctgggtcgtcgatgggaaacagtccagcgtggccctgcgcgaggtacaggtgctcagccgcgacgaacgccaggtggtgatcggacagggcctggccgacggcgaccgggtggtccgcgccggagtctacagcctcaagcccggccagaagatcaaactcgacgaggatgcgcgatga

SEQ ID NO: 11940 - DNA, 534 bp, Pseudomonas aeruginosa
tcaccggcgagcgccagttgcccgactcggagttcgtcgcccagcgcctgggcagcatccacagcgtgctctgcgccagtcccggctacctgcagcagcgcggcgtgccacgctcggtggacgacctggagcgccacgtctgcctgcgcctgcaggacccggcctacccggagggctggatcttcgccgacgagcagggcgagcgcaccgtcagcccgcagaacaccttcatggtcaatgtcgccgaggtcatggcccaggcggccaaggccgacctcggcatcgccctgctgcccagctacgtggcggccgcggcgctgcgcaacggcgagctgctacgggtgttgcccggccatgccatgcaccagcggaccatctatgcgctgtatccctcgcggcgttacctggacgcgaagatccgcacctgggtcgatctgttgcaacaggaacttccccaggcattcgcccgcgacgaaactaccatgcaaagttcaagttactgggcacagtgaaggattgttgttattgaggtaa

SEQ ID NO: 11941 - DNA, 210 bp, Pseudomonas aeruginosa
acagggtgtcatcggagacgcgccatgaatcgccagatccttgctgccgccatactcagtttgttttccctcgcattttcccaggccggtttcgccgaagagtcttcgctgatgaccaaccgcatggtcgacgccaaccagcaggccatcgagcaccagcaggaactttccgcctccgccgcgcaggccggggcccgcagcgactcctga

SEQ ID NO: 11942 - DNA, 216 bp, Pseudomonas aeruginosa
ttgtcgctggctgtcgacgatattcgttctgtcttcatcgatctcgccatgcaagagcgggacgtggaaagcctaaagcctgatgagtcgaagagactttcaatagaagagtccgactgcgttccagccggtttccagtgtccggaaatacactggcaagacttcccgacgccgaactttgattgctcctattcgacgtcttctcaaggccgctga

SEQ ID NO: 11943 - DNA, 933 bp, Pseudomonas aeruginosa
accggccgtggcaggcgggcgagggtgggaatcgggcggtgcagttccgcaggctgtccgttcatcgtcatgacttggcgtcgtgtcgctagtcggcagagtctggcagggctaacctgccgcctcaagtttcccggagcccacgccgatgctcgacttctccgcccacgcgcttccctacgcctcgcaacgttcgccggtccatgcccgccgcggcatggtcgccacctcgcagccgcaggcggcgcaggtcgggctggagatattgcgccgtggcggcaatgccatcgacgcggcgatcgccaccgccgccgcgctgacggtggtcgagccgaccggctgcgggattggcggcgatgccttcgccctggtctggacccgcggacgcctgcacggcctggacgccagcgggcgcgcgccgggcctgctcgatcgcgagcgggtgcgcgccgccggccacgagcggatgccgctgtacggctggacgccggtcaccgtgccgggctgtccggcggcctggggcgaactgtcgcggcgcttcggcaaattgccgttcgaacaactgctgcggccggcgatcgagctggctcgcgatggctttccggtctcgccggtgatcgcccgcctgtggcagagcggcctggacaagttccgcgcggcgttgccgcagcggcccgagctgcgggcctggttcgacgagttcctcatcgacggccgggcgccgcgcgccggcgaggtgttccgccagccgggccaggccgacaccctggacgagctggcgcgcagccagtgcgaaagcttctatcgcggcgagctggccagggccatcgtcggccacgccgagcgcagcggcggctacctgcgcgcggaggacctggccggctaccaggcgaagtgggtcgaaccgatctcactgaactaccgtggctatga

SEQ ID NO: 11944 - DNA, 876 bp, Pseudomonas aeruginosa
cgtctgggagattccgccgagcggccagggcctgatcgccctgatgaccctgaacatcctcaagggcttcgaattcggcgagcgcgactgcgcgcggacctggcatcgccaactggaggcgatgaagctggcgtacgtcgacgggctgcactacatcagccagccgcagtcgatgcgggtctcggtcgaggaactgctgcacgaggactacgccgccagccgccgtgcgctgatcggcgagcgcgcgctcgatcccagccccggccagccgaggccgggcggcacggtgtacctggcctgtggcgacgaggagggcaacctggtctcgttcatccagagcaactaccacggcttcggctccggcgtggtggtgcccggcaccggcatcgccttgcagaaccgcggcgccgagttcagcctcgatccggaccacgtgaattgcctggagccgggcaagcagaccttccacaccatcattcccggtttcctcagcaaggacggcgtgccgctcggcccgttcggcgtgatgggcgcctatatgcagccgcagggccacgtgcagatggtgatgaacctggtggacttcggcctcaacccccaggctgccctcgacgcgccgcgctggcagtggctgggcgggctgcgcgtcggcatcgaacatgccgcgccgcgcgcgctggcggcggagctggcgcagcgtgggcaccaggtggagatcgcctacgactcgaccagctacgggcgcggccagatcgtcctgcgcgacccggccagcggcgtgctctgtggcggcaccgagccgcgcaccgattcgcagatcgcggtgtggtgaggggacccatgtgggtgaggcggggagacctgtccggcggataa

SEQ ID NO: 11945 - DNA, 981 bp, Pseudomonas aeruginosa
aaaaacaggcgttcccttcgccgcaggaaacccggcgaagcgcccgcgccgtcttggcttcgttcttgctatccatggcgaggcctgaccgctcggacaggttcgcccactagaagaaaagctattcactccaggagcgtttcaatgagccgcacactcgccaccgtgatgctagccggggggctactggccgcaggccaggctgtcgccgaagaccatgacatgacgccgacccacgagaccgactcggggccgctgctctggcacaacgagagcctgacctacctctacggcaagaacttcaagatcaacccgccgatccagcagaccttcaccctggaacatgccagcggctggacctggggcgacctgttcatcttcttcgaccagatcaactacaacggcaaggaagacgccagcaacggcaagaacacctactacggcgagatcactccgcgcctgagcttcggcaagctcaccggagcggacctctccttcggcccggttaaggacgtgctgctggccggcacctacgagttcggcgaaggcgataccgaggcctacctgctcggcccgggcttcgacctggcgatccccggcttcgactacttccagctcaacttctactaccgcaagcccgacggcaaccgcgtgcgcgccggcgcctggcagatcaccccggtgtggtcctacaccattccggtgggcaactccgacatcctcatcgacggctacatggactgggtgatcaacaacaagagcgccagcaccagccgccgcaaccagagcgactaccacgccaacctgcacttcaacccacaggtcaagtacgacctgggcaaggccctcggctacgaggcgaagcacctgtacgtgggcctggagtacgactactggtccgacaagtacggcgtgaaggactcgcagtacttcaccaccgaccagaacaccgccagcttcctggtcaagtaccacttctga

SEQ ID NO: 11946 - DNA, 2175 bp, Pseudomonas aeruginosa
gacggccccgatgcacagcgaagaccaacgccccaacgacctcatctacggcctcgacgaccggccgcgcccgcttcccgccttccttgccgcgctacagcacgtgctggccagcttcgtcggcatcgtcactccgccgctggtgatcggctcgctgctcggcctcggcgagcacctgccatacctgatcagcatggcgctgatggtttccggcgccggcaccctgatccaggcgcgccggccgttcggcatcggcgccgggatgatctgcctgcaaggcaccagcttcgccttcctcggcgccgtgctggccgccgggatgctggtgaagcagcgcggcggcggtcccgaggagatcctcgcgatgatcttcggcgtgtgcttcttcggcgccttcgtgcagatcgtcctcagtcgtttcctcggccatcttcgccgggtgatcacgccgctggtcaccggcatcgtcatcaccctgatcggcgtcagcctgatcaaggtcggcatcaccgacctcggcggcggagccggggccacggacttcggcgcaccggccaatctcgcgctgggcgcgctggtgctgctgagcatcgtcctgctgaaccgctcgcgcctgccctggctgcgcctggccgccatcgtcatcggcctggcgctgggtaccctggcggcctgggcgaccggcctgttcgttccgcgggcgttgcccgagctgccgctggtcagcctgccgcagccgttccgcttcggcttcgccttcgactggatggccttcctgccggtggcgctgatctacctgatcagcagcatcgagacggtcggcgatctgaccgccaactgcatgctctcgcggcagcccctggagggaccggcgtacctgcagcggttgcgcggcggggtgctcggcgacggcgtcagttgcctgctggcagccaccttcagcgccttcccgaacaccaccttcgcgcagaacaacggggtgatccagctcaccggggtggccagccggcacgtcgggatctatatcggcggcgtgttgctggcgctcggcctgttcccctgggtcggcgcgatcctccagcagatccccaagccggtactcggcggcgccaccctggtgatgttcggcagcgtcgccgccgccggcatccgcattctcggccagaccgcgatggaccgccgcagcgtgctgatcatcgccgcctcgttcggcgtcggcctcggcgtggccgcgcagccgaccctgctcgaccagatgccggcggtggtgaagaccctgttcgactcggcgatcaccagcggcggcatcaccgccatcctgctcaacctgctgctgcccgaggagcgcgttgccgaagcggcgcaggccagcgcgaagggcggcgccctggcgcgctggcgcaagccgctgggttgatacgggcgtttgcaaatttttccgcgcctggcttgtgtcccgcggccgggctggggtatcaacgcggggatcacgccgatggaaacctgcgcatgaccctgacagtgcccgcccacgacccggccgcccgcgacaagccggccgggcgcatccgccagaagaacgaggaggcgatcctcgccgcggccgaggaggagttcgcccgccacggcttcaagggcaccagcatgaacaccatcgcgcagaacgtcggcctgcccaaggccaacctgcactactacttcggcaacaagctgggcctctacacggcggtgctgagcaacatcctcgaactctgggacagtaccttcaacaccctcggcgtcgacgacgatccggccgaggcgctggcccgctacatccgcgccaagatggagttctcccgccgctacccgctggcctcgcggatcttcgccatggagatcatcagcggcggagagtgcctcaccgcgcatttcaaccaggactaccgcagctggttccgcggtcgcgccgcggtattcgaggcctggatcgccgccggccggatggacccggtggatcccgtgcacctgatcttcctgctctggggcagcacccagcactacgccgacttcgccagccagatcggcctggtcaccggccgcaagcgcatgtccaggcaggacttcgccgccgccgccgacaacctggtgcggatcatcctcaagggctgcggactgaccccgccggcggcctga

SEQ ID NO: 11947 - DNA, 501 bp, Pseudomonas aeruginosa
acgcgatgccgagcaccctgcaaggcctcgccgaataccgcgaggaaatccgcaagagccgcttccacaccatcgccgcgccggtggccgacgaggacgaggcgcaggcgttcatcgccgcccaccgcgacgcttccgccggacacaactgctgggcctggaagtgcggcgcgcagtaccgcttcagcgacgacggcgaacccggcggcagcgccgggcggccgatcctggcggccatcgagggacaggacatggactgcgtggcggtgctggtcagccgctggttcggtggcatcaagctcggcaccggcggcctcgcccgcgcctatggcggcggcgcggccaagtgcctgcagcaggcgccgcgcagcgagctggtcgagcgctgtcgggtgcgcttcgcctgtgccttcgccgaccacgcgctgctcaaggcgcgcagcctggcgctgggcgccagcgtggcggccgaagactacggcgccgacggcgtcgtcctga

SEQ ID NO: 11948 - DNA, 2181 bp, Pseudomonas aeruginosa
agcagagcaggatgcgttggcgagtgtagctttcacgcatggccagcaggtctagcgtttccatgggtgcccctagtcgaatcggaaggacaggatggtgatgtcgtcgcgttgcgggtgctcgccctggtactcggcgagcgtcgccacgaaggcctcggcctgctcggggagcggctgccgcgcgtggtcgcggagcatgtcggcgaagcgccggctgccgaagccgaagccgtgttcgccgccggcctggtcgaggaaaccgtcggtgctcaggtagaaggtccagcccggcgccagcggtacctcgatgttgcggtagtcgccacggcgcttgtcgcctatcgcccggcgcgcgcccttgagttcctggacctcctcgccgtcgctggcgtacagcgagatcttcgccccggcgaaggccagctggcggcgccggcggtcgacccagaccagcccggcatccatgttggtggccagcgcctgggggatctgctcctggctgagcatgctgcgcatcgcctggtcggtctcgccgaggatcgccgccgggtcgcggctgcccaccgcctcgatggcgtggtcgatggcggcgcgggcgagcatggtcatcagcgcgccgggcacgccgtgaccggcgcagtcgaccacgccgatcaggtagccgtcggcctgctcgcggtacacgtagaagtcgccgccgaccacgtcgcgcggtttccacaggatgaagtgatgctcgccgagggtggcgctgagctggcggtcggggaggatcgcgcgctggatcaggctggcatagtcgaggctgtcgccgatcttcttctgcgcggcggccatctcgcggttggcttcctccagcgcctgggtgcgctcctggaccttgtcttccagctcggcggtgtgccggcggacctggtcggccatgctggcgaaggccttcgacagcgagccgatctcgtcctggcgcgccagcggcagcggcgtgtcgtagcgcccggcggcgatcgccttggccgagcgcttgaggctgcgcagggggcgcaacagcaggcgctcgacggcataggcgaagcccagcagcagggccaccagcaacagcaggaacgtgcccgccagcggccaaagccagcggttgtcgaggacctgggcggcgtgcaggtcgacggcggtgagcacgtaccagcgcagttggggaatgtaggccacggcgaagagttgctggcggccgtcgaggccggcccacaggcagtgcaccgagccggccttggcgcgggccaggcgcatggcctcgcgcagggcgtcgcgctgttccggctggtcgagcaggtcgaacacccggtggcgttcgctggcgccgccggcggcggagctgtaggcgatcaggcggcggtccgggtgggcctggatggcgccgtcgtcgccgacgatcatcggcgtcacgcccggctcgcgggcgatgatgaagtcgtcgaggaagccgctcaggtccaggccgctgccggccaggccgatgggccggccctggtcgcggatcaccaggttgaaccagaccttggtcaggttcagcttgctgtcgacattgacgttgatgttgtaggcggcgctgttgcgcagggtattgaagtaccaggcgtcttccgggtcgccggcctccagggtgtagcgcggccgttcgctgtagggttggcggccgtcgttgaagtagtagtggtgggagccgctggcgatgatgaagtaggcgtggtcgcggaagtcgccgcggtagccctcggcctcgcggaagaacagcgcgcggcgcgccgggtcgtcttccttcagcagccagtcgcgggtcaccaccgattcggcgaaacggcgcgacaacgccagttcgcgggagaccggggcgaggatcttctgccggtgcagcagggtgaagttcttcgcgtaggccaggccgaagtgcgtacggatgtcgtccatcgcgcgccagcccagcagcaccgccgggaccagtgccagggcacaggccagcaacagcgccaccaccgatttgccgcgcaacccccagttcgccgccatggctatccctatcagtttctcgcccggcccgcggccgaaatcatggatcgaaagcgtgtgtcgaacttttggcgaaagggccaattgtgcagatgtgcattatttcaggcaacgtaa

SEQ ID NO: 11949 - DNA, 267 bp, Pseudomonas aeruginosa
cggttcagcggcgcgccttcccgggcctggagattcatcgcgatcaggccgggctgtagacggtctggccgacggagcgcaccaggtggctggcgtggacgaagttctccgaatgcccggcgaagaacaggccctccggccgcagcagggccaccatgcgttccagcaggcgggtctgggtcggcttgtcgaagtagatcatcacgttgcggcagaagatcgcgtcgagttccccggcgatcgaccagtctgcctccagcaggttga

SEQ ID NO: 11950 - DNA, 1215 bp, Pseudomonas aeruginosa
tggccctttgctagttccagtaaagacaatgtccggtggatttcaattattggcgccggtttctcgtcggatagttatccggttagacggattggctatcgatacccctcagaacaattccacttcgcccacgttgacgctgttctggctcaccgggctgggcaagggccggcgcagttcctcgacctcccgcgcgacccgttcgggccattcctggcgcggccgcgcctccagcgcgccgaggccgagggcgaaggcgccaagacgcgcatggtgcttgcgcatctggccgagcaactggctgcccatgtcctggaattgcagggcggtgaccgccgcgtcgacgccctggccgacttccagcgagagccggtccagttcgtggatgaccttcagggtgtgccggttcatggcctccaggtcatcgagcatgccctggatcttgtgcttggaatcgagggcgaaggacatgtccttgtcggccagttgcgagatcgcgctctcggcgtcctggatctcgtggtggaccacgtcgacgtgcttgcggatggcggcggaaaactccgtggagcgggtcgacagcgcgcgcacttcatcggcgaccacggcgaagccgcggccgctctcgccggctcgggcggcctcgatggcagcgttgagggcgagcaggttggtctgcttggcgatggcgtccatgtcctgggtcgactgcaggatctcggtgatcttcaggcgcacctggtccatgcgttccaccagttgctgcgaggtccggctggtttccagggtagcctcgacgaacaggctgagggtctgctgggtggtcctgacgaagtcctggaagttgatgccttcgtcgacctggccgcgcccgtcgtagcgctcgatcagcgaatgggacaggccgcgctgggtatcgatgcgttcggcgaggccgtggaagctgtcgctgagctggcggatcgccgaatgcagcagttcgtcgatctgccgggcgtgaccgtccagttgcgcggtttcgtcggcgagcgcccgttgcgccgcgctccaggccggcgaagcggcatccgcctgcgggttggcattcgctaccgcttgccgaggggcgcgcaggaggaggacgagcatggccaggctggcgaaccaaccgagcgccaggaccagccagacgccgaggccgacggcatgcagcccggcgcacaacgcccagggtag

SEQ ID NO: 11951 - DNA, 855 bp, Pseudomonas aeruginosa
cagcttgttcgccgcgtagtagaggctggtgttgccggcgtcgacgtaccagtcccgcaggacccgcaccagggcgccggactccaggtaggcataggcgtgctgcatgcataccagggtgatgcccaggcccatggcggcgacctcgcaggtggcttccgggtcgctcatggtcatgcgttcgcgcagctcgatcggcgcctcctcgccgttgcgccggcgcagcggccaggagcgcacgcggccggtctgcggcgagcggatgcggatcccgtcgaagccgcccaggtcgcctggatggcggattggcggcttgtcgcggaggtaggcgggcgaggcgaggaggatcaggtggcccggcgtcaggttgcgcgccaccaccccgggcggcagttcgaaaccaccgccgatggcggcgtcgaagccttcgccgatgaggtcgacctggcgattgtcgaaatgccagtcgggcacgatgtcgggatagcgttcgaggaactcgccgagcagcggcaggatgtagtcgcggccgaaggccagccccatgctgaccttcaacgtgccgctgggttggttgccgacgctggagacgttggcgagagcggtctggatgccctccaggctgccgccgacctcttgcaggaaacgctccccggcttcggtcagggtcaggcgccgggtgctgcgctggaacaggcgcacgccgaggttgctttccaggcgggcgacgttcttgcccaccccggccggcgtcaggcccaggcgcctggcggcctcggcgaagctaccggcctcggcgctgcggacgaagcactggatgttgctgagggtttccatgggaaagggcccgcataa

SEQ ID NO: 11952 - DNA, 495 bp, Pseudomonas aeruginosa
cgattacccgctaccaggtctgcaatggacgacggaaactcggggcctgtctatccactccgatggagatttccatgtccgtatcctctgcatccctcgccggcaaagtcgccttcgtccagggcggttcccgcggcatcggcgccgccatcgttcgccggctggccgccgaaggcgccagcgtcgccttcacctacgtcagctcggcggacaagtcccgggccctggcggccgaactcgaaggcgccggagccagcatcctggccctgcatgccgatagcgccgacgcggcggcgctcgtcgccgccgtcgacgaagcggcggctcgcttcggacgcatcgacatcctggtcaacaacgccgccgtcctcgccctcggttcggtggaagagctgccgctggccgacttcgagcggaccctggcgatcaacgtgcgcagcgtcttcgtcgccacccaggcggcggtcaagcacatgggcgacggcgggcgggtga

SEQ ID NO: 11953 - DNA, 555 bp, Pseudomonas aeruginosa
cccggcttgccttccagttccggggtcagcgcctcggccatggtgccgatcccggcgatgtggtggtcggtgccggtgagcagcatcgagcgggtcggcgagcaggtcgaggcggtgtggaagtcggtcaggcgcaggccggcgatggccagggcgtcgaggttcggcgtggcgatctcgccgccgaaggcgccgatatcggagaagcccaggtcgtcggcgacgatcaccaggaagttggggcgtttgctcatgcgcgggtctcgtctggatgggaggagaaggtggggccctcgcccccgcccttcccgcagggggaaagggccagggcaaggggcttttcagcaagcgaggaattcgaagggcaggttttccacccgtcgcggcggcggcgcgacgtactcgccgtcggcggtcagttcgtgcagcagcgcttcgcgctggcgcaggaagtcgaagccaccgcgctcgcgcggatgcgccaggcccacctcgaccacccgcctgatccgccccggacgcggctccatcaccaccacccggtcggccaggtag

SEQ ID NO: 11954 - DNA, 1167 bp, Pseudomonas aeruginosa
aaaaatgaatttttattatttattttcgaggcgccgctgtgcatagctagccgcacacccgctcccggcgggaatccctctcttcccgttccaaggagccgccccatgaaagcgcttacgtcttccctgctcggtctgttcgccgcgcctgtgctcgccggcctgctcggtgcctacgtgccgctggcgagcgccgctccgccgaaggaaatccgcatcgcggtgccggacgtcagcgccggcagttcgcactcgggcggcggcgtggtcgacgtgctctacacccgccagttgctggagaaggagttcgccaacgacggcatcgcggtgaaatggagcttcttcaagggcgccggcccggtggtcaacgaagcgttcgccaacggccaggtggacttcgcctacctcggcgacctggcggcgatcatcggcaagtccggaggcctggacagccgcctgctggccgctaccgcgcgaggggtcaaccactatctcggcgtgcagccgggctccgggatcaagaccctggaggatctcaagggcaagcgcgtaggcatctttcgtggcaccgccagccagttgtcgttcgacaatgccctggccagcgtcggtctcagcgagaaggacctgaaggtgatcaacctcgatttcagcgccgccctgtccgccctcgcagccaggcagatcgatgccacctggggcctggccggactgttcgccctgcgcgaccgcgggctcgcggaaattccgctgagcacccgcgacctgaacggcgccggcaccctgcaggcgctgctggtcggctccggagccttcgtcgatgcccatccggacatcaccgagcggctgctcaaggtgcagttgcaggcccaggactggctggcccgcgaggagaaccgcgacgcttacatcgaactggtgtcgaagcaggccagctacccggtggtgatcctgcagagcgagtaccgtggccgcaagctgggcgacgccctgtcgccgcgcctggacaccgatttccttggccggctggatgcttcgatccaggcggccaagcgtttcggcctgatccgtcgcgaattcagcgccgagcagtgggccgcgccggaactgctggaggcggccggcaagctggcgaaggccaaggccgtggcgcaggcggcggagtga

SEQ ID NO: 11955 - DNA, 909 bp, Pseudomonas aeruginosa
cctgcccatcactacgacagcgcggcgccagcgccgggcctcgccctgcgcgtcggcggcattcctgattttcttccggaggagagcggtcatatgaatctcgatagcaaattgttcgacgcgacactcgatctcgaacgcgtgaaagtttcggtgagaacgctggtgaagttatcccgccaggaacaatcggcgatcatccggaccctcaacgagtttggtttcctgctgttgcgcagcgaacagggcgaagacaggcaggaacttctcgcgctcaaggagttgttcggccgcgccgccccccacccgcgcgccgacgccgacggcatcgtgccgatcagcaatgcgcggtatgtcagcggctacctcggctccacgccgctggagcacaagctgcacaccgacggcgctttcctcgacaccccggagcaattgtgcagcctgcaatgcgtgcgcaacgcccgggagggcggggagaccctgctggccagcgccggactggccttcgagcgcctgcgccggcgcatgccgaccaagcatctcggcctgctgcgcggcgacgccctgaccatcgtgcgcaagcaccagagcagcacccagccggtgttccgcctgaacggcgaggcgctgggcatcaagttccggcagaacgacggggcggccgaggtggtcgagcatcctgtggcggtggaggccttcgccgaactggtggcggcgctcgaggatccggcctgccaactgcggatcaagctcgagccgggggaaatcctggtgctcgacaacactgcggtgttgcacgggcgcactgccttctgcgccaacgaactgcgcgagatgcgccggctcaacttcgacggccacggccgcctgcgggcggagctggaactgggcttcaaggtggggttgtga

SEQ ID NO: 11956 - DNA, 1125 bp, Pseudomonas aeruginosa
gtgccaggtgggcgcagtctcggaagtcgctccgcaggccgcttgtgtttccctgcctcggcttttgccggggcctgccattggcaggggctggcatgtgcaacggcaggccgggtcaagcatttcggaagtcaccgacggagagtgtggcgtcggccgtcatccgcaacggccgtgggtgggagcctaggctcccgatgcaacctcgcctcagggaatacgcttcatgaacaacaagaccctatgcccttcgctcttgctctgcctttcgctgctcgcaccgctgtcttgtctcggggagaccgccgccgcgccctatccgctggcccacccaccgcgcctggccgactacctcccgccgccgccggcggcggactcggctgcggccgtcgccgatctcggcgcggtgctggaagcgcaacgcctgcgcacgcccgaacaggtacgccgggtacgcgcccacgaccagtgggaggacaacgtcttccccttcgccggcgacctgctgggcgcctcgttcgacaaggaacgcctgccgctgacccggagtttcttcaaccgcgcccaggaaaacctggtcgaggtgctgatgccggcgaagaagcacttcgcccgcccgcgtccctacgaagtgacaccgaaggtgaagccggtgctgccgccgccggagggggagtcctatcccagcggccacaccatggacagctacttcaaggcctcgctgctgagcatgctggtgccggagcatcacgatgcgttcttcgcccgcgccgaggagcatgcgcagagccgtgtgctggccggcgtgcacttccccagcgacctggaaggcgggcagaccgccgccgcggcgctggtggcgagcctgctggccgatccggcggtggccgccgacttcgccgcggtgcgcgaggagctgcgcggcgcgctggggttgccgaaactccagtagaggaagggaaagcgcgcggcggctcaggccgccgcgtgttgcgcctggtccagttccaccagcgtctcgatcatcgccttggccgctgccgaaagccggtagccgctgcggctgatgatgccgcagcgggcgctgaggctatccaggttctgcggcaggttgcgccactgtag

SEQ ID NO: 11957 - DNA, 870 bp, Pseudomonas aeruginosa
cggttgcagttcgccgcgctgcaggtaggggcgcagggtctcgtcgctggcgatgccgatggcgtcggtctggcggacgatacggatcagcgcgtgcatgttctcgcagcggatgttggcggcgaagtcgatcttgccgctgaggttcgccagcagcttgcggatgcccgggggaatcagggtcgaggccagcgggtagttgaacaggtcgttggtggacaggctgtccttgcccagcagcggatgttgcggacggcagaagaactggccgcggcgcggggtcagcgggcgcgtctggaagttcgggtcggcctcgaagtcgcggatgtcggcgacgaagaattcgatctcttcgcggagcagggcgcggctgagcttttcccagttgtccacgtccaggctgatctgcacccgcgggtggcggttgatgaagtcggccaccgcgtccggcaccagttgctgggccggcgccggcccgctgccgaagcgcagctcgccggcatccagcttgttcaactgggcgatctcgtggatcaggttggccgacccctgcaccaggctcagcgcgtgttgcagcaccacctggccttccggcgtcgggcgcaggtccttgctgccacggtccaccaactgacagccaagctcctgctccaggccctggatgctgcggctgaaggccggctgggtgatgcccatggcgtccgccgcgcggacgaaactgcggtgttcggcgagggcgatgaagtaacgcagttggcgcagatccatgatgctttaccggcattggaaatattggacaaaggcatttgccgttcgggatgtgctggttttaaatgcaagctcttattccgtcaacaaagaacaaattag

SEQ ID NO: 11958 - DNA, 2034 bp, Pseudomonas aeruginosa
gccgtccgccggcccccttcgaacctttcgccagatcgctgccttgcgcggcatggccgcctgctgcctgcgtccggctgcgccggaaccgaggacattcacgatgaagcaccactaccgcttgccgctccgccgaacgccgcccggcggctccgactacgccctggccctgctgctcgccctcggcggtgcgttgccggccagtgccgccgatgctcccgcgcccgccgaggaagcgccgccgctggccagcagcgtcccggacaaggccgatacggccctgggcaaggtcactgtcaccgcgcgtcgccgcgaggaggattcgcagaaggtaccgacgccgatcaccgtgctcggcggcgagactctcgaggcccagcgcatctcccgggtgcaggacctgcagcaggtgctgcccagcgtcaatgtcgcctacatccatgcgcggcagtcgagcgtcgccgtgcgcggcatcggcaacaaccccgccagcgacggcctggaaggcagcgccgggatctacctcgacaacgtctacctgggacgtccgggaatggccgtgttcgacctgctggacatcgagcaactggagctgctgcgcggtccgcagggcaccctgttcggcaagaacaccaccgccggggtgctgaacatcagcacccgcgcgccgaccttcactgccgagcgtaccgtcgaggtctccggcgggcaggatggctacttccagggccgcggcacggtttccgggccgctcggcgaaaccctcgccggacgcctctcggcctatcgcacccgcgacgacggctacatcaagaacatccacgacgacaactatctcaacggcggcgagcgccagggcgcgcgcgggcaattgctgttcgagccgaacgaggacttcagcctgcgctggatcgccgactacaacgaggaggattcgagcaacggcagcatggtggtctacggcgccgccgagcgtttctggcagcgcgccgcgctggtcggcgcttcgccgttgcgcgatccgcagcgcaggaaggtcaacatcaacggccgccagcacgtcagcgtgcaccagggcggcagctcgctggaggccaactggaacctcgccggcggctaccgcctgacctccatcagcgcctaccgctactggcacttcaccccggccaacgacgagcaactgaacgtctcggcgatcaacgacaccggggtggaagtgcacgaccggcagttctcccaggagatccgcctggcctcgcccaccggcggtgccttcgaatacgtggtgggcgcctacgcgttcaggcagaacctcggcaacaagaccttcacctcctacggaccgttggccgacctgtacctgctcggcgccaatctcggcgcgctgaacgacacctactcgaaggccaacggcaagatcgagaccgacagcttcgcgctgttcgcccagggcacctggcacctcaccgaacgcctggacttcaccgccggcctgcgcggtacctacgaggagaagaacgccaaggtcgagcgcttcgctccgctgggcggcgcggcggtcggcggggtcggcgcggcggtgcgcaacggccagctcggcgcctacgattccggcgatctcagccagtacaacttcgccccttcggcgttgctcagcctcagctaccagttcagcgacgacctgctcggctacgccagcctgtcccacggcgagaagtccggcggggtcaacctggcggtgggcagcgcaccgagcgccggcgccgattcgctgctggtcggaccggagcgcgccaacgacgccgagctgggcctgaagagcacgctcttcgaccggcgcctgttgctcaacgccaacctgttctggaccggcatccacgggtaccaggccaccaccctgtaccaggcgccgggcttgacccagttggtgcaggtgctggccaacgccggcagcgtgcgctcgcgtggtctggagttcgaggccaccgcgctgccgttgcgcggcctgaccctgaacttcaacggctcctataa

SEQ ID NO: 11959 - DNA, 1008 bp, Pseudomonas aeruginosa
gcatcgacgggcaacgcagccggacgatccggaaggcatgacggacccggccctctcctcgccggggagggcgaccacaggcagaacgaacccgcgaggaccccttacatgagccaatccgccaccgcccggcaacccgaacccgaggtcgccgaggcattccgcatcacccccctggaggcgccgctgggcgccgaagtccgtggcctcgacgcgcgccggccgctggcgccggagcaggtcctggcgctcaagcaggcgctgcgcgagcaccacatcctggtgttccgccagcagcacctcgacgatgagcagtacttgcgcttcgccaccctgttcggctcggtgttccagccgccggcggacatcccggtgctgtcctcgggtggcgacggcaaggtgccggacatcgtcaaggtggccaacaccggcgacggcgaactgggcaacttcgccctgccggcacacatcgaccaccaatggacgccggtgccgtcctccggctcgttcctctacgcactggaggtgccgtccagtggcggcgagacgcgcttcaccaacctggcgcgcgcctacgagagcctcgacgaggcgacccggcgcgagatcgatggcctgcgcctgatcaactacaaccccttcatccgcctgcgcgagggcggctacggcggcggtttcgccacctaccgcacgccggacatcgaaccgatccagggcagcgagcacccgctggtacgcacccacccggaaagcggccggcgcgtactgttcctcagcgcccacaccgaggtggagattcccggctacgaccccgcgcggggccaggcgctgatcggtcgcctgcgcgaacatctggcgcgcccggaactgagctacagccacgcctggtcggtgggcgacatcgtctggtgggacaaccaggccgtgctgcatgcgcgcaacgccttcccggccagcgagcggcggcgcctgaagcgcatcagcctagcgggcagccgtccgttctga

SEQ ID NO: 11960 - DNA, 993 bp, Pseudomonas aeruginosa
agccgccggcgcgacgatcggcagcgccgccgaggccttcggcgccgacctggtgctgaaggtggtcgcgcccagcgccgccgagctggcccagatgaaaagcggcgccgtgctggtcggcatgctcaaccccttcgacaacgagaacatcgcccgcatggccgagcgcggcatcaccgccttcgccctcgaggccgcgccgcgtacctcgcgggcgcagagcctggacgtgctctcctcgcaggccaacatcgccggctacaaggcggtgatgctcgccgccaaccactacccgcgcttcatgccgatgctgatgaccgccgccggcaccgtgaaggccgcccgcgtgctgatcctcggcgccggcgtcgccggcctgcaggcgatcgccacggccaagcgcctgggcgcggtgatcgaggcttccgacgtgcgtccggcggtgaaggagcagatcgagtcgctcggcgccaagttcgtcgacgtgccctacgagaccgacgaagagcgcgagtgcgccgaaggcgtcggcggctacgcgcggccgatgccggcctcgtggatggagcgccaggccaaggccgtgcacgagcgcgccaagcagtcggacatcgtcatcaccaccgcgctgatccccggccgcaaggcgccgacgctgctgcacgaggcgaccgtggcggagatgaagccgggctcggtggtcatcgacctggccgccgcccagggcggcaactgcccgctgaccgaggccgaccaggtcgtggtccggcacggcgtgaccatcgtcggccacagcaacctggccgcgctggtaccggcggacgcctcggcgctatacgcgcgcaacatcctcgatttcctcaagctcaccctgaacgccgaaggcttcagcgtgaacctcgaggacgacatcgtcgccgcctgcctgatgtgccgcgacggccaggcggtgcgcaagaacggctgagccgctgcgtcgggaagcttcgataa

SEQ ID NO: 11961 - DNA, 1890 bp, Pseudomonas aeruginosa
cgggatctacaacctgatcatcttcgtgctggccgtgtacgtcggctaccacgtggtatggaacgtcacccctgccttgcacaccccgctgatggcggtgaccaacgcgatttccgcgatcgtcatcgtcggcgccatgctcgccgccgccctgaccgtgaccccgctgggcaaggccatgggcaccctcgccgtggccctggccgcggtcaatgtgttcggtggcttcctggtcacccggcgcatgctggaaatgttcaagaagaaagcgccgaaggcggggggccactgatgagcatgaacctggtcaccctcctgtacctcatcgcctcggtctgcttcatccaggccctgaaaggcctgtcgcacccgaccacctcgcgccgcggcaacctcttcggcatggtcggcatggccatcgccgtggccaccaccgtcggcctggtgttcaagctgggcgcggagatcgccaccaccggcgtcggctacatcgtcgtcggcctgctggtcggcggtaccgccggctcgatcatggccaagcgcgtcgagatgaccaagatgcccgagctggtcgccttcatgcacagcatgatcggcctggccgcggtgttcatcgccatcgcagcggtggtcgagccgcagtcgctggggatcgtcgcgcacctgggcgacaccattcccaccggcaaccgcctggagctgttcctcggcgcggccatcggcgccatcaccttctccggttcggtgatcgccttcggcaagctctccggcaagtacaagttccgcctgttccagggcaccccggtgcagttctccgggcagcacctgctgaacctggtgctcggcctggcaaccctcggcctgggcctggtgttcatgttcaccggcaacctcaccgccttcgccgtgatgctggcgctggccttcgtcctcggcgtgctgatcatcatccccatcggcggcgccgacatgccggtggtggtgtcgatgctcaactcctattccggctgggccgcggcgggtatcggcttctcgctgaacaactcgatgctgatcatcgccggctcgctggtcggctcctcgggcgcgatcctctcctacatcatgtgcaaggcgatgaaccgctcgttcttcaacgtcatcctcggcggcttcggcgccgaagccgacgccggcggcccggcgggctccaaggagcagcgtccggtgaagtccggttcggccgacaatgcctcgttcctgctgaccaacgccgacagcgtgatcatcgtccccggctacggcctggcggtggcccgcgcccagcacgcgctgatggaactggcggagaagctgacccatcgcggggtcaccgtgaagttcgccatccacccggtcgccgggcgcatgccggggcacatgaacgtggctgctggccgaggccgaagtgccctacaagcaggtgttcgagatggaggacatcaactccgagttcggccagaccgacgtggtcctggtgctcggtgccaacgacgtggtcaacccggcggcgaagaacgatccgaagtcgcccatcgccggcatgccgatcctcgaggcctacaaggccaagaccgtgatcgtcaacaagcgatccatggccagcggatacgccggcctggacaacgagctgttgtacctggacaagactatgatggtgttcggcgacgccaagaaagtcatcgaagacatggtcaaggcggtggagtgattccccgctgggtccaccagaaccccggcccaggccggggtttttcgttttcgcgggttgcccgcgcagcgttctccgccgattccaacggcgaaaacaccagcctttcaggaatatttttcatgcccgcaaggcatgggtttttagtcggatcggtgtag

SEQ ID NO: 11962 - DNA, 603 bp, Pseudomonas aeruginosa
gcctccttgccaatcatgcaactccttgcgccgctaggactccagcacggacttgagcggccatggagttcgtcagtgcaaggagtttttcatggcaacaccccagcctgtcgatgcccgcacgcagccctggcgcgagacgcccggcggcgacctggtggcgctcggtcggccggttcgccaggcgttgcacctggttcgccacaacccggcacagggtcgggtgctcagccggcgcgagacgatcctgctggtcctgttcgccctgaccctgcacggagcggtgatccattggctgagccagcagagaaccccggcgctgcccgaggtgccgccacaggtgccgccgatgaccatcgagttcaccgccccggcgccgccggtggtggaaccgccgccgcccgagccgttgccgccggtggtcgaggaaccgccaccaccggtggtcgacgagaacgcggtgaagccgccgccgccgaagccggtgccaaagccgaaacccaagcccaagccgcaaccccggcccaagccggcgccgaaggccgtcgagccggctccgcccgcgccgccgcaacccgccgcgccacccgccccgccggcgcc

SEQ ID NO: 11963 - DNA, 732 bp, Pseudomonas aeruginosa
gggcaggccccgccggttggaggcgcgtattcgcgaggtgtcgcagcgctacggcatgccgctggagcctcgccggctggtccatgggctgtccatcggcgagcgccagcgggtggagatcgtgcgctgcctgatgcaggacatccgcctgctgatcctcgacgagccgacttcggtgctgaccccacgcgaggccgaggatctcttcgtcaccctgcgccgtcttgcggaagagggctgcagtgtcctcttcatcagccacaagctggccgaggtccgtgcgctctgccagcgcgccacggtgctgcgcggcggacgggtggccggacagtgcgtgccggcgcaatgttccgatctcgagctggcgcggctgatggtgggcgacgccgagggcctggcggcggaatatccgaaggttaccggcggcgcgcctttcctccaggtgcgcgacctgcactggcgcaacccggaccccttcggcgtgtccttcgccggcctcgatctggaggtgcgcagcggcgagatcctcggtatcgccggggtcgccggcaacggccaggacgagttgctcgctctgctcagcggcgaagtgcgcctgccgcgcgcccaggccgagcgcatccgcctaggcgcctgcgccggcgcgcacctggcgccggatgcgcggcgccgcgccggccaggccttcgtgcccgccgagcggctggggcacggcgcggtggccggagatga

SEQ ID NO: 11964 - DNA, 1467 bp, Pseudomonas aeruginosa
tcgccttgcgcgatgccggtacggcgatcctggtggtctccgaggacctcgacgagctgttcctgctcagcgaccgcatcgccgcgctgtgttcgggtcggctgtgcccggcggtcgccaccgcgagcgcttcgccgcagcaggtcggcggctggatggccggtcaattcgaggcgccggcggcagtcgccggcgccgttgcccaagggagcctgtgatgctgttgtccctggaaccgcgcggccgacagtcacgctggatgctgctggcctctccgctgctggcggggctgctgaccctggtctgcggtgcgctactgttcgcctgtctcggccacgatccctggcagaccctgcataccgtgctggtacagccgctcagcgacctctatgggctcggcgagctgctggtcaaggccatgccgatcctgctctgtgccctcggcctggcactggcctaccaggcgcgcgtgtggaacatcggcgcggagggccagttgctggtcggcgccctggccggcagcgcggtggcgatccagttgctcgactggcagagccgctgggcgctggcctgggtgctgctcgccggcaccgctgccggggcgctctgggccgggttcgccgcctggctgcgaacgcgcttcaacgccaacgagatcctgaccaccatcatgctcaactacatcgcgctgaacctgctgctgtacggcgtgcacgggccgttgaaggacccggatggcttcaacttcccgcagtcggcgctgttcggcgaggccagccgcctgccggcgctgttcgaggacagccgggtgcaccttggcgcattgttcggcctgctggcgctggcggcggtctgggtgctggcgcagcgcaacttcctcggtttccaggtccgcgtgctcggcctcgaccgccgcgccgccggtttcgtcggtttccgcgagaagcgcctggtctggttcgtgctgctgttctccggcgcgctggcaggcctggccggcgtctgcgaggtcgccgggccgatcggccaactggtgccgcaggtctcgccgggctacggctatgcggcgatcaccgtggccttccttggccgtctcaatccgttcggcatcctctgcgccagcctgctgatggcgttgctctacctcggcggcgaggccgcgcagatgagcctcaacctgccattggcgctgtccgggctgttccaggggatgatgctgttcttcctcctcgcctgcgacgtgctgatcctctaccgcccacgtttgcacggacgctggcgcaagcgcccggcgctgcgcgacgccctggcctgagccgaaccgccgaggaaccacgatggatatcgatctgctcgacaacctgctgttcgccatggtccgcaccggtactccgctgctgctggtggccctgggcgaactggtctgcgagagaagcggggtgctcaacctgggccaggaggggatga

SEQ ID NO: 11965 - DNA, 297 bp, Pseudomonas aeruginosa
tcgtcccacttgtccagagacttgatgtcgatgggcgacagcttccagtgcttgagcggatcgtcgcggcgcgagatgaagcgccgcagttgttcctcgcggctcaccgagaaccagtacttgaacagcaggatgccgctgttggtgagcatgcgctccagctccggcgcctggcgcatgaactccaggtattgcagcggcgaacagaagcccatgacccgctcgacgccggcgcggttgtaccaggagcggtcgaagaagaccatctcgccggcggtgggcagatgttggatgtag

SEQ ID NO: 11966 - DNA, 1878 bp, Pseudomonas aeruginosa
  unsure (82),(1213),(1327): Identity of nucleotide at the above locations are unknown.
ttcgccggcaggctcgccgaggtgctgtcctcgctgttgccgtggggcgcactggcgacctgcagggccaccggcttctggntgattgcctggatctcctcgcgggccttctgcgccgggctggccactcgcgggcggcgggtcgccggcttgcgcggggcgcggcgggcggctggccgggccggcttggccggctgcgcggcgggttgctcgggggaggggggactgacagtgggttcttcgctcatgcgggactccttccgttctacgttttcagctatgcagtcccccactctatgcccctgccgggaggcgtccgttgacccccatcaaaccgcgcccggccgccaccgggaggaaagccttacacctctccataaatcccttgtaggatatcgccacgcgcgtggcgtcccgtcgtcgccccgcggacctggatcagcagacagggtgaacactgagctggctctcatcaaccgagggccggcagcgttcgcgccggcccgccgatccgacgaaggtccgcacatgtcccgcacctggattcgcagtcccctcgccatcttcaccgccaacggtctcgacgccgccggcggcctggtcgtcgaagacggccgcatcgtcaagctgctcggcgccggccaacagcccgcgcagccctgcgccagccagttcgacgccagccggcacgtggtgttgccggggctggtcaacacccatcaccacttctaccagaccctcacccgcgcctgggcgccggtggtcaaccagccgctgttcccctggctgaagaccctctacccggtctgggcgcggctgaccccggagaaactcgaactggccaccaaggtggcgctggccgagctgctgttgtccgggtgtaccactgccgccgaccaccactacctgtttcccggcggcctcgaacaggccatcgacgtgcaggccggggtggtcgaggaactgggcatgcgcgccatgctcacccgcggctcgatgagcctcggcgagaaggacggcggcttgccgccgcagcagacggtgcaggaggccgagaccatcctcgccgacagcgagcgactgatcgcccgctaccaccagcgcggagacggtgcccgggtgcagatcgccctggcgccctgctcgccgttctcggtgactccggagatcatgcgcgccagcgccgaactggcggcgcgccacgaggtacgcntgcacacccacctggcggagaccctcgacgaggaagacttctgcctgcagcgcttcggcctgcgcaccgtggactacctggatagcgtcggctggctcggcccgcgcacctggntggcccacggcatccacttcaacgccgaggagatccgccggctcggcgaggcgggcaccggtatctgccattgcccgagttcgaacatgcgcctggcctcgggcatctgcccgaccgtggagctggaggcggccggcgcgccgatcggcctgggagtcgatggctcggcttccaacgacgcctcgaacatgatcctcgaggcgcgccaggccctgtacctgcaacgcctgcgctacggcgccgagcggatcaccccggaactcgccctgggctgggcaacccgtggctcggcacgcctgctcgggcgcagcgacatcggcgagctggcccccggcaagcaggccgacctggccttgttcaagctcgacgagctgcgcttctcgggtagccacgacccgctctcggcgctgctgctgtgcgctgccgaccgtgccgaccgggtaatggtcggcggcgcctggcgagtggtcgacggtgccgtggaagggctcgacctggccgccctgatcgcccgccaccgcgaggcggcgagcgccctgatcgccgggtga

SEQ ID NO: 11967 - DNA, 447 bp, Pseudomonas aeruginosa
agggaggcccggtgcacgacgccacggtggtcgcctacctgctcaagccctcgctgttcaagggcaagcggatcaacgtgcaggtcgacagccgcgagggcatcaccttcggccagaccgtggccgactggtacggcggcctcaagcagccggccaacgtcgagtggatcaacgagggcgatgcccaggggttcttcgacctgctcaccgagcgtatcgcccgcctgccctgagtctctcgccgtacggccggcgccgggtcagccgtggcgccggctggcgagttggcgcagggcctgctcggcgtcgccgacgacgatcctgccgggcaccgacagcatcaggttgagcggcaggccgaactcttccagggtcatgccgtcgcggtcgcgggtcggatcctcgccgatcagctccggggcgtgccggcggattcgctcggcgtag

SEQ ID NO: 11968 - DNA, 894 bp, Pseudomonas aeruginosa
  unsure (136): Identity of nucleotide at the above locations are unknown.
cgacgccgcgccctacgagcccgtcctcgagcagaccgcccaggcctggctggtgcgcctgcgcggtacgccggatgcggcgacccggcgggccttcgaggactggctggcgcagcggccggcgcatgccgaggcntatgcccgcgccgaggcgctctggcgcctgacggaaataccggcgagccgcctggccatcgaagaggccgatgccctggaagcctacctgcggccgcgccgagcgtcgcgcaacccgcggcgctgggcctacccgctggccagcgtcgcctgcctgctggcgatgctctggctgggcggctggtggcagcccggcgactggctgcaggactggcgtgccgactatgtcgccgcgccgggacaggtcgccgaatggaagctggccgatggctcctacctgagcctggacgccggcagcgcggtgcgcgtgcgtatcgacggcggccagcggcgggtcgaactgctgcgcggcgccgccgcgttgcgggtgaagcgcgacgcgctgccattcgtggtcgaggccggcgaaggtcgggcgcgggtactgggcaccgagttcgaggtccgtcgcggcgccggggcgacccgcgtcaccgtgttgcaagggcgggtcgcggtgagcgccggcaccggtgcgggcgccgccgaggaagtgctgggcgccggccagcaggtcggcttcgccgacggcaagctgggccggcccgtggccatcgacgccgccgccgcgctggcctggcgccagggttggctgagcttctaccggcggccgctggcggaagtgctcgacgaactcgctcgctactaccccggacgcattctcctgctcgacgacgcgctcggtcgccagctggtcagcggcagcttccgcagcgatga

SEQ ID NO: 11969 - DNA, 1335 bp, Pseudomonas aeruginosa
cctgcaattcggcatggaccacgagaagcgcaagatcttccgcgccgacctgctgcgcgacagcaagaccagccgcttcgactacctcgacccggtctatggccaggtggtgccgtcgacccgggtggtcgccggcgacagcgaccagaccgacaagctgcgcagcgactcgctgtacttccaggactcgatccacctggacgaacgctggatcctggtcggcggcgcgcgctaccagatctacgaccagctcgccgggcgcggccggccgttcaacgccaacaccgatatcaacgggcagaaatgggtgccgcgcggcggcctggtctaccgcctgagcgacgaggtttcgctgtacggcagctacacgcgctcgttcaagccgaactcgaccatcgccccgctgagcaccggcgagaccatcgattcggcgatcctgccggagcaggcgacctcctgggagctgggcgccaagctggatgtgccggggcgtctcagcggcaccctggcgctgttcgacattcgcaagaagaacgtgctggtcaacgaactcgacggtgccggcaacagcagcgtgcgcgccgccggccgggtccgctcgcgcggcctggagctggacctcaccggccagctcagcgaacgctggagcctgatcggcagctacgcctggctcgccgcggaagtcaccgaggacccgaccctggagggcaagcgcctgcagaacgtggcgcgcaacaccgcgtcgctgtcggcggtctacgaactcggccagctcttcggcggcgaccgcctgcgcctgggcggcggcgcgcgccacgtcggcaagcgcccgggcgacccggccaattccttcgacctgccctcctacaccgtggccgatgccttcgccagctacgacacccgcttcggcggacacggcgtgaagttccagctcaacgtgaagaacctgttcgaccgcacctactacccgtccagtgccaatcgactgtacgtggcgatgggcgagccccggcagttccaggtgtcgacgacggtggagttctgagtcggcgctcgctccaggtggggttccccggcgtcctcctggacgtggaggcccccctgaagggcgaagggtcggcgcgatgctgcccgaccatgctccatccggttccttcttcccccagggaagggattgcccggcgcgtgagtcgttccgccatccagtgccttctccctttggggaaaggaaggcggagaaccgcctggcacgacctcgccgcacgccacacctcgttcccaacccgcccgttgggtaccatgcccgcaccactcgccgccacggccgccccatga

SEQ ID NO: 11970 - DNA, 696 bp, Pseudomonas aeruginosa
ccgaaactggcaccccaaagccttgacccccgactacaagacctccgtgccgcgctcgccgagccaggcgctggtgagcatcccgcaatcgctctcggaaaccagcgggccggacttctcccacctcaggctcggccgccacgacaacgacctgctgctcaacttcgaccacggcggcctgccccagggcgagcgcatcatcatgttcggccgggtcttcgaccagtacggcaagccggtcccgcacaccctggtggagatgtggcaggccaacgccggcgggcgctaccggcacaagaacgaccgctacctggcgccgctcgacccgaacttcggcggcgtcggccggaccctcaccgacagcgagggccactattacttccgcaccatcaagcccgggccctatccctggcgcaacggccccaacgactggcgcccggcgcacatccacgtgtctgtcagcggcccggcgatcgccgcgcggctggtcacccagatgtacttcgagggcgacccgctgatccccaagtgcccgatcatccgcacccttgccgacccggaggcggcgcagagcctgatcggccggctcgacatgagcatggccaacccgatggattgcctggcctaccgcttcgacatcgtcctgcgcgggcagcgcaagaccttcttcgagaacgtctgaggagccgaccatga

SEQ ID NO: 11971 - DNA, 480 bp, Pseudomonas aeruginosa
gccacgaactgctgcgggaaaccccttcccagaccgccggtccctatgtccacatcggcctggcgctggccgccgccggcaacccgacccgtgacctggagatctggaaccgcatggcccgcgaagacgcgccgggccagcacatcctcctgctcggccacgtctacgacggcaacggccacctggtgcgcgactcgttcctggagttctggcaggccgacagcgaaggccgctaccaggagcgctacgatccggagcgaccgttcaacagcttcggccgcaccgccaccaccttcgatgccggcgagtggaccctgcacacggtcaagccgggggtggtgcgtaacgcccagggcgtgccgatggcgccgcacatcaacgtctcgctgttcgcccgcggcatcaacatccacttgcagacccggctgtacttcgatgacgagaccgaggccaacgccgcctgtccggtgctcaacctga

SEQ ID NO: 11972 - DNA, 1221 bp, Pseudomonas aeruginosa
aatccctgccaattctgggagtttccggccggatcggccggtatctgtatggatcgcgaaggggaaggcatgtcagacgccagaggcgcttttcattccaaaggtcgctggtcgcggatggcgctgcccgccatcctgtgcgccggcctgcttgtcggttgcggcgccgagccgcccgccgaggaacacgtccgtgtgctggcgcagacggtgaagatggccgagttcgcctcggccacctcgatcaccggcgacatccaggcacgggtacaggccgaccagtcgttccgtgtcggcggcaagatcgtcgagcgcctggtcgatgtcggcgaccacgtcgcggctggccaggtgctggcgcggctcgacccgcaggaccagcgcagcaacgtggagaacgcccaggcggcggtcgccgcgcagcaggcgcagtcgaagctcgccgacctcaactaccagcggcagaaggcgctgctgcccaagggctacaccagccagagcgagtacgaccaggcgctggcctctgtgcgcagcgcgcagagttcgctgaaggccgcccaggcgcagttggccaacgcccgcgacctgctttcctataccgagctgcgtgcctccgacgccggggtcatcactgcccgccaggccgaggtcggccaggtggtgcaggccaccgtgccgatcttcaccctggcccgcgacggcgagcgcgacgcggtgttcaacgtctacgagtcgttgttcagccacgatgtcgacggccagcggatcaccgtcagcctgctcggcaagccggaagtcaccgccagcggcaaggtccgcgagatcaccccgacggtggacgagcgcagcggtacgctgaaggtcaaggtcggcctcgactcggtgccggcggaaatgagcctcggcagcgtggtcaacgccagcgtcgccgcgccggccgagcacagcgtggtgctgccctggtcggcgctgtccaaggtcggcgagcagccggcggtctggttgctcgaccagcaaggcaaggcgcgtctgcaaccggtgcgggtggcacgctacgccagcgagaaggtggtcatcgacggtggcctggaggcgggccagacggtggtcacggtgggcggccaactgctccatccgggccaggtggtcgaggtggcccagccgccgcagccgacccagagcaccgccagccgcgacgccgtgggcggaggccagccatga

SEQ ID NO: 11973 - DNA, 2367 bp, Pseudomonas aeruginosa
tcggacagggcctggccgacggcgaccgggtggtccgcgccggagtctacagcctcaagcccggccagaagatcaaactcgacgaggatgcgcgatgaagggcggtttcaacctgtcggactgggccctgcgccaccagtccctggtctggtacctgatggcggtatcgctggtgatgggcgtgttctcctacctcaacctggggcgcgaggaggatccctcgttcgccatcaagaccatggtcatccagacccgctggccgggcgccacggtggacgacaccctggagcaggtcaccgaccgcatcgagaagaagctcgaggacctggactcgctggattacgtgaagagctacacgcgacccggcgaatcgacggtcttcgtctacctcaaggacaccaccaaggccggcgacatcccggatatctggtaccaggtgcgcaagaagatatccgacatccagggcgaattcccccagggcatccagggaccgggtttcaacgacgagttcggcgacgtgttcggcagcgtctacgccttcaccgccgacggcctggacttccgccagctgcgcgactacgtggagaaagtgcgcctggacatccgctcggtgaaagacctgggcaaggtgcagatgatcggtgcgcagaacgaggtcatctacctcaacttctctacccgcaagctggccgccctcggtctcgaccagcgccaggtcgtgcagagcctgcaggcgcagaacgcggtgaccccgtccggcgtggtcgaggccggccccgagcgcatctcggtgcgcacctccggcaacttccgttcggaaaaggacctgcaggcggtcaacctgcgggtcaacgatcgtttctaccggctgtccgacctggccagcatcagccgcgatttcgtcgacccgccgacctcgctgttccgctacaagggcgagccggccatcggcctggcggtggcgatgaaggagggcggcaatatcctcgagttcggcgaggcgctcaatgcgcgcatgcaggagatcaccggcgaactgccggttggtgtcggcgtgcaccaggtgtcgaaccaggcccaggtggtgaagaaggcggtcggcggtttcacccgggcgctgttcgaggcggtggtgatcgtcctcatcgtcagcttcgtcagcctcggcctgcgcgccgggctggtggtggcctgctcgatcccgctggtgctggcgatggtcttcgtgttcatggaatacaccgacatcaccatgcagcgggtttccctcggcgcgctgatcatcgccctcggcctgctggtggacgatgccatgatcaccgtggagatgatgatcacgcgcctcgaactgggcgactcgctgcacgactcggcgacctacgcctacacctcgacggccttcccgatgctcaccgggaccctggtgacggtggccggcttcgtgcccatcgggctcaacgccagctccgccggcgagtacaccttcaccctgttcgcagtgatcgccgtggcgctgctgctgtcgtggatcgtcgcggtgctgttcgccccggtgatcgccgtgcacatcctgccgaagactctcaagcacaagtcggagcagaagaagggccgcatcgccgagcgtttcgacagcctgctgcacctggcgatgcgccggcgctggacgaccatcttcctcaccgcgctgctgttcggcgtgtcgctgttcctgatgaagttcgtccagcaccagttcttcccgtcttccgaccgtccggaactgctggtcgacctcaacctgccgcaaaacagcagcatccacgagaccagggcggtgatggaccgtctggaaacgacgctgaaggacgacgaggacatcgaccactggagcgcctacgtcggcgaaggcgcgatccgcttctacctgccgctggaccagcagttgcagaacaacttctatggccagctggtgatcgtcaccaaggacctggaggcccgcgagcgcgtcgccgcgcgcctgcgcgatcgcttgcgcaaggactacgtcggcatcagcacctacgtgcagccgctggagatggggccgccggtgggacggccgatccagtaccgggtcagcggaccgcagatcgacaaggtccgcgagtacgccatgggcctggccggcgtgctcgacggcaacccgaacatcggcgatatcgtctacgactggaacgagcccgggaagatgctcaagatcgacatcgcccaggacaaggcgcgccagctcgggctttcctccgaggacgtggcgcagatcatgaacagcgtggtgaccggcagcgcggtgacccaggtgcgcgacgacatctacctggtgaacgtcatcggccgcgccgaggatag

SEQ ID NO: 11974 - DNA, 786 bp, Pseudomonas aeruginosa
cgagcgcggctcgctggagaccctggagagcctgcagatcgtcacgcccagcggcacctcgatcccgctcaaggcgttcgccaaggtcagctacgagctggagcagccgctggtgtggcgccgcgaccgcaagccgacgatcacggtgaaggcgtcgctgcgcggcgagatccagcccaccgacctggtcgcccggctggcgccggaggtcaagcgcttcgccgacggcctgccggcgaactaccggatcgaagtgggcggcacggtggaggagagcggcaaggccgagggcccgatcgccaaggtggtgccgctgatgctgttcctcatggcgaccttcctgatgatccagttgcagagcgtgcagaagctgttcctggtggccagcgtcgcgccgctggggctgatcggggtggtcgcggcgttgctgccgaccggcacgccgatgggcttcgtggcgatcctcgggattctcgcgctgatcggcatcatcatccgcaactcggtgatcctggtgacccagatcgatgccttcgagaaagacggcaagacgccctgggaagccgtgctggaagccacccaccaccgcacccggccgatcctgctgacggcggcggcggccagcctggggatgatccccatcgcccgcgaagtgttctgggggccgatggcctatgcgatgatcggcggcatcgtcgccgccacgctgctcacgctgatcttcctgccggcgctgtacgtcgcctggtaccggattccggaaccgggacgctgagcgcggcgtaa

SEQ ID NO: 11975 - DNA, 1017 bp, Pseudomonas aeruginosa
gcagcccggcgtcagggaaaatccgaccaatttacgaatctgttttgcaaccgaggtaatagtggacacattgcaaggcatgcgcgtgttcgccagggtggtggacagcggcagcttcacttccgccgcccaggccctggacctgtccaccgcgcaggtatcgcggctgatctccgacctggaggcgcacctgcagacgcgcctgctgcaccgcaccacccggcgcctggccctgaccgaggccggcgagcgttacctggaacggtgccgcgggatcctcgaggacatcgaggtcgccgaggccgaagccgccggcgcgcacatccgcccctgcggccgcttgcgcgtgcagtcgctgatgggcatgggccagcatcacctggtgccgatgatcgcccgctacggcgcactgttccccgacgtggtgatcgagctgaccctgtcccagcgcaacccggacatgctcgaggaaggccaggacgtgctgatcaccggcgagcgccagttgcccgactcggagttcgtcgcccagcgcctgggcagcatccacagcgtgctctgcgccagtcccggctacctgcagcagcgcggcgtgccacgctcggtggacgacctggagcgccacgtctgcctgcgcctgcaggacccggcctacccggagggctggatcttcgccgacgagcagggcgagcgcaccgtcagcccgcagaacaccttcatggtcaatgtcgccgaggtcatggcccaggcggccaaggccgacctcggcatcgccctgctgcccagctacgtggcggccgcggcgctgcgcaacggcgagctgctacgggtgttgcccggccatgccatgcaccagcggaccatctatgcgctgtatccctcgcggcgttacctggacgcgaagatccgcacctgggtcgatctgttgcaacaggaacttccccaggcattcgcccgcgacgaaactaccatgcaaagttcaagttactgggcacagtgaaggattgttgttattga

SEQ ID NO: 11976 - DNA, 1350 bp, Pseudomonas aeruginosa
gaaggagcaaccgcaatgaggaatctgttcgccttgacgccgatggcgctggcgctgtgcaccgcgtccgccgcctgggccgatgagggggaagccaaagaaggcttcatcgaaggctccagcctccaattgctgacccgcaactactacttcaaccatgaccgccggcacgcttccgggcacgacagcaaggaatgggcgcaaggcttcatcgccacctttcagtccggctacacgcccggcgtggtcggcttcggcgtcgacgcctacggcatgctcgggctgaagctcgacggcggcggcggtaccggcggcaccagcatcctgccgatcaccgcgccgagcaaggaaggctacgaatccggcaaggcgcccgatgagttctccagtggcggggcggcgctgaagatccgcgccttcgacaccgagctgaagctgggcgaccagttcctcagcaacccggtggtcgccggcggcgagtcgcgcatgctgccgcagaccttccgcggtgtgagcctgaccaacaacagtttcgaggacctgaccctcacggctggccaggtcagtttcaccaagtactacaaccagagtggccaccgtcgcctcggctcgtactacggcgaactgccgggcgaccgcgacagccatcatctcagctggctgggcggcacctggggcggcatcgagggcttcaccagcagcctgtacgccgccgaactgcagaacgtctggaagcagtactacgccgacgtcgactacacctacgagatcgacgacaactggtcgctgaaccccggcgcgcactactacaagaccgtcgacagcggcgactcgttgctcggccggatcgacaacaacacctacagcctgcatttcgcggtcggctacaggcagcacaccgtcaccgcggtgctgcagaaggtcaacggcaacacgccgttcgactacatcaaccagggcgacagcatcttcctcgacaactcgcagcagtattccgacttcaacggtcccaacgagaagtcctggaagctgcaatacgactacgacttcgtcgccctcggcctacccggcctgagcgcctcggcctcgtactcgcgcggcaagctggacctgacccgggtcgatccggacagccccggctacggcggctggtacagcgccgacggcaagaacgccaagcactgggaacgcgacctcgacctgcagtacgtggtccagggcggtccggccaaggacctctcgctgcgcctgcgctgggccacccaccgcggcaccggcggctacagcgcggtggacaacgacatcgacgaataccgggtgatcgtcgactatcccatcgacgtgttctga

SEQ ID NO: 11977 - DNA, 1650 bp, Pseudomonas aeruginosa
cctgccgcctcaagtttcccggagcccacgccgatgctcgacttctccgcccacgcgcttccctacgcctcgcaacgttcgccggtccatgcccgccgcggcatggtcgccacctcgcagccgcaggcggcgcaggtcgggctggagatattgcgccgtggcggcaatgccatcgacgcggcgatcgccaccgccgccgcgctgacggtggtcgagccgaccggctgcgggattggcggcgatgccttcgccctggtctggacccgcggacgcctgcacggcctggacgccagcgggcgcgcgccgggcctgctcgatcgcgagcgggtgcgcgccgccggccacgagcggatgccgctgtacggctggacgccggtcaccgtgccgggctgtccggcggcctggggcgaactgtcgcggcgcttcggcaaattgccgttcgaacaactgctgcggccggcgatcgagctggctcgcgatggctttccggtctcgccggtgatcgcccgcctgtggcagagcggcctggacaagttccgcgcggcgttgccgcagcggcccgagctgcgggcctggttcgacgagttcctcatcgacggccgggcgccgcgcgccggcgaggtgttccgccagccgggccaggccgacaccctggacgagctggcgcgcagccagtgcgaaagcttctatcgcggcgagctggccagggccatcgtcggccacgccgagcgcagcggcggctacctgcgcgcggaggacctggccggctaccaggcgaagtgggtcgaaccgatctcactgaactaccgtggctatgacgtctgggagattccgccgagcggccagggcctgatcgccctgatgaccctgaacatcctcaagggcttcgaattcggcgagcgcgactgcgcgcggacctggcatcgccaactggaggcgatgaagctggcgtacgtcgacgggctgcactacatcagccagccgcagtcgatgcgggtctcggtcgaggaactgctgcacgaggactacgccgccagccgccgtgcgctgatcggcgagcgcgcgctcgatcccagccccggccagccgaggccgggcggcacggtgtacctggcctgtggcgacgaggagggcaacctggtctcgttcatccagagcaactaccacggcttcggctccggcgtggtggtgcccggcaccggcatcgccttgcagaaccgcggcgccgagttcagcctcgatccggaccacgtgaattgcctggagccgggcaagcagaccttccacaccatcattcccggtttcctcagcaaggacggcgtgccgctcggcccgttcggcgtgatgggcgcctatatgcagccgcagggccacgtgcagatggtgatgaacctggtggacttcggcctcaacccccaggctgccctcgacgcgccgcgctggcagtggctgggcgggctgcgcgtcggcatcgaacatgccgcgccgcgcgcgctggcggcggagctggcgcagcgtgggcaccaggtggagatcgcctacgactcgaccagctacgggcgcggccagatcgtcctgcgcgacccggccagcggcgtgctctgtggcggcaccgagccgcgcaccgattcgcagatcgcggtgtggtga

SEQ ID NO: 11978 - DNA, 1716 bp, Pseudomonas aeruginosa
aggactcgcagtacttcaccaccgaccagaacaccgccagcttcctggtcaagtaccacttctgagtccgtcgcgcggggctgccggcccggccccgccagcgcgccccgtcattgcgcgccgtgcatcggcacggtgcgcgacggtcgcctccgtggtccttgcgtttgcctcccgttgtccgctcgacccacgccgggcgtgccttgcagcctgagcggcaggaataagctgatcaactggacagctttttgcagaagccgtgcatcctcctcgccgcccgaggagcgccaccctgagacggccccgatgcacagcgaagaccaacgccccaacgacctcatctacggcctcgacgaccggccgcgcccgcttcccgccttccttgccgcgctacagcacgtgctggccagcttcgtcggcatcgtcactccgccgctggtgatcggctcgctgctcggcctcggcgagcacctgccatacctgatcagcatggcgctgatggtttccggcgccggcaccctgatccaggcgcgccggccgttcggcatcggcgccgggatgatctgcctgcaaggcaccagcttcgccttcctcggcgccgtgctggccgccgggatgctggtgaagcagcgcggcggcggtcccgaggagatcctcgcgatgatcttcggcgtgtgcttcttcggcgccttcgtgcagatcgtcctcagtcgtttcctcggccatcttcgccgggtgatcacgccgctggtcaccggcatcgtcatcaccctgatcggcgtcagcctgatcaaggtcggcatcaccgacctcggcggcggagccggggccacggacttcggcgcaccggccaatctcgcgctgggcgcgctggtgctgctgagcatcgtcctgctgaaccgctcgcgcctgccctggctgcgcctggccgccatcgtcatcggcctggcgctgggtaccctggcggcctgggcgaccggcctgttcgttccgcgggcgttgcccgagctgccgctggtcagcctgccgcagccgttccgcttcggcttcgccttcgactggatggccttcctgccggtggcgctgatctacctgatcagcagcatcgagacggtcggcgatctgaccgccaactgcatgctctcgcggcagcccctggagggaccggcgtacctgcagcggttgcgcggcggggtgctcggcgacggcgtcagttgcctgctggcagccaccttcagcgccttcccgaacaccaccttcgcgcagaacaacggggtgatccagctcaccggggtggccagccggcacgtcgggatctatatcggcggcgtgttgctggcgctcggcctgttcccctgggtcggcgcgatcctccagcagatccccaagccggtactcggcggcgccaccctggtgatgttcggcagcgtcgccgccgccggcatccgcattctcggccagaccgcgatggaccgccgcagcgtgctgatcatcgccgcctcgttcggcgtcggcctcggcgtggccgcgcagccgaccctgctcgaccagatgccggcggtggtgaagaccctgttcgactcggcgatcaccagcggcggcatcaccgccatcctgctcaacctgctgctgcccgaggagcgcgttgccgaagcggcgcaggccagcgcgaagggcggcgccctggcgcgctggcgcaagccgctgggttga

SEQ ID NO: 11979 - DNA, 1407 bp, Pseudomonas aeruginosa
tttgacgtcacaatgatggcgagcaggcaaaggcccgtggttcgggcctgtcgtcggcggggtctcggcgggggaggttgcggggggcggcgaaaaagcgcagcgggccggccaggatcccgctcagaggcggttgccgctgccgcgccgggcggcttgctggagcagcgcggcggcgatccgttcgagcggcagcacgtcttccgcggcgcccagttccaccgcttcgcggggcatgccgtagaccacgcaggtagcctcgtcctgggccagggtgtagccgccggcctggcggatcgccaggagcccgcgcgcgccgtccttgcccatgccggtgagcaggccggcgagcaggttgcgcccggcgcagcgagccagcgactcgaacatcacgtccactgccgggcggtggccgttgacctgcgcctggcggttcaaacgcaccacgtagttggcgccggagcgctgcacctccatgtggtggtcgcccggcgcgaccagggcgtggccgggcagtatgcggtcgccgtcgcgcgcttcgctgacgctgagccgggtcaggcgatccaggcgctcggcgaagctgcgggtgaagccgggaggcatgtgctgggtgatgaccaccccgggactgtgcgccggcaggccgagcagcacttccttgagcgcctcggtgccgccggtggaggcgccgagggcgatgatcttctcggtgctgagcagcggcgccgcgctttccggcggcgccggcgcgtccgccgcacggcggcgcaggcgggcgcgggcgacggtcttgagcttggcgcggatttcctcggcataggcctgcatgccttcggcgatgcccagccggggcttggcgatgaagtccaccgcgcccagttccagcgcgcgcagggtggcttcggaaccgcgctcggtgagcgaggagatcatcagcaccggggtcggccgcgccttcatcagcttgtcgaggaaggtcaggccgtccattcgcggcatttccacgtcgaggctgatcacgtccggcgcgtgctgcttgatcaggtcgcgggcgacgaaggcgtccggcgcgcagccgaccaggcgcagctccgggtcggcctggatgatctccttgagcaggctgcggatcagggcggaatcgtcgacgaccaggacactgatgggcatggcgggctctcccggagagtcagaacaggtcgatggggccgccgtccgcgttgcggtcgatacggcggcggtagtcgcgttcacgctgcagcacggtgtcgttcttcagctccaccagggacttcaccaggacccggccattgcgcgggaagaagtagatcttgcgcgggaaggcctccagcacgtcgctggcgagcagcgggatacgctcggtggccaggtagtcgagggtga

SEQ ID NO: 11980 - DNA, 3366 bp, Pseudomonas aeruginosa
cgatcaccaggtcttcgccgctggcgaagtattcgccgggcaaaagcttcaccgcatcgcaggcgaagtacggatcgtagtagcggttcagcggcgcgccttcccgggcctggagattcatcgcgatcaggccgggctgtagacggtctggccgacggagcgcaccaggtggctggcgtggacgaagttctccgaatgcccggcgaagaacaggccctccggccgcagcagggccaccatgcgttccagcaggcgggtctgggtcggcttgtcgaagtagatcatcacgttgcggcagaagatcgcgtcgagttccccggcgatcgaccagtctgcctccagcaggttgatctggcggaactccaccagttgccgcagttcctccaccacccgcgccttgccggcgttgggcccggtgccgcggaggaagaagcgtttcttcagcggcgccggcatctgctccagacgctccagcggatagacgccctggcgggcgcagtcgagcaccccggtatcgatgtccgaggcgacgatcttcaccggcggatcgaagctgcccagcgcctccaccagggtgatggcgatcgaatagggttcctcgccggtactcgccgccgccgaccagatgcgcagcgggcgatgccgctgcaactggcggcgggcgaggtcggcgagcagggggaagtggtggcgttcgcggaagaatgcggtgaggttggtggtcagcgcgttgacgaacaactgctgctcgcccggctcgcggtcgaggtgggtgaaatattcggcgaagctcccgagccgcagcaggcgcaggcgccgcgagaggcggctatagaccagttgcgccttgctctcggccaggctgatgccggtcagtcggtagagtcgctcgcgtacttgctggaagtcctcgcgggtgtagtggaactcctggttgccgaacaccggcgaaggcgtggaggtgggcattggcgtcgggtttccctggtcgaccctaagggcttgccgccctccgcctggcggaggcgcggcgtggtctcagaactcttcccagccgtcttccttgcgcgccttgctggcccgcgccatgccgctgcgggccagcggcgccggcgcgctggggcgtggcgcggacggccgcgcgctggcgagctggaccacgctcggcggagtgtccagcctgaacaccgccaccgactggttgagcaggcccgcctgctcctgcatggcctcggccgcggccgcggcttcctccaccagcgcggcgttctgctgggtcatgtcgtccatctgcgagaccgcgctgttcacctcttcgatgccggtgctctgctcggcggaggcggcggcgatctccgacatgatgtcggtgacccggcggatcgccaccacgatgtcgctcatggtctgtccggcctgggccaccagggtgttgccgttctccaccttgtccaccgagtcggagatcagcgtcttgatctccttggccgcggcggcggaacgctgggcgagggtgcgcacttccccggcgaccaccgcgaagccgcggccctgctcgccggcgcgggctgcctcgaccgcggcgttgagggcgaggatgttggtctggaaggcgatgccgtcgatcaccccgatgatgtcggcgatcttgcgcgccgactcgttgatcgaggacatggtgctgaccaccttctgcaccacggtgccgccctgggtcgccacttccgaggcattggccgccagcgagttggcctggcgggcattctcggcgttgagcttcaccgtgctggtcagttcttccatgctcgaggcggtttcctccaggctcgacgcctgctgctcggtgcgcgccgacagttcggcgttgccgctggcgatctcgctggcggcggtgttgatggtgtcggcggcctcgcgaatctgcccgagcatccgcgacaggctttgtgcggtgtcgttggagaaatccttgagctggccgaaggtgccctggtagtcggcctcgatgcgctgggtgaggtcgccctgggccagcgccccgagcatccgcgagacgtcgcgcaagccgcggtcggcggtatccaccaggctgttcaggtccttcgccagcctgaggaagaagccttccttgccggcctcctcgacgcgcttgctgaagtcgccggcggccgccgcctgcaccagttgcgagacttcctgctcggcgcggtgttcctcggtgcggtcggtccattgcacggcggagccgaggcgttcgttggcgtcgttgaacactggcaccacatcgagggagaagcgccggccgccgaggttgagctcggccttgtgcacgccggtgaggttggccagcaggtgccgctggtgcgccggattcttgtggaacacgtcgatgttggcgcccatcaggcggccggcgtcgaagttcggcaactgcttgcggatatccgcttcggcgcgaccgagcatctcgctgacggtgcggttcatgtagatgatgttgaggtcgttgtcggcgatcatcacgttggccgagacgttgtccagcgcgctcttgatccgcgcgttgtaggccgccgtggccagttgcgccgaggtcgcctcggcggccccgcgcaggcgttcgcgaacgccgtcgatggcttcggtgatctgcgccttcttgcccggcaggcggtccatcagcggctcgaagttgccctggccgtaggcggtgaccacgctgaccaccttcatcttcaccgcgatgtgcgcggccaccagttcgttgacgcccttggcgatgcgcgccgcgcgaccttccaggcgttcggcgggaatcgtctggtcgatccagccggcttcgtgctggcggctcatctccgccagccccgcctccaggctttccacctgctggagttcggcgcgttgttcgcgcagttgccgctgcagcgctcgcaggctgtcgtagagacgctcgtagccgggcgccggggcctcgccgacggcggtgtcgagctggccgtcggcgaacgactggaggagcgtggcgatccggtcggcgcgttgctgcgccaccgcatgtgcattgaacagacccatttcgatatcccctgcctatccctcgttggcgccgctcaggccgcggcttcgtcgaccagcgccatttcgcggctggtcatcagtctctcgatgtccaccaggatcaacatgcgctcgcccgcggtggccaggccgagcaggtattcggtgtcgaagctggcgccgaactccggcggcggcctgatcgcgtcgccgcccagtgcgatcacgtcggataccgagtccaccaccacgccgacgatgcgccggccgatgttgaggatgatcaccacggtgaacgggtcgtag

SEQ ID NO: 11981 - DNA, 3390 bp, Pseudomonas aeruginosa
ccgcggatctcctgcacgcggaggatgtcgatggcgtactcctcgcggcccagggtgaaggtcaggtattcctgcgccgggccgttcgcctggcttgcctcagtgccgttcatcggcggtgtcctcccgcgccgccaggcgtggcagcgcatcgacgtcgagaatcagggcgacgctgccgtcgcccatgatggtggcgccggcgataccctccacgcggcggaaattctgttccaggctcttgatcaccacctgctgctggccgaccagttcgtccacctgcagggcgaagctgcgcccctcggactcgaggatcaccacgatgccctgctccggcgccggcgcctcgccgccgatgcgcaacagctcgtgcaggctgaacagcggcaggtactcgccgcgtacgcggatcatcgcgttgtcttcgccgccgaggccgcgcacgtcgtcgctgcgcgcctgcagcgactcgacgatgtaggtcagcggaatcacgtagttgaccgcttcgacggcgacgatcaggccgtcgaggatcgccagggtcagcggcaggcggatgccgatgcgagtgcccatgccgggcgccgagtcgatgtcgatgcgcccgcccatggcaccgatgttgcgcttcaccacgtccatgccgacgccgcgtccggacagctcggtgaccgtctcggcggtggagaagccgggcatgaacaccagttgccagacctcggcgtcgctcatcccgtcatgcaccggcaggttgcgctcgcgggccttggcgaggatgcgcggacgcgacaggccgcgaccgtcgtcggaaacctccaccaccacgctgccgccctggtggctggcggcgagcttcaccgtgccgctcgccggcttgccggcggcgaggcgttcggcgggcgtttcgatgccgtggtcgatgctgttgcggacgatgtgggtgagcggatcgctgagtttctcgatcacgctcttgtccagttcggtgtgctcgccgtgcaggtgcagctcgacctgcttgcccaggcgcgtggcggtgtcgcgcaccagcctggggaagcggctgaagatgaagttgatcggcagcatgcggatcgacatcaccgactcctgcaggtcgcgggtgttgtgttcgagctgggccagggcgtgctgcaggcgctcgtggcggctcgggtcgagctgctcgccgagctggccgagcatggcctgggtgatcaccagttcgccgaccaggttgatcaggctgtcgatcttttccacgctgacccggatcgagccggactcgccgtcgccacgcactggcgcgactgcgcccctggccgtcgcggcgacggcttgcgcgggcgcactgggcgcggcggggctgccgggggcgccgtcgaacaggccgaaggcgcgttcctccgccggtggggaacccggtgcctcatcgaagaggccgaacgcttcgctcgcggccggtgcgccgggcgcctcgtcgaagagcccgaacgctcccggcgcggccgctcgttccggagcgcccgggccttcgtcgaagaagccgaaggcatcgtcgtccgcggtttccctggcgggactggcgggcgcgtcgtcgaacaggccgaagccttcctccgccgcttcctgttccggcacccgcagccagccgcgcaggcgctcgaccgtctccagcaacggcaccccggggtcgggacggccgctgcgatgggcgtcgagcaggcgctgcaacacgtcgcgggcttcgaggaaggaactgatcatgtccggccgcaggtgcatctggccgcagcggatgcggtcgagcagggtctccagttcgtgggtgacggcggtgatgtcgtcgaaaccgaacattccgctggaacccttgatcgaatgcgcggcgcggaagattccgtgcagcgtctcgctgtccggccggtccaggtcgagaccgatcaggaggagttcgagggtggccaggtgttcctcggtttcctcgaagaacacctggagaaactggctcatatcctggggcatgggacctcccccgcgggggaacgggaatcagggcaggaccttgcgcgtcacttcgagcagtttcggcgggtcgaacggcttcaccagccagccggtggcgccggcgctgcgtccctgctgcttcatcgcgtcgctcgattcggtggtcagcatgaggatcggcacgctgcggtagccggccaggttacgcaggctgcggatcagcgacaggccgtccatgttcggcatgttctggtcggtgaacaccaggctgtagctcttgctctgggccttgccgaggccttccttgccgtccgcggcctcgtccacctcgtagccggcggacttcagggtgaagctcagcatctggcggatagacgccgagtcgtcgacgatcagaatcggtttgcccatggtcttgcgtcctcacggtgtccctaccgcagcgccaagctcggcggcgaaggtggtgtgtgccaggtggctgtgacggagggctctgatggccctttgctagttccagtaaagacaatgtccggtggatttcaattattggcgccggtttctcgtcggatagttatccggttagacggattggctatcgatacccctcagaacaattccacttcgcccacgttgacgctgttctggctcaccgggctgggcaagggccggcgcagttcctcgacctcccgcgcgacccgttcgggccattcctggcgcggccgcgcctccagcgcgccgaggccgagggcgaaggcgccaagacgcgcatggtgcttgcgcatctggccgagcaactggctgcccatgtcctggaattgcagggcggtgaccgccgcgtcgacgccctggccgacttccagcgagagccggtccagttcgtggatgaccttcagggtgtgccggttcatggcctccaggtcatcgagcatgccctggatcttgtgcttggaatcgagggcgaaggacatgtccttgtcggccagttgcgagatcgcgctctcggcgtcctggatctcgtggtggaccacgtcgacgtgcttgcggatggcggcggaaaactccgtggagcgggtcgacagcgcgcgcacttcatcggcgaccacggcgaagccgcggccgctctcgccggctcgggcggcctcgatggcagcgttgagggcgagcaggttggtctgcttggcgatggcgtccatgtcctgggtcgactgcaggatctcggtgatcttcaggcgcacctggtccatgcgttccaccagttgctgcgaggtccggctggtttccagggtagcctcgacgaacaggctgagggtctgctgggtggtcctgacgaagtcctggaagttgatgccttcgtcgacctggccgcgcccgtcgtag

SEQ ID NO: 11982 - DNA, 636 bp, Pseudomonas aeruginosa
tcgcggccgaaggccagccccatgctgaccttcaacgtgccgctgggttggttgccgacgctggagacgttggcgagagcggtctggatgccctccaggctgccgccgacctcttgcaggaaacgctccccggcttcggtcagggtcaggcgccgggtgctgcgctggaacaggcgcacgccgaggttgctttccaggcgggcgacgttcttgcccaccccggccggcgtcaggcccaggcgcctggcggcctcggcgaagctaccggcctcggcgctgcggacgaagcactggatgttgctgagggtttccatgggaaagggcccgcataaaccattggtatcggctgaatatagcgattacccgctaccaggtctgcaatggacgacggaaactcggggcctgtctatccactccgatggagatttccatgtccgtatcctctgcatccctcgccggcaaagtcgccttcgtccagggcggttcccgcggcatcggcgccgccatcgttcgccggctggccgccgaaggcgccagcgtcgccttcacctacgtcagctcggcggacaagtcccgggccctggcggccgaactcgaaggcgccggagccagcatcctggccctgcatgccgatag

SEQ ID NO: 11983 - DNA, 579 bp, Pseudomonas aeruginosa
cgccgacgcggcggcgctcgtcgccgccgtcgacgaagcggcggctcgcttcggacgcatcgacatcctggtcaacaacgccgccgtcctcgccctcggttcggtggaagagctgccgctggccgacttcgagcggaccctggcgatcaacgtgcgcagcgtcttcgtcgccacccaggcggcggtcaagcacatgggcgacggcgggcgggtgatcagcatcggcagcaccaatgccgaacgcatgccgttcgccggcggcgccacctacgcgatgagcaagtcggcgctggtcggcctgaccaagggcctggcccgcgacctcggcccgcgcgggatcacggtgaacaacgtgcagccgggtccggtggataccgacatgaacccggacgacggcgacttcgccgaggccctcaagggcctgatggcgctgccgcgctacgcccgcagcgaggaaattgccagcttcgtcgcctacttggccgggccggaagcggcctacatcaccggggccagcctgaccatcgatggcggtttctcggcctgacccgggtcgcctcgttccacccggcgaagtag

SEQ ID NO: 11984 - DNA, 1311 bp, Pseudomonas aeruginosa
atgcgttcatgcgtgtctccagcgcgtggcgcgcgcttcgatgcgttggccgagggcattgagcagggcgccggtgaggccgaccaggagcatgccggcgccgatcaggtccatgcggaacaattgctgggcgccgatcatcaggctgccgatgccgccgtcggagggcatgaagtactcggcgccgatggttcccagccaggcgtagatcagcgccaggcgcaggccggcgaacaccgacggggcggcacccggcaggaccagccggagcagccgtcgccagggacccaggcgcagcacccgggccgcctcgccgaggctcggcggcaggctggcgatgccgcgctgggtggccagcagcagcgggaagaaggcggcgattgcgacgaacgtcagcttggccggttcgcccaggccgaaccaggcggtgagcagcggtacccaggcgaagatcgccacctgccgcagtgccgcgaaagtggggccgaagaagcgttccgccgggcgccacaggccgagcagcaggccgccgaggaaacccaggccgccgcccagcaggagcccgccgagcgtgcgcttcaggctgtcgaacagggcgcctgggaggctgccgtcgagcgctccgctccaggtcgcccgcgccacttccagagggctggcgaggatcgccggatcgacccattcggcgctgctcgccgactgccacaggagcagcagcgccagcggcggcagccacacctgcaggcgctgccagccgcgtcccggcgggcgccggcggaattcgccggtggcggcttgcggccagtgcagcaggcggcggtcgagccactggatggcgcggtccatgcccaccccgaccaggccgatgatgaggatgcagacgaacacgatgtcgagcatgaacagttgccggccctgcaccatcaggtagccgataccctcgctggaagcaagcaactcgaccgccagcagcgaggtccagccctgcgccagggccaggcgcagcccggtgaggaaggccggcagcgccgccggcaggatcagccgccagaccagcaggcgtggcggcaggcgcagtactgcggcggcttcgcgcagcttgggctgggcgtcgcgcacgccgaccagggtatggatggtcaccggcaccacgaccgctttcaccagcaccaccagcttgagcagttcgccgatgccgaagaacagcatgaacagcgggatccaggccagcgtggggatttgcgcgagggcgctgaaggtggggaagaccaggcgctcggcacgcggactgaagcccagccaggcgcctag

SEQ ID NO: 11985 - DNA, 1230 bp, Pseudomonas aeruginosa
acggcgaggcgctgggcatcaagttccggcagaacgacggggcggccgaggtggtcgagcatcctgtggcggtggaggccttcgccgaactggtggcggcgctcgaggatccggcctgccaactgcggatcaagctcgagccgggggaaatcctggtgctcgacaacactgcggtgttgcacgggcgcactgccttctgcgccaacgaactgcgcgagatgcgccggctcaacttcgacggccacggccgcctgcgggcggagctggaactgggcttcaaggtggggttgtgatcgcacagttcgtcgcggtggtgctgccgatcctgatctgcaccgggatcggtttcgcctggagccgttccgccgggccggtggatacccgcgcgctggtgttcctggtggccaacgtcggctttccctgcctgctgctgtcgtcgctggaccgccccggcctgtccattggcatggtggccggggtgttcctcgccaccgcgctggcggtgctggcgttcgccctgctgggcctggtcgccctgcgcctgctgcggatgccggtgcggcgctacctgccgtcgatcatgctgccgaactccgggaacatgggcatccccatcgcctacctggccttcggcgaggaggcgctggtgtatgcggtggcgttctccaccctgatccaggtgggccacgcgacgctcggcgtctggttcgcttcgggcgatatcaccccggcgagcatcctgcgcaacccgatgatctatgccctggccgtggcgctgggcctgatcgccctgggctggagcctgccgccgccgttgcgcgatgtgacccgcctgctgggcgggattaccgtgccgctgatgctggtgatgctcggcctgtcgctggccggtctgcgcctgcacgagacctggcggccgttgctgctgtctctggtgcgggtctggggcggtttcgcggtcggctatgggatcgctgccggcctgggcatggaggcggtggcggcgggcaccttcgccatccagtgcgggatgccgaccgcggtgctcacctacctgttggccaagcgttacgacggaccggtgaacgaagtggcaggcatggtgctgatcaccacgctgctggtgctgctctccacgcctttgttcatccagttgctgccgcgcgcgtgaagacgatccgggccgccccgcggggcggcccggggcgtcaccagatcgagcgggagtaa

SEQ ID NO: 11986 - DNA, 762 bp, Pseudomonas aeruginosa
gctcccgatgcaacctcgcctcagggaatacgcttcatgaacaacaagaccctatgcccttcgctcttgctctgcctttcgctgctcgcaccgctgtcttgtctcggggagaccgccgccgcgccctatccgctggcccacccaccgcgcctggccgactacctcccgccgccgccggcggcggactcggctgcggccgtcgccgatctcggcgcggtgctggaagcgcaacgcctgcgcacgcccgaacaggtacgccgggtacgcgcccacgaccagtgggaggacaacgtcttccccttcgccggcgacctgctgggcgcctcgttcgacaaggaacgcctgccgctgacccggagtttcttcaaccgcgcccaggaaaacctggtcgaggtgctgatgccggcgaagaagcacttcgcccgcccgcgtccctacgaagtgacaccgaaggtgaagccggtgctgccgccgccggagggggagtcctatcccagcggccacaccatggacagctacttcaaggcctcgctgctgagcatgctggtgccggagcatcacgatgcgttcttcgcccgcgccgaggagcatgcgcagagccgtgtgctggccggcgtgcacttccccagcgacctggaaggcgggcagaccgccgccgcggcgctggtggcgagcctgctggccgatccggcggtggccgccgacttcgccgcggtgcgcgaggagctgcgcggcgcgctggggttgccgaaactccagtag

SEQ ID NO: 11987 - DNA, 2493 bp, Pseudomonas aeruginosa
cagtcgcccggggctgagccgtccgccggcccccttcgaacctttcgccagatcgctgccttgcgcggcatggccgcctgctgcctgcgtccggctgcgccggaaccgaggacattcacgatgaagcaccactaccgcttgccgctccgccgaacgccgcccggcggctccgactacgccctggccctgctgctcgccctcggcggtgcgttgccggccagtgccgccgatgctcccgcgcccgccgaggaagcgccgccgctggccagcagcgtcccggacaaggccgatacggccctgggcaaggtcactgtcaccgcgcgtcgccgcgaggaggattcgcagaaggtaccgacgccgatcaccgtgctcggcggcgagactctcgaggcccagcgcatctcccgggtgcaggacctgcagcaggtgctgcccagcgtcaatgtcgcctacatccatgcgcggcagtcgagcgtcgccgtgcgcggcatcggcaacaaccccgccagcgacggcctggaaggcagcgccgggatctacctcgacaacgtctacctgggacgtccgggaatggccgtgttcgacctgctggacatcgagcaactggagctgctgcgcggtccgcagggcaccctgttcggcaagaacaccaccgccggggtgctgaacatcagcacccgcgcgccgaccttcactgccgagcgtaccgtcgaggtctccggcgggcaggatggctacttccagggccgcggcacggtttccgggccgctcggcgaaaccctcgccggacgcctctcggcctatcgcacccgcgacgacggctacatcaagaacatccacgacgacaactatctcaacggcggcgagcgccagggcgcgcgcgggcaattgctgttcgagccgaacgaggacttcagcctgcgctggatcgccgactacaacgaggaggattcgagcaacggcagcatggtggtctacggcgccgccgagcgtttctggcagcgcgccgcgctggtcggcgcttcgccgttgcgcgatccgcagcgcaggaaggtcaacatcaacggccgccagcacgtcagcgtgcaccagggcggcagctcgctggaggccaactggaacctcgccggcggctaccgcctgacctccatcagcgcctaccgctactggcacttcaccccggccaacgacgagcaactgaacgtctcggcgatcaacgacaccggggtggaagtgcacgaccggcagttctcccaggagatccgcctggcctcgcccaccggcggtgccttcgaatacgtggtgggcgcctacgcgttcaggcagaacctcggcaacaagaccttcacctcctacggaccgttggccgacctgtacctgctcggcgccaatctcggcgcgctgaacgacacctactcgaaggccaacggcaagatcgagaccgacagcttcgcgctgttcgcccagggcacctggcacctcaccgaacgcctggacttcaccgccggcctgcgcggtacctacgaggagaagaacgccaaggtcgagcgcttcgctccgctgggcggcgcggcggtcggcggggtcggcgcggcggtgcgcaacggccagctcggcgcctacgattccggcgatctcagccagtacaacttcgccccttcggcgttgctcagcctcagctaccagttcagcgacgacctgctcggctacgccagcctgtcccacggcgagaagtccggcggggtcaacctggcggtgggcagcgcaccgagcgccggcgccgattcgctgctggtcggaccggagcgcgccaacgacgccgagctgggcctgaagagcacgctcttcgaccggcgcctgttgctcaacgccaacctgttctggaccggcatccacgggtaccaggccaccaccctgtaccaggcgccgggcttgacccagttggtgcaggtgctggccaacgccggcagcgtgcgctcgcgtggtctggagttcgaggccaccgcgctgccgttgcgcggcctgaccctgaacttcaacggctcctataacgacgtcacctacctgtcgttcaaggatgccccgtgccctgcggaagtcagcacccggcccggcgcgccgagcagttgcgacctcaccgggcagcgcgtggtcggcgcctcgaaatggatcgccaatctcaatggcgaataccagtggcgcctcgacgaccgcttccaaccctacgtcagcgccagctacgcctaccgctccgccgccgagggcacgctggacaactccgacctttcgaagatcgacggctacgccctggtgaacctcgccgccggtctgcgcagcgatctcggcgacggccaactggacacctcggtatggctgaagaacgccttcgacaaggactactacctgagcgccttcgccagcatcaacggctcctacaccgcatcggtggggcagccgcgcacgctcggcgtatcgctgcgctacgacttctga

SEQ ID NO: 11988 - DNA, 675 bp, Pseudomonas aeruginosa
catgagcaatgcagcacaagccctcgccacgccggtacggctcgacgtccggccggtcgccggacggatcggcgcggagattcgcggcgtgaccctgtccggcgaactggacgccgccaccgtcgaggcgatccaggccgccctggtacgccacaaggtgatcttcttccgggaccagagccatctcgacgaccagacccaggaggccttcgcccacttgctcggcgaaccggtcgcccaccccaccgtgccgtcccgcgaaggcacccgcttcctcctcgagctggatggcgccgaaggccgccgggccaactcctggcataccgacgtgaccttcgtcgaggcctacccgaaggcctcgatcctgcgcagcgtggtggccccggagtccggcggcgacaccgtctgggccaacacggcgagcgcctacgccgacctgccggcggagctgcgcgagctggccgaccggctctgggcggtgcacagcaacgagtacgactacgccggggtctagcccagcgcctcggtggagcagttggagaactaccgcaaggtgttcacctcgaccgtctacgagaccgagcacccggtggtccgcgtgcatccgcaaagcggcgagcggacgctgctcctcggccacttcgtgaaacgcctgaagggtctttcgcagcatga

SEQ ID NO: 11989 - DNA, 513 bp, Pseudomonas aeruginosa
gccaatccgccaccgcccggcaacccgaacccgaggtcgccgaggcattccgcatcacccccctggaggcgccgctgggcgccgaagtccgtggcctcgacgcgcgccggccgctggcgccggagcaggtcctggcgctcaagcaggcgctgcgcgagcaccacatcctggtgttccgccagcagcacctcgacgatgagcagtacttgcgcttcgccaccctgttcggctcggtgttccagccgccggcggacatcccggtgctgtcctcgggtggcgacggcaaggtgccggacatcgtcaaggtggccaacaccggcgacggcgaactgggcaacttcgccctgccggcacacatcgaccaccaatggacgccggtgccgtcctccggctcgttcctctacgcactggaggtgccgtccagtggcggcgagacgcgcttcaccaacctggcgcgcgcctacgagagcctcgacgaggcgacccggcgcgagatcgatggcctgcgcctga

SEQ ID NO: 11990 - DNA, 1119 bp, Pseudomonas aeruginosa
gtgcagatcggtgtccccctcgagacccatgccggtgagacgcgggtttccgccaccccggaaaccgtcaagaagctgatcggccaaggccaccaggtgatcgtccagagcggcgccggcgtcaacgccagccagccggacagtgcctatgaagccgccggcgcgacgatcggcagcgccgccgaggccttcggcgccgacctggtgctgaaggtggtcgcgcccagcgccgccgagctggcccagatgaaaagcggcgccgtgctggtcggcatgctcaaccccttcgacaacgagaacatcgcccgcatggccgagcgcggcatcaccgccttcgccctcgaggccgcgccgcgtacctcgcgggcgcagagcctggacgtgctctcctcgcaggccaacatcgccggctacaaggcggtgatgctcgccgccaaccactacccgcgcttcatgccgatgctgatgaccgccgccggcaccgtgaaggccgcccgcgtgctgatcctcggcgccggcgtcgccggcctgcaggcgatcgccacggccaagcgcctgggcgcggtgatcgaggcttccgacgtgcgtccggcggtgaaggagcagatcgagtcgctcggcgccaagttcgtcgacgtgccctacgagaccgacgaagagcgcgagtgcgccgaaggcgtcggcggctacgcgcggccgatgccggcctcgtggatggagcgccaggccaaggccgtgcacgagcgcgccaagcagtcggacatcgtcatcaccaccgcgctgatccccggccgcaaggcgccgacgctgctgcacgaggcgaccgtggcggagatgaagccgggctcggtggtcatcgacctggccgccgcccagggcggcaactgcccgctgaccgaggccgaccaggtcgtggtccggcacggcgtgaccatcgtcggccacagcaacctggccgcgctggtaccggcggacgcctcggcgctatacgcgcgcaacatcctcgatttcctcaagctcaccctgaacgccgaaggcttcagcgtgaacctcgaggacgacatcgtcgccgcctgcctgatgtgccgcgacggccaggcggtgcgcaagaacggctga

SEQ ID NO: 11991 - DNA, 324 bp, Pseudomonas aeruginosa
agaccggtgaaaacgatggatatcatttctgacgggatctacaacctgatcatcttcgtgctggccgtgtacgtcggctaccacgtggtatggaacgtcacccctgccttgcacaccccgctgatggcggtgaccaacgcgatttccgcgatcgtcatcgtcggcgccatgctcgccgccgccctgaccgtgaccccgctgggcaaggccatgggcaccctcgccgtggccctggccgcggtcaatgtgttcggtggcttcctggtcacccggcgcatgctggaaatgttcaagaagaaagcgccgaaggcggggggccactga

SEQ ID NO: 11992 - DNA, 327 bp, Pseudomonas aeruginosa
acgtggctgctggccgaggccgaagtgccctacaagcaggtgttcgagatggaggacatcaactccgagttcggccagaccgacgtggtcctggtgctcggtgccaacgacgtggtcaacccggcggcgaagaacgatccgaagtcgcccatcgccggcatgccgatcctcgaggcctacaaggccaagaccgtgatcgtcaacaagcgatccatggccagcggatacgccggcctggacaacgagctgttgtacctggacaagactatgatggtgttcggcgacgccaagaaagtcatcgaagacatggtcaaggcggtggagtga

SEQ ID NO: 11993 - DNA, 564 bp, Pseudomonas aeruginosa
gactccagcacggacttgagcggccatggagttcgtcagtgcaaggagtttttcatggcaacaccccagcctgtcgatgcccgcacgcagccctggcgcgagacgcccggcggcgacctggtggcgctcggtcggccggttcgccaggcgttgcacctggttcgccacaacccggcacagggtcgggtgctcagccggcgcgagacgatcctgctggtcctgttcgccctgaccctgcacggagcggtgatccattggctgagccagcagagaaccccggcgctgcccgaggtgccgccacaggtgccgccgatgaccatcgagttcaccgccccggcgccgccggtggtggaaccgccgccgcccgagccgttgccgccggtggtcgaggaaccgccaccaccggtggtcgacgagaacgcggtgaagccgccgccgccgaagccggtgccaaagccgaaacccaagcccaagccgcaaccccggcccaagccggcgccgaaggccgtcgagccggctccgcccgcgccgccgcaacccgccgcgccacccgccccgccggcg

SEQ ID NO: 11994 - DNA, 240 bp, Pseudomonas aeruginosa
gcgccggcggggcgggtggcgcggcgggttgcggcggcgcgggcggagccggctcgacggccttcggcgccggcttgggccggggttgcggcttgggcttgggtttcggctttggcaccggcttcggcggcggcggcttcaccgcgttctcgtcgaccaccggtggtggcggttcctcgaccaccggcggcaacggctcgggcggcggcggttccaccaccggcggcgccggggcggtga

SEQ ID NO: 11995 - DNA, 513 bp, Pseudomonas aeruginosa
gagttgagcatcgacaccaccaccggcatgtcggcgccgccgatggggatgatgatcagcacgccgaggacgaaggccagcgccagcatcacggcgaaggcggtgaggttgccggtgaacatgaacaccaggcccaggccgagggttgccaggccgagcaccaggttcagcaggtgctgcccggagaactgcaccggggtgccctggaacaggcggaacttgtacttgccggagagcttgccgaaggcgatcaccgaaccggagaaggtgatggcgccgatggccgcgccgaggaacagctccaggcggttgccggtgggaatggtgtcgcccaggtgcgcgacgatccccagcgactgcggctcgaccaccgctgcgatggcgatgaacaccgcggccaggccgatcatgctgtgcatgaaggcgaccagctcgggcatcttggtcatctcgacgcgcttggccatgatcgagccggcggtaccgccgaccagcaggccgacgacgatgtag

SEQ ID NO: 11996 - DNA, 1002 bp, Pseudomonas aeruginosa
ggggtcctcgcgggttcgttctgcctgtggtcgccctccccggcgaggagagggccgggtccgtcatgccttccggatcgtccggctgcgttgcccgtcgatgcctaccggcacgtcgccgccgagggtcacccggcgcaccacgcgcggctggtcgccgtagtcgtcgatcgcgtagtgctgggtcgcgcggttgtcccagatcgccacgtcgccggcctgccagcgccagcgcacggtgttctccaggcgcgtgacgtgcccctgcagcaccgcgaagaggtgcgccgagtcatgctgcgaaagacccttcaggcgtttcacgaagtggccgaggagcagcgtccgctcgccgctttgcggatgcacgcggaccaccgggtgctcggtctcgtagacggtcgaggtgaacaccttgcggtagttctccaactgctccaccgaggcgctgggctagaccccggcgtagtcgtactcgttgctgtgcaccgcccagagccggtcggccagctcgcgcagctccgccggcaggtcggcgtaggcgctcgccgtgttggcccagacggtgtcgccgccggactccggggccaccacgctgcgcaggatcgaggccttcgggtaggcctcgacgaaggtcacgtcggtatgccaggagttggcccggcggccttcggcgccatccagctcgaggaggaagcgggtgccttcgcgggacggcacggtggggtgggcgaccggttcgccgagcaagtgggcgaaggcctcctgggtctggtcgtcgagatggctctggtcccggaagaagatcaccttgtggcgtaccagggcggcctggatcgcctcgacggtggcggcgtccagttcgccggacagggtcacgccgcgaatctccgcgccgatccgtccggcgaccggccggacgtcgagccgtaccggcgtggcgagggcttgtgctgcattgctcatgtcatgttcctcatgcgtggggtactgcgtgggtga

SEQ ID NO: 11997 - DNA, 588 bp, Pseudomonas aeruginosa
cttccgaaatgcttgacccggcctgccgttgcacatgccagcccctgccaatggcaggccccggcaaaagccgaggcagggaaacacaagcggcctgcggagcgacttccgagactgcgcccacctggcactcaggtgggagaaaacaataaatgcaaaatctcagacgcgctgtattcgccggcctggtcgccggcacgctttccgaaggggcggccgcgacggccggggatgggggcttcgtcgaggacagcgaactgcagttcctcgctcgcacctactacttcaaccgcgactaccgcgacagcccgaacaacgccgggcgcaaccgcttcaagcccaggagcgagcgcaacggctaccgtgaggaagccacccagggcctgcgcctccagttcgcctccggctacacgccgggcagcctcggcttcggcctcgacgcccatgccatgctcggcctgcaactggacagcggcggcggccgcaccggcaccggcaacctgccggtcggcgccgacggccatcccgaccatcgctacggcaaggtcggtggcgccctcaggctacgccacggcgaaacccgcctga

SEQ ID NO: 11998 - DNA, 2385 bp, Pseudomonas aeruginosa
agtacggccagaccaccaccagcgcgccggtgttcgccgccagcagcaaccgcacgctggccggcatggcctacggcctgctgctggaggaccgctcgttcgacgggctgctgctcgagggcgggcgcttcaccgccgcctccggccccggcgaatccaaggtccgcggcgacatcagcaccgtctacggacgcctcggcgcctatccggtgcgcctcgacgcggtcggcttcctcggcggtcaatggcaggccacggagcggctgcaactgtcgctctacgcctcgcgcttcgacgacatctggcagcaggcctatttcggcgccagccatcgccagccgctgggcggggagcgcgcgctgcgggtcgacctcgacgcctaccgcacccgcgacagcggccagagccgcttcggccgcatcgacaccctggccagctccctggccctgggctacgaacaggggccgcagcgcatcaccctggcctaccagcgtgtccatggcgagcagccgttcgactacatggccttcggcgacgggcgctccagcgcgtccatggtactcgccaactcggtgggctactccgacttcaacggaccgggcgagcgttcctggcaattacgctatgacctggacctcggcgcgctcggcctgcctgggctcagcctgcatgcgctgcatgcccgcggccgtgccggggccagcgccagcagtgccgccgagagcatctacgccggactctacgggcgtgacgggcggcaccgggaaaacgacctcggcttcgcctatcgggtcaaggcgggccccctcgccggcctcgcgctgcgcgcctcgcaggcctggcaccggggcaacgcgagctatctcgacggcgacatcgacgaaacccggctggtcgtcgattactcccgctcgatctggtgacgccccgggccgccccgcggggcggcccggatcgtcttcacgcgcgcggcagcaactggatgaacaaaggcgtggagagcagcaccagcagcgtggtgatcagcaccatgcctgccacttcgttcaccggtccgtcgtaacgcttggccaacaggtaggtgagcaccgcggtcggcatcccgcactggatggcgaaggtgcccgccgccaccgcctccatgcccaggccggcagcgatcccatagccgaccgcgaaaccgccccagacccgcaccagagacagcagcaacggccgccaggtctcgtgcaggcgcagaccggccagcgacaggccgagcatcaccagcatcagcggcacggtaatcccgcccagcaggcgggtcacatcgcgcaacggcggcggcaggctccagcccagggcgatcaggcccagcgccacggccagggcatagatcatcgggttgcgcaggatgctcgccggggtgatatcgcccgaagcgaaccagacgccgagcgtcgcgtggcccacctggatcagggtggagaacgccaccgcatacaccagcgcctcctcgccgaaggccaggtaggcgatggggatgcccatgttcccggagttcggcagcatgatcgacggcaggtagcgccgcaccggcatccgcagcaggcgcagggcgaccaggcccagcagggcgaacgccagcaccgccagcgcggtggcgaggaacaccccggccaccatgccaatggacaggccggggcggtccagcgacgacagcagcaggcagggaaagccgacgttggccaccaggaacaccagcgcgcgggtatccaccggcccggcggaacggctccaggcgaaaccgatcccggtgcagatcaggatcggcagcaccaccgcgacgaactgtgcgatcacaaccccaccttgaagcccagttccagctccgcccgcaggcggccgtggccgtcgaagttgagccggcgcatctcgcgcagttcgttggcgcagaaggcagtgcgcccgtgcaacaccgcagtgttgtcgagcaccaggatttcccccggctcgagcttgatccgcagttggcaggccggatcctcgagcgccgccaccagttcggcgaaggcctccaccgccacaggatgctcgaccacctcggccgccccgtcgttctgccggaacttgatgcccagcgcctcgccgttcaggcggaacaccggctgggtgctgctctggtgcttgcgcacgatggtcagggcgtcgccgcgcagcaggccgagatgcttggtcggcatgcgccggcgcaggcgctcgaaggccagtccggcgctggccagcagggtctccccgccctcccgggcgttgcgcacgcattgcaggctgcacaattgctccggggtgtcgaggaaagcgccgtcggtgtgcagcttgtgctccagcggcgtggagccgaggtag

SEQ ID NO: 11999 - DNA, 2436 bp, Pseudomonas aeruginosa
aaccctttcgcccgcctggagccggcccctgccgcgcctggcgccgccgccctccgcggctttcgcccggcgcctgggggacggcctgctgccctggttgctgccgctcgggctggcgctgctgtggtgggtcgccagccatcgccactggatgtcggcccaggtgctgccaactcccgagctggtctggcagagcgcccgcgagttgctcgccggcgaactctggagcgaattggcgatcagcctgcggcgcctggcctggggcctgctcgccggggtcgccagcggcgccgcgctaggcgcctggctgggcttcagtccgcgtgccgagcgcctggtcttccccaccttcagcgccctcgcgcaaatccccacgctggcctggatcccgctgttcatgctgttcttcggcatcggcgaactgctcaagctggtggtgctggtgaaagcggtcgtggtgccggtgaccatccataccctggtcggcgtgcgcgacgcccagcccaagctgcgcgaagccgccgcagtactgcgcctgccgccacgcctgctggtctggcggctgatcctgccggcggcgctgccggccttcctcaccgggctgcgcctggccctggcgcagggctggacctcgctgctggcggtcgagttgcttgcttccagcgagggtatcggctacctgatggtgcagggccggcaactgttcatgctcgacatcgtgttcgtctgcatcctcatcatcggcctggtcggggtgggcatggaccgcgccatccagtggctcgaccgccgcctgctgcactggccgcaagccgccaccggcgaattccgccggcgcccgccgggacgcggctggcagcgcctgcaggtgtggctgccgccgctggcgctgctgctcctgtggcagtcggcgagcagcgccgaatgggtcgatccggcgatcctcgccagccctctggaagtggcgcgggcgacctggagcggagcgctcgacggcagcctcccaggcgccctgttcgacagcctgaagcgcacgctcggcgggctcctgctgggcggcggcctgggtttcctcggcggcctgctgctcggcctgtggcgcccggcggaacgcttcttcggccccactttcgcggcactgcggcaggtggcgatcttcgcctgggtaccgctgctcaccgcctggttcggcctgggcgaaccggccaagctgacgttcgtcgcaatcgccgccttcttcccgctgctgctggccacccagcgcggcatcgccagcctgccgccgagcctcggcgaggcggcccgggtgctgcgcctgggtccctggcgacggctgctccggctggtcctgccgggtgccgccccgtcggtgttcgccggcctgcgcctggcgctgatctacgcctggctgggaaccatcggcgccgagtacttcatgccctccgacggcggcatcggcagcctgatgatcggcgcccagcaattgttccgcatggacctgatcggcgccggcatgctcctggtcggcctcaccggcgccctgctcaatgccctcggccaacgcatcgaagcgcgcgccacgcgctggagacacgcatgaacgcattcaccgcgcccgccacgggcaccccgctggtcagcttccgccaggtgcgcaagcacttcgccgtggacggccggcgactggaagcgatccagcagttcgacctggagatcggcgagggcgagttcatcgccatcgtcggcgccagtggctgcggcaagtcgaccctgctgcgcctgctgatcggcctggaccgcgactacgacggcgagatccgcgtcgacggccggccaatcgccggcatcggcggcgaacgcggcatcgtgttccaggagcaccgcctgttcccctggctgacggtgcagcagaacgtcgccctcggcctggtcaacgaagcccttggcgaaaccgacaaggcggcgcggatcgacgaatacatccgcctggtcggcctgcacggcttcgagcgtgcctacccgcaccagttgtccggcggcatggcccagcgcgtggcgatcgcccgtggcctggtggccagcccgcgcctgctgctgctcgacgagccgttcagcgccctcgacgcactgacccgccagcagttgcaggaagagttgctggcgatccgccggcgcacccgtatcaccaccctgctggtcacccacgacgtcgaggaggcgctctacctggccgaccgggtggtggtgatggagccgcgtccggggcggatcaggcgggtggtcgaggtgggcctggcgcatccgcgcgagcgcggtggcttcgacttcctgcgccagcgcgaagcgctgctgcacgaactgaccgccgacggcgagtacgtcgcgccgccgccgcgacgggtggaaaacctgcccttcgaattcctcgcttgctga

SEQ ID NO: 12000 - DNA, 1698 bp, Pseudomonas aeruginosa
aaagccccttgccctggccctttccccctgcgggaagggcgggggcgagggccccaccttctcctcccatccagacgagacccgcgcatgagcaaacgccccaacttcctggtgatcgtcgccgacgacctgggcttctccgatatcggcgccttcggcggcgagatcgccacgccgaacctcgacgccctggccatcgccggcctgcgcctgaccgacttccacaccgcctcgacctgctcgccgacccgctcgatgctgctcaccggcaccgaccaccacatcgccgggatcggcaccatggccgaggcgctgaccccggaactggaaggcaagccgggttacgaagggcatctcaacgagcgcgtggtggcgctgccggagctgctccgcgaggccggctaccagaccctcatggccggcaagtggcacctcggtctgaagccggaacagacgccccatgcacgcggtttcgagcgttccttctcgctgctgccgggcgccgccaaccactatggtttcgagccgccctacgacgaaagcactccgcgcatcctcaagggtacgccagcgctctacgtggaagacgagcgctacctcgacacgctgccggagggcttctattcctccgacgccttcggcgacaagctgctgcaatacctcaaggagcgcgaccagagccggccgttcttcgcctacctgccgttctccgcgccgcactggccgctgcaagcgccgcgggagatcgtcgagaagtaccgcggtcgctacgacgccggtccagaagcgctgcgccaggaacgcctggcccggctcaaggagctgggcctggtggaagcggacgtcgaagcccatccggtgctcgccctgacccgcgagtgggaggccctggaggacgaggaacgggctaagtcggcgcgggcgatggaggtctatgcggcgatggtcgagcgcatggactggaacatcggcagggtcgtggactacctgcgccggcagggcgagctggacaacaccttcgtcctgttcatgtccgacaacggcgccgaaggcgccctgctggaggcgttcccgaaattcggcccggacctgctgggctttctcgaccggcactacgacaacagcctggaaaacatcggccgcgccaattcctacgtctggtatggcccgcgctgggcccaggcggccaccgcaccatcgcgcctgtacaaggcgttcacaacccagggcgggattcgcgtgccagcgctggtgcgctacccgcggctaagccggcagggtgcgatcagccatgccttcgccacggtgatggacgtcaccccgaccatcctcgacctcgccggtgtccgccacccaggcaagcgctggcgcggccgcgagatcgccgagccgcgcggcaggtcttggctgggttggctttccggcgagaccgaggcggcccacgacgagaacaccgtgaccggctgggagctgttcggcatgcgtgcgatccgccagggcgactggaaggcggtgtacctgccggccccggtgggcccggccacctggcagctctacgacctggcccgcgacccgggcgagatccacgacctcgctgacagccagccgggcaagctggcggagctgatcgagcattggaagcgatacgtcagcgagaccggtgtcgtagagggggcttcgcctttcctggtgcgataa

SEQ ID NO: 12001 - DNA, 876 bp, Pseudomonas aeruginosa
gcggaacctctcccctcgccctctcccttcaggagggagcgtctggccagaaggtcggggagaggggctacttcgccgggtggaacgaggcgacccgggtcaggccgagaaaccgccatcgatggtcaggctggccccggtgatgtaggccgcttccggcccggccaagtaggcgacgaagctggcaatttcctcgctgcgggcgtagcgcggcagcgccatcaggcccttgagggcctcggcgaagtcgccgtcgtccgggttcatgtcggtatccaccggacccggctgcacgttgttcaccgtgatcccgcgcgggccgaggtcgcgggccaggcccttggtcaggccgaccagcgccgacttgctcatcgcgtaggtggcgccgccggcgaacggcatgcgttcggcattggtgctgccgatgctgatcacccgcccgccgtcgcccatgtgcttgaccgccgcctgggtggcgacgaagacgctgcgcacgttgatcgccagggtccgctcgaagtcggccagcggcagctcttccaccgaaccgagggcgaggacggcggcgttgttgaccaggatgtcgatgcgtccgaagcgagccgccgcttcgtcgacggcggcgacgagcgccgccgcgtcggcgctatcggcatgcagggccaggatgctggctccggcgccttcgagttcggccgccagggcccgggacttgtccgccgagctgacgtaggtgaaggcgacgctggcgccttcggcggccagccggcgaacgatggcggcgccgatgccgcgggaaccgccctggacgaaggcgactttgccggcgagggatgcagaggatacggacatggaaatctccatcggagtggatag

SEQ ID NO: 12002 - DNA, 780 bp, Pseudomonas aeruginosa
cctggccggctaccgcagcgtgccgatcctcatgctgaccaccgaatcgagcgacgcgatgaagcagcagggacgcagcgccggcgccaccggctggctggtgaagccgttcgacccgccgaaactgctcgaagtgacgcgcaaggtcctgccctgattcccgttcccccgcgggggaggtcccatgccccaggatatgagccagtttctccaggtgttcttcgaggaaaccgaggaacacctggccaccctcgaactcctcctgatcggtctcgacctggaccggccggacagcgagacgctgcacggaatcttccgcgccgcgcattcgatcaagggttccagcggaatgttcggtttcgacgacatcaccgccgtcacccacgaactggagaccctgctcgaccgcatccgctgcggccagatgcacctgcggccggacatgatcagttccttcctcgaagcccgcgacgtgttgcagcgcctgctcgacgcccatcgcagcggccgtcccgaccccggggtgccgttgctggagacggtcgagcgcctgcgcggctggctgcgggtgccggaacaggaagcggcggaggaaggcttcggcctgttcgacgacgcgcccgccagtcccgccagggaaaccgcggacgacgatgccttcggcttcttcgacgaaggcccgggcgctccggaacgagcggccgcgccgggagcgttcgggctcttcgacgaggcgcccggcgcaccggccgcgagcgaagcgttcggcctcttcgatga

SEQ ID NO: 12003 - DNA, 693 bp, Pseudomonas aeruginosa
ggcaccgggttccccaccggcggaggaacgcgccttcggcctgttcgacggcgcccccggcagccccgccgcgcccagtgcgcccgcgcaagccgtcgccgcgacggccaggggcgcagtcgcgccagtgcgtggcgacggcgagtccggctcgatccgggtcagcgtggaaaagatcgacagcctgatcaacctggtcggcgaactggtgatcacccaggccatgctcggccagctcggcgagcagctcgacccgagccgccacgagcgcctgcagcacgccctggcccagctcgaacacaacacccgcgacctgcaggagtcggtgatgtcgatccgcatgctgccgatcaacttcatcttcagccgcttccccaggctggtgcgcgacaccgccacgcgcctgggcaagcaggtcgagctgcacctgcacggcgagcacaccgaactggacaagagcgtgatcgagaaactcagcgatccgctcacccacatcgtccgcaacagcatcgaccacggcatcgaaacgcccgccgaacgcctcgccgccggcaagccggcgagcggcacggtgaagctcgccgccagccaccagggcggcagcgtggtggtggaggtttccgacgacggtcgcggcctgtcgcgtccgcgcatcctcgccaaggcccgcgagcgcaacctgccggtgcatga

SEQ ID NO: 12004 - DNA, 630 bp, Pseudomonas aeruginosa
cgggatgagcgacgccgaggtctggcaactggtgttcatgcccggcttctccaccgccgagacggtcaccgagctgtccggacgcggcgtcggcatggacgtggtgaagcgcaacatcggtgccatgggcgggcgcatcgacatcgactcggcgcccggcatgggcactcgcatcggcatccgcctgccgctgaccctggcgatcctcgacggcctgatcgtcgccgtcgaagcggtcaactacgtgattccgctgacctacatcgtcgagtcgctgcaggcgcgcagcgacgacgtgcgcggcctcggcggcgaagacaacgcgatgatccgcgtacgcggcgagtacctgccgctgttcagcctgcacgagctgttgcgcatcggcggcgaggcgccggcgccggagcagggcatcgtggtgatcctcgagtccgaggggcgcagcttcgccctgcaggtggacgaactggtcggccagcagcaggtggtgatcaagagcctggaacagaatttccgccgcgtggagggtatcgccggcgccaccatcatgggcgacggcagcgtcgccctgattctcgacgtcgatgcgctgccacgcctggcggcgcgggaggacaccgccgatga

SEQ ID NO: 12005 - DNA, 2160 bp, Pseudomonas aeruginosa
ccagccgcgaaatggcgctggtcgacgaagccgcggcctgagcggcgccaacgagggataggcaggggatatcgaaatgggtctgttcaatgcacatgcggtggcgcagcaacgcgccgaccggatcgccacgctcctccagtcgttcgccgacggccagctcgacaccgccgtcggcgaggccccggcgcccggctacgagcgtctctacgacagcctgcgagcgctgcagcggcaactgcgcgaacaacgcgccgaactccagcaggtggaaagcctggaggcggggctggcggagatgagccgccagcacgaagccggctggatcgaccagacgattcccgccgaacgcctggaaggtcgcgcggcgcgcatcgccaagggcgtcaacgaactggtggccgcgcacatcgcggtgaagatgaaggtggtcagcgtggtcaccgcctacggccagggcaacttcgagccgctgatggaccgcctgccgggcaagaaggcgcagatcaccgaagccatcgacggcgttcgcgaacgcctgcgcggggccgccgaggcgacctcggcgcaactggccacggcggcctacaacgcgcggatcaagagcgcgctggacaacgtctcggccaacgtgatgatcgccgacaacgacctcaacatcatctacatgaaccgcaccgtcagcgagatgctcggtcgcgccgaagcggatatccgcaagcagttgccgaacttcgacgccggccgcctgatgggcgccaacatcgacgtgttccacaagaatccggcgcaccagcggcacctgctggccaacctcaccggcgtgcacaaggccgagctcaacctcggcggccggcgcttctccctcgatgtggtgccagtgttcaacgacgccaacgaacgcctcggctccgccgtgcaatggaccgaccgcaccgaggaacaccgcgccgagcaggaagtctcgcaactggtgcaggcggcggccgccggcgacttcagcaagcgcgtcgaggaggccggcaaggaaggcttcttcctcaggctggcgaaggacctgaacagcctggtggataccgccgaccgcggcttgcgcgacgtctcgcggatgctcggggcgctggcccagggcgacctcacccagcgcatcgaggccgactaccagggcaccttcggccagctcaaggatttctccaacgacaccgcacaaagcctgtcgcggatgctcgggcagattcgcgaggccgccgacaccatcaacaccgccgccagcgagatcgccagcggcaacgccgaactgtcggcgcgcaccgagcagcaggcgtcgagcctggaggaaaccgcctcgagcatggaagaactgaccagcacggtgaagctcaacgccgagaatgcccgccaggccaactcgctggcggccaatgcctcggaagtggcgacccagggcggcaccgtggtgcagaaggtggtcagcaccatgtcctcgatcaacgagtcggcgcgcaagatcgccgacatcatcggggtgatcgacggcatcgccttccagaccaacatcctcgccctcaacgccgcggtcgaggcagcccgcgccggcgagcagggccgcggcttcgcggtggtcgccggggaagtgcgcaccctcgcccagcgttccgccgccgcggccaaggagatcaagacgctgatctccgactcggtggacaaggtggagaacggcaacaccctggtggcccaggccggacagaccatgagcgacatcgtggtggcgatccgccgggtcaccgacatcatgtcggagatcgccgccgcctccgccgagcagagcaccggcatcgaagaggtgaacagcgcggtctcgcagatggacgacatgacccagcagaacgccgcgctggtggaggaagccgcggccgcggccgaggccatgcaggagcaggcgggcctgctcaaccagtcggtggcggtgttcaggctggacactccgccgagcgtggtccagctcgccagcgcgcggccgtccgcgccacgccccagcgcgccggcgccgctggcccgcagcggcatggcgcgggccagcaaggcgcgcaaggaagacggctgggaagagttctgagaccacgccgcgcctccgccaggcggagggcggcaagcccttag

SEQ ID NO: 12006 - DNA, 1311 bp, Pseudomonas aeruginosa
ccgcctctcgcggcgcctgcgcctgctgcggctcgggagcttcgccgaatatttcacccacctcgaccgcgagccgggcgagcagcagttgttcgtcaacgcgctgaccaccaacctcaccgcattcttccgcgaacgccaccacttccccctgctcgccgacctcgcccgccgccagttgcagcggcatcgcccgctgcgcatctggtcggcggcggcgagtaccggcgaggaaccctattcgatcgccatcaccctggtggaggcgctgggcagcttcgatccgccggtgaagatcgtcgcctcggacatcgataccggggtgctcgactgcgcccgccagggcgtctatccgctggagcgtctggagcagatgccggcgccgctgaagaaacgcttcttcctccgcggcaccgggcccaacgccggcaaggcgcgggtggtggaggaactgcggcaactggtggagttccgccagatcaacctgctggaggcagactggtcgatcgccggggaactcgacgcgatcttctgccgcaacgtgatgatctacttcgacaagccgacccagacccgcctgctggaacgcatggtggccctgctgcggccggagggcctgttcttcgccgggcattcggagaacttcgtccacgccagccacctggtgcgctccgtcggccagaccgtctacagcccggcctgatcgcgatgaatctccaggcccgggaaggcgcgccgctgaaccgctactacgatccgtacttcgcctgcgatgcggtgaagcttttgcccggcgaatacttcgccagcggcgaagacctggtgatcgtcaccgtgctcggctcctgcgtctcggtgtgcctgcgcgacccgctcaacggcatcgccgggatgaaccacttcatgctccccgagcgcggcctcggcggcgacccggcctcgccgtcggcgcgctacggcagccacgccatggaactgctgatcaaccgcatgctggccctcggcgccagccgcgagcgcctgcaggccaaggtcttcggcggcggctcggtactgcgccagatcagcgccgccatcggccagcgcaacgtcgagttcaccctcgactacctggccaccgagcgtatcccgctgctcgccagcgacgtgctggaggccttcccgcgcaagatctacttcttcccgcgcaatggccgggtcctggtgaagtccctggtggagctgaagaacgacaccgtgctgcagcgtgaacgcgactaccgccgccgtatcgaccgcaacgcggacggcggccccatcgacctgttctga

SEQ ID NO: 12007 - DNA, 1185 bp, Pseudomonas aeruginosa
ctctccgggagagcccgccatgcccatcagtgtcctggtcgtcgacgattccgccctgatccgcagcctgctcaaggagatcatccaggccgacccggagctgcgcctggtcggctgcgcgccggacgccttcgtcgcccgcgacctgatcaagcagcacgcgccggacgtgatcagcctcgacgtggaaatgccgcgaatggacggcctgaccttcctcgacaagctgatgaaggcgcggccgaccccggtgctgatgatctcctcgctcaccgagcgcggttccgaagccaccctgcgcgcgctggaactgggcgcggtggacttcatcgccaagccccggctgggcatcgccgaaggcatgcaggcctatgccgaggaaatccgcgccaagctcaagaccgtcgcccgcgcccgcctgcgccgccgtgcggcggacgcgccggcgccgccggaaagcgcggcgccgctgctcagcaccgagaagatcatcgccctcggcgcctccaccggcggcaccgaggcgctcaaggaagtgctgctcggcctgccggcgcacagtcccggggtggtcatcacccagcacatgcctcccggcttcacccgcagcttcgccgagcgcctggatcgcctgacccggctcagcgtcagcgaagcgcgcgacggcgaccgcatactgcccggccacgccctggtcgcgccgggcgaccaccacatggaggtgcagcgctccggcgccaactacgtggtgcgtttgaaccgccaggcgcaggtcaacggccaccgcccggcagtggacgtgatgttcgagtcgctggctcgctgcgccgggcgcaacctgctcgccggcctgctcaccggcatgggcaaggacggcgcgcgcgggctcctggcgatccgccaggccggcggctacaccctggcccaggacgaggctacctgcgtggtctacggcatgccccgcgaagcggtggaactgggcgccgcggaagacgtgctgccgctcgaacggatcgccgccgcgctgctccagcaagccgcccggcgcggcagcggcaaccgcctctgagcgggatcctggccggcccgctgcgctttttcgccgccccccgcaacctcccccgccgagaccccgccgacgacaggcccgaaccacgggcctttgcctgctcgccatcattgtga

SEQ ID NO: 12008 - DNA, 594 bp, Pseudomonas aeruginosa
tcgcctacagctccgccgccggcggcgccagcgaacgccaccgggtgttcgacctgctcgaccagccggaacagcgcgacgccctgcgcgaggccatgcgcctggcccgcgccaaggccggctcggtgcactgcctgtgggccggcctcgacggccgccagcaactcttcgccgtggcctacattccccaactgcgctggtacgtgctcaccgccgtcgacctgcacgccgcccaggtcctcgacaaccgctggctttggccgctggcgggcacgttcctgctgttgctggtggccctgctgctgggcttcgcctatgccgtcgagcgcctgctgttgcgccccctgcgcagcctcaagcgctcggccaaggcgatcgccgccgggcgctacgacacgccgctgccgctggcgcgccaggacgagatcggctcgctgtcgaaggccttcgccagcatggccgaccaggtccgccggcacaccgccgagctggaagacaaggtccaggagcgcacccaggcgctggaggaagccaaccgcgagatggccgccgcgcagaagaagatcggcgacagcctcgactatgccagcctga

SEQ ID NO: 12009 - DNA, 918 bp, Pseudomonas aeruginosa
aagctacactcgccaacgcatcctgctctgcttcaacggaccgatctcgcgcagcctgatcgaggagataggccacgcgctgcgcaactacctgcacgccgaacaggccaagccgagcgaagcgatggacgtcttcgcggtgtacatcgagatgacccagaacatccgccactacgccaatctcaagggctacggcgaacacgaggcggcggccacggtagccatcgcccgcaacgaggacggccactacgtggtgtccgccggcaacctggtggaacgcgacgacggccagagcctggtgcgcagcatccaggccatcgccaacctcgacaaggccgccctcaaggccgcctacaaggagcagctacgccgcccgcgcgacagcggctgcgccagcggagccggtctcggcctgctggacatcgcccgcaagtccagcgaaccactggccgcatcgctgaaggaacagcccgacgggcgcgccttcttcagcctgcgcgccgtgatctgaccccgtgttttaggaagaacaccatcatgagtgacctgcacatacccggcacccagtccacgcccgccatccagggcgactggcaggccggacgcctgtccatgcaaggcgattcctacccggaaaactcctatgaactgttcggccaggtgatcgactgggtcgagcgcttcctcgccgccgggcagcggccgctggaactggacctgcgcctgctgtacctgaacaccagttcgatcaaggccatgatggacatcctcgacctgctcgaagaggcccaccagggcggtcgcccggtcagcctgcgctggcactacgaccggcgcaacgaacgggtcgccgagctggccgaggagttccgcgaggactgcagcttccccttcgccatccaggcccacgacgagtag

SEQ ID NO: 12010 - DNA, 834 bp, Pseudomonas aeruginosa
ccgacgatgagccgcgaacgcgaactggacgcctggatcgacggcctgctggccgatccgcagttccacgggcatccgctgcaccaggcgctggcccgcctgcgccagcaatcgctggagcaactggtgcggctggagcgcatcgcccggatctccgacggtttccagtcgatggcgcgggagcagaacctgtcgctgtccgagcgctaccacaagcagctgcggcgcctggaaaaggtggcgcggatctccgaccgctaccagcagatgatgcgcgacctcaacctggcgctgaaggaagcctcgatccgcgacccactgaccggcctgcccaaccgacgcatgctgctggagcgcctcagggaggagaacgaacgctcccagcgccacggccagagctacgtgctggcaatgctcgatgtggacttcttcaagcaggtcaacgatacctggggccacgacagcggtgaccgggtgctggtggaaatcgcccgggccatggagtccgagctacgcgaatacgacctctgcggacgctggggcggcgaggaattcctcctgctgctgccgcagacccgcctgcaggacgccggcccggtactcgagcgggtgcgcgacagcgtacggaccctggcggtacgcgtcggcaccgaggcgctgagcgtcaccgccagcgtcggcgttaccgaacaccgcatcggcgaaacctattcgcagaccgtcaatcgcgccgacgccgcactgctcgacgccaagcgcagcggccgcgacaaatgcgtgttcgccgcgctcccgccgcttcctgccccttcccgcccggctccagcgcgctga

SEQ ID NO: 12011 - DNA, 1218 bp, Pseudomonas aeruginosa
ccggcgtccagccgtacagcggcatccgctcgtggccggcggcgcgcacccgctcgcgatcgagcaggcccggcgcgcgcccgctggcgtccaggccgtgcaggcgtccgcgggtccagaccagggcgaaggcatcgccgccaatcccgcagccggtcggctcgaccaccgtcagcgcggcggcggtggcgatcgccgcgtcgatggcattgccgccacggcgcaatatctccagcccgacctgcgccgcctgcggctgcgaggtggcgaccatgccgcggcgggcatggaccggcgaacgttgcgaggcgtagggaagcgcgtgggcggagaagtcgagcatcggcgtgggctccgggaaacttgaggcggcaggttagccctgccagactctgccgactagcgacacgacgccaagtcatgacgatgaacggacagcctgcggaactgcaccgcccgattcccaccctcgcccgcctgccacggccggtctacgcgcgcgccgaaagcctgcgcgccggctcctggacctcgcgccaccggcacgcctgggtacagctttcctacgccatcagcggcgtgctcggcgtacataccgccgagggcagcttcttcgccccgccgcagcgggcgatctggattccggcgcagctggaacacgaggtggtcacctccacccgcgccgagatgcgcagcctgtacatccgtggcgacgcctgcgcctgggcgccgacgcgctgccgggtgctggaggtgacgccgctggcgcgcgagctgatcaagagtttctgcgagttgccggtggactacccggagggcgacagcgccgaatcgcggctggtgcaggtgctgctggaccagttgcggctgctgccggaggtcgccttctccctgccgatgccgcgcgagccgcgcctgctgcggctgtgccaggcactgatcgacgaaccgacccagagcctgaccatgggcgactgggcgcagcgcctgggcacctcggaaaagaccctgtcgcgcctgttccagcgcgagaccgggatgaactaccggctctggcgccaacgccagcgcctgctcgcctcgctcaacgcgctggaggccggcgacagcgtcaccggcgccgccctggacagcggctacgactcgacctcggcctacatcgccgccttcaagggactcttcggcttcactcccggcgaactgttccgccagcgctga

SEQ ID NO: 12012 - DNA, 792 bp, Pseudomonas aeruginosa
cagctcgccgttgcgcagcgccgcggccgccacgtagctgggcagcagggcgatgccgaggtcggccttggccgcctgggccatgacctcggcgacattgaccatgaaggtgttctgcgggctgacggtgcgctcgccctgctcgtcggcgaagatccagccctccgggtaggccgggtcctgcaggcgcaggcagacgtggcgctccaggtcgtccaccgagcgtggcacgccgcgctgctgcaggtagccgggactggcgcagagcacgctgtggatgctgcccaggcgctgggcgacgaactccgagtcgggcaactggcgctcgccggtgatcagcacgtcctggccttcctcgagcatgtccgggttgcgctgggacagggtcagctcgatcaccacgtcggggaacagtgcgccgtagcgggcgatcatcggcaccaggtgatgctggcccatgcccatcagcgactgcacgcgcaagcggccgcaggggcggatgtgcgcgccggcggcttcggcctcggcgacctcgatgtcctcgaggatcccgcggcaccgttccaggtaacgctcgccggcctcggtcagggccaggcgccgggtggtgcggtgcagcaggcgcgtctgcaggtgcgcctccaggtcggagatcagccgcgatacctgcgcggtggacaggtccagggcctgggcggcggaagtgaagctgccgctgtccaccaccctggcgaacacgcgcatgccttgcaatgtgtccactattacctcggttgcaaaacagattcgtaa

SEQ ID NO: 12013 - DNA, 3264 bp, Pseudomonas aeruginosa
attggtcggattttccctgacgccgggctgcctatactggccgccgtcgccgtagcaacgccgggcataccctgcccggcgtcggggcggatggcccacccgccgtccgctctccttccccccgcacagactctgctacggcggcgcccccttccccttacgccgcgctcagcgtcccggttccggaatccggtaccaggcgacgtacagcgccggcaggaagatcagcgtgagcagcgtggcggcgacgatgccgccgatcatcgcataggccatcggcccccagaacacttcgcgggcgatggggatcatccccaggctggccgccgccgccgtcagcaggatcggccgggtgcggtggtgggtggcttccagcacggcttcccagggcgtcttgccgtctttctcgaaggcatcgatctgggtcaccaggatcaccgagttgcggatgatgatgccgatcagcgcgagaatcccgaggatcgccacgaagcccatcggcgtgccggtcggcagcaacgccgcgaccaccccgatcagccccagcggcgcgacgctggccaccaggaacagcttctgcacgctctgcaactggatcatcaggaaggtcgccatgaggaacagcatcagcggcaccaccttggcgatcgggccctcggccttgccgctctcctccaccgtgccgcccacttcgatccggtagttcgccggcaggccgtcggcgaagcgcttgacctccggcgccagccgggcgaccaggtcggtgggctggatctcgccgcgcagcgacgccttcaccgtgatcgtcggcttgcggtcgcggcgccacaccagcggctgctccagctcgtagctgaccttggcgaacgccttgagcgggatcgaggtgccgctgggcgtgacgatctgcaggctctccagggtctccagcgagccgcgctcgctatcctcggcgcggccgatgacgttcaccaggtagatgtcgtcgcgcacctgggtcaccgcgctgccggtcaccacgctgttcatgatctgcgccacgtcctcggaggaaagcccgagctggcgcgccttgtcctgggcgatgtcgatcttgagcatcttcccgggctcgttccagtcgtagacgatatcgccgatgttcgggttgccgtcgagcacgccggccaggcccatggcgtactcgcggaccttgtcgatctgcggtccgctgacccggtactggatcggccgtcccaccggcggccccatctccagcggctgcacgtaggtgctgatgccgacgtagtccttgcgcaagcgatcgcgcaggcgcgcggcgacgcgctcgcgggcctccaggtccttggtgacgatcaccagctggccatagaagttgttctgcaactgctggtccagcggcaggtagaagcggatcgcgccttcgccgacgtaggcgctccagtggtcgatgtcctcgtcgtccttcagcgtcgtttccagacggtccatcaccgccctggtctcgtggatgctgctgttttgcggcaggttgaggtcgaccagcagttccggacggtcggaagacgggaagaactggtgctggacgaacttcatcaggaacagcgacacgccgaacagcagcgcggtgaggaagatggtcgtccagcgccggcgcatcgccaggtgcagcaggctgtcgaaacgctcggcgatgcggcccttcttctgctccgacttgtgcttgagagtcttcggcaggatgtgcacggcgatcaccggggcgaacagcaccgcgacgatccacgacagcagcagcgccacggcgatcactgcgaacagggtgaaggtgtactcgccggcggagctggcgttgagcccgatgggcacgaagccggccaccgtcaccagggtcccggtgagcatcgggaaggccgtcgaggtgtaggcgtaggtcgccgagtcgtgcagcgagtcgcccagttcgaggcgcgtgatcatcatctccacggtgatcatggcatcgtccaccagcaggccgagggcgatgatcagcgcgccgagggaaacccgctgcatggtgatgtcggtgtattccatgaacacgaagaccatcgccagcaccagcgggatcgagcaggccaccaccagcccggcgcgcaggccgaggctgacgaagctgacgatgaggacgatcaccaccgcctcgaacagcgcccgggtgaaaccgccgaccgccttcttcaccacctgggcctggttcgacacctggtgcacgccgacaccaaccggcagttcgccggtgatctcctgcatgcgcgcattgagcgcctcgccgaactcgaggatattgccgccctccttcatcgccaccgccaggccgatggccggctcgcccttgtagcggaacagcgaggtcggcgggtcgacgaaatcgcggctgatgctggccaggtcggacagccggtagaaacgatcgttgacccgcaggttgaccgcctgcaggtccttttccgaacggaagttgccggaggtgcgcaccgagatgcgctcggggccggcctcgaccacgccggacggggtcaccgcgttctgcgcctgcaggctctgcacgacctggcgctggtcgagaccgagggcggccagcttgcgggtagagaagttgaggtagatgacctcgttctgcgcaccgatcatctgcaccttgcccaggtctttcaccgagcggatgtccaggcgcactttctccacgtagtcgcgcagctggcggaagtccaggccgtcggcggtgaaggcgtagacgctgccgaacacgtcgccgaactcgtcgttgaaacccggtccctggatgccctgggggaattcgccctggatgtcggatatcttcttgcgcacctggtaccagatatccgggatgtcgccggccttggtggtgtccttgaggtagacgaagaccgtcgattcgccgggtcgcgtgtagctcttcacgtaatccagcgagtccaggtcctcgagcttcttctcgatgcggtcggtgacctgctccagggtgtcgtccaccgtggcgcccggccagcgggtctggatgaccatggtcttgatggcgaacgagggatcctcctcgcgccccaggttgaggtaggagaacacgcccatcaccagcgataccgccatcaggtaccagaccagggactggtggcgcagggcccagtccgacaggttgaaaccgcccttcatcgcgcatcctcgtcgagtttgatcttctggccgggcttgaggctgtag

SEQ ID NO: 12014 - DNA, 1377 bp, Pseudomonas aeruginosa
tcgaggtggccgaggcgaactcggccatcttcaccgtctgcgccagcacacggacgtgttcctcggcgggcggctcggcgccgcaaccgacaagcaggccggcgcacaggatggcgggcagcgccatccgcgaccagcgacctttggaatgaaaagcgcctctggcgtctgacatgccttccccttcgcgatccatacagataccggccgatccggccggaaactcccagaattggcagggattctagccgcgtccccaaggattgcgactatcagatggaagcgggggttccttttccaaacttgtggaggggatcgcctccggcgtcaggtgaacaggcgcgcgctcagctcgcggctggcctccagcagcaacggcaggaaacggctttccagttcggcgcgggagacccgcccggcatgggtgccgacgttcagcgcggcgagcacatggccggcggagtcgcgtaccggcaccgccagcgagcgcaggccgacttccagctcctggtcgacgatgcaccagccctggcgacgaatctccaccaggcacggcagcagggtctcgggggtatacagggtacggctggtcttggcctgcatctccactccgccgaagtaggcgtgcagcgcgtcgtcgtccagcgcggcgaggaggatgcggcccatcgaggtgcaataggcgggcagccggctgccgacgttgaggtccaccgaaatcagccgctggggagtggccgaacgggcgatgtagagcacgtcgtcgccctccagggtggccatcgagcaggcttcgtggagctgttcgctgaggcggtcgaggatcggctgcgcggtgatcgccagcggcgtcgacgacaggtaggcgtggccgagggtgagcaccttcggcaacagcgagtaggtgcgcccgtcggtggtggcgtagccaagctgcatcagcgtgtgcaggcagcgacgcacggcggcgcggggtatctcggtgcggtggctgatctgggcgatggtcaggtgccgcttgcgctcctggaacgcatggatcaccgccaggccacgggccagcgaggtcatgaagttgggatcgccggtgaaggcctcgatgcgcttggccggcgaaaggacggtcggcggcgccagggtggcggggtgttccgggagttcgctcatggacgttcgggctcgggtcacggaaaggctcgccgattatcggacactcgttcgatcatcgcaattgaccggagcgcctccgactgtagtactgtcggggctacccatcgccctccgggagtaatgtcaggtacccatcggcgggttctgggtacgcccttgccgctccggcaagggcgcccttccttcccgcgcgatcgatgcgcctag

SEQ ID NO: 12015 - DNA, 1119 bp, Pseudomonas aeruginosa
ggaccggcggtctgggaaggggtttcccgcagcagttcgtggctcatggtcggctcctcagacgttctcgaagaaggtcttgcgctgcccgcgcaggacgatgtcgaagcggtaggccaggcaatccatcgggttggccatgctcatgtcgagccggccgatcaggctctgcgccgcctccgggtcggcaagggtgcggatgatcgggcacttggggatcagcgggtcgccctcgaagtacatctgggtgaccagccgcgcggcgatcgccgggccgctgacagacacgtggatgtgcgccgggcgccagtcgttggggccgttgcgccagggatagggcccgggcttgatggtgcggaagtaatagtggccctcgctgtcggtgagggtccggccgacgccgccgaagttcgggtcgagcggcgccaggtagcggtcgttcttgtgccggtagcgcccgccggcgttggcctgccacatctccaccagggtgtgcgggaccggcttgccgtactggtcgaagacccggccgaacatgatgatgcgctcgccctggggcaggccgccgtggtcgaagttgagcagcaggtcgttgtcgtggcggccgagcctgaggtgggagaagtccggcccgctggtttccgagagcgattgcgggatgctcaccagcgcctggctcggcgagcgcggcacggaggtcttgtagtcgggggtcaaggctttggggtgccagtttcggtcacggatgacgaaacgacggctttcggcgtcgtgcatgtcgggctcctgttattcgcgttatcggtcgccaggcttgtggattcaggcatggaaaacgaagtcttgcgcaggaggcgggacggggacagtgaattatccggccccatacataaccatttggttatgctttatcagtgcaactcggcggccacctcgcgcaacaccgcgctgaaccattgcgcccccagcggcaacggcaaggccgcgttgtggcacagcccgaccgaaccgcccggttcgcggatacccaggtccagctcggccagctcgccgttgccgacgtccaggcgcacggcatcgcgcggcgccacccagatcgcctcgctgcgcaacacatag

SEQ ID NO: 12016 - DNA, 4161 bp, Pseudomonas aeruginosa
  unsure (3880): Identity of nucleotide at the above locations are unknown.
cgcaggaaggtcacgcccgcctcggtcagctcggcgccggccttgctccgttcgaacaggcgcgcgccgaggatttcctccagttccttgagggtcttggagatcgccggctgcgacaccgccacggcatccgccgccttggcgaagctgcgctggcgggcgacttcgaggaagcaggcgaggtggcggaacttgatgcggttgtcgaggttcatggggcggccgtggcggcgagtggtgcgggcatggtacccaacgggcgggttgggaacgaggtgtggcgtgcggcgaggtcgtgccaggcggttctccgccttcctttccccaaagggagaaggcactggatggcggaacgactcacgcgccgggcaatcccttccctgggggaagaaggaaccggatggagcatggtcgggcagcatcgcgccgacccttcgcccttcaggggggcctccacgtccaggaggacgccggggaaccccacctggagcgagcgccgactcagaactccaccgtcgtcgacacctggaactgccggggctcgcccatcgccacgtacagtcgattggcactggacgggtagtaggtgcggtcgaacaggttcttcacgttgagctggaacttcacgccgtgtccgccgaagcgggtgtcgtagctggcgaaggcatcggccacggtgtaggagggcaggtcgaaggaattggccgggtcgcccgggcgcttgccgacgtggcgcgcgccgccgcccaggcgcaggcggtcgccgccgaagagctggccgagttcgtagaccgccgacagcgacgcggtgttgcgcgccacgttctgcaggcgcttgccctccagggtcgggtcctcggtgacttccgcggcgagccaggcgtagctgccgatcaggctccagcgttcgctgagctggccggtgaggtccagctccaggccgcgcgagcggacccggccggcggcgcgcacgctgctgttgccggcaccgtcgagttcgttgaccagcacgttcttcttgcgaatgtcgaacagcgccagggtgccgctgagacgccccggcacatccagcttggcgcccagctcccaggaggtcgcctgctccggcaggatcgccgaatcgatggtctcgccggtgctcagcggggcgatggtcgagttcggcttgaacgagcgcgtgtagctgccgtacagcgaaacctcgtcgctcaggcggtagaccaggccgccgcgcggcacccatttctgcccgttgatatcggtgttggcgttgaacggccggccgcgcccggcgagctggtcgtagatctggtagcgcgcgccgccgaccaggatccagcgttcgtccaggtggatcgagtcctggaagtacagcgagtcgctgcgcagcttgtcggtctggtcgctgtcgccggcgaccacccgggtcgacggcaccacctggccatagaccgggtcgaggtagtcgaagcggctggtcttgctgtcgcgcagcaggtcggcgcggaagatcttgcgcttctcgtggtccatgccgaattgcaggtcatgttgcatcccggccagttgcagcgttccgctcaggccgagggtggcgaagctgtcgctgctgaccgcgccgtgggtgccgtccatgcgccgggtcagggtgccgtcggcattcacggccatcacccgggcctggttgtcgtcgtaggtctcgcgactgtagccgtagccgaagtgggccttccaggtgtcgtcgagctgccgttcgagatccaggcgggtcagctcggaacggccctcggtgatgttgaagggctcgtccaggcgccggctgcgcgggatgtccagcgggcggttggtacgcgggtcgatggccgtgccacggtcgaacggcgtggtgaactcgcggtgctcgtagctcaggttgaccgtcgtgtcctcgccgtaccaggccagcgagggcgccaccagcgtctcgcgactcttgccgaagtcgcgccagtaatcctcgtcctcatgatcgaggatcatccggtaggccagtccgctgtcgcccagcgggccggtggagtcgagctggccgccgctgccgttgcgcccgtgggcgtaggccgagccacgcagggtcagggcgttggcttgttgcagttgaggcttcttgctcaccacgttgaccaccccgcccgggtcctggatgccatagagcagggatgctggccccttcagcacctcgacgtggtcggcggtggcggtgaaattgcggccctgcaccgagggcatgccgtcgcgcatgatcgagccgtcgcggttgtcgccgaagccgcgcttcatcaccgcgtcctgggtaccgccgagggtgttggcctgggtgatgccgctgatgttgcccagcgcgtcgtcaaggttgcgcgggcgctggtcctgcagcgcctgtgccgggaccacgctgatcgcctgggggatttccagtaccggcgcatcgccgcggctgatcgaggcgttggccgccggccggtagccctgcgccggggcggcggcggagaccgtcgtggcatcgaggtcgagcgcgccgctggcggggatcggttccagggtcagggtgcgctcgtcgatccgccgcgcgcgcaggccgctgccctgcagcaggcgttgcagcgcctcctccgcgtccagcgaaccgtgcaatgccggagcggtcgcctgcggcggcagctcggcggtgtagagcagcgtctgcccgctggcccggctgaacgcgttgagcgcctgggccagcggcgcggcagcctggctgaagcggtagcgaaccgcctcggcggcctgcacggtggcggcgagacagccgaggctgaggaacagggcggggagagtacgcagggcgaagcgcgggaacggggtcatgggttgctcgtgtcggtcgcttttctaatgcgaatcaatcgcggtcatgagcactacacgaagcggcgccggatttacctcaccccgcagggcaaaaaaattcttcgccgggaaagattcctgcggccaaacggaccggggccaccgtcagcgaatcaccaccaggcgtccgaacaggatctgctggcgatagccgagcaccgcctgcagcgacttcagcgcggcttcgggatcatcgctgcggaagctgccgctgaccagctggcgaccgagcgcgtcgtcgagcaggagaatgcgtccggggtagtagcgagcgagttcgtcgagcacttccgccagcggccgccggtagaagctcagccaaccctggcgccaggccagcgcggcggcggcgtcgatggccacgggccggcccagcttgccgtcggcgaagccgacctgctggccggcgcccagcacttcctcggcggcgcccgcaccggtgccggcgctcaccgcgacccgcccttgcaacacggtgacgcgggtcgccccggcgccgcgacggacctcgaactcggtgcccagtacccgcgcccgaccttcgccggcctcgaccacgaatggcagcgcgtcgcgcttcacccgcaacgcggcggcgccgcgcagcagttcgacccgccgctggccgccgtcgatacgcacgcgcaccgcgctgccggcgtccaggctcaggtaggagccatcggccagcttccattcggcgacctgtcccggcgcggcgacatagtcggcacgccagtcctgcagccagtcgccgggctgccaccagccgcccagccagagcatcgccagcaggcaggcgacgctggccagcgggtaggcccagcgccgcgggttgcgcgacgctcggcgcggccgcaggtaggcttccagggcatcggcctcttcgatggccaggcggctcgccggtatttccgtcaggcgccagagcgcctcggcgcgggcatangcctcggcatgcgccggccgctgcgccagccagtcctcgaaggcccgccgggtcgccgcatccggcgtaccgcgcaggcgcaccagccaggcctgggcggtctgctcgaggacgggctcgtagggcgcggcgtcgctatcgggtcgggtcatggctgggcgctccttgcctgctcgccggccgggccggccaggctcgccttgcaggcgtcgagggcgcgcatcatatgtttttccacggcgctttgggaaagctgcatggcctgggcgatctccgcgtag

SEQ ID NO: 12017 - DNA, 1179 bp, Pseudomonas aeruginosa
gcaggcccgcaaatgataatgcttatcatcaataccgagaagccggcgacgacgaaacgccttgcgggtcgcgcgccgggctacccggcacgccgcccctcacttcaccaggcgcgcatccaggctgttctgcgccaggcgcctggcctgctcctcggtcattcccaggctctgctgcaaggcatggaagttctcggtgacatagccgccgaagtaggccgggtcatcggagttcaccgtcaccttcacgccgcgttcgagcatgtcgaggatggtgtgctggctcatgtcgtcgaacacgcagagcttggtgttggacagcgggcagacggtcagcgggatctgttcgtcgatcagccgccgcatcagccgctcgtcctcgaaggcgcgtacgccgtggtcgatgcgctcgaccttgagcaggtcgagggcttcccatatgtactcgggcggcccctcctcgccggcatgggcgacggtgaggaagccttcgctgcgggcccggtcgaagacccgctggaacttgctcggcggatgccctacttccgagctgtcgaggccgacggcgatgaaggcgtcgcggaacggcagcgcctggtcgagggttttctgcgcctgttcctcgctgaggtggcggaggaagctgaggatcagcccatggcggatgcccagcagcttctcgccgtcctgcagcgcggcgcggatgccggcgagcaccacctcgaagggaatgccgcgatcggtgtgggtctgcgggtcgaagaacggctcgacgtggacgacgttctgcgccttgcacttctgcaggtaggcccaggtcaggtcgtagaagtcctgctcggtgcgcagcacgtcggcgccggcgtagtaaaggtcgaggaattcctgcaggttgttgaaggcgtaggccttgcgcagggtctcgacgtcgttccagggcagggcgatgcggttgcgctcggcgagggcgaacagcagctccggctccagggtaccttccaggtgcaggtgcagttcggccttgggcaaggcgttgagccattcgtacatggggtgggttctcgatcaggctggtcttggccggcaagtttaacctgtcccgggagtcaggcccgcggcaaacccacgagccgctcccgcgcgcgacgggcggctcaggccgtttcgccgcgccgatag

SEQ ID NO: 12018 - DNA, 2526 bp, Pseudomonas aeruginosa
tcgaggacgacgagaaggtctacgccgaggcggccgccgcgccgggccacgcgaacctggatatcccggcctgaggcgggcggtcgcgccaacgaaaacgcccggggcgctttcgcgctccgggcgtccctggttcgacggtcgctggccgggtcactccggcgcggaggtccggatcaggtggtcgaaggcgctcagcgaagccttggcgccctcgcccacggcgatcacgatctgcttgtacggcaccgtggtcacgtcgccggcggcgaagatgccgggcagcgaggtctcgccacgggcgtcgacgatgatctcgccacgcggcgacagctcgacgctgcccttgagccactcggtgttgggcagcaggccgatctgcacgaagatgccttccagctcgatcgacttgaactcctcggagttgcggtccttgtacaccaggccggtgaccttctggccgtcgcccttcacttcgctggtcagggcactggtgatcacctcgacgttcggcaggctgtagagcttgcgttgcagcacggcgtcggcgcgcaacttgctgtcgaattccagcagggtcacgtgggcgacgatgccggccaggtcgatggccgcctcgacgccagagttgccgccgccgatcaccgccacgcgcttgcccttgaacagcgggccgtcgcagtgcgggcagaagcacacacccttggccttgtactcctgctcgccgggcacgcccatttcgcgccagcgagcgccggtggcgaggatcagggtcttggccttgaggctgccgccgctctcgaactgcacctcgtgcaactcgccggtgttcttcgccggaaccagcttgctggcgcgctgcaggttcatgatgtcgacctcgtagtgacgcacgtgctcttcaagcgcccgcgccagcttcggcccttcggtctcctgcaccgagatgaagttctcgatggccatggtgtccagcacctggccgccgaagcgctcggcggcgacgccggtgcgaatgcccttgcgcgcggcgtagatcgccgccgcggcgccggccgggccaccgccgaccaccagcacgtcgaaggcgtcgcgggcggtcagcttctcggcgtcgcgggcggcggcgccggtgtcgatcttggcgaggatctcttccacgcccatgcggccctggccgaagacttcgccgttgaggtagatgctcggcaccgacatgatctggcgcgcctcgacctcatcctggaacagcgcgccgtcgatggcgacgtgacggatgttcgggttgagcacggccatcaggttcagcgcctggaccacgtccgggcagttctggcaggacagcgagaagtaggtttcgaactcgaaggtgccctcgatgcccttgacctgctcgatcacgtccgcgtcgagcttggaggggtggccgcctacctgcagcagggccagcaccagcgaggtgaattcgtggcccatggggataccggcgaagcgcaggccgatgtccgcaccggggcggttcagcgagaacgacggtttgcgcgcatcgctgccgtcggtcttcagggtgatcttgtcggtcaggccgacgatgtcttgcagcaggcccagcaactcgcgggatttgtcgctgtcatcgagggacgcgacgatctcgaacggctggctgaccttttccaggtaggccttcaactgggttttaagattggcgtccaacatggttcagctcctcgaaattcgggcaaacgtatccccggcggatgggacatccgccctgcacggcgcgttggctgggtgaagggcggacgatccgcgagggatcgtccgccggagaggctggcggcgaatgccgccggcgcggtcttagatcttgccgaccaggtccagggacggagcgagggtcttctcgccttccttccacttggccgggcagacttcgcccgggtgggcggcggtgtactgggcggccttcagcttgcgcacggtctcgccgacgtcacgggcgatctcgttggagtggatctcgacggtcttgatcacgccttccgggttgatcacgaaggtaccgcgcagggccaggccttcttccgggatgtgcacgccgaaggcgttggtcagctggtgggtcgggtcgccgatcagcgggaactgggccttgccgactgccggggaggtttcgtgccagaccttgtgcgagaagtgggtgtcggtggtcacgatgtagacctcggcaccggctttctggaactcgccgtagttgttggcggcgtcttcgatctcggtcgggcagttgaaggtgaaggcagccggcatgaagatcaggaccgaccacttgcccttcagggattgctcggtcacctcgatgaacttgccgttgtggaaagcgttgaccttgaacggttggacttgagtgttgatcagggacatcagtcgttcctctctcagttgaatggggtgtttcaaatcgactgggagaatcttaacggggttcggcaaaaatgccccattgatttaggccatcagtga

SEQ ID NO: 12019 - DNA, 1458 bp, Pseudomonas aeruginosa
accagcgcgtcctgggcgaacagcatgcgcccgagcagcggcaactcgcccagcaccggcagcgccagcggggcgaacccttgcagcggcttgccgacccaggcggcgccgacgaacgacgacaggccgacgccgaagatggtcagcgccagcccgcaggccacctggttggcgttcaggtacagggcgaccccggcgaacagcgccgccagcagcatgccggcgagcaccgcgaggagcacgccgagccacaggctgccgctggagaaggcgaccatgaagccgatcaccgcgccgaacagcatcatcccctcctggcccaggttgagcaccccgcttctctcgcagaccagttcgcccagggccaccagcagcagcggagtaccggtgcggaccatggcgaacagcaggttgtcgagcagatcgatatccatcgtggttcctcggcggttcggctcaggccagggcgtcgcgcagcgccgggcgcttgcgccagcgtccgtgcaaacgtgggcggtagaggatcagcacgtcgcaggcgaggaggaagaacagcatcatcccctggaacagcccggacagcgccaatggcaggttgaggctcatctgcgcggcctcgccgccgaggtagagcaacgccatcagcaggctggcgcagaggatgccgaacggattgagacggccaaggaaggccacggtgatcgccgcatagccgtagcccggcgagacctgcggcaccagttggccgatcggcccggcgacctcgcagacgccggccaggcctgccagcgcgccggagaacagcagcacgaaccagaccaggcgcttctcgcggaaaccgacgaaaccggcggcgcggcggtcgaggccgagcacgcggacctggaaaccgaggaagttgcgctgcgccagcacccagaccgccgccagcgccagcaggccgaacaatgcgccaaggtgcacccggctgtcctcgaacagcgccggcaggcggctggcctcgccgaacagcgccgactgcgggaagttgaagccatccgggtccttcaacggcccgtgcacgccgtacagcagcaggttcagcgcgatgtagttgagcatgatggtggtcaggatctcgttggcgttgaagcgcgttcgcagccaggcggcgaacccggcccagagcgccccggcagcggtgccggcgagcagcacccaggccagcgcccagcggctctgccagtcgagcaactggatcgccaccgcgctgccggccagggcgccgaccagcaactggccctccgcgccgatgttccacacgcgcgcctggtaggccagtgccaggccgagggcacagagcaggatcggcatggccttgaccagcagctcgccgagcccatagaggtcgctgagcggctgtaccagcacggtatgcagggtctgccagggatcgtggccgagacaggcgaacagtag

SEQ ID NO: 12020 - DNA, 549 bp, Pseudomonas aeruginosa
ccggccatccagccgccgacctgctgcggcgaagcgctcgcggtggcgaccgccgggcacagccgacccgaacacagcgcggcgatgcggtcgctgagcaggaacagctcgtcgaggtcctcggagaccaccaggatcgccgtaccggcatcgcgcaaggcgatcagcgcgcggtggatcagcgccgccgcgccgacgtccacgccccaggtgggatgcgccgccaccagcaggcgcggggcctggaggatctcgcggccgaggatgaacttctgcaggttgccgccggaaaggatgcgtgccggcgccccggcacccggggccttcacggcgaaacggcggatgatctcctcggccagcgccagcaccttgcgccgccggaccaacccgcgcttcaccagtccctgctggaaggcggtgagcagcgcattgtccgccaggctcatctccggccaccgcgccgtgccccagccgctcggcgggcacgaaggcctggccggcgcggcgccgcgcatccggcgccaggtgcgcgccggcgcaggcgcctag

SEQ ID NO: 12021 - DNA, 627 bp, Pseudomonas aeruginosa
gcggatgcgctcggcctgggcgcgcggcaggcgcacttcgccgctgagcagagcgagcaactcgtcctggccgttgccggcgaccccggcgataccgaggatctcgccgctgcgcacctccagatcgaggccggcgaaggacacgccgaaggggtccgggttgcgccagtgcaggtcgcgcacctggaggaaaggcgcgccgccggtaaccttcggatattccgccgccaggccctcggcgtcgcccaccatcagccgcgccagctcgagatcggaacattgcgccggcacgcactgtccggccacccgtccgccgcgcagcaccgtggcgcgctggcagagcgcacggacctcggccagcttgtggctgatgaagaggacactgcagccctcttccgcaagacggcgcagggtgacgaagagatcctcggcctcgcgtggggtcagcaccgaagtcggctcgtcgaggatcagcaggcggatgtcctgcatcaggcagcgcacgatctccacccgctggcgctcgccgatggacagcccatggaccagccggcgaggctccagcggcatgccgtagcgctgcgacacctcgcgaatacgcgcctccaaccggcggggcctgcccgc

SEQ ID NO: 12022 - DNA, 501 bp, Pseudomonas aeruginosa
aaaatattcctgaaaggctggtgttttcgccgttggaatcggcggagaacgctgcgcgggcaacccgcgaaaacgaaaaaccccggcctgggccggggttctggtggacccagcggggaatcactccaccgccttgaccatgtcttcgatgactttcttggcgtcgccgaacaccatcatagtcttgtccaggtacaacagctcgttgtccaggccggcgtatccgctggccatggatcgcttgttgacgatcacggtcttggccttgtaggcctcgaggatcggcatgccggcgatgggcgacttcggatcgttcttcgccgccgggttgaccacgtcgttggcaccgagcaccaggaccacgtcggtctggccgaactcggagttgatgtcctccatctcgaacacctgcttgtagggcacttcggcctcggccagcagccacgttcatgtgccccggcatgcgcccggcgaccgggtggatggcgaacttcacggtga

SEQ ID NO: 12023 - DNA, 534 bp, Pseudomonas aeruginosa
ccaggttcatgctcatcagtggccccccgccttcggcgctttcttcttgaacatttccagcatgcgccgggtgaccaggaagccaccgaacacattgaccgcggccagggccacggcgagggtgcccatggccttgcccagcggggtcacggtcagggcggcggcgagcatggcgccgacgatgacgatcgcggaaatcgcgttggtcaccgccatcagcggggtgtgcaaggcaggggtgacgttccataccacgtggtagccgacgtacacggccagcacgaagatgatcaggttgtagatcccgtcagaaatgatatccatcgttttcaccggtcttcagggcgcaggcgcgaggcgtgcgcatttatcgttatcgaagcttcccgacgcagcggctcagccgttcttgcgcaccgcctggccgtcgcggcacatcaggcaggcggcgacgatgtcgtcctcgaggttcacgctgaagccttcggcgttcagggtgagcttgaggaaatcgaggatgttgcgcgcgtatag

SEQ ID NO: 12024 - DNA, 1014 bp, Pseudomonas aeruginosa
cgccgaggcgtccgccggtaccagcgcggccaggttgctgtggccgacgatggtcacgccgtgccggaccacgacctggtcggcctcggtcagcgggcagttgccgccctgggcggcggccaggtcgatgaccaccgagcccggcttcatctccgccacggtcgcctcgtgcagcagcgtcggcgccttgcggccggggatcagcgcggtggtgatgacgatgtccgactgcttggcgcgctcgtgcacggccttggcctggcgctccatccacgaggccggcatcggccgcgcgtagccgccgacgccttcggcgcactcgcgctcttcgtcggtctcgtagggcacgtcgacgaacttggcgccgagcgactcgatctgctccttcaccgccggacgcacgtcggaagcctcgatcaccgcgcccaggcgcttggccgtggcgatcgcctgcaggccggcgacgccggcgccgaggatcagcacgcgggcggccttcacggtgccggcggcggtcatcagcatcggcatgaagcgcgggtagtggttggcggcgagcatcaccgccttgtagccggcgatgttggcctgcgaggagagcacgtccaggctctgcgcccgcgaggtacgcggcgcggcctcgagggcgaaggcggtgatgccgcgctcggccatgcgggcgatgttctcgttgtcgaaggggttgagcatgccgaccagcacggcgccgcttttcatctgggccagctcggcggcgctgggcgcgaccaccttcagcaccaggtcggcgccgaaggcctcggcggcgctgccgatcgtcgcgccggcggcttcataggcactgtccggctggctggcgttgacgccggcgccgctctggacgatcacctggtggccttggccgatcagcttcttgacggtttccggggtggcggaaacccgcgtctcaccggcatgggtctcgagggggacaccgatctgcactcacgaatctcctgcgtgattgtcgagtag

SEQ ID NO: 12025 - DNA, 2991 bp, Pseudomonas aeruginosa
gcctcgacgaaggtcacgtcggtatgccaggagttggcccggcggccttcggcgccatccagctcgaggaggaagcgggtgccttcgcgggacggcacggtggggtgggcgaccggttcgccgagcaagtgggcgaaggcctcctgggtctggtcgtcgagatggctctggtcccggaagaagatcaccttgtggcgtaccagggcggcctggatcgcctcgacggtggcggcgtccagttcgccggacagggtcacgccgcgaatctccgcgccgatccgtccggcgaccggccggacgtcgagccgtaccggcgtggcgagggcttgtgctgcattgctcatgtcatgttcctcatgcgtggggtactgcgtgggtgaaggctcagaagtcgtagcgcagcgatacgccgagcgtgcgcggctgccccaccgatgcggtgtaggagccgttgatgctggcgaaggcgctcaggtagtagtccttgtcgaaggcgttcttcagccataccgaggtgtccagttggccgtcgccgagatcgctgcgcagaccggcggcgaggttcaccagggcgtagccgtcgatcttcgaaaggtcggagttgtccagcgtgccctcggcggcggagcggtaggcgtagctggcgctgacgtagggttggaagcggtcgtcgaggcgccactggtattcgccattgagattggcgatccatttcgaggcgccgaccacgcgctgcccggtgaggtcgcaactgctcggcgcgccgggccgggtgctgacttccgcagggcacggggcatccttgaacgacaggtaggtgacgtcgttataggagccgttgaagttcagggtcaggccgcgcaacggcagcgcggtggcctcgaactccagaccacgcgagcgcacgctgccggcgttggccagcacctgcaccaactgggtcaagcccggcgcctggtacagggtggtggcctggtacccgtggatgccggtccagaacaggttggcgttgagcaacaggcgccggtcgaagagcgtgctcttcaggcccagctcggcgtcgttggcgcgctccggtccgaccagcagcgaatcggcgccggcgctcggtgcgctgcccaccgccaggttgaccccgccggacttctcgccgtgggacaggctggcgtagccgagcaggtcgtcgctgaactggtagctgaggctgagcaacgccgaaggggcgaagttgtactggctgagatcgccggaatcgtaggcgccgagctggccgttgcgcaccgccgcgccgaccccgccgaccgccgcgccgcccagcggagcgaagcgctcgaccttggcgttcttctcctcgtaggtaccgcgcaggccggcggtgaagtccaggcgttcggtgaggtgccaggtgccctgggcgaacagcgcgaagctgtcggtctcgatcttgccgttggccttcgagtaggtgtcgttcagcgcgccgagattggcgccgagcaggtacaggtcggccaacggtccgtaggaggtgaaggtcttgttgccgaggttctgcctgaacgcgtaggcgcccaccacgtattcgaaggcaccgccggtgggcgaggccaggcggatctcctgggagaactgccggtcgtgcacttccaccccggtgtcgttgatcgccgagacgttcagttgctcgtcgttggccggggtgaagtgccagtagcggtaggcgctgatggaggtcaggcggtagccgccggcgaggttccagttggcctccagcgagctgccgccctggtgcacgctgacgtgctggcggccgttgatgttgaccttcctgcgctgcggatcgcgcaacggcgaagcgccgaccagcgcggcgcgctgccagaaacgctcggcggcgccgtagaccaccatgctgccgttgctcgaatcctcctcgttgtagtcggcgatccagcgcaggctgaagtcctcgttcggctcgaacagcaattgcccgcgcgcgccctggcgctcgccgccgttgagatagttgtcgtcgtggatgttcttgatgtagccgtcgtcgcgggtgcgataggccgagaggcgtccggcgagggtttcgccgagcggcccggaaaccgtgccgcggccctggaagtagccatcctgcccgccggagacctcgacggtacgctcggcagtgaaggtcggcgcgcgggtgctgatgttcagcaccccggcggtggtgttcttgccgaacagggtgccctgcggaccgcgcagcagctccagttgctcgatgtccagcaggtcgaacacggccattcccggacgtcccaggtagacgttgtcgaggtagatcccggcgctgccttccaggccgtcgctggcggggttgttgccgatgccgcgcacggcgacgctcgactgccgcgcatggatgtaggcgacattgacgctgggcagcacctgctgcaggtcctgcacccgggagatgcgctgggcctcgagagtctcgccgccgagcacggtgatcggcgtcggtaccttctgcgaatcctcctcgcggcgacgcgcggtgacagtgaccttgcccagggccgtatcggccttgtccgggacgctgctggccagcggcggcgcttcctcggcgggcgcgggagcatcggcggcactggccggcaacgcaccgccgagggcgagcagcagggccagggcgtagtcggagccgccgggcggcgttcggcggagcggcaagcggtagtggtgcttcatcgtgaatgtcctcggttccggcgcagccggacgcaggcagcaggcggccatgccgcgcaaggcagcgatctggcgaaaggttcgaagggggccggcggacggctcagccccgggcgactgtcaggggcgacagccgccggcgacgcggaagggcattcggaacggcggaggtggggcggcaaaggcacggtggaccatgttcagctcctggggtctatctatacttattactaa

SEQ ID NO: 12026 - DNA, 864 bp, Pseudomonas aeruginosa
aaccagcacatcccgaacggcaaatgcctttgtccaatatttccaatgccggtaaagcatcatggatctgcgccaactgcgttacttcatcgccctcgccgaacaccgcagtttcgtccgcgcggcggacgccatgggcatcacccagccggccttcagccgcagcatccagggcctggagcaggagcttggctgtcagttggtggaccgtggcagcaaggacctgcgcccgacgccggaaggccaggtggtgctgcaacacgcgctgagcctggtgcaggggtcggccaacctgatccacgagatcgcccagttgaacaagctggatgccggcgagctgcgcttcggcagcgggccggcgccggcccagcaactggtgccggacgcggtggccgacttcatcaaccgccacccgcgggtgcagatcagcctggacgtggacaactgggaaaagctcagccgcgccctgctccgcgaagagatcgaattcttcgtcgccgacatccgcgacttcgaggccgacccgaacttccagacgcgcccgctgaccccgcgccgcggccagttcttctgccgtccgcaacatccgctgctgggcaaggacagcctgtccaccaacgacctgttcaactacccgctggcctcgaccctgattcccccgggcatccgcaagctgctggcgaacctcagcggcaagatcgacttcgccgccaacatccgctgcgagaacatgcacgcgctgatccgtatcgtccgccagaccgacgccatcggcatcgccagcgacgagaccctgcgcccctacctgcagcgcggcgaactgcaaccgctacagtggcgcaacctgccgcagaacctggatag

SEQ ID NO: 12027 - DNA, 849 bp, Pseudomonas aeruginosa
ggaagccacccagggcctgcgcctccagttcgcctccggctacacgccgggcagcctcggcttcggcctcgacgcccatgccatgctcggcctgcaactggacagcggcggcggccgcaccggcaccggcaacctgccggtcggcgccgacggccatcccgaccatcgctacggcaaggtcggtggcgccctcaggctacgccacggcgaaacccgcctgaagtacggccagaccaccaccagcgcgccggtgttcgccgccagcagcaaccgcacgctggccggcatggcctacggcctgctgctggaggaccgctcgttcgacgggctgctgctcgagggcgggcgcttcaccgccgcctccggccccggcgaatccaaggtccgcggcgacatcagcaccgtctacggacgcctcggcgcctatccggtgcgcctcgacgcggtcggcttcctcggcggtcaatggcaggccacggagcggctgcaactgtcgctctacgcctcgcgcttcgacgacatctggcagcaggcctatttcggcgccagccatcgccagccgctgggcggggagcgcgcgctgcgggtcgacctcgacgcctaccgcacccgcgacagcggccagagccgcttcggccgcatcgacaccctggccagctccctggccctgggctacgaacaggggccgcagcgcatcaccctggcctaccagcgtgtccatggcgagcagccgttcgactacatggccttcggcgacgggcgctccagcgcgtccatggtactcgccaactcggtgggctactccgacttcaacggaccgggcgagcgttcctggcaattacgctatga

SEQ ID NO: 12028 - DNA, 1797 bp, Pseudomonas aeruginosa
ataataaaaattcatttttttataaccaaaagcagtatgacaggccgcacgggcctctccgcgtcatatgcagccagagcatggaaaatattctccaaatgcatttgccgctgcctggtgcctttctttaaatggcccttcttagcgaaaaaatgcattgattcggcgatttatattcccatgaagaatatcgataaaaccctttcgcccgcctggagccggcccctgccgcgcctggcgccgccgccctccgcggctttcgcccggcgcctgggggacggcctgctgccctggttgctgccgctcgggctggcgctgctgtggtgggtcgccagccatcgccactggatgtcggcccaggtgctgccaactcccgagctggtctggcagagcgcccgcgagttgctcgccggcgaactctggagcgaattggcgatcagcctgcggcgcctggcctggggcctgctcgccggggtcgccagcggcgccgcgctaggcgcctggctgggcttcagtccgcgtgccgagcgcctggtcttccccaccttcagcgccctcgcgcaaatccccacgctggcctggatcccgctgttcatgctgttcttcggcatcggcgaactgctcaagctggtggtgctggtgaaagcggtcgtggtgccggtgaccatccataccctggtcggcgtgcgcgacgcccagcccaagctgcgcgaagccgccgcagtactgcgcctgccgccacgcctgctggtctggcggctgatcctgccggcggcgctgccggccttcctcaccgggctgcgcctggccctggcgcagggctggacctcgctgctggcggtcgagttgcttgcttccagcgagggtatcggctacctgatggtgcagggccggcaactgttcatgctcgacatcgtgttcgtctgcatcctcatcatcggcctggtcggggtgggcatggaccgcgccatccagtggctcgaccgccgcctgctgcactggccgcaagccgccaccggcgaattccgccggcgcccgccgggacgcggctggcagcgcctgcaggtgtggctgccgccgctggcgctgctgctcctgtggcagtcggcgagcagcgccgaatgggtcgatccggcgatcctcgccagccctctggaagtggcgcgggcgacctggagcggagcgctcgacggcagcctcccaggcgccctgttcgacagcctgaagcgcacgctcggcgggctcctgctgggcggcggcctgggtttcctcggcggcctgctgctcggcctgtggcgcccggcggaacgcttcttcggccccactttcgcggcactgcggcaggtggcgatcttcgcctgggtaccgctgctcaccgcctggttcggcctgggcgaaccggccaagctgacgttcgtcgcaatcgccgccttcttcccgctgctgctggccacccagcgcggcatcgccagcctgccgccgagcctcggcgaggcggcccgggtgctgcgcctgggtccctggcgacggctgctccggctggtcctgccgggtgccgccccgtcggtgttcgccggcctgcgcctggcgctgatctacgcctggctgggaaccatcggcgccgagtacttcatgccctccgacggcggcatcggcagcctgatgatcggcgcccagcaattgttccgcatggacctgatcggcgccggcatgctcctggtcggcctcaccggcgccctgctcaatgccctcggccaacgcatcgaagcgcgcgccacgcgctggagacacgcatga

SEQ ID NO: 12029 - DNA, 429 bp, Pseudomonas aeruginosa
agccggaacagacgccccatgcacgcggtttcgagcgttccttctcgctgctgccgggcgccgccaaccactatggtttcgagccgccctacgacgaaagcactccgcgcatcctcaagggtacgccagcgctctacgtggaagacgagcgctacctcgacacgctgccggagggcttctattcctccgacgccttcggcgacaagctgctgcaatacctcaaggagcgcgaccagagccggccgttcttcgcctacctgccgttctccgcgccgcactggccgctgcaagcgccgcgggagatcgtcgagaagtaccgcggtcgctacgacgccggtccagaagcgctgcgccaggaacgcctggcccggctcaaggagctgggcctggtggaagcggacgtcgaagcccatccggtgctcgccctga

SEQ ID NO: 12030 - DNA, 1761 bp, Pseudomonas aeruginosa
cttcgccgaggccgccaggcgcctgggcctgacgccggccggggtgggcaagaacgtcgcccgcctggaaagcaacctcggcgtgcgcctgttccagcgcagcacccggcgcctgaccctgaccgaagccggggagcgtttcctgcaagaggtcggcggcagcctggagggcatccagaccgctctcgccaacgtctccagcgtcggcaaccaacccagcggcacgttgaaggtcagcatggggctggccttcggccgcgactacatcctgccgctgctcggcgagttcctcgaacgctatcccgacatcgtgcccgactggcatttcgacaatcgccaggtcgacctcatcggcgaaggcttcgacgccgccatcggcggtggtttcgaactgccgcccggggtggtggcgcgcaacctgacgccgggccacctgatcctcctcgcctcgcccgcctacctccgcgacaagccgccaatccgccatccaggcgacctgggcggcttcgacgggatccgcatccgctcgccgcagaccggccgcgtgcgctcctggccgctgcgccggcgcaacggcgaggaggcgccgatcgagctgcgcgaacgcatgaccatgagcgacccggaagccacctgcgaggtcgccgccatgggcctgggcatcaccctggtatgcatgcagcacgcctatgcctacctggagtccggcgccctggtgcgggtcctgcgggactggtacgtcgacgccggcaacaccagcctctactacgcggcgaacaagctgctaccggccaagacccgggtcttcgtcgacttcgtcgtcgactacttccgccgccaggacctggcccggcgcttctccgccttcccaaccggctagcgccagccatccgtcgcctcggcaaacgggaaaaggccctggcaccggcctcgccggaaaaacggcagtttgacattaccgattgggactctagttttagaaaacgccgccgacgagcttggaaggcgtcttccgcacggtcccgagggaccgcctggaagccctgctccgatccggcacatggagtgcagcatgcgcgagtccctcggtgtttcgttaccatcccggcccctgctgctgaagctgggcctgctttccctaccctgggcgttgtgcgccgggctgcatgccgtcggcctcggcgtctggctggtcctggcgctcggttggttcgccagcctggccatgctcgtcctcctcctgcgcgcccctcggcaagcggtagcgaatgccaacccgcaggcggatgccgcttcgccggcctggagcgcggcgcaacgggcgctcgccgacgaaaccgcgcaactggacggtcacgcccggcagatcgacgaactgctgcattcggcgatccgccagctcagcgacagcttccacggcctcgccgaacgcatcgatacccagcgcggcctgtcccattcgctgatcgagcgctacgacgggcgcggccaggtcgacgaaggcatcaacttccaggacttcgtcaggaccacccagcagaccctcagcctgttcgtcgaggctaccctggaaaccagccggacctcgcagcaactggtggaacgcatggaccaggtgcgcctgaagatcaccgagatcctgcagtcgacccaggacatggacgccatcgccaagcagaccaacctgctcgccctcaacgctgccatcgaggccgcccgagccggcgagagcggccgcggcttcgccgtggtcgccgatga

SEQ ID NO: 12031 - DNA, 378 bp, Pseudomonas aeruginosa
ggacgcaagaccatgggcaaaccgattctgatcgtcgacgactcggcgtctatccgccagatgctgagcttcaccctgaagtccgccggctacgaggtggacgaggccgcggacggcaaggaaggcctcggcaaggcccagagcaagagctacagcctggtgttcaccgaccagaacatgccgaacatggacggcctgtcgctgatccgcagcctgcgtaacctggccggctaccgcagcgtgccgatcctcatgctgaccaccgaatcgagcgacgcgatgaagcagcagggacgcagcgccggcgccaccggctggctggtgaagccgttcgacccgccgaaactgctcgaagtgacgcgcaaggtcctgccctga

SEQ ID NO: 12032 - DNA, 1956 bp, Pseudomonas aeruginosa
ttcccgttcccccgcgggggaggtcccatgccccaggatatgagccagtttctccaggtgttcttcgaggaaaccgaggaacacctggccaccctcgaactcctcctgatcggtctcgacctggaccggccggacagcgagacgctgcacggaatcttccgcgccgcgcattcgatcaagggttccagcggaatgttcggtttcgacgacatcaccgccgtcacccacgaactggagaccctgctcgaccgcatccgctgcggccagatgcacctgcggccggacatgatcagttccttcctcgaagcccgcgacgtgttgcagcgcctgctcgacgcccatcgcagcggccgtcccgaccccggggtgccgttgctggagacggtcgagcgcctgcgcggctggctgcgggtgccggaacaggaagcggcggaggaaggcttcggcctgttcgacgacgcgcccgccagtcccgccagggaaaccgcggacgacgatgccttcggcttcttcgacgaaggcccgggcgctccggaacgagcggccgcgccgggagcgttcgggctcttcgacgaggcgcccggcgcaccggccgcgagcgaagcgttcggcctcttcgatgaggcaccgggttccccaccggcggaggaacgcgccttcggcctgttcgacggcgcccccggcagccccgccgcgcccagtgcgcccgcgcaagccgtcgccgcgacggccaggggcgcagtcgcgccagtgcgtggcgacggcgagtccggctcgatccgggtcagcgtggaaaagatcgacagcctgatcaacctggtcggcgaactggtgatcacccaggccatgctcggccagctcggcgagcagctcgacccgagccgccacgagcgcctgcagcacgccctggcccagctcgaacacaacacccgcgacctgcaggagtcggtgatgtcgatccgcatgctgccgatcaacttcatcttcagccgcttccccaggctggtgcgcgacaccgccacgcgcctgggcaagcaggtcgagctgcacctgcacggcgagcacaccgaactggacaagagcgtgatcgagaaactcagcgatccgctcacccacatcgtccgcaacagcatcgaccacggcatcgaaacgcccgccgaacgcctcgccgccggcaagccggcgagcggcacggtgaagctcgccgccagccaccagggcggcagcgtggtggtggaggtttccgacgacggtcgcggcctgtcgcgtccgcgcatcctcgccaaggcccgcgagcgcaacctgccggtgcatgacgggatgagcgacgccgaggtctggcaactggtgttcatgcccggcttctccaccgccgagacggtcaccgagctgtccggacgcggcgtcggcatggacgtggtgaagcgcaacatcggtgccatgggcgggcgcatcgacatcgactcggcgcccggcatgggcactcgcatcggcatccgcctgccgctgaccctggcgatcctcgacggcctgatcgtcgccgtcgaagcggtcaactacgtgattccgctgacctacatcgtcgagtcgctgcaggcgcgcagcgacgacgtgcgcggcctcggcggcgaagacaacgcgatgatccgcgtacgcggcgagtacctgccgctgttcagcctgcacgagctgttgcgcatcggcggcgaggcgccggcgccggagcagggcatcgtggtgatcctcgagtccgaggggcgcagcttcgccctgcaggtggacgaactggtcggccagcagcaggtggtgatcaagagcctggaacagaatttccgccgcgtggagggtatcgccggcgccaccatcatgggcgacggcagcgtcgccctgattctcgacgtcgatgcgctgccacgcctggcggcgcgggaggacaccgccgatgaacggcactga

SEQ ID NO: 12033 - DNA, 2055 bp, Pseudomonas aeruginosa
gcaggggatatcgaaatgggtctgttcaatgcacatgcggtggcgcagcaacgcgccgaccggatcgccacgctcctccagtcgttcgccgacggccagctcgacaccgccgtcggcgaggccccggcgcccggctacgagcgtctctacgacagcctgcgagcgctgcagcggcaactgcgcgaacaacgcgccgaactccagcaggtggaaagcctggaggcggggctggcggagatgagccgccagcacgaagccggctggatcgaccagacgattcccgccgaacgcctggaaggtcgcgcggcgcgcatcgccaagggcgtcaacgaactggtggccgcgcacatcgcggtgaagatgaaggtggtcagcgtggtcaccgcctacggccagggcaacttcgagccgctgatggaccgcctgccgggcaagaaggcgcagatcaccgaagccatcgacggcgttcgcgaacgcctgcgcggggccgccgaggcgacctcggcgcaactggccacggcggcctacaacgcgcggatcaagagcgcgctggacaacgtctcggccaacgtgatgatcgccgacaacgacctcaacatcatctacatgaaccgcaccgtcagcgagatgctcggtcgcgccgaagcggatatccgcaagcagttgccgaacttcgacgccggccgcctgatgggcgccaacatcgacgtgttccacaagaatccggcgcaccagcggcacctgctggccaacctcaccggcgtgcacaaggccgagctcaacctcggcggccggcgcttctccctcgatgtggtgccagtgttcaacgacgccaacgaacgcctcggctccgccgtgcaatggaccgaccgcaccgaggaacaccgcgccgagcaggaagtctcgcaactggtgcaggcggcggccgccggcgacttcagcaagcgcgtcgaggaggccggcaaggaaggcttcttcctcaggctggcgaaggacctgaacagcctggtggataccgccgaccgcggcttgcgcgacgtctcgcggatgctcggggcgctggcccagggcgacctcacccagcgcatcgaggccgactaccagggcaccttcggccagctcaaggatttctccaacgacaccgcacaaagcctgtcgcggatgctcgggcagattcgcgaggccgccgacaccatcaacaccgccgccagcgagatcgccagcggcaacgccgaactgtcggcgcgcaccgagcagcaggcgtcgagcctggaggaaaccgcctcgagcatggaagaactgaccagcacggtgaagctcaacgccgagaatgcccgccaggccaactcgctggcggccaatgcctcggaagtggcgacccagggcggcaccgtggtgcagaaggtggtcagcaccatgtcctcgatcaacgagtcggcgcgcaagatcgccgacatcatcggggtgatcgacggcatcgccttccagaccaacatcctcgccctcaacgccgcggtcgaggcagcccgcgccggcgagcagggccgcggcttcgcggtggtcgccggggaagtgcgcaccctcgcccagcgttccgccgccgcggccaaggagatcaagacgctgatctccgactcggtggacaaggtggagaacggcaacaccctggtggcccaggccggacagaccatgagcgacatcgtggtggcgatccgccgggtcaccgacatcatgtcggagatcgccgccgcctccgccgagcagagcaccggcatcgaagaggtgaacagcgcggtctcgcagatggacgacatgacccagcagaacgccgcgctggtggaggaagccgcggccgcggccgaggccatgcaggagcaggcgggcctgctcaaccagtcggtggcggtgttcaggctggacactccgccgagcgtggtccagctcgccagcgcgcggccgtccgcgccacgccccagcgcgccggcgccgctggcccgcagcggcatggcgcgggccagcaaggcgcgcaaggaagacggctgggaagagttctga

SEQ ID NO: 12034 - DNA, 912 bp, Pseudomonas aeruginosa
gaccacgccgcgcctccgccaggcggagggcggcaagcccttagggtcgaccagggaaacccgacgccaatgcccacctccacgccttcgccggtgttcggcaaccaggagttccactacacccgcgaggacttccagcaagtacgcgagcgactctaccgactgaccggcatcagcctggccgagagcaaggcgcaactggtctatagccgcctctcgcggcgcctgcgcctgctgcggctcgggagcttcgccgaatatttcacccacctcgaccgcgagccgggcgagcagcagttgttcgtcaacgcgctgaccaccaacctcaccgcattcttccgcgaacgccaccacttccccctgctcgccgacctcgcccgccgccagttgcagcggcatcgcccgctgcgcatctggtcggcggcggcgagtaccggcgaggaaccctattcgatcgccatcaccctggtggaggcgctgggcagcttcgatccgccggtgaagatcgtcgcctcggacatcgataccggggtgctcgactgcgcccgccagggcgtctatccgctggagcgtctggagcagatgccggcgccgctgaagaaacgcttcttcctccgcggcaccgggcccaacgccggcaaggcgcgggtggtggaggaactgcggcaactggtggagttccgccagatcaacctgctggaggcagactggtcgatcgccggggaactcgacgcgatcttctgccgcaacgtgatgatctacttcgacaagccgacccagacccgcctgctggaacgcatggtggccctgctgcggccggagggcctgttcttcgccgggcattcggagaacttcgtccacgccagccacctggtgcgctccgtcggccagaccgtctacagcccggcctga

SEQ ID NO: 12035 - DNA, 1155 bp, Pseudomonas aeruginosa
agaacgacaccgtgctgcagcgtgaacgcgactaccgccgccgtatcgaccgcaacgcggacggcggccccatcgacctgttctgactctccgggagagcccgccatgcccatcagtgtcctggtcgtcgacgattccgccctgatccgcagcctgctcaaggagatcatccaggccgacccggagctgcgcctggtcggctgcgcgccggacgccttcgtcgcccgcgacctgatcaagcagcacgcgccggacgtgatcagcctcgacgtggaaatgccgcgaatggacggcctgaccttcctcgacaagctgatgaaggcgcggccgaccccggtgctgatgatctcctcgctcaccgagcgcggttccgaagccaccctgcgcgcgctggaactgggcgcggtggacttcatcgccaagccccggctgggcatcgccgaaggcatgcaggcctatgccgaggaaatccgcgccaagctcaagaccgtcgcccgcgcccgcctgcgccgccgtgcggcggacgcgccggcgccgccggaaagcgcggcgccgctgctcagcaccgagaagatcatcgccctcggcgcctccaccggcggcaccgaggcgctcaaggaagtgctgctcggcctgccggcgcacagtcccggggtggtcatcacccagcacatgcctcccggcttcacccgcagcttcgccgagcgcctggatcgcctgacccggctcagcgtcagcgaagcgcgcgacggcgaccgcatactgcccggccacgccctggtcgcgccgggcgaccaccacatggaggtgcagcgctccggcgccaactacgtggtgcgtttgaaccgccaggcgcaggtcaacggccaccgcccggcagtggacgtgatgttcgagtcgctggctcgctgcgccgggcgcaacctgctcgccggcctgctcaccggcatgggcaaggacggcgcgcgcgggctcctggcgatccgccaggccggcggctacaccctggcccaggacgaggctacctgcgtggtctacggcatgccccgcgaagcggtggaactgggcgccgcggaagacgtgctgccgctcgaacggatcgccgccgcgctgctccagcaagccgcccggcgcggcagcggcaaccgcctctga

SEQ ID NO: 12036 - DNA, 2583 bp, Pseudomonas aeruginosa
tttcggccgcgggccgggcgagaaactgatagggatagccatggcggcgaactgggggttgcgcggcaaatcggtggtggcgctgttgctggcctgtgccctggcactggtcccggcggtgctgctgggctggcgcgcgatggacgacatccgtacgcacttcggcctggcctacgcgaagaacttcaccctgctgcaccggcagaagatcctcgccccggtctcccgcgaactggcgttgtcgcgccgtttcgccgaatcggtggtgacccgcgactggctgctgaaggaagacgacccggcgcgccgcgcgctgttcttccgcgaggccgagggctaccgcggcgacttccgcgaccacgcctacttcatcatcgccagcggctcccaccactactacttcaacgacggccgccaaccctacagcgaacggccgcgctacaccctggaggccggcgacccggaagacgcctggtacttcaataccctgcgcaacagcgccgcctacaacatcaacgtcaatgtcgacagcaagctgaacctgaccaaggtctggttcaacctggtgatccgcgaccagggccggcccatcggcctggccggcagcggcctggacctgagcggcttcctcgacgacttcatcatcgcccgcgagccgggcgtgacgccgatgatcgtcggcgacgacggcgccatccaggcccacccggaccgccgcctgatcgcctacagctccgccgccggcggcgccagcgaacgccaccgggtgttcgacctgctcgaccagccggaacagcgcgacgccctgcgcgaggccatgcgcctggcccgcgccaaggccggctcggtgcactgcctgtgggccggcctcgacggccgccagcaactcttcgccgtggcctacattccccaactgcgctggtacgtgctcaccgccgtcgacctgcacgccgcccaggtcctcgacaaccgctggctttggccgctggcgggcacgttcctgctgttgctggtggccctgctgctgggcttcgcctatgccgtcgagcgcctgctgttgcgccccctgcgcagcctcaagcgctcggccaaggcgatcgccgccgggcgctacgacacgccgctgccgctggcgcgccaggacgagatcggctcgctgtcgaaggccttcgccagcatggccgaccaggtccgccggcacaccgccgagctggaagacaaggtccaggagcgcacccaggcgctggaggaagccaaccgcgagatggccgccgcgcagaagaagatcggcgacagcctcgactatgccagcctgatccagcgcgcgatcctccccgaccgccagctcagcgccaccctcggcgagcatcacttcatcctgtggaaaccgcgcgacgtggtcggcggcgacttctacgtgtaccgcgagcaggccgacggctacctgatcggcgtggtcgactgcgccggtcacggcgtgcccggcgcgctgatgaccatgctcgcccgcgccgccatcgaccacgccatcgaggcggtgggcagccgcgacccggcggcgatcctcggcgagaccgaccaggcgatgcgcagcatgctcagccaggagcagatcccccaggcgctggccaccaacatggatgccgggctggtctgggtcgaccgccggcgccgccagctggccttcgccggggcgaagatctcgctgtacgccagcgacggcgaggaggtccaggaactcaagggcgcgcgccgggcgataggcgacaagcgccgtggcgactaccgcaacatcgaggtaccgctggcgccgggctggaccttctacctgagcaccgacggtttcctcgaccaggccggcggcgaacacggcttcggcttcggcagccggcgcttcgccgacatgctccgcgaccacgcgcggcagccgctccccgagcaggccgaggccttcgtggcgacgctcgccgagtaccagggcgagcacccgcaacgcgacgacatcaccatcctgtccttccgattcgactaggggcacccatggaaacgctagacctgctggccatgcgtgaaagctacactcgccaacgcatcctgctctgcttcaacggaccgatctcgcgcagcctgatcgaggagataggccacgcgctgcgcaactacctgcacgccgaacaggccaagccgagcgaagcgatggacgtcttcgcggtgtacatcgagatgacccagaacatccgccactacgccaatctcaagggctacggcgaacacgaggcggcggccacggtagccatcgcccgcaacgaggacggccactacgtggtgtccgccggcaacctggtggaacgcgacgacggccagagcctggtgcgcagcatccaggccatcgccaacctcgacaaggccgccctcaaggccgcctacaaggagcagctacgccgcccgcgcgacagcggctgcgccagcggagccggtctcggcctgctggacatcgcccgcaagtccagcgaaccactggccgcatcgctgaaggaacagcccgacgggcgcgccttcttcagcctgcgcgccgtgatctga

SEQ ID NO: 12037 - DNA, 1536 bp, Pseudomonas aeruginosa
agccgtggcgggcgaactcctcctcggccgcggcgaggatcgcctcctcgttcttctggcggatgcgcccggccggcttgtcgcgggcggccgggtcgtgggcgggcactgtcagggtcatgcgcaggtttccatcggcgtgatccccgcgttgataccccagcccggccgcgggacacaagccaggcgcggaaaaatttgcaaacgcccgtatcaacccagcggcttgcgccagcgcgccagggcgccgcccttcgcgctggcctgcgccgcttcggcaacgcgctcctcgggcagcagcaggttgagcaggatggcggtgatgccgccgctggtgatcgccgagtcgaacagggtcttcaccaccgccggcatctggtcgagcagggtcggctgcgcggccacgccgaggccgacgccgaacgaggcggcgatgatcagcacgctgcggcggtccatcgcggtctggccgagaatgcggatgccggcggcggcgacgctgccgaacatcaccagggtggcgccgccgagtaccggcttggggatctgctggaggatcgcgccgacccaggggaacaggccgagcgccagcaacacgccgccgatatagatcccgacgtgccggctggccaccccggtgagctggatcaccccgttgttctgcgcgaaggtggtgttcgggaaggcgctgaaggtggctgccagcaggcaactgacgccgtcgccgagcaccccgccgcgcaaccgctgcaggtacgccggtccctccaggggctgccgcgagagcatgcagttggcggtcagatcgccgaccgtctcgatgctgctgatcaggtagatcagcgccaccggcaggaaggccatccagtcgaaggcgaagccgaagcggaacggctgcggcaggctgaccagcggcagctcgggcaacgcccgcggaacgaacaggccggtcgcccaggccgccagggtacccagcgccaggccgatgacgatggcggccaggcgcagccagggcaggcgcgagcggttcagcaggacgatgctcagcagcaccagcgcgcccagcgcgagattggccggtgcgccgaagtccgtggccccggctccgccgccgaggtcggtgatgccgaccttgatcaggctgacgccgatcagggtgatgacgatgccggtgaccagcggcgtgatcacccggcgaagatggccgaggaaacgactgaggacgatctgcacgaaggcgccgaagaagcacacgccgaagatcatcgcgaggatctcctcgggaccgccgccgcgctgcttcaccagcatcccggcggccagcacggcgccgaggaaggcgaagctggtgccttgcaggcagatcatcccggcgccgatgccgaacggccggcgcgcctggatcagggtgccggcgccggaaaccatcagcgccatgctgatcaggtatggcaggtgctcgccgaggccgagcagcgagccgatcaccagcggcggagtgacgatgccgacgaagctggccagcacgtgctgtag

SEQ ID NO: 12038 - DNA, 1491 bp, Pseudomonas aeruginosa
tgggcgaacctgtccgagcggtcaggcctcgccatggatagcaagaacgaagccaagacggcgcgggcgcttcgccgggtttcctgcggcgaagggaacgcctgttttttcagtgttttggacaaaggcggcgaaatgcctccaacctctctacgacggcaaaaacctgaccccaaggacagtttttgccttgcactggtgcgtggtcgggaggggcgtgctcgactttgggttggcagcgcgaagaaaactggatacacaaaaacgatttgtgacaaaaagaatcagcagacttttgtacacaaaacagtgcgtggtctttctacacatcaccgccccggcgttcgggcgagaagcggcgcggatgatgccagagacggcgggcggaattcatccccgaatggggtttttcgtcgggtttcaggacgcccggacgtaaattcgccagggcctgggagactccggtggcatgacatccagaaggcgctctcgatgttgcgtagcggagcgcgctcgagtacgggtcgcctggcagcctatgcctgccgggtcttcttgcttcgtcatccgcagggcggatacgccttgggcattatccgccggacaggtctccccgcctcacccacatgggtcccctcaccacaccgcgatctgcgaatcggtgcgcggctcggtgccgccacagagcacgccgctggccgggtcgcgcaggacgatctggccgcgcccgtagctggtcgagtcgtaggcgatctccacctggtgcccacgctgcgccagctccgccgccagcgcgcgcggcgcggcatgttcgatgccgacgcgcagcccgcccagccactgccagcgcggcgcgtcgagggcagcctgggggttgaggccgaagtccaccaggttcatcaccatctgcacgtggccctgcggctgcatataggcgcccatcacgccgaacgggccgagcggcacgccgtccttgctgaggaaaccgggaatgatggtgtggaaggtctgcttgcccggctccaggcaattcacgtggtccggatcgaggctgaactcggcgccgcggttctgcaaggcgatgccggtgccgggcaccaccacgccggagccgaagccgtggtagttgctctggatgaacgagaccaggttgccctcctcgtcgccacaggccaggtacaccgtgccgcccggcctcggctggccggggctgggatcgagcgcgcgctcgccgatcagcgcacggcggctggcggcgtagtcctcgtgcagcagttcctcgaccgagacccgcatcgactgcggctggctgatgtagtgcagcccgtcgacgtacgccagcttcatcgcctccagttggcgatgccaggtccgcgcgcagtcgcgctcgccgaattcgaagcccttgaggatgttcagggtcatcagggcgatcaggccctggccgctcggcggaatctcccagacgtcatagccacggtagttcagtga

SEQ ID NO: 12039 - DNA, 1383 bp, Pseudomonas aeruginosa
gccgagggcgacgaagtcgtagtcgtattgcagcttccaggacttctcgttgggaccgttgaagtcggaatactgctgcgagttgtcgaggaagatgctgtcgccctggttgatgtagtcgaacggcgtgttgccgttgaccttctgcagcaccgcggtgacggtgtgctgcctgtagccgaccgcgaaatgcaggctgtaggtgttgttgtcgatccggccgagcaacgagtcgccgctgtcgacggtcttgtagtagtgcgcgccggggttcagcgaccagttgtcgtcgatctcgtaggtgtagtcgacgtcggcgtagtactgcttccagacgttctgcagttcggcggcgtacaggctgctggtgaagccctcgatgccgccccaggtgccgcccagccagctgagatgatggctgtcgcggtcgcccggcagttcgccgtagtacgagccgaggcgacggtggccactctggttgtagtacttggtgaaactgacctggccagccgtgagggtcaggtcctcgaaactgttgttggtcaggctcacaccgcggaaggtctgcggcagcatgcgcgactcgccgccggcgaccaccgggttgctgaggaactggtcgcccagcttcagctcggtgtcgaaggcgcggatcttcagcgccgccccgccactggagaactcatcgggcgccttgccggattcgtagccttccttgctcggcgcggtgatcggcaggatgctggtgccgccggtaccgccgccgccgtcgagcttcagcccgagcatgccgtaggcgtcgacgccgaagccgaccacgccgggcgtgtagccggactgaaaggtggcgatgaagccttgcgcccattccttgctgtcgtgcccggaagcgtgccggcggtcatggttgaagtagtagttgcgggtcagcaattggaggctggagccttcgatgaagccttctttggcttccccctcatcggcccaggcggcggacgcggtgcacagcgccagcgccatcggcgtcaaggcgaacagattcctcattgcggttgctccttcttacagcgtggtgaaatccggcaaggccggaaagcgtgttgtggtgtcgttcccggcgacgcttctgctggcgtcgcgcgggcgatcgctcccatggggcgcccagccgggcgcaacccgaaaaaaaaggccgctggtatcagcggccttgagaagacgtcgaataggagcaatcaaagttcggcgtcgggaagtcttgccagtgtatttccggacactggaaaccggctggaacgcagtcggactcttctattgaaagtctcttcgactcatcaggctttaggctttccacgtcccgctcttgcatggcgagatcgatga

SEQ ID NO: 12040 - DNA, 492 bp, Pseudomonas aeruginosa
gcgctccagtggtcgatgtcctcgtcgtccttcagcgtcgtttccagacggtccatcaccgccctggtctcgtggatgctgctgttttgcggcaggttgaggtcgaccagcagttccggacggtcggaagacgggaagaactggtgctggacgaacttcatcaggaacagcgacacgccgaacagcagcgcggtgaggaagatggtcgtccagcgccggcgcatcgccaggtgcagcaggctgtcgaaacgctcggcgatgcggcccttcttctgctccgacttgtgcttgagagtcttcggcaggatgtgcacggcgatcaccggggcgaacagcaccgcgacgatccacgacagcagcagcgccacggcgatcactgcgaacagggtgaaggtgtactcgccggcggagctggcgttgagcccgatgggcacgaagccggccaccgtcaccagggtcccggtgagcatcgggaaggccgtcgaggtgtag

SEQ ID NO: 12041 - DNA, 450 bp, Pseudomonas aeruginosa
gtcgccgagtcgtgcagcgagtcgcccagttcgaggcgcgtgatcatcatctccacggtgatcatggcatcgtccaccagcaggccgagggcgatgatcagcgcgccgagggaaacccgctgcatggtgatgtcggtgtattccatgaacacgaagaccatcgccagcaccagcgggatcgagcaggccaccaccagcccggcgcgcaggccgaggctgacgaagctgacgatgaggacgatcaccaccgcctcgaacagcgcccgggtgaaaccgccgaccgccttcttcaccacctgggcctggttcgacacctggtgcacgccgacaccaaccggcagttcgccggtgatctcctgcatgcgcgcattgagcgcctcgccgaactcgaggatattgccgccctccttcatcgccaccgccaggccgatggccggctcgcccttgtag

SEQ ID NO: 12042 - DNA, 1527 bp, Pseudomonas aeruginosa
cgctgcgggcgaacagttcttcctggcgccgggcattggcctgggcgtcgatcaactgtgcctcggcgctggccaggtcgccctggctggcgcgcaactggttctgctggtcggtggggtcgagggtcgccagcagcgcgcccttgccgacgaagtcaccgacgtcgaacaggcgcgaggcgatccgtccgttggtgcggaagccgagcacgctctcgtagcgcgcctggatgctaccggcgaagcgaccgaggtcgtcgttcttcagggtcttcacggtcaccgtcagcaccggccgcggcggtgccggcggcggctcgtcgccgcagccggagaggagcagggcgaagccgaacaggccggcgagggaaaacggcttcatggctggcctccgcccacggcgtcgcggctggcggtgctctgggtcggctgcggcggctgggccacctcgaccacctggcccggatggagcagttggccgcccaccgtgaccaccgtctggcccgcctccaggccaccgtcgatgaccaccttctcgctggcgtagcgtgccacccgcaccggttgcagacgcgccttgccttgctggtcgagcaaccagaccgccggctgctcgccgaccttggacagcgccgaccagggcagcaccacgctgtgctcggccggcgcggcgacgctggcgttgaccacgctgccgaggctcatttccgccggcaccgagtcgaggccgaccttgaccttcagcgtaccgctgcgctcgtccaccgtcggggtgatctcgcggaccttgccgctggcggtgacttccggcttgccgagcaggctgacggtgatccgctggccgtcgacatcgtggctgaacaacgactcgtagacgttgaacaccgcgtcgcgctcgccgtcgcgggccagggtgaagatcggcacggtggcctgcaccacctggccgacctcggcctggcgggcagtgatgaccccggcgtcggaggcacgcagctcggtataggaaagcaggtcgcgggcgttggccaactgcgcctgggcggccttcagcgaactctgcgcgctgcgcacagaggccagcgcctggtcgtactcgctctggctggtgtagcccttgggcagcagcgccttctgccgctggtagttgaggtcggcgagcttcgactgcgcctgctgcgcggcgaccgccgcctgggcgttctccacgttgctgcgctggtcctgcgggtcgagccgcgccagcacctggccagccgcgacgtggtcgccgacatcgaccaggcgctcgacgatcttgccgccgacacggaacgactggtcggcctgtacccgtgcctggatgtcgccggtgatcgaggtggccgaggcgaactcggccatcttcaccgtctgcgccagcacacggacgtgttcctcggcgggcggctcggcgccgcaaccgacaagcaggccggcgcacaggatggcgggcagcgccatccgcgaccagcgacctttggaatgaaaagcgcctctggcgtctga

SEQ ID NO: 12043 - DNA, 594 bp, Pseudomonas aeruginosa
gccgggtcatcggagttcaccgtcaccttcacgccgcgttcgagcatgtcgaggatggtgtgctggctcatgtcgtcgaacacgcagagcttggtgttggacagcgggcagacggtcagcgggatctgttcgtcgatcagccgccgcatcagccgctcgtcctcgaaggcgcgtacgccgtggtcgatgcgctcgaccttgagcaggtcgagggcttcccatatgtactcgggcggcccctcctcgccggcatgggcgacggtgaggaagccttcgctgcgggcccggtcgaagacccgctggaacttgctcggcggatgccctacttccgagctgtcgaggccgacggcgatgaaggcgtcgcggaacggcagcgcctggtcgagggttttctgcgcctgttcctcgctgaggtggcggaggaagctgaggatcagcccatggcggatgcccagcagcttctcgccgtcctgcagcgcggcgcggatgccggcgagcaccacctcgaagggaatgccgcgatcggtgtgggtctgcgggtcgaagaacggctcgacgtggacgacgttctgcgccttgcacttctgcaggtag

SEQ ID NO: 12044 - DNA, 531 bp, Pseudomonas aeruginosa
caaggcacgcacgcgatgaccgcgatctacctggccgggccggacgtcttccgccccgacgccgaagcccatggcgaaaccctcaaggcgctctgcgccgagttcggcttcgtcggcctctacccgctcgaccacgccctgcccgccgacatccgcgagccagccgcacaggccgcctggatctaccgcgccaatgtcggcctgatcgagcgcgccgactgcgtgctggccaacctcgaaccgttccgcggcagcgagccggacagcggcaccgccttcgaagtgggttacgccctggccctgggcaagccggtatatgcctacctcagcgatgccggcgcctacaccgagcgcctcgcccggctggccccggaatggctcggcgagcaccccggcgaggaccgcgacggttggcaactggagggtttcggcctgccattgaacctgatgctggcggtgccttcgcggctggtcgccggcggcccgcgcgaggccctgcgacgcttcgccgaggaactcgagcgcgcctga

SEQ ID NO: 12045 - DNA, 780 bp, Pseudomonas aeruginosa
ctgctggcagatagccgccgcccggcccgtcgcttgccggccataatcctggacaacaacggccccatccgggaggccggcctgcaagaggcatccgatgaaccgatccaagggttccagcagccgtcgtaccttcctgcgcctggcagccctgctgctgcccgccggcgccctgctcggcagcctgccgggtgtacgcgccgcggccaggccgcggaaactctatctggccggtcccgatgtgttccgcgccgacgccgtcgcccacggcgaagcactcaaggcactgtgcgcacgctacggtttcgagggcctctacccgctggacaacgcgctgccgaaacagctcgccgagccgcgcgaacaggcggcctggatctaccgcgccaacatcggcctgatcgaacgcgccgacgcggtgctggccaacctgaacttcttccgcggcgccgagccggacagcggcaccgccttcgaggtcggctatgccaccgccctcggcaagccggtctatggctacgtcgacgacgccggcagctacgccgagcgaatccgccggcacgccccggagctgatcggcgaggatccgacccgcgaccgcgacggcatgaccctggaagagttcggcctgccgctcaacctgatgctgtcggtgcccggcaggatcgtcgtcggcgacgccgagcaggccctgcgccaactcgccagccggcgccacggctgacccggcgccggccgtacggcgagagactcagggcaggcgggcgatacgctcggtga

SEQ ID NO: 12046 - DNA, 1674 bp, Pseudomonas aeruginosa
  unsure (786),(900): Identity of nucleotide at the above locations are unknown.
tcagcgtccgcggcgatggcggcgccaccgtttcggcagcggacagaggaaggctggcgggcatcagcagggcgagtcctagcagaaggctgcaaaagcgattgcatgggcgggcggcgcgtaacatggggcggctcctggtggggaatgccacagtctagccagttgcgggccacgcgccgacctatgcgaaccgacagaggaagcctggcgcctcctctgtcggcgcccgcctcacccggcgatcagggcgctcgccgcctcgcggtggcgggcgatcagggcggccaggtcgagcccttccacggcaccgtcgaccactcgccaggcgccgccgaccattacccggtcggcacggtcggcagcgcacagcagcagcgccgagagcgggtcgtggctacccgagaagcgcagctcgtcgagcttgaacaaggccaggtcggcctgcttgccgggggccagctcgccgatgtcgctgcgcccgagcaggcgtgccgagccacgggttgcccagcccagggcgagttccggggtgatccgctcggcgccgtagcgcaggcgttgcaggtacagggcctggcgcgcctcgaggatcatgttcgaggcgtcgttggaagccgagccatcgactcccaggccgatcggcgcgccggccgcctccagctccacggtcgggcagatgcccgaggccaggcgcatgttcgaactcgggcaatggcagataccggtgcccgcctcgccgagccggcggatctcctcggcgttgaagtggatgccgtgggccanccaggtgcgcgggccgagccagccgacgctatccaggtagtccacggtgcgcaggccgaagcgctgcaggcagaagtcttcctcgtcgagggtctccgccaggtgggtgtgcangcgtacctcgtggcgcgccgccagttcggcgctggcgcgcatgatctccggagtcaccgagaacggcgagcagggcgccagggcgatctgcacccgggcaccgtctccgcgctggtggtagcgggcgatcagtcgctcgctgtcggcgaggatggtctcggcctcctgcaccgtctgctgcggcggcaagccgccgtccttctcgccgaggctcatcgagccgcgggtgagcatggcgcgcatgcccagttcctcgaccaccccggcctgcacgtcgatggcctgttcgaggccgccgggaaacaggtagtggtggtcggcggcagtggtacacccggacaacagcagctcggccagcgccaccttggtggccagttcgagtttctccggggtcagccgcgcccagaccgggtagagggtcttcagccaggggaacagcggctggttgaccaccggcgcccaggcgcgggtgagggtctggtagaagtggtgatgggtgttgaccagccccggcaacaccacgtgccggctggcgtcgaactggctggcgcagggctgcgcgggctgttggccggcgccgagcagcttgacgatgcggccgtcttcgacgaccaggccgccggcggcgtcgagaccgttggcggtgaagatggcgaggggactgcgaatccaggtgcgggacatgtgcggaccttcgtcggatcggcgggccggcgcgaacgctgccggccctcggttgatgagagccagctcagtgttcaccctgtctgctga

SEQ ID NO: 12047 - DNA, 987 bp, Pseudomonas aeruginosa
  unsure (192): Identity of nucleotide at the above locations are unknown.
aaacgtagaacggaaggagtcccgcatgagcgaagaacccactgtcagtcccccctcccccgagcaacccgccgcgcagccggccaagccggcccggccagccgcccgccgcgccccgcgcaagccggcgacccgccgcccgcgagtggccagcccggcgcagaaggcccgcgaggagatccaggcaatcanccagaagccggtggccctgcaggtcgccagtgcgccccacggcaacagcgaggacagcacctcggcgagcctgccggcgaactatccctatcacacgcggatgcgccgcaacgagtacgagaaggccaagcacgacctgcagatcgaactgctcaaggtgcagagctgggtgaaggagaccggccagcgcgtggtggtcctgttcgaaggccgcgacgccgccggcaagggcggcaccatcaagcgcttcatggaacacctgaacccgcgcggcgcgcggatcgtagccttggagaaaccgtcctcccaggagcagggccagtggtatttccagcgctacatccaacatctgcccaccgccggcgagatggtcttcttcgaccgctcctggtacaaccgcgccggcgtcgagcgggtcatgggcttctgttcgccgctgcaatacctggagttcatgcgccaggcgccggagctggagcgcatgctcaccaacagcggcatcctgctgttcaagtactggttctcggtgagccgcgaggaacaactgcggcgcttcatctcgcgccgcgacgatccgctcaagcactggaagctgtcgcccatcgacatcaagtctctggacaagtgggacgactacaccgccgccaagcaggcgatgttcttccataccgacaccgccgacgcgccgtggacggtcatcaagtccgacgacaagaagcgcgcgcgactcaactgcatccgccacttcctgcactcgctggactacccggacaaggaccggcgcatcgcccatga

SEQ ID NO: 12048 - DNA, 561 bp, Pseudomonas aeruginosa
gcccgacccgttgctggtggggccggcctcgcgggtgatcgaggacgacgagaaggtctacgccgaggcggccgccgcgccgggccacgcgaacctggatatcccggcctgaggcgggcggtcgcgccaacgaaaacgcccggggcgctttcgcgctccgggcgtccctggttcgacggtcgctggccgggtcactccggcgcggaggtccggatcaggtggtcgaaggcgctcagcgaagccttggcgccctcgcccacggcgatcacgatctgcttgtacggcaccgtggtcacgtcgccggcggcgaagatgccgggcagcgaggtctcgccacgggcgtcgacgatgatctcgccacgcggcgacagctcgacgctgcccttgagccactcggtgttgggcagcaggccgatctgcacgaagatgccttccagctcgatcgacttgaactcctcggagttgcggtccttgtacaccaggccggtgaccttctggccgtcgcccttcacttcgctggtcagggcactggtgatcacctcgacgttcggcaggctgtag

SEQ ID NO: 12049 - DNA, 804 bp, Pseudomonas aeruginosa
ttaaaacaactaatcgaagaacctgccctcgtcagtgcccggccttccacggctggcccagggaaaccggggcatacagccgggtgcgcagggcatcgcgggagagcaggaccagcaccaggatggtcgccgcatagggcagcatcgccagcaggttggccggaatcgacagcccgatcccctgggccaccaggtgcaggatgctggccaggccgaacaaccaggcaccgagcagcacgcggaacacccgccaactggcgaagaccaccagcgccagggcgatccagccgcgtccggcggtcatgttctccgcccacatcggcgtgtaggccagcgacaggtaggcaccggccaggccggccatggcgccgccgaagagcaccgccagggtgcgcacgcgcagcaccggcaggcccatcgcgctggccgcgtcggggttctcgccgaccgcctggagaaccagcccggcgcggctgcgcaggagcatccaggcgaccgcggcgaacagcgccaggctcaggtagaccagcgcgtcctgggcgaacagcatgcgcccgagcagcggcaactcgcccagcaccggcagcgccagcggggcgaacccttgcagcggcttgccgacccaggcggcgccgacgaacgacgacaggccgacgccgaagatggtcagcgccagcccgcaggccacctggttggcgttcaggtacagggcgaccccggcgaacagcgccgccagcagcatgccggcgagcaccgcgaggagcacgccgagccacaggctgccgctggagaaggcgaccatga

SEQ ID NO: 12050 - DNA, 705 bp, Pseudomonas aeruginosa
gcagcgcattgtccgccaggctcatctccggccaccgcgccgtgccccagccgctcggcgggcacgaaggcctggccggcgcggcgccgcgcatccggcgccaggtgcgcgccggcgcaggcgcctaggcggatgcgctcggcctgggcgcgcggcaggcgcacttcgccgctgagcagagcgagcaactcgtcctggccgttgccggcgaccccggcgataccgaggatctcgccgctgcgcacctccagatcgaggccggcgaaggacacgccgaaggggtccgggttgcgccagtgcaggtcgcgcacctggaggaaaggcgcgccgccggtaaccttcggatattccgccgccaggccctcggcgtcgcccaccatcagccgcgccagctcgagatcggaacattgcgccggcacgcactgtccggccacccgtccgccgcgcagcaccgtggcgcgctggcagagcgcacggacctcggccagcttgtggctgatgaagaggacactgcagccctcttccgcaagacggcgcagggtgacgaagagatcctcggcctcgcgtggggtcagcaccgaagtcggctcgtcgaggatcagcaggcggatgtcctgcatcaggcagcgcacgatctccacccgctggcgctcgccgatggacagcccatggaccagccggcgaggctccagcggcatgccgtag

SEQ ID NO: 12051 - DNA, 531 bp, Pseudomonas aeruginosa
ggcgccggcggggcgggtggcgcggcgggttgcggcggcgcgggcggagccggctcgacggccttcggcgccggcttgggccggggttgcggcttgggcttgggtttcggctttggcaccggcttcggcggcggcggcttcaccgcgttctcgtcgaccaccggtggtggcggttcctcgaccaccggcggcaacggctcgggcggcggcggttccaccaccggcggcgccggggcggtgaactcgatggtcatcggcggcacctgtggcggcacctcgggcagcgccggggttctctgctggctcagccaatggatcaccgctccgtgcagggtcagggcgaacaggaccagcaggatcgtctcgcgccggctgagcacccgaccctgtgccgggttgtggcgaaccaggtgcaacgcctggcgaaccggccgaccgagcgccaccaggtcgccgccgggcgtctcgcgccagggctgcgtgcgggcatcgacaggctggggtgttgccatgaaaaactccttgcactga

SEQ ID NO: 12052 - DNA, 1386 bp, Pseudomonas aeruginosa
ggcacttcggcctcggccagcagccacgttcatgtgccccggcatgcgcccggcgaccgggtggatggcgaacttcacggtgaccccgcgatgggtcagcttctccgccagttccatcagcgcgtgctgggcgcgggccaccgccaggccgtagccggggacgatgatcacgctgtcggcgttggtcagcaggaacgaggcattgtcggccgaaccggacttcaccggacgctgctccttggagcccgccgggccgccggcgtcggcttcggcgccgaagccgccgaggatgacgttgaagaacgagcggttcatcgccttgcacatgatgtaggagaggatcgcgcccgaggagccgaccagcgagccggcgatgatcagcatcgagttgttcagcgagaagccgatacccgccgcggcccagccggaataggagttgagcatcgacaccaccaccggcatgtcggcgccgccgatggggatgatgatcagcacgccgaggacgaaggccagcgccagcatcacggcgaaggcggtgaggttgccggtgaacatgaacaccaggcccaggccgagggttgccaggccgagcaccaggttcagcaggtgctgcccggagaactgcaccggggtgccctggaacaggcggaacttgtacttgccggagagcttgccgaaggcgatcaccgaaccggagaaggtgatggcgccgatggccgcgccgaggaacagctccaggcggttgccggtgggaatggtgtcgcccaggtgcgcgacgatccccagcgactgcggctcgaccaccgctgcgatggcgatgaacaccgcggccaggccgatcatgctgtgcatgaaggcgaccagctcgggcatcttggtcatctcgacgcgcttggccatgatcgagccggcggtaccgccgaccagcaggccgacgacgatgtagccgacgccggtggtggcgatctccgcgcccagcttgaacaccaggccgacggtggtggccacggcgatggccatgccgaccatgccgaagaggttgccgcggcgcgaggtggtcgggtgcgacaggcctttcagggcctggatgaagcagaccgaggcgatgaggtacaggagggtgaccaggttcatgctcatcagtggccccccgccttcggcgctttcttcttgaacatttccagcatgcgccgggtgaccaggaagccaccgaacacattgaccgcggccagggccacggcgagggtgcccatggccttgcccagcggggtcacggtcagggcggcggcgagcatggcgccgacgatgacgatcgcggaaatcgcgttggtcaccgccatcagcggggtgtgcaaggcaggggtgacgttccataccacgtggtag

SEQ ID NO: 12053 - DNA, 1137 bp, Pseudomonas aeruginosa
gctgatgcgcttcaggcgccgccgctcgctggccgggaaggcgttgcgcgcatgcagcacggcctggttgtcccaccagacgatgtcgcccaccgaccaggcgtggctgtagctcagttccgggcgcgccagatgttcgcgcaggcgaccgatcagcgcctggccccgcgcggggtcgtagccgggaatctccacctcggtgtgggcgctgaggaacagtacgcgccggccgctttccgggtgggtgcgtaccagcgggtgctcgctgccctggatcggttcgatgtccggcgtgcggtaggtggcgaaaccgccgccgtagccgccctcgcgcaggcggatgaaggggttgtagttgatcaggcgcaggccatcgatctcgcgccgggtcgcctcgtcgaggctctcgtaggcgcgcgccaggttggtgaagcgcgtctcgccgccactggacggcacctccagtgcgtagaggaacgagccggaggacggcaccggcgtccattggtggtcgatgtgtgccggcagggcgaagttgcccagttcgccgtcgccggtgttggccaccttgacgatgtccggcaccttgccgtcgccacccgaggacagcaccgggatgtccgccggcggctggaacaccgagccgaacagggtggcgaagcgcaagtactgctcatcgtcgaggtgctgctggcggaacaccaggatgtggtgctcgcgcagcgcctgcttgagcgccaggacctgctccggcgccagcggccggcgcgcgtcgaggccacggacttcggcgcccagcggcgcctccaggggggtgatgcggaatgcctcggcgacctcgggttcgggttgccgggcggtggcggattggctcatgtaaggggtcctcgcgggttcgttctgcctgtggtcgccctccccggcgaggagagggccgggtccgtcatgccttccggatcgtccggctgcgttgcccgtcgatgcctaccggcacgtcgccgccgagggtcacccggcgcaccacgcgcggctggtcgccgtagtcgtcgatcgcgtagtgctgggtcgcgcggttgtcccagatcgccacgtcgccggcctgccagcgccagcgcacggtgttctccaggcgcgtga

SEQ ID NO: 12054 - DNA, 609 bp, Pseudomonas aeruginosa
acaccttgcggtagttctccaactgctccaccgaggcgctgggctagaccccggcgtagtcgtactcgttgctgtgcaccgcccagagccggtcggccagctcgcgcagctccgccggcaggtcggcgtaggcgctcgccgtgttggcccagacggtgtcgccgccggactccggggccaccacgctgcgcaggatcgaggccttcgggtaggcctcgacgaaggtcacgtcggtatgccaggagttggcccggcggccttcggcgccatccagctcgaggaggaagcgggtgccttcgcgggacggcacggtggggtgggcgaccggttcgccgagcaagtgggcgaaggcctcctgggtctggtcgtcgagatggctctggtcccggaagaagatcaccttgtggcgtaccagggcggcctggatcgcctcgacggtggcggcgtccagttcgccggacagggtcacgccgcgaatctccgcgccgatccgtccggcgaccggccggacgtcgagccgtaccggcgtggcgagggcttgtgctgcattgctcatgtcatgttcctcatgcgtggggtactgcgtgggtgaaggctcagaagtcgtag

SEQ ID NO: 12055 - DNA, 924 bp, Pseudomonas aeruginosa
agcatcatggatctgcgccaactgcgttacttcatcgccctcgccgaacaccgcagtttcgtccgcgcggcggacgccatgggcatcacccagccggccttcagccgcagcatccagggcctggagcaggagcttggctgtcagttggtggaccgtggcagcaaggacctgcgcccgacgccggaaggccaggtggtgctgcaacacgcgctgagcctggtgcaggggtcggccaacctgatccacgagatcgcccagttgaacaagctggatgccggcgagctgcgcttcggcagcgggccggcgccggcccagcaactggtgccggacgcggtggccgacttcatcaaccgccacccgcgggtgcagatcagcctggacgtggacaactgggaaaagctcagccgcgccctgctccgcgaagagatcgaattcttcgtcgccgacatccgcgacttcgaggccgacccgaacttccagacgcgcccgctgaccccgcgccgcggccagttcttctgccgtccgcaacatccgctgctgggcaaggacagcctgtccaccaacgacctgttcaactacccgctggcctcgaccctgattcccccgggcatccgcaagctgctggcgaacctcagcggcaagatcgacttcgccgccaacatccgctgcgagaacatgcacgcgctgatccgtatcgtccgccagaccgacgccatcggcatcgccagcgacgagaccctgcgcccctacctgcagcgcggcgaactgcaaccgctacagtggcgcaacctgccgcagaacctggatagcctcagcgcccgctgcggcatcatcagccgcagcggctaccggctttcggcagcggccaaggcgatgatcgagacgctggtggaactggaccaggcgcaacacgcggcggcctga

SEQ ID NO: 12056 - DNA, 1359 bp, Pseudomonas aeruginosa
atgcaaaatctcagacgcgctgtattcgccggcctggtcgccggcacgctttccgaaggggcggccgcgacggccggggatgggggcttcgtcgaggacagcgaactgcagttcctcgctcgcacctactacttcaaccgcgactaccgcgacagcccgaacaacgccgggcgcaaccgcttcaagcccaggagcgagcgcaacggctaccgtgaggaagccacccagggcctgcgcctccagttcgcctccggctacacgccgggcagcctcggcttcggcctcgacgcccatgccatgctcggcctgcaactggacagcggcggcggccgcaccggcaccggcaacctgccggtcggcgccgacggccatcccgaccatcgctacggcaaggtcggtggcgccctcaggctacgccacggcgaaacccgcctgaagtacggccagaccaccaccagcgcgccggtgttcgccgccagcagcaaccgcacgctggccggcatggcctacggcctgctgctggaggaccgctcgttcgacgggctgctgctcgagggcgggcgcttcaccgccgcctccggccccggcgaatccaaggtccgcggcgacatcagcaccgtctacggacgcctcggcgcctatccggtgcgcctcgacgcggtcggcttcctcggcggtcaatggcaggccacggagcggctgcaactgtcgctctacgcctcgcgcttcgacgacatctggcagcaggcctatttcggcgccagccatcgccagccgctgggcggggagcgcgcgctgcgggtcgacctcgacgcctaccgcacccgcgacagcggccagagccgcttcggccgcatcgacaccctggccagctccctggccctgggctacgaacaggggccgcagcgcatcaccctggcctaccagcgtgtccatggcgagcagccgttcgactacatggccttcggcgacgggcgctccagcgcgtccatggtactcgccaactcggtgggctactccgacttcaacggaccgggcgagcgttcctggcaattacgctatgacctggacctcggcgcgctcggcctgcctgggctcagcctgcatgcgctgcatgcccgcggccgtgccggggccagcgccagcagtgccgccgagagcatctacgccggactctacgggcgtgacgggcggcaccgggaaaacgacctcggcttcgcctatcgggtcaaggcgggccccctcgccggcctcgcgctgcgcgcctcgcaggcctggcaccggggcaacgcgagctatctcgacggcgacatcgacgaaacccggctggtcgtcgattactcccgctcgatctggtga

SEQ ID NO: 12057 - DNA, 1023 bp, Pseudomonas aeruginosa
tcgacggcaggtagcgccgcaccggcatccgcagcaggcgcagggcgaccaggcccagcagggcgaacgccagcaccgccagcgcggtggcgaggaacaccccggccaccatgccaatggacaggccggggcggtccagcgacgacagcagcaggcagggaaagccgacgttggccaccaggaacaccagcgcgcgggtatccaccggcccggcggaacggctccaggcgaaaccgatcccggtgcagatcaggatcggcagcaccaccgcgacgaactgtgcgatcacaaccccaccttgaagcccagttccagctccgcccgcaggcggccgtggccgtcgaagttgagccggcgcatctcgcgcagttcgttggcgcagaaggcagtgcgcccgtgcaacaccgcagtgttgtcgagcaccaggatttcccccggctcgagcttgatccgcagttggcaggccggatcctcgagcgccgccaccagttcggcgaaggcctccaccgccacaggatgctcgaccacctcggccgccccgtcgttctgccggaacttgatgcccagcgcctcgccgttcaggcggaacaccggctgggtgctgctctggtgcttgcgcacgatggtcagggcgtcgccgcgcagcaggccgagatgcttggtcggcatgcgccggcgcaggcgctcgaaggccagtccggcgctggccagcagggtctccccgccctcccgggcgttgcgcacgcattgcaggctgcacaattgctccggggtgtcgaggaaagcgccgtcggtgtgcagcttgtgctccagcggcgtggagccgaggtagccgctgacataccgcgcattgctgatcggcacgatgccgtcggcgtcggcgcgcgggtggggggcggcgcggccgaacaactccttgagcgcgagaagttcctgcctgtcttcgccctgttcgctgcgcaacagcaggaaaccaaactcgttgagggtccggatgatcgccgattgttcctggcgggataa

SEQ ID NO: 12058 - DNA, 1320 bp, Pseudomonas aeruginosa
cctgcggattacccgcgtgaaactttcatgacgcgatatacgcagaatccccgaccaacggctggatacttcgctcgatccagtcattggttgggtcggtgcaagaatctcgaaacatattacaaattgctacgaaacggcgccgcctcggccgtccccggctcggcgtcactccgccgcctgcgccacggccttggccttcgccagcttgccggccgcctccagcagttccggcgcggcccactgctcggcgctgaattcgcgacggatcaggccgaaacgcttggccgcctggatcgaagcatccagccggccaaggaaatcggtgtccaggcgcggcgacagggcgtcgcccagcttgcggccacggtactcgctctgcaggatcaccaccgggtagctggcctgcttcgacaccagttcgatgtaagcgtcgcggttctcctcgcgggccagccagtcctgggcctgcaactgcaccttgagcagccgctcggtgatgtccggatgggcatcgacgaaggctccggagccgaccagcagcgcctgcagggtgccggcgccgttcaggtcgcgggtgctcagcggaatttccgcgagcccgcggtcgcgcagggcgaacagtccggccaggccccaggtggcatcgatctgcctggctgcgagggcggacagggcggcgctgaaatcgaggttgatcaccttcaggtccttctcgctgagaccgacgctggccagggcattgtcgaacgacaactggctggcggtgccacgaaagatgcctacgcgcttgcccttgagatcctccagggtcttgatcccggagcccggctgcacgccgagatagtggttgacccctcgcgcggtagcggccagcaggcggctgtccaggcctccggacttgccgatgatcgccgccaggtcgccgaggtaggcgaagtccacctggccgttggcgaacgcttcgttgaccaccgggccggcgcccttgaagaagctccatttcaccgcgatgccgtcgttggcgaactccttctccagcaactggcgggtgtagagcacgtcgaccacgccgccgcccgagtgcgaactgccggcgctgacgtccggcaccgcgatgcggatttccttcggcggagcggcgctcgccagcggcacgtaggcaccgagcaggccggcgagcacaggcgcggcgaacagaccgagcagggaagacgtaagcgctttcatggggcggctccttggaacgggaagagagggattcccgccgggagcgggtgtgcggctagctatgcacagcggcgcctcgaaaataaataa

SEQ ID NO: 12059 - DNA, 1845 bp, Pseudomonas aeruginosa
tcggcgccggcatgctcctggtcggcctcaccggcgccctgctcaatgccctcggccaacgcatcgaagcgcgcgccacgcgctggagacacgcatgaacgcattcaccgcgcccgccacgggcaccccgctggtcagcttccgccaggtgcgcaagcacttcgccgtggacggccggcgactggaagcgatccagcagttcgacctggagatcggcgagggcgagttcatcgccatcgtcggcgccagtggctgcggcaagtcgaccctgctgcgcctgctgatcggcctggaccgcgactacgacggcgagatccgcgtcgacggccggccaatcgccggcatcggcggcgaacgcggcatcgtgttccaggagcaccgcctgttcccctggctgacggtgcagcagaacgtcgccctcggcctggtcaacgaagcccttggcgaaaccgacaaggcggcgcggatcgacgaatacatccgcctggtcggcctgcacggcttcgagcgtgcctacccgcaccagttgtccggcggcatggcccagcgcgtggcgatcgcccgtggcctggtggccagcccgcgcctgctgctgctcgacgagccgttcagcgccctcgacgcactgacccgccagcagttgcaggaagagttgctggcgatccgccggcgcacccgtatcaccaccctgctggtcacccacgacgtcgaggaggcgctctacctggccgaccgggtggtggtgatggagccgcgtccggggcggatcaggcgggtggtcgaggtgggcctggcgcatccgcgcgagcgcggtggcttcgacttcctgcgccagcgcgaagcgctgctgcacgaactgaccgccgacggcgagtacgtcgcgccgccgccgcgacgggtggaaaacctgcccttcgaattcctcgcttgctgaaaagccccttgccctggccctttccccctgcgggaagggcgggggcgagggccccaccttctcctcccatccagacgagacccgcgcatgagcaaacgccccaacttcctggtgatcgtcgccgacgacctgggcttctccgatatcggcgccttcggcggcgagatcgccacgccgaacctcgacgccctggccatcgccggcctgcgcctgaccgacttccacaccgcctcgacctgctcgccgacccgctcgatgctgctcaccggcaccgaccaccacatcgccgggatcggcaccatggccgaggcgctgaccccggaactggaaggcaagccgggttacgaagggcatctcaacgagcgcgtggtggcgctgccggagctgctccgcgaggccggctaccagaccctcatggccggcaagtggcacctcggtctgaagccggaacagacgccccatgcacgcggtttcgagcgttccttctcgctgctgccgggcgccgccaaccactatggtttcgagccgccctacgacgaaagcactccgcgcatcctcaagggtacgccagcgctctacgtggaagacgagcgctacctcgacacgctgccggagggcttctattcctccgacgccttcggcgacaagctgctgcaatacctcaaggagcgcgaccagagccggccgttcttcgcctacctgccgttctccgcgccgcactggccgctgcaagcgccgcgggagatcgtcgagaagtaccgcggtcgctacgacgccggtccagaagcgctgcgccaggaacgcctggcccggctcaaggagctgggcctggtggaagcggacgtcgaagcccatccggtgctcgccctgacccgcgagtgggaggccctggaggacgaggaacgggctaa

SEQ ID NO: 12060 - DNA, 687 bp, Pseudomonas aeruginosa
gtcggcgcgggcgatggaggtctatgcggcgatggtcgagcgcatggactggaacatcggcagggtcgtggactacctgcgccggcagggcgagctggacaacaccttcgtcctgttcatgtccgacaacggcgccgaaggcgccctgctggaggcgttcccgaaattcggcccggacctgctgggctttctcgaccggcactacgacaacagcctggaaaacatcggccgcgccaattcctacgtctggtatggcccgcgctgggcccaggcggccaccgcaccatcgcgcctgtacaaggcgttcacaacccagggcgggattcgcgtgccagcgctggtgcgctacccgcggctaagccggcagggtgcgatcagccatgccttcgccacggtgatggacgtcaccccgaccatcctcgacctcgccggtgtccgccacccaggcaagcgctggcgcggccgcgagatcgccgagccgcgcggcaggtcttggctgggttggctttccggcgagaccgaggcggcccacgacgagaacaccgtgaccggctgggagctgttcggcatgcgtgcgatccgccagggcgactggaaggcggtgtacctgccggccccggtgggcccggccacctggcagctctacgacctggcccgcgacccgggcgagatccacgacctcgctga

SEQ ID NO: 12061 - DNA, 978 bp, Pseudomonas aeruginosa
tcgctatattcagccgataccaatggtttatgcgggccctttcccatggaaaccctcagcaacatccagtgcttcgtccgcagcgccgaggccggtagcttcgccgaggccgccaggcgcctgggcctgacgccggccggggtgggcaagaacgtcgcccgcctggaaagcaacctcggcgtgcgcctgttccagcgcagcacccggcgcctgaccctgaccgaagccggggagcgtttcctgcaagaggtcggcggcagcctggagggcatccagaccgctctcgccaacgtctccagcgtcggcaaccaacccagcggcacgttgaaggtcagcatggggctggccttcggccgcgactacatcctgccgctgctcggcgagttcctcgaacgctatcccgacatcgtgcccgactggcatttcgacaatcgccaggtcgacctcatcggcgaaggcttcgacgccgccatcggcggtggtttcgaactgccgcccggggtggtggcgcgcaacctgacgccgggccacctgatcctcctcgcctcgcccgcctacctccgcgacaagccgccaatccgccatccaggcgacctgggcggcttcgacgggatccgcatccgctcgccgcagaccggccgcgtgcgctcctggccgctgcgccggcgcaacggcgaggaggcgccgatcgagctgcgcgaacgcatgaccatgagcgacccggaagccacctgcgaggtcgccgccatgggcctgggcatcaccctggtatgcatgcagcacgcctatgcctacctggagtccggcgccctggtgcgggtcctgcgggactggtacgtcgacgccggcaacaccagcctctactacgcggcgaacaagctgctaccggccaagacccgggtcttcgtcgacttcgtcgtcgactacttccgccgccaggacctggcccggcgcttctccgccttcccaaccggctag

SEQ ID NO: 12062 - DNA, 1365 bp, Pseudomonas aeruginosa
cgccagccatccgtcgcctcggcaaacgggaaaaggccctggcaccggcctcgccggaaaaacggcagtttgacattaccgattgggactctagttttagaaaacgccgccgacgagcttggaaggcgtcttccgcacggtcccgagggaccgcctggaagccctgctccgatccggcacatggagtgcagcatgcgcgagtccctcggtgtttcgttaccatcccggcccctgctgctgaagctgggcctgctttccctaccctgggcgttgtgcgccgggctgcatgccgtcggcctcggcgtctggctggtcctggcgctcggttggttcgccagcctggccatgctcgtcctcctcctgcgcgcccctcggcaagcggtagcgaatgccaacccgcaggcggatgccgcttcgccggcctggagcgcggcgcaacgggcgctcgccgacgaaaccgcgcaactggacggtcacgcccggcagatcgacgaactgctgcattcggcgatccgccagctcagcgacagcttccacggcctcgccgaacgcatcgatacccagcgcggcctgtcccattcgctgatcgagcgctacgacgggcgcggccaggtcgacgaaggcatcaacttccaggacttcgtcaggaccacccagcagaccctcagcctgttcgtcgaggctaccctggaaaccagccggacctcgcagcaactggtggaacgcatggaccaggtgcgcctgaagatcaccgagatcctgcagtcgacccaggacatggacgccatcgccaagcagaccaacctgctcgccctcaacgctgccatcgaggccgcccgagccggcgagagcggccgcggcttcgccgtggtcgccgatgaagtgcgcgcgctgtcgacccgctccacggagttttccgccgccatccgcaagcacgtcgacgtggtccaccacgagatccaggacgccgagagcgcgatctcgcaactggccgacaaggacatgtccttcgccctcgattccaagcacaagatccagggcatgctcgatgacctggaggccatgaaccggcacaccctgaaggtcatccacgaactggaccggctctcgctggaagtcggccagggcgtcgacgcggcggtcaccgccctgcaattccaggacatgggcagccagttgctcggccagatgcgcaagcaccatgcgcgtcttggcgccttcgccctcggcctcggcgcgctggaggcgcggccgcgccaggaatggcccgaacgggtcgcgcgggaggtcgaggaactgcgccggcccttgcccagcccggtgagccagaacagcgtcaacgtgggcgaagtggaattgttctga

SEQ ID NO: 12063 - DNA, 522 bp, Pseudomonas aeruginosa
tcagttccttcctcgaagcccgcgacgtgttgcagcgcctgctcgacgcccatcgcagcggccgtcccgaccccggggtgccgttgctggagacggtcgagcgcctgcgcggctggctgcgggtgccggaacaggaagcggcggaggaaggcttcggcctgttcgacgacgcgcccgccagtcccgccagggaaaccgcggacgacgatgccttcggcttcttcgacgaaggcccgggcgctccggaacgagcggccgcgccgggagcgttcgggctcttcgacgaggcgcccggcgcaccggccgcgagcgaagcgttcggcctcttcgatgaggcaccgggttccccaccggcggaggaacgcgccttcggcctgttcgacggcgcccccggcagccccgccgcgcccagtgcgcccgcgcaagccgtcgccgcgacggccaggggcgcagtcgcgccagtgcgtggcgacggcgagtccggctcgatccgggtcagcgtggaaaagatcgacagcctga

SEQ ID NO: 12064 - DNA, 537 bp, Pseudomonas aeruginosa
ttctcgacgtcgatgcgctgccacgcctggcggcgcgggaggacaccgccgatgaacggcactgaggcaagccaggcgaacggcccggcgcaggaatacctgaccttcaccctgggccgcgaggagtacgccatcgacatcctccgcgtgcaggagatccgcggctacgaccaggtcaccgcgatcgccaacgcgccgcccttcatcaagggcgtgatcaacctgcgcggggcgatcgtgccgatcgtcgacctgcgcatcaagttccacctcgccgaggtcacctacgacccgttcaccgtggtgatcatcctcaacatcggccggcgcatcgtcggcgtggtggtggactcggtatccgacgtgatcgcactgggcggcgacgcgatcaggccgccgccggagttcggcgccagcttcgacaccgaatacctgctcggcctggccaccgcgggcgagcgcatgttgatcctggtggacatcgagagactgatgaccagccgcgaaatggcgctggtcgacgaagccgcggcctga

SEQ ID NO: 12065 - DNA, 2091 bp, Pseudomonas aeruginosa
tgcacatctgcacaattggccctttcgccaaaagttcgacacacgctttcgatccatgatttcggccgcgggccgggcgagaaactgatagggatagccatggcggcgaactgggggttgcgcggcaaatcggtggtggcgctgttgctggcctgtgccctggcactggtcccggcggtgctgctgggctggcgcgcgatggacgacatccgtacgcacttcggcctggcctacgcgaagaacttcaccctgctgcaccggcagaagatcctcgccccggtctcccgcgaactggcgttgtcgcgccgtttcgccgaatcggtggtgacccgcgactggctgctgaaggaagacgacccggcgcgccgcgcgctgttcttccgcgaggccgagggctaccgcggcgacttccgcgaccacgcctacttcatcatcgccagcggctcccaccactactacttcaacgacggccgccaaccctacagcgaacggccgcgctacaccctggaggccggcgacccggaagacgcctggtacttcaataccctgcgcaacagcgccgcctacaacatcaacgtcaatgtcgacagcaagctgaacctgaccaaggtctggttcaacctggtgatccgcgaccagggccggcccatcggcctggccggcagcggcctggacctgagcggcttcctcgacgacttcatcatcgcccgcgagccgggcgtgacgccgatgatcgtcggcgacgacggcgccatccaggcccacccggaccgccgcctgatcgcctacagctccgccgccggcggcgccagcgaacgccaccgggtgttcgacctgctcgaccagccggaacagcgcgacgccctgcgcgaggccatgcgcctggcccgcgccaaggccggctcggtgcactgcctgtgggccggcctcgacggccgccagcaactcttcgccgtggcctacattccccaactgcgctggtacgtgctcaccgccgtcgacctgcacgccgcccaggtcctcgacaaccgctggctttggccgctggcgggcacgttcctgctgttgctggtggccctgctgctgggcttcgcctatgccgtcgagcgcctgctgttgcgccccctgcgcagcctcaagcgctcggccaaggcgatcgccgccgggcgctacgacacgccgctgccgctggcgcgccaggacgagatcggctcgctgtcgaaggccttcgccagcatggccgaccaggtccgccggcacaccgccgagctggaagacaaggtccaggagcgcacccaggcgctggaggaagccaaccgcgagatggccgccgcgcagaagaagatcggcgacagcctcgactatgccagcctgatccagcgcgcgatcctccccgaccgccagctcagcgccaccctcggcgagcatcacttcatcctgtggaaaccgcgcgacgtggtcggcggcgacttctacgtgtaccgcgagcaggccgacggctacctgatcggcgtggtcgactgcgccggtcacggcgtgcccggcgcgctgatgaccatgctcgcccgcgccgccatcgaccacgccatcgaggcggtgggcagccgcgacccggcggcgatcctcggcgagaccgaccaggcgatgcgcagcatgctcagccaggagcagatcccccaggcgctggccaccaacatggatgccgggctggtctgggtcgaccgccggcgccgccagctggccttcgccggggcgaagatctcgctgtacgccagcgacggcgaggaggtccaggaactcaagggcgcgcgccgggcgataggcgacaagcgccgtggcgactaccgcaacatcgaggtaccgctggcgccgggctggaccttctacctgagcaccgacggtttcctcgaccaggccggcggcgaacacggcttcggcttcggcagccggcgcttcgccgacatgctccgcgaccacgcgcggcagccgctccccgagcaggccgaggccttcgtggcgacgctcgccgagtaccagggcgagcacccgcaacgcgacgacatcaccatcctgtccttccgattcgactag

SEQ ID NO: 12066 - DNA, 741 bp, Pseudomonas aeruginosa
actgttcggccaggtgatcgactgggtcgagcgcttcctcgccgccgggcagcggccgctggaactggacctgcgcctgctgtacctgaacaccagttcgatcaaggccatgatggacatcctcgacctgctcgaagaggcccaccagggcggtcgcccggtcagcctgcgctggcactacgaccggcgcaacgaacgggtcgccgagctggccgaggagttccgcgaggactgcagcttccccttcgccatccaggcccacgacgagtagccgacgatgagccgcgaacgcgaactggacgcctggatcgacggcctgctggccgatccgcagttccacgggcatccgctgcaccaggcgctggcccgcctgcgccagcaatcgctggagcaactggtgcggctggagcgcatcgcccggatctccgacggtttccagtcgatggcgcgggagcagaacctgtcgctgtccgagcgctaccacaagcagctgcggcgcctggaaaaggtggcgcggatctccgaccgctaccagcagatgatgcgcgacctcaacctggcgctgaaggaagcctcgatccgcgacccactgaccggcctgcccaaccgacgcatgctgctggagcgcctcagggaggagaacgaacgctcccagcgccacggccagagctacgtgctggcaatgctcgatgtggacttcttcaagcaggtcaacgatacctggggccacgacagcggtga

SEQ ID NO: 12067 - DNA, 411 bp, Pseudomonas aeruginosa
ccgggtgctggtggaaatcgcccgggccatggagtccgagctacgcgaatacgacctctgcggacgctggggcggcgaggaattcctcctgctgctgccgcagacccgcctgcaggacgccggcccggtactcgagcgggtgcgcgacagcgtacggaccctggcggtacgcgtcggcaccgaggcgctgagcgtcaccgccagcgtcggcgttaccgaacaccgcatcggcgaaacctattcgcagaccgtcaatcgcgccgacgccgcactgctcgacgccaagcgcagcggccgcgacaaatgcgtgttcgccgcgctcccgccgcttcctgccccttcccgcccggctccagcgcgctgagcctcctcaggcgtccagccgctgcagccgcacctggcctcggctga

SEQ ID NO: 12068 - DNA, 1266 bp, Pseudomonas aeruginosa
acgcctgcgcctcgtcctcgtcggccaccggcgcggcgatggtgtggaagcggctcttgcggatttcctcgcggtattcggcgaggccttgcagggtgctcggcatcgcgttcaggccgccggcggggtcagtccgcagcccttgaggatgatccgcaccaggttgtcggcggcggcggcgaagtcctgcctggacatgcgcttgcggccggtgaccaggccgatctggctggcgaagtcggcgtagtgctgggtgctgccccagagcaggaagatcaggtgcacgggatccaccgggtccatccggccggcggcgatccaggcctcgaataccgcggcgcgaccgcggaaccagctgcggtagtcctggttgaaatgcgcggtgaggcactctccgccgctgatgatctccatggcgaagatccgcgaggccagcgggtagcggcgggagaactccatcttggcgcggatgtagcgggccagcgcctcggccggatcgtcgtcgacgccgagggtgttgaaggtactgtcccagagttcgaggatgttgctcagcaccgccgtgtagaggcccagcttgttgccgaagtagtagtgcaggttggccttgggcaggccgacgttctgcgcgatggtgttcatgctggtgcccttgaagccgtggcgggcgaactcctcctcggccgcggcgaggatcgcctcctcgttcttctggcggatgcgcccggccggcttgtcgcgggcggccgggtcgtgggcgggcactgtcagggtcatgcgcaggtttccatcggcgtgatccccgcgttgataccccagcccggccgcgggacacaagccaggcgcggaaaaatttgcaaacgcccgtatcaacccagcggcttgcgccagcgcgccagggcgccgcccttcgcgctggcctgcgccgcttcggcaacgcgctcctcgggcagcagcaggttgagcaggatggcggtgatgccgccgctggtgatcgccgagtcgaacagggtcttcaccaccgccggcatctggtcgagcagggtcggctgcgcggccacgccgaggccgacgccgaacgaggcggcgatgatcagcacgctgcggcggtccatcgcggtctggccgagaatgcggatgccggcggcggcgacgctgccgaacatcaccagggtggcgccgccgagtaccggcttggggatctgctggaggatcgcgccgacccaggggaacaggccgagcgccagcaacacgccgccgatatag

SEQ ID NO: 12069 - DNA, 747 bp, Pseudomonas aeruginosa
atcagcgccaccggcaggaaggccatccagtcgaaggcgaagccgaagcggaacggctgcggcaggctgaccagcggcagctcgggcaacgcccgcggaacgaacaggccggtcgcccaggccgccagggtacccagcgccaggccgatgacgatggcggccaggcgcagccagggcaggcgcgagcggttcagcaggacgatgctcagcagcaccagcgcgcccagcgcgagattggccggtgcgccgaagtccgtggccccggctccgccgccgaggtcggtgatgccgaccttgatcaggctgacgccgatcagggtgatgacgatgccggtgaccagcggcgtgatcacccggcgaagatggccgaggaaacgactgaggacgatctgcacgaaggcgccgaagaagcacacgccgaagatcatcgcgaggatctcctcgggaccgccgccgcgctgcttcaccagcatcccggcggccagcacggcgccgaggaaggcgaagctggtgccttgcaggcagatcatcccggcgccgatgccgaacggccggcgcgcctggatcagggtgccggcgccggaaaccatcagcgccatgctgatcaggtatggcaggtgctcgccgaggccgagcagcgagccgatcaccagcggcggagtgacgatgccgacgaagctggccagcacgtgctgtagcgcggcaaggaaggcgggaagcgggcgcggccggtcgtcgaggccgtag

SEQ ID NO: 12070 - DNA, 888 bp, Pseudomonas aeruginosa
ccctgccagactctgccgactagcgacacgacgccaagtcatgacgatgaacggacagcctgcggaactgcaccgcccgattcccaccctcgcccgcctgccacggccggtctacgcgcgcgccgaaagcctgcgcgccggctcctggacctcgcgccaccggcacgcctgggtacagctttcctacgccatcagcggcgtgctcggcgtacataccgccgagggcagcttcttcgccccgccgcagcgggcgatctggattccggcgcagctggaacacgaggtggtcacctccacccgcgccgagatgcgcagcctgtacatccgtggcgacgcctgcgcctgggcgccgacgcgctgccgggtgctggaggtgacgccgctggcgcgcgagctgatcaagagtttctgcgagttgccggtggactacccggagggcgacagcgccgaatcgcggctggtgcaggtgctgctggaccagttgcggctgctgccggaggtcgccttctccctgccgatgccgcgcgagccgcgcctgctgcggctgtgccaggcactgatcgacgaaccgacccagagcctgaccatgggcgactgggcgcagcgcctgggcacctcggaaaagaccctgtcgcgcctgttccagcgcgagaccgggatgaactaccggctctggcgccaacgccagcgcctgctcgcctcgctcaacgcgctggaggccggcgacagcgtcaccggcgccgccctggacagcggctacgactcgacctcggcctacatcgccgccttcaagggactcttcggcttcactcccggcgaactgttccgccagcgctgagcccggcgaagggcccagcgcgcggggctcagaacacgtcgatgggatag

SEQ ID NO: 12071 - DNA, 1245 bp, Pseudomonas aeruginosa
aaccgcccttcatcgcgcatcctcgtcgagtttgatcttctggccgggcttgaggctgtagactccggcgcggaccacccggtcgccgtcggccaggccctgtccgatcaccacctggcgttcgtcgcggctgagcacctgtacctcgcgcagggccacgctggactgtttcccatcgacgacccagacctgggtcttgccgtcgcgctccagcagcacgctggccggcagcacgctgcgcacgctaccggcgctgctcagctggacctggatggtcgaaccgaggcgaaacgcctccggcgtctgcgccaggctcaggcgcacgcgacgggtgcgggtcgaggcgtcggcctgcggacccagctcgcggatgctgccggtggtcctggcctgcgggtcgagctgggcgctgaccaggaagcgcgcgtcggccggcaggctctcggcgacctcggtgggcaggtcgaagactgcctcgcgcacttcgggccgggccagggtgaccaccgcctggccggcgctgaccacttgcccggcctcggcgtgccaggtggtgatgacgccgtcgaaatcggtcaccaggcgcgtgtaggaaagctggtccctggcctgctgcaccgccgctttggcctggtcgaagctggcctggctggtcttcaggcgggtccgcgcatcgtccaggcgcgcctgggcagtaacgctgcgggcgaacagttcttcctggcgccgggcattggcctgggcgtcgatcaactgtgcctcggcgctggccaggtcgccctggctggcgcgcaactggttctgctggtcggtggggtcgagggtcgccagcagcgcgcccttgccgacgaagtcaccgacgtcgaacaggcgcgaggcgatccgtccgttggtgcggaagccgagcacgctctcgtagcgcgcctggatgctaccggcgaagcgaccgaggtcgtcgttcttcagggtcttcacggtcaccgtcagcaccggccgcggcggtgccggcggcggctcgtcgccgcagccggagaggagcagggcgaagccgaacaggccggcgagggaaaacggcttcatggctggcctccgcccacggcgtcgcggctggcggtgctctgggtcggctgcggcggctgggccacctcgaccacctggcccggatggagcagttggccgcccaccgtgaccaccgtctggcccgcctccaggccaccgtcgatgaccaccttctcgctggcgtag

SEQ ID NO: 12072 - DNA, 879 bp, Pseudomonas aeruginosa
tactgtcggggctacccatcgccctccgggagtaatgtcaggtacccatcggcgggttctgggtacgcccttgccgctccggcaagggcgcccttccttcccgcgcgatcgatgcgcctagaagtcaaagaacaccgtctcgttgtcgccctggatgcggatgtcgaaacggtaggcgagctgtccgtccacttcgcagcgctgcgcgagcagggtgtcgcgacgcggcgcctgctcgatcaggttgagcaccggacaggcggcgttggcctcggtctcgtcatcgaagtacagccgggtctgcaagtggatgttgatgccgcgggcgaacagcgagacgttgatgtgcggcgccatcggcacgccctgggcgttacgcaccacccccggcttgaccgtgtgcagggtccactcgccggcatcgaaggtggtggcggtgcggccgaagctgttgaacggtcgctccggatcgtagcgctcctggtagcggccttcgctgtcggcctgccagaactccaggaacgagtcgcgcaccaggtggccgttgccgtcgtagacgtggccgagcaggaggatgtgctggcccggcgcgtcttcgcgggccatgcggttccagatctccaggtcacgggtcgggttgccggcggcggccagcgccaggccgatgtggacatagggaccggcggtctgggaaggggtttcccgcagcagttcgtggctcatggtcggctcctcagacgttctcgaagaaggtcttgcgctgcccgcgcaggacgatgtcgaagcggtaggccaggcaatccatcgggttggccatgctcatgtcgagccggccgatcaggctctgcgccgcctccgggtcggcaagggtgcggatga

SEQ ID NO: 12073 - DNA, 1335 bp, Pseudomonas aeruginosa
ccatttggttatgctttatcagtgcaactcggcggccacctcgcgcaacaccgcgctgaaccattgcgcccccagcggcaacggcaaggccgcgttgtggcacagcccgaccgaaccgcccggttcgcggatacccaggtccagctcggccagctcgccgttgccgacgtccaggcgcacggcatcgcgcggcgccacccagatcgcctcgctgcgcaacacatagctgcggctgagggtcggcgagagggtttccaggcgctgtccggcgagcgcgatgccccattgcacgaacaggctgtcggcgtggcggcggatggtggtgccggccagcggcagcaccagtgggaattcggccagccgctgcaggtcgccgaggggcgcggcgagcaaggggtggccgggacgcaccaccagcatcatcgactcgctgtacaggtgctcgaaggtcaggccctggatgtccgggctatcggtcatccgcccgaccaccaggtccagctcgccgaccttcagttgcgccagcaggtaggcgctgggtccggtggcgacgctgaccaccagcgcaccgtggcgccggtgcaggcgccggatcacctcgggcaccaccaggctctccaccgtcgacagcacgccgacccgcaccgtctcgacctgcgcctcgtggccgcgcagggtgttcaccccgtcgcgcagggcctgcacgcaggggccggcatagcgcaggaaggtcacgcccgcctcggtcagctcggcgccggccttgctccgttcgaacaggcgcgcgccgaggatttcctccagttccttgagggtcttggagatcgccggctgcgacaccgccacggcatccgccgccttggcgaagctgcgctggcgggcgacttcgaggaagcaggcgaggtggcggaacttgatgcggttgtcgaggttcatggggcggccgtggcggcgagtggtgcgggcatggtacccaacgggcgggttgggaacgaggtgtggcgtgcggcgaggtcgtgccaggcggttctccgccttcctttccccaaagggagaaggcactggatggcggaacgactcacgcgccgggcaatcccttccctgggggaagaaggaaccggatggagcatggtcgggcagcatcgcgccgacccttcgcccttcaggggggcctccacgtccaggaggacgccggggaaccccacctggagcgagcgccgactcagaactccaccgtcgtcgacacctggaactgccggggctcgcccatcgccacgtacagtcgattggcactggacgggtagtaggtgcggtcgaacaggttcttcacgttga

SEQ ID NO: 12074 - DNA, 1191 bp, Pseudomonas aeruginosa
  unsure (470): Identity of nucleotide at the above locations are unknown.
cgcgggtcgccccggcgccgcgacggacctcgaactcggtgcccagtacccgcgcccgaccttcgccggcctcgaccacgaatggcagcgcgtcgcgcttcacccgcaacgcggcggcgccgcgcagcagttcgacccgccgctggccgccgtcgatacgcacgcgcaccgcgctgccggcgtccaggctcaggtaggagccatcggccagcttccattcggcgacctgtcccggcgcggcgacatagtcggcacgccagtcctgcagccagtcgccgggctgccaccagccgcccagccagagcatcgccagcaggcaggcgacgctggccagcgggtaggcccagcgccgcgggttgcgcgacgctcggcgcggccgcaggtaggcttccagggcatcggcctcttcgatggccaggcggctcgccggtatttccgtcaggcgccagagcgcctcggcgcgggcatangcctcggcatgcgccggccgctgcgccagccagtcctcgaaggcccgccgggtcgccgcatccggcgtaccgcgcaggcgcaccagccaggcctgggcggtctgctcgaggacgggctcgtagggcgcggcgtcgctatcgggtcgggtcatggctgggcgctccttgcctgctcgccggccgggccggccaggctcgccttgcaggcgtcgagggcgcgcatcatatgtttttccacggcgctttgggaaagctgcatggcctgggcgatctccgcgtaggtgcggccgtggatgcgattgagcaggaaaatccgccgggtccgctcgggcaggccgcgcaaggcggcctcgacccggcgccactggtcgccggcctcgagcgcctgctcgggactgaccggctcgccctggcgctgctccggcagccaatcgtccagttgccgttgccgcgatccttcgccacgcaagtggtcgatggccaggttgcgcgcgctgcgcaggaggtagctgccaagctcctccaccggggcggccgggcgccgccagaagcgcaggaacagctcctggaccaggtcggcggcggtcgcccggcagcagacccagcggctgaccaggctttccatgcgctggcgctgggccaggaaggccttgaggagatccgcgcggcgcgccgcatcgccgtctgccggcaaggcatccgggcgcgggccgggaggtag

SEQ ID NO: 12075 - DNA, 678 bp, Pseudomonas aeruginosa
tcctggacaacaacggccccatccgggaggccggcctgcaagaggcatccgatgaaccgatccaagggttccagcagccgtcgtaccttcctgcgcctggcagccctgctgctgcccgccggcgccctgctcggcagcctgccgggtgtacgcgccgcggccaggccgcggaaactctatctggccggtcccgatgtgttccgcgccgacgccgtcgcccacggcgaagcactcaaggcactgtgcgcacgctacggtttcgagggcctctacccgctggacaacgcgctgccgaaacagctcgccgagccgcgcgaacaggcggcctggatctaccgcgccaacatcggcctgatcgaacgcgccgacgcggtgctggccaacctgaacttcttccgcggcgccgagccggacagcggcaccgccttcgaggtcggctatgccaccgccctcggcaagccggtctatggctacgtcgacgacgccggcagctacgccgagcgaatccgccggcacgccccggagctgatcggcgaggatccgacccgcgaccgcgacggcatgaccctggaagagttcggcctgccgctcaacctgatgctgtcggtgcccggcaggatcgtcgtcggcgacgccgagcaggccctgcgccaactcgccagccggcgccacggctga

SEQ ID NO: 12076 - DNA, 429 bp, Pseudomonas aeruginosa
catggggcggctcctggtggggaatgccacagtctagccagttgcgggccacgcgccgacctatgcgaaccgacagaggaagcctggcgcctcctctgtcggcgcccgcctcacccggcgatcagggcgctcgccgcctcgcggtggcgggcgatcagggcggccaggtcgagcccttccacggcaccgtcgaccactcgccaggcgccgccgaccattacccggtcggcacggtcggcagcgcacagcagcagcgccgagagcgggtcgtggctacccgagaagcgcagctcgtcgagcttgaacaaggccaggtcggcctgcttgccgggggccagctcgccgatgtcgctgcgcccgagcaggcgtgccgagccacgggttgcccagcccagggcgagttccggggtgatccgctcggcgccgtag

SEQ ID NO: 12077 - DNA, 273 bp, Pseudomonas aeruginosa
  unsure (233): Identity of nucleotide at the above locations are unknown.
cgcaggcgttgcaggtacagggcctggcgcgcctcgaggatcatgttcgaggcgtcgttggaagccgagccatcgactcccaggccgatcggcgcgccggccgcctccagctccacggtcgggcagatgcccgaggccaggcgcatgttcgaactcgggcaatggcagataccggtgcccgcctcgccgagccggcggatctcctcggcgttgaagtggatgccgtgggccanccaggtgcgcgggccgagccagccgacgctatccaggtag

SEQ ID NO: 12078 - DNA, 1155 bp, Pseudomonas aeruginosa
  unsure (248): Identity of nucleotide at the above locations are unknown.
tgggggtcaacggacgcctcccggcaggggcatagagtgggggactgcatagctgaaaacgtagaacggaaggagtcccgcatgagcgaagaacccactgtcagtcccccctcccccgagcaacccgccgcgcagccggccaagccggcccggccagccgcccgccgcgccccgcgcaagccggcgacccgccgcccgcgagtggccagcccggcgcagaaggcccgcgaggagatccaggcaatcanccagaagccggtggccctgcaggtcgccagtgcgccccacggcaacagcgaggacagcacctcggcgagcctgccggcgaactatccctatcacacgcggatgcgccgcaacgagtacgagaaggccaagcacgacctgcagatcgaactgctcaaggtgcagagctgggtgaaggagaccggccagcgcgtggtggtcctgttcgaaggccgcgacgccgccggcaagggcggcaccatcaagcgcttcatggaacacctgaacccgcgcggcgcgcggatcgtagccttggagaaaccgtcctcccaggagcagggccagtggtatttccagcgctacatccaacatctgcccaccgccggcgagatggtcttcttcgaccgctcctggtacaaccgcgccggcgtcgagcgggtcatgggcttctgttcgccgctgcaatacctggagttcatgcgccaggcgccggagctggagcgcatgctcaccaacagcggcatcctgctgttcaagtactggttctcggtgagccgcgaggaacaactgcggcgcttcatctcgcgccgcgacgatccgctcaagcactggaagctgtcgcccatcgacatcaagtctctggacaagtgggacgactacaccgccgccaagcaggcgatgttcttccataccgacaccgccgacgcgccgtggacggtcatcaagtccgacgacaagaagcgcgcgcgactcaactgcatccgccacttcctgcactcgctggactacccggacaaggaccggcgcatcgcccatgagcccgacccgttgctggtggggccggcctcgcgggtgatcgaggacgacgagaaggtctacgccgaggcggccgccgcgccgggccacgcgaacctggatatcccggcctga

SEQ ID NO: 12079 - DNA, 1110 bp, Pseudomonas aeruginosa
tcgaagaacctgccctcgtcagtgcccggccttccacggctggcccagggaaaccggggcatacagccgggtgcgcagggcatcgcgggagagcaggaccagcaccaggatggtcgccgcatagggcagcatcgccagcaggttggccggaatcgacagcccgatcccctgggccaccaggtgcaggatgctggccaggccgaacaaccaggcaccgagcagcacgcggaacacccgccaactggcgaagaccaccagcgccagggcgatccagccgcgtccggcggtcatgttctccgcccacatcggcgtgtaggccagcgacaggtaggcaccggccaggccggccatggcgccgccgaagagcaccgccagggtgcgcacgcgcagcaccggcaggcccatcgcgctggccgcgtcggggttctcgccgaccgcctggagaaccagcccggcgcggctgcgcaggagcatccaggcgaccgcggcgaacagcgccaggctcaggtagaccagcgcgtcctgggcgaacagcatgcgcccgagcagcggcaactcgcccagcaccggcagcgccagcggggcgaacccttgcagcggcttgccgacccaggcggcgccgacgaacgacgacaggccgacgccgaagatggtcagcgccagcccgcaggccacctggttggcgttcaggtacagggcgaccccggcgaacagcgccgccagcagcatgccggcgagcaccgcgaggagcacgccgagccacaggctgccgctggagaaggcgaccatgaagccgatcaccgcgccgaacagcatcatcccctcctggcccaggttgagcaccccgcttctctcgcagaccagttcgcccagggccaccagcagcagcggagtaccggtgcggaccatggcgaacagcaggttgtcgagcagatcgatatccatcgtggttcctcggcggttcggctcaggccagggcgtcgcgcagcgccgggcgcttgcgccagcgtccgtgcaaacgtgggcggtagaggatcagcacgtcgcaggcgaggaggaagaacagcatcatcccctggaacagcccggacagcgccaatggcaggttga

SEQ ID NO: 12080 - DNA, 810 bp, Pseudomonas aeruginosa
gcggctgtaccagcacggtatgcagggtctgccagggatcgtggccgagacaggcgaacagtagcgcaccgcagaccagggtcagcagccccgccagcagcggagaggccagcagcatccagcgtgactgtcggccgcgcggttccagggacaacagcatcacaggctcccttgggcaacggcgccggcgactgccgccggcgcctcgaattgaccggccatccagccgccgacctgctgcggcgaagcgctcgcggtggcgaccgccgggcacagccgacccgaacacagcgcggcgatgcggtcgctgagcaggaacagctcgtcgaggtcctcggagaccaccaggatcgccgtaccggcatcgcgcaaggcgatcagcgcgcggtggatcagcgccgccgcgccgacgtccacgccccaggtgggatgcgccgccaccagcaggcgcggggcctggaggatctcgcggccgaggatgaacttctgcaggttgccgccggaaaggatgcgtgccggcgccccggcacccggggccttcacggcgaaacggcggatgatctcctcggccagcgccagcaccttgcgccgccggaccaacccgcgcttcaccagtccctgctggaaggcggtgagcagcgcattgtccgccaggctcatctccggccaccgcgccgtgccccagccgctcggcgggcacgaaggcctggccggcgcggcgccgcgcatccggcgccaggtgcgcgccggcgcaggcgcctaggcggatgcgctcggcctgggcgcgcggcaggcgcacttcgccgctga

SEQ ID NO: 12081 - DNA, 1740 bp, Pseudomonas aeruginosa
accgcattggctggtgatgcggaatcgggcccttccgggcctttgactacaggtatgaacatgagcgaaagcttcgcaaaactctttgaagaaagtctgaaatccctcgacatgcagccgggtgccatcatcaccggcatcgtggtcgacatcgatggtgactgggtcaccgtccatgccggtctgaaatccgagggcgtcatcccggtcgagcagttctacaacgaacagggcgagctgaccatcaaggtgggtgacgaagtccacgtcgcactggacgcggtaaaaaacggctttggcgagaccaagctgtcccgcgagaaagccaagcgcgccgagagctggattgttctggaagcggctttcgctgccgacgaagtggtcaagggcgtcatcaacggcaaggtcaagggcggtttcaccgtcgacgtcaacggcatccgcgcgttcctgccgggttcgctggtcgacgttcgtccggttcgcgacaccacccacctggaaggcaaagagctcgagttcaaggtcatcaagctcgaccagaagcgcaacaacgttgtcgtttcccgccgcagcgtcctggaagccgagaacagcgccgagcgtgaagctctgctggaatcgctgcaggaaggccagcaggtcaagggtatcgtcaagaacctcaccgactacggcgcattcgtggacctgggcggcgtaaacggcctgctgcacatcaccgacatggcctggaagcgcatcaagcatccgtccgagatcgtcaacgttggcgacgagatcgacgtcaaggtcctgaagttcgaccgcgagcgcaaccgtgtatccctgggcctgaagcaactgggcgaagacccgtgggttgccatcaaggcgcgttacccggaaggcacccgcgtcatggctcgcgtcaccaacctcaccgactacggctgcttcgccgagctggaagagggcgtggaaggcctggtacacgtctccgaaatggactggaggggggggaacatccatccgtcgaaagtcgtccaagttggtgaagaaatggaaattcaggttctggacatcgacaaaaacgtcgtcgtatctccctgggtatcaagcagtgcaaatccaacccgtggggaagacttctccagccagttcaacaagggtgaccgtatctccggtaccatcaagtcgatcaccgacttcggtatcttcatcggtctggacggcggcattgacggcctggtccacctgtccgacatctcctggaacgaagtcggcgaagaagccgtacgtcgcttcaagaagggcgacgagctggaaaccgtcatcctgtcggtcgacccggagcgcgagcgcatctccttgggcatcaagcagctggaagacgatccgttctccaactacgcgtccctgcacgagaaaggcagcatcgtccgcggtaccgtgaaggaagtcgacgccaagggcgctgtcatcagcctgggcgacgacatcgaaggtatcctgaaggcttccgaaatcagccgtgaccgcgtcgaagacgcgcgcaacgtcctgaaggaaggcgaggaagtcgaagccaagatcatcagcatcgaccgcaagagccgcgtcatcagcctctccgtcaagtccaaggacgtcgacgacgagaaggacgcaatgaaagaactgcgtaagcaggaagtagaaagcgctggtccgaccaccatcggtgatctgatccgtgctcagatggagaatcagggctaa

SEQ ID NO: 12082 - DNA, 1365 bp, Pseudomonas aeruginosa
gttcccgttgtgcggtcgcaggcgcgggcaggtaaaattgaggtgagttggaaaatgatagatgttaacacagtggtagagaagttcaaaagccgacaggccttgattggtatcgtgggtctgggttatgtcggtttaccactgatgctgcgatacaacgccattggtttcgatgtcttgggtatcgatatcgatgatgtcaaggttgacaagcttaatgccgggcagtgctatatcgaacatattccgcaagccaaaattgctaaggcccgtgcaagcggtttcgaggctacgaccgatttcagccgtgtcagtgaatgtgatgccctgatcctttgtgtgccgacgccgctgaacaagtatcgcgagccggatatgagctttgtcatcaataccaccgacgcactaaaaccgtatctgcgcgtagggcaggtggtttcgctggaaagtaccacctatccgggaactaccgaggaagagttgttgccacgcgtgcaggagggtggcctcgtggttggccgggacatctacctggtctattctccggagcgtgaagatccgggcaacccgaacttcgagactcgtaccattccgaaagtgatcggtggtcacactcctcagtgtctggaagtcggcattgccctgtatgaacaggccatcgaccgggtcgtgccggtcagttccaccaaggccgccgagatgaccaagctgttggagaacattcatcgcgcggtcaatatcggtctggtcaacgaaatgaagatcgttgctgatcgcatgggtatcgacatctttgaagtggttgatgctgcggcgaccaagccgttcggtttcactccttactacccagggccgggactgggcgggcactgtatcccgatcgatcccttctacctgacttggaaggctcgcgaatacggactgcatacccgcttcatcgaactgtctggtgaggtcaaccaggccatgccggaatacgtactgggcaaactcatggatggcctgaacgaggcaggcagggccctcaagggcagtcgtgtactggtattgggtatcgcttataagaagaatgtcgacgacatgcgcgagtcgccatccgtggaaatcatggagctgatcgaagccaagggtgggatggtcgcctatagcgatccgcatgtgccggtgttcccgaagatgcgtgaacaccacttcgaactgagcagtgagccgctgactgccgaaaacctggctaggttcgacgctgtagtgcttgcgaccgaccatgacaagtttgactatgagctgatcaaggccgaagccaagctagttgttgacagccgtggcaagtaccgctccccggcggcacacatcatcaaggcttga

SEQ ID NO: 12083 - DNA, 1953 bp, Pseudomonas aeruginosa
aaaaggaggtggccgtcctcggtcacctgtttacagcaggtttccgcaggatcattcatcagcatgtcatctagtagctctaaattgctgaacggtatggtcgcggtaagttcaggcagaaacattcggctggatgtccaggggctgcgggctgttgcagttctggctgtgctagcttaccacgccaacagtgcctggctcagggctgggtttgtcggcgttgacgtgttcttcgtcatttccgggtttatcattaccgccttactggtcgagcgcggtgtaaaagttgatctggtagagttttacgcgggccgtatcaaacgtatttttccagcctatttcgtcatgttggcgattgtctgcattgtctcgacaattctgtttctgcctgatgactatgttttttttgaaaaaagtctacagtcatctgtatttttttccagtaatcactatttcgctaattttggtagttactttgctccgagagctgaagagctgccgctgctgcatacttggtcgttggccatcgagatgcagttttatctgttctaccctgtactgttcatgtgcctgccatgtcgatggcgcttgccggtgttcatcctattagctattttgctgttcatttggagtggctattgcgtattcagcggcagccaagatgctcagtacttcgccttgctagctcgtgtacctgagttcatgtcgggagctgttgtcgcattatcattacgtgatcgtgagctacccgccaggcttgcgatacttgcggggttattgggggcggcgttgctggtctgctccttcattatcatcgacaagcagcactttcccggattctggtcgctcctgccatgcctgggagccgctctgctcattgctgcccgacgtggccctgccagcctgctgctggccagcaggcccatggtctggataggtggtatctcctattcgttgtatctgtggcactggccaattctggcattcatccgttactacaccggccaatacgaattgagcttcgtggcgctgttggcatttctcacaggttcgttcctgctggcctggttctcataccgctacatcgagacacctgccagaaaggctgtgggtctgcgccagcaggcgctgaagtggatgttggccgccagtgtggtagctatagtggttacggggggggcgcagttcaatgtgttggttgtggcgccggcgccaattcagttgacgcgctacgctgcaccagagtcgatctgccatggtgttcaggtaggggagtgcaagcgaggcagcgtcaatgccgtaccccgtgtgctggtgatcggtgatagccatgctgcgcagcttaactacttcttcgacgtggttggcaacgagtcaggtgtggcttaccgagtactcaccggaagcagttgtgtgcctatacctgctttcgatcttgaacgtttgccccgttgggcgcggaaaccctgccaagcgcagattgatgcagttgcccaatcaatgttgaactttgacaagatcattgtggcgggcatgtggcagtatcagatgcagagtccggcatttgcccaggctatgcgtgccttccttgtcgataccagctatgccggcaagcaggtcgttctactcgggcagataccgatgttcgaatcaaacgtgcagcgtgtgcgtcgtttcagggagctgggtttgtcagctccgcttgttagctccagctggcaaggtgcgaaccagcagttgcgtgctctagccgagggtattccaaacgtacggttcatggatttttctaccagcgccttcttcgccgatgctccttatcaggacggagagcttatttaccaggatagccatcaccttaacgaggtgggggctcgccgctatggatatttcgcgagccgtcaattgcagcggctgtttgaacaaccacaatcgagtgtgagtctcaagccatga

SEQ ID NO: 12084 - DNA, 1338 bp, Pseudomonas aeruginosa
gcagtccctgctaactgtaatgcttggctctggtgttttcttgatgctgcttttccttgcgctaatttcttttccactcaagatgtctttaggaaaaactctatgagtgcggcttttatcaaccgtgtcgcacgagtattagtaggcaccttgggagcacagctcataacgattggtgtcactctgctactggttcgtctgtattctcctgctgaaatgggcgctttcagtgtttggctatcgttcgctacgatttttgcagttgtagttactgggcgctatgagttggctattttttcgactcgagaagagggcgaactccaggcaatcgtcaagctgatacttcagttgacactattgattttcgttgccgtggcgattgctgttgttataggtagacatctgattgagtcgatgccagttgtgatcggcgaatactggttcgcattggcggtggcttcgctggggttggggataaataagctagtcttgtcgttacttacatttcaacaatcttttaatcggttgggagttgctcgtgtaagcctggctgcatgtattgccgttgcacaagtttcagctgcatatttactggagggcgtatcagggctgatctatggccagctgtttggtgtcgtcgtagccacggcgcttgcggccctttgggtaggaaagtcgctgattttaaattgtatcgagacaccgtggcgtatggtacgacaagtagcggtacagtacatcaatttcccgaagttttctctgcctgcggatctggtcaacacggttgccagtcaggtgcctgtgattttattggcggcaaagtttggtggagacagtgcaggctggtttgccctgactctgaagataatgggagctcccatttccttgttggctgcttcggtgctcgatgtgttcaaagaacaagccgctcgtgactaccgagagtttggtaattgccgaggtatcttcctcaagactttcaggttgcttgccgtcctcgcgctacctccttttattatattttggttcattggcgagtgggcctttgggttagtctttggcgaagcgtgggctgagtcggggcgttatgctgtattgatggttccgttgttttatatgcgtttcgtggtgagtccgctcagctatacaatctatattgcccagcggcagagtatggatttgttgtggcagctagccttgttgctcctgacgtttatctgttttaccttgcctgactctgtcgactcggtgttgtggttttactccatagcatatgctgttatgtattttgtctatttctggatgtccttccagtgtgccaagggagatgccaagtga

SEQ ID NO: 12085 - DNA, 1152 bp, Pseudomonas aeruginosa
gtgcttcgggaggttgttgtgatgaagatctgttcgcgctgtgttatggatacatctgacgctgaaatcgtatttgatgaggcgggagtctgtaatcactgccataaatttgacaatgttcagtcccggcagctgttttccgatgctagtggtgagcagcgccttcaaaagataattgggcagatcaagaaggacggttcaggtaaggattatgactgcatcattggccttagtggcggcgtagatagttcctatcttgctgtaaaggtcaaggatcttggcttgcgcccactggttgtgcatgtggacgccggctggaatagcgaacttgcagtcagtaatattgaaaagattgtaaaatattgcggttttgatttacatactcatgtaataaactgggaggaaattcgtgatcttcagttggcttatatgaaagctgctgtcgccaatcaggatgtgcctcaagatcatgccttcttcgctagtatgtatcactttgctgtgaagaataatattaagtacattctgagtggtggtaatttggccactgaggcagtattcccagatacatggcacggcagcgctatggatgcaataaacctaaaggctattcacaaaaaatatggtgagcgtccgctaagggactacaagactattagttttcttgagtactatttctggtatccctttgtcaaaggaatgagaacggtccgtccgttgaatttcatggcctatgataaggccaaggctgaaaccttccttcaagaaacgataggctatcgttcttacgcgcgaaagcatggagagtcgattttcaccaagcttttccagaactactatctaccgaccaagtttggctatgataaacgcaaactgcactactccagcatgattttgtctgggcaaatgacgcgtgacgaagctcaggctaaactggctgagccgctatatgatgcagatgaactgcagtttgatatcgaatatttctgcaagaagatgcgaatcacccaggctcaatttgaagagttgatgaatgcacctgttcatgactattcggagtttgccaactgggattctcgacagaggattgcgaaaaaagttcaaatgattgtccagcgtgcgctgggtcgtcgcatcaatgtctactcgtga

SEQ ID NO: 12086 - DNA, 561 bp, Pseudomonas aeruginosa
cgggccaagttcgtcggcatgaccgtgccggatgccaagcgcctgaaggatctcgaactggaaaacagccggctgaagaagttgctcgccgagtccctcctcgacatcggggcgctgaaagtggtcacccggggaaagggggagtccggcagcggggcgggggggcaggagatgcaggcgcaaaccgacatctccgagcgtcgtgcctgtcagttgttcaggctgtcccgctctgtgttgtgccaccagccgcgaactagtgtgcaaaacaccgagctgcaagcccaactggtggaactggcaagggcttcggcactttggctatcacctcctgcacattctgctgcggcgtgctggtgtgcagatcaactacaagcggatttaccggctataccgagccgtcggcttgatggtgaagcggcggaggcgccgccacaggggcgcggtggcatgcgaatgcctgagcctgccgagcgcaccgaactaggtcttgtcgatggatttcgtcttcgacgcgctcagcactgggcgacggatcaaatgcctgacggtggtcgatga

SEQ ID NO: 12087 - DNA, 189 bp, Pseudomonas aeruginosa
ctcagtccggcaagcccacgcagaacgccttcatcgtcattcaacggcaagttccgcaatgagcactgctgctgctcgctggtcgaagccagaatccgcatcgtggcctggcggcacgattacaacgagcaccgaccgtccagcgccattggcaatctcacctcgctagagtttgctgcaagttggtga

SEQ ID NO: 12088 - DNA, 342 bp, Pseudomonas aeruginosa
aggagtgcacccatgcacctaatcaaatccgctctgcttctcatcctgttcgcctgtcttccgttttcggcttccgccgcaccggtcgccgtcgccaagaatccgctggccgcaacgacacctgcgacgaccgtgtcgccgggggagcaggtcaatatcaatacggtcgacgaggccgccctgatacgggggctcaacggtgtcggcgaggccaaggccagggcgatcctcgagtatcgtgcggcccatggtccgttcgtctcggtggatcaactgctggaagtgaaaggggtaggcccggcgttgctggagaagaaccgggcgcggatcgtcatcgagtga

SEQ ID NO: 12089 - DNA, 423 bp, Pseudomonas aeruginosa
tccagaccatcggtcgtgccgcgcgcaacctgcacggcaaggcgatcctctacgccgacaacgtcaccggctcgatgcagcgtgcgatcgacgagaccgagcggcgtcgggccaagcagatcgccttcaacgaagcccatggcatcgtgcccaagggggtgcgcaaggacatcaaggacattctcgaaggcgccgtggtgcccggcgcgcgcggcaagcgcaagggcgtggccaaggtggcggaggagagcgggcgctacgagaacgaactgcgctcgccgagcgagatcagcaagcgcatccgccaactggaggaaaagatgtaccagttggcccgcgacctggagttcgaggcggcggcgcaactgcgcgacgagatccagacgctgcgcgagcgcctggtcaacgtctgatcctcagtga

SEQ ID NO: 12090 - DNA, 585 bp, Pseudomonas aeruginosa
gaggtggagatccacgagccttcctcgagggttgccgccagcgcgccctggatgtccttcagcgaggagttggtgatctggatgtcgagcaccgccatgaatgcgccgagcatggcgctgagcaccgcgatccagtcgcgccgggtcggttcgccaagcggccgggccagcgcctcagcggtcacggagctcgacctcggcttcgacggacatgccggggcggatgcggccatgcagcgggttgtcggcctcgaacacgatcttcaccgggatgcgttgcaccaccttggtgaagtttccggtggcgttgtccggtggcagcaggctgaactgcgcgccggaagcggcgaacaggctatcgatgcggccgtcgataggcgtgtcggggaaggcgtcgaaggtcaggcgcgccttctgcccgtcgcgcatgcggcctacctgggtctccttgaagttggcctggacccagatgtcttcgtccggcaccagcgacagcaaatgggtgccgacctgcacgtactggccgttgcgtgcgctgcgctggccgaccaggccgctgatcggcgaatggatcagggtgcgtga

SEQ ID NO: 12091 - DNA, 930 bp, Pseudomonas aeruginosa
ggaacaataatggggcttgatgatgcgctgatcttcacccgcgtggtggagtaccacagcttcacccaggccgcgcagagcctgggcatgcagaagtccacggtgagccggcgcatcgccctgctggaggagcgcctgggcgtgcgcctgctcaatcgcactacccgcaagttgcgcctgaccgaagtagggcaggcctactacgagcgctgccggcagatcatgcacgatttcgccgaggccgagcaggcggtcatgcagttgcaacaggcgccgtcgggattgctgcggatcacctcgccgatagagttcggccagatgttcctcgccagcctgctgggcgacttcatgcgccagtacccgcagatcaccgccgaggtcgagctggcctcgcgcagcgtcgatccgctgcaggagggcgtcgacatcgtgatcatggtcggccagccggaggattccaccctggtggcccgtcgcctgctctctaccagccgctggctctgcgccagccccgactacctggcggcgcacggcacgccgacatcggtggccgagcttgccgggcatcgcgcggtccttctgtccaccgactcccagcgctactggccgctttccggagacagcctgccctgccagcgggtgctgtcctgcaacaacatcaccttcgcccgcgaggcggtggtcgccggtgccggcattgccgcgctaccggcgctgatctgtgcggagagcgtgcacagcgggcgtctggtgcgtttgctggcggacgtgccgttgccggtcggcgaactgtatgcggtctatccttcgcggcgtttccaggcgatgaaggtcaaggccttcctcgatttcctgatcagccgcctgccggccgacaccggtcgtttactggagccggaggcggcccgcctgataacatcgcgcccctga

SEQ ID NO: 12092 - DNA, 906 bp, Pseudomonas aeruginosa
actgaggaggtgcgagatgagcagcctgacctggattcgcggtttcaacgggacgatcggccgcatcgcgccgcgttggacggccgagcgtatgcgtcggacgttcatggtgcctggcgagtggccgccgaaggattgggagctgccgctgctggccagctcggagcgcgtcactctgcgcttcgggctgtcggtgttgcgctggggagaggggccggcagtcctgctgctgcatggctgggccggcaggccgacacagttcgcccatctgatcgagcaactggtcggcgcgggttattcggtgtatgccctcgatgcgccggcccatggccgctcgccgggcagggaggcgaacgtggtgctgttcgcccacgccttgctggaggccgctggcgagttgccgccgctgcgtgcggtggtcggtcattccctgggtggcgcggcggcgttgctggcagcccagatggggctgcgcagcgaagcgctggtgacggtctcggcgccgtcgcggattctcgaacagttgcgcctgttcgctcgtttcgtcggtttgccggccctggctcgctcgcatttcatccgcctggtcgagcggcaggcgggcatatccgcggcgtgcctggatgtggcgcgctaccgtctggaaatgcccggactggtggtgcatgccgacgacgacacgcgcgtagcggtggaaaatgccgagcgcatccatgccgcctggccggccagtcgcttgctgcgcctgccgggcggcggccaccaccgactgctcggcgagcgcaggctgagcgagtcgctgctggcgctgctcgaggagcgcccggcgatgcgcgcttgccggcgcgtggaaaagacggcgagcgcttcctgaggcgcgtagcagaggggttgtcgttgtcctga

SEQ ID NO: 12093 - DNA, 966 bp, Pseudomonas aeruginosa
tggttcgtgcaaatcgccctggcgccgatggaaggtctggtggatgaaatcctccgcgacgtgctgacccgcgtcggcggcatcgattggtgcgtcaccgaattcatccgcatcaccgatcgcctgctgccggccacggctttccacaagctggcgccggagctgcgcgacggcagccggacccgcgccgggacgccgatgcgtgtgcagttgctcggctccgatcctgcgtgcctggcggataacgccgcgttcgcctgtgagctgggtgccccggtgatcgacctgaacttcggttgtccggccaagaccgtgaaccgctcgcgcggcggcgcggtattgctcaaggagccggagctgatgcacgacatcgtcgccgccgtgcgtcgcgcggtgccgagcgagattgcggtgacctcgaagatgcgcctgggctacgacagtcccgacggcgccctggattgcgcgcgggccctggccgacggcggctcggcccatgtagtggtgcatgcccggaccaaggtcgatggctacaggccgccggcgcactgggagtgggtggcgcgggtggccgaggcggtgcgcgtgccggtgttcgccaatggcgaagtgtggacgctcgacgactacctgcgttgtcgcgaggtcagcggggtggaggacatcatgctcggtcgcggcctggtctcgcgtcctggcctggctcggcagatcgccgcctggcgcgatggcggcgaaatccacgagatgccctggagcgagctgttgccgctgctgcgcgacttctggctacaggcccggcgcaagctcgccccgcgctatgccccggggcgtctcaagcagtggctgggcatgctcacgcgcacctatcccgaagccgtcgagctgttcgcgcggattcgccgggaaagcgattgcgaaaccatcgaccggctgttgcaggtgtcgttcagccaggcggcctag

SEQ ID NO: 12094 - DNA, 372 bp, Pseudomonas aeruginosa
tcgatgtattcgttgggcgatcccagccgcgaggccatcgaggatacgttgacgatgctgccgccgcgcccgccgtggcgggtcgacaggcgcttcaccgcctcgcgggcgcagaggaagctgccggtcacgttggtcgcgaataccctgtgcaggcgcgccgcgtcgatgttttccaggcgcgtctgcgcttccagcacgccggcgttgttgaccagcacgtcgaggcggccgaaacgttcgtcgatggcggcgaacagccgctcgacatcgccttcctcggctacgtcggccgccaccgccagggcttcgccgccctggcgctcgatgcgctggcgcagcgcttcggcggcctcgcggttgcgcagatag

SEQ ID NO: 12095 - DNA, 936 bp, Pseudomonas aeruginosa
agcgaaatcatcaggcagggcgccatggcccggcttgaagtcaaccgttccggcgaactggaggtgtttgcccgggtcgtcgagtcggggggcttttccgccgccgctcgacgttgcggcatgacgccctcggcagtcagcaagttgatcacccggctcgaacagcgcctgggaacccgcttgctgaaccgctccacccgacaattgcaactgacacccgagggatgcgcgttctacgagcgcggggtgcgtatcctggccgatctggaggaagccgagcggtgtgcgagcgaaaacgcggcgccgcgtgggcgcttgcgagtcaacgccaacgtgcctttcgggcatcacttcctgctgccgctgctgcccgagttcctcgcgcagcatcccgaggtgacgctggatatcgtgctgaccgatgaggtcgtcgacatcctcgagcagcgcaccgacgtggccgtgcgcgcggggccgctgaaaagctcgagcctggtggcgcgcaagctggggagcacgcgcatgctgatcgtcggtgcgccggcctatctggcccggcatggcatgccggccacgccgcaggcgctgctggggcacaaccgcctcggcgccaactatgtgcgaacgcgctccggctggccgctgcgggacgccggcgaggaactcgtggtgccgttgtcgggcaacgcccaggccagcgatggcgaggcgctgcgccgtctggccgtggccggcctgggcctggcgcggctggccgcgttccaggtgcgcgaggacatagccgccgggcgcctgattcccgtgctcgaggcatacaacccaggcgacctggaggaagtccacgccgtctacgtcggccagggcggctatctgccgctgcgcgtgcgggcgttcctggactttctggcggagcgcgtcgatatgagccagggttga

SEQ ID NO: 12096 - DNA, 972 bp, Pseudomonas aeruginosa
atcgcttcaggccgctggagtgccgttgccgaatgcctgttcgtcgagcaggcgcatgaaggcgcgcgcggcgttcgacagggtccgctcggtgtgcaggatatagccgagctggcggctgagctggatgtcctgcagcggcaggcgcaccacctggtcgtcgagcatggtccgcggcagcacgctccaggccaggccgatggagaccatcatcttgatggtctccaggtagttggtgctcatggcgatgttcggcgtcagcccttcggcttcgaacatgcgccgcacgatgtggtgggtgaaggtgttgccgccggggaataccgcggggtgcttggcgacgtcggcgaggaacaccgtgccctgtcgggccagcgggtgctccggggcggcgacgaagtccagcgggtcgtcccacaccgggactgcgcgcaccggttcggcggtttccggggccagggtgatcaccgccagttccgcacgaccatgaaggatctcctcgtaggccacttccgaatccaggaactggatatccagcgccacctgcggatgcgcccgggtgaaggcgcgcagcagcggcggcaggcgatgcaggccgatgtggtggctggtggccaggaccagccggccgctgacctcgccggtgaggttgttcagcgcccggcgggtgtcgtcgagcacgttgagcaactggtaggcgcgcggcagcagggcgcggccggcctcggtgaggttgacctcgcggccgacccggtcgaacagccgggcattgagctgctgttcgagggcggcgatgcgcttgctcaccgccggttgggtcaggtgcaggcgctcgccggcttcggagaagctgccggtctcggcaatggcgatgaaggtgttgaggctgttcaggtccattgcgggcctccgctggtttcggctgcccggagcttagcgccaatggattcctgttgggaatgctttggatga

SEQ ID NO: 12097 - DNA, 1443 bp, Pseudomonas aeruginosa
gctgatgaggaaatcccgatggccggcaagaccctctacgacaaactctgggacatgcacctggtcaagcagcgcgacgacggttcggcgctgatctacatcgaccgccatatcctgcacgaagtgacctcgccgcaggccttcgagggtcttcgcctggccgggcgcaagccgtggcggatcgacgccaacatcgccaccccggaccacaacgtgccgaccacccgcaccgagcgcaagggcggcatcgccgccatcgccgacgaggtctcgcgcctgcaggtgcagaccctcgacgagaactgcgacgacttcggcatcaccgaattcaagatgaacgacgtgcgccagggcatcgtccatgtggtcggtccggagcagggcgcgaccctcccggggatgaccgtggtctgcggcgactcgcacacttccacccacggcgccttcggcgcgctggcccacggcatcggcacttccgaggtagagcatgtgctggcgacccagtgcctggtggcgaagaagatgaagaacatgctggtcaaggtcgaaggcaggttgccggccggcgtcacggcgaaggatatcgtcctcgcggtgatcggcaggatcggcaccgccggcggcaacggccacgccatcgagttcgccggcagcgccatccgcgacctgtccatcgaagggcggatgaccatctgcaacatgtcgatcgaggcgggcgcccgcgtcggcctggtcgccgtcgaccagaagaccatcgactacgtgaagggccggcccttcgcgccgagcgccgagcaatgggaccaggccgtcgcctgctggcaggggctggtgtcggacgccgatgcccgcttcgataccgtggtcgagctggacgccgcgcagatcaagccgcaggtcagctggggcacgtcgccggaaatggtcctggccgtggaccagaacgtgccggacccggcccgcgagagcgacccgatcaagcgcggttcgatcgagcgcgccttgaaatacatgggcctgcggccgaaccaggcgatcaccgacatccagctggaccgggtattcatcggttcctgcaccaactcgcggatcgaggacctgcgcgctgccgccgaagtggccaggggccgcaaggtcgccgcgaccatcaagcaggcgctggtggtgccgggttccgggttggtcaaggagcaggccgagaaggaaggcctggaccggatcttcatcgaggccggcttcgaatggcgcgagccgggctgttccatgtgcctggcgatgaacccggaccggctggagagcggcgaacactgcgcctcgacctccaaccgcaacttcgagggccgtcagggcgccggtggccgtacccacctggtcagcccggcgatggccgccgccgcggccgtcaacggccgcttcatcgatgtccgcgaattgctcgcctga

SEQ ID NO: 12098 - DNA, 783 bp, Pseudomonas aeruginosa
cgttgtccagcgccagtttggcgcccaggcttcggcctacctgagcagcgccgtgcatgcccagggcgaggaattcgccttgctgcgcgacgccctggccgggcgcccggaagcgcgggtcctcgacctgggctgcggcgccggccacgtgagcttccaggtcgccgccctggcaggggaggtggtggcctacgatctttccgccgagatgctcgccgtggtggcgcagagcgccgcggaacggggcatggcgaacatccgtaccgaacagggcaaggcggagagcctgcccttcgccgacggcgagttcgatttcgtcttcagtcgctattccacccatcactggcgcgatgtcggcctggccctgcgcgaggtgcggcgggtgctcaagcccggcggggtggcgatcttcgtcgacgtggcggcgcccgggcaggccttgccggacaccttcctgcagaccgtcgagctgctccgcgacaccagccatgtgcgcaactactcgccggccgagtgggcgcgcctgagcggcgaggcgggcttgctggtaaccggaagccggcgccagcgcctgcgcctggagttccagtcgtgggtcgagcggatgcgtacgccggaggtgttccgccaggcgatccgcagcctgcagctggcggtgggcgaggaagtcagggagtatttcgagattgccgacgacggctcgttcagcaccgacgtgctggtgctgtggctgcgtcgggagtgacggttcgatcgcggcggcgcatgcccgccgttcaatga

SEQ ID NO: 12099 - DNA, 552 bp, Pseudomonas aeruginosa
cttcgatttttccagtgtcggcctggccttcttcgccgcggcagccgaggtgtcgcgtgcccatgccgagcgcgcccgcgcggcgggttgttcggtgatcgacctgagcggcgccctggaaccgagcgtcgcaccgccggtcatggtttcggtgaatgccgaacgcctggcctcgcaagcagcgccgttccttttgtccagtccttgcgccgtagccgccgaactgtgcgaagtgctggcgccactcctggccacgctggattgccggcaactgaacctgacagcctgcctctccgtctccagcctggggcgcgaaggggtcaaggaactcgcccggcagaccgccgaactgctcaatgcgcgccccctggagccgcgtctcttcgaccgccagatcgccttcaacctgctcgcgcaggtcggcgcggtggatgccgagggacacagcgcgatcgagcggcgcatcttcgcggaggtgcaggccttgcttggcgagcgtatcggaccgttgaacgttacctgcatccaggcgccggtattcttcggcgatag

SEQ ID NO: 12100 - DNA, 831 bp, Pseudomonas aeruginosa
cctgggttcgggcgaggtgatcccgagcctggcgtcgccggaagagttcagcaaggcgggcgtcgatcgcctgtactacctcaccgacctgaagttcacgccggtggtgaagcccaacggcaagagcgtcattcgcgtgacctcgtcgaagccggtgcaggagccctacctgaacttcctggtccaggtgctctggccgaacggccgcctgctgcgcgagtacaccgtcctgctggatccgccgctgtactccccgcaggccgcggcaagcgctccgcaagcgccggtcagcgcgccgcgcgcgaccggcgccccgcgagccccgcaggctccggctccggtgcgtaccaccgcgccggcaggcagcgacacctatcgcaccgtttccaacgacacgctctgggagatcgcccagcgcaaccgtaccgatcgcgtttccgtaccccaggcgatgctcgcgttccaggaactgaatccgggcgccttcgtcgatggcaacatcaaccggctgaagagcggccaggtcctgcgcattcccaccgaacagcagatgctggagcgctcgccgcgcgaggcgctgtcccaggtgcaggcgcagaaccagagctggcgcggcagccgcaatccggccgcgggcagcgctggcgccaggcagttggatgcgacccagcgcaatgccgccgggtcggcgccatccaaggtcgacgccacggacaacctgcgcctggtgtctggcgagggcaaggccagcaagggtgccgacaagggcgggaagggcgacagcaaggcgctcgccgataccctggcggtgaccaaggaaagcctcgatag

SEQ ID NO: 12101 - DNA, 432 bp, Pseudomonas aeruginosa
cactcgccgcgagaacgaagaactgcagagccgcatgcaggatctgcagagccagttggacaagctgcagaagttgatccagctgaaggacgcccagttggccaagctgcaagggcagttgggcgccgaaggccagggcgcagcccagccgaacgcagccctgccggatgcgtcccagcccaatgcggccgcgcaggcgccggctcagcccgggactcccgctgcggcagcgccgactcctgctccagccggagaagcacccgccgctccggcgcagcctccggtggcgccgccgcccgcgccagctgccgagaagcctccggcacctgccgttccggcgcccgctccggtacaggcggcagagcagccggcaccgagcttcctcgacgaactgctggccaacccgctgtggttggcggtgatcggcggtag

SEQ ID NO: 12102 - DNA, 966 bp, Pseudomonas aeruginosa
cgctttccttcaccatatggtgcgcaacatcgctggcgtcctgatgaccatcggtgccggcgagcggccgatcgaatgggcgaaggaggtgctcgaggcgcgcgaccggcgcgccggtggggtcaccgctcacccctacggactctatctggtgcgggtggagtaccccggggagttcgagttgcccgagcgctacctggggccgcatttcctttccggattgcccgatatcgtcggctgacgtcgaatcgggcttttgctaccatcgagaattcccgccggaccggccgtccggcggttcgtcgctcactcgccgaggattctccgtcgttgccagccgttcgcatcaagatctgcggtatcacccgagtcgaggacgccctggccgctgccgcggcgggcgccgatgccatcggcctggtgttctatgcgaagagcccgcgggcggtggatatccatcgggcgcgggagatcgttcgtgccctgccgccgttcgtgaccagcgtcggcctgttcgtcaacgccagccgctgcgaactgggcgagattctcgatgcggtgccgctggacctgctgcaattccatggcgacgagcgcgccgaggactgcgagggacatcggcgaccctacctgaaggccctgcgggtgaagcccggcgacgacatcgtcgggcgcgcggcggcatatccgggagctgccgggattctcctggatacctatgtggaaggcgtgcccggcggcacgggggcggcgttcgactggtcgctggtgccgaccgacctgggcaaacccctggtgctggccggcggtctgacgccggataacgtcggcagggcagtcgagcaggtcaagccctacgcggtggacgtcagcggtggcgtcgaggcgagcaagggaatcaaggatgcggcgagggtccgcgcgttcgtggacgcggtgcgttcgcggcgccgcgacgagacatga

SEQ ID NO: 12103 - DNA, 2052 bp, Pseudomonas aeruginosa
gcatggcgccatcgacatgatcgtgcatcgtgccgagttgcggccgcgcctggccaatctgctgtcggccttcactcattcgccgagccccgtatccgcatgacccagcgttccctggccgattggctgagctatctcgaacaactccatccgacggccatcgacatgggcctggagcgttcccgcgaggtagcgcgccggctcggcctgggaaggccggcgaaacgcgtggtcaccgttaccgggaccaacggcaagggctccacctgcgccctgctcgccgaactgctgcgtgagcaggggttgtcggtcggggtctacagctcgccgcacctgctgcgctacaacgagcgggtgcggatcgatggcgtcgaggccggcgatgcgcaactgtgcgacgccttctccgcggtggaggccgcacgtggcgagatttccctgacctatttcgaaatgggcactctggccgccttctggctgttcgagcgcgccgggctggacttcgcggtgctggaagtcggccttggcgggcgcctggatgcggtcaacctgatcgacgccgacctggcgctgatcaccagcatcggcctggaccatgcggactggctgggcgatacccgcgaaagcgtggctttcgagaaagccggtatcctgcgcgccggcaaaccggccctgtgcggcgatttcgatcccccgcagccattgctggagcaggtggctgcgctgggggcaccgctttacctgcgcggtcgcgactacgacctggcgctcgccgatcatggctggcactggcgcgggctggccgcggacggccaggcgctggcgctgcacgatctgccgttgctcgggttgcccatggaaaacgccgcgctggccctgcaggcctacgcgttgctcgagttgccctggcaggcggagcgcctggccgaggcgctgcggcggacccgggtgaccggtcgcctcgatcgccgcgacctgtcctggaacggccagccacgccagctcctgctggacgtcgggcacaatccccaggccgcccagtacctggcgcaacgcctgcgtgccgcagcgccacgaggacgctacctggcggtcttcggcctgctggcggacaaagacctggatggcgtactggaacccttgaccggcttggtgcaggattgggccgttgcaccgttgccgactccgcgttcgcggccggccgcggagctggaggcggcgctgatcctgcgccaggttccggcgagcagccatgcggatatcgccgccgccctggacgcgcagtgcgccaaggctaccgcggatgatgtcattctgctgttcggatcgttctatagcgtggccgaaggcctggaatggctggcccgtagaacggataacggggagttaatcatggccttgctggaaagagggctgaagcagcgcatcgtcggggcgttggtgctgatcgccctggcggtgatcttcctgccgatgctgttcacccgcgaagacgagtcgcgccaggtcgtggtggaagcgccgccgcgcccgcaatcgccggccatgcccagtgtcgaggtgcagccgaccgaggtgccggaactgcagcccggcgaagaaggcaacgctcccgagatcgtcgaggaaggctccccggccgccgccggccagcccagccagccgatcggcggcctgccggcgaccccgccggccacccagccgcccgcccaggcccaggcgccggccgccagcctgccgccaagccagccgcaaccgcccgctgcgccgccgagcccgccgcccgcggagaagcgcctggacgccaacaacctgccgcagagctggtcggtacagcttgccagcctgtccaaccgggcgcgcgccgaggaattgcagaagaccctgcgctcccagggctacaacgcctacatccgcagcttcgacgggatgaaccgggtcttcgtcgggccggtgatccagcgcgccgaggcggatcgcctgcgcgaccagttgagcaagcagcagaagctcaacggcttcgtcgtgcgcttccagccggaacgcggttga

SEQ ID NO: 12104 - DNA, 1518 bp, Pseudomonas aeruginosa
gggttgcgtcacatgtgtggcatcgtcggtatcgtgggcaagtcgaacgtcaatcaggcgctgtatgacgcgctcaccgtcctccaacatcgcggccaggacgctgccggtatcgtcacctgccatgacgataagctgtacctgcgcaaggacaacggcctggtccgcgacgtcttccagcagcgccacatgcagcgcctgatcggcagcgtcggcatcggccatgtgcgttacccgaccgccggcagctccagctcggcggaagcgcagccgttctacgtcaactcgccctacggcatcaccctggcgcacaacggcaacctgaccaatgtcgagcagttggccaaggaaatctacgaatccgacctgcgccacgtgaacaccaactccgattcggaagtgctgctcaacgtgttcgcccacgagctggcggtgcgcaacaagctgcagcccaccgaggaggacatcttcgccgcggtttcctgcgtgcacgaccgttgcgtcggcggctacgcggtggtggcgatgatcaccggccatggcatcgtcggtttccgcgaccccaatgcgatccgtccgatcgtcttcggccagcggcataccgagaacggcgtcgaatacatgatcgcctccgagagcgtggccctggacgtactcggcttcaccctgatccgcgacctggcgccgggcgaggcggtgtacatcaccgaggaaggcaagctctatacccgccagtgcgccaaagcaccgaagtacgcgccgtgcatcttcgagcacgtctacctggcgcgtccggattcgatcatggacggcatctcggtgtacaaggcgcgcctgcgcatgggcgagaagcttgccgacaagatcctccgcgagcgtcccgaccacgacatcgacgtggtcatcccgatcccggacaccagccgcaccgcggcgctggaactggccaaccggctcggcgtgaagttccgcgagggcttcgtcaagaaccgctacatcggccgcaccttcatcatgcccggccaggcggcgcggaagaaatccgtgcggcagaagctcaacgccatcgagctggagttccgcggcaagaacgtgatgctggtggatgactccatcgtccgcggcaccacctgcaagcagatcatccagatggcccgcgaggccggggcgaagaacgtctacttctgctccgccgcgccggccgtgcgctaccccaacgtctacggcatcgacatgccgagtgcgcacgagctgatcgcgcacaatcgcagcaccgaggacgtcagcaagctgatcggcgccgactggctggtctaccaggacctgcccgacctgatcgacgcggtcggcggcggcaagatcaagatcgatcacttcgactgcgccgtgttcgacggcgagtacgtgaccggcgacgtcaacgaggcttacctgaaccggatcgaacaggcgcgcaacgatgcgaccaaggccaagagccaggcggtcagcgcgatcatcgatctgtacaacgactga

SEQ ID NO: 12105 - DNA, 936 bp, Pseudomonas aeruginosa
caaaggggagagcggcatgactcaggactgggatgccgggcgtctcgacagcgacctggaaggcgcggccttcgacaccctggcggttcgcgccgggcaacggcggacgccggagggcgagcacggcgaggcgctgttcaccacttccagctacgtcttccgcaccgccgccgacgcggccgcgcggttcgccggcgaagtgccgggcaacgtctattcgcgttacaccaaccccacggtacgcaccttcgaggagcgcatcgccgccctcgaaggagccgagcaggcggtggccacggcgtcgggcatgtcggcgatcctcgccctggtgatgagcctgtgcagctccggcgaccacgtgctggtctcgcgcagcgtgttcggctcgaccatcagcctgttcgacaagtacttcaagcgcttcggtatccaggtcgactatccgccgttgagcgatctcgcggcctgggaggcggcgtgcaagccgaataccaagctgttcttcgtcgagtcgccatccaacccgctggccgagctggtggatatcgccgcgctggccgagatcgcccacgccaagggtgcgctgctggcggtggacaactgcttctgcacgccggccctgcaacagccgctgaagctcggtgcggacgtggtgatccactccgcgaccaagtacatcgacggccagggccggggcatgggcggggtggtcgccggtcgcggcgagcagatgaaggaagtggtcggcttcctccgcaccgccggaccgaccctcagcccgttcaacgcctggctgttcctcaagggcctggaaaccctgcgtatccgcatgcaggcgcacagcgccagtgccctggccctggccgaatggctggagcgccagccgggcatcgagcgggtctactacgcgggcctgccgagccatcctcagcatga

SEQ ID NO: 12106 - DNA, 1056 bp, Pseudomonas aeruginosa
gttggcccggcgccagcagagcggcttcggcgcggtcgtcagcttcgacgtgaagggcgggcgcgatgccgcctggcgcttcatcgacgctacccggatggtctcgatcaccaccaacctgggcgacaccaagaccaccatcgcccacccggcgaccacctcccacggtcgactgtcccccgaggaccgcgcgcgcgccgggatcggcgacagcctgatccgggtcgcggtcggcctggaagacctcgacgacctcaaggccgacatggctcgggggctggccgcgctgtgatcgaacccaacctgcgaggcaacggcaaggtcgccctggtcaccggggcggcccggggcattggcctgggcatcagtgcctggctgatcgccgagggctggcaggtagtgcttgccgacaacgaccgtgaacgcggggccagggtggccgaggcgctgggcgagcacgcctggttcgtggccatggacgtggcccaggagggccaggtggcgatgagcgtggccgaggtgctcggtcagttcggccgcctcgacggcctggtctgcaacgccgccatcgccaatccgcgcaatacgccgctggaggcgctgagtctcggcgagtggacccggaccctggcggtcaacctgaccggtccgatgctgctggccaagtactgcacgccttatctgcgcgcgcacaatggcgccatcgtcaacatcgcctcgactcgtgcccaccagtcggagcctgactccgaggcctacgccgcgagcaagggcgggttgctggcgctgacccatgccctggccgccagcctgggcccggatatccgtgtcaatgcgctcagccccggctggatcgatacccgcgaggccgccgagcgcgaggctgcgccgctgaccgagctggaccacgaccagcacctggtcggccgggtcggaacggtggaggatgtcgcgtcgctggtggcttggctgctctccgaggacgccggtttcgtcaccggccaggaattcctggtcgatggcggcatgacccggaaaatgatctacctcgactga

SEQ ID NO: 12107 - DNA, 639 bp, Pseudomonas aeruginosa
gttggtggggagatgcggaaaaggcgctgttccgaaaggagcagcgcctttttttcgtatgaggccgccttgccggtatggcgccgttattccgtcttcagttcgcgcagatcgacggcctgtccatcgaacaactggttggcgttggtcggcaggatgctgggtcgtccctccgggccgcgagtgccgtcgatgacccggatgtcgctgtatttcttgcccgagagcgcggcgagaccggcgctgtcgcggaccaccgtaggacgcaggaagaccatcaggttgcgcttggtgtgggtgtccttggtggaacggaacaggcgaccgagcaatgggatgtccccgagcaggggaaccttcgactcggcttgggaaacgtcgtcctggatcaggccgccgatcacgatcacctggccgttctcggcgaggatggtgctcttgatcgagcgcttgctggtgatcaggtcggtattgttgcgctgctgggcgttgggcagcagggccgagatctcctgctcgatctccaggcgcagggccgcgccgtcgttgatgtgcggagtgaccttgaggctgacgccgatatccttgcgctccacggtggtgaacgggttgctcgaaccttcgctgttggtggtgtag

SEQ ID NO: 12108 - DNA, 780 bp, Pseudomonas aeruginosa
gagccggtctggaacggtacgttctggccgaccagaatctccgctttctggttgtccagggtcaacaggctcggggtcgacagcaggttgctcttggtgttggccgagagcgcggtgaccagcgcgccgaagctgctgctgccgatgccgacgatggcgccgtcggggatggattccggtgccttgttgctctcgagcgattgcagcagggtgccgatggacagtccggtattggcgaagttggtcttggttccgcccatgccgcccttgttgatcgcccattgcacgccgacggcatcctggatgtcgccggagatctcgacgatggccgcttccaccaatacctgggcacgcggcacgtcgagctggcgaacgatgtcttcgagagcgttgaccgtgtccgggtcggccagcaggaccagggcgttggtgctttcgtcggcacggatgaggatgttgctcggtcggccgccgccggtctgttcgccgccctggccgccattgttcttcatgccttcggaaatctggccgagggtttccgcgagggtcttggcgtcgttgtggcgcaggcggatcacccgggtgttggccgagcgcgcggtcggggtgtccagcgattgcgccagttgcaccagcttggcgcgcgcctgcggcgggccgaggatgatcaggcggttggtgcgcgcgtcggcgatcacctgggcgcccgccgcgcccttggcctggccgcggctcatggcgttgttgagcacctcggcggcgtccatcacccagccgtag

SEQ ID NO: 12109 - DNA, 1530 bp, Pseudomonas aeruginosa
ggttaccgctataaggcatccatgatgacagccccattacccgacatcgccgcgccggccgcaccgccacggcgtctgccgttcagcttcgccaagcgccagggcctgctgttcctgtgcctggaggagcagtactggctggcctgccggccgcaggtggagctggcggcgatcgccgaggcgcagcgcttcgccggccgccgcctgccgctcaaggcgctcggcgaggacgccttcaaccaggccctggcggcctcctaccagcacgactcctcggcggccatgcagctcgccgaggacctcggcggcagcctggacctcgccgcgctggccgaccaggtcccggaaaccgaggacctgatggagcaggaggacgacgcgccgatcattcgcctgatcaacgcgatcctcggcgaggcgatccgcgagaacgcctcggacatccacctggaaaccttcgagaaacgcctggtggtgcgcttccgcgtcgacggcgtgctgcgcgaggtgctggagcccaagcgcgagctggcggccctgctggtatcgcggatcaaggtcatggcacggctggacatcgccgagaagcgtattccccaggatgggcggatttccctgcgggtcggcgggcgcgaggtggacatccgcgtctcgaccctgccctcggccaacggtgaacgggtggtgctgcgtctgctcgacaagcaggccgggcgcctgaacctgcaacacttgggcatgagcgagcgcgaccgcaagctgatggacgaaacggtgcgcaagccgcacggcatcctgctggtcaccggccccaccggctcgggcaagaccaccaccctgtacgccagcctgaccacgctcaacgaccgcacgcggaacatcctcaccgtcgaggatccgatcgaataccacctggagggcatcggccagacccaggtcaacgccaaggtcgacatgaccttcgcccgcggcctgcgggcgatcctccggcaggacccggacgtggtgatggtcggcgagatccgcgaccgggagaccgccgagatcgcggtgcaggcttcgctgaccggccacctggtgctctcgaccctgcacaccaacagcgccatcggtgcgatcacccgcctggtggacatgggcatcgagccgttcctgctgtcctcctccatgcttggcgtgctggcccagcgcctggtgcgggtgctctgcccggcgtgcaaggagccctaccgcgccgacgaggccgagtgcgcgctgctcggcgtcgatcccgccgcgccgccgaccctgcatcgcgcccgcggctgcggcgagtgccaccagcatggctatcgcgggcgtaccggtatctatgagctggtggtgttcgacgaccacatgcgctcgctgatccacaacgaatcctccgagcaggaaatgacccggcatgcccgcaccagcggaccgagcatccgcgacgacggtcggcgcaaggtgctggaaggcgtcaccacggtcgaggaagtcctgcgcgtgacccgggaagaataa

SEQ ID NO: 12110 - DNA, 531 bp, Pseudomonas aeruginosa
tattcatgggcgcggtggtgctggtcatcgtcctggccattcttcttccgatcctttctctcaaccaactcgtggggtaatcgcgtgaatcagagccgcccattgcagcgtcgccaacagtcgggcttcaccctgatcgaaatcatggtcgtggtggtcatcctcggcatcctcgccgccctggtggtgccgcaggtaatgagccgtcccgaccaggccaaggtcaccgtggccaagggcgacatcaaggccatcgctgccgcgctggacatgtacaagctggacaacttcgcctatccgagcacccagcagggcctcgaggcgctggtgaagaagcccaccggcaatccgcagccgaagaactggaacaaggacggctacctgaagaagctgccggtcgatccgtggggcaatccctaccagtacctggcgccgggcaccaagggcccgttcgacctgtattcgctgggcgccgacggcaaggaaggcggcagcgacaacgacgccgacatcggtaactgggacaactga

SEQ ID NO: 12111 - DNA, 525 bp, Pseudomonas aeruginosa
ccggacatgcgggcttcgcgcggcttcaccctcatcgagctgatggtggtgatggtcatcatcagcgtactgatcggcctggcggtgctcagcaccggcttcgccagcacctcgcgggagctggacagcgaggccgagcggctcgccgggctgatcggcgtgctgaccgacgaggccgtgctggacaaccgcgagtacggcctgcgcctggagcgcgatgcctaccaggtactgcgctacgacgaagcgaaggcgcgctggttgccggtggcgcgcgacagccaccgcctgccggagtgggcggagctgaccttcgagctggacggccagccgctggtgctggccggcagcaagggcgagaaggagcagaagaaaggcaccgaccagccgcaattgctgatcctctccagtggcgaactcagtccgttccgcctgcgcctggccgagcgcggacccgaggggcgggcgttgtcgctgagcagcgacggtttccgcctgccacgggtcgaggtggcgcggcgatga

SEQ ID NO: 12112 - DNA, 1485 bp, Pseudomonas aeruginosa
ccgtggcgccttcctcagcgagggcgagaacgaccagatcgtcgaactcacccgtggtggctggcgcaacccgctcggccaggcgcgctcgcgcctgcagcgggtgcgctggtcgctgtccggggagaccctcgaacgccgctactggctggttctggaccgcgcccaggacagcaagccacgggtgcagcaggtgctggacggggttaccgcgctgagctggcgcttcctcgacaaggagcacaactggcagggccactggccgaccgacgaaggcagcgaggaggagcgcctggaaagcctgccgctggcggtggagatgaccctggagcaccgccactacggcaagctggtgcgcgtctggcgtctgctcgatccgccgctcaagcaggaccagccgcagggccagccgggcggcgagaatggcgagaacggcgagggcggagtgccgcagccgccggaaggcatgccgggggcgccggaatgaggcgcgggcagaacggcgtcgcgctgatcaccgtgctgctggtggtggcggtggtgaccatcgtctgcgccgggctgatcatccgccagcagttggcgatacgcagcagcgccaaccagttgcacgtgcgccaggcctggcactatgcgctgggcggcgaacgcctggcggaagcggtgctgcgccgcgacctgcgccagggcggcgagaatacccgcgagccggtggaccacctgggcgaggcctgggctcgaccgatgacgccgttcaagctggacgacggcggcgagctgcgggtgcggatcgaggaccccagcggacgtttcaacctcaacgggctggtgcgcaagcgcaaggtcaagccggattcggtgaagcagttccgtcgcctgctggccaccctggggatgaaggaagagatcgtccagggcttgccggaccggctggccgactggctcgacgctgaccagaatccgcagggcgagcaaggcgccgaggacaaccagtacctgctggaggcgccggcctaccgcgccgccaaccgcagtttcaaggacgtgtccgagctgcgcctgctgaaattgtcggaagccgactatcgacgcctgctgccgttcgtcagcgccttgcccgaagatgcgccgctgaacgtgaacactgccagcgtgccggtgctggccgccatgttcgagatcgatccgggacaggcggaaaacatcgtggcggcccgtgggcgagaaggcttccaggagaagactgagttcagcaagcacctgaacgagttgggatcaaaggcaagtaacgtcaactttgccgtcggcacccgctacttccaggtgatcagcgaggtcagcctgggcgaccgccggcaggtgctggtgagtaccttgcagcggggcaaggacggcaagatacgcgtgatggcccgcgacatggggcagggcggcctgcccatcccgtcgacgggcggcgacgattggaagaaggacgagcgatga

SEQ ID NO: 12113 - DNA, 534 bp, Pseudomonas aeruginosa
gaggttgagatgaaggtgatgacgcaattccacgagcgcctcagggcccaggcggaaacctcgcagctggcgatccgctggcgcgggctgccggcgcgggaccgcctggcgctgctctggctcggcgcgttcctcctgctggtggtgctctacctggcgctgtggcgcccggccgagcgccatctgcagtcggcgcggcagtatttcaccgaacagcgcgcggtgcatgcatacatccagcagcaggcgcccaacgtgcgccaggccgatgccgcggcgccacaggcgcagatcgacccggcggcgctgcagggcatggtcacggcttcggcggcccaggccggactgagtgtcgagcgcctcgacaacgaaggcgagggcgccgtgcaggtggccctgcagccggcgccattcgccaagctgctgccctggctggagcagttgaacgggcagggcgtgcaggtggcggaggccggcctggaccgccaggtcgacggccgggtctcggcgcgcctgagccagcgggtcgagtga

SEQ ID NO: 12114 - DNA, 474 bp, Pseudomonas aeruginosa
cccaggcggtgcatgaggcgggtggcaagatctgcatgcagatcctgcatgccggccgctacgcctacagtccgaagcacgtggcgccgagcgcgatccaggcgccgatcaatccgttcaagcccaaggaactcgacgaggaaggcatccagaagcagatcgccgacttcgtcaactgcgccagcctggcccaggtcgccggctacgacggcgtcgagatcatgggatcggaaggctacttcatcaaccagttcctcgtgcagcacaccaaccagcgcaccgaccgctggggcggcagctacgagaaccgcatgcgcctgccggtggagatcgtccgccgggtgcgcgaggcggtggggccgaacttcatcatcatctatcgcctgtcgatgctcgacctggtcgagggcggcagcagctgggacgagatcgtgctgctggcgaaggccgtcgagaaggccggcgcgaccctga

SEQ ID NO: 12115 - DNA, 942 bp, Pseudomonas aeruginosa
gctgactccttgccgtttccccactggtcaccgcatacacccttgcagcgtctcgaactcgactggctgcaacgggccggggtcgaactggcgctgctgcgcctggaccaggccgatccgctgatctccggcaacaaggggttcaagctcgcgccacacctggcgctggcccgcgagcaggggctggacggcctgatcagcctcggcggcgcccactccaaccacctgcacgcgctggccggcgctggcgcgcgtttcggtttccgttgcgtcggcctgttgcgcggacacgaagtcgatacgccgacggtgcgcgacctgcgcagtctcggcatggaactgcactggctcggctacggcggctatcgccagcggcatgccgccggcttctggcttccctggcgggaacgttacccaggcttgctgccggtcgccgagggcggtggcgggctgctgggcgcgcgcggttgtatcgggctggtggagcgcatagcgacccagttgccgacgctcggctgggacgattacgacgcgatctgggtggccgccggtaccggtacgacactggccggcctggtgctcggcgaggccgggcggcatcccgtggtgggcgcgctggcggtgccggaggaccacggcgtcgccgcccaggtcgcggcgacccttgccgaggcgggctgggccgataccggctatcgcctgctggacgccagccgtggtggtttcgcccgcctcgatgggcgattggcgcggttcatcgtcgagttcgagacggccagcggcgtcgccctcgaaccgctgtacaccggcaagctgctgctcgccctgcgcgaggccgtggagagcggcgcggtggctcgcggcagccggttggtggcgctgcacagcggaggcctgcagggccgccgggcattgcaggagcgtttgctggcgttgctctga

SEQ ID NO: 12116 - DNA, 1548 bp, Pseudomonas aeruginosa
actggaggccaaggtcggcgaggtgctggacggccagtacatcgtcgagagccgcttcctcctcgatgcccaggtgcgtcgcggtatcgactcgatggggcagggcgatgcgctcaacgacgtggtcctgcacccgggcaagtcgacccggatgatcgagttcgagctgtatatcgacggccagttcgtctgcagccagaaggccgacggcctgatcgtcgccacgcccaccggttccaccgcctacgcgctgtccgccggcggtccgatcatgcatccgaagctggatgccatcgtcatcgtgccgatgtacccacacatgctttccagccgcccgatcgtggtggacggcaacagcgagctgaagatcgtcgtgtcgccgaacatgcagatctacccgcaggtctcctgcgacgggcagaaccatttcacctgcgcccccggcgatactgtgacgatcagcaagaagccgcagaagctgcgcctgatccaccccatcgaccacaactactacgagatctgccggaccaagctcggctggggcagccgcctgggcggaggcgactgatgcaactcgaccccggacgtggctacgacctgatcggcgatgtccacggctgcgcgcataccctggaccgcctcctcgacctgctcggctaccgcctgcagggcggcgtctggcgccatccgcggcgccaggtgctgttcctcggcgacatcgtcgaccgcggcccgcgcatccgcgaggccctgcaccgggtgcacgcgatggtcgacgccggcgaggcgctgtgcatcatgggcaaccacgaattcaacgcgctcggctggagcaccccggcggcgcccggcagcggccgccagtacgtccgcgagcatacgccgcggcatgcccggctgatcaaggagaccctcgagcagttcgagggccacgatgccgactggcgcgacttcctcggctggttccagcaactgccgctgttcctcgatgccgggcgcttccgcatggtccatgcctgctgggacggcgagctgatcgcgaccctgcgccggcagttccccgacgggcggatcagcgaagccttcctgcaggagtcggcggagcccggcagctttgccgacctggcctgcaaccgcctgctgcgcggcaccgacatgcgcctgccgcacggtgccaccctgaccagcagcgatggctatacgcgcgccttcttccgcaccaagttctgggtcgaggacgaggcgccgcgcacctacggcgatatcgtcttccagcccgacgcgttgcccgaagcgatcgcccgcgagccgctcagcgaggagcagaagtccagcctgctgacctacggcgccgacgaaccgctgttgttcgtcggccactactggcgacgcggcacgccggcgccgatccggccgaacctggcctgcctggactacagcgcggtgatgtacggcaagctggcggcctaccgcctggatgaggaaacccgcctggaccggcacaagtttgtttgggtcgaagtgaagcggccggaggctgacgagtga

SEQ ID NO: 12117 - DNA, 1056 bp, Pseudomonas aeruginosa
gatctaccagaacctcaagctggccatcgagatcggcaagtggccggacggccgcaagctgacccaggagcagaaggaactctgcctgcaggcggtgatcgcctgggagctgcagaacctccccgaggaggagcgcaccggctacatgggcccgcagcactgctcctcgcattccgacgagccgatcccgaacatcctgttcaagtcggactccgtgcactgatggaagaaatcgcccgcggcgcgctgagcaagatgacggcgcgcctggaaagcaatgctcccgtgcaatacgccttccgcctcgacgaccgcgaagtcgcggtgaacccgctgatcggccggccgctgcgcctggagtacctcggcagcatcttctgcacccattgcggccgcaagacgaagaagagtttcagccagggctattgctatccctgcttcacccggctggcgcagtgcgacagttgcatcgtcagcccggagaagtgccactacgagcagggcacctgccgcgaaccggagtggggcgagcggttctgcatgaccgatcacgtggtgtacctggccaactcctccggggtgaaggtcggcatcacccgcgccagccagattcccacccgctggatcgaccagggcgcgcgccaggcgctgccgatcctgcgcgtggccacccgccagcagtccggcctggtggaagacctgctgcgcagccaggtcgccgaccgcaccaattggcgggccatgctcaagggcgaagccgagccggtcgatctggcggcagtccgcgagcagttgttcgaccagtgcgccgacggcctgcgcgaattgcagcaacgtttcggcctgcaggcgatccaaccggttatcgacctcgatccgctcgagatcgcctacccggtcgaggcctacccgagcaaggtcgccagcctcgacctggaaaaaacgcctatcgtcgaaggcacgcttcgcggtatcaagggccagtacctgatcctcgacaccggggtgatcaacattcgcaaatacacggcctaccagatcgccgtgcatcactga

SEQ ID NO: 12118 - DNA, 2676 bp, Pseudomonas aeruginosa
gcagaagggccacaagccatgcgcaccgagcaaccgaaagtcatccacctcaaggactatcaggcgccggactacctgatcgacgagacccacctgaagttcgaactgttcgaagaccacagcctggtacacgccgagttgaagctgcggcgcaaccccgagcgcggcgccggcctgccgccgctgttgctgcatggccagcaactggagctgctggcgctcgaactggacggccaggcgctcggcgcggacgactaccaactggacgacgagcagctcggggtgaaaccgcggcaggccgagttcgtcctcaggagcacggtgcgtatccatccggagagcaacaccgcgctggaaggcctgtacaagtccggcaagatgttctgcacccagtgcgaggccgagggtttccgcaagatcacctattacctcgaccgtcccgacgtgatgagtcgcttcaccaccaccgtcagcgccgaacagcagcgctacccggtgctgctctccaacggcaacccggtggccagcggttccgaaggcaacggccggcactgggcgacctgggaagacccgttcaagaagccggcctacctgttcgccctggtcgccggcgacctctggtgcgtcgaggacagcttccgcaccatgagccagcgcgacgtggcgttgcgcatctacgtcgagccggagaacattgacaaggtccagcacgccatggacagcctgaagaagtcgatgcgctgggacgaggaggtctacggccgcgagtacgacctggacatcttcatgatcgtcgcggtcaacgacttcaacatgggcgcgatggagaacaagggcctcaacatcttcaactccagttgcgtcctggcccgcgccgaaaccgccaccgacgccgcccaccagcgggtcgagggcgtggtggcgcatgagtatttccacaactggtcgggcaaccgggtcacctgccgcgactggttccaactgtcgctcaaggagggcttcaccgtattccgcgactcggagttctccgccgacatgaactcgcgcacggtcaagcgcgtcgaggacgtcgccttcctgcgcaccaaccagttcgccgaggacgccgggccgatggcgcatccggtgcgccccgactcgttcatcgagatttccaacttctacaccctgaccgtctacgagaagggctcggaagtggtgcggatgatccacaccctgctcggcgccgaaggcttccgcaagggctcggacctgtacttccagcgccacgacggccaggcggtgacctgcgacgatttcgtcaaggccatggaagacgccaatggcgtcgacctgacccagttcaagcgctggtacagccagtccggcactccgcgcctggcggtggaaggcgagtacgacgccgccgcccgccgctacaccctgacggtgcgccagagctgcccgccgactcccggccagccgagcaaggaacccttcgtcatcccgctggagctgggtctgctcgacggccagggccacgaacttccgctgcgcctggaaggcgaggccgcggcccagggcggcaaccgcgtgctggcggtgaccgaggccgagcagcgcttcgtcttcgtcgaggtgccggagcagccgctgccatcgctgctgcgcggcttctccgcgccggtgaaactgagcttcccctacagccgcgaccagttgctgttcctcatgcagcacgacagcgacggcttcaaccgctgggaggccggccaacagctctcggtgcaggtcctgcaggagctgatcggccagcaccagcgcggcgagcaactggtactcgacccgcgcctgatcgaggcctaccgcaccctcctggcggacgaggcgctggaccaggcgatggtcgccgagatgctctcgctgcccagcgaggcctatctcaccgagatcagcgaagtcgccgatgtcgacgcgatccatgccgcccgcgaattcgcccgccagcgtatcggcgaagcgctgttcgagccgctgtggcagcgttaccaggccaaccgcaagatttcccgtgacaccgcctacctcgccgaggcctcgcacatagcccggcgcagcctgcagaacatcgcgctgtcctacctgtcgctgtcgggccgggaggaaatcctcgccgcctgcctggagcagtacgaaggctgcgacaacatgaccgagcgcctgaccgccctggcggtgctggtcaactccggcttcgaggcggagaagggcaaggccctggccatgttcgccgattacttcaaggatgacccgctggtgatggaccagtggttcagcgtgcaggccggctcgccgctgccgggcgggctggagcgggtccaggcgctgatgcagcacccggccttcaccctgaagaacccgaacaaggtgcgcgcgctgatcggcgcgttcgccaaccagaacctggtcaacttccatcgtcctgacggcgccggctatcgcttcctcgccgaccaggtgatcgtgctcaacgcactcaacccgcagatcgcctcgcgcctgctggtgccgctgacccgctggcgcaagtacgacgaggcgcggcaggcgctgatgcgcggcgagctggaacgcatcctggcctccggcgaattgtccagcgacgtctacgaagtggtgagcaagagcctggcctga

SEQ ID NO: 12119 - DNA, 534 bp, Pseudomonas aeruginosa
ccacatggagtgagttcccgatgtacatccccaaccgccagccccggctgcgctccgcgccggcccgggccggcttcgccttcgtcgggctgctgccgctgctgggcggccaggcccaggccgtcgaattcagcttcctcgacaacgaggtgtccggttcgctcgacaccaccctgtcctacggcaccctgtggcgggtgcaggggcaggacaagagcaacaacgacatcaacaccaacgacggcaaccgcaacttcgataccggcctggtttccgaggtctacaagatcacctcggacctggaggcgacctggcgcaactatggcgtgttcatccgcggcacggcgttctatgacacccagatcatggacaagcgcaacgactactacagccacaacgatccatcgcagccgagccagagctatccccacgacgaccgtttcaccagccagacccgcgatatcgccgggcacaaggcggaaatcctcgacgcctacgtctacggcagctgggacatcggcaacatgccgctga

SEQ ID NO: 12120 - DNA, 1440 bp, Pseudomonas aeruginosa
agtactccttctgaccgaaccgataacgacacgggcgccgcgagcgcccggcacctcacacggagaaccctcatgttgaacaagcacctgctgatcggcgcttccctggcgctggcactgggcagcggcggcgcgctggccggcgtttccgccggcgaggcggcgcaactgaagtcgagcctcaccccgctgggcgcggagaaggccggcaacgccgccggcagcattcccgcctggaccggcggcatcacccaggcgccggccggctacaagccgggccagcaccacccggacccgttcgccgcggacaagccgctgttcaccatcgacaaggccaacctggagcagtacagggaacacctgaccccgggccagctggcgctgttcaagacctacccggacagcttccggatgccggtctaccccagtcgccgttccggttcggcgccgcagtggctgtacgacaacaccttcgccaatgccaccagcgccaggctgctggacggcggcaacgggttcgccgacgcctatggcggggtgccgttcccgattccgaagagcggcgtggaggcgctgtggaaccacgtcgcccgctaccgcggcacctatgtcgtgcgccgcgcttcggaagtcgcggtacagcgcaacggtagctactcgctggtgacctcgcagcaggaagcgctgttcaagtactacctcaagggcggcagcttcgccgacctgaacaacctgatgttctactacctgtcgttcaccaagagcccggcgcgcctggccggcggcgcggtgctggtgcacgagaccctcgaccaggtcaaggagccgcgccaggcctggggctacaacgccggccagcgccgtgtgcggcgtgcgccgaaccttgcctacgacacgccgatcgccgccgccgacggcctgcgcaccgccgacgacaccgacatgttcaacggcgcgccggaccgctatgactggaagctgctgggcaagaaggaaatctacattccctacaacaactacaaggtcagcagccccgaggtgaagtacgaggaactgctcaagccgggccacctcgatccgcaatacacccgctacgagctgcaccgcgtgtgggtggtggaaggtaccctgaagccgggcgcgcggcatatctactccaagcgcaccctgtacctcgacgaggacagctggagcgcggcggtggtcgaccagtacgacggtcgcggcgaactgtggcgggtgtcgatggcctacctgaagaacttctacgacctgccgtacacctggagcgcgctggatgtgttccacgacctgcaggcgcgtcgctaccacgtgcagaacctggacaacgaggagccgggtaccatcgacttcacccaggcgataccggacgactcctacttcaagccctcggccctgcgccgccgcggcacccgctga

SEQ ID NO: 12121 - DNA, 1278 bp, Pseudomonas aeruginosa
tcgctccgctcgccggcgccgaccgcttccctccggggaggagggcggcgccgatccccccgttacagacggcttacacgcttaacaaaagataacgtggcttcaattgtctccgtcgccaaacgctggctatataacgctcaccacgaaccactaataacaacaacggggacggtatccatgcgtgagcccatgacgtggcgcacttcgcccggccaaaccgcggacgcttcgcggcatccggccattccttccagatcgcccctggccagcagggccctgtcgtttctcggggcactttctcttctgaccttcgccgccaccccggtcctggccgagtcgacgccaaccgccgcgccgccgcaattcgccgtggaatcgccgaaggccgccagcagcctgctgctcagcgtcgcccatgccggcaagcggctggtcgcggtcggcgaccgtgggcatatcctgctctccgacgacgacggcaagacctggacccaggccaaggtgccgacccgccagttgctcacctcggtgttcttcgtcaacgagcgcaagggctgggcggtcgggcacgatgcgcagatcctcgtcagcgacgacgccggcagcacctggaccaggcagttcgaggacctcggccgcgaagcgccgttgctggacatctggttcgccgacgaacagcacggcctggccgtcggtgcctatggcgcgctgctggagacccgcgacggcggccagcactgggaagacgtcagcgagcgcctggacaacgaggaccagttccacctcaacgccatcgccgcggtcaaggacaacggcctgctggtggtcggcgaagccggcagcctgttccgctcgaaggactggggcgccacctgggaaaaactcgaaggcccctacgagggctcgctgttcggcgccatcggtaccgccgatgcgggcggcgtgctggtctacggcctgcgcggccacctgttccgctccgccgatttcggcgacagctgggaagagataccgctgaaggcggcgtccggcgacctggaattcggtctctccgacggcgcgctgctggcggacgggcgtatcgtcgtggtcggccacggcggcagtgtcctcgaaagcaccgacggcgggcgcagcttcagcgtgttcaaccgtcccgaccggctgtccctggccggcgtcagcgccaccggcgacggccacctgatcctggtcggccagggcggcgtgcacctcgctgcggcgaacggtgccgcgctcgaacaacaacaataa

SEQ ID NO: 12122 - DNA, 2031 bp, Pseudomonas aeruginosa
cgcggtgcgcgagcacccgttctggcgcctgctgtcgaacttcgccagcccgaaggtggccccggtgtccatcgccatcgccctgctgatgctcggcggcggcctctggtatggcaagcacctgaagatcggcgacctcgaccagggtgcgccggaactgcgtcccgactcgcgctacaacctcgacaacgacttcatcatccgcaactactcgaccagttcggacgtgctggtggtgatggtcaagacctccccggaaggctgctccacccaccaggccctggcggccatggacgaactggcctggaagctggagaacaccgagggcgtgcagtcggcgatctcgatggtcaccgtgtccaagcaggtgatcaaggggatgaacgaaggcaacctgaaatgggagaccctgtcgcgcaaccaggacgtgctgaacaactccatcgcccgtgccgacggtctctacaacaccgactgctcgctggcgccgctgctggtcttcctcaacgaccacaaggccgagaccctcgaccgcgcggtggcggcggtgcaggccttcgccgcggagaacgacaaggacgacctgcagttccagctggccgccggcaacgccgggatcgaggccgccaccaacgaggtgatcaagcagtccgaactgatcatcctggttctggtgtacatctgcgtggcggccatgtgcatgatcaccttccgttccttcgccgcgaccctctgcatcgtcctgccgctgatcctcacctcggtgctgggcaacgcgctgatggcggcgctgggcatcggcgtgaaggtcgcgaccctgccggtgatcgccctcggcgtcggcatcggggtggactacgggatctacatctacacccgcctggagtctttcctgcgcatgggcctgccgttgcaggaggcctactacgagaccctccgctccaccggcaaggcggtgctgttcaccggcctgtgcctggcgatcggcgtggccacctggatcttctcggcgatcaagttccaggccgacatgggcctgatgctgaccttcatgctgctctggaacatgttcggcgccctctggctgctgccggccctggcgcgtttcctgatcaacccggccaagctgcaggccaggaaggcctcgctgttcgctcactgagtcgcaccgagcctcgccaagaccgcggccccggccgcggtttttttcgcgcggaggaaggccgccgcgcttcagtccggtgtggcggggaacagcagctcgcagcggaagcgctgctcgtcgctgctgtaatgcaggcgccagccgctcttctggcacaggcgctggaccaggtcgaggcccaggccataaccgaacgccatcgactcctccgtgccctgggccgcaccgatggggttgctgatcagcaggctgcggtcgcgcacgacgatttccaccacgccctcgtcgctgtactgcagggcgttgcgcagcaggttgccgatgatgatccgtgcgcgggtctgcggcaggctgtgtggctccacgtcgaggtggaaggtcaggccgcggcgctggctcagcgcctgctgttcctcgagcagctcctccagcaggcgaccgacctcgatgtgtccgtcgtcgcgcagttcgccgctctcgcggctgagccagagcagggtttcggtcatctgctgcatgcccagcgccgagcggcggatgcgttgcaaggcatgcggggagggcgcgcggccgggttggtcgagcagctccaggttcatgccgatcaccgccagcggggtgcgcagctcatggctggcgtagcgcaggaagcgctcctcgcgctggctgaagtccttgatccgggtcacgctgttccacagggtatccgccagcacgttgagttcgcggtagttgaagcgcggccgctggctgtccggggcaaggtcgtcgagggtcatcgaccagcgcgtcagcttgcgcaacggcgcgacgatgaaccagaccagcaggccgacggcggccagcgaaggcagggtgaccgatag

SEQ ID NO: 12123 - DNA, 1296 bp, Pseudomonas aeruginosa
  unsure (30),(256): Identity of nucleotide at the above locations are unknown.
tcgcagaccaccccggcggcctcgaggtantcgatgacggtgccggcgagatcgaagttgtcttcgacgacgagtacgtggatatgcatggtatctgttcgcatgacggatgggacgctgtgcctggttcgccgcgggcgttgcccgcgcctacttgagcaccttgatcggcttcaccggggtgccgtcgctccactggcccatgccggtctgctccggcgtaacgcccagggcgtactggcggttgcggttgtanaacgccgcgtcggtgaggccatcgaacagcttccaggtgccgtaccagtcgagggcgtcgatcaccagcgggtcgtggccggtatagcggccttcggcctgctggacttcgaggcgcttctcgacgcggtcgagcaaccagtcgctgtcttcttccttcggatactgcgggccgaataccggcgcggtgggtgccgcgtggttggccagcagcggcggagcgccgtggcgatcgctgcgcagcagcagcaggttcttgtcgctgggcggaatgtgccggctctggcggtagatgcgcttggcgtcggtgcaggccacgtggctgtcctagtcgccgcagaccgccagcagcagggtgcccttggccagccccgacaggcgttcctgggtcacgccgtcccagcgcttgccctggctcttgccgggctcgaccaccatcagcgccttcgccgccggcagcttcaggcgttcgctggcggccgccaggttggcggcgagcagtccgccggcggagtggccgaggtaggcgacctggttcagccgcgggcgcacccccagctcgccggcctgcaggcgcctgagggcgtcgccgagggcgccggcggcattgtcgaggaagtctgcgttgggcgtcttcaggtccggctggtagcgcgggtagaccaccaccatgccgcggcggacgatatggtcgatccaggcgcggtagaggtccggctgcatcacgctccagccgtgcaggaagatcaccagcggagcgttgccggggaccggttgctcgggggtgaacacccagtattcgcgagcgccttcgccgaagtgccactgatgcacgctggcatggcgatagtccgcgccgcccggcccttcggccggctgcgtcggcggcgtgggcgcggtcggcggttcggcggccgtcgcggcgtggcccaggagcaggccgcacaggacgaggtacagggtacggaagcgcatgcgggccctcttgcggaatcggaatatcgtgccagtcctaaccatagcgccgttcagcgcggatag

SEQ ID NO: 12124 - DNA, 1302 bp, Pseudomonas aeruginosa
ccgctctgcttcggcaggagggtgacgatccagcgggtggtggcctgggcccggccgttctgcgtggcgagacggttgacctggcgcgtgccgaggacctcgaagagggcgtccagcgggctcaggtcgggtttgccgaagagggtcgggtcgtccgattccagcgtcagttcgacgctttccccttcggtcaggcgggcgcggtcgacgctggcgctgaagctggcatgggcggaaacgcagaggagcgcgagaagcaggctgcagaacaggcggatcatggcgtggcttcctggcgttgctgctgttggtaccagaacttgcgccgcagcaattcggcgggatcgtcgggaatctgtcgcagccattgctcgagggcctggcgacgttcgtcgtcgagtccgtcgtcggcttcctcgtcgcccgtccgctcgtcctcggcgttgggctgcggctgcgcttggccgggtgctccggcggtcttctcgccttcgtcttccggcaggctggtcgagggcgccgcggcctgggccttctgcgcatcgacggtcgccgcgtcgcgcggcggccgctggctgcttccggatggcgggctctgctggctcgcttcctggcgctgttccttgttctcgccggcctgctgctgcgccgcctgttcctggcgttggcgcagcagttcctcgaccagggccttgttgcgttgcgcggcgaccagttgcggctggcgctccagggcttgttcgtaggcgtcgacggcggcttccagttcgccctggcgggccagggcgttgccacggttgtagtgatcgtcggcctggtcgccttgggcgaaggcctgggccgcggcggcgtactcgcgggcctggtagagcgacaggcctttccagcggaagtcctcgaagcgcttcgccgcctcgtccgcctggccccgttgcaacaggcgctggccttgctggtccggacgcagccagaggtcttcgaactggaaggccatggccggttgcggcaggctcagcatcaacagcggcaggcagaacagccagccgcgccgtccggcacaggcggccagcaggagcagcggcaggagcagccagtaaccctggtcggcccagcgctgcaggcgcagcagggcgttctcgcgatcttcctccagcgtgccgccgcgggccagcaggccgaggctgtcgaggtcgcggtcgttcggccgcaggcgctggtagccggcgccgatctccgcggcgaagcggcgcagcccgctttcgtcgagcctgggcaggaggatgccgccctggtcgtccttga

SEQ ID NO: 12125 - DNA, 1236 bp, Pseudomonas aeruginosa
gctggtcgtccgacagcggcaccagggtatgcgcgctgccggcgtagacgacgatcgcggtctgcgcgtcgttgcgcgtgcgaagcaggtcgagcagcttgcgccgggcctgctccaggcgggtcggcgacaggtcgccggcaagcatcccgggagtcagctggaggatcgccaccagcgggtcgctacgcttcatcgagggctgttccagttgctgccaactgggcccgagcaaggccagcagggccagcagccaggcgatgccgaggcagatccagggcatgcggttctgccgcccggcgccgccgaccagcagccagggctggaaggccgtcggcaacagcaactgccagcgtccggcacgacgctggcgatgcagcagcttccacagcaaccagccaagcagcggcgccagcagcagccagtaggggcgcagccagtgcggccaggcgtccagcaacaggttcatggttgcctcccggaacggcggcgcggccaggtccggttttcccgtggccagagttccagcgccaccagcagcacactcaggccgagggcggcggccagcggccaactgtacagcgccagggccgggcgcgcccgggtagtctgctgggcgaccggttcgaggcggtcgagggtcgcggaaatgctttccagctcggcgctggatcgcgcgcggaagtattcgccgccagtgctctcggcgataccgcgcagggtcggctcgtcgagatcgagccccgggttgaagccgaacaggccgggcacgccgccttgctgcgggtcggcgccgatgccgatggtgtagatcttcacctgttgctcggcggccagttgcgcggcgatctgcggggctatctgtccgccggtgttggcgccgtcggtgatcagcaccagcacccggctttccgcaggccgctggcgcaggcgcttgaccgccaggccgatggcgtcgccgatcgcggtgttcttgccggcgatgccgatctgtgcctcgtccagccagacccgcacggtgtgccggtcgaaggtcagcggcgcctgcaggtaggcctggctgccgaacaggatcaggccgacgcggtcgccacgacggtcttcgatgaagtcgccgaagagtttcttgatcagttccaggcggctgatctcgtcttcctgccagcgcatgtcgcggtagtccatggagccggagacatccaccgcgagcagcaggtcgcggccgctggcgggtag

SEQ ID NO: 12126 - DNA, 4884 bp, Pseudomonas aeruginosa
caagccaagcggagtacaaccatggcgttcttcaccgcggccagcaaagccgatttccagcatcaactgcagacggcactggcgcagcacctcggcgacaaggcgttaccacaagtcacgctgttcgccgaacagttcttcagcctgatctccctcgatgaactgacccagcgtcggctttccgacctggtcggttgcaccctttccgcctggcgcctgctggagcgcttcgaccgcgaccagcccgaagtccgcgtatacaaccccgactacgagaagcacggctggcaatccacccacaccgcggtggaagtgctgcacccggacctgccgttcctggtcgactcggtacgcatggaactgaaccgccgcggctacagcatccataccctgcagaccaacgtcctcagcgtgcgccgctcggccaagggcgagctgaaggaaatcctgcccaagggtagccagggcaaggacgtcagccaggaatcgctgatgtacctggagatcgaccgttgcgcccacgccggcgaactgcgggcgctggagaaggccatcctggaagtgctcggtgaagtacgcgtgaccgtcgccgacttcgaaccgatgaaggccaaggcccgcgaactgctgacctggcttggcaaggccaagctgaaggtgccggcggaggaactgaaggaagtacgcagctatctcgaatggctgctggacaaccacttcaccttcctcggctacgaggaattcagcgtcgccgacgaggccgacggcgggcgcatggtctacgacgagaaatccttcctcggcctgacccgtctgctgcgtgccggcctgagcaaggatgacctgcacatcgaggactatgccgtcgcctacctgcgcgaaccggtcctgctgtccttcgccaaggctgcccatccgagccgtgtgcaccgcccggcctacccggactacgtgtcgatccgcgagctggacggcaagggccgggtgatccgcgagtgccgcttcatgggcctgttcacctcctcggtgtacaacgagagcgtcaacgacatccccttcatccgcggcaaggtcgccgaagtgatgcggcgctccggtttcgacaccaaggcccacctcggcaaggaactggcccaggtgctggaagtactgccgcgcgacgacctgttccagaccccggtggacgagctgttcagcaccgccctggcgatcgtccgcatccaggagcgcaacaagatccgcgtgttcctgcgcaaggacccctacggtcgcttctgctactgcctggcctacgtgccgcgcgacgtgtattccaccgagacgcgcctgaagatccagcaggtcctgatggagcgcctgcaggccagcgactgcgagttctggaccttcttctccgagtcggtgctggcccgcgtgcagttcatcctccgcgtcgacccgaagtcgcgcatcgacatcgacccggcgcgcctggaggaagaagtgatccaggcctgccgttcctggcaggacgactacagcagcctggtggtggaaaacctcggcgaggccaagggcaccaacgtcctggccgacttcccgaaaggcttcccggccggctaccgcgagcgcttcgccccgcacttcgcggtggtcgacctgcagcacctgctcagcctctccgagcagcgcccgctggtgatgagcttctaccagccgctggcgcagggcgagcagcaactgcactgcaagctgtaccacgccgacaccccgctggccctgtccgacgtcctgccgatcctggagaacctcggcctgcgcgtgctcggcgaattcccctaccgcctgcgccaccagaacggccgcgaatactggatccacgacttcgccttcacctacgccgaagggctggacgtggacatccagcagctcaacgagatcctccaggacgccttcgtccacatcgtcagcggcgacgccgagaacgacgccttcaaccgcctggtgctgaccgccaacctgccgtggcgcgacgtcgccctgctgcgtgcctacgcgcgttacctgaagcagatccgcctgggcttcgacctcggctacatcgccagtgcgctgaatgcccacaccgacatcgcccgcgagctggtgcggctgttcaagacccgcttctacctggcgcgcaaactcaccgcggaagacctggaagacaagcaacagaagctggagcaggcgatcctcggtgccctcgacgaagtccaggtgctcaacgaggaccgcatcctgcggcgctacctcgacctgatcaaggcgaccctgcggaccaacttctaccagcccgacggcaacggccagaacaagagctacttcagcttcaagttcaacccgaaggccattccggagctgcccaggccggtgcccaagtacgagatcttcgtctactcgccgcgcgtcgagggcgtgcacctgcgcggcggcaaggtggctcgcggcggcttgcgctggtcggaccgcgaggaagacttccgcaccgaggtgctcggcctggtcaaggcccagcaggtgaagaacgcggtgatcgtgccggtcggcgccaagggcggcttcgtcccgcgccgcctgccgcttggcggtagccgcgacgagatccaggccgaggcgatcgcctgctaccggatcttcatttccggcctgctcgatatcaccgacaacctcaaggaaggcgaagtggtgccgccggccaacgtggtccgccacgacgaggacgatccctacctggtggtcgccgcggacaagggcacggcgaccttctccgacatcgccaacggcatcgccgccgagtacggcttctggctcggcgacgccttcgcctcgggcggctccgccggctacgaccacaagggcatggggattaccgccaagggcgcctgggtcagcgtgcaacggcacttccgcgagcgcggcatcgacgtgcagaaggacaacatcagcgtcatcggcatcggcgacatggccggcgacgtgttcggcaacggcctgctgatgtcggacaagctgcaactggtggccgccttcaaccacatgcatatcttcatcgacccgaacccggacgccgccagcagcttcgtcgagcgccagcgcctgttcaacctgccgcgttcgagctgggccgactacgacgccaagctgatctccgccggcggcgggatcttcctgcgcagcgccaagagcatcgccatcaccccggaaatgaaggcgcgcttcgacatccaggccgacaggctggcgcccaccgagctgatccatgcgctgctcaaggcgccggtcgacctgctctggaacggcgggatcggtacctacgtgaagtcgagcaaggaaacccacgccgatgtcggcgacaaggccaacgatggtctgcgcgtcgacggccgcgagctgcgcgcgaaggtggtgggcgagggcggcaacctgggcatgacccaactggcgcgggtcgagttcggcctgcacggcggtgccaacaacaccgacttcatcgacaacgccggtggcgtggactgctccgaccatgaggtcaacatcaagatcctgctcaacgaagtggtgcaggccggcgacatgaccgagaagcagcgcaacgcgctgctggtgaagatgaccgacgcggtcggcgccctggtgctgggcaacaactacaagcagacccaggcgctgtccctggcgcaacgtcgcgcccgcgagcggatcgccgagtacaagcggctgatgggcgacctcgaggcgcgtggcaagctcgatcgcgccctggagttcctgccttccgacgaggagctggcggaacgcatcagtgccggccaggggctgacccgcgccgagctgtcggtgctgatctcctacagcaagatcgacctcaaggaatcgctgctgaaatcgctggtgcccgacgatgactacctgacccgcgacatggagaccgccttcccggcattgctggcggagaagttcggcgacgccatgcgccgccatcgcctgaagcgcgagatcgtcagcacgcagatcgccaacgacctggtcaaccacatgggcatcaccttcgtgcagcgcctgaaggagtccaccggcatgagcgcggccaacgtcgccggggcctacgtgatcgtccgcgacgtattccacctgccgcattggttccgccagatcgagaatctcgactaccaggtgcccgctgatatccagctgaccctgatggacgaactgatgcgcctcggccgccgcgccacccgctggttcctccgcagccgccgcaacgagctggacgcggcgcgcgacgtggcccacttcggcccgcgcatcgccgccctcggcctgaagctcaacgagctgctcgaagggccgacccgcgagctgtggcaggcgcgctaccagacctacgtcgacgccggcgtgccggaactgctggcacgcatggtggccggtaccagccacttgtacacgctgctgccgatcatcgaggcgtccgacgtgaccggccaggacaccgcggaagtggccaaggcctatttcgccgtgggcagcgcgctggacctgacctggtacctgcaacagatcaccaacctgccggtggagaacaactggcaggcgctggcccgcgaggcgttccgcgacgacctcgactggcagcagcgggcgatcaccgtctcggtgttgcagatgcaggacggaccgaaggaggtcgaggctcgcgtcggcctgtggctggaacagcacctgccgctggtcgagcgctggcgggcgatgctggtcgaactgcgtgccgcgtcgggtaccgactacgccatgtacgccgtggccaaccgcgagctgatggacctggcgcagagcagccagcacggtgtctgcatcccctga

SEQ ID NO: 12127 - DNA, 450 bp, Pseudomonas aeruginosa
ataaatatgcccaccaaccaggatctccaactggcagcgcatctgcgcagccaggtcaccaccctgacccgccgcctgcgtcgcgaggcgcaggccgatccggtgcaattctcgcaactggtcgtgcttggcgcgatcgaccgccttggcggcgacgtcacaccttccgagctggccgccgccgagcggatgcgctcgtcgaatctggccgcgctgctgcgcgaactggaacgcggagggctgatcgtccgtcacgccgatccgcaagatgggcgcagaacccgcgtgtcgctgagctcggagggccggcgaaatctctacggcaaccgcgccaagcgcgaagaatggctggtgcgtgccatgcacgcctgtctcgacgagagcgagcgcgccctgctggcggcggccggtccgttgctgacacgcctggcgcaattcgaggagccctga

SEQ ID NO: 12128 - DNA, 615 bp, Pseudomonas aeruginosa
atccagggctttgggttccggcagatggaagaggagttcccgatgaacacagcactgatcggtctcgactacatcgtcgatatcatgcatcccgacggtaggattgcccgctgtgcagaacaggccgccttgcgtggcgtggtcgcgcgtttcaaccgcgctctcgccgtcgccgagcagcgtggctggctgcggatcgcggtgagggtgggcttcgagcccggctatccggacctgccggaacattcgccgatcttcgctgccgcgcaggcactcggcgctctcgacctctgcgggcgcggttgcgcatttcatcctgacctgaagcgggatgccgtgcagatggaagtgctcaagccgcgcatcagcgccttctatgccacgcgcctggaggccgtgttgcgggcgaggcggatcgagcgcctggtgctcgccggtgtcagtacgacctgggctgtgcaggccgccgcgcgcgatgcgcacgatcgcgactaccaagtgctggtgttggaggaggcctgcgcggcggccagcgacgaggagcaccggcgctccatcgaggtcctgggcggcatcgcgcggatcgtcacgctcgaccagttggcagcgctctag

SEQ ID NO: 12129 - DNA, 999 bp, Pseudomonas aeruginosa
gcggcgcgtcgtgtgtgcgcctcgctgacacgcctgttcgacggccgcgccatggggcgcgcgctcgccgtgtcgctgccgctgttcgtgctctacagcgccagcggcgatgccaactggctgctggcgaatatcgcgacgatctccgtggcggtcgtcgtcgagcgggtcggtagcgcaccgctcgcggcgctcggccagggggtggcgatcatcctcggctttctcggcctgtcgttcgcgctcgcctggggagcggcgtttgccatcgcttgcgcagcgctcgccgctgctgctgtcgcgctatccggcctggatacgcgcttgcgcacgctgggcaatttcgtctttattcctgtgctctatctggcctgcgaggttgccgcgacgcaccgcgctgcgctgtccctggtgccgtatctcgtcgtcgcaacgctaccatcggtggcgctcgccggtgtcgataccttgcgccacgcagcgctcgcacgccgttacggcaccctgctgcgctggcgtggggcgcacttgacgggccacgcggccgcgcatgacgagctgctccaggctgtgttggcggtcacactcgccgtagcctgcagcgcgaccttggtggcgtggcggcacatcgaatacggccagtgggcgatctggtcatccgccagcgtggttaccggcaatgccgccagcgcgcacctgaagctgcgcgatcgcgggcttggcgcgctgctcggcgtaccgctcggcctcgtggtaggggccgctctaccgcatgttctattggtccacaccttggcgactcttgcctcggtcctcaccctcgtcggattccgtcactacgcgacaggttttgccgcgcgttgcgcgtgcatcgcctgcgcctcctgggcgattcagcagtcgcccctggtcgcctcgctgcgggtcgccgaagtactggcgggtggggcgataggcgtcgcctcggtgtggctggtgcggttcctcgcacgcaactga

SEQ ID NO: 12130 - DNA, 624 bp, Pseudomonas aeruginosa
cgaaggctacgtgccgttcgtcagcaccccggcgctggactacctgggggtgagcgacgtcgaggtgcaaccgcggcgcatcgcgctgctctacgatccgcgcgagggcgacctgaccctgagccccggccacgtctacctcggcggcctgctcgaatacctcggttatcgggtcgactacctgcccaccgaccagccgctgcccgaacgtccgctgagcggtatctacgcgggggtagtcacctggatgaccagtggaccgccgctggccagcgacgccttcgacaactggatcgctgcgcgtctcgacgaaaaggtgccggtggcgttcctcgccggcctgcccacagagaacgacggcctgttgcagcgcctgggtattcgccggctgtcgcagaagctcaaggtcaagccgagcaccgagacccacgaccaggcgctgctgggcgccttcgaagcgccgctggtgatccgggtccgcgacctgccggcgctcaccgtactcgacccggcgcgggtggccccggcgctcaagctcaagggcgacggcaaggagtacgtgccggtggcgaccgccgactggggcggcttcgccctggcgccctatgtgctggaggagggtag

SEQ ID NO: 12131 - DNA, 1413 bp, Pseudomonas aeruginosa
cgagcaccggcgctggatcctcgatccgttcgccttcctgcgcaaggccttgcgccttgcgccgctgccgagtcccgacgcgaccaccgagaatggccggcgcatcgccaccgtgcacatcgatggcgacggcttcgtctcccgtgccgaggtgcccggcagtccctatgccggccagcaggtgctggaggacttcatcaagccctatccgttcctcacctcggtctcggtgatcgaaggcgaggtcgggccgaagggcatgtacccgcacctggccagggagctggagccgatcgcccggcgcatcttcgccgacgacaaggtcgaggtcgccagccataccttcagccatccgttcttctggcagccgcaactggccgagcagggcgagaacttcgaggcccagtatggctacaagatggccatcccgggctacgacaaggtcgacttcgtacgcgaggtgatcggcgcccgcgactacatcgagcagcgcctgaccaccccgcggaagccggtgaagatgatcttctggtccggcgacgcgctgcccgacgccgccaccatcaagctcgcctacgacgccgggctgatgaacgtcaacggcggcaataccgcgctgacccgggcctttccctcgctgaccggactctacccgctgatccggcccacccgcggcggcgtgcagtactacgcgccgatcatcaacgagaacgtctacaccaatctctggcaggggccgtactacggcttccgcggcgtcatcgataccttcgccctgaccgacagcccgcgccgcctgcgcggcctgcacctgtactaccacttctattcggggaccaagcaggcctcgatccgcaccatgcaccagatctacgcggcgatgcaggcggagcatccgttgtcgctgtggatgagcgactacatcccgcgcctggaaggcctgcatcgcgccagcctggccaagcgtgccgatggcagctggcagttgcgcggcttcgccgccttgcgcacggtgcgcctggacccggcgctgggttggccggacctcgctcgctccacgggagtcgcgggcgtgcgcgacctgccccaggggcgctatgtacacctgagtgcggcgaatgcgcgcctggtcctgcgcgacagccgcgatccgcggccggcgctggaggaggccaacctgccgctgaagcactggcgctaccgcgacgatggccgcgtcgagttcgccttcgccgggcacctgccattgcgcctggtggtgcgcgcggcgggcgattgccggctgagcgcggccggcaaggccttcccgggaaaggccggcaacggcctgtggacgttcgagttgccgatggagcaggtgcgcgatggccaactcgtctgccgctgacaagcatccccaggcgcgcctgctga

SEQ ID NO: 12132 - DNA, 1122 bp, Pseudomonas aeruginosa
cctacagcacgcgcttcggccgctgaacgcggcccggatacggaattcaacaggaggaacacaacatgcaatccatccgctgcctggctctcgcggccgtcgccctgttcatggcgggctgctccagcttcaccagcgaaagcgctacgccgctggcgcgcggcgcgcagtggggcctggtgccgctgctcaattactcccaggcgccgcaggccggcgagcgtgccgagcagatcctgctcagcgtgctggccgaggagggcgtgcggccgcgcctgtacccggcgcagccgcaaggcgacctgcaactggtcgacgaccgcgagcgccagcagcgcgcgctggactgggcacgccagcagaagctggcctacgtggtcaccggcagcgtcgaggagtggcagtacaagaacggcctcgacggcgagccggcggtgggcgtcagcctgcaggtgctggagccggcctccgggcgggtgctctggagcaccagcggggcgcgcgccggctggtcccgggaaagcctggcgggcgccgcgcagaaagtcctgcgcgagctggtcggcgacctgcggctcgagtgacggcgatgtccgcgcacaaggatttcgccctcgcaccgcgcgccagcggcagcgtctcctgggtcgagacgctggtcatcagcgcgctcgcgctgggcctgggctggtggttcagcccggacgacccgctgcaggtcaacgccacctttccctgggtgatcctcgcgcccctgttgctgggcatgcgctacggcttcgtccgcgggttggccagcgcggcgctgctggtggcggcgctgttcgcgtttcgcgtccagggcgtcgaggcttatgcccaggtaccggcggccttcatcgtcggcgtgctgctctgcgccatgttggtgggcgagttccgcgacatctgggaacgccgcctggagcgcctggagctggcgaacgagtaccgccagttgcgcctcgacgaattcacccgcgcccatcacatcctgcgcatctcccacgatcgcctggaacagcgggtcgccggcaacgaccagagcctgcgcagttcgctgctcggtctgcgacaactgctgcgcgagctgccgggcgatga

SEQ ID NO: 12133 - DNA, 816 bp, Pseudomonas aeruginosa
ggcaccgctcgatgcgctggcggaaaccgtgctggcgctgctggcccagtacggttcgctgcgcatcgccggactctaccgggtgcgccacgaccgcaccccggagccgcaatccttggcgacgctcggcgagatgccggcgctggacgccgacgatctgctggtgcgcacctgcctggagcgcggcgaactggtcagcgtgcgccaggaactgctggagcgcggcgagcagcgtgcgcacagcgcgctgcaggtgtgcgtgccgctggtcgacaccgatgggcggatcctcgccctgctggcggtggagcagatgccattcttcgtcttcaacgaacgtaccttcagcctgctggcgatcctcgccgggcacatcgccgacttgctgcagagcgaccgtcgcgcactgcaactggccgacatcgacgcccagcgcttctcccagtacctcaagcgctccctgctggacgcccgcgaccatgggttgccggcctgcctgtatgccttcgagttgaccgatgcgcgctacggcgaagaggtccagcgtctgctggaaggcagccagcgtggcctcgacgtgcagttgcgactgcgcaacgacgagggccggcgggtcctgctggtgttgttgccgctgacttccgccgaaggctcccaggggtatctgcagcgcctgaggattctcttcgccgaacgcttcggccaggcccgcgagctggagtcgctgggcgtgcgcatccgccagtacgaactggacgccggcaacgatcggcaggcgctgggacatttccttttcaacgagtgcggcctgaatga

SEQ ID NO: 12134 - DNA, 897 bp, Pseudomonas aeruginosa
tgttcagcgacggcggtctgcaggacgtcctgcgccatgcgccggacccgaaccagcggctcacggcgatcttcgccacccggcggatgcccggcaaggaggcgatcccgatcctcaagctggccctgcgcgaccccgccgacgacgtccgcctgctggcctactcgatgctcgaccagaaggaaagccggatcaaccagcgcatcgaggccgccctcggccgcctcgccggcgccacgccggcgcgacgcggcgcgctgcacggaaccctggcgcgctggtactgggaactggcctacctggggttggcccagggcagcgtgctggagcacatcctcgagcaggcgcgcgagcataccgaccaggcgctgcgcggcgcaccctcggccgacctgcatctgctggccgggcgcatcgccctcgaacaaggccgcctggaggatgccggacgcgccctccaggccgccgaggaggcgggaatcgatagcgcccagctggcgccgttccgcgccgaggtggcgttcttccagcggcgctaccgggacatcccccggcttctcgccggaatgcccgacgacatgctgcaacggccgcccttcgcggccctggcgagatactggacatgaccgaacacaccgctccgacggcgcccgtcgccgatgtctgcctgctgctggagggcacctggccctatgtccgcggcggcgtctccagctgggtcaaccagttgatcctcggtctccccgacctgaccttctcggtgttcttcatcggcggccagaaggatgcctacggcaagcgccactacccgatcccggacaatgtgctgcacatcgaggaacacttcctgtaaaccgcctggagttcgccgaacccgcagacgcgacagggcagtag

SEQ ID NO: 12135 - DNA, 1338 bp, Pseudomonas aeruginosa
cgagaccgaaaaggcgttgcgcgatctgcaccgtttcttccactacccggagacgccggacgtggaggagggcgacgcgctgctcgacctgctcgccgagggccgcatcggccgcgaggactttctccacagcaaggccagttgggaggcgatcaccgcaggctacgagcgctattgcaccgatccgtccttcgtcaattacttctggaccctgcgctcgatgcaggcgccggtgttcatgctcgccgaggcggcccggcggatgccgcgggcgcgcatgctgcactcgatctccaccggctacgccggcctgctgggctgcatcctgcaacgtcgctggggctgccgctacctgctcagcgagcacggcatctacaccaaggagcgcaaaatcgacctggcccaggccaactggatcgcggagaaccccgacgagcagctgagtaccggactggatgccgaggtcagctacatccgtcgcttgtggatccgcttcttcgagcgtgtcggcctgctcacctatcgcgcggccaatccgatcgtcgccctctacgaaggcaaccgccagcgccaggtactcgatggcgccgagccacggcgcacccgggtgatccccaacggcatcgacctcgatgcctgggccggcgccctcgaacggcggccgccggggattccgccggtggtcgggctggtcggccgggtagtgccgatcaaggacgtgaagaccttcatccgcgccatgcgcggggtggtcagcgcgatgccggaggcggagggctggatcgtcggtccggaggaggaagatccggactatgccagcgaatgccgcagcctggtggccagcctcggcctgcaggacaaggtgaagttcctcggtttccgtcggatcggcgaggtcctgccgcaactcggcctgatggtcctcacctcgatcagcgaagcgcagccgctggtgatcctcgaagcctgggctgccggcgccccggtggtgagcagcgacgtcggctcctgccgcgaactgatcgaaggcgccgacgccgaagatcgcgccctgggtcgcgccggggaggtggtggcgatcgccgacccgcaggccacttcgcgggcgatcctcgccctgctgcgcaatccgcagcgctggcaggcggcccaggcggtcggcctgcaacgggtcgaacgctactacaccgaggcgctgatgctcggacgttaccgcgggctgtaccgcgaagccacggagattgcatgacatggccggcatcggcttcgaactgcggaagatcctttcccgcgattcctatacggcgaccctgcgcgcctacctctacgccgggctga

SEQ ID NO: 12136 - DNA, 1833 bp, Pseudomonas aeruginosa
cgtgaagcggcccgacattgccgggctgatggagaaactggcctacaagccgaccgaggcgaacaagaccttcggcgtgctgcgcaagatgttcaacctggccgaagtgtggggctaccgcccggacggcacgaacccgtgccgccacgtccccatgtacccgccgggcaaggaaacccggctcatcgtggacgaggaaatggtgcggatcttccgccagttggagaagctggaggcggaggggctggagaactacgtcatcccgctggcgatccggctgcaattcgagttcgccgcccggcgctccgaaatctgcccgctcgaatggagctggctggacttcgagaaccggcgcgtggtgtggcccgacagcaaggtcggcggcatttccaagcccatgagcgaggaagcctatcggctgctttcgacggcgccgcgccgggagggctgcccctacgtcctgccatcgccgaacgacccggccaagcacctgacctttggcgagcactatggcggctggtgccgggtgctcaaggccgccggcgtcccgcacgtcggcacgcacggcatccgccatcgctcgacgaccgacattgccaattcgggcgtgccgaccaaagtgggcatgaagctgacgggccacaagaccgtagcgatgttcatgcactacgtccacaccgaggacaagccggtgcgcgatgcggccgaactggtggccagccggcgccaggccatcacgggcgcacgccagcttgcggaggcggcggcatgaacacgcgccggtcatccgcagcatcgtccacagcgccttcggcgctgctgggcgacattcgggcactgatcgaggcggcgcgcaagcgcgccgcctcgacggtgaatagcgagctgacgatgctctattggcgcatcggccagcgcatccgcacgcaggtcttggacgggcgccggggcgcttatggcaaggaagtcctgcccaccctggcggcgcagttggtgaaggagtacggcggcagctttgccgagcagaacctgcgccgcatggtgcagttcgcggccaccttccccgacgagcagattctcgtatcactgatacgagaattgagctggacgcacttcatcgccctgatcccgctgaaagacccgctccagcgggactactacgcacagatggcgagcaccgaacgctggagcgtgcggacgctgcgcgagcgcatcgactcgatgttgtacgagcgcacggcgctgtctcaaaagccgggcgagacgatcgcacaggagttggcgaagatgcgcgatgcgcagcgaatgtcgcccgccctggtcatgcgcgacccctacatcctcgacttcctggggctgcgggacacttggcaagaaggcgacttggaggcggcgatcatccgcgaaatggagtcgttcttgttggagctgggcgcgggtttcagcttcgtggcccggcagaagcgcatccagatcgacggcgaggatttccacctcgacctgctgttttacaaccgcaagctgcggcggctggtggcagtggagttgaaggtcggcgagttcaaggcagctttcaagggacagatggagctttatcttcgctggctggacaagcacgaacgggagccggaggaagcctcgccgctggggatcatcctttgcaccggcaagaagcgcgagcagatcgaattgctggagttggacaagtcgggcatccacgtcgccgagtacctgaccgccttgccgccgaggggcgtgctggtggagcggctgcaacaagcaacgcaacgggcgcggttgcagatcgagcagcgcaagaccgacaacgagtag

SEQ ID NO: 12137 - DNA, 393 bp, Pseudomonas aeruginosa
gcctggcgtgatcgagcagttgcagtcgatgacagcgccggcggcgggctgattgcgtcgtgcggccttcggtgcgtcgctccttcgcgggcggcgcacattttcatatccccccaggggggatacaattgccacatgaacgcgacacacaagcactcaacccatcccgatctcgtgaagcggctgaaacgcgccgatggtcatcttcggcacgtcatagggatgatcgaaagtggcgaatcctgtctcgacatcgcccgccagctcgcggcggtggaaagcgcggtgacggccgcaaagcgcgtcctgatccacgaccacatcgaccattgcctggcccatgacgaagactccgttttgaccgaaatgaaggcactgaccaaactgctctga

SEQ ID NO: 12138 - DNA, 1320 bp, Pseudomonas aeruginosa
ggcccgccgatgctctccgtcctgaagaaccgtacctatcgtcacctgttcgccgctcaggtgattgcgcttgtcggcaccggcctgatgacggtggcccttggcctgcttgcctacgatctggccggggcgaatgccggcgcggtactcgggacggcactcgcaatcaagatgctggcctatgtcggagtcgccccggtcgcgcaggcgttcgccgaccggctgccgcgacggtcgttgctcgttgcccttgacctagtacgagcatccgttgcgctctgcctgccctttgtcagcgaaatctggcaaatctatctgctgatcttcgtcttgcaggcggcgtccgcaggcttcacgccgacctttcaagccactatcccggacatccttcccgacgaagacgagtacacgaaagcactgtcgctttcccggctggcctacgatttggaaagcctgatttccccgatgctggccgccgcgctactgacggtcatcagcttccacaacctgtttgccggaacggttctcggcttcctcgtgtcagccgcgcttgtggtcagcgtgaggcttcccacaaccgttcccggcccgcgtcgtggcatatgggatcgcactacgcggggcacgcgcatttacctcgccacgccgcgccttcggggtctgctggcgatcagcctcgcggtggcagcagcggggtcaatggtgatcgtgaacacggtggtcatcgtgaaggcacgcttcggcctgggcgaatccgaggtagcgtgggcgctggcggccttcggaggcgggtcgatggttgcggccttcgcgctgcctcgcctgctcgacaagattgctgatcggcctgtcatgattgcgggagcgacgatgctggttgtgggaacggcagccggggcaatgattccgacatatgccgttctggtggtgatctggttggtggtcggcttcggctacagcgtggcgcaaacaccttccggccggctgttgcgccgctccgctcaccccgaggatcgccccgcggtctttgccgcgcaattcgccctctcccatgcgtgttggctcatttgctatcccttggccggtcgcttcggcgctgcctttgggctgcaatcgaccttcatcatcatgtcgctgattggtcttgtcggagtgggactggcgctgtggctctggcccgctagtgattcttccgacatcgcccacgatcaccctgatctaccgccagatcatcctcacttgcgcgaacatgcagaccgaggcgggcaccgtcatcccatgatcgttgacgatctgcaccgggactgggcgcgcatttaa

SEQ ID NO: 12139 - DNA, 537 bp, Pseudomonas aeruginosa
ccacgaccacgcctttggtctttgcgacctgggcctggggatgccggaaatcggctgggtcagcctgggcgagctggcgaccgtgcgcggcaggctgggcctgccgatcgagcgcgacctgtctttccgcgccgagaagcggttgagcgcctacgcgcgcgatgcccggttggtcgggcgtgtcgtcgtctgaaccagcccttggagcgccgcaaggcgctccttgcgctttcccaaccttcgcaggagatcaatgccatgagcagccatcacgactacatcatcgaaatcacggcgcaacacgatgcgctcaagccgttcgcgccggagaacggtcagcccttgcgcttcaagatcggcgacgcggtgatctacaccaacgagtttggcgcgcagttccggcgccgcgtcaccgggttctaccagcctaccgagccttcggggctgtatgcgcgtggcaggcgctactacctgaactcgacttcgccttggatgccggttgcggaatccagcctgcgtcctgacgactcggcgtga

SEQ ID NO: 12140 - DNA, 2070 bp, Pseudomonas aeruginosa
ccgcaaggagttatcaccatgaacgccgtactcaaaaccgaagccgtcgccatcgaagccgccgcaccgctggaaatggccgacccgtccaagaacctgattctggttccgctctcgcagttgctgccgcgccgctccaagcgcaacgcccgcaagatgccgcgcctgtccatccccgaactggccgcgagcattgcccgcatcggcctgctgcaaaacctgatcgtcatcctttccgcagatggcgaggcttacgaggtggtggcaggcgaccgccgactgaccgccttgaagctgctggcgaagaagaagcgcatccccgccgactacgaagtgccgtgcctgctggtgcccgatgcttcggcccgtaccgtcagcctcgcggaaaacctgatgcgcgagcagatgcaccccgccgaccagttcgaggcgttcgccgcgctggtcaaggaaggccggcccatcgaggacattgccgccgacttcggcgtgtccccgctggtggtgcagcgccgcttgaagctcgcccacatcgcgccgcgcctgatggccgactaccgcgccggaaccgtcacgctggaacagttgatggccttgaccatcaccgacgaccacgccgcgcaggaagccgcgttctttggtgcgccggaatggcagcgcagcccgtccaagctgcgcgagcgcctgaccgaacgcgaaatcgacgcctcgcacgcgctggtgcgcttcgtcgggctggacacctaccggcaggcaggcggcggcgtccgccgcgacctgttcgcagaaggcgatgccggaacctacctcaccgataccgcagtgctggaaacgctggtgcgcgacaagctggcaacgctggccgaggacgtgcgcgccgaggggtgggcatgggtggaggccgtgccgcatctggcctacgaggaacggcaggcgttccagaacgccccgcgccatcgccgcgagccgaccacccgcgaagcccgccgcatcgcctcgctggaaacccgcctcgaaaagatcgacgccgaactggaagaagcctgcgacgccgaggacaaggccaaggccgagaagctggaacagcggcgcgatcaggtggtcggggaactgcaagacgcggaggatgccttgcagggctatgcccccgaggtgcgcgaggtggccggtgccatcgtcaccatcgaccgcaacggcgaggccgtcattcatcgcggcctgctgcgcgaagccgaggccaaggcgctgcgcacgctggaaaagctgcggcgcggtttcggcagtgccgaaggcgaagccgccaacgacgagcacgaggacgccgacgacgcgcccaaggccgcgagcctgtccgaccggctggcgcagcggttgagcgcccaccgcacggcggcgctgcaaatcgaagttgcacggcatccgcatgtcgcgctggccgcgctggtgcatggcatggtgcagaccgtcttgcagcccgacgcctacggcgatggcctgccgctgggcgtgcgcctcacggcgcaagaccgactggaaggcatggccccggactggccggaatcgcccgctgccgtggcgctgcgcgaactgcaacaggtggccggtgaagccttgccggaggacagcgccgaactgctcgctgtgctgctggcgaagtcgcaagacgaactggtgcggttgctggccgtgtgcgtggcttccacggtggacgtggtgacgcctcgcgccacggcgcaccagcccggcgaggaactggcgcaggccgtgggcctcgacatagccgcatggtggaagccgaccgcagaaggctacttcaagcacgtttccaaggctgtgattctggatgccgtgggcgcgtttgcaccggaatctgtcacccggctggcgaagctcaagaaggccgacattgccagcgaggccgagcggctggccgatggcacgggctggatgcccgccatcttcaaggccgcaggcccgcagaatgccgcgcaggaggcaggcccggagcaggacgccccggaggatgccgaggcaatggcggatgaaccagccgaggcgctggccgcttga

SEQ ID NO: 12141 - DNA, 837 bp, Pseudomonas aeruginosa
cctggcccgcgtcagcgggcgagccggaaaagccttcgggcggggatgccgactctgccccatctcctttcggagtggttcggcccaaggcgtccttgtctcgttgtgaatcctggcgggggtgcggctgcgcctcgggcttatggctgcaaccgtccggcgaaaacaatttccccgccgctacgcggcttccacgcgcaacaaattcttttcgcctcccggctctccactgcgtttcgaccgcaagcggtgcagccagcccgtcccccgccggccggatcacaacaaggacgcgatgggcgcgaaccttgttcaaccgaaaggagaaatcatcatggccaacatcggcaccttcaccgcagacaaagacggcttcaccggcacgctgcgcaccctgacgctcaacgtcaaggtcaagctggttcccaacgacaagggcagcagcgagaacgcccccgacttccgcctccaggccgccggccacgacatcggcgcggcgtggaacaagaccagcgaggccgggcgggaatacaagtccgtgaccctcgacgatccttcgttcccggctccggtctatgcccgcctgatcgaaggcgaggacggtacgcacgacctgatctggtcgcgcagcaagccccaggcggcgtgaccgccgcagcgccccgcccatcgcggcggggcgctgtgctgctgttcgcagcacatcaccacgtcacgcgcgcggcttcgccgcgccgcgctccttcagcaccgcctccagctcccggcgcacctgcgccagcagctcgtcggccttgtgcgtgctgtcgcccgcgtaggccagcgtcagcagcgtga

SEQ ID NO: 12142 - DNA, 387 bp, Pseudomonas aeruginosa
ggacgacgcaaaacggccctgagcaggacagcttggttttctgagactgcctccatccggttgcgctgtgtggccggagctttgaaagctatggaggttcacaccatgcgtcccgctcctttgcggcctgccgccactgtctcgaccgctgccgcgcagccccaacgctatctcaccaacgacgaagccgccgaatacctgcgcctgtcgccgcgcacgctggaaaagcagcgcgtgatcggtggtggtccgcgctttcgcaagttcggccggcgcgtcatgtacgccgtggccgacctcgatgcctgggccgccgaccgcagcttcgagacgacttccgatcccgagtacgccgagcaccactcggccgacagccgtgcgcgctga

SEQ ID NO: 12143 - DNA, 723 bp, Pseudomonas aeruginosa
ggaaacgccgctgcggtggacaaccaccacgcggccacaaacgcagcagccaaagcccggttttccagcacggaggaccgcgccatgatcgtcgcactgctcaaccagaaaggcggcgtgggcaagaccacgctcgccacgcacatcgccggcgaactggcgatgcgcgggcagcacgtcgtgctgctcgacgccgacccgcagggttcatcgctggactggacgcagcgcagaagccagcaaggcttgccacggctgttcagcgtcgtgggcctcgcacgcgaaacgctgcatcaggaagcgccggaactcgccaggagggccgatcacatcatcatcgatgggccgccgcgcatcgccgccttggcgcgctcagcgctgctggcggccgatcgcgtgctgattccggtgcagcccagcccctacgatctgtgggccagcgccgagatggtggcgcttatccgcgaggcgcaggtgtttcggccgctgctccgcgcagccttcgtcatcaaccggcgcgtcagtaccaccgtgatcgggcgcgaagcgcgccaggcgctcgccgaccaaccgcttcctgcgctgcgcgcggaagtgcatcagcgcatcgtgttcgccgacagcgtggccgctggccggcttgcacgcgagacggcacccgatagtgccgctgcccgcgaaatcaccgccttggtggacgaactgctgcggtggccgacatga

SEQ ID NO: 12144 - DNA, 984 bp, Pseudomonas aeruginosa
acccgcgcgcaccctccagctcgaccgctggcggcgctgcgcggtgttcctaccgggcgccgtgttctgccgcatccgctggcaggccaacgactacggcaccgtgcgctggcagctcatggcgatgcaggcttgcacgccgctcgatgcggcgcagcgcatccccggcgtgcagccgggcgcgagcctgctgctgcacgccgagggcgagaacgcagtgcgcgcggtgctggagcgcatcgacgccatcgaggcgctgggtatcgcgcccggcggcgcctcgctcgcgtactggcgcacgctcgccaaccggctcgctgcgcgcttgccgctgcccgaatacaccgccgagcggcacgccgcctggctgaccgggagggcgctgccatgaccgccgtttccactgccgacgccgcgccgcgtcctcgctcggcccgcacaggtttgctcgctcgcatcgtgctggcgggcctgtccgcctgcggcctcgctgcgctggcctgggcgtccttcgtgcatccgctgccgcgcctgatctacaacccgtccgacagcgtggcggtcggctggtatcgcgtcgatccgctgggctacggtgccggctcgctgccacgtccgttgtccgtggacagcatcgtcctgaccacgttgccgccagatgccgccgcgctggccgcgcagcgcggctacctgccggcgcgcgtgccgctgctcaagcgcgtgggcgccatcgcaccgcaggaggtgtgcatctctggccgcatcgtccgcatcgacggcgtgccttcggccgccgtgctgcccgctgaccgttggggccggccgctgtcatcctggcagcaatgccgtcgccttgaagctggcgaactgttcctgctcagtgtgaccaacccggcatcgtttgacagcaggtacttcgggccggtcagcgcgtccgccgtgatcggcatcgcgcatccaatctggctggaggcccgtccatga

SEQ ID NO: 12145 - DNA, 1365 bp, Pseudomonas aeruginosa
tggcggccgattcgctgcacgttgctgtgcatctcatcgtgccatcgggcatgccgctccggtggctctctgcgtgtcgtcgcgcgtgcagtgccagcgcatccgcgctgcacttcgcgcagccttcccatgtgcaggcgtcttgcctcgaacgcgcctggcctatggccgtcgccgcgttcgccggcgcgctggctgctcacgcagcagcgccgacgggccgccgacgcccggagcgccagcgaggggcaaaggcggaaggcaagacaaaaggacgcggcaccgggccgcgtcgaaagccagtctgcacatgggggttgcgcggcacggcgcggcttcgccgccgtgccgcttgtggcgcgaggcccgcgccgatgcaggcatgtccgcgtgcttcgcacgaccggacacgccagagcttgcagagggcataaccatgaccgaccgccgcgacgacgatttccgcatccgccctggcgccccgaagaacaggggccagggcttcgtctccaaggtgctcaagcaggcaggcaaggccagcagcggcaagtccacagtgcgccgtgcggcctcggcgcgtggcaccgtccagcggcccggttcgcgcctggggcgtggccatacggcggcgcgtttcgccggggcgaagctgacgcgaatgtcgcggcgcgtgaccatcaagacgctgctggtcaaccagcgccaggccagcccgcagtcgctcgccaagcacctgcgctacatcgaacgcgacggcgtgggccgcgatggcgagccgggccaagcctacgggccgcagaccgatgctgccgacctcgacgccttcaaggaacgctgcgccgacgaccgacaccatttccgcttcatcctctcgcccgaggatggcgcggaactcgaagacctgcgcacctacacgcggtacctcatgggccgcatggaggccgacctgggcacgggcctcgattgggtggcggtcaaccactggaataccgacaacccgcacacgcacatcgtcgtgcgcgggcgcgacggcaccggcaaagacctcatcatcgcgggcgactacatcgcgcacggcttccgccatcgcgccgccgagctggcgaccgaatggctggggccacgcaccgagctggagatccagcagaccttgcagcgcgaggtggaacaggagcgatggacgagcctggatcgcaccctgcaacgcgaggctggccagggtggccgggtgcagatcgaacgcttcaacgaaccgcggctgcaacgccaacgcctgttgctgatcggccgcctacaacgcttgcagcgcctgggcctggccgacgaaatacagcccggcacttgggccgtccatgccgacgctga

SEQ ID NO: 12146 - DNA, 552 bp, Pseudomonas aeruginosa
aaagacgctgcgcaccctgggcgagcgtggcgacatcatcagcaccatgcagcgtgccatgcgcggcgagccgcgcgagctggcggcgttcgagccgggcgaggatggccgaaccattctcggccgcgtggccgcgaaggggctggccgacgagctgcgcgaccggggctatctggttatcgacggggtggacggcaaagcccactacgtcgcgctcaacgcccgcgacgagctggcgaactatccaaccggtgccgtggtggaggtgaagggatcggccgacgggcgcgccgccgacaagaacatcgctgcgctggcgagcgatgggctgtaccgcgccgatcatcacctcgccatcgcgcagggtcaggccgtaccgggccgcaatccgcaggaggtcgtcgtagtccacatccgccgcctcgaagccctgcgccgtgccggcattgtggagcgtgtggccgaagggctatggaaggtgccggacgacctggccgaacagggccgccgctacgacgcgcagcgcctaggtggcgtggccgtggaacttaa

SEQ ID NO: 12147 - DNA, 300 bp, Pseudomonas aeruginosa
ttccccggatgcacctgcgccatgaaaagaatcatcccgcttttactgttcgccgcgatgactgcctgcggccagtccgaggcgcctcagaaggccaacatttcggaggcgaatattccgacggtggaggaactggccgccaaccctgaacgactcaaggaactgcgccagcagtgcaagaccgatcgccccaggctgggcgacgtgttgtgcaaccgggtcgccgaagccacacgcaagcggttctatggcgacggtgcaacgccatacaatccgccgaaggaaccaccaaaattttga

SEQ ID NO: 12148 - DNA, 417 bp, Pseudomonas aeruginosa
aaaacggctttggcgagaccaagctgtcccgcgagaaagccaagcgcgccgagagctggattgttctggaagcggctttcgctgccgacgaagtggtcaagggcgtcatcaacggcaaggtcaagggcggtttcaccgtcgacgtcaacggcatccgcgcgttcctgccgggttcgctggtcgacgttcgtccggttcgcgacaccacccacctggaaggcaaagagctcgagttcaaggtcatcaagctcgaccagaagcgcaacaacgttgtcgtttcccgccgcagcgtcctggaagccgagaacagcgccgagcgtgaagctctgctggaatcgctgcaggaaggccagcaggtcaagggtatcgtcaagaacctcaccgactacggcgcattcgtggacctgggcggcgtaa

SEQ ID NO: 12149 - DNA, 597 bp, Pseudomonas aeruginosa
agcaactgggcgaagacccgtgggttgccatcaaggcgcgttacccggaaggcacccgcgtcatggctcgcgtcaccaacctcaccgactacggctgcttcgccgagctggaagagggcgtggaaggcctggtacacgtctccgaaatggactggaggggggggaacatccatccgtcgaaagtcgtccaagttggtgaagaaatggaaattcaggttctggacatcgacaaaaacgtcgtcgtatctccctgggtatcaagcagtgcaaatccaacccgtggggaagacttctccagccagttcaacaagggtgaccgtatctccggtaccatcaagtcgatcaccgacttcggtatcttcatcggtctggacggcggcattgacggcctggtccacctgtccgacatctcctggaacgaagtcggcgaagaagccgtacgtcgcttcaagaagggcgacgagctggaaaccgtcatcctgtcggtcgacccggagcgcgagcgcatctccttgggcatcaagcagctggaagacgatccgttctccaactacgcgtccctgcacgagaaaggcagcatcgtccgcggtaccgtga

SEQ ID NO: 12150 - DNA, 309 bp, Pseudomonas aeruginosa
ccgcttgaaaaagaagggaaaaccatgaccaagtcggagttgatcgaacggatcgttacccatcaggggcaactgtccgcgaaggatgtcgagttggcaatcaagaccatgctggagcaaatgtcccaggccctggcgaccggggaccggatcgagatccgtggtttcggcagcttttccttgcactaccgcgccccgcgcgtcggtcgcaaccccaagaccggggagtcggtacgcctcgacggcaagttcgtgccgcacttcaagccgggcaaggagttgcgggatcgggtcaacgagccggagtga

SEQ ID NO: 12151 - DNA, 372 bp, Pseudomonas aeruginosa
ggtctgctcgagtccctgcctggtctttgtgggctcgagtgctattcgcatctagatgactacacaatgcttggaaggtcgggtgggatgggtgtcctgttagagggggggctgagttaccatgtcttactggtttggctggagtctttagatggaggcttggttcatggcatcgtgtcgctcccggttggtcttcgccaaaggtcaagcttttatggaactactttcgtttctgatggtcaagatgcattgaggcttttggcggagagtttcatgtattgcttgcacgtaattcatcctgttgagttcgctgtcggtaatgtgtcttctgggcgctctgtctttcccttgctagtgtgtaaaaacttctaa

SEQ ID NO: 12152 - DNA, 1059 bp, Pseudomonas aeruginosa
ctggacttttcgatgactgacgaaatacaaaagcacggcggtgtagctggcgatatcgatctggttgagctggttcgaggattatgggaggagaagtggatagttcttatattttctttgctaggtattttgtttgcagctatctacgcttttctcagtactcctgtctatgaggcccgcatagcgattttgcctccgtcgttgagtgatgtggcaggtttcaatcagggacgtaccagggaaaccgggcttggtcccttcaaggtccaggatgtgtactctgtttttgttcgcaacctgcaggctgatggaactcgtcatcgttttttcaatgagacctatttgccttctttggatgaagagcttcgttcggtttcgcgtgatgcgctctataaaaggttcactgatcagataagtattagtttgccggggaaagactttccgggtcgttatcttgttgcgattgaacaggaggatccggagcgtgcggcgagttgggttcgtcggtatatagctgatgcggccgagatttctattcaggaaatgttgaacaatgcgcatcgcgagattgaggtcaaggctcgagatattgagcagcgcatacagaacttgcgagagaatgccaaggcaagacgtgaagatcgtattgttcagctcaaggaggcgttgaaggtcgcaggtgcgctgaaattggaggagcctccactgatcagtgggcaatcctctgaggagctctcggctatcatgaatggaagtctgatgtatatgcgtggcagtaaggcgattatggccgagattcagacattggaggcgcgtagctctgatgatccttttattccggcgttgcgtactcttcaggagcagcagttattgctgagtagcttgcgtgttaattcggagcgggtttctgtttttcgacaagacggtccgatagaaacgccggactcaccagttcgtccaaggagagcgatgattttgatttttgggttgataattggtggtgtgcttggtggttttctggcgttgtgccggatttttttgaagaagtatgctcgttag

SEQ ID NO: 12153 - DNA, 1080 bp, Pseudomonas aeruginosa
ttgttgacagccgtggcaagtaccgctccccggcggcacacatcatcaaggcttgatcacccatcccagcatgtccatccgctcgtgccagaaggccgggcggatccgctcatttccataggacgaaccatgaaaaatttcgctctcatcggtgctgccggctacatcgctcctcgccatatgcgcgccatcaaagacaccggtaactgcctggtttcggcctatgacatcaatgactcggtcggtattattgatagcatctctccccagagcgagttttttaccgagttcgagttctttcttgatcatgcgagcaacctcaagcgcgactctgctaccgcgctggactacgtatcgatctgctcgcccaattacctgcactacccgcatatcgctgcaggtctgcgcttgggttgcgacgtaatctgcgaaaagccgcttgttccaaccccagagatgctcgatcagttggctgttatcgagcgcgaaaccgataagcgcctctacaacattctgcaactgcgtcatcaccaggcgatcatcgcattgaaggacaaggtcgcccgcgaaaaaagtccgcataagtacgaggtcgatctgacttacattacttcccgcggcaactggtatctgaaaagctggaagggagatccacgtaagtcgttcggcgtggctaccaacatcggtgtgcacttctacgacatgctgcacttcatctttggcaagctgcagcgtaatgttgtgcacttcacttccgagtacaaggcagctggttatctggagtacgagcaggcccgtgtgcgttggtttctgtccgtggatgctaacgacctgccggagtcggtcaagggcaaaaagccgacctatcgttcgattaccgtcaacggtgaggaaatggagttctctgaaggctttaccgatctacatacaaccagctacgaagaaattctcgctggtcgtggttatggcatcgatgacgctcgtcattgtgtggaaactgtcaataccattcgcagcgccgtcatcgtaccggcctctgataacgaagggcatccgttcgtcgcggcgcttgcgcgttga

SEQ ID NO: 12154 - DNA, 1179 bp, Pseudomonas aeruginosa
gcagctgcagctgaacgagcagggcgaagctgtctgctcacactccggtgcgcgctatgtactcaatggaaagatcctgagcaaggtggacgtgtgaccatgattgaattcatcgacctgaagaaccagcaagcgcgtatcaaggacaagatcgatgccggtatccagcgcgtgctgagacacgggcagtacattcttggcccggaagtcactgagcttgaggatcgcctcgccgatttcgtcggcgctaagtactgcatcagttgcgccaacggtactgacgctctacagattgtgcagatggccttgggtgttggcccaggtgacgaagtaatcacccctggttttacttatgttgcgacagcggagaccgtcgcgcttttgggagccaagccggtttacgtggatattgatccacgcacctacaatcttgatccgcagttgctggaggctgcgatcacaccgcgtacgaaggctatcattcctgtttcgctgtatggccagtgtgcagacttcgatgcaatcaacggcattgcctccaaatatggtatccctgtcattgaggatgctgcacagagcttcggtgcttcgtacaagggtaagcgttcttgtaatctgagtaccgttgcctgcaccagcttcttcccgagcaaaccgttgggttgctatggggatggtggagcgatcttcactaacgacgatgaactggctactgctattcgtcaaattgcccggcatggtcaggaccgccgctatcatcacattcgtgtgggggtgaatagtcggttggacacattgcaggctgcgattcttctaccgaagcttgaaattttcgaggaggagattgcgttgcgccagaaggtagccgcggagtatgacctatcactgaaacaggtcggtatcggcacgccgtttattgaagtgaataacatcagtgtttatgcccagtatacggtgcgtatggataatcgagagtctgttcaggcttctttgaaagctgccggggttccaactgctgtgcattaccctattccgcttaataagcagcctgctgttgcggatgagaaagcgaaactaccagtgggtgacaaggctgctactcaagtaatgagcctacccatgcatccctatctggatacggcatccatcaaaatcatctgtgctgcgttgacgaattga

SEQ ID NO: 12155 - DNA, 1320 bp, Pseudomonas aeruginosa
cggatgtatatacttgctcgagtcgacaggtctattctgctgaacacagtgttactgtttgctttcttttcagcgacagtgtgggtgaataataattatatctatcatctctatgattatatggggtctgcgaaaaaaactgtcgacttcggcttgtatccgtacttgatggtcttggcgctcatctgtgccctgttgtgtggaggggcaattcgcaggccaggtgatctgttagttacattattagttgtaatacttgttcctcattcattggttcttaatggagctaatcaatattctccggatgcgcaaccatgggctggcgtgcctctggcaattgcttttggtattttgatcatcggcattgtcaataagataagattccatccgctaggtgcattgcagcgagaaaaccaaggaaggcgaatgttagtgctactgtcagtactcaacatagtagtgcttgtgtttattttctttaaaagcgctggttatttttcctttgactttgctgggcagtatgctcgccgtgcacttgctcgtgaggtttttgctgcgggttctgcaaacggctacttgtcgtcaatcggtacccaggcattctttcctgtgttgtttgcctggggggtctacagacgacaatggttctacttggtcctgggtattgtcaatgcactagtgctgtggggagcgtttggacagaagtatccttttgtcgtgttgtttctaatttatggcctgatggtttattttcgacgattcggtcaggtcagagtgtcttgggttgtctgcgcactattgatgcttttgcttttaggggcgttggagcatgaggtgtttggctattcattcttgaatgattattttctacgtcgtgcttttattgtgccttccaccctgttgggggcagttgatcagtttgtgtctcagttcggatccaattattacagggataccctgttgggcgcgctcttgggtcagggtaggactgagccgttgagctttcgtctggggacggaaattttcaataatcccgatatgaatgcgaatgtaaacttcttcgcgatagcctatatgcagttgggttatgtgggggttatggctgagtcgatgttggtgggcggtagtgtcgttctcatgaatttcttattttcgaggtatggtgcattcatggccattccggttgctttgttatttactacaaagattcttgagcagtccctgctaactgtaatgcttggctctggtgttttcttgatgctgcttttccttgcgctaatttcttttccactcaagatgtctttaggaaaaactctatga

SEQ ID NO: 12156 - DNA, 798 bp, Pseudomonas aeruginosa
attcggtatgcagttattcaaaaacttcgtggagcttgtctgatggtccggaggcgcgttatcccatgcttgctgctcaaggatcgcggtctagtgaaaaccgtgaagttcaaggagcccaagtacgttggagacccgatcaacgcaatacgcatcttcaatgagaaagaagtcgacgaactgattttgctggatatagatgcttccaggctcaatcaagagcctaactatgagttgatcgcggaagtggctggtgagtgttttatgcctatttgctatgggggcggtatcaagacattggagcatgcggaaaaaatcttttccctaggtgtcgaaaaagtttcgataaataccgccgctcttatggatctttcgttgattcgaagaattgccgataagtttggttcgcaaagcgtagttggctctatcgactgccgcaagggtttctggggaggacactccgtgttctcagagaatgggacgcgcgacatgaaacgctccccattggagtgggcgcaagcgctcgaagaggctggagtgggtgagatttttctaaattctattgatcgagatggagtgcagaaaggcttcgacaacgctctagtggaaaatatcgcttctaacgtccatgtgccagtgatcgcctgtggtggagctggctccatcgctgacctcatcgatctttttgagcgtacgtgtgtgtcggcagtagcggcgggaagcctattcgttttccatggcaagcatcgtgcggtactgattagttatccggatgtcaacaagctcgacgtcggttag

SEQ ID NO: 12157 - DNA, 1077 bp, Pseudomonas aeruginosa
gcgagattccatatgaaaattctgaccatcattggtgcgcgtccgcagtttattaaagcgagtgtggtttcaaaggctatcattgagcagcagaccctttcggaaatcatcgttcatactggtcagcattttgatgccaatatgtctgaaatatttttcgaacagctgggtattccaaagccggattaccagttggatatccatggtggtactcacggccaaatgaccgggcgtatgctaatggagatcgaggatgtaattctcaaggagaaacctcatcgcgtattggtatacggcgataccaactctaccttggctggagcgttggctgcctccaagctgcatgttcctatcgcacacatcgaagccggcctgcgaagtttcaatatgcggatgccggaggaaattaaccgtattcttactgatcaggttagtgatattctgttttgccctactcgagttgcaattgataatctcaagaatgaaggtttcgaaagaaaggctgcgaagatagtcaacgtgggtgatgtgatgcaggatagcgctctattctttgcgcagcgtgcaacctcgccaattggacttgcgtcacaagatgggtttattctcgcgaccctgcatcgtgccgagaacaccgacgatccagttcgcctgacttcgatagtcgaggctctgaatgaaatccagattaatgttgcacctgtggtgctacccctgcatccacgtacccgcggtgtcatcgagcgcctagggctcaagctggaagtgcaggttatcgatcctgtcggatatctggaaatgatctggctgttgcaacgctctggcctggtgctcacggacagcggcggtgttcagaaagaagcattcttcttcggcaagccctgcgtgaccatgcgtgaccagaccgaatgggtggagctagtgacctgtggagccaacgttcttgtgggagcggcccgcgacatgattgtcgaatctgcacggactagcctgggaaagaccattcaagacgatggtcagctttacggaggcggtcaagcctcttctcggattgctgaatatcttgccaagctgtga

SEQ ID NO: 12158 - DNA, 975 bp, Pseudomonas aeruginosa
tgggcgcgcagcatgaaagctgtcatggtgaccggtgcatcaggattcgtcggatcggccttgtgctgtgagcttgctcggacagggtatgcggtgattgcggtggtacggcgggttgttgaaagaataccttctgtgacgtacatcgaagctgatctgaccgatccagccacgtttgccggcgagttcccgacggtggattgcattattcatctcgctggacgtgcccatatactcactgacaaggttgcagacccgctcgccgcatttcgtgaagtcaaccgagatgcgactgtccggttggctacccgtgcgctcgaggctggggtgaagcgtttcgtgtttgtcagttcaattggcgttaacggtaacagcacccggcaacaggctttcaacgaagattctccagccggcccacatgcgccctatgccatctccaaatacgaggctgagcaggagctggggactttgctccggggtaaaggtatggagttggtggttgtccgaccgcctttgatctatgccaatgatgcgccaggtaacttcggccgtttgctcaagctcgtcgctagtggtctgccgcttccgcttgacggtgtccgtaatgcgcgcagcctggtttctaggagaaacatcgtgggtttcctgagtctttgtgccgaacaccccgatgctgcgggcgaactgtttctggtggcggatggcgaggatgtttccattgcgcaaatgatcgaggccctgagtcggggaatgggcaggcgtccagctcttttcacgtttccagcggtgctgctgaagcttgtaatgtgcttgctgggtaaggcttccatgcatgaacagctctgtggctcgttacaggtcgatgcttccaaggcccgccggctgctcggctgggttcccgtcgagactattggtgccggtctgcaagcagcaggtcgagagtacatttttcgccagagggagcgccgaaaatga

SEQ ID NO: 12159 - DNA, 1080 bp, Pseudomonas aeruginosa
cggacacatccaaacccctggtcggcaattacgctgaactttaataaggttctctttccaatgatgatctggatgatcgcgtgtctagttgtcttgctgttttcatttgtcgctacctgggggctgcgtcgctatgcattagcgacgaaactgatggatgttccgaatgcccgtagctcccacagtcaaccgacgcctagggggggaggtgttgcaatcgttctggtcttccttgcagcgttggtgtggatgctgagtgcaggcagtatctccggcggctgggggggggcgatgctgggtgcaggttctggcgtggcactgttagggttcctggatgaccatgggcacattgctgcgcgttggcggctgctcggccatttctcagcagcgatatggatcttgctgtggacgggtggtttcccgccgctggatgtggttgggcatgctgtcgacttaggatggctgggccacgtattggcagttttctatttggtatgggtgctgaacctttataacttcatggatggcattgatggtattgccagtgtcgaggccattggtgtctgtgtaggaggggccctgatctactggcttacagggcatgtcgcgatggttggtatccctctgttgctggcgtgcgcggtcgccggcttcctgatctggaacttccctccagctcgaatcttcatgggtgatgcggggagtggttttcttggtatggttattggtgcactagctattcaggctgcatggaccgccccctcgctgttctggtgctggttgatattgctgggagtgttcatcgttgatgcaacctatactctgatccgccggatagccagaggggagaaattctatgaggcgcatcgcagccacgcttatcagtttgcctcgcgccgttatgctagccatctgcgggttaccttgggtgttctggctatcaacactctttggttgttgccgttggcactgatggttgcattgggttggatcagcggcttcatcggtatcctggttgcttatgctcctctttgcctcttggcggtaggatacaaggcgggttccttggaaaaatcctaa

SEQ ID NO: 12160 - DNA, 369 bp, Pseudomonas aeruginosa
aagtggtcacccggggaaagggggagtccggcagcggggcgggggggcaggagatgcaggcgcaaaccgacatctccgagcgtcgtgcctgtcagttgttcaggctgtcccgctctgtgttgtgccaccagccgcgaactagtgtgcaaaacaccgagctgcaagcccaactggtggaactggcaagggcttcggcactttggctatcacctcctgcacattctgctgcggcgtgctggtgtgcagatcaactacaagcggatttaccggctataccgagccgtcggcttgatggtgaagcggcggaggcgccgccacaggggcgcggtggcatgcgaatgcctgagcctgccgagcgcaccgaactag

SEQ ID NO: 12161 - DNA, 216 bp, Pseudomonas aeruginosa
gtcttgtcgatggatttcgtcttcgacgcgctcagcactgggcgacggatcaaatgcctgacggtggtcgatgacttcaccaaggagtcggttggcatcctggtggagcacggtatcagcggttttcgtgtcacacgggcgctggacgagatggcacggttgcgcggctacccgaaggcgatccgcaccccccgagttcaccggcaaggcgcttga

SEQ ID NO: 12162 - DNA, 1329 bp, Pseudomonas aeruginosa
aaaggggaagtcaagcctctcccgatgacttccccattttccctacaggacctggacgatggccttggtgatggtctccaggttcgatttgttcagcgcggcgacgcagatacggccggtgctgacggcgtagataccgaactcggtcttcaggcgctcgacctggtcggcggtcaggccggaataggagaacatgccacgttggcgaccgacgaagctgaagtcgcgcttggcgccgtgggctgccagttgctcgaccatcgccaggcgcatgtcgcggatgcggtcgcgcatctcgcccagttcctgctcccagagggcccgcagttccgggctgttgagcacggaggagacgacgctggcgccgtgggtcggtgggttcgaatagttggtgcggatcactcgcttcacctgggacagcacgcgggccgattcatcgcggctttcggttacgatcgagagggcgccgacgcgttcgccatagagcgagaaggatttggagaacgagctggaaacgaagaagctcaggcccgactgggcgaacaggcgcaccgcggcggcgtcttcctcgatgccgttgccgaagccctggtaggcgatgtcgaggaacggcacgtggcccttggccttgagcacgtccagcacctgtttccagtcgtccagctcgagatcgacgccggtcggattatggcagcaggcgtgcaggaccacgatcgaacgggccggcagggcattcaggtcttccagcaggccggcgcggttcacgccattgctggcggcgtcgtaatagcggtagttctgcaccgggaagccggcggcttcgaacagtgcgcggtggttttcccagctcgggtcgctgatggccacggtggcgtcgggcagcaggcgcttgaggaagtcggcgccgagcttgagcgcgccggtgccgccgacggcctgggtcgtgaccacacggccggcggccagcagctcggactcgttaccgaacagcagtttctgtacgccctggtcgtaggcggcgatcccttcgatcggcaggtagccgcgcggcgcgtgggcctcgatgcgggccttctcggcagcctgcacggcacgcaacagcggaatgcgcccctcctcgttgtagtacacgcccacgcccaggttgatcttgcccggacgggtatcggcgttgaaggcttcgttcaggccaaggatgggatcacgcggtgccatttcgacggcagaaaacagactcattttgcggctgctcggagtgtgaagagaggagggcaacgcaacccgttatgcgggggcgcaaagggttgcgcaaacggggggttattatag

SEQ ID NO: 12163 - DNA, 1668 bp, Pseudomonas aeruginosa
tcccgcgtcctacctgaagatggtcctgcacctggaccgcggcgaccgcatcgaccagcgcgaactgctgcggcgactgaccagcctgcagtacacccgcaacgacatggatttcgcccgtgcgactttccgtgtgcgtggcgatgtgatcgacatcttcccggccgaatccgatctcgaggcgattcgtgtcgagttgttcgacgacgaggtggaaagcctctcggccttcgatccgctcaccggcgaggtgatccgcaagctgccgcgcttcaccttctaccccaagagccactacgtgaccccgcgcgagacgctgctggaggcggtcgaccagatcaaggccgaactcaaggaacgcctggactacctgcgcaacaacaacaagctggtggaagcgcagcgcctggagcagcgcacccgtttcgacctggagatgatcctcgagctgggctactgcaacggcatcgagaactactcgcgctatctttccgggcgggcccccggcgagccgccgccgacgctctacgactacctgccggccaactcgctgctggttatcgacgaatcgcacgtcagcgttccgcaggtcggcgcgatgttcaagggcgaccgctcgcgcaaggagaccctggtggaatacggtttccgcctgccttcggcgctggacaaccggccgctgcgcttcgaagagtgggaggcggtgagtccgcagaccatcttcgtctccgccaccccgggcccctacgaggcggagcatgccgggcgggtcatcgagcaggtggtgcgtcccaccgggctggtcgatccggagatcgaggtacgtccggcgatgacccaggtggacgacctgctctcgcagatccgccagcgtgtggccaaggacgagcgggtgctggtgactaccctgaccaagcgcatggccgaggacctcaccgattatctcggcgatcacgacgtgcgggtgcgctacttgcactcggacatcgataccgtcgagcgagtggagatcatccgcgacctgcgcgccggtgcgttcgacgtgctggtggggatcaacctgctgcgcgaaggcctggacatgcccgaggtgtcgctggtggcgatcctcgacgcggacaaggaaggcttcctgcgctcggagcgctcgctgatccagaccatcggtcgtgccgcgcgcaacctgcacggcaaggcgatcctctacgccgacaacgtcaccggctcgatgcagcgtgcgatcgacgagaccgagcggcgtcgggccaagcagatcgccttcaacgaagcccatggcatcgtgcccaagggggtgcgcaaggacatcaaggacattctcgaaggcgccgtggtgcccggcgcgcgcggcaagcgcaagggcgtggccaaggtggcggaggagagcgggcgctacgagaacgaactgcgctcgccgagcgagatcagcaagcgcatccgccaactggaggaaaagatgtaccagttggcccgcgacctggagttcgaggcggcggcgcaactgcgcgacgagatccagacgctgcgcgagcgcctggtcaacgtctgatcctcagtgagccccggcgtcggcgcgggtgccgatgccggccggcagcgagcgggtcagcagcaccgcgagcatgctcactgcgagcaccatgccgatga

SEQ ID NO: 12164 - DNA, 654 bp, Pseudomonas aeruginosa
gcaccgcgatccagtcgcgccgggtcggttcgccaagcggccgggccagcgcctcagcggtcacggagctcgacctcggcttcgacggacatgccggggcggatgcggccatgcagcgggttgtcggcctcgaacacgatcttcaccgggatgcgttgcaccaccttggtgaagtttccggtggcgttgtccggtggcagcaggctgaactgcgcgccggaagcggcgaacaggctatcgatgcggccgtcgataggcgtgtcggggaaggcgtcgaaggtcaggcgcgccttctgcccgtcgcgcatgcggcctacctgggtctccttgaagttggcctggacccagatgtcttcgtccggcaccagcgacagcaaatgggtgccgacctgcacgtactggccgttgcgtgcgctgcgctggccgaccaggccgctgatcggcgaatggatcagggtgcgtgacaggttgatttcggcttgcgccagttcggtgcgggcgctggcgatctgcgcttccaggcgcttgatctcggcgcccagggtgtcgcgctggacgcgttgtgcctcgaggtcggcgcgggccttggccagttgcgagcgagccacatggttgtcggcggtgagggtggtgacccgttcctcggaaacgtag

SEQ ID NO: 12165 - DNA, 1509 bp, Pseudomonas aeruginosa
cttccgcttggcaagagagtctccatgaccactgttcgtactcgcatcgccccgtcgccgacgggcgacccgcacgtcggtaccgcatacatcgcgctgttcaacctgtgcttcgcgcgtcagcacggcggtcagttcatcctgcgcatcgaggacaccgaccagctgcgttcgacgcgggagtccgagcagcagatctacgacgccctgcgctggctcggcatcgaatgggacgagggcccggacgtcggcggcccgcatggcccgtaccggcagagcgagcgcgggcatatctacaagaagtattcggacgaactggtcgagaagggccatgccttcacctgcttctgcacgcccgagcgcctcgatgcggttcgcgccgagcagatggcgcgcaaggaaaccccgcgctacgacggccactgcatgcacctgccgaaggatgaggtgcagcgccgcctcgccgccggcgagtcccacgtcacccgcatgaaggtgccgaccgagggcgtctgcgtggtgccggacatgctccgcggcgatgtcgagattccgtgggatcgcatggacatgcaggtgctgatgaaggccgacggcctgcccacctacttcctcgccaacgtggtcgacgaccacctgatgggcatcacccacgtcctgcgcggcgaagagtggctgccgtcggcgcccaagctgatcaagctctacgagtatttcggctgggagcagccgcagctgtgctacatgccactgctgcgcaacccggacaagagcaagctgtccaagcgcaagaatccgacctctatcaccttctacgagcgcatgggctacctgccgcaggcgctgctcaactacctcgggcggatgggctggtcgatgccggacgagcgcgagaaattcaccctcgccgagatgatcgagcatttcgacctgtcgcgcgtctccctgggcggaccgatcttcgacctggagaagctctcctggctgaacgggcagtggatccgcgagcagtccgtggaggagttcgcccgtgaggtgcagaagtgggcgttgaatcccgaatacctgatgaagatcgctccgcacgtgcagggacgggtggagaacttcagccagatcgcgccgctggccggattcttcttcagcggcggggtgccgctggacgcttcgctgttcgaacacaagaagctcgatccgacccaggtccgccaggtcctgcaactggtgctgtggaaactcgaatccctgcgccagtgggagaaggaacgcatcaccggctgcatccaggctgtcgccgaacacctccagctcaagctgcgcgacgtgatgccgctgatgttcccggccatcaccgggcatgccagctcggtttcggtgctggacgccatggagatccttggcgccgacctgtcgcgctatcgcttgcgccaggccctggagctgctgggcggggcgtcgaaaaaggaaaccaaggaatgggagaagatccgcgacgccattcccggctga

SEQ ID NO: 12166 - DNA, 1326 bp, Pseudomonas aeruginosa
cgtcggggaagtgatgggcgcggcggggctcaccgtcggcggcttctatgcccacttccagagcaaggatgcgctgatgctcgaggcgttcgagcaattgctcggcaagcgccgcgaactgctcggcgaactcgatcccggattgtcgggaaaggagcgtcgtgccttggcggccgccttctacctgtcgcgcaagcatcgggacgcacaggtcgacgccggttgtccgctgccggcgaccctagccgaggtggcgcgcctgccggaggggtttcgcgaggtcttgagcagacatgtcgagatcatggtcgccagcctggcggaaagtcccgaggaaaccgacgtcgccctggccgacctggtgctgatgattggcggtttggcgctggcccgggcattggggccgggggagctgtccgaccgggttctgcgtgccgccaagcaggcggtgaactgaggaggtgcgagatgagcagcctgacctggattcgcggtttcaacgggacgatcggccgcatcgcgccgcgttggacggccgagcgtatgcgtcggacgttcatggtgcctggcgagtggccgccgaaggattgggagctgccgctgctggccagctcggagcgcgtcactctgcgcttcgggctgtcggtgttgcgctggggagaggggccggcagtcctgctgctgcatggctgggccggcaggccgacacagttcgcccatctgatcgagcaactggtcggcgcgggttattcggtgtatgccctcgatgcgccggcccatggccgctcgccgggcagggaggcgaacgtggtgctgttcgcccacgccttgctggaggccgctggcgagttgccgccgctgcgtgcggtggtcggtcattccctgggtggcgcggcggcgttgctggcagcccagatggggctgcgcagcgaagcgctggtgacggtctcggcgccgtcgcggattctcgaacagttgcgcctgttcgctcgtttcgtcggtttgccggccctggctcgctcgcatttcatccgcctggtcgagcggcaggcgggcatatccgcggcgtgcctggatgtggcgcgctaccgtctggaaatgcccggactggtggtgcatgccgacgacgacacgcgcgtagcggtggaaaatgccgagcgcatccatgccgcctggccggccagtcgcttgctgcgcctgccgggcggcggccaccaccgactgctcggcgagcgcaggctgagcgagtcgctgctggcgctgctcgaggagcgcccggcgatgcgcgcttgccggcgcgtggaaaagacggcgagcgcttcctga

SEQ ID NO: 12167 - DNA, 1188 bp, Pseudomonas aeruginosa
cagaggggttgtcgttgtcctgacctcggttcttcggtaaaaagcgctgtggcccgcgcggagcgatccggcggggcgagccgtttcgaatcgaggaatgcccatgacattgccgctggatcgggtcctgctgcaggccagcccggtattgccggtgctggtgatcgaggacgtggcgctggcgcccgacctggcgcgcgcgttgtatgcgggcggcgtcacggtgttggaagtgacgctgcgcacgccgcaggcgctggacgcgatcgccgccatccatcgcgaggtgcccgaggtcctgctgggggcgggtaccctgatccacaccgagcagtttctcgaggcacgcgacgcgggcgcgcagttcgccgtcagccccggatgcacgccgcgccttgccgccgccgcggaggatgccggcctgccatacctgcccggggtgatgacgccttcggaagtgttgctggcgctggagtacggttatcgctcgctgaagctgttcccggccgatggcactgccagcgtgaaaatgctgaaaagcctgaaggggccgttcaccggcatccgcttctgcccgaccggcggggtcaacctggacaacctgctgaatttcctccgcctgcccaatgtcgcctgtgtcggcggcacctggctggcgccgccgagcctgatccgggcgcgggcctgggatcagatcacacaactggccagggaagcgcgcgaactggccggcagcctggagcagcattgatgaattgggactacgccgatccgttcgtgatcgacctcagggtcctcgccgaggacatcgacgggctcggccacgcgaacaacgccgtctacgtcagttggttggagcgctgcgcctggcgccactcgcagcggctgggcctggacctggccgagtaccgccggctggaccgggcgatggcggtgctgcgccacgagatcgactacctggccgcggcctacgagggcgacgaactgcaactggcgacctggatcgtcgagtccgaccagcgcctgcggatgaaccggcgcttccagttggtacgcccggcggatggcgccacgctgctgcgggcgcagaccaccttcgtctgcatcgaactgtccagcggcaagccgaagcggatgccggcggagttcatcgacggctatggccaggctctgctcgccggggcctga

SEQ ID NO: 12168 - DNA, 495 bp, Pseudomonas aeruginosa
tggtgcatgcccggaccaaggtcgatggctacaggccgccggcgcactgggagtgggtggcgcgggtggccgaggcggtgcgcgtgccggtgttcgccaatggcgaagtgtggacgctcgacgactacctgcgttgtcgcgaggtcagcggggtggaggacatcatgctcggtcgcggcctggtctcgcgtcctggcctggctcggcagatcgccgcctggcgcgatggcggcgaaatccacgagatgccctggagcgagctgttgccgctgctgcgcgacttctggctacaggcccggcgcaagctcgccccgcgctatgccccggggcgtctcaagcagtggctgggcatgctcacgcgcacctatcccgaagccgtcgagctgttcgcgcggattcgccgggaaagcgattgcgaaaccatcgaccggctgttgcaggtgtcgttcagccaggcggcctagcttgcgtagcaggcctagcggccgccgctga

SEQ ID NO: 12169 - DNA, 264 bp, Pseudomonas aeruginosa
gcagcgctgcaattggtcttcggttcgagcgcttcgaacagcgacaggtgcagctccaggggcgccgcgctggaggatggcgtaggtcggatagcgagcgccaaggtggaagccgagggactggtagaaggcgctggcgctgtccagatcgcggcaggggaaggtcgggattgcgcgttccatagcgacggttctcgaaaggatgagtttcgatctgagcacgacgaacggtcgttctcaaggctcttgaaatacttccgatga

SEQ ID NO: 12170 - DNA, 495 bp, Pseudomonas aeruginosa
cgacgagtatcgcatcgtcatcgccgccgccggcttccaggaagaagacctggacctgcaggtcgagcgcggcgtgctgaccgtcagtggcggcaagcgcgagaagtccacggacaacgtgacctacctgcaccagggcatcgcccagcgcgccttcaagctgtcgttccgcctcgccgatcatatcgaggtcaaggcggcttcgctggccaacggcctgctgaacatcgacctggtgcggctggttccggaagaagccaagccgaagcgtatcgccatcaatggccagcgcccggcactggacaaccagtaaccgtcagcggtgatcgaaaaaaggcgccttcgggcgccttttttcatttcgttgcgctatcggcccggggctccgccggtaggccgtcgggcacctcgtccagcaggacgtcgaggtcgacggcggccgccatcgcccggttgccttcgtcgctggggtgcagatggtcgccggagtcgtag

SEQ ID NO: 12171 - DNA, 441 bp, Pseudomonas aeruginosa
atacgccgattccgcggccgaaagcttttcttcctagcgcttcatccacaggaggcaatccagatgagcgatgacatccagcgttaccccagcagcctgccgtttcccttttcccgcgcggtgcgggccggcggcttcctgtttctttccggacaggtgccgatgagtccgaccggcgaggtggtacgtggcgatatccagacccagaccgaagcggtgatggcacgcatcggcgagaccctggagagctgtggcgcgcgtttcgaccaactggtgaaggtcaccgtctggctgtcggacatggcccacttcgccggtttcaacgaggtctaccagcgtcatgtgcagggggccttgccggtacgctcgacggtgaccgccgggctggcgctgggggtcgacgtggaggtcgaggtgcaggcgtgggtcggcgagggctga

SEQ ID NO: 12172 - DNA, 273 bp, Pseudomonas aeruginosa
aatacatgggcctgcggccgaaccaggcgatcaccgacatccagctggaccgggtattcatcggttcctgcaccaactcgcggatcgaggacctgcgcgctgccgccgaagtggccaggggccgcaaggtcgccgcgaccatcaagcaggcgctggtggtgccgggttccgggttggtcaaggagcaggccgagaaggaaggcctggaccggatcttcatcgaggccggcttcgaatggcgcgagccgggctgttccatgtgcctggcgatga

SEQ ID NO: 12173 - DNA, 984 bp, Pseudomonas aeruginosa
tggcaaggtgctgggtttcgaggtcgacccgttccgcaagcattgcctgctcaacggcctcgacgacatcggcctgacgctgcaggacgccgatgcgatccgtgccttcgaggacggctaccgccagcagcagccctggctgttccgctgagcgccacgcgagtccccttgccgggcgcatcctgggtagggtgcgcccggtttttctcccggagtaggttcatgagcgaccacgatgacgttgtccagcgccagtttggcgcccaggcttcggcctacctgagcagcgccgtgcatgcccagggcgaggaattcgccttgctgcgcgacgccctggccgggcgcccggaagcgcgggtcctcgacctgggctgcggcgccggccacgtgagcttccaggtcgccgccctggcaggggaggtggtggcctacgatctttccgccgagatgctcgccgtggtggcgcagagcgccgcggaacggggcatggcgaacatccgtaccgaacagggcaaggcggagagcctgcccttcgccgacggcgagttcgatttcgtcttcagtcgctattccacccatcactggcgcgatgtcggcctggccctgcgcgaggtgcggcgggtgctcaagcccggcggggtggcgatcttcgtcgacgtggcggcgcccgggcaggccttgccggacaccttcctgcagaccgtcgagctgctccgcgacaccagccatgtgcgcaactactcgccggccgagtgggcgcgcctgagcggcgaggcgggcttgctggtaaccggaagccggcgccagcgcctgcgcctggagttccagtcgtgggtcgagcggatgcgtacgccggaggtgttccgccaggcgatccgcagcctgcagctggcggtgggcgaggaagtcagggagtatttcgagattgccgacgacggctcgttcagcaccgacgtgctggtgctgtggctgcgtcgggagtga

SEQ ID NO: 12174 - DNA, 642 bp, Pseudomonas aeruginosa
cggtatcggcccggaaatcatggcggaagcggtcaaggtgctggaactggccaacgacaggttccagctcggcttcgaactggccgaggacgtcatcggtggcgcggccatcgacaagcacggcgtgccgctggccgaccagaccctgcagcgcgcgcgccaggccgatgcggtgctgctgggcgcggtaggggggccgaagtgggacaggatcgaacgcgatatccgtcccgagcgcggtctgctgaagattcgctcgcaactgggcctgttcgccaacctgcgtccggccatcctctatccgcaactggccgcggcctccagcctgaagccggaagtggtcgccgggctggacatcctcatcgtccgcgaactgaccggcggcatctacttcggccagccccgcgagcagcgcgtgctggagaacggcgagcgccaagcctacgacaccctgccgtacagcgagagcgaaatccgtcgtatcgcccgcgtcggtttcgacatggcccgcgtacgcaacaacaggctctgctcggtggacaaggccaacgtcctcgcctccagccaactgtggcgggaagtggtggaagaggtggcgaaggactacccggacgtcgagctttcccatatgtacgtggataa

SEQ ID NO: 12175 - DNA, 564 bp, Pseudomonas aeruginosa
tggctgccggccagctcacttctctcatataggtgtagttgcgatgaagcgtgtaggtctgatcggttggcgcgggatggtgggttccgtactcatgcagcggatgctggaagagcgggacttcgacctgatcgagccggtgttcttcaccacgtcgaacgtcggtggccagggcccggaagtgggcaaggacatcgctccgctgaaggacgcctacagcatcgacgagctgaagaccctcgacgtgatcctgacctgccagggcggcgactacaccagcgaagtattccccaagctgcgcgaggccggctggcagggctactggatcgatgccgcctccagtctgcgcatggaagacgacgcggtgatcgtcctcgacccggtcaaccgcaaggtcatcgaccaggctctggacgccggcacccgcaactacatcggcggcaactgcaccgtcagcctgatgctgatggccctgggcgggctgttcgacgccggcctggtcgagtggatgagtgccatgacctaccaggccgcctccggcgccggcgcgcagaacatgcgtga

SEQ ID NO: 12176 - DNA, 609 bp, Pseudomonas aeruginosa
cctggccaacccggccagcgcgatcctcgacatcgaccgcaaggtggcggagaccctgcgcagcgaagccttccccaccgagcatttcggcgcgccgctgggcggcagcctgatcccctggatcgacaaggaactgcccaacgggcagagccgcgaggagtggaaagcccaggcggagaccaacaagatcctcgcccgcttcaagaacccgatcccggtcgacggtatctgcgtgcgcgtcggcgccatgcgttgccacagccaggcgctgaccatcaagttgaacaaggatgtgccgctgaccgacatcgagggcctgatcagccagcacaatccctgggtcaagctggtgccgaaccaccgcgaggtaagcgtgcgcgagctgaccccggccgccgtcaccggcaccctgagcgttccggtcgggcgcctgcgcaagctgaacatgggctcccagtatctcggcgccttcaccgttggcgaccagttgctgtggggcgctgccgagccgctgcggcgcatgctgcgcatcctgctggagcgctgatcgatccggcgccgcccgcaatgggtggcgcctcgattgcctgggcgaaggtgggcaagtaa

SEQ ID NO: 12177 - DNA, 1050 bp, Pseudomonas aeruginosa
agtgccacgcctatttcgcagaccgccgaggcttttcccatgtcccagcccctcaatgtcgcagtcgtaggcgccaccggatcggttggcgaggctctggtcggtctcctcgacgaacgcgacttcccgcttcatcgtctgcacctgctggccagcgccgagtcggccgggcagcgcatgggtttcgccgaaagcagcctgcgcgtcggcgatgtcgatagcttcgatttttccagtgtcggcctggccttcttcgccgcggcagccgaggtgtcgcgtgcccatgccgagcgcgcccgcgcggcgggttgttcggtgatcgacctgagcggcgccctggaaccgagcgtcgcaccgccggtcatggtttcggtgaatgccgaacgcctggcctcgcaagcagcgccgttccttttgtccagtccttgcgccgtagccgccgaactgtgcgaagtgctggcgccactcctggccacgctggattgccggcaactgaacctgacagcctgcctctccgtctccagcctggggcgcgaaggggtcaaggaactcgcccggcagaccgccgaactgctcaatgcgcgccccctggagccgcgtctcttcgaccgccagatcgccttcaacctgctcgcgcaggtcggcgcggtggatgccgagggacacagcgcgatcgagcggcgcatcttcgcggaggtgcaggccttgcttggcgagcgtatcggaccgttgaacgttacctgcatccaggcgccggtattcttcggcgatagcctcagcgtgaccctgcagtgcgcggagccggtggacctggccgcggtgacgcgggtcctcgatgcgacgaaaggtatcgaatgggtcggcgagggcgattatccgacggtggtcggcgatgccctcggccaggacgagacctatgtcggccgggtgagggcggggcaggctgatccctgtcaggtcaatttgtggattgtgtctgataatgtgcgaaaaggtgccgcgctgaatgccgtgctcctgggtgagttgttgataaaacactatctgtaa

SEQ ID NO: 12178 - DNA, 2928 bp, Pseudomonas aeruginosa
aagatacttacccacagatttgtagaattaatcgagcttgttaatactggttcgatccgctgctgccggggagcgtccgtccatgcatggctgggcgagcggacagcaagcaccgacgcactccctctcgtgaaacgagaaaagatattaaaaccaagggattacactatggttcggcttcgtacactggttcgggcaatcgcggcggcctcggtcctgacttccggcatggcgcatggattgggactgggggaaatcaccctgaagtcggcgttgaaccaaccgttggatgccgagatcgagctgctcgaagttcgtgacctgggttcgggcgaggtgatcccgagcctggcgtcgccggaagagttcagcaaggcgggcgtcgatcgcctgtactacctcaccgacctgaagttcacgccggtggtgaagcccaacggcaagagcgtcattcgcgtgacctcgtcgaagccggtgcaggagccctacctgaacttcctggtccaggtgctctggccgaacggccgcctgctgcgcgagtacaccgtcctgctggatccgccgctgtactccccgcaggccgcggcaagcgctccgcaagcgccggtcagcgcgccgcgcgcgaccggcgccccgcgagccccgcaggctccggctccggtgcgtaccaccgcgccggcaggcagcgacacctatcgcaccgtttccaacgacacgctctgggagatcgcccagcgcaaccgtaccgatcgcgtttccgtaccccaggcgatgctcgcgttccaggaactgaatccgggcgccttcgtcgatggcaacatcaaccggctgaagagcggccaggtcctgcgcattcccaccgaacagcagatgctggagcgctcgccgcgcgaggcgctgtcccaggtgcaggcgcagaaccagagctggcgcggcagccgcaatccggccgcgggcagcgctggcgccaggcagttggatgcgacccagcgcaatgccgccgggtcggcgccatccaaggtcgacgccacggacaacctgcgcctggtgtctggcgagggcaaggccagcaagggtgccgacaagggcgggaagggcgacagcaaggcgctcgccgataccctggcggtgaccaaggaaagcctcgatagcactcgccgcgagaacgaagaactgcagagccgcatgcaggatctgcagagccagttggacaagctgcagaagttgatccagctgaaggacgcccagttggccaagctgcaagggcagttgggcgccgaaggccagggcgcagcccagccgaacgcagccctgccggatgcgtcccagcccaatgcggccgcgcaggcgccggctcagcccgggactcccgctgcggcagcgccgactcctgctccagccggagaagcacccgccgctccggcgcagcctccggtggcgccgccgcccgcgccagctgccgagaagcctccggcacctgccgttccggcgcccgctccggtacaggcggcagagcagccggcaccgagcttcctcgacgaactgctggccaacccgctgtggttggcggtgatcggcggtagcgcactgctggcgttgctggtgctgctgatgatcctgtcgcggcgcaatgcgcagaaagagaaggaagaagtccaggctttcgccgcggatgccggcgaggaacaggaggatgcgctggacctgggaaaggacggcttcgacgacctgaccctcgacgagcctgagccgcaggtcgcagccgctgcgccgcaggtcgagaagaccaccgcgcagacttccgatgctctgggcgaggccgacatctatatcgcctacgggcgtttcaaccaggccgccgaactgttgcagaacgccatctacgacgagccgcagcgcaccgacctgcgcctcaagctgatggaagtctatgccgagatgggcgatcgcgaaggtttcgctcgccaggaaaacgagctgcgcgaaatcggcggcgcacagccgcaggtcgagcagctcaagtcgcgctatccggcaatggtcgcggtcgccgcggttgccggcctggccggcgccaagctggcgcaggacgagctggatagcttcagcctcgacgacctgtcgctcgacgacagcggtcacgcggccaagccggatgcggcaggacaggatctcgacgacgccttcgacctgagcctggacgacctgggcggcgacgacgtgcaggccgacctcaagtccgacagcggggcgctggacgacctgaccctggacagcgatctggacctggcggcctcgaccgcggcggacaagcctgtcgacgatctcgacttcggcctggatttcgcggagttggcagagactccgagccaacccaagcatgacgacctgggcgatttctccctggatctcgatgcgccggaagacaagctttcggacgacgacttcctgctttcgctgaacgacgaagtgcccgccgcggcgcccgccgacaacgaattcaccctcgataccgaggctgccgaagagccggcgttgtccctgccggacgacttcgacctgtcgctggccgacgagccgacggagccggccgctccggagaagggcgaggacagtttcgccgcccagttggacgaggtgagtgcgcagttggacgagttggccagcaaccttgacgagccgaagagcgcgacgccgagtttctccgccgaagatgcagcggtcgcctccgccctggacggagacgccgacgatgacttcgacttcctctccggtgccgacgaagcggcgaccaagctggatctggctcgtgcctacatcgacatgggcgatagcgaaggcgcgcgcgatatcctcgacgaagtcctggccgaaggtaacgacagccagcaggcggaagcccgcgagttgctggagcgcctggcctga

SEQ ID NO: 12179 - DNA, 879 bp, Pseudomonas aeruginosa
tccggaaatgaagcgactctcatgaacgatgttgttccgccagcggcagccgaatcggctgccgctggcgtttccagaatcgccctcggcatcgagtacaagggctcccgctatcgtggctggcagcgccaggaagccggcgtgccttccgtgcaggaagcgctggagcgcgccttgtcgaaggttgccgccgagccggtcggggtgatctgcgccggccgtaccgacgctgccgttcatgccagcggccaggtggtgcatttcgacaccgcggtggagcgcccgttgaaagcatgggtgatgggcaccaacgccaacctgcccgcggatatcagtgtgacctgggcgagggtgatgccggcgcatttccacgcgcgcttctcggccatggcccggcgctatcgctacgccatctacaacgatccgatccgcccggcgcacctggccgaggaggtcacctggaaccatcggccgctggatatcgggcggatgcgcgaggcggcccaggtactggtcggcacccatgacttcacctcgttccgggcggtgcagtgccaggccaagtcgccggtcaagaccatgcatcacgtgcgcttgctggagcatggtcggttgatcgtgctggacatccgcggtaacgctttccttcaccatatggtgcgcaacatcgctggcgtcctgatgaccatcggtgccggcgagcggccgatcgaatgggcgaaggaggtgctcgaggcgcgcgaccggcgcgccggtggggtcaccgctcacccctacggactctatctggtgcgggtggagtaccccggggagttcgagttgcccgagcgctacctggggccgcatttcctttccggattgcccgatatcgtcggctga

SEQ ID NO: 12180 - DNA, 1020 bp, Pseudomonas aeruginosa
ccgcgcaggcgggggatgggacaggccgcgaaacgcttcgcagccgtggggcccaccgctgccggcggtcacgaagatgaatttgctcagggacgccgtcaccggatcggtgcggccatcccgaccttgcactggagaacaaagagcatgagcaactggctggtagacaagctgatcccttccatcatgcgttccgagtcccagaagagttcggtaccggaaggcctgtggcacaaatgcccgtcctgcgaagccgtgctgtaccgtccggagctggaaaagaccctggatgtctgcccgaagtgcgatcaccacatgcgcatcaacgcgcgtacccgcctggacatcttcctcgatgaggacggtcgcgaggagctgggtgccgacctcgagccggtggaccgcctgaaattccgcgacagcaagaagtacaaggatcgcctcgccgcggcacagaaggacaccggcgagaaggacgcgctgatcgccatgagcggcaagctgcagggtatgccggtggtcgcctgcgccttcgagttctccttcatgggcggttcgatgggcgccatcgtcggcgagcgcttcgttcgcgcagccaacgtcgccctggagaagcgctgcccgctgatctgcttctccgcctccggcggcgcgcgcatgcaggaagcgctgatctcgctgatgcagatggccaagacctcggcggtcctggcgcgcctgcgcgaagaaggcatcccgttcgtctcggtattgaccgacccggtctacggcggcgtttccgccagcctggcgatgctcggcgacgtgatcgtcggcgaacccaaggcgctgatcggcttcgccggtccccgcgtgatcgagcagaccgtccgcgagaagctgccggaaggcttccagcgtagcgagttcctccttgagcatggcgccatcgacatgatcgtgcatcgtgccgagttgcggccgcgcctggccaatctgctgtcggccttcactcattcgccgagccccgtatccgcatga

SEQ ID NO: 12181 - DNA, 471 bp, Pseudomonas aeruginosa
tcttcctgccgatgctgttcacccgcgaagacgagtcgcgccaggtcgtggtggaagcgccgccgcgcccgcaatcgccggccatgcccagtgtcgaggtgcagccgaccgaggtgccggaactgcagcccggcgaagaaggcaacgctcccgagatcgtcgaggaaggctccccggccgccgccggccagcccagccagccgatcggcggcctgccggcgaccccgccggccacccagccgcccgcccaggcccaggcgccggccgccagcctgccgccaagccagccgcaaccgcccgctgcgccgccgagcccgccgcccgcggagaagcgcctggacgccaacaacctgccgcagagctggtcggtacagcttgccagcctgtccaaccgggcgcgcgccgaggaattgcagaagaccctgcgctcccagggctacaacgcctacatccgcagcttcgacgggatga

SEQ ID NO: 12182 - DNA, 576 bp, Pseudomonas aeruginosa
aatgcagcgccttttctgcttgtgggctgcatagtggcatttacctgggtcgattggacgatggtcgccatcatcgtcgtttccagcctgatcagtctgagtcgcggcttcgtcaaggaagccttgtccctgcttacctggatagtcgccggcgcggtggcctggatgttcggcggggcgctggcgcagcacctgggcgagtacatccagaccccctcggcccgcatcatcgcagcctgcgcgctgctgttcatcgcgaccctgctgctcggggcgctggtcaactacctcatcggcgaactgatccgggtcaccggcctctccggcaccgaccgcttcctcggcatggtcttcggcggtgcgcgcggcgtactgctggtcgtgctgctggtcggcctgctcagcctggccccggtacagcaggacccttggtggcagcagtcggtgctgatgccgcatttcctgatggttgccgactggtcgaagaacttcattctcggtttcgccggccagtggttgccggccgcgccgataacgccgccgagcggcatcggcgggctgcttcccagccagtga

SEQ ID NO: 12183 - DNA, 1311 bp, Pseudomonas aeruginosa
accggatcgaacaggcgcgcaacgatgcgaccaaggccaagagccaggcggtcagcgcgatcatcgatctgtacaacgactgacaaaggggagagcggcatgactcaggactgggatgccgggcgtctcgacagcgacctggaaggcgcggccttcgacaccctggcggttcgcgccgggcaacggcggacgccggagggcgagcacggcgaggcgctgttcaccacttccagctacgtcttccgcaccgccgccgacgcggccgcgcggttcgccggcgaagtgccgggcaacgtctattcgcgttacaccaaccccacggtacgcaccttcgaggagcgcatcgccgccctcgaaggagccgagcaggcggtggccacggcgtcgggcatgtcggcgatcctcgccctggtgatgagcctgtgcagctccggcgaccacgtgctggtctcgcgcagcgtgttcggctcgaccatcagcctgttcgacaagtacttcaagcgcttcggtatccaggtcgactatccgccgttgagcgatctcgcggcctgggaggcggcgtgcaagccgaataccaagctgttcttcgtcgagtcgccatccaacccgctggccgagctggtggatatcgccgcgctggccgagatcgcccacgccaagggtgcgctgctggcggtggacaactgcttctgcacgccggccctgcaacagccgctgaagctcggtgcggacgtggtgatccactccgcgaccaagtacatcgacggccagggccggggcatgggcggggtggtcgccggtcgcggcgagcagatgaaggaagtggtcggcttcctccgcaccgccggaccgaccctcagcccgttcaacgcctggctgttcctcaagggcctggaaaccctgcgtatccgcatgcaggcgcacagcgccagtgccctggccctggccgaatggctggagcgccagccgggcatcgagcgggtctactacgcgggcctgccgagccatcctcagcatgagttggcccggcgccagcagagcggcttcggcgcggtcgtcagcttcgacgtgaagggcgggcgcgatgccgcctggcgcttcatcgacgctacccggatggtctcgatcaccaccaacctgggcgacaccaagaccaccatcgcccacccggcgaccacctcccacggtcgactgtcccccgaggaccgcgcgcgcgccgggatcggcgacagcctgatccgggtcgcggtcggcctggaagacctcgacgacctcaaggccgacatggctcgggggctggccgcgctgtga

SEQ ID NO: 12184 - DNA, 876 bp, Pseudomonas aeruginosa
cctggccggcagcctgcgcgagtttcccaccgcctttcccgagctgtaccgggcgactgtggctgccggcgagcatgccgggcacctcggcccggtgctggagcaacttgccgactacaccgagcagcgccagcagtcgcggcagaagatccagctggcgctgctctatccggtgatcctgatggtcgcttcgctggccatcgtcggcttcctgctgggctacgtggtgcccgacgtggtccgggtgttcatcgacagcgggcagaccctgccactgttgacccgcgtgctgatcggcgtcagcgactgggtcaaggcctggggcgcgctggccttcgtcgcggcgatcggcggggtgatcggcttccgctacgcgctgcgcaaggatgcctttcgcgagcgctggcatggcttcctgctgcgcgtgccgctggtcggtcggctggtgcgttccaccgacaccgcgcgcttcgcctcgaccctggcgatcctcacccgcagcggcgtgccgctggtggaggcgctggcgatcgccgccgaggtgatcgccaaccggatcatccgcaacgaagtggtcaaggccgcgcagaaggtccgcgagggcgccagcctgacccgctcgctggaagccaccggacagttcccgccgatgatgctgcacatgatcgccagcggcgagcgctccggcgagctggaccagatgctggcgcgcaccgcgcgcaaccaggagaacgacctggcggcgcagatcggcctgatggtcggcctgttcgaaccgttcatgctgatattcatgggcgcggtggtgctggtcatcgtcctggccattcttcttccgatcctttctctcaaccaactcgtggggtaatcgcgtga

SEQ ID NO: 12185 - DNA, 1143 bp, Pseudomonas aeruginosa
gcagcgacggtttccgcctgccacgggtcgaggtggcgcggcgatgaagcgcgcgcgtggtttcaccctgctggaagtgctggtggccctggcgatcttcgccatggtcgcggccagcgtgctcagtgccagcgcgcgcagcctgcagaacgcctcgcggctggaagacaagaccctggcgatgtggatcgccgacaaccgtctcaacgaattgcaactggaacagacgccgccctccagcggccacaaccagggcgagctggagttcgccgggcgccgctgggagtggcgcacccaggtcgacagcaccgccgagcaggatatgcggcgggtgatcgtctgggtcgcggcgaagcccctcggccgcgagcgtggcagcatcgaggaacgcgccgcggcgcgcctcgtcggtttcctcgggagccagccatgaggctacagcggggcttcaccctgctcgagctgctgatcgccatcgccatcttcgccctgctggccctggccacctaccgcatgttcgacagcgtgatgcagaccgaccaggcgactcgcgtgcaggagcagcgcatgcgcgagctggtgcgggcgatgggcgccctggagcgcgacctgacccaggcggtcgaacgtccggtacgcgacgagctgggcgataaccgtggcgccttcctcagcgagggcgagaacgaccagatcgtcgaactcacccgtggtggctggcgcaacccgctcggccaggcgcgctcgcgcctgcagcgggtgcgctggtcgctgtccggggagaccctcgaacgccgctactggctggttctggaccgcgcccaggacagcaagccacgggtgcagcaggtgctggacggggttaccgcgctgagctggcgcttcctcgacaaggagcacaactggcagggccactggccgaccgacgaaggcagcgaggaggagcgcctggaaagcctgccgctggcggtggagatgaccctggagcaccgccactacggcaagctggtgcgcgtctggcgtctgctcgatccgccgctcaagcaggaccagccgcagggccagccgggcggcgagaatggcgagaacggcgagggcggagtgccgcagccgccggaaggcatgccgggggcgccggaatga

SEQ ID NO: 12186 - DNA, 1077 bp, Pseudomonas aeruginosa
tggcccgcgacatggggcagggcggcctgcccatcccgtcgacgggcggcgacgattggaagaaggacgagcgatgagtggagtgagtgcgctgttcctgccgcccgccagcacggcgggggccgatggggaactggcggtatggtgggtgcaggatggcgagtgccggcgcgcgccgttcgcccaggcgctggcggagatccgcgcgccctggcggctgtacctgccggtggaggcggtgaccgcctgcgcggtgaacctgcctacacagaaggcgcgctggttgcgccagtcgctgcctttcgcggtggaggaacaactggccgacgatgtcgagcagatgcaccttgcccttgggtcggcgctggccgacggccgccaccgggtattcgccgtgcagcgcacctggcttgccgcctggctggcgctggccgagggcgcgggcaaggcgccggcttcgctgcatgtcgatgccgattgcctgccgggcgagggcagttgcctgttctggctggaagagcgctggttgctcggcggcagcggcgccgtacgcctggcctgcggcagcgaggattggccggtactgcgcgacagttgcccgccgccccagcgggccttcgccgcgcaggaggtggcggccccggagggagtggaagtccagcccctggcgggcaatccgcacgtctggctgagcgagcagccgctgggcaccgacctggcccaggccgagttcgccgcgcgccagcagagcagccagtggcgccgctggcggccgctgctggggctggtcgggctgtggctggtgttgcaatggggctttaccctggtccaggcctggcagttgcagcgcgaaggcgaccgctacgcggcgcagagcgcagaactctaccgccagttgtttcccgaggaccgcaagctgatcaacctgcgcgcgcagttcgaccagcacctggccgacagcgccagcagcggcggcgagggccagttgctcggcctgcttggccaggccgccacggtgatcggcggcgagccaacggtgagcgtcgagcaactggacttcagcgccgctcgcggtga

SEQ ID NO: 12187 - DNA, 384 bp, Pseudomonas aeruginosa
aataccggcctgtcacgccgggggtcgcgggttcgagtcccgtccgctgcgccattcacttcccctcccgagttcaccaccccgaactcgccgtcttccactagaaggcgggcagcctggctgcaacaagaggaagtcgctttaccgggcatcttgcccagccgacgcgcagcggtagttcagtcggttagaataccggcctgtcacgccgggggtcgcgggttcgagtcccgtccgctgcgccatacatcttcaccacgccgaggcggggtgagccacgaagaaagcggccaatggccgcttttttcgtttccgtcgtcccctgcgccttccgttttctccttgtttgccggatttcctgctccgtcggtccgcgcgcggtaa

SEQ ID NO: 12188 - DNA, 1233 bp, Pseudomonas aeruginosa
ccagagattgaccagttgcgcaccgccgccgggattggcctggcgcatgccctgcgacgaaccgagcaggctctggccgtcttcggtgacgttccacaggcggctatgggcgaaggccacggcggcgccgcgcgcaccgctggccagcaggcgctcgccgaccgccaggtgctgccaggcctcggcgttgctcaggctgttcggcgccaggcgtacgtcgccgggaaccagctccgcatcgaagccgggccagggctgctgccagcgaccgctctggttcagggcggcggggatcgccagcagttcgacgcgctgttcgaccagggtggcgtaggtgtccgggtaccagctgtcggtgccgatcagcacgcccaggcgtcctgccggcgtatccagcacctgcaggcgctcgccgcgaccgttgttgaggtagctcagttcgtggcgggtcgggaacaccttgcgttgcggctggccgagcggccggccgtcgggaccgaaggtcaggctgacgttgtacagctggccggtgccgggacgcagctcgccgtcctcgacctcggggtcgggcaggacgatggagccggcgaccaccgtcaccttgaaatcatgggcgagcccgccgaacagggtctggtagtcgtgggccatgtccaccgccttcatccggaacagggtgtcggtgagacgctgatcgccgcgcgcggtgatccagccgcgcgccaccttcagtgggttgctcgcggccatccagtccatcgccgtgggccagtcggcagcggcgtagacctcgggcttctcgccgctggccaccagccaggtgccgacatgctcggggaacaccaccaccgtgcgctcgttgagcaggccctggcggcgggcattttccaggtaggcgtggaatttcagttgcaaccgttcggcgctctggtagtccggcgtgaacagttccggctggaccgccagcaggttgccgcgctcgccgggctggccctggaccacgctgacctggctgcgcaggtcggacaggtagtggcctaccgggcggcgttcggcccagccggcgtaggcggcgaagagggtgatgaggatcaggaagatcagcttgcgcatgcgggtctccaaggcagcccacagggtaggggagtggcgtcggcttgccaagcatccctgtgcattccgatcagtaacttgtcatttaggatcattgagcgctccggtggcgctccttag

SEQ ID NO: 12189 - DNA, 1776 bp, Pseudomonas aeruginosa
ggcgggtggcaagatctgcatgcagatcctgcatgccggccgctacgcctacagtccgaagcacgtggcgccgagcgcgatccaggcgccgatcaatccgttcaagcccaaggaactcgacgaggaaggcatccagaagcagatcgccgacttcgtcaactgcgccagcctggcccaggtcgccggctacgacggcgtcgagatcatgggatcggaaggctacttcatcaaccagttcctcgtgcagcacaccaaccagcgcaccgaccgctggggcggcagctacgagaaccgcatgcgcctgccggtggagatcgtccgccgggtgcgcgaggcggtggggccgaacttcatcatcatctatcgcctgtcgatgctcgacctggtcgagggcggcagcagctgggacgagatcgtgctgctggcgaaggccgtcgagaaggccggcgcgaccctgatcaataccggcatcggctggcacgaggcgcgcatcccgaccatcgccaccaaggtaccgcgcgcggccttcaccaaggtcaccgccaagctgcgcggcgaggtcggcatcccgctgatcaccaccaaccgcatcaacactcccgaggtggcggagaaggtcctggccgagggcgatgccgacatggtctccatggcccggccgttcctcgccgacccggatttcgtcaacaaggccgccgccggccacgccgaacggatcaacacctgtatcggctgcaaccaggcctgcctcgaccacaccttcggcggcaagctgaccagttgcctggtcaacccgcgcgcctgccacgaaaccgagctgaactacatccccaccaccaggccgaaaaaaatcgccgtggtcggcgccggcccggccggcctggccgccgccaccgtggccgccgagcgtgggcaccgggtcagcctgttcgacgccgccggcgagatcggcgggcagttcaacgtggccaagcgggttcccggcaaggaagagttccacgagaccctgcgctacttccgcaacaagctggagagcaccggtgtcgaactgcacctgaaccgccgggtcggcgtggacaacctggtcgcgggcggctacgacgagatcgtcctcgccaccggcatcgttccgcgcacaccggcgatccccggcatcgagcatccgaaggtgatcagctacctggatgcgatcctcgagcgcaagccggtgggtggcaaggtggcggtgatcggcgccggcggcatcggcttcgacgtctccgaattcatcacccatgccggtccgtccaccagcctggagcgcgaggcgttctggaaggagtgggggatcgatactcgcctggaagcccgcggcggcatcgccgggatcaaggccgaggtgcatccggcggcgcgccaggtgttcctcctgcaacgcaagaagagcaaggtcggcgacggcctcggcaagaccaccggctggatccatcgcgccggcgtgaagaacaagcaggtgcagatggtgaatgccgtggagtatctcgggatggacgacgccggcctgcatatccgcgttgccgagggcgagccgcaggtgctgccggtggataccgtgatcgtctgcgccggccaggacccgctgcgcgagttgcaggacggcctgctggcggccggccagagcgtgcacctgatcggtggcgccgacgtcgccgccgagctggatgccaagcgcgccatcaaccagggttcgcgcctggccgccgaactctgagagcctttccgcgatctgttgcgtag

SEQ ID NO: 12190 - DNA, 1581 bp, Pseudomonas aeruginosa
catgccagatgggtactgccggatgcgggccgcctcgccaggcgttcgagggttagcgatgagcatgcagaaaaagccacagatggcggaggccgtgctgttcttcaacgacagcggcgtctgcaaggaaatgctgtatcccgaattcgaggcgctgctcgatggcctggtgcgcatgccggaatacgccgaccggcagatgcacctggcctatgtgttgatcaatccgcgcctgcaggcgcgggcggcggtgttcttctatctcgatttcgacgagcagggcggcgccgacaccggctggaacctgcctctgcgcaacctcgccgaacgcgccggacgcggccccgacatgggcggcgggccgatccgcctggcctgtcgcagccagtgcccggtgtcctggcaccagatgcacctctgggacccggagagcagcgccggacgcaaccatttcgtgctcatccgcgacgcgctcaggcgcaaccagctgggcctgctggtggacgaagagcctgccgcggtggagccgcagcggctgcagatggccgccgaagagcaatggtacgccgccggtcccgccgccccgaaggcaccgcccgcggagcctccgcgcaagcaggaggacgagcagacggcgcgcctggcgcaactggtcaagcagcagcgacaacagctcgccgccctggcccggcagcaggagcagcgcctggccgggctcgcccggcagcacgaagaggaactggccaggcgcgaacaggacgcccgcgggcaactggacatcctgcgcagcgaagtgctcagcctgcaacaggccctggaacggcaggcgcgggagaacgccgaattgcagcagcgtctgctggagcagggcgagcagttccagcgcaaccgcgaggaactgacccggcaactgcgtttcatcgagaaccaggggcgcaacgagaccgacctgctgcgctcggagttcgccgacgaactggaggctcgagtggcggcggcggtggccggctacaaggagcaggtctcgatccgcgacgtcgaactggcctaccgcaacgagctggaccagcaactggagcaggaactggccgagctgcgcgccgagcgcgaccgtctggccgcccaggggccggagcaactgctggagcgtctatccggccagggcgtggtattcgtcgcctaccatcccggcgccgggcacctgaccatccccttgcaggacatcccgcgttaccaggacaatccgctggcctacgcggcggccaagtgcttcgtctccgagagccagtaccgccagtggctggaccacttccagcagccgcgctgcgaggcgctgctgcccggcggcgaacgctgcaacctgccgctcgaccgggtcgacaacccggcgcgcttcgtcgccggcgacaccaactgctgcgcccggcacaagaccacggggcgcctgcgcaccgtgagctgactccttgccgtttccccactggtcaccgcatacacccttgcagcgtctcgaactcgactggctgcaacgggccggggtcgaactggcgctgctgcgcctggaccaggccgatccgctga

SEQ ID NO: 12191 - DNA, 927 bp, Pseudomonas aeruginosa
tccgctctatcccgcccgccagcttttcgcaggaaccgcatggaaccctttcccaaaatcggcataatcggacgcctcggcagcacccaggtgctggacaccattcgccggctgaagaaattcctgatcgatcgccacctgcatgtgatcctcgaggacaccatcgccgaagtcctgcccggacacggcctgcagacctgctcgcggaagatcatgggcgagatctgcgacctggtggtggtggtcggcggcgatggcagcatgctcggcgcggcccgagcgctggcccggcacaaggtgccggtgctggggatcaaccgcggcagcctgggcttcctcaccgacatccgcccggatgaactggaggccaaggtcggcgaggtgctggacggccagtacatcgtcgagagccgcttcctcctcgatgcccaggtgcgtcgcggtatcgactcgatggggcagggcgatgcgctcaacgacgtggtcctgcacccgggcaagtcgacccggatgatcgagttcgagctgtatatcgacggccagttcgtctgcagccagaaggccgacggcctgatcgtcgccacgcccaccggttccaccgcctacgcgctgtccgccggcggtccgatcatgcatccgaagctggatgccatcgtcatcgtgccgatgtacccacacatgctttccagccgcccgatcgtggtggacggcaacagcgagctgaagatcgtcgtgtcgccgaacatgcagatctacccgcaggtctcctgcgacgggcagaaccatttcacctgcgcccccggcgatactgtgacgatcagcaagaagccgcagaagctgcgcctgatccaccccatcgaccacaactactacgagatctgccggaccaagctcggctggggcagccgcctgggcggaggcgactga

SEQ ID NO: 12192 - DNA, 297 bp, Pseudomonas aeruginosa
aatggccggtacgccttttcaccggagccggccatgtcgtccttcaatcaagcgatcgagaacatcactcctgagatctaccagaacctcaagctggccatcgagatcggcaagtggccggacggccgcaagctgacccaggagcagaaggaactctgcctgcaggcggtgatcgcctgggagctgcagaacctccccgaggaggagcgcaccggctacatgggcccgcagcactgctcctcgcattccgacgagccgatcccgaacatcctgttcaagtcggactccgtgcactga

SEQ ID NO: 12193 - DNA, 198 bp, Pseudomonas aeruginosa
gtcgcttcaccaccaccgtcagcgccgaacagcagcgctacccggtgctgctctccaacggcaacccggtggccagcggttccgaaggcaacggccggcactgggcgacctgggaagacccgttcaagaagccggcctacctgttcgccctggtcgccggcgacctctggtgcgtcgaggacagcttccgcaccatga

SEQ ID NO: 12194 - DNA, 1695 bp, Pseudomonas aeruginosa
cacccagatcatggacaagcgcaacgactactacagccacaacgatccatcgcagccgagccagagctatccccacgacgaccgtttcaccagccagacccgcgatatcgccgggcacaaggcggaaatcctcgacgcctacgtctacggcagctgggacatcggcaacatgccgctgagcgcgcgcttcggccgccaggtgttcaactggggcgagggcatcttctaccgtggcggggtcaacaccaccaacccggtggacgccgccaagtaccgcctgcccggttccgagctcaaggaagtgctgatgccggtggaagcgctgagcttcaacatcggcctgaccgacaacctgtcgatggaaaccttctaccagtggaactggaaggaaacccgcctcgacccggtcggtaccttcttctccgagaccgacctgttcgccgacggcggcaacaccggctacagcgacttcaccggcaccgcgctggacaccccggtgcccggcttcggcaacgtcatcggcctgtaccaggcgctgggcaacaatccgctgctcagcggcgcgctgaagaacaccggcctatatgccaacggcgtgaccccggcctacggcaacgtgatgaaggtgtcgtccatcggcaaggacatcaacgcgcgcaacgacggccagttcggcgtggccttccgctacatcgccgaggaactgaacagcaccgagttcggcttctacttcgtcaactaccactccaaggagccgaccctgtacgccgacatcggcgactatgccggggccgacctggcggcgctggccaacaccctgcggccgatcgccggcaacctcgccgaagccctggccaacggcctggtgaccgccgacgtgatgggcaacatcaatgcccgccgcgagttcgccgaagacatccgcatgtacggcttcagcttcaacaccacggtgggcgacgcctcggtgttcggcgagctggcctaccggccgaacctgccgatcggcatcgccgccaccaacgacctgatcggcgacctcgcccacggtgcggcggaagccgccaacggcgggcagatcaacgtcggcgggcagatggtcggcctcggcgggcagatccacaactacgagcgggtcgaggcgttcaacacctccctcgggaccatctacaacttcggtccgtcgctgagcttcgactcgttgaccggcgtcgccgagctggcttcggaacacctgcgcggcagcagcctgaagtacaccgcctacgacggcagcacccgctactatgccgggcgcggcaacagctcgtacgtttccggcggcgaccgtggcgaccaggtgaaccgcaacgcctacggctacaccctgctgctcagcggcacctggaacgacgtgttcgccggggtcaacgtgtcgccctacgtggtctacaaggacgacttcgaaggcaactcctaccagaccggcaacttcatcgaaggtcgcaaggcctacaccctggggatcaaggccacctacctgaacagcctggaaggcgaactgcagtacaccgagttctacggcggcgggcagaacaacaacatccgcgaccgcgacaacatcggcctgaccgtgaagtactccttctgaccgaaccgataacgacacgggcgccgcgagcgcccggcacctcacacggagaaccctcatgttga

SEQ ID NO: 12195 - DNA, 711 bp, Pseudomonas aeruginosa
ccttcgccgccaccccggtcctggccgagtcgacgccaaccgccgcgccgccgcaattcgccgtggaatcgccgaaggccgccagcagcctgctgctcagcgtcgcccatgccggcaagcggctggtcgcggtcggcgaccgtgggcatatcctgctctccgacgacgacggcaagacctggacccaggccaaggtgccgacccgccagttgctcacctcggtgttcttcgtcaacgagcgcaagggctgggcggtcgggcacgatgcgcagatcctcgtcagcgacgacgccggcagcacctggaccaggcagttcgaggacctcggccgcgaagcgccgttgctggacatctggttcgccgacgaacagcacggcctggccgtcggtgcctatggcgcgctgctggagacccgcgacggcggccagcactgggaagacgtcagcgagcgcctggacaacgaggaccagttccacctcaacgccatcgccgcggtcaaggacaacggcctgctggtggtcggcgaagccggcagcctgttccgctcgaaggactggggcgccacctgggaaaaactcgaaggcccctacgagggctcgctgttcggcgccatcggtaccgccgatgcgggcggcgtgctggtctacggcctgcgcggccacctgttccgctccgccgatttcggcgacagctgggaagagataccgctga

SEQ ID NO: 12196 - DNA, 2370 bp, Pseudomonas aeruginosa
accagcatcagcaaaacaaggcgagccctggtagaacgcctgattttcaacaaccggccggtggtgatcttcctctgcctgctggtcagcgtcttcctgttctaccaggccacccaggtgcggccgtccaccagcttcgagaagatgatcccgctggagcacccgttcatccagaaaatgctcgagcaccgcaacgacctggccaacctcggcaacaccgtgcgcatctcggtggaggcggtgaacggcgacatcttcaccaaggagtacatggagacgctccggcagatccatgacgaggtgttctacatccccggcgtcgaccgttccggcctgaagtcgttgtggagccccagcgtgcgctggaccgaagtgaccgaggaaggcttcgccggcggcgaggtgatcccgcagacctacgacggttcgccgcgggcgctggaggaactgcgcaacaacgtgctcaagtccgggcagatcggccgcctggtggcgaacaacttcaagtcgagcatcgtcgacgtaccgctgctggagatgtacccgaacccgaagaaccagagcgaactgatcaagctcgactaccgccagttctcccatgagctggaagagaagatccgcgacaagtaccagttgcagaatcccaacgtgaaggtgcacatcgtcggcttcgcgaagaaggtcggcgacctgatcgacgggctggtgatggtggtcggcttcttcggtatctgcctgctgatcaccctggtcctgctgtactggttcaccaagtgcatccgcagcaccatcgccgtgctgatcaccaccctggtcgcggtgctctggcagctcggcctgctcaacctggtcggtttcggcctcgatccctattcgatgctggtgccgttcctgatcttcgccatcggtatttcccacggcgtgcagaagatcaatggcatcgccttgcagtccagcggcgccgacaatgcgctgatggcggcgcggctgaccttccgccaactgttcctgccggggatgatcgcgatcctcgccgacgccgtcggcttcatcaccctgctggtgatcgacatcggggtgatccgcgagctggccatcggcgcctcgatcggcgtggcggtgatcgtcttcaccaacctgatcctgctgcccgtggcgatctcctacatcggcatcagcaagaaggcggtgcagcgcagcaaggatgacgcggtgcgcgagcacccgttctggcgcctgctgtcgaacttcgccagcccgaaggtggccccggtgtccatcgccatcgccctgctgatgctcggcggcggcctctggtatggcaagcacctgaagatcggcgacctcgaccagggtgcgccggaactgcgtcccgactcgcgctacaacctcgacaacgacttcatcatccgcaactactcgaccagttcggacgtgctggtggtgatggtcaagacctccccggaaggctgctccacccaccaggccctggcggccatggacgaactggcctggaagctggagaacaccgagggcgtgcagtcggcgatctcgatggtcaccgtgtccaagcaggtgatcaaggggatgaacgaaggcaacctgaaatgggagaccctgtcgcgcaaccaggacgtgctgaacaactccatcgcccgtgccgacggtctctacaacaccgactgctcgctggcgccgctgctggtcttcctcaacgaccacaaggccgagaccctcgaccgcgcggtggcggcggtgcaggccttcgccgcggagaacgacaaggacgacctgcagttccagctggccgccggcaacgccgggatcgaggccgccaccaacgaggtgatcaagcagtccgaactgatcatcctggttctggtgtacatctgcgtggcggccatgtgcatgatcaccttccgttccttcgccgcgaccctctgcatcgtcctgccgctgatcctcacctcggtgctgggcaacgcgctgatggcggcgctgggcatcggcgtgaaggtcgcgaccctgccggtgatcgccctcggcgtcggcatcggggtggactacgggatctacatctacacccgcctggagtctttcctgcgcatgggcctgccgttgcaggaggcctactacgagaccctccgctccaccggcaaggcggtgctgttcaccggcctgtgcctggcgatcggcgtggccacctggatcttctcggcgatcaagttccaggccgacatgggcctgatgctgaccttcatgctgctctggaacatgttcggcgccctctggctgctgccggccctggcgcgtttcctgatcaacccggccaagctgcaggccaggaaggcctcgctgttcgctcactga

SEQ ID NO: 12197 - DNA, 2160 bp, Pseudomonas aeruginosa
agctggcatgggcggaaacgcagaggagcgcgagaagcaggctgcagaacaggcggatcatggcgtggcttcctggcgttgctgctgttggtaccagaacttgcgccgcagcaattcggcgggatcgtcgggaatctgtcgcagccattgctcgagggcctggcgacgttcgtcgtcgagtccgtcgtcggcttcctcgtcgcccgtccgctcgtcctcggcgttgggctgcggctgcgcttggccgggtgctccggcggtcttctcgccttcgtcttccggcaggctggtcgagggcgccgcggcctgggccttctgcgcatcgacggtcgccgcgtcgcgcggcggccgctggctgcttccggatggcgggctctgctggctcgcttcctggcgctgttccttgttctcgccggcctgctgctgcgccgcctgttcctggcgttggcgcagcagttcctcgaccagggccttgttgcgttgcgcggcgaccagttgcggctggcgctccagggcttgttcgtaggcgtcgacggcggcttccagttcgccctggcgggccagggcgttgccacggttgtagtgatcgtcggcctggtcgccttgggcgaaggcctgggccgcggcggcgtactcgcgggcctggtagagcgacaggcctttccagcggaagtcctcgaagcgcttcgccgcctcgtccgcctggccccgttgcaacaggcgctggccttgctggtccggacgcagccagaggtcttcgaactggaaggccatggccggttgcggcaggctcagcatcaacagcggcaggcagaacagccagccgcgccgtccggcacaggcggccagcaggagcagcggcaggagcagccagtaaccctggtcggcccagcgctgcaggcgcagcagggcgttctcgcgatcttcctccagcgtgccgccgcgggccagcaggccgaggctgtcgaggtcgcggtcgttcggccgcaggcgctggtagccggcgccgatctccgcggcgaagcggcgcagcccgctttcgtcgagcctgggcaggaggatgccgccctggtcgtccttgaggaagctgccatcctcctgctgcaccggagcgcccttcggcgtgccgacgccgagcacggcgaggcgcgccgcccggtgctcgagggcgctgcggatgccctggcgctcgggttcgctcagctcgctggtcagcagcagcaggcggccgcggccctgggcgccctgttccagcaggtcgagggcctggcgcacggcgaggtcggcgcgctggccgggctcgggcatgatcgaaggtttcagggcgtcgagcaggttgcgcgcggtgagctggtcgtccgacagcggcaccagggtatgcgcgctgccggcgtagacgacgatcgcggtctgcgcgtcgttgcgcgtgcgaagcaggtcgagcagcttgcgccgggcctgctccaggcgggtcggcgacaggtcgccggcaagcatcccgggagtcagctggaggatcgccaccagcgggtcgctacgcttcatcgagggctgttccagttgctgccaactgggcccgagcaaggccagcagggccagcagccaggcgatgccgaggcagatccagggcatgcggttctgccgcccggcgccgccgaccagcagccagggctggaaggccgtcggcaacagcaactgccagcgtccggcacgacgctggcgatgcagcagcttccacagcaaccagccaagcagcggcgccagcagcagccagtaggggcgcagccagtgcggccaggcgtccagcaacaggttcatggttgcctcccggaacggcggcgcggccaggtccggttttcccgtggccagagttccagcgccaccagcagcacactcaggccgagggcggcggccagcggccaactgtacagcgccagggccgggcgcgcccgggtagtctgctgggcgaccggttcgaggcggtcgagggtcgcggaaatgctttccagctcggcgctggatcgcgcgcggaagtattcgccgccagtgctctcggcgataccgcgcagggtcggctcgtcgagatcgagccccgggttgaagccgaacaggccgggcacgccgccttgctgcgggtcggcgccgatgccgatggtgtag

SEQ ID NO: 12198 - DNA, 942 bp, Pseudomonas aeruginosa
tccatggagccggagacatccaccgcgagcagcaggtcgcggccgctggcgggtagcggcagggggtcgccgacccactgcgggcgggccgcggcgagcagcaggaggaaccagagcagggcgaagcgcacctgctgccgccaggccggcaggcgtgcgcgggcacggcgtccggcgaggctttcgagttcgtcgaggaagctcaccttgagcgccgcctcgccgctgtcggcggccggcagcaccaggcgcagcagccagggcaacggggcgaaggcgaagacccagggccaggcgaactcaaacatgcttgcgaatccaggtggcgacggcggcgtcgaggccgtccacggccttgtcgtcgagggtgcagtcggcgcggtagccgccttccaccaggatcatccagcgggtcaggccggcggccgggcaacggttgtcgaggaacgccagccaggcgcggccgctgagggcgtggctgccgctatctggccagcgcgccctgcagacccgcttgagcaggccgttgatggcttgcagccagggcccggcggaagccctgccgtagggcttggcaagcgccgccagttcggccagggccgcttcgcgcagcggatccagcggcgcttcgccgcgggtggcgatggtgcgccgcggcaggtgccggcgcagtcgccagagcccccagccgagcaacggcagcagggcggccagcagccaccagccgggcgctggcggccaccagccgacgggcaggggagcgatcagcggttccagccggtcgagcggattcatgcgcgataccccggctggtgttgttccagcaggtcccgcaactgctccaccaggtcttcctgggtcgacagcggcagcagcggcacgcccagtcgctgggccagccgctgccagcgcgcgcggcgcgcctcggcctgttcgcgatag

SEQ ID NO: 12199 - DNA, 618 bp, Pseudomonas aeruginosa
gcctggcgcagctcgtcggcgtgggtgtccagctcgaggtcggcggcgccttcgcggaagcgcagcagtccggcggcgggaagggcatggtcgagcgggtcggacagcggcagcagcaccaggtcggtatggcgtgcgatcaggctgagttgctgctcggcgacgtcattgagtgtgcgctcgtcgcacagcaccaggatcaggctgcccgggcgcagcacttcgcgggcgcggcgtagggccaggccgaacagttcgccaggccgctcggccggcgtctcgcgcagctcgcgattggcccgcaatagctggttgaacagttgcagcaggctgtgcttgctgcgtcgcggcttgatttcgtggcagtcgcggtcgctgaataccaggccgccgatacggtcgttgtgggccagcgccgaccagccgatgaaggccgccgcgcgtgccgccagcaccgccttgaagcacaggccggagccgaagaacaggcgctggctctgttcgaccaggacgaacaccggtcgctcgcgttcctcgtggaacagcttggtgtgcggctcgcgggtgcgcgcggtgacgcgccagtcgatggtccgtacgtcgtcgccgggctggtag

SEQ ID NO: 12200 - DNA, 906 bp, Pseudomonas aeruginosa
aaagcctccgcctctcgccgtgacctgcctcgcgaagcgcggcggatcgacgcgcccggggaacttcgccggctcaggcgggtcggtttccgcgatgcgaacagcgaatggacagagcgtttgtcaggagcgacattgccggggcttgcccggcgcaagggggagggccgcgcccggcgtgggtggcggcgctgggtcggtgggctgctgttgctgctcggcgcgctcgccagcggatgttcgaacgcgccgcgcaacgccgccggcgaggacaccagccagggttcgatgcgcgctggcgaattcctccagaccgatgccgatcgcatggccaccctggccatgcgcgacaacctgcaaagcctctaccagttgctctggaagctatacaagcgcaatcccgccgaatggaagaagaccggcctgccgagccaggccgacgccgagctggcgatccgccgggccatcgagcagaaccgcgaactcagcgacctgggcggccgccgcgacatcgccgcactgtcctactccctcgatccggcgttcaagggcgaccgcgtcggtgccttcatctactccctggccagcatgctgatcaccgcccatggcgggcgcaccgagttctacgtctaccaggggatcgacgcgcagtacgtctacaacgccgcgcgcaacgttgaggtcgccacctggatgctggctacccgcaaggacgacaagggtgccccgttgctgctttccaacgccctcaccgacgacgccagcaacctcagctacgcccgcgagttcgccaagatcgtcgcgcgcctggacctgctcgccgaggtgctcggcgaacgctaccggcggatcagcgtgaactacgcccagggactgctgttcatgcatttcctgccggtgcagtga

SEQ ID NO: 12201 - DNA, 465 bp, Pseudomonas aeruginosa
tcgtgccggtcggcgccaagggcggcttcgtcccgcgccgcctgccgcttggcggtagccgcgacgagatccaggccgaggcgatcgcctgctaccggatcttcatttccggcctgctcgatatcaccgacaacctcaaggaaggcgaagtggtgccgccggccaacgtggtccgccacgacgaggacgatccctacctggtggtcgccgcggacaagggcacggcgaccttctccgacatcgccaacggcatcgccgccgagtacggcttctggctcggcgacgccttcgcctcgggcggctccgccggctacgaccacaagggcatggggattaccgccaagggcgcctgggtcagcgtgcaacggcacttccgcgagcgcggcatcgacgtgcagaaggacaacatcagcgtcatcggcatcggcgacatggccggcgacgtgttcggcaacggcctgctga

SEQ ID NO: 12202 - DNA, 3024 bp, Pseudomonas aeruginosa
cagtttccgcttaaaaatttagcaattagcatatttagtcattatattgacgttaatcgcctgcggctgctttggctgtgcccgcactgtcagggattcgacgttgccaccggaaaccgcatccatgcttccgacctgccgcttcggtcggtatcgaccctgccgcgtaggctgggcatgcggttcagcaagaaaggaatcgccgtgctgcgtctgccgtcccgccgtaacacccttcgacccatcgagcgcccgctcgcctggcttgccggcctggcgctggcgctttgtgccggcactgccgcaggggctgccggcgggccgtccagcgtggcgttatggtacgccgagcggccgccgctggccgagctttcccagttcgactgggtggtgctcgaagcggcgcacctcaagccggccgatgtcgggtatctgaaagagcagggcagcacgcccttcgcctatctgtcggtcggcgagttcgacggcgacgccgccgccatcgccgacagcggcctggcccggggcaagagcgcggtccgcaaccaagcctggaacagccaggtaatggacctcgccgcgccgagctggcgggcgcacctgctcaagcgcgccgcggagctgcgcaaacagggctacgccggcctgttcctcgataccctggacagcttccagctacaggccgaggagcgccgcgagggccagcgccgggcgctggccagtttcctcgcccagctgcatcgccaggagccgggcctcaagctgtttttcaatcgcggtttcgaagtgctgccggagttgcccggcgtcgcgtcggcggtggccgtggagtcgatccatgccggttgggacgccgctgccgggcaataccgcgaggtgccccaggacgatcgcgattggctgaagggtcacctggatgccctgcgcgcccagggcatgcccatcgtcgccatcgactacctgccgccggagcggcgcgacgaggcgcgcgcgctcgctgcgcgcctgcgtagcgaaggctacgtgccgttcgtcagcaccccggcgctggactacctgggggtgagcgacgtcgaggtgcaaccgcggcgcatcgcgctgctctacgatccgcgcgagggcgacctgaccctgagccccggccacgtctacctcggcggcctgctcgaatacctcggttatcgggtcgactacctgcccaccgaccagccgctgcccgaacgtccgctgagcggtatctacgcgggggtagtcacctggatgaccagtggaccgccgctggccagcgacgccttcgacaactggatcgctgcgcgtctcgacgaaaaggtgccggtggcgttcctcgccggcctgcccacagagaacgacggcctgttgcagcgcctgggtattcgccggctgtcgcagaagctcaaggtcaagccgagcaccgagacccacgaccaggcgctgctgggcgccttcgaagcgccgctggtgatccgggtccgcgacctgccggcgctcaccgtactcgacccggcgcgggtggccccggcgctcaagctcaagggcgacggcaaggagtacgtgccggtggcgaccgccgactggggcggcttcgccctggcgccctatgtgctggaggagggtagcgagcaccggcgctggatcctcgatccgttcgccttcctgcgcaaggccttgcgccttgcgccgctgccgagtcccgacgcgaccaccgagaatggccggcgcatcgccaccgtgcacatcgatggcgacggcttcgtctcccgtgccgaggtgcccggcagtccctatgccggccagcaggtgctggaggacttcatcaagccctatccgttcctcacctcggtctcggtgatcgaaggcgaggtcgggccgaagggcatgtacccgcacctggccagggagctggagccgatcgcccggcgcatcttcgccgacgacaaggtcgaggtcgccagccataccttcagccatccgttcttctggcagccgcaactggccgagcagggcgagaacttcgaggcccagtatggctacaagatggccatcccgggctacgacaaggtcgacttcgtacgcgaggtgatcggcgcccgcgactacatcgagcagcgcctgaccaccccgcggaagccggtgaagatgatcttctggtccggcgacgcgctgcccgacgccgccaccatcaagctcgcctacgacgccgggctgatgaacgtcaacggcggcaataccgcgctgacccgggcctttccctcgctgaccggactctacccgctgatccggcccacccgcggcggcgtgcagtactacgcgccgatcatcaacgagaacgtctacaccaatctctggcaggggccgtactacggcttccgcggcgtcatcgataccttcgccctgaccgacagcccgcgccgcctgcgcggcctgcacctgtactaccacttctattcggggaccaagcaggcctcgatccgcaccatgcaccagatctacgcggcgatgcaggcggagcatccgttgtcgctgtggatgagcgactacatcccgcgcctggaaggcctgcatcgcgccagcctggccaagcgtgccgatggcagctggcagttgcgcggcttcgccgccttgcgcacggtgcgcctggacccggcgctgggttggccggacctcgctcgctccacgggagtcgcgggcgtgcgcgacctgccccaggggcgctatgtacacctgagtgcggcgaatgcgcgcctggtcctgcgcgacagccgcgatccgcggccggcgctggaggaggccaacctgccgctgaagcactggcgctaccgcgacgatggccgcgtcgagttcgccttcgccgggcacctgccattgcgcctggtggtgcgcgcggcgggcgattgccggctgagcgcggccggcaaggccttcccgggaaaggccggcaacggcctgtggacgttcgagttgccgatggagcaggtgcgcgatggccaactcgtctgccgctga

SEQ ID NO: 12203 - DNA, 348 bp, Pseudomonas aeruginosa
caagcatccccaggcgcgcctgctgaatccctgggccctgctgccggtcgctctcggggtggcgctggtgctgtggctgaccttcaacagcgaagaggtattcatgcccagcggcgatggcgagcccgacgcggtctcggtgaactacgccgaactgctgttgcaggcgcacccggagaacgacgcgctgcgcctgaccctgatcgacctgctggtcaagctcggcgacttcgagcaggcgcgtcatcacctcgcccgtctgcgcggcaaggaccgcctggcaacgccgttctacgaggtggaactggacatccttggcgccctggccaggcccgagggcatggatga

SEQ ID NO: 12204 - DNA, 2712 bp, Pseudomonas aeruginosa
cgaacgcaacgccaggctgacgttgcggcgcgaactggccgatggcttcgccgcggcgacgctcgatggcagctggcgcgacgacgaggaccgccacggtctgggggtgctgcgcaattggcggctgagctcgcgcgacgaactggaagcgggcctcgactggcaccgcgagaccgacgagaccggcctgatgcgagccctcggcatgcgcgacagcctacggctcggcggccgccacaccctcagcgggcgcgaccagttgagctggtcgctggcgcacaaccgcttctccacccgccagggcgacgacctcggcaacggcgaggcgctgtccctggaatgggcccacacactgttcttcgacggcccggcctggcaactgcgcggcggcatcgactaccagcgcaatcgcctggagaaccgcgtgccggacgacctgctggcggcccatggcggtgcgctggcgctcgatggcgcgcgcagccaggacctgctgcaggaccgctatggccaggtctacctcggcagcacctggcgccgtggcttccctggcgcgctgaaccgcagccgtccgcaatacacctggatcgtcgacaccctggccggctggcagtggacagagaaggagttcaactacggcatcgatctcggcatcggcatggagctgctgggcgacgacgaactggcgttcaccttcggctaccagtcggctccccagggcggcggcggcgatgccggcggcacgctcggggtgacctacagcacgcgcttcggccgctgaacgcggcccggatacggaattcaacaggaggaacacaacatgcaatccatccgctgcctggctctcgcggccgtcgccctgttcatggcgggctgctccagcttcaccagcgaaagcgctacgccgctggcgcgcggcgcgcagtggggcctggtgccgctgctcaattactcccaggcgccgcaggccggcgagcgtgccgagcagatcctgctcagcgtgctggccgaggagggcgtgcggccgcgcctgtacccggcgcagccgcaaggcgacctgcaactggtcgacgaccgcgagcgccagcagcgcgcgctggactgggcacgccagcagaagctggcctacgtggtcaccggcagcgtcgaggagtggcagtacaagaacggcctcgacggcgagccggcggtgggcgtcagcctgcaggtgctggagccggcctccgggcgggtgctctggagcaccagcggggcgcgcgccggctggtcccgggaaagcctggcgggcgccgcgcagaaagtcctgcgcgagctggtcggcgacctgcggctcgagtgacggcgatgtccgcgcacaaggatttcgccctcgcaccgcgcgccagcggcagcgtctcctgggtcgagacgctggtcatcagcgcgctcgcgctgggcctgggctggtggttcagcccggacgacccgctgcaggtcaacgccacctttccctgggtgatcctcgcgcccctgttgctgggcatgcgctacggcttcgtccgcgggttggccagcgcggcgctgctggtggcggcgctgttcgcgtttcgcgtccagggcgtcgaggcttatgcccaggtaccggcggccttcatcgtcggcgtgctgctctgcgccatgttggtgggcgagttccgcgacatctgggaacgccgcctggagcgcctggagctggcgaacgagtaccgccagttgcgcctcgacgaattcacccgcgcccatcacatcctgcgcatctcccacgatcgcctggaacagcgggtcgccggcaacgaccagagcctgcgcagttcgctgctcggtctgcgacaactgctgcgcgagctgccgggcgatgaggcaccgctcgatgcgctggcggaaaccgtgctggcgctgctggcccagtacggttcgctgcgcatcgccggactctaccgggtgcgccacgaccgcaccccggagccgcaatccttggcgacgctcggcgagatgccggcgctggacgccgacgatctgctggtgcgcacctgcctggagcgcggcgaactggtcagcgtgcgccaggaactgctggagcgcggcgagcagcgtgcgcacagcgcgctgcaggtgtgcgtgccgctggtcgacaccgatgggcggatcctcgccctgctggcggtggagcagatgccattcttcgtcttcaacgaacgtaccttcagcctgctggcgatcctcgccgggcacatcgccgacttgctgcagagcgaccgtcgcgcactgcaactggccgacatcgacgcccagcgcttctcccagtacctcaagcgctccctgctggacgcccgcgaccatgggttgccggcctgcctgtatgccttcgagttgaccgatgcgcgctacggcgaagaggtccagcgtctgctggaaggcagccagcgtggcctcgacgtgcagttgcgactgcgcaacgacgagggccggcgggtcctgctggtgttgttgccgctgacttccgccgaaggctcccaggggtatctgcagcgcctgaggattctcttcgccgaacgcttcggccaggcccgcgagctggagtcgctgggcgtgcgcatccgccagtacgaactggacgccggcaacgatcggcaggcgctgggacatttccttttcaacgagtgcggcctgaatgatcagcaagtggctgtttag

SEQ ID NO: 12205 - DNA, 828 bp, Pseudomonas aeruginosa
cggcgccttcctgttcgagctgagcagttgggcgagcgtcttcgccgacctgccgttcggccaggcgctggcgctctacctgttcgcccacggcctgggcagcgcgctgctgtgcgtcggcgtatggctgctgctgccgcggcgctacaagttcccgctgccgtggagcccgctgttcctcttcagcctggccttcttcgtgccgctgatcggagcggtcggcgtcgctgcggcggtattcccggcgctgtacctgccgcgccagcgtggcgagcaggcctggcaggcgatgggcgtccccgagctgccgttccggccgaaggaaaagcgcctcgacatgatgttcagcgacggcggtctgcaggacgtcctgcgccatgcgccggacccgaaccagcggctcacggcgatcttcgccacccggcggatgcccggcaaggaggcgatcccgatcctcaagctggccctgcgcgaccccgccgacgacgtccgcctgctggcctactcgatgctcgaccagaaggaaagccggatcaaccagcgcatcgaggccgccctcggccgcctcgccggcgccacgccggcgcgacgcggcgcgctgcacggaaccctggcgcgctggtactgggaactggcctacctggggttggcccagggcagcgtgctggagcacatcctcgagcaggcgcgcgagcataccgaccaggcgctgcgcggcgcaccctcggccgacctgcatctgctggccgggcgcatcgccctcgaacaaggccgcctggaggatgccggacgcgccctccaggccgccgaggaggcgggaatcgatag

SEQ ID NO: 12206 - DNA, 366 bp, Pseudomonas aeruginosa
cgcccagctggcgccgttccgcgccgaggtggcgttcttccagcggcgctaccgggacatcccccggcttctcgccggaatgcccgacgacatgctgcaacggccgcccttcgcggccctggcgagatactggacatgaccgaacacaccgctccgacggcgcccgtcgccgatgtctgcctgctgctggagggcacctggccctatgtccgcggcggcgtctccagctgggtcaaccagttgatcctcggtctccccgacctgaccttctcggtgttcttcatcggcggccagaaggatgcctacggcaagcgccactacccgatcccggacaatgtgctgcacatcgaggaacacttcctgtaa

SEQ ID NO: 12207 - DNA, 1293 bp, Pseudomonas aeruginosa
accgcctggagttcgccgaacccgcagacgcgacagggcagtagcgagaccgaaaaggcgttgcgcgatctgcaccgtttcttccactacccggagacgccggacgtggaggagggcgacgcgctgctcgacctgctcgccgagggccgcatcggccgcgaggactttctccacagcaaggccagttgggaggcgatcaccgcaggctacgagcgctattgcaccgatccgtccttcgtcaattacttctggaccctgcgctcgatgcaggcgccggtgttcatgctcgccgaggcggcccggcggatgccgcgggcgcgcatgctgcactcgatctccaccggctacgccggcctgctgggctgcatcctgcaacgtcgctggggctgccgctacctgctcagcgagcacggcatctacaccaaggagcgcaaaatcgacctggcccaggccaactggatcgcggagaaccccgacgagcagctgagtaccggactggatgccgaggtcagctacatccgtcgcttgtggatccgcttcttcgagcgtgtcggcctgctcacctatcgcgcggccaatccgatcgtcgccctctacgaaggcaaccgccagcgccaggtactcgatggcgccgagccacggcgcacccgggtgatccccaacggcatcgacctcgatgcctgggccggcgccctcgaacggcggccgccggggattccgccggtggtcgggctggtcggccgggtagtgccgatcaaggacgtgaagaccttcatccgcgccatgcgcggggtggtcagcgcgatgccggaggcggagggctggatcgtcggtccggaggaggaagatccggactatgccagcgaatgccgcagcctggtggccagcctcggcctgcaggacaaggtgaagttcctcggtttccgtcggatcggcgaggtcctgccgcaactcggcctgatggtcctcacctcgatcagcgaagcgcagccgctggtgatcctcgaagcctgggctgccggcgccccggtggtgagcagcgacgtcggctcctgccgcgaactgatcgaaggcgccgacgccgaagatcgcgccctgggtcgcgccggggaggtggtggcgatcgccgacccgcaggccacttcgcgggcgatcctcgccctgctgcgcaatccgcagcgctggcaggcggcccaggcggtcggcctgcaacgggtcgaacgctactacaccgaggcgctgatgctcggacgttaccgcgggctgtaccgcgaagccacggagattgcatga

SEQ ID NO: 12208 - DNA, 1065 bp, Pseudomonas aeruginosa
gccgttcgcctaccgcctgctggtgatggccaacttcgtggtgctctgcaacctgtggctggtgatcatcttcctgtcgggaatgaaggcctacaaacgcatcctgctggtgatgttcatcggctacgcgctgatggtcgcctgtgcctacctgctgcgtttcatgcagatggacggcctgctgctggcattgctgatcggccacgccagcctgctgttcgtcttcctctacgacatcctccgcgagtacccggccaggcgcatggtggccttcgacttcctcgaccgccggcaggtcttcgtcagtctgctgctgaccggcctctgctacaacctggggacctggatcgacaagttcatcttctggttcaacccctccacctcggacctggtgatcggcccgctgcgcgcctcgatcctctacgacctgccgatcttcctcgcctacctgtcgatcattcccggcatggcggtgttcctggtgcgcatcgagaccgacttcgccgagtggtacgagcgggtctacgaggcgatccgcggcggagagaccctgcagcacatcggcctgctcaaggagcagatgatcctcgccatccgccagggcctgctggaaatctgcaaggtgcaggggctggcggtggtcctgctgttcctgctggcgccgcaactgctcggctggctgggaatttcccgctattacctgccgctgttctacatcgacctgatcggggtgagcatccaggtagtgttcatggccttgctcaacgtcttcttctacctggacaagcgccgcatcgtcctcgaactctgcgtgctgttcgtgatcgtcaacggcgccctgaccttcgtcagcctgctgctcgggccgagcttcttcggctacggcttcaccctgtcgctgctggtctgcgtgctggtcgggctgtaccgcctgaccaccgcgctggacgacctggagtacgagaccttcatgctcaatcgctgaggggtttcgccggcggcagggtctttcagaaagggccgattcacccggttgaatcggcccctttttttgtttcacgatga

SEQ ID NO: 12209 - DNA, 1365 bp, Pseudomonas aeruginosa
ctccagcccggtagttcgctggactgcgccgtagctagatacagcaggtttatcaataacttacgcgcgtccatcatatgccggtgctttctgaaacttgacccggttttccctcgcgccgctcctatctggctcctggaatccgggttgttccgaggagtcatcatggcaaagatcaagctcaccaagaccgccgtggagtcggcccaaccccaggccaaggatgttgaactgcgggataccgtggtgcccggcttcctgtgcaagattaccccgaccggccgccgggtgttcatgctccagtaccgcacgaactccggccagccccgcaagccctcgctggggctgtacggggagctgaccgtcgaacaggcacgagtcaaggcacaggactggctggccgaggttcgccggggcggcgaccccggcggcgccaaggccgaggcgcgcaaggcgcccacgatggccgagttgtgcaagaagttcatggaggactactccaagaagcgcaacaagcccagcacgcaggacggctatcagggcgtcatagaccgcaacatcatcccgctgctgggccgcaagaaggtgcatgacgtgaagcggcccgacattgccgggctgatggagaaactggcctacaagccgaccgaggcgaacaagaccttcggcgtgctgcgcaagatgttcaacctggccgaagtgtggggctaccgcccggacggcacgaacccgtgccgccacgtccccatgtacccgccgggcaaggaaacccggctcatcgtggacgaggaaatggtgcggatcttccgccagttggagaagctggaggcggaggggctggagaactacgtcatcccgctggcgatccggctgcaattcgagttcgccgcccggcgctccgaaatctgcccgctcgaatggagctggctggacttcgagaaccggcgcgtggtgtggcccgacagcaaggtcggcggcatttccaagcccatgagcgaggaagcctatcggctgctttcgacggcgccgcgccgggagggctgcccctacgtcctgccatcgccgaacgacccggccaagcacctgacctttggcgagcactatggcggctggtgccgggtgctcaaggccgccggcgtcccgcacgtcggcacgcacggcatccgccatcgctcgacgaccgacattgccaattcgggcgtgccgaccaaagtgggcatgaagctgacgggccacaagaccgtagcgatgttcatgcactacgtccacaccgaggacaagccggtgcgcgatgcggccgaactggtggccagccggcgccaggccatcacgggcgcacgccagcttgcggaggcggcggcatga

SEQ ID NO: 12210 - DNA, 564 bp, Pseudomonas aeruginosa
gggggcggtcttgctgtgtcccttcaccgtatcacggcgttctcgccgtgcaagggctgcgcgcgccttgcgcgcttgcgtcctggcggccgtctgcgacccctgactgctgcgctgcgccgtgagggcgacggttccgggcaattccgcccttgcaaccggagaaccgtcatgaacgacaaatcacacgtttccctcgaacagcacgtttgcctggtctgcggcacggcgttcgacaccggcgcgatcctgctggacaagcgcctgcgcgcgagcatggagcgccacacggcgaccggctggggcctgtgccccgagcatcagaagctggccgacgatggctttgtcgcgctggtcgaatgcgatccgcagcgcagcgggtcgcaggctggcgggcgcatgaagcccgagcaggcataccggaccggccggctggcccatctgcggcgcacggtgttcgcgcaggtgttcaacgtgccgatcgcggacgagcaggcttgcgtgttcgttgagcctggcgtgatcgagcagttgcagtcgatgacagcgccggcggcgggctga

SEQ ID NO: 12211 - DNA, 426 bp, Pseudomonas aeruginosa
cccctgactgcttgcgctgcgccgtgccccggaagggtcgggcaattccgcccggcaacctttcaggagttcaccatgaacaacgcactcatcactgacgagcagcgcatcgtgctgctggccaacggccgcgaatccttggagaacccggacttcgatccggcacccgtcgtcaagctgttcacgccggatgccggcgcgacctggctgctgaccgagattgatcccgatgaccacgaccacgcctttggtctttgcgacctgggcctggggatgccggaaatcggctgggtcagcctgggcgagctggcgaccgtgcgcggcaggctgggcctgccgatcgagcgcgacctgtctttccgcgccgagaagcggttgagcgcctacgcgcgcgatgcccggttggtcgggcgtgtcgtcgtctga

SEQ ID NO: 12212 - DNA, 687 bp, Pseudomonas aeruginosa
ccgaacgcgaaatcgacgcctcgcacgcgctggtgcgcttcgtcgggctggacacctaccggcaggcaggcggcggcgtccgccgcgacctgttcgcagaaggcgatgccggaacctacctcaccgataccgcagtgctggaaacgctggtgcgcgacaagctggcaacgctggccgaggacgtgcgcgccgaggggtgggcatgggtggaggccgtgccgcatctggcctacgaggaacggcaggcgttccagaacgccccgcgccatcgccgcgagccgaccacccgcgaagcccgccgcatcgcctcgctggaaacccgcctcgaaaagatcgacgccgaactggaagaagcctgcgacgccgaggacaaggccaaggccgagaagctggaacagcggcgcgatcaggtggtcggggaactgcaagacgcggaggatgccttgcagggctatgcccccgaggtgcgcgaggtggccggtgccatcgtcaccatcgaccgcaacggcgaggccgtcattcatcgcggcctgctgcgcgaagccgaggccaaggcgctgcgcacgctggaaaagctgcggcgcggtttcggcagtgccgaaggcgaagccgccaacgacgagcacgaggacgccgacgacgcgcccaaggccgcgagcctgtccgaccggctggcgcagcggttga

SEQ ID NO: 12213 - DNA, 429 bp, Pseudomonas aeruginosa
ttctggatgccgtgggcgcgtttgcaccggaatctgtcacccggctggcgaagctcaagaaggccgacattgccagcgaggccgagcggctggccgatggcacgggctggatgcccgccatcttcaaggccgcaggcccgcagaatgccgcgcaggaggcaggcccggagcaggacgccccggaggatgccgaggcaatggcggatgaaccagccgaggcgctggccgcttgacccgcgccgaaggcaagcgccccggcctcgaccggggcgcttcgctgcaaggagaagcccccatgacccgcaccaccaccagccgcccgcgcatggcggcgatctacgcccccggcacggtgcgcgcccgccgctggcacggcgacggcgacgtgcgcggctaccgcccgcccttgggctggtcggcttgcgctga

SEQ ID NO: 12214 - DNA, 540 bp, Pseudomonas aeruginosa
atcctggcgggggtgcggctgcgcctcgggcttatggctgcaaccgtccggcgaaaacaatttccccgccgctacgcggcttccacgcgcaacaaattcttttcgcctcccggctctccactgcgtttcgaccgcaagcggtgcagccagcccgtcccccgccggccggatcacaacaaggacgcgatgggcgcgaaccttgttcaaccgaaaggagaaatcatcatggccaacatcggcaccttcaccgcagacaaagacggcttcaccggcacgctgcgcaccctgacgctcaacgtcaaggtcaagctggttcccaacgacaagggcagcagcgagaacgcccccgacttccgcctccaggccgccggccacgacatcggcgcggcgtggaacaagaccagcgaggccgggcgggaatacaagtccgtgaccctcgacgatccttcgttcccggctccggtctatgcccgcctgatcgaaggcgaggacggtacgcacgacctgatctggtcgcgcagcaagccccaggcggcgtga

SEQ ID NO: 12215 - DNA, 606 bp, Pseudomonas aeruginosa
gttcccagccgccacctatggtttccctcgaaaaaccaagatgacagcccattgcgccctatagggctacaatctatagtgttcatttggtgttctacgttttcgtgcctttacggaaatccgcatttgctggttccagcaaagccacgcaagcgcatccgtgcttgcacacgaaggcgtaaatccggtttggcggttctgcgcttgggcgtgaaaccgcatccgtgcatcattggatttgtgggattgccaaccatgccccagccactcgccaccgtcccggagcgcgcgcaactgctcgccaacggcgaggctcgtgccgctggccaggccatcgacccggtgcccgtggtgcggctgttcacgccggacgcgcatgtgacctggctgctggccgcactcgatcccgccgatggcgacaccgcctggggcctcatcgacctgggaatcggaatgccggcgcaaggaaccgtcaagctgtccgagctggctggcatcgtcgggccgcatcagcagcccgtgatgcgcgaccgctacttccggcccacgcgcacgctgtcggaatacacccggctggccgagcgcgacggggctatcccggactga

SEQ ID NO: 12216 - DNA, 813 bp, Pseudomonas aeruginosa
ttcttccgtcgcggccagtcctgttcgcagggaggttgcgtcatggtcgatcgcagcgccgagcactggtatccgactgccgcgtatctgtacgtgctgcacttggacgaccttgggacggcctgggaatatctgcgcagaaaccccgattaccggctcgactggctgcgccatcatcgccggccgaaagccgcgcagcaggcggcgcatcgctggggcttgcgcctgctggaagatccggcgttggatgcgcgcgacgcgcatccagcctggttgcccggccatgtggccgtggtgcagctctatcccgacgccgatccgccgcagtatgctcccgcgttcacgttttggcgcattgccgggcacaagcaactgctccatgacggcaaagggctggcgctgatggcgcacagcccaggtcattgcctgcgcttcgcgctggcgcccggcctggaagacgggatggctgtcgcctatgcccgccgcggcggcgccgccgcacctgcgcgcaaccatgcgctcggcgcggccctggcttctgcgaagcccaggccggcacccgccgcgctgcttgagctacacaccttgcaggcgctcgacgcaaccctagcgggtgcgtccttgcgcgaggtggccgaaggcttgttcggcggcgatgccgcagccgattggtacagcgacggcggcctgcgctccaaggtacgccgcttggtacggcgcggcgatgcgctgatgcgcggcggctatcgccgcctagcacagcttccgccgcttgagaagggtcgttttgaggacgacgcaaaacggccctga

SEQ ID NO: 12217 - DNA, 1290 bp, Pseudomonas aeruginosa
tcggtggtggtccgcgctttcgcaagttcggccggcgcgtcatgtacgccgtggccgacctcgatgcctgggccgccgaccgcagcttcgagacgacttccgatcccgagtacgccgagcaccactcggccgacagccgtgcgcgctgatcggcggcgcgcggcaggccatcgccatgtccagcaccgcgctgccgtcccggcagcggccgatgcaggagcgcgaacagctcgacctgttccgcgccttgcccggcgacatggcaccgcgcgacagccaagacctgatggcctatccgttcttctcgctcggcaagtccaagcgggtcaagcccatcgacttccgcgcgggcaacgtcacgatccgcgtggaaggcacggccgagcacggcatcgccacgatttgggatgcagacgtgttgatatgggcggcctcgcagatcgtggaggcgaaggacgcgggcctgcggccgtcgcggctgatgcgcgccacgccctacgagatcctgcgcttcatcgggcgtggcaagtcgctgcgcgactaccagcgcctcaaagccgcgctggatcgcctgcaatcgaccaccgtggccacgtccatccgcgagacgaccgggcggcgcttgcaccgcttctcgtggatcaacgaatggaaggaactggccgatgccagcggcacgccgctgggcatcgagctgattctgccggactggttctatgcgggcgtgctcgacgccgccctggtgctgaccatcgacccggcgtatttccggctgacgggcggcatcgagcggtggctgtaccgcctggtacgcaagcacggcggcaagcaggaatacggttggcagttcgattttcgctacctgcaccagaagtccggcagcaccgccaagtcctacgacttcgcctgcgacctgcgcgcgcttgtcgcgcggcagtcgttgcccggctacgtcctgggcatcgagcagatgccggacaacggcatggagctgctgacgttccggcccgtgccgccgacggcacggggataacttcgggaaagcctgtggatggcgtcgtgctatcaggcgtgcggggtatcgtgctatcaggcgtgggactatcgtgctatcaggcgtgccgatcggccgcaaacccgcgccagcactgggtttcctcgccctctaacttccctaacttaatttctctaacttttagtagggaaacgccgctgcggtggacaaccaccacgcggccacaaacgcagcagccaaagcccggttttccagcacggaggaccgcgccatga

SEQ ID NO: 12218 - DNA, 657 bp, Pseudomonas aeruginosa
catcacgcccgccatgcgggcgcgcatcaaggtgtcggccttcacgcaaggcgtgaccgtggccgatctgctgcgcggcttgctggagcgcgagtttccagaacactgcagggagaacacgccatgactgcatccgcttcgcctgccgctggcgctgccacggctgcgctcgcagcgcctaccggccagcctgccagcgcgccgctgacgcgcgtggcgctggcctacatcgaaccgcgcttcaagctctatctgcgcttcggtgaacccgcgcgcaccctccagctcgaccgctggcggcgctgcgcggtgttcctaccgggcgccgtgttctgccgcatccgctggcaggccaacgactacggcaccgtgcgctggcagctcatggcgatgcaggcttgcacgccgctcgatgcggcgcagcgcatccccggcgtgcagccgggcgcgagcctgctgctgcacgccgagggcgagaacgcagtgcgcgcggtgctggagcgcatcgacgccatcgaggcgctgggtatcgcgcccggcggcgcctcgctcgcgtactggcgcacgctcgccaaccggctcgctgcgcgcttgccgctgcccgaatacaccgccgagcggcacgccgcctggctgaccgggagggcgctgccatga

SEQ ID NO: 12219 - DNA, 2451 bp, Pseudomonas aeruginosa
tcggcatcgcgcatccaatctggctggaggcccgtccatgatggcggccgattcgctgcacgttgctgtgcatctcatcgtgccatcgggcatgccgctccggtggctctctgcgtgtcgtcgcgcgtgcagtgccagcgcatccgcgctgcacttcgcgcagccttcccatgtgcaggcgtcttgcctcgaacgcgcctggcctatggccgtcgccgcgttcgccggcgcgctggctgctcacgcagcagcgccgacgggccgccgacgcccggagcgccagcgaggggcaaaggcggaaggcaagacaaaaggacgcggcaccgggccgcgtcgaaagccagtctgcacatgggggttgcgcggcacggcgcggcttcgccgccgtgccgcttgtggcgcgaggcccgcgccgatgcaggcatgtccgcgtgcttcgcacgaccggacacgccagagcttgcagagggcataaccatgaccgaccgccgcgacgacgatttccgcatccgccctggcgccccgaagaacaggggccagggcttcgtctccaaggtgctcaagcaggcaggcaaggccagcagcggcaagtccacagtgcgccgtgcggcctcggcgcgtggcaccgtccagcggcccggttcgcgcctggggcgtggccatacggcggcgcgtttcgccggggcgaagctgacgcgaatgtcgcggcgcgtgaccatcaagacgctgctggtcaaccagcgccaggccagcccgcagtcgctcgccaagcacctgcgctacatcgaacgcgacggcgtgggccgcgatggcgagccgggccaagcctacgggccgcagaccgatgctgccgacctcgacgccttcaaggaacgctgcgccgacgaccgacaccatttccgcttcatcctctcgcccgaggatggcgcggaactcgaagacctgcgcacctacacgcggtacctcatgggccgcatggaggccgacctgggcacgggcctcgattgggtggcggtcaaccactggaataccgacaacccgcacacgcacatcgtcgtgcgcgggcgcgacggcaccggcaaagacctcatcatcgcgggcgactacatcgcgcacggcttccgccatcgcgccgccgagctggcgaccgaatggctggggccacgcaccgagctggagatccagcagaccttgcagcgcgaggtggaacaggagcgatggacgagcctggatcgcaccctgcaacgcgaggctggccagggtggccgggtgcagatcgaacgcttcaacgaaccgcggctgcaacgccaacgcctgttgctgatcggccgcctacaacgcttgcagcgcctgggcctggccgacgaaatacagcccggcacttgggccgtccatgccgacgctgaaaagacgctgcgcaccctgggcgagcgtggcgacatcatcagcaccatgcagcgtgccatgcgcggcgagccgcgcgagctggcggcgttcgagccgggcgaggatggccgaaccattctcggccgcgtggccgcgaaggggctggccgacgagctgcgcgaccggggctatctggttatcgacggggtggacggcaaagcccactacgtcgcgctcaacgcccgcgacgagctggcgaactatccaaccggtgccgtggtggaggtgaagggatcggccgacgggcgcgccgccgacaagaacatcgctgcgctggcgagcgatgggctgtaccgcgccgatcatcacctcgccatcgcgcagggtcaggccgtaccgggccgcaatccgcaggaggtcgtcgtagtccacatccgccgcctcgaagccctgcgccgtgccggcattgtggagcgtgtggccgaagggctatggaaggtgccggacgacctggccgaacagggccgccgctacgacgcgcagcgcctaggtggcgtggccgtggaacttaaatcgcacctacccatcgagcggcaggcccgcgtgatcggggccacctggctcgaccagcagttgatcggcggcggctcgggcctgggcgacctgggctttggtggcgaggccaagcaggcgatgcagcagcgcgccgacttcctggcggaacagggattggcagagcgtcgcgggcagcgcgtgatcctggcgcgcaacctgctgggcacgttgcgcaaccgggaactggcgcaggctgcgaaggacattgctgccgaaaccggcctggaacatcgcccggtggccgatgggcagcgcgtggccggcatctaccggcgctctgtcatgctcgccagcggacgctacgccatgctcgatgacggcatgggtttcagcctggtgccgtggaggccggtgatcgaacagcggctggggcagcagatcgccgcagcggtgcgcggcggcggggtgtcgtgggaggtgggacgacagagagggtcggccatttcctga

SEQ ID NO: 12220 - DNA, 948 bp, Pseudomonas aeruginosa
tcatcatatcggtcaattgttctattcgtcgatcgatttgatttttcttcaccgccaatgaacaccaaaactcggggaatcatggagatgaccacggcgatggtcatatccggcacggtcggctggttcgtgctcgaaacacggatgccggccgcttccgtcgtgttctggcgctgtgcattcggggcggttgctatgctgttggcctgcgctggcctgggcctgctgcgccggggcgtactcgacgccaggcaggcgggactggctgcgctgggcggcgtggccttgatcgccaactgggtcttgctgttcaccgcctactcgcacgcctccatctctgtcgccaccgtgacctaccacactcagcccttcatgctggtggcgttgggggcgctgttcttcggcgaaaagctgacggcgaacaagctcggatggctgggtgtggccttcggtggcgtcgtgctgatcgtcatcggcggccagcaggccggctcgcacgctccgggttacctggccggcatcggcttggcactggcggccgcgttcttctatgccatcgccgcggccatcaccaagagtctcaagggcgttccaccgcacgtgatcgtcgtgattcagatgatcgtgggcagcgtgcttctggcgccgtttgccctctggcccgatggcgcatcctcgccccatgcctggggcctcctgctggccatcggcttcatccacaccggcctgatgtccacactgctgtacggcgcgatccagaagatatcgaccgcgctggtgggggtgctttcgttcgtctatccgatcgtcgccatcgtggtcgatgcctgggcattcgaccacctgctgggcgcgatgcagatcgtcggggccgtcgccatcctggctgccgtggcggggatgaatctcggatggaaccttttccatctggatcgtagaaacgcttag

SEQ ID NO: 12221 - DNA, 936 bp, Pseudomonas aeruginosa
cctatggaactacgccacttgcgctgcttctttgcggtcgccgaagaacttcacttcgcccgtgcggccgagcggctgcacatcgagcagtcgccgctgtcgcgtgccatcaaggagctagaagaagaactgggcgtggtgctgtttgcccgtaccacgcgaagcacgcgcctgacccgtgcgggcaagctgttcctggatcatgtgccgcgcgtcttcgccgccttgcagcaggcgcgcgacagcgtgaaggcggccgccaacggcttccacggccagttgcgtatcgccttgtccgacggcatcacgccgtcgcggctacctgccttgctggcgctgtgccgccaagaagaacccgaagttgaactccggttcttcgaggtgccattgtctcagcagatcaaaggtctacatgacgatctgtacgacgtggggtttgcgcagtccgatgaagtgggcgacggcatcgtcaccacgcccgcatggagcgatgcgctcatggtggcggtgcccgcgcggcatccgttactggcccacaaacgcatccctttggatgaactgctgcgctacccgctggtgctgtgcgacccacaggtatgcgagggtcttgccaagcacgtcgaacgggtgctgcgccggacagacatggagccattgattgccgagcgggtggcctcctgcgatctgatgatggcgctggtctccgcaggtttcgcgctgggcctgactggtgaggcgcacattgccgccagccgcgagccaggcgtggtggcccggccactagcatcgcgtgtgccgcggttgacgacctactcgctgcgccttgagggcgatccgtccaacgagctggcgcgcttcatcgagcgcgtgcaggccatcgaatcgccggaagctcccaagcattaccctgattccccggatgcacctgcgccatga

SEQ ID NO: 12222 - DNA, 606 bp, Pseudomonas aeruginosa
acaaccacaatcgagtgtgagtctcaagccatgagttattatcagcaccccagcgcgatcgtcgacgacggtgcgcagatcggtagcgactcccgagtttggcacttcgtgcacatctgtgcaggtgcccggattggcgcaggggtttcgttgggtcagaacgtattcgtcggcaacaaggtcgttattggtgatcgctgcaagatccagaacaacgtgtcggtatatgacaatgtcactctcgaagagggcgtgttctgcgggccgagcatggtatttaccaacgtttacaacccccgctcgttgatcgagcgcaaggatcagtaccgtaacacgttggtaaaaaaaggtgccacgcttggtgccaactgcactatcgtctgtggcgtgactattggtgaatatgccttcgtgggtgcgggtgcggtcattaacaagaatgttccatcttatgccctgatggtaggcgtgcccgctcgacagattggttggatgagcgaattcggtgagcagctgcagctgaacgagcagggcgaagctgtctgctcacactccggtgcgcgctatgtactcaatggaaagatcctgagcaaggtggacgtgtga

SEQ ID NO: 12223 - DNA, 708 bp, Pseudomonas aeruginosa
ctctgtcgactcggtgttgtggttttactccatagcatatgctgttatgtattttgtctatttctggatgtccttccagtgtgccaagggagatgccaagtgatcgttgttattgattacggtgtaggtaacattgcttcagtcttgaacatgctgaagcgagttggtgccaaagccaaggcatccgatagccgagaggatatcgagcaggcggagaaactgattttgcctggtgtcggtgcttttgacgccggaatgcaaacactacgcaagagtgggctggtggatgtactgacagagcaggtcatgatcaaacgaaagccggtcatgggggtgtgtctcgggagtcagatgctggggctgcgatctgaggagggagcggaaccggggcttggatggatcgatatggatagcgtccgtttcgaaaggcgtgacgaccgaaaggttccacatatgggctggaatcaagtgtccccgcaattggagcatcctatacttagcggtataaacgagcaaagccgattctattttgttcatagttattatatggttccgaaagacccagacgatatcctgttgagttgtaattatgggcaaaaattcactgcggcggtggctcgggataatgttttcggatttcagtttcatcctgagaagagtcataaattcggtatgcagttattcaaaaacttcgtggagcttgtctga

SEQ ID NO: 12224 - DNA, 1239 bp, Pseudomonas aeruginosa
ctattcggagtttgccaactgggattctcgacagaggattgcgaaaaaagttcaaatgattgtccagcgtgcgctgggtcgtcgcatcaatgtctactcgtgatgaccggggccgtcatgactaaagttgctcatttgacatcggttcactcgcgttatgatattcgtatatttcgaaagcagtgtagaacactctctcaatacggatacgatgtgtatctggttgtcgcagatggtaagggtgatgaagtcaaggatggtgtaaggattgttgatgtcggagtactctcaggtcgcttgaatcgtattctaaaaaccacccgaaaaatttatgaacaggctttggcgcttggggctgatgtctatcattttcatgatcccgaactgatacctgttggtcttcgactgaaaaagcaaggtaagcaggttatcttcgactcccatgaggatgtgccgaagcaactgctgagtaaaccttacatgcgaccgtttttacgccgtgtagtggctgtgttattttcctgctatgagaaatatgcatgccctaagctggatgcagtccttacggcaacgccgcatattcgtgaaaaatttaaaaatattaatgggaatgttctagatattaataactttcccatgttgggtgagttggatgcgatggttccttgggcaagcaagaaaactgaagtctgctacgtcggtggtatcacttccattcgtggtgttcgtgaagtcgttaagagtcttgagtgcttgaagtcctcggcgcgcttgaatttagtgggaaagttttcagagccagagatagaaaaagaagtcagagcgctcaaaggatggaactccgttaacgaacatggtcagcttgatcgagaagatgttcgtcgtgtactcggtgactctgttgccgggttggtgacatttctcccaatgcctaatcatgttgatgcacaacctaataagatgttcgagtatatgtcgtcgggaatccctgtgatcgcttccaattttcctctctggcgggaaattgttgaaggtagcaattgtggtatatgcgtagatcctctaagtcctgctgccattgctgaagcgatcgactatctggtaagtaatccgtgtgaggcggcagcgctgggacgtaatggccagcgggcagtgaacgaacgttataactgggatttggaagggcgcaaactagcgcggttctattccgatctactgagtaagcgagattccatatga

SEQ ID NO: 12225 - DNA, 1260 bp, Pseudomonas aeruginosa
aggattttatttagttccatgaacgtctggtatgtgcatccctatgctggcggccccggagttggtcgttattggcggccttattatttctccaagttttggaatcaggctgggcatcggtcggtcataatctcggcaggctatcaccatctgctggaaccggatgaaaagcgttcgggcgtcacctgtgtaaatggagccgaatacgcatatgtacctactttgcgctatttgggcaatggcgtgggcagaatgctatcgatgctcatatttaccatgatgttgctgccattctgcctgatcttggccctgaagcgtggaacgccggatgcgattatctactcatcgcctcacccgtttggcgtcgttagctgttggctggctgctcgcctgctaggcgcgaaatttgtatttgaggtgcgcgatatctggcctttgagtctggtcgaactgggaggcttgaaagctgacaatcccctggtgcgtgttaccggttggatcgaaagattctcctatgcgcgagctgataagatcatcagtctgctgccatgtgcggagccgcacatggccgacaaaggacttgccgctggaaagttcctgtgggttccgaatggcgttgacagcagcgatatctctcctgatagcgctgtgagttcaagtgatttggtccggcatgtacaagttctcaaggagcagggtgttttcgttgtgatctatgctggagcgcacggcgaacccaatgctctggagggattggttcgctctgccggactgctgcgcgagcgtggtgcaagtatcagaatcattctggtgggcaagggagagtgcaaagagcaactcaaggcgattgccgcacaggatgccagcgggctagtggagtttttcgatcagcagcccaaagagactatcatggctgtcctgaagctggcgtcggcgggctacatctcgctcaagtcagaaccgatcttccgctttggcgtgagccccaacaagctatgggattacatgctggttgggttgccagtcattttcgcctgcaaggcagggaacgacccggttagtgactacgattgcggtgtatctgccgacccagatgcccctgaggatattactgcagccatcttccgtctgttgctgctgagcgaagacgagcgtcgcacaatggggcaaagagggcgtgatgcggtcctggagcattatacctacgagagtctggctcttcaggtgttgaacgcccttgctgatgggcgcgcagcatga

SEQ ID NO: 12226 - DNA, 255 bp, Pseudomonas aeruginosa
cggtggtcgatgacttcaccaaggagtcggttggcatcctggtggagcacggtatcagcggttttcgtgtcacacgggcgctggacgagatggcacggttgcgcggctacccgaaggcgatccgcaccccccgagttcaccggcaaggcgcttgatcagtgggcctatcggcgtgatattaagttgaagctgactcagtccggcaagcccacgcagaacgccttcatcgtcattcaacggcaagttccgcaatga

SEQ ID NO: 12227 - DNA, 2016 bp, Pseudomonas aeruginosa
acggggctgataaataggatgttggataatttgaggataaagctcctgggattgccgcgccgctataagcgaatgctgcaagtcgctgccgatgtgactcttgtgtggctatccctctggctggctttcttggtcaggttgggcacagaagacatgatcagcccgtttagcggccatgcctggctgttcatcgccgccccgttggtggccattcccctgttcatccgcttcggcatgtaccgggcggtgatgcgctacctaggcaacgacgcccttatcgcgatcgccaaggccgtcaccatttccgcgctggtcctgtcgttgctggtctattggtaccgctccccgccggcgccggtgccgcgttccctggtgttcaactactggtggttgagcatgctgctgatcggcggcttgcgtctggccatgcgccagtatttcatgggcgactggtactctgctgtgcagtcggtaccatttctcaatcgccaggatggcctgcccagggtggctatctatggcgcgggggcggccggcaaccagttggttgcggcgttgcgtctcggtcgggcgatgcgtccggtggcgttcatcgatgacgacaagcagatcgccaaccgggtcattgccggtctgcgggtctataccgccaagcatatccgccagatgatcgacgagacgggcgcgcaggaggttctcctggcgattccttccgccactcgggcccggcgccgagagattctcgagtccctggagccgttcccgctgcacgtgcgcagcatgcccggcttcatggacctggccagcggccgggtcaaggtggacgacctgcaggaggtggacatcgctgacctgctggggcgcgacagcgtcgcaccgcgcaaggagctgctggaacggtgcatccgcggtcaggtggtgatggtgaccggggcgggcggctctatcggttcggaactctgtcggcagatcatgagttgttcgcctagcgtgctgatcctgttcgagcacagcgaatacaacctctatagcatccatcaggaactggagcgtcggatcaagcgcgagtcgctttcggtgaacctgttgccgatcctcggttcggtgcgcaatcccgagcgcctggtggacgtgatgcgtacctggaaggtcaataccgtctaccatgcggcggcctacaagcatgtgccgatcgtcgagcacaacatcgccgaaggcgttctcaacaacgtgataggcaccttgcatgcggtgcaggccgcggtgcaggtcggcgtgcagaacttcgtgctgatttccaccgacaaggcggtgcggccgaccaatgtgatgggcagcaccaagcgcctggcggagatggtccttcaggcgctcagcaacgaatcggcgccggtgctgttcggcgatcggaaggacgtgcatcacgtcaacaagacccgtttcaccatggtccgcttcggcaacgtcctcggttcgtccggctcggtcattccgctgttccgcgagcagatcaagcgcggcggcccggtgacggtcacccacccgagcatcacccgttacttcatgaccattcccgaggcggcgcagttggtcatccaggccggttcgatggggcagggcggagatgtattcgtgctggacatggggccgccggtgaagatcctggagctcgccgagaagatgatccacctgtccggcctgagcgtgcgttccgagcgttcgccccatggtgacatcgccatcgagttcagtggcctgcgtcctggcgagaagctctacgaagagctgctgatcggtgacaacgtgaatcccaccgaccatccgatgatcatgcgggccaacgaggaacacctgagctgggaggccttcaaggtcgtgctggagcagttgctggccgccgtggagaaggacgactactcgcgggttcgccagttgctgcgggaaaccgtcagcggctatgcgcctgacggtgaaatcgtcgactggatctatcgccagaggcggcgagaaccctga

SEQ ID NO: 12228 - DNA, 2178 bp, Pseudomonas aeruginosa
agagaggagggcaacgcaacccgttatgcgggggcgcaaagggttgcgcaaacggggggttattatagacaccccttgatgcatgcggcgacatttaggtgcatgctttcagctatttctgacgccggattttccttggcgtcacagctccctgcgaggtttttcatggatacgttccaactcgactcgcgcttcaagcccgccggcgaccaaccggaagccatccggcagatggtcgaggggctggaggcggggctttcgcaccagaccctgctgggggtgacgggctctggcaagactttcagcatcgccaacgtgattgcccaggtgcagcgcccgaccctggtcctggcgccgaacaagaccctggcggcccagctctacggggagttcaagacgttcttcccgcacaattccgtggagtacttcgtttcctactacgactactaccagccggaggcctacgtcccgtcttccgatacctatatcgagaaggactcctcgatcaacgaccatatcgagcagatgcgcctgtcggcgaccaaggcgctgctcgagcgtccggatgcgatcatcgtcgccaccgtgtcgtccatctacggcctcggtgatcccgcgtcctacctgaagatggtcctgcacctggaccgcggcgaccgcatcgaccagcgcgaactgctgcggcgactgaccagcctgcagtacacccgcaacgacatggatttcgcccgtgcgactttccgtgtgcgtggcgatgtgatcgacatcttcccggccgaatccgatctcgaggcgattcgtgtcgagttgttcgacgacgaggtggaaagcctctcggccttcgatccgctcaccggcgaggtgatccgcaagctgccgcgcttcaccttctaccccaagagccactacgtgaccccgcgcgagacgctgctggaggcggtcgaccagatcaaggccgaactcaaggaacgcctggactacctgcgcaacaacaacaagctggtggaagcgcagcgcctggagcagcgcacccgtttcgacctggagatgatcctcgagctgggctactgcaacggcatcgagaactactcgcgctatctttccgggcgggcccccggcgagccgccgccgacgctctacgactacctgccggccaactcgctgctggttatcgacgaatcgcacgtcagcgttccgcaggtcggcgcgatgttcaagggcgaccgctcgcgcaaggagaccctggtggaatacggtttccgcctgccttcggcgctggacaaccggccgctgcgcttcgaagagtgggaggcggtgagtccgcagaccatcttcgtctccgccaccccgggcccctacgaggcggagcatgccgggcgggtcatcgagcaggtggtgcgtcccaccgggctggtcgatccggagatcgaggtacgtccggcgatgacccaggtggacgacctgctctcgcagatccgccagcgtgtggccaaggacgagcgggtgctggtgactaccctgaccaagcgcatggccgaggacctcaccgattatctcggcgatcacgacgtgcgggtgcgctacttgcactcggacatcgataccgtcgagcgagtggagatcatccgcgacctgcgcgccggtgcgttcgacgtgctggtggggatcaacctgctgcgcgaaggcctggacatgcccgaggtgtcgctggtggcgatcctcgacgcggacaaggaaggcttcctgcgctcggagcgctcgctgatccagaccatcggtcgtgccgcgcgcaacctgcacggcaaggcgatcctctacgccgacaacgtcaccggctcgatgcagcgtgcgatcgacgagaccgagcggcgtcgggccaagcagatcgccttcaacgaagcccatggcatcgtgcccaagggggtgcgcaaggacatcaaggacattctcgaaggcgccgtggtgcccggcgcgcgcggcaagcgcaagggcgtggccaaggtggcggaggagagcgggcgctacgagaacgaactgcgctcgccgagcgagatcagcaagcgcatccgccaactggaggaaaagatgtaccagttggcccgcgacctggagttcgaggcggcggcgcaactgcgcgacgagatccagacgctgcgcgagcgcctggtcaacgtctga

SEQ ID NO: 12229 - DNA, 1227 bp, Pseudomonas aeruginosa
ctggatctggttgaactgcggtccggcgaagtccgggttgagcaccccggagaagaagctggcaaggccgaacaggccgaagccggcggcgcagagcaggcgcggcgagaccagcttcatcaacttcgggaccagcgggatcaggaacagctggggaatgcccatccacatgatcacctcgccgatctgcatggcgttgtagccctggatttgtgccaggtacagcggcagtacgtagatcgagccgtacaggcccatgcccagaccgatgctggaaatgctcgcgaggccgaagttgcggttgcgcaggatgcccaggtcgatcagcgggttcggccgcgacagttgcaggatgacgaacaggaccaggctgaacagggcgacgctgccgaggctgacgatcagttgcgactccagccagtccttgcggtgaccttcctcgaggaaaacctgcaggcagcccaggccgatgccgagggtgacaatgccggcgtagtcggtactcttcagcagttcccaatgcggcgcctttttctccaggccgtagagcagcccggcgatcatcaacaggcccggcggcacgttgatatagaagatgtattcccagccgaagttttccgtcagccagcctcccagggtcggtccgatggagggcgcgaaggtggcggtgatggcgaacagcgccatgcccttcggacggtggtgttccggcaacttgaccagggccagggtgaacgccagcggaatcagcgcgccgccggtgaaaccctgcatggcgcggaacacgatcatgctttccaggttccaggcgaacgagcagagcagcgaggacaccaggaagcccaccgagatcatcaccgccaggcggcgtgccgagagcagttgcaccagccaggcggtcatcgggatcatgatgatctccgccaccaggtaggaggtggagatccacgagccttcctcgagggttgccgccagcgcgccctggatgtccttcagcgaggagttggtgatctggatgtcgagcaccgccatgaatgcgccgagcatggcgctgagcaccgcgatccagtcgcgccgggtcggttcgccaagcggccgggccagcgcctcagcggtcacggagctcgacctcggcttcgacggacatgccggggcggatgcggccatgcagcgggttgtcggcctcgaacacgatcttcaccgggatgcgttgcaccaccttggtga

SEQ ID NO: 12230 - DNA, 948 bp, Pseudomonas aeruginosa
tgcgctgatcttcacccgcgtggtggagtaccacagcttcacccaggccgcgcagagcctgggcatgcagaagtccacggtgagccggcgcatcgccctgctggaggagcgcctgggcgtgcgcctgctcaatcgcactacccgcaagttgcgcctgaccgaagtagggcaggcctactacgagcgctgccggcagatcatgcacgatttcgccgaggccgagcaggcggtcatgcagttgcaacaggcgccgtcgggattgctgcggatcacctcgccgatagagttcggccagatgttcctcgccagcctgctgggcgacttcatgcgccagtacccgcagatcaccgccgaggtcgagctggcctcgcgcagcgtcgatccgctgcaggagggcgtcgacatcgtgatcatggtcggccagccggaggattccaccctggtggcccgtcgcctgctctctaccagccgctggctctgcgccagccccgactacctggcggcgcacggcacgccgacatcggtggccgagcttgccgggcatcgcgcggtccttctgtccaccgactcccagcgctactggccgctttccggagacagcctgccctgccagcgggtgctgtcctgcaacaacatcaccttcgcccgcgaggcggtggtcgccggtgccggcattgccgcgctaccggcgctgatctgtgcggagagcgtgcacagcgggcgtctggtgcgtttgctggcggacgtgccgttgccggtcggcgaactgtatgcggtctatccttcgcggcgtttccaggcgatgaaggtcaaggccttcctcgatttcctgatcagccgcctgccggccgacaccggtcgtttactggagccggaggcggcccgcctgataacatcgcgcccctgaatttccgttttaacttccgcttggcaagagagtctccatga

SEQ ID NO: 12231 - DNA, 465 bp, Pseudomonas aeruginosa
ccactgttcgtactcgcatcgccccgtcgccgacgggcgacccgcacgtcggtaccgcatacatcgcgctgttcaacctgtgcttcgcgcgtcagcacggcggtcagttcatcctgcgcatcgaggacaccgaccagctgcgttcgacgcgggagtccgagcagcagatctacgacgccctgcgctggctcggcatcgaatgggacgagggcccggacgtcggcggcccgcatggcccgtaccggcagagcgagcgcgggcatatctacaagaagtattcggacgaactggtcgagaagggccatgccttcacctgcttctgcacgcccgagcgcctcgatgcggttcgcgccgagcagatggcgcgcaaggaaaccccgcgctacgacggccactgcatgcacctgccgaaggatgaggtgcagcgccgcctcgccgccggcgagtcccacgtcacccgcatga

SEQ ID NO: 12232 - DNA, 762 bp, Pseudomonas aeruginosa
tggcctaggacaccgccctttcacggcggtaacaggggttcgagtcccctaggggacgccactttttcccgctctgcggggctctatagggccattccgaattggaatggcccttttgttttttcccttttcgaatttcctgacagacggcccggccgtacgcttgccgatttttattatgcatataatatttcatccataatattttcggagatcgtcatgagcgataagaaaacccagacccgtgcccgcatcctcggtgccgccacccaggccctgctcgagcggggcgccgtcgaacctagcgtcggggaagtgatgggcgcggcggggctcaccgtcggcggcttctatgcccacttccagagcaaggatgcgctgatgctcgaggcgttcgagcaattgctcggcaagcgccgcgaactgctcggcgaactcgatcccggattgtcgggaaaggagcgtcgtgccttggcggccgccttctacctgtcgcgcaagcatcgggacgcacaggtcgacgccggttgtccgctgccggcgaccctagccgaggtggcgcgcctgccggaggggtttcgcgaggtcttgagcagacatgtcgagatcatggtcgccagcctggcggaaagtcccgaggaaaccgacgtcgccctggccgacctggtgctgatgattggcggtttggcgctggcccgggcattggggccgggggagctgtccgaccgggttctgcgtgccgccaagcaggcggtgaactga

SEQ ID NO: 12233 - DNA, 711 bp, Pseudomonas aeruginosa
aaagcgctgtggcccgcgcggagcgatccggcggggcgagccgtttcgaatcgaggaatgcccatgacattgccgctggatcgggtcctgctgcaggccagcccggtattgccggtgctggtgatcgaggacgtggcgctggcgcccgacctggcgcgcgcgttgtatgcgggcggcgtcacggtgttggaagtgacgctgcgcacgccgcaggcgctggacgcgatcgccgccatccatcgcgaggtgcccgaggtcctgctgggggcgggtaccctgatccacaccgagcagtttctcgaggcacgcgacgcgggcgcgcagttcgccgtcagccccggatgcacgccgcgccttgccgccgccgcggaggatgccggcctgccatacctgcccggggtgatgacgccttcggaagtgttgctggcgctggagtacggttatcgctcgctgaagctgttcccggccgatggcactgccagcgtgaaaatgctgaaaagcctgaaggggccgttcaccggcatccgcttctgcccgaccggcggggtcaacctggacaacctgctgaatttcctccgcctgcccaatgtcgcctgtgtcggcggcacctggctggcgccgccgagcctgatccgggcgcgggcctgggatcagatcacacaactggccagggaagcgcgcgaactggccggcagcctggagcagcattga

SEQ ID NO: 12234 - DNA, 666 bp, Pseudomonas aeruginosa
cggtatgccgcccttcaggcgttcgatacggccgggctcgccgccgctggcgtggatctcggtatcgatcagtccgggccgcaccgcgttgacccggataccctccgccgccacttccctggccagcccgatggtcatgctgtcgatggcgcccttggcggcggcatagtcgatgtattcgttgggcgatcccagccgcgaggccatcgaggatacgttgacgatgctgccgccgcgcccgccgtggcgggtcgacaggcgcttcaccgcctcgcgggcgcagaggaagctgccggtcacgttggtcgcgaataccctgtgcaggcgcgccgcgtcgatgttttccaggcgcgtctgcgcttccagcacgccggcgttgttgaccagcacgtcgaggcggccgaaacgttcgtcgatggcggcgaacagccgctcgacatcgccttcctcggctacgtcggccgccaccgccagggcttcgccgccctggcgctcgatgcgctggcgcagcgcttcggcggcctcgcggttgcgcagatagttgaggacgaccgcatagccgcgctcggcggcgagcagagcggtggcggcgccgatgccgcggctggctccggtgatcagcatgacgttgcgcatgatgatgctccccaggtcagtagcgagtga

SEQ ID NO: 12235 - DNA, 528 bp, Pseudomonas aeruginosa
aggtcaggtagtcggcgtcccagcccaggccctgccagaacaggttggacagcggcgcgtcaagggccgattgcgcgcggatcaggccggcgccgcgcgagcgcagggcctcctcggcactgcccaccagttcccgggccaggccctggcggcgggcctgcggcagtacgtagagctctgcgatctctcccacccgtgcctgaccgtcctcgatctgccacaggtgggcgaggacgaaaccgcggggatgctgctgggcctccgccagccagagcaagcggttgcgcgaggcggccaggagcagtgcctggatcgcctgctggtcgccggcatccagggtttccccggcttcgcggacattggcttgccagagcgcggccaccgcggggacgtcgtcggcgctggccaggcgaacccggtgttgctctggcgtcgcatcgagctcctggccgacccgcagcaggttgccgtcgggatcgaccagggcgaattcgcgcataccccagggctggtcttccagggccgtga

SEQ ID NO: 12236 - DNA, 465 bp, Pseudomonas aeruginosa
ttcaggagattcgcaatgagcaacgctttttccctcgccccgctgttccgtcattccgtaggcttcgatcgcttcaacgatctgttcgagtcggccctgcgcaatgaggccgggagtacctacccgccctacaacgtcgaaaagcacggtgacgacgagtatcgcatcgtcatcgccgccgccggcttccaggaagaagacctggacctgcaggtcgagcgcggcgtgctgaccgtcagtggcggcaagcgcgagaagtccacggacaacgtgacctacctgcaccagggcatcgcccagcgcgccttcaagctgtcgttccgcctcgccgatcatatcgaggtcaaggcggcttcgctggccaacggcctgctgaacatcgacctggtgcggctggttccggaagaagccaagccgaagcgtatcgccatcaatggccagcgcccggcactggacaaccagtaa

SEQ ID NO: 12237 - DNA, 2085 bp, Pseudomonas aeruginosa
ggaaatcccgatggccggcaagaccctctacgacaaactctgggacatgcacctggtcaagcagcgcgacgacggttcggcgctgatctacatcgaccgccatatcctgcacgaagtgacctcgccgcaggccttcgagggtcttcgcctggccgggcgcaagccgtggcggatcgacgccaacatcgccaccccggaccacaacgtgccgaccacccgcaccgagcgcaagggcggcatcgccgccatcgccgacgaggtctcgcgcctgcaggtgcagaccctcgacgagaactgcgacgacttcggcatcaccgaattcaagatgaacgacgtgcgccagggcatcgtccatgtggtcggtccggagcagggcgcgaccctcccggggatgaccgtggtctgcggcgactcgcacacttccacccacggcgccttcggcgcgctggcccacggcatcggcacttccgaggtagagcatgtgctggcgacccagtgcctggtggcgaagaagatgaagaacatgctggtcaaggtcgaaggcaggttgccggccggcgtcacggcgaaggatatcgtcctcgcggtgatcggcaggatcggcaccgccggcggcaacggccacgccatcgagttcgccggcagcgccatccgcgacctgtccatcgaagggcggatgaccatctgcaacatgtcgatcgaggcgggcgcccgcgtcggcctggtcgccgtcgaccagaagaccatcgactacgtgaagggccggcccttcgcgccgagcgccgagcaatgggaccaggccgtcgcctgctggcaggggctggtgtcggacgccgatgcccgcttcgataccgtggtcgagctggacgccgcgcagatcaagccgcaggtcagctggggcacgtcgccggaaatggtcctggccgtggaccagaacgtgccggacccggcccgcgagagcgacccgatcaagcgcggttcgatcgagcgcgccttgaaatacatgggcctgcggccgaaccaggcgatcaccgacatccagctggaccgggtattcatcggttcctgcaccaactcgcggatcgaggacctgcgcgctgccgccgaagtggccaggggccgcaaggtcgccgcgaccatcaagcaggcgctggtggtgccgggttccgggttggtcaaggagcaggccgagaaggaaggcctggaccggatcttcatcgaggccggcttcgaatggcgcgagccgggctgttccatgtgcctggcgatgaacccggaccggctggagagcggcgaacactgcgcctcgacctccaaccgcaacttcgagggccgtcagggcgccggtggccgtacccacctggtcagcccggcgatggccgccgccgcggccgtcaacggccgcttcatcgatgtccgcgaattgctcgcctgaggagaaccgagatgaaaccctatacccagacgaccggtctcgtcgctccgctggatcgcgccaacgtcgataccgatcagatcattcccaagcaattcctcaagtcgatcaagcgcaccggcttcggccccaacctgttcgacgaatggcgctacctggatgtcgggcagccgggacaggacaactcgaagcgtccgctgaacccggacttcgtcctcaaccagccgcgctaccagggcgccagcgtactgctggcgcgggagaacttcggctgcggctcgtcccgcgagcacgcgccctgggcgctggacgagtacggtttccgcacggtgatcgcaccgagctatgccgacatcttcttcaacaacagtttcaagaacggcttgctgccgatcatcctgcccgaggccgaggtggacgaactgttccgccaggtcgaggcgaacgaaggctaccagttgtccatcgacctggcggcgcagaccgttacccgtcctgatggcaaggtgctgggtttcgaggtcgacccgttccgcaagcattgcctgctcaacggcctcgacgacatcggcctgacgctgcaggacgccgatgcgatccgtgccttcgaggacggctaccgccagcagcagccctggctgttccgctga

SEQ ID NO: 12238 - DNA, 1335 bp, Pseudomonas aeruginosa
ccggaagccggcgccagcgcctgcgcctggagttccagtcgtgggtcgagcggatgcgtacgccggaggtgttccgccaggcgatccgcagcctgcagctggcggtgggcgaggaagtcagggagtatttcgagattgccgacgacggctcgttcagcaccgacgtgctggtgctgtggctgcgtcgggagtgacggttcgatcgcggcggcgcatgcccgccgttcaatgaatgaaggacaagagggtgttatgagcaagcagatcctggttctccccggtgacggtatcggcccggaaatcatggcggaagcggtcaaggtgctggaactggccaacgacaggttccagctcggcttcgaactggccgaggacgtcatcggtggcgcggccatcgacaagcacggcgtgccgctggccgaccagaccctgcagcgcgcgcgccaggccgatgcggtgctgctgggcgcggtaggggggccgaagtgggacaggatcgaacgcgatatccgtcccgagcgcggtctgctgaagattcgctcgcaactgggcctgttcgccaacctgcgtccggccatcctctatccgcaactggccgcggcctccagcctgaagccggaagtggtcgccgggctggacatcctcatcgtccgcgaactgaccggcggcatctacttcggccagccccgcgagcagcgcgtgctggagaacggcgagcgccaagcctacgacaccctgccgtacagcgagagcgaaatccgtcgtatcgcccgcgtcggtttcgacatggcccgcgtacgcaacaacaggctctgctcggtggacaaggccaacgtcctcgcctccagccaactgtggcgggaagtggtggaagaggtggcgaaggactacccggacgtcgagctttcccatatgtacgtggataacgccgccatgcaactggtgcgcgcgcccaagcagttcgacgtgatggtcaccgacaacatgttcggcgacatcctgtcggatgaggcttccatgctgaccggttccatcggcatgctgccttctgcctcgctcgacgcgaacaacaagggcatgtacgaaccctgccacggttccgccccggacatcgccggtcagggcatcgccaacccgttggcgaccatcctctcggtctcgatgatgttgcgctacagcttcagccaggcgaccgccgccgacgccatcgagcaggcggtgagcaaggtcctcgaccaagggctgcgcaccggcgacatctggtccgaaggctgccgcaaggtcggcacccgggaaatgggcgatgccgtagtcgcggcactcaagaatctgtaa

SEQ ID NO: 12239 - DNA, 1182 bp, Pseudomonas aeruginosa
tctgacgggcttggccggcgccatgatggctgccggccagctcacttctctcatataggtgtagttgcgatgaagcgtgtaggtctgatcggttggcgcgggatggtgggttccgtactcatgcagcggatgctggaagagcgggacttcgacctgatcgagccggtgttcttcaccacgtcgaacgtcggtggccagggcccggaagtgggcaaggacatcgctccgctgaaggacgcctacagcatcgacgagctgaagaccctcgacgtgatcctgacctgccagggcggcgactacaccagcgaagtattccccaagctgcgcgaggccggctggcagggctactggatcgatgccgcctccagtctgcgcatggaagacgacgcggtgatcgtcctcgacccggtcaaccgcaaggtcatcgaccaggctctggacgccggcacccgcaactacatcggcggcaactgcaccgtcagcctgatgctgatggccctgggcgggctgttcgacgccggcctggtcgagtggatgagtgccatgacctaccaggccgcctccggcgccggcgcgcagaacatgcgtgaactgctcaagcagatgggcgccgcccatgcatcggtggcggatgacctggccaacccggccagcgcgatcctcgacatcgaccgcaaggtggcggagaccctgcgcagcgaagccttccccaccgagcatttcggcgcgccgctgggcggcagcctgatcccctggatcgacaaggaactgcccaacgggcagagccgcgaggagtggaaagcccaggcggagaccaacaagatcctcgcccgcttcaagaacccgatcccggtcgacggtatctgcgtgcgcgtcggcgccatgcgttgccacagccaggcgctgaccatcaagttgaacaaggatgtgccgctgaccgacatcgagggcctgatcagccagcacaatccctgggtcaagctggtgccgaaccaccgcgaggtaagcgtgcgcgagctgaccccggccgccgtcaccggcaccctgagcgttccggtcgggcgcctgcgcaagctgaacatgggctcccagtatctcggcgccttcaccgttggcgaccagttgctgtggggcgctgccgagccgctgcggcgcatgctgcgcatcctgctggagcgctga

SEQ ID NO: 12240 - DNA, 312 bp, Pseudomonas aeruginosa
gtgcgcagttggacgagttggccagcaaccttgacgagccgaagagcgcgacgccgagtttctccgccgaagatgcagcggtcgcctccgccctggacggagacgccgacgatgacttcgacttcctctccggtgccgacgaagcggcgaccaagctggatctggctcgtgcctacatcgacatgggcgatagcgaaggcgcgcgcgatatcctcgacgaagtcctggccgaaggtaacgacagccagcaggcggaagcccgcgagttgctggagcgcctggcctgatccggaaatgaagcgactctcatga

SEQ ID NO: 12241 - DNA, 777 bp, Pseudomonas aeruginosa
ccatcggtgccggcgagcggccgatcgaatgggcgaaggaggtgctcgaggcgcgcgaccggcgcgccggtggggtcaccgctcacccctacggactctatctggtgcgggtggagtaccccggggagttcgagttgcccgagcgctacctggggccgcatttcctttccggattgcccgatatcgtcggctgacgtcgaatcgggcttttgctaccatcgagaattcccgccggaccggccgtccggcggttcgtcgctcactcgccgaggattctccgtcgttgccagccgttcgcatcaagatctgcggtatcacccgagtcgaggacgccctggccgctgccgcggcgggcgccgatgccatcggcctggtgttctatgcgaagagcccgcgggcggtggatatccatcgggcgcgggagatcgttcgtgccctgccgccgttcgtgaccagcgtcggcctgttcgtcaacgccagccgctgcgaactgggcgagattctcgatgcggtgccgctggacctgctgcaattccatggcgacgagcgcgccgaggactgcgagggacatcggcgaccctacctgaaggccctgcgggtgaagcccggcgacgacatcgtcgggcgcgcggcggcatatccgggagctgccgggattctcctggatacctatgtggaaggcgtgcccggcggcacgggggcggcgttcgactggtcgctggtgccgaccgacctgggcaaacccctggtgctggccggcggtctgacgccggataa

SEQ ID NO: 12242 - DNA, 1011 bp, Pseudomonas aeruginosa
gcaggggttgtcggtcggggtctacagctcgccgcacctgctgcgctacaacgagcgggtgcggatcgatggcgtcgaggccggcgatgcgcaactgtgcgacgccttctccgcggtggaggccgcacgtggcgagatttccctgacctatttcgaaatgggcactctggccgccttctggctgttcgagcgcgccgggctggacttcgcggtgctggaagtcggccttggcgggcgcctggatgcggtcaacctgatcgacgccgacctggcgctgatcaccagcatcggcctggaccatgcggactggctgggcgatacccgcgaaagcgtggctttcgagaaagccggtatcctgcgcgccggcaaaccggccctgtgcggcgatttcgatcccccgcagccattgctggagcaggtggctgcgctgggggcaccgctttacctgcgcggtcgcgactacgacctggcgctcgccgatcatggctggcactggcgcgggctggccgcggacggccaggcgctggcgctgcacgatctgccgttgctcgggttgcccatggaaaacgccgcgctggccctgcaggcctacgcgttgctcgagttgccctggcaggcggagcgcctggccgaggcgctgcggcggacccgggtgaccggtcgcctcgatcgccgcgacctgtcctggaacggccagccacgccagctcctgctggacgtcgggcacaatccccaggccgcccagtacctggcgcaacgcctgcgtgccgcagcgccacgaggacgctacctggcggtcttcggcctgctggcggacaaagacctggatggcgtactggaacccttgaccggcttggtgcaggattgggccgttgcaccgttgccgactccgcgttcgcggccggccgcggagctggaggcggcgctgatcctgcgccaggttccggcgagcagccatgcggatatcgccgccgccctggacgcgcagtgcgccaaggctaccgcggatga

SEQ ID NO: 12243 - DNA, 747 bp, Pseudomonas aeruginosa
cggggagttaatcatggccttgctggaaagagggctgaagcagcgcatcgtcggggcgttggtgctgatcgccctggcggtgatcttcctgccgatgctgttcacccgcgaagacgagtcgcgccaggtcgtggtggaagcgccgccgcgcccgcaatcgccggccatgcccagtgtcgaggtgcagccgaccgaggtgccggaactgcagcccggcgaagaaggcaacgctcccgagatcgtcgaggaaggctccccggccgccgccggccagcccagccagccgatcggcggcctgccggcgaccccgccggccacccagccgcccgcccaggcccaggcgccggccgccagcctgccgccaagccagccgcaaccgcccgctgcgccgccgagcccgccgcccgcggagaagcgcctggacgccaacaacctgccgcagagctggtcggtacagcttgccagcctgtccaaccgggcgcgcgccgaggaattgcagaagaccctgcgctcccagggctacaacgcctacatccgcagcttcgacgggatgaaccgggtcttcgtcgggccggtgatccagcgcgccgaggcggatcgcctgcgcgaccagttgagcaagcagcagaagctcaacggcttcgtcgtgcgcttccagccggaacgcggttgaccgcgacccgcggcttaccgtcgcgggcgcgctctgctaaaatgcagcgccttttctgcttgtgggctgcatag

SEQ ID NO: 12244 - DNA, 975 bp, Pseudomonas aeruginosa
gctgtacctgcgcaaggacaacggcctggtccgcgacgtcttccagcagcgccacatgcagcgcctgatcggcagcgtcggcatcggccatgtgcgttacccgaccgccggcagctccagctcggcggaagcgcagccgttctacgtcaactcgccctacggcatcaccctggcgcacaacggcaacctgaccaatgtcgagcagttggccaaggaaatctacgaatccgacctgcgccacgtgaacaccaactccgattcggaagtgctgctcaacgtgttcgcccacgagctggcggtgcgcaacaagctgcagcccaccgaggaggacatcttcgccgcggtttcctgcgtgcacgaccgttgcgtcggcggctacgcggtggtggcgatgatcaccggccatggcatcgtcggtttccgcgaccccaatgcgatccgtccgatcgtcttcggccagcggcataccgagaacggcgtcgaatacatgatcgcctccgagagcgtggccctggacgtactcggcttcaccctgatccgcgacctggcgccgggcgaggcggtgtacatcaccgaggaaggcaagctctatacccgccagtgcgccaaagcaccgaagtacgcgccgtgcatcttcgagcacgtctacctggcgcgtccggattcgatcatggacggcatctcggtgtacaaggcgcgcctgcgcatgggcgagaagcttgccgacaagatcctccgcgagcgtcccgaccacgacatcgacgtggtcatcccgatcccggacaccagccgcaccgcggcgctggaactggccaaccggctcggcgtgaagttccgcgagggcttcgtcaagaaccgctacatcggccgcaccttcatcatgcccggccaggcggcgcggaagaaatccgtgcggcagaagctcaacgccatcgagctggagttccgcggcaagaacgtgatgctggtggatga

SEQ ID NO: 12245 - DNA, 429 bp, Pseudomonas aeruginosa
ctccatcgtccgcggcaccacctgcaagcagatcatccagatggcccgcgaggccggggcgaagaacgtctacttctgctccgccgcgccggccgtgcgctaccccaacgtctacggcatcgacatgccgagtgcgcacgagctgatcgcgcacaatcgcagcaccgaggacgtcagcaagctgatcggcgccgactggctggtctaccaggacctgcccgacctgatcgacgcggtcggcggcggcaagatcaagatcgatcacttcgactgcgccgtgttcgacggcgagtacgtgaccggcgacgtcaacgaggcttacctgaaccggatcgaacaggcgcgcaacgatgcgaccaaggccaagagccaggcggtcagcgcgatcatcgatctgtacaacgactgacaaaggggagagcggcatga

SEQ ID NO: 12246 - DNA, 2022 bp, Pseudomonas aeruginosa
ggccgccttgccggtatggcgccgttattccgtcttcagttcgcgcagatcgacggcctgtccatcgaacaactggttggcgttggtcggcaggatgctgggtcgtccctccgggccgcgagtgccgtcgatgacccggatgtcgctgtatttcttgcccgagagcgcggcgagaccggcgctgtcgcggaccaccgtaggacgcaggaagaccatcaggttgcgcttggtgtgggtgtccttggtggaacggaacaggcgaccgagcaatgggatgtccccgagcaggggaaccttcgactcggcttgggaaacgtcgtcctggatcaggccgccgatcacgatcacctggccgttctcggcgaggatggtgctcttgatcgagcgcttgctggtgatcaggtcggtattgttgcgctgctgggcgttgggcagcagggccgagatctcctgctcgatctccaggcgcagggccgcgccgtcgttgatgtgcggagtgaccttgaggctgacgccgatatccttgcgctccacggtggtgaacgggttgctcgaaccttcgctgttggtggtgtaggagccggtctggaacggtacgttctggccgaccagaatctccgctttctggttgtccagggtcaacaggctcggggtcgacagcaggttgctcttggtgttggccgagagcgcggtgaccagcgcgccgaagctgctgctgccgatgccgacgatggcgccgtcggggatggattccggtgccttgttgctctcgagcgattgcagcagggtgccgatggacagtccggtattggcgaagttggtcttggttccgcccatgccgcccttgttgatcgcccattgcacgccgacggcatcctggatgtcgccggagatctcgacgatggccgcttccaccaatacctgggcacgcggcacgtcgagctggcgaacgatgtcttcgagagcgttgaccgtgtccgggtcggccagcaggaccagggcgttggtgctttcgtcggcacggatgaggatgttgctcggtcggccgccgccggtctgttcgccgccctggccgccattgttcttcatgccttcggaaatctggccgagggtttccgcgagggtcttggcgtcgttgtggcgcaggcggatcacccgggtgttggccgagcgcgcggtcggggtgtccagcgattgcgccagttgcaccagcttggcgcgcgcctgcggcgggccgaggatgatcaggcggttggtgcgcgcgtcggcgatcacctgggcgcccgccgcgcccttggcctggccgcggctcatggcgttgttgagcacctcggcggcgtccatcacccagccgtagcgcaggttgatcacgctgtagtcgtggctgcccttctggtcgagctggcggatcacgtcttcgattcgcgcgatattggcgctgcggtcgctgatgatcagcgcgttggccgagggcaccgcggcgaggtggccatattgtgggaccagcggacggatcagcgggatgagttccgataccgggctctgctgcacctggatcacccgcgtctccaggcgatccggcgcgctctggccgccgccggcctcggtcttggcctcggcgttgggcacgatgcgcgcctggtcgccctgggcaaccacggtgaagccgtgggtgctcatcaccgagaggaacaactggtagacctcgctcaacgagagctgggccttggagaccacgctgacctggcccttgacccgcgggtcgacgacgaaggtctcgccggtgatttcggaaatctggtcgatgaattcgcggatgtcggcatccttgaggttgatcgtccagtgcgcctcctgctggttgccggccgggacgaaggcgttcccgccgctgttttcggcgtgcgccgcctggatgccgagggccaggctgagaaggacggcgggaacgtacgaacgactggaaggggcaaacagggcgcggagcaaaggctgggacatcgggtcagtcgctttccgtag

SEQ ID NO: 12247 - DNA, 663 bp, Pseudomonas aeruginosa
ggcatccatgatgacagccccattacccgacatcgccgcgccggccgcaccgccacggcgtctgccgttcagcttcgccaagcgccagggcctgctgttcctgtgcctggaggagcagtactggctggcctgccggccgcaggtggagctggcggcgatcgccgaggcgcagcgcttcgccggccgccgcctgccgctcaaggcgctcggcgaggacgccttcaaccaggccctggcggcctcctaccagcacgactcctcggcggccatgcagctcgccgaggacctcggcggcagcctggacctcgccgcgctggccgaccaggtcccggaaaccgaggacctgatggagcaggaggacgacgcgccgatcattcgcctgatcaacgcgatcctcggcgaggcgatccgcgagaacgcctcggacatccacctggaaaccttcgagaaacgcctggtggtgcgcttccgcgtcgacggcgtgctgcgcgaggtgctggagcccaagcgcgagctggcggccctgctggtatcgcggatcaaggtcatggcacggctggacatcgccgagaagcgtattccccaggatgggcggatttccctgcgggtcggcgggcgcgaggtggacatccgcgtctcgaccctgccctcggccaacggtga

SEQ ID NO: 12248 - DNA, 678 bp, Pseudomonas aeruginosa
acgggtggtgctgcgtctgctcgacaagcaggccgggcgcctgaacctgcaacacttgggcatgagcgagcgcgaccgcaagctgatggacgaaacggtgcgcaagccgcacggcatcctgctggtcaccggccccaccggctcgggcaagaccaccaccctgtacgccagcctgaccacgctcaacgaccgcacgcggaacatcctcaccgtcgaggatccgatcgaataccacctggagggcatcggccagacccaggtcaacgccaaggtcgacatgaccttcgcccgcggcctgcgggcgatcctccggcaggacccggacgtggtgatggtcggcgagatccgcgaccgggagaccgccgagatcgcggtgcaggcttcgctgaccggccacctggtgctctcgaccctgcacaccaacagcgccatcggtgcgatcacccgcctggtggacatgggcatcgagccgttcctgctgtcctcctccatgcttggcgtgctggcccagcgcctggtgcgggtgctctgcccggcgtgcaaggagccctaccgcgccgacgaggccgagtgcgcgctgctcggcgtcgatcccgccgcgccgccgaccctgcatcgcgcccgcggctgcggcgagtgccaccagcatggctatcgcgggcgtaccggtatctatga

SEQ ID NO: 12249 - DNA, 1392 bp, Pseudomonas aeruginosa
gctggtggtgttcgacgaccacatgcgctcgctgatccacaacgaatcctccgagcaggaaatgacccggcatgcccgcaccagcggaccgagcatccgcgacgacggtcggcgcaaggtgctggaaggcgtcaccacggtcgaggaagtcctgcgcgtgacccgggaagaataatggccgccttcgaatacctcgccctcgaccccagcggtcgccagcagaagggcgtgctggaggcggacagcgcgcgccaggtccgccagttgctgcgcgagcgccaattggcgccgctcgacgtgaagcccacccgtacccgcgagcagagcgggcagggcgggcgcctgacgttcgcccgcggactgtccgcgcgcgacctggcattggtgacccggcaactggcgaccctggtccaggccgcgttgccgatcgaggaggcgctgcgcgccgccgcggcgcagtccacctcgcagcgcatccagtcgatgcttctcgcggtgcgcgccaaggtcctcgaaggccatagcctggccggcagcctgcgcgagtttcccaccgcctttcccgagctgtaccgggcgactgtggctgccggcgagcatgccgggcacctcggcccggtgctggagcaacttgccgactacaccgagcagcgccagcagtcgcggcagaagatccagctggcgctgctctatccggtgatcctgatggtcgcttcgctggccatcgtcggcttcctgctgggctacgtggtgcccgacgtggtccgggtgttcatcgacagcgggcagaccctgccactgttgacccgcgtgctgatcggcgtcagcgactgggtcaaggcctggggcgcgctggccttcgtcgcggcgatcggcggggtgatcggcttccgctacgcgctgcgcaaggatgcctttcgcgagcgctggcatggcttcctgctgcgcgtgccgctggtcggtcggctggtgcgttccaccgacaccgcgcgcttcgcctcgaccctggcgatcctcacccgcagcggcgtgccgctggtggaggcgctggcgatcgccgccgaggtgatcgccaaccggatcatccgcaacgaagtggtcaaggccgcgcagaaggtccgcgagggcgccagcctgacccgctcgctggaagccaccggacagttcccgccgatgatgctgcacatgatcgccagcggcgagcgctccggcgagctggaccagatgctggcgcgcaccgcgcgcaaccaggagaacgacctggcggcgcagatcggcctgatggtcggcctgttcgaaccgttcatgctgatattcatgggcgcggtggtgctggtcatcgtcctggccattcttcttccgatcctttctctcaaccaactcgtggggtaa

SEQ ID NO: 12250 - DNA, 924 bp, Pseudomonas aeruginosa
ctgggacaactgaccggacatgcgggcttcgcgcggcttcaccctcatcgagctgatggtggtgatggtcatcatcagcgtactgatcggcctggcggtgctcagcaccggcttcgccagcacctcgcgggagctggacagcgaggccgagcggctcgccgggctgatcggcgtgctgaccgacgaggccgtgctggacaaccgcgagtacggcctgcgcctggagcgcgatgcctaccaggtactgcgctacgacgaagcgaaggcgcgctggttgccggtggcgcgcgacagccaccgcctgccggagtgggcggagctgaccttcgagctggacggccagccgctggtgctggccggcagcaagggcgagaaggagcagaagaaaggcaccgaccagccgcaattgctgatcctctccagtggcgaactcagtccgttccgcctgcgcctggccgagcgcggacccgaggggcgggcgttgtcgctgagcagcgacggtttccgcctgccacgggtcgaggtggcgcggcgatgaagcgcgcgcgtggtttcaccctgctggaagtgctggtggccctggcgatcttcgccatggtcgcggccagcgtgctcagtgccagcgcgcgcagcctgcagaacgcctcgcggctggaagacaagaccctggcgatgtggatcgccgacaaccgtctcaacgaattgcaactggaacagacgccgccctccagcggccacaaccagggcgagctggagttcgccgggcgccgctgggagtggcgcacccaggtcgacagcaccgccgagcaggatatgcggcgggtgatcgtctgggtcgcggcgaagcccctcggccgcgagcgtggcagcatcgaggaacgcgccgcggcgcgcctcgtcggtttcctcgggagccagccatga

SEQ ID NO: 12251 - DNA, 1341 bp, Pseudomonas aeruginosa
cgtcaactttgccgtcggcacccgctacttccaggtgatcagcgaggtcagcctgggcgaccgccggcaggtgctggtgagtaccttgcagcggggcaaggacggcaagatacgcgtgatggcccgcgacatggggcagggcggcctgcccatcccgtcgacgggcggcgacgattggaagaaggacgagcgatgagtggagtgagtgcgctgttcctgccgcccgccagcacggcgggggccgatggggaactggcggtatggtgggtgcaggatggcgagtgccggcgcgcgccgttcgcccaggcgctggcggagatccgcgcgccctggcggctgtacctgccggtggaggcggtgaccgcctgcgcggtgaacctgcctacacagaaggcgcgctggttgcgccagtcgctgcctttcgcggtggaggaacaactggccgacgatgtcgagcagatgcaccttgcccttgggtcggcgctggccgacggccgccaccgggtattcgccgtgcagcgcacctggcttgccgcctggctggcgctggccgagggcgcgggcaaggcgccggcttcgctgcatgtcgatgccgattgcctgccgggcgagggcagttgcctgttctggctggaagagcgctggttgctcggcggcagcggcgccgtacgcctggcctgcggcagcgaggattggccggtactgcgcgacagttgcccgccgccccagcgggccttcgccgcgcaggaggtggcggccccggagggagtggaagtccagcccctggcgggcaatccgcacgtctggctgagcgagcagccgctgggcaccgacctggcccaggccgagttcgccgcgcgccagcagagcagccagtggcgccgctggcggccgctgctggggctggtcgggctgtggctggtgttgcaatggggctttaccctggtccaggcctggcagttgcagcgcgaaggcgaccgctacgcggcgcagagcgcagaactctaccgccagttgtttcccgaggaccgcaagctgatcaacctgcgcgcgcagttcgaccagcacctggccgacagcgccagcagcggcggcgagggccagttgctcggcctgcttggccaggccgccacggtgatcggcggcgagccaacggtgagcgtcgagcaactggacttcagcgccgctcgcggtgacgtcgccctccaggtgcgggctcccggtttcgacgtgctggaacggctgcgttcgcgtctcagcgagtccgggctggcggtgcagctgggttcggccagccgcgatggctcgacggtcagcgcgcgtctggtgataggaggttga

SEQ ID NO: 12252 - DNA, 624 bp, Pseudomonas aeruginosa
gatgaaggtgatgacgcaattccacgagcgcctcagggcccaggcggaaacctcgcagctggcgatccgctggcgcgggctgccggcgcgggaccgcctggcgctgctctggctcggcgcgttcctcctgctggtggtgctctacctggcgctgtggcgcccggccgagcgccatctgcagtcggcgcggcagtatttcaccgaacagcgcgcggtgcatgcatacatccagcagcaggcgcccaacgtgcgccaggccgatgccgcggcgccacaggcgcagatcgacccggcggcgctgcagggcatggtcacggcttcggcggcccaggccggactgagtgtcgagcgcctcgacaacgaaggcgagggcgccgtgcaggtggccctgcagccggcgccattcgccaagctgctgccctggctggagcagttgaacgggcagggcgtgcaggtggcggaggccggcctggaccgccaggtcgacggccgggtctcggcgcgcctgagccagcgggtcgagtgagcggcccgtggctggggccggcatgggccccggcgccgaccgcgccgacaggcgatcgccgaaatttcaaaaaaaattcaatcagggcattgacttag

SEQ ID NO: 12253 - DNA, 1374 bp, Pseudomonas aeruginosa
tcaggcgctctgtcgctgggcgcggcggaattcgccgggcgtctgcccgctccagcgcttgaaggcgcgctggaaggcttccgccgaggcgaagccgaacaggtaggcgatttcgccgaaagccaggtcggtctcgcggatgtagaccatcgccaggtcgcggcgggtgtcgttgaggatgctgcggaactgggtgccttcctcggccagcttgcgccgcagggtccaggtcggcaacttgaggcgcgcggcgatttcctcgaggtccggttcgcgaccattgagcatcggccccagcaggcggctgacgcgctcgcgccaactgcgggtgcgggtcaactgctccagttcgcggttgcagagttccagcatctggctccaggtgctcggacagtgctcggcattcgccagggccaggctggcctggctcaggcgcaactggttggtcggcgcgccgaattccaccgggcagccgaagaatgcctcgtagcgctcggcccaaggcggcgctggatattcgatctccacccgctccgctttcaacggctgccttgccagggcgccgagatggctgatccagcctgccagcaccgaatcgacgacgaagcggttataggcgttataagggctgatcgaatagaagcgcagccaggcgccgccggcgtcttccaccaggctcgactggccccggtagttctgcgcgtaaagcggttccaggtggatcattgcccgcgcggcggcgcgcatgttgggcgcctgggcgacgctgacgccggccaggcccatctgtccgagacggctcaggcggcccatctgcaggccaagggcggggtctccgctgagctgtatggcggcatggccgaggcgcatgtagcgagggatcgacaggcgcgccccgggttcggccaggcgccgctggtcgaggccgtactgctcgagcagtgctgcgggctcgacgccggcggcgagcagggcgtcggccagcgcctggacgaagccgaccgagaggtcgccgaggcgaacccggggcgcgctcatagccagagattgaccagttgcgcaccgccgccgggattggcctggcgcatgccctgcgacgaaccgagcaggctctggccgtcttcggtgacgttccacaggcggctatgggcgaaggccacggcggcgccgcgcgcaccgctggccagcaggcgctcgccgaccgccaggtgctgccaggcctcggcgttgctcaggctgttcggcgccaggcgtacgtcgccgggaaccagctccgcatcgaagccgggccagggctgctgccagcgaccgctctggttcagggcggcggggatcgccagcagttcgacgcgctgttcgaccagggtggcgtag

SEQ ID NO: 12254 - DNA, 2298 bp, Pseudomonas aeruginosa
gcggcgaagagggtgatgaggatcaggaagatcagcttgcgcatgcgggtctccaaggcagcccacagggtaggggagtggcgtcggcttgccaagcatccctgtgcattccgatcagtaacttgtcatttaggatcattgagcgctccggtggcgctccttagagtcgtcgccataccgaccgctgcccgtcccgcgcattgcgcccgaggccgcggcatatccgtgaacgcgtttcgcccgatgtggagacccccgatgaccgccgccgttccctatccgcacctgctcgccccgttggacctcggcttcaccaccctgcgcaaccgcaccctgatggggtccatgcacactggcctggaagagaagccgcagggcttcgagcgcatggcggcgttcttcgccgaacgcgcccgcggtggcgtcggcctgatggtcaccggcggcatcggcccgaacgaggagggcggcgtgtattccggcgcggccaagctgagcacgccggaagaggcggagaagcacaggatcgtgacccaggcggtgcatgaggcgggtggcaagatctgcatgcagatcctgcatgccggccgctacgcctacagtccgaagcacgtggcgccgagcgcgatccaggcgccgatcaatccgttcaagcccaaggaactcgacgaggaaggcatccagaagcagatcgccgacttcgtcaactgcgccagcctggcccaggtcgccggctacgacggcgtcgagatcatgggatcggaaggctacttcatcaaccagttcctcgtgcagcacaccaaccagcgcaccgaccgctggggcggcagctacgagaaccgcatgcgcctgccggtggagatcgtccgccgggtgcgcgaggcggtggggccgaacttcatcatcatctatcgcctgtcgatgctcgacctggtcgagggcggcagcagctgggacgagatcgtgctgctggcgaaggccgtcgagaaggccggcgcgaccctgatcaataccggcatcggctggcacgaggcgcgcatcccgaccatcgccaccaaggtaccgcgcgcggccttcaccaaggtcaccgccaagctgcgcggcgaggtcggcatcccgctgatcaccaccaaccgcatcaacactcccgaggtggcggagaaggtcctggccgagggcgatgccgacatggtctccatggcccggccgttcctcgccgacccggatttcgtcaacaaggccgccgccggccacgccgaacggatcaacacctgtatcggctgcaaccaggcctgcctcgaccacaccttcggcggcaagctgaccagttgcctggtcaacccgcgcgcctgccacgaaaccgagctgaactacatccccaccaccaggccgaaaaaaatcgccgtggtcggcgccggcccggccggcctggccgccgccaccgtggccgccgagcgtgggcaccgggtcagcctgttcgacgccgccggcgagatcggcgggcagttcaacgtggccaagcgggttcccggcaaggaagagttccacgagaccctgcgctacttccgcaacaagctggagagcaccggtgtcgaactgcacctgaaccgccgggtcggcgtggacaacctggtcgcgggcggctacgacgagatcgtcctcgccaccggcatcgttccgcgcacaccggcgatccccggcatcgagcatccgaaggtgatcagctacctggatgcgatcctcgagcgcaagccggtgggtggcaaggtggcggtgatcggcgccggcggcatcggcttcgacgtctccgaattcatcacccatgccggtccgtccaccagcctggagcgcgaggcgttctggaaggagtgggggatcgatactcgcctggaagcccgcggcggcatcgccgggatcaaggccgaggtgcatccggcggcgcgccaggtgttcctcctgcaacgcaagaagagcaaggtcggcgacggcctcggcaagaccaccggctggatccatcgcgccggcgtgaagaacaagcaggtgcagatggtgaatgccgtggagtatctcgggatggacgacgccggcctgcatatccgcgttgccgagggcgagccgcaggtgctgccggtggataccgtgatcgtctgcgccggccaggacccgctgcgcgagttgcaggacggcctgctggcggccggccagagcgtgcacctgatcggtggcgccgacgtcgccgccgagctggatgccaagcgcgccatcaaccagggttcgcgcctggccgccgaactctga

SEQ ID NO: 12255 - DNA, 1620 bp, Pseudomonas aeruginosa
tctccgtccgctcaaaacccgaccgcttcacaatttcccctaccgctcggcgggccgtccggcatcgcccgggtgtctgccaacccagtcacattgcccgcgacattttttcccctagacttgcccgaacaacgagatagcgcctgtttttcaggtgacatgccagatgggtactgccggatgcgggccgcctcgccaggcgttcgagggttagcgatgagcatgcagaaaaagccacagatggcggaggccgtgctgttcttcaacgacagcggcgtctgcaaggaaatgctgtatcccgaattcgaggcgctgctcgatggcctggtgcgcatgccggaatacgccgaccggcagatgcacctggcctatgtgttgatcaatccgcgcctgcaggcgcgggcggcggtgttcttctatctcgatttcgacgagcagggcggcgccgacaccggctggaacctgcctctgcgcaacctcgccgaacgcgccggacgcggccccgacatgggcggcgggccgatccgcctggcctgtcgcagccagtgcccggtgtcctggcaccagatgcacctctgggacccggagagcagcgccggacgcaaccatttcgtgctcatccgcgacgcgctcaggcgcaaccagctgggcctgctggtggacgaagagcctgccgcggtggagccgcagcggctgcagatggccgccgaagagcaatggtacgccgccggtcccgccgccccgaaggcaccgcccgcggagcctccgcgcaagcaggaggacgagcagacggcgcgcctggcgcaactggtcaagcagcagcgacaacagctcgccgccctggcccggcagcaggagcagcgcctggccgggctcgcccggcagcacgaagaggaactggccaggcgcgaacaggacgcccgcgggcaactggacatcctgcgcagcgaagtgctcagcctgcaacaggccctggaacggcaggcgcgggagaacgccgaattgcagcagcgtctgctggagcagggcgagcagttccagcgcaaccgcgaggaactgacccggcaactgcgtttcatcgagaaccaggggcgcaacgagaccgacctgctgcgctcggagttcgccgacgaactggaggctcgagtggcggcggcggtggccggctacaaggagcaggtctcgatccgcgacgtcgaactggcctaccgcaacgagctggaccagcaactggagcaggaactggccgagctgcgcgccgagcgcgaccgtctggccgcccaggggccggagcaactgctggagcgtctatccggccagggcgtggtattcgtcgcctaccatcccggcgccgggcacctgaccatccccttgcaggacatcccgcgttaccaggacaatccgctggcctacgcggcggccaagtgcttcgtctccgagagccagtaccgccagtggctggaccacttccagcagccgcgctgcgaggcgctgctgcccggcggcgaacgctgcaacctgccgctcgaccgggtcgacaacccggcgcgcttcgtcgccggcgacaccaactgctgcgcccggcacaagaccacggggcgcctgcgcaccgtgagctga

SEQ ID NO: 12256 - DNA, 993 bp, Pseudomonas aeruginosa
tccaccccatcgaccacaactactacgagatctgccggaccaagctcggctggggcagccgcctgggcggaggcgactgatgcaactcgaccccggacgtggctacgacctgatcggcgatgtccacggctgcgcgcataccctggaccgcctcctcgacctgctcggctaccgcctgcagggcggcgtctggcgccatccgcggcgccaggtgctgttcctcggcgacatcgtcgaccgcggcccgcgcatccgcgaggccctgcaccgggtgcacgcgatggtcgacgccggcgaggcgctgtgcatcatgggcaaccacgaattcaacgcgctcggctggagcaccccggcggcgcccggcagcggccgccagtacgtccgcgagcatacgccgcggcatgcccggctgatcaaggagaccctcgagcagttcgagggccacgatgccgactggcgcgacttcctcggctggttccagcaactgccgctgttcctcgatgccgggcgcttccgcatggtccatgcctgctgggacggcgagctgatcgcgaccctgcgccggcagttccccgacgggcggatcagcgaagccttcctgcaggagtcggcggagcccggcagctttgccgacctggcctgcaaccgcctgctgcgcggcaccgacatgcgcctgccgcacggtgccaccctgaccagcagcgatggctatacgcgcgccttcttccgcaccaagttctgggtcgaggacgaggcgccgcgcacctacggcgatatcgtcttccagcccgacgcgttgcccgaagcgatcgcccgcgagccgctcagcgaggagcagaagtccagcctgctgacctacggcgccgacgaaccgctgttgttcgtcggccactactggcgacgcggcacgccggcgccgatccggccgaacctggcctgcctggactacagcgcggtgatgtacggcaagctggcggcctaccgcctggatga

SEQ ID NO: 12257 - DNA, 864 bp, Pseudomonas aeruginosa
cgagtgagcgcggtgcaggtcctgaagtttcccctctcggtcgacctggccggcttcgtcggcctgctgcggcgtctgaacgtgccgcaccgggtcagcgaggaatccggccagcaggtcctttgggtgcccgacgagcggctcgccgagcaggtccgcgagttgtaccggcgttatcccgaaggcgatccgcaggcgaccctggaggccgcgccgcgaccggcggggcagggtttcgtccggcaactgcggatgagcccgatgaccgccgcggtgttgctgctgaccttcgtcgtcgccgctgtcacctaccttggcgacaacttcgcgacgatgcgctggctgaccttccaggacttccgtatccagggccagtacgcgctgttcacgccgttggccgagagcctggcggcgggtcaatggtggcggctgttcacgccgatgctgatccacttcggctggctgcacctggcgatgaacgccatgtggttctgggagctgggccggcgcatcgaattccgccagggccgtccgatgctgctcggcctgaccctgctgttcggcctggtgtccaacgtggtgcagtacgcggtgagcggcgccagcctgttcggcgggttgtccggggtgctctatggcctgctcgggcactgctggatcttccagtacctggcgccgaaccaggcctatcgcctgcccaggggcgtcgtggcgatgatgctgatctggctgctggtgtgcctgtccggggtgatcgacctgctcggcttcggctccatcgccaacggcgcgcacgttggcgggctgctggtcggttgcctcagcggtttgctgggcggcctgctggcgcggcgtcgccgttga

SEQ ID NO: 12258 - DNA, 1656 bp, Pseudomonas aeruginosa
tcgcctgggagctgcagaacctccccgaggaggagcgcaccggctacatgggcccgcagcactgctcctcgcattccgacgagccgatcccgaacatcctgttcaagtcggactccgtgcactgatggaagaaatcgcccgcggcgcgctgagcaagatgacggcgcgcctggaaagcaatgctcccgtgcaatacgccttccgcctcgacgaccgcgaagtcgcggtgaacccgctgatcggccggccgctgcgcctggagtacctcggcagcatcttctgcacccattgcggccgcaagacgaagaagagtttcagccagggctattgctatccctgcttcacccggctggcgcagtgcgacagttgcatcgtcagcccggagaagtgccactacgagcagggcacctgccgcgaaccggagtggggcgagcggttctgcatgaccgatcacgtggtgtacctggccaactcctccggggtgaaggtcggcatcacccgcgccagccagattcccacccgctggatcgaccagggcgcgcgccaggcgctgccgatcctgcgcgtggccacccgccagcagtccggcctggtggaagacctgctgcgcagccaggtcgccgaccgcaccaattggcgggccatgctcaagggcgaagccgagccggtcgatctggcggcagtccgcgagcagttgttcgaccagtgcgccgacggcctgcgcgaattgcagcaacgtttcggcctgcaggcgatccaaccggttatcgacctcgatccgctcgagatcgcctacccggtcgaggcctacccgagcaaggtcgccagcctcgacctggaaaaaacgcctatcgtcgaaggcacgcttcgcggtatcaagggccagtacctgatcctcgacaccggggtgatcaacattcgcaaatacacggcctaccagatcgccgtgcatcactgagcagaagggccacaagccatgcgcaccgagcaaccgaaagtcatccacctcaaggactatcaggcgccggactacctgatcgacgagacccacctgaagttcgaactgttcgaagaccacagcctggtacacgccgagttgaagctgcggcgcaaccccgagcgcggcgccggcctgccgccgctgttgctgcatggccagcaactggagctgctggcgctcgaactggacggccaggcgctcggcgcggacgactaccaactggacgacgagcagctcggggtgaaaccgcggcaggccgagttcgtcctcaggagcacggtgcgtatccatccggagagcaacaccgcgctggaaggcctgtacaagtccggcaagatgttctgcacccagtgcgaggccgagggtttccgcaagatcacctattacctcgaccgtcccgacgtgatgagtcgcttcaccaccaccgtcagcgccgaacagcagcgctacccggtgctgctctccaacggcaacccggtggccagcggttccgaaggcaacggccggcactgggcgacctgggaagacccgttcaagaagccggcctacctgttcgccctggtcgccggcgacctctggtgcgtcgaggacagcttccgcaccatgagccagcgcgacgtggcgttgcgcatctacgtcgagccggagaacattga

SEQ ID NO: 12259 - DNA, 1125 bp, Pseudomonas aeruginosa
gtatttccacaactggtcgggcaaccgggtcacctgccgcgactggttccaactgtcgctcaaggagggcttcaccgtattccgcgactcggagttctccgccgacatgaactcgcgcacggtcaagcgcgtcgaggacgtcgccttcctgcgcaccaaccagttcgccgaggacgccgggccgatggcgcatccggtgcgccccgactcgttcatcgagatttccaacttctacaccctgaccgtctacgagaagggctcggaagtggtgcggatgatccacaccctgctcggcgccgaaggcttccgcaagggctcggacctgtacttccagcgccacgacggccaggcggtgacctgcgacgatttcgtcaaggccatggaagacgccaatggcgtcgacctgacccagttcaagcgctggtacagccagtccggcactccgcgcctggcggtggaaggcgagtacgacgccgccgcccgccgctacaccctgacggtgcgccagagctgcccgccgactcccggccagccgagcaaggaacccttcgtcatcccgctggagctgggtctgctcgacggccagggccacgaacttccgctgcgcctggaaggcgaggccgcggcccagggcggcaaccgcgtgctggcggtgaccgaggccgagcagcgcttcgtcttcgtcgaggtgccggagcagccgctgccatcgctgctgcgcggcttctccgcgccggtgaaactgagcttcccctacagccgcgaccagttgctgttcctcatgcagcacgacagcgacggcttcaaccgctgggaggccggccaacagctctcggtgcaggtcctgcaggagctgatcggccagcaccagcgcggcgagcaactggtactcgacccgcgcctgatcgaggcctaccgcaccctcctggcggacgaggcgctggaccaggcgatggtcgccgagatgctctcgctgcccagcgaggcctatctcaccgagatcagcgaagtcgccgatgtcgacgcgatccatgccgcccgcgaattcgcccgccagcgtatcggcgaagcgctgttcgagccgctgtggcagcgttaccaggccaaccgcaagatttcccgtga

SEQ ID NO: 12260 - DNA, 2046 bp, Pseudomonas aeruginosa
caaggccgcagagaaacggccgaacggcgaaccgcccgcagtggcggcgcccaacgcatgaccacatggagtgagttcccgatgtacatccccaaccgccagccccggctgcgctccgcgccggcccgggccggcttcgccttcgtcgggctgctgccgctgctgggcggccaggcccaggccgtcgaattcagcttcctcgacaacgaggtgtccggttcgctcgacaccaccctgtcctacggcaccctgtggcgggtgcaggggcaggacaagagcaacaacgacatcaacaccaacgacggcaaccgcaacttcgataccggcctggtttccgaggtctacaagatcacctcggacctggaggcgacctggcgcaactatggcgtgttcatccgcggcacggcgttctatgacacccagatcatggacaagcgcaacgactactacagccacaacgatccatcgcagccgagccagagctatccccacgacgaccgtttcaccagccagacccgcgatatcgccgggcacaaggcggaaatcctcgacgcctacgtctacggcagctgggacatcggcaacatgccgctgagcgcgcgcttcggccgccaggtgttcaactggggcgagggcatcttctaccgtggcggggtcaacaccaccaacccggtggacgccgccaagtaccgcctgcccggttccgagctcaaggaagtgctgatgccggtggaagcgctgagcttcaacatcggcctgaccgacaacctgtcgatggaaaccttctaccagtggaactggaaggaaacccgcctcgacccggtcggtaccttcttctccgagaccgacctgttcgccgacggcggcaacaccggctacagcgacttcaccggcaccgcgctggacaccccggtgcccggcttcggcaacgtcatcggcctgtaccaggcgctgggcaacaatccgctgctcagcggcgcgctgaagaacaccggcctatatgccaacggcgtgaccccggcctacggcaacgtgatgaaggtgtcgtccatcggcaaggacatcaacgcgcgcaacgacggccagttcggcgtggccttccgctacatcgccgaggaactgaacagcaccgagttcggcttctacttcgtcaactaccactccaaggagccgaccctgtacgccgacatcggcgactatgccggggccgacctggcggcgctggccaacaccctgcggccgatcgccggcaacctcgccgaagccctggccaacggcctggtgaccgccgacgtgatgggcaacatcaatgcccgccgcgagttcgccgaagacatccgcatgtacggcttcagcttcaacaccacggtgggcgacgcctcggtgttcggcgagctggcctaccggccgaacctgccgatcggcatcgccgccaccaacgacctgatcggcgacctcgcccacggtgcggcggaagccgccaacggcgggcagatcaacgtcggcgggcagatggtcggcctcggcgggcagatccacaactacgagcgggtcgaggcgttcaacacctccctcgggaccatctacaacttcggtccgtcgctgagcttcgactcgttgaccggcgtcgccgagctggcttcggaacacctgcgcggcagcagcctgaagtacaccgcctacgacggcagcacccgctactatgccgggcgcggcaacagctcgtacgtttccggcggcgaccgtggcgaccaggtgaaccgcaacgcctacggctacaccctgctgctcagcggcacctggaacgacgtgttcgccggggtcaacgtgtcgccctacgtggtctacaaggacgacttcgaaggcaactcctaccagaccggcaacttcatcgaaggtcgcaaggcctacaccctggggatcaaggccacctacctgaacagcctggaaggcgaactgcagtacaccgagttctacggcggcgggcagaacaacaacatccgcgaccgcgacaacatcggcctgaccgtgaagtactccttctga

SEQ ID NO: 12261 - DNA, 627 bp, Pseudomonas aeruginosa
cgacacgggcgccgcgagcgcccggcacctcacacggagaaccctcatgttgaacaagcacctgctgatcggcgcttccctggcgctggcactgggcagcggcggcgcgctggccggcgtttccgccggcgaggcggcgcaactgaagtcgagcctcaccccgctgggcgcggagaaggccggcaacgccgccggcagcattcccgcctggaccggcggcatcacccaggcgccggccggctacaagccgggccagcaccacccggacccgttcgccgcggacaagccgctgttcaccatcgacaaggccaacctggagcagtacagggaacacctgaccccgggccagctggcgctgttcaagacctacccggacagcttccggatgccggtctaccccagtcgccgttccggttcggcgccgcagtggctgtacgacaacaccttcgccaatgccaccagcgccaggctgctggacggcggcaacgggttcgccgacgcctatggcggggtgccgttcccgattccgaagagcggcgtggaggcgctgtggaaccacgtcgcccgctaccgcggcacctatgtcgtgcgccgcgcttcggaagtcgcggtacagcgcaacggtag

SEQ ID NO: 12262 - DNA, 1149 bp, Pseudomonas aeruginosa
gcccatgacgtggcgcacttcgcccggccaaaccgcggacgcttcgcggcatccggccattccttccagatcgcccctggccagcagggccctgtcgtttctcggggcactttctcttctgaccttcgccgccaccccggtcctggccgagtcgacgccaaccgccgcgccgccgcaattcgccgtggaatcgccgaaggccgccagcagcctgctgctcagcgtcgcccatgccggcaagcggctggtcgcggtcggcgaccgtgggcatatcctgctctccgacgacgacggcaagacctggacccaggccaaggtgccgacccgccagttgctcacctcggtgttcttcgtcaacgagcgcaagggctgggcggtcgggcacgatgcgcagatcctcgtcagcgacgacgccggcagcacctggaccaggcagttcgaggacctcggccgcgaagcgccgttgctggacatctggttcgccgacgaacagcacggcctggccgtcggtgcctatggcgcgctgctggagacccgcgacggcggccagcactgggaagacgtcagcgagcgcctggacaacgaggaccagttccacctcaacgccatcgccgcggtcaaggacaacggcctgctggtggtcggcgaagccggcagcctgttccgctcgaaggactggggcgccacctgggaaaaactcgaaggcccctacgagggctcgctgttcggcgccatcggtaccgccgatgcgggcggcgtgctggtctacggcctgcgcggccacctgttccgctccgccgatttcggcgacagctgggaagagataccgctgaaggcggcgtccggcgacctggaattcggtctctccgacggcgcgctgctggcggacgggcgtatcgtcgtggtcggccacggcggcagtgtcctcgaaagcaccgacggcgggcgcagcttcagcgtgttcaaccgtcccgaccggctgtccctggccggcgtcagcgccaccggcgacggccacctgatcctggtcggccagggcggcgtgcacctcgctgcggcgaacggtgccgcgctcgaacaacaacaataaggcgggggtcgcatgagtgccatgaaccagcatcagcaaaacaaggcgagccctggtag

SEQ ID NO: 12263 - DNA, 564 bp, Pseudomonas aeruginosa
ggccatcgaacagcttccaggtgccgtaccagtcgagggcgtcgatcaccagcgggtcgtggccggtatagcggccttcggcctgctggacttcgaggcgcttctcgacgcggtcgagcaaccagtcgctgtcttcttccttcggatactgcgggccgaataccggcgcggtgggtgccgcgtggttggccagcagcggcggagcgccgtggcgatcgctgcgcagcagcagcaggttcttgtcgctgggcggaatgtgccggctctggcggtagatgcgcttggcgtcggtgcaggccacgtggctgtcctagtcgccgcagaccgccagcagcagggtgcccttggccagccccgacaggcgttcctgggtcacgccgtcccagcgcttgccctggctcttgccgggctcgaccaccatcagcgccttcgccgccggcagcttcaggcgttcgctggcggccgccaggttggcggcgagcagtccgccggcggagtggccgaggtaggcgacctggttcagccgcgggcgcacccccagctcgccggcctgcaggcgcctga

SEQ ID NO: 12264 - DNA, 522 bp, Pseudomonas aeruginosa
ggcttggcaagcgccgccagttcggccagggccgcttcgcgcagcggatccagcggcgcttcgccgcgggtggcgatggtgcgccgcggcaggtgccggcgcagtcgccagagcccccagccgagcaacggcagcagggcggccagcagccaccagccgggcgctggcggccaccagccgacgggcaggggagcgatcagcggttccagccggtcgagcggattcatgcgcgataccccggctggtgttgttccagcaggtcccgcaactgctccaccaggtcttcctgggtcgacagcggcagcagcggcacgcccagtcgctgggccagccgctgccagcgcgcgcggcgcgcctcggcctgttcgcgataggcctggcgcagctcgtcggcgtgggtgtccagctcgaggtcggcggcgccttcgcggaagcgcagcagtccggcggcgggaagggcatggtcgagcgggtcggacagcggcagcagcaccaggtcggtatggcgtgcgatcaggctga

SEQ ID NO: 12265 - DNA, 1770 bp, Pseudomonas aeruginosa
cctgcacatcgaggactatgccgtcgcctacctgcgcgaaccggtcctgctgtccttcgccaaggctgcccatccgagccgtgtgcaccgcccggcctacccggactacgtgtcgatccgcgagctggacggcaagggccgggtgatccgcgagtgccgcttcatgggcctgttcacctcctcggtgtacaacgagagcgtcaacgacatccccttcatccgcggcaaggtcgccgaagtgatgcggcgctccggtttcgacaccaaggcccacctcggcaaggaactggcccaggtgctggaagtactgccgcgcgacgacctgttccagaccccggtggacgagctgttcagcaccgccctggcgatcgtccgcatccaggagcgcaacaagatccgcgtgttcctgcgcaaggacccctacggtcgcttctgctactgcctggcctacgtgccgcgcgacgtgtattccaccgagacgcgcctgaagatccagcaggtcctgatggagcgcctgcaggccagcgactgcgagttctggaccttcttctccgagtcggtgctggcccgcgtgcagttcatcctccgcgtcgacccgaagtcgcgcatcgacatcgacccggcgcgcctggaggaagaagtgatccaggcctgccgttcctggcaggacgactacagcagcctggtggtggaaaacctcggcgaggccaagggcaccaacgtcctggccgacttcccgaaaggcttcccggccggctaccgcgagcgcttcgccccgcacttcgcggtggtcgacctgcagcacctgctcagcctctccgagcagcgcccgctggtgatgagcttctaccagccgctggcgcagggcgagcagcaactgcactgcaagctgtaccacgccgacaccccgctggccctgtccgacgtcctgccgatcctggagaacctcggcctgcgcgtgctcggcgaattcccctaccgcctgcgccaccagaacggccgcgaatactggatccacgacttcgccttcacctacgccgaagggctggacgtggacatccagcagctcaacgagatcctccaggacgccttcgtccacatcgtcagcggcgacgccgagaacgacgccttcaaccgcctggtgctgaccgccaacctgccgtggcgcgacgtcgccctgctgcgtgcctacgcgcgttacctgaagcagatccgcctgggcttcgacctcggctacatcgccagtgcgctgaatgcccacaccgacatcgcccgcgagctggtgcggctgttcaagacccgcttctacctggcgcgcaaactcaccgcggaagacctggaagacaagcaacagaagctggagcaggcgatcctcggtgccctcgacgaagtccaggtgctcaacgaggaccgcatcctgcggcgctacctcgacctgatcaaggcgaccctgcggaccaacttctaccagcccgacggcaacggccagaacaagagctacttcagcttcaagttcaacccgaaggccattccggagctgcccaggccggtgcccaagtacgagatcttcgtctactcgccgcgcgtcgagggcgtgcacctgcgcggcggcaaggtggctcgcggcggcttgcgctggtcggaccgcgaggaagacttccgcaccgaggtgctcggcctggtcaaggcccagcaggtgaagaacgcggtgatcgtgccggtcggcgccaagggcggcttcgtcccgcgccgcctgccgcttggcggtag

SEQ ID NO: 12266 - DNA, 936 bp, Pseudomonas aeruginosa
ccgcgacgagatccaggccgaggcgatcgcctgctaccggatcttcatttccggcctgctcgatatcaccgacaacctcaaggaaggcgaagtggtgccgccggccaacgtggtccgccacgacgaggacgatccctacctggtggtcgccgcggacaagggcacggcgaccttctccgacatcgccaacggcatcgccgccgagtacggcttctggctcggcgacgccttcgcctcgggcggctccgccggctacgaccacaagggcatggggattaccgccaagggcgcctgggtcagcgtgcaacggcacttccgcgagcgcggcatcgacgtgcagaaggacaacatcagcgtcatcggcatcggcgacatggccggcgacgtgttcggcaacggcctgctgatgtcggacaagctgcaactggtggccgccttcaaccacatgcatatcttcatcgacccgaacccggacgccgccagcagcttcgtcgagcgccagcgcctgttcaacctgccgcgttcgagctgggccgactacgacgccaagctgatctccgccggcggcgggatcttcctgcgcagcgccaagagcatcgccatcaccccggaaatgaaggcgcgcttcgacatccaggccgacaggctggcgcccaccgagctgatccatgcgctgctcaaggcgccggtcgacctgctctggaacggcgggatcggtacctacgtgaagtcgagcaaggaaacccacgccgatgtcggcgacaaggccaacgatggtctgcgcgtcgacggccgcgagctgcgcgcgaaggtggtgggcgagggcggcaacctgggcatgacccaactggcgcgggtcgagttcggcctgcacggcggtgccaacaacaccgacttcatcgacaacgccggtggcgtggactgctccgaccatga

SEQ ID NO: 12267 - DNA, 693 bp, Pseudomonas aeruginosa
tatccagctgaccctgatggacgaactgatgcgcctcggccgccgcgccacccgctggttcctccgcagccgccgcaacgagctggacgcggcgcgcgacgtggcccacttcggcccgcgcatcgccgccctcggcctgaagctcaacgagctgctcgaagggccgacccgcgagctgtggcaggcgcgctaccagacctacgtcgacgccggcgtgccggaactgctggcacgcatggtggccggtaccagccacttgtacacgctgctgccgatcatcgaggcgtccgacgtgaccggccaggacaccgcggaagtggccaaggcctatttcgccgtgggcagcgcgctggacctgacctggtacctgcaacagatcaccaacctgccggtggagaacaactggcaggcgctggcccgcgaggcgttccgcgacgacctcgactggcagcagcgggcgatcaccgtctcggtgttgcagatgcaggacggaccgaaggaggtcgaggctcgcgtcggcctgtggctggaacagcacctgccgctggtcgagcgctggcgggcgatgctggtcgaactgcgtgccgcgtcgggtaccgactacgccatgtacgccgtggccaaccgcgagctgatggacctggcgcagagcagccagcacggtgtctgcatcccctgatgcgaccggactga

SEQ ID NO: 12268 - DNA, 387 bp, Pseudomonas aeruginosa
tccgggtccgcgacctgccggcgctcaccgtactcgacccggcgcgggtggccccggcgctcaagctcaagggcgacggcaaggagtacgtgccggtggcgaccgccgactggggcggcttcgccctggcgccctatgtgctggaggagggtagcgagcaccggcgctggatcctcgatccgttcgccttcctgcgcaaggccttgcgccttgcgccgctgccgagtcccgacgcgaccaccgagaatggccggcgcatcgccaccgtgcacatcgatggcgacggcttcgtctcccgtgccgaggtgcccggcagtccctatgccggccagcaggtgctggaggacttcatcaagccctatccgttcctcacctcggtctcggtga

SEQ ID NO: 12269 - DNA, 3660 bp, Pseudomonas aeruginosa
gcgcggccggcaaggccttcccgggaaaggccggcaacggcctgtggacgttcgagttgccgatggagcaggtgcgcgatggccaactcgtctgccgctgacaagcatccccaggcgcgcctgctgaatccctgggccctgctgccggtcgctctcggggtggcgctggtgctgtggctgaccttcaacagcgaagaggtattcatgcccagcggcgatggcgagcccgacgcggtctcggtgaactacgccgaactgctgttgcaggcgcacccggagaacgacgcgctgcgcctgaccctgatcgacctgctggtcaagctcggcgacttcgagcaggcgcgtcatcacctcgcccgtctgcgcggcaaggaccgcctggcaacgccgttctacgaggtggaactggacatccttggcgccctggccaggcccgagggcatggatgaggagcagacgcgccgattgctggagcgcctgcgcaagatcgagcacgtttcgttgaacgacgccatgctcgaacgacttgcccgtcatgccctggccctggacgcgccggacctggcggcgcggacctttgccgaactggccggccgcgacccgcagggccggcagcgctggctggacgaggcggcgcgctggtacctggcttccggcgagccgctgccggcggcggacatccagcggcaactggccgaagcgcaaaccgagccggcgaagcgcctggcctatctgcgccaggccttcgccagcctgctcgctggcgagcgcggcgaacaggcggcgttgttgctggacgagcggctggacgccttgccggaggatgaatcgaccctggcctggctcgcccagggcgtacgcgccgccgaaggcagccagcgctacgacctggccgaacgcttcatccggcgctggcgcgaattgcgccccgaggaccatgaggcgctggccgccgacctgcgtctgaacatggccgccgggcgggtcgagcgggcctgggaggtcggccaggagctgctggccctgcgcccggaggacaggacgctgctggccgatctcgcgcgccttggcgaatggaccggcaacggcccgcgggcgctgggcctgtggaagcaactgctggccggcgccgatgacccggccctgcgcgggcatgcctggcgcctgtcgctgcagatgttcgatttcgacagcgccatcgagctgctggcgcccatcggtgcgcagcgacagatgaccgacgaggaactcgatgcgctggtctacagccatgaaacccgcggcacgccggaagagggcgaggcatggctgcgcggctacgtgcagcgttatccgaaacagcgcctggcctggcagcgcttgcaacagattctcgaacacacccagcagttgcaggaagagaccggggtctgggcgcggatggcccggcatttcccgctgagtgtcaaggaacgcatgcagtgggcggaaacccactggaacctgttcgatccgcgccaggcctggaaggtcctcgccggcgtggatacccgcgcgatccgcgagccggagttctggcgcctgcgcgcggcgctggcctgggccctggagcaggacgacgatgcccgcgccgcctacgagcgcatgctggccctggacatccgcctgaacagcagcgacgaggaccagttgatcgccctgtaccgggacagcaatccgaagcaggccttgcaggtgcttatcggcagttggcagcgcagccgcgatccgcggcgcctggccagcgccctgcaactggcggagaacctccacgactggccggccctgaagagcctgctggccgaggccgaaggcctgccggaagcgcagggcagcccctattactgggtggctagggcgcggctggcggaacaggaaggccatggcgacgtcgccgagcgtctgtaccgggaagccctggtgcgtttccccggcgagaacctggtgcgcgaacgcctgctctggttctacatcgaccgtggccgtcgcgacagcctggcgcccctgttggcgcagtggcatggcctggcgctgcgggacagcacgctgtggctgccgttcgccagcgccagcctgctgctcgagcgtaacgaccaggcgctggcctggttccgcctgtacctcaagtccaatcccaacgactggctggtgcaggccgcctacgccgacgcactggatgccagcggctaccaggacaaggccctgcgcctgcgccgactactgctccggcggctcgaccgcgaggcggtcagggccaccccggacagcttcgccgcctacctgcgcctgctcgccgtggcccaggggccgctgctcgcccagggcgaggcgcggcgggcctggaatggcgagccggcgatgctgcagctgtggttcgagcagttcctcgaccagctcgccgccaccaaccaggagccgctgaaggatgactggctggcctgggcgcgcggccggggcctgaagatcgggcgcaacgaagagatccaggccgccctgcgcagccagaatcgcgccgccctgcaacgcctgctggagcgcggcgagctggatccggcgcagcgggtcgaggcgctggtgcgtctcggccatggcggcgaagcgctgggcgaggccctgggcgcactgggcgacggccactcgcgcgacaaccgcgagcagctgcggcggcaggcggcggaaatcctcgaacgcactccccagggcctgcaactgggttggaacaagcgcgacttcggcggtctcgacttcaaggggccgacgctgcgcgcggcgcgccacctcggcgacgactggtacgccgatctcgaactgggcagtggccgctatcacggcgatgcgctggatagctcgctcctcggtagcgaacgcaacgccaggctgacgttgcggcgcgaactggccgatggcttcgccgcggcgacgctcgatggcagctggcgcgacgacgaggaccgccacggtctgggggtgctgcgcaattggcggctgagctcgcgcgacgaactggaagcgggcctcgactggcaccgcgagaccgacgagaccggcctgatgcgagccctcggcatgcgcgacagcctacggctcggcggccgccacaccctcagcgggcgcgaccagttgagctggtcgctggcgcacaaccgcttctccacccgccagggcgacgacctcggcaacggcgaggcgctgtccctggaatgggcccacacactgttcttcgacggcccggcctggcaactgcgcggcggcatcgactaccagcgcaatcgcctggagaaccgcgtgccggacgacctgctggcggcccatggcggtgcgctggcgctcgatggcgcgcgcagccaggacctgctgcaggaccgctatggccaggtctacctcggcagcacctggcgccgtggcttccctggcgcgctgaaccgcagccgtccgcaatacacctggatcgtcgacaccctggccggctggcagtggacagagaaggagttcaactacggcatcgatctcggcatcggcatggagctgctgggcgacgacgaactggcgttcaccttcggctaccagtcggctccccagggcggcggcggcgatgccggcggcacgctcggggtgacctacagcacgcgcttcggccgctga

SEQ ID NO: 12270 - DNA, 558 bp, Pseudomonas aeruginosa
acgcggcccggatacggaattcaacaggaggaacacaacatgcaatccatccgctgcctggctctcgcggccgtcgccctgttcatggcgggctgctccagcttcaccagcgaaagcgctacgccgctggcgcgcggcgcgcagtggggcctggtgccgctgctcaattactcccaggcgccgcaggccggcgagcgtgccgagcagatcctgctcagcgtgctggccgaggagggcgtgcggccgcgcctgtacccggcgcagccgcaaggcgacctgcaactggtcgacgaccgcgagcgccagcagcgcgcgctggactgggcacgccagcagaagctggcctacgtggtcaccggcagcgtcgaggagtggcagtacaagaacggcctcgacggcgagccggcggtgggcgtcagcctgcaggtgctggagccggcctccgggcgggtgctctggagcaccagcggggcgcgcgccggctggtcccgggaaagcctggcgggcgccgcgcagaaagtcctgcgcgagctggtcggcgacctgcggctcgagtga

SEQ ID NO: 12271 - DNA, 894 bp, Pseudomonas aeruginosa
tcctcgcgcccctgttgctgggcatgcgctacggcttcgtccgcgggttggccagcgcggcgctgctggtggcggcgctgttcgcgtttcgcgtccagggcgtcgaggcttatgcccaggtaccggcggccttcatcgtcggcgtgctgctctgcgccatgttggtgggcgagttccgcgacatctgggaacgccgcctggagcgcctggagctggcgaacgagtaccgccagttgcgcctcgacgaattcacccgcgcccatcacatcctgcgcatctcccacgatcgcctggaacagcgggtcgccggcaacgaccagagcctgcgcagttcgctgctcggtctgcgacaactgctgcgcgagctgccgggcgatgaggcaccgctcgatgcgctggcggaaaccgtgctggcgctgctggcccagtacggttcgctgcgcatcgccggactctaccgggtgcgccacgaccgcaccccggagccgcaatccttggcgacgctcggcgagatgccggcgctggacgccgacgatctgctggtgcgcacctgcctggagcgcggcgaactggtcagcgtgcgccaggaactgctggagcgcggcgagcagcgtgcgcacagcgcgctgcaggtgtgcgtgccgctggtcgacaccgatgggcggatcctcgccctgctggcggtggagcagatgccattcttcgtcttcaacgaacgtaccttcagcctgctggcgatcctcgccgggcacatcgccgacttgctgcagagcgaccgtcgcgcactgcaactggccgacatcgacgcccagcgcttctcccagtacctcaagcgctccctgctggacgcccgcgaccatgggttgccggcctgcctgtatgccttcgagttga

SEQ ID NO: 12272 - DNA, 990 bp, Pseudomonas aeruginosa
atgatcagcaagtggctgtttagcggcgccttcctgttcgagctgagcagttgggcgagcgtcttcgccgacctgccgttcggccaggcgctggcgctctacctgttcgcccacggcctgggcagcgcgctgctgtgcgtcggcgtatggctgctgctgccgcggcgctacaagttcccgctgccgtggagcccgctgttcctcttcagcctggccttcttcgtgccgctgatcggagcggtcggcgtcgctgcggcggtattcccggcgctgtacctgccgcgccagcgtggcgagcaggcctggcaggcgatgggcgtccccgagctgccgttccggccgaaggaaaagcgcctcgacatgatgttcagcgacggcggtctgcaggacgtcctgcgccatgcgccggacccgaaccagcggctcacggcgatcttcgccacccggcggatgcccggcaaggaggcgatcccgatcctcaagctggccctgcgcgaccccgccgacgacgtccgcctgctggcctactcgatgctcgaccagaaggaaagccggatcaaccagcgcatcgaggccgccctcggccgcctcgccggcgccacgccggcgcgacgcggcgcgctgcacggaaccctggcgcgctggtactgggaactggcctacctggggttggcccagggcagcgtgctggagcacatcctcgagcaggcgcgcgagcataccgaccaggcgctgcgcggcgcaccctcggccgacctgcatctgctggccgggcgcatcgccctcgaacaaggccgcctggaggatgccggacgcgccctccaggccgccgaggaggcgggaatcgatagcgcccagctggcgccgttccgcgccgaggtggcgttcttccagcggcgctaccgggacatcccccggcttctcgccggaatgcccgacgacatgctgcaacggccgcccttcgcggccctggcgagatactggacatga

SEQ ID NO: 12273 - DNA, 588 bp, Pseudomonas aeruginosa
ccttctcggtgttcttcatcggcggccagaaggatgcctacggcaagcgccactacccgatcccggacaatgtgctgcacatcgaggaacacttcctgtaaaccgcctggagttcgccgaacccgcagacgcgacagggcagtagcgagaccgaaaaggcgttgcgcgatctgcaccgtttcttccactacccggagacgccggacgtggaggagggcgacgcgctgctcgacctgctcgccgagggccgcatcggccgcgaggactttctccacagcaaggccagttgggaggcgatcaccgcaggctacgagcgctattgcaccgatccgtccttcgtcaattacttctggaccctgcgctcgatgcaggcgccggtgttcatgctcgccgaggcggcccggcggatgccgcgggcgcgcatgctgcactcgatctccaccggctacgccggcctgctgggctgcatcctgcaacgtcgctggggctgccgctacctgctcagcgagcacggcatctacaccaaggagcgcaaaatcgacctggcccaggccaactggatcgcggagaaccccgacgagcagctga

SEQ ID NO: 12274 - DNA, 1422 bp, Pseudomonas aeruginosa
tgctcggacgttaccgcgggctgtaccgcgaagccacggagattgcatgacatggccggcatcggcttcgaactgcggaagatcctttcccgcgattcctatacggcgaccctgcgcgcctacctctacgccgggctgatcagctccggtccctgggtgctgtcgatcgtcagcgtgatgctgatcggcgtgctgagcctcggcgtggtggtgccggacgtgctggtccggcagttcctgatcacggtgacctacctgatggcgctgtcgctgatcttcaccgggggactgcaactgttcttcacccgcttcatttccgatcgcctgttcgagcgcaagcacgaggcgatcctgcccaacctgctgggcgtgctgttgctggtgacgttggcggcgggcctgctctcggcgatattgctggcgaccctgttcgatgagccgttcgcctaccgcctgctggtgatggccaacttcgtggtgctctgcaacctgtggctggtgatcatcttcctgtcgggaatgaaggcctacaaacgcatcctgctggtgatgttcatcggctacgcgctgatggtcgcctgtgcctacctgctgcgtttcatgcagatggacggcctgctgctggcattgctgatcggccacgccagcctgctgttcgtcttcctctacgacatcctccgcgagtacccggccaggcgcatggtggccttcgacttcctcgaccgccggcaggtcttcgtcagtctgctgctgaccggcctctgctacaacctggggacctggatcgacaagttcatcttctggttcaacccctccacctcggacctggtgatcggcccgctgcgcgcctcgatcctctacgacctgccgatcttcctcgcctacctgtcgatcattcccggcatggcggtgttcctggtgcgcatcgagaccgacttcgccgagtggtacgagcgggtctacgaggcgatccgcggcggagagaccctgcagcacatcggcctgctcaaggagcagatgatcctcgccatccgccagggcctgctggaaatctgcaaggtgcaggggctggcggtggtcctgctgttcctgctggcgccgcaactgctcggctggctgggaatttcccgctattacctgccgctgttctacatcgacctgatcggggtgagcatccaggtagtgttcatggccttgctcaacgtcttcttctacctggacaagcgccgcatcgtcctcgaactctgcgtgctgttcgtgatcgtcaacggcgccctgaccttcgtcagcctgctgctcgggccgagcttcttcggctacggcttcaccctgtcgctgctggtctgcgtgctggtcgggctgtaccgcctgaccaccgcgctggacgacctggagtacgagaccttcatgctcaatcgctga

SEQ ID NO: 12275 - DNA, 588 bp, Pseudomonas aeruginosa
cctagtacgagcatccgttgcgctctgcctgccctttgtcagcgaaatctggcaaatctatctgctgatcttcgtcttgcaggcggcgtccgcaggcttcacgccgacctttcaagccactatcccggacatccttcccgacgaagacgagtacacgaaagcactgtcgctttcccggctggcctacgatttggaaagcctgatttccccgatgctggccgccgcgctactgacggtcatcagcttccacaacctgtttgccggaacggttctcggcttcctcgtgtcagccgcgcttgtggtcagcgtgaggcttcccacaaccgttcccggcccgcgtcgtggcatatgggatcgcactacgcggggcacgcgcatttacctcgccacgccgcgccttcggggtctgctggcgatcagcctcgcggtggcagcagcggggtcaatggtgatcgtgaacacggtggtcatcgtgaaggcacgcttcggcctgggcgaatccgaggtagcgtgggcgctggcggccttcggaggcgggtcgatggttgcggccttcgcgctgcctcgcctgctcgacaagattgctga

SEQ ID NO: 12276 - DNA, 861 bp, Pseudomonas aeruginosa
acagcaaaccctcttttctttgtcaggagaaagatcatgcaactcgcatcccgcttcgcttcccgttccccggtgctgcgttcggaacgtcccttgtccgacgaccaaatccgggccgtggccccgtccatcttcgcggacgccccgcacgaaagccgctccgagcggtacagctacatccccaccgctaccgtgctgcaagaactgcggggggaaggcttcgagcctttcatggtgacgcaaacccgcgtgcgccacgacgaccgccgcgactacaccaagcacatgatccggctgcgccacgccagccagatcaacggccgcgaggccaacgaaatcatcctgctgaactcccatgacggcactagcagctatcagatgctcgccggaatgttccggttcgtatgcagcaatggccttgtctgcggcgacaccgtggcggacgtgcgcgtaccccacaagggcgacgtagccgggcacgtcatcgaaggcgcttacgaagtcttgcacggctttgaccgggcgcaggaatcccgcgatgccatgcgcgccatcacgctcgacgccggggaatcggaagtgttcgcccgcgctgcgctggcgttgaagtacgaggaggacaagcccgcgcccatcacggaatcgcaaatcctgatgccgcgccgccatgacgacgaccgccgcgacctgtggagcgtgttcaaccgcacgcaggagaacttgaccaaaggcggcctgtccgcccgcgccgcgagtggccgccgccagaccacccggcccgtgcagggcatcgaccaaagcgtgcgcctgaatcgcgccctgtggctgctggccgatggcctgcgccagttgaaagcctga
